United States Patent 12,624,385 (RIBOREGULATORS AND METHODS OF USE THEREOF) - sequence listing, part 9

SEQ ID NO: 136524 - DNA, 103 bp, Artificial Sequence
  Synthetic Polynucleotide
taatacgactcactatagggacctgctccgtagccatcggacaagcccccaacagaggagagggggcatgtccgatggcaacctggcggcagcgcaaaagatg

SEQ ID NO: 136525 - DNA, 103 bp, Artificial Sequence
  Synthetic Polynucleotide
taatacgactcactataggggaccggctccacctgctccgtagccatcggaacagaggagaccgatgatgacggagcagaacctggcggcagcgcaaaagatg

SEQ ID NO: 136526 - DNA, 103 bp, Artificial Sequence
  Synthetic Polynucleotide
taatacgactcactatagggtatggccccggaccggctccacctgctccgaacagaggagacggagcatgtggagccggaacctggcggcagcgcaaaagatg

SEQ ID NO: 136527 - DNA, 103 bp, Artificial Sequence
  Synthetic Polynucleotide
taatacgactcactataggggctgggtccccggttacagagtgggtactcaacagaggagagagtacatgctctgtaacaacctggcggcagcgcaaaagatg

SEQ ID NO: 136528 - DNA, 103 bp, Artificial Sequence
  Synthetic Polynucleotide
taatacgactcactatagggctgcggaggatatggccccggaccggctccaacagaggagaggagccatgccggggccaaacctggcggcagcgcaaaagatg

SEQ ID NO: 136529 - DNA, 103 bp, Artificial Sequence
  Synthetic Polynucleotide
taatacgactcactatagggaagggggatgctgcggaggatatggccccgaacagaggagacggggcatgatcctccgcaacctggcggcagcgcaaaagatg

SEQ ID NO: 136530 - DNA, 103 bp, Artificial Sequence
  Synthetic Polynucleotide
taatacgactcactatagggtcgttcccataagggggatgctgcggaggaaacagaggagatcctccatggcatcccccaacctggcggcagcgcaaaagatg

SEQ ID NO: 136531 - DNA, 103 bp, Artificial Sequence
  Synthetic Polynucleotide
taatacgactcactatagggcgcggtctgctcgttcccataagggggatgaacagaggagacatcccatgtatgggaacaacctggcggcagcgcaaaagatg

SEQ ID NO: 136532 - DNA, 103 bp, Artificial Sequence
  Synthetic Polynucleotide
taatacgactcactataggggtgcaaagctcgcggtctgctcgttcccataacagaggagaatgggaatgagcagaccgaacctggcggcagcgcaaaagatg

SEQ ID NO: 136533 - DNA, 103 bp, Artificial Sequence
  Synthetic Polynucleotide
taatacgactcactataggggcataggccggtgcaaagctcgcggtctgcaacagaggagagcagacatggagctttgcaacctggcggcagcgcaaaagatg

SEQ ID NO: 136534 - DNA, 103 bp, Artificial Sequence
  Synthetic Polynucleotide
taatacgactcactataggggaggagatcagcataggccggtgcaaagctaacagaggagaagctttatgccggcctataacctggcggcagcgcaaaagatg

SEQ ID NO: 136535 - DNA, 103 bp, Artificial Sequence
  Synthetic Polynucleotide
taatacgactcactatagggtgtcctcggagaggagatcagcataggccgaacagaggagacggcctatgctgatctccaacctggcggcagcgcaaaagatg

SEQ ID NO: 136536 - DNA, 103 bp, Artificial Sequence
  Synthetic Polynucleotide
taatacgactcactatagggggtgtttccttgtcctcggagaggagatcaaacagaggagatgatctatgctccgaggaaacctggcggcagcgcaaaagatg

SEQ ID NO: 136537 - DNA, 103 bp, Artificial Sequence
  Synthetic Polynucleotide
taatacgactcactatagggtgaagggcagggtgtttccttgtcctcggaaacagaggagatccgagatgaaggaaacaaacctggcggcagcgcaaaagatg

SEQ ID NO: 136538 - DNA, 103 bp, Artificial Sequence
  Synthetic Polynucleotide
taatacgactcactatagggcgctgtaggcgctgggtccccggttacagaaacagaggagatctgtaatgggggacccaaacctggcggcagcgcaaaagatg

SEQ ID NO: 136539 - DNA, 103 bp, Artificial Sequence
  Synthetic Polynucleotide
taatacgactcactatagggtgttaggttctgaagggcagggtgtttcctaacagaggagaaggaaaatgcctgcccttaacctggcggcagcgcaaaagatg

SEQ ID NO: 136540 - DNA, 103 bp, Artificial Sequence
  Synthetic Polynucleotide
taatacgactcactataggggccgtgggggtgttaggttctgaagggcagaacagaggagactgcccatgagaacctaaaacctggcggcagcgcaaaagatg

SEQ ID NO: 136541 - DNA, 103 bp, Artificial Sequence
  Synthetic Polynucleotide
taatacgactcactataggggaaggtccgggccgtgggggtgttaggttcaacagaggagagaacctatgacccccacgaacctggcggcagcgcaaaagatg

SEQ ID NO: 136542 - DNA, 103 bp, Artificial Sequence
  Synthetic Polynucleotide
taatacgactcactatagggtcatccagtcgaaggtccgggccgtgggggaacagaggagacccccaatgcccggacctaacctggcggcagcgcaaaagatg

SEQ ID NO: 136543 - DNA, 103 bp, Artificial Sequence
  Synthetic Polynucleotide
taatacgactcactatagggctcttaaccttcatccagtcgaaggtccggaacagaggagaccggacatgcgactggataacctggcggcagcgcaaaagatg

SEQ ID NO: 136544 - DNA, 103 bp, Artificial Sequence
  Synthetic Polynucleotide
taatacgactcactataggggggtgggtttctcttaaccttcatccagtcaacagaggagagactggatgaaggttaagaacctggcggcagcgcaaaagatg

SEQ ID NO: 136545 - DNA, 103 bp, Artificial Sequence
  Synthetic Polynucleotide
taatacgactcactatagggtcgctgtcttgggtgggtttctcttaacctaacagaggagaaggttaatggaaacccacaacctggcggcagcgcaaaagatg

SEQ ID NO: 136546 - DNA, 103 bp, Artificial Sequence
  Synthetic Polynucleotide
taatacgactcactatagggtctgacaccttcgctgtcttgggtgggtttaacagaggagaaaacccatgcaagacagcaacctggcggcagcgcaaaagatg

SEQ ID NO: 136547 - DNA, 103 bp, Artificial Sequence
  Synthetic Polynucleotide
taatacgactcactatagggcaggcctggctctgacaccttcgctgtcttaacagaggagaaagacaatgaaggtgtcaaacctggcggcagcgcaaaagatg

SEQ ID NO: 136548 - DNA, 103 bp, Artificial Sequence
  Synthetic Polynucleotide
taatacgactcactatagggtgggcgagcccaggcctggctctgacacctaacagaggagaaggtgtatgagccaggccaacctggcggcagcgcaaaagatg

SEQ ID NO: 136549 - DNA, 103 bp, Artificial Sequence
  Synthetic Polynucleotide
taatacgactcactataggggcgctgtgggcgctgtaggcgctgggtcccaacagaggagagggaccatgcgcctacagaacctggcggcagcgcaaaagatg

SEQ ID NO: 136550 - DNA, 103 bp, Artificial Sequence
  Synthetic Polynucleotide
taatacgactcactatagggcggaggccactgggcgagcccaggcctggcaacagaggagagccaggatggggctcgccaacctggcggcagcgcaaaagatg

SEQ ID NO: 136551 - DNA, 103 bp, Artificial Sequence
  Synthetic Polynucleotide
taatacgactcactataggggaagttggtgcggaggccactgggcgagccaacagaggagaggctcgatgagtggcctcaacctggcggcagcgcaaaagatg

SEQ ID NO: 136552 - DNA, 103 bp, Artificial Sequence
  Synthetic Polynucleotide
taatacgactcactataggggccttgtggtgaagttggtgcggaggccacaacagaggagagtggccatggcaccaactaacctggcggcagcgcaaaagatg

SEQ ID NO: 136553 - DNA, 103 bp, Artificial Sequence
  Synthetic Polynucleotide
taatacgactcactatagggtctgtcagctgccttgtggtgaagttggtgaacagaggagacaccaaatgcaccacaagaacctggcggcagcgcaaaagatg

SEQ ID NO: 136554 - DNA, 103 bp, Artificial Sequence
  Synthetic Polynucleotide
taatacgactcactatagggcttttccagttctgtcagctgccttgtggtaacagaggagaaccacaatgcagctgacaaacctggcggcagcgcaaaagatg

SEQ ID NO: 136555 - DNA, 103 bp, Artificial Sequence
  Synthetic Polynucleotide
taatacgactcactatagggaatggaactccttttccagttctgtcagctaacagaggagaagctgaatgaactggaaaaacctggcggcagcgcaaaagatg

SEQ ID NO: 136556 - DNA, 103 bp, Artificial Sequence
  Synthetic Polynucleotide
taatacgactcactatagggtacttgttgaaatggaactccttttccagtaacagaggagaactggaatgggagttccaaacctggcggcagcgcaaaagatg

SEQ ID NO: 136557 - DNA, 103 bp, Artificial Sequence
  Synthetic Polynucleotide
taatacgactcactatagggccggctcaggtacttgttgaaatggaactcaacagaggagagagttcatgttcaacaagaacctggcggcagcgcaaaagatg

SEQ ID NO: 136558 - DNA, 103 bp, Artificial Sequence
  Synthetic Polynucleotide
taatacgactcactatagggccctccgggcccggctcaggtacttgttgaaacagaggagatcaacaatgacctgagccaacctggcggcagcgcaaaagatg

SEQ ID NO: 136559 - DNA, 103 bp, Artificial Sequence
  Synthetic Polynucleotide
taatacgactcactataggggcaatctccaccctccgggcccggctcaggaacagaggagacctgagatgggcccggagaacctggcggcagcgcaaaagatg

SEQ ID NO: 136560 - DNA, 103 bp, Artificial Sequence
  Synthetic Polynucleotide
taatacgactcactatagggggaggttggggcgctgtgggcgctgtaggcaacagaggagagcctacatggcccacagcaacctggcggcagcgcaaaagatg

SEQ ID NO: 136561 - DNA, 103 bp, Artificial Sequence
  Synthetic Polynucleotide
taatacgactcactatagggcagggtggcggcaatctccaccctccgggcaacagaggagagcccggatggtggagattaacctggcggcagcgcaaaagatg

SEQ ID NO: 136562 - DNA, 103 bp, Artificial Sequence
  Synthetic Polynucleotide
taatacgactcactatagggcattgagctccagggtggcggcaatctccaaacagaggagatggagaatgccgccacccaacctggcggcagcgcaaaagatg

SEQ ID NO: 136563 - DNA, 103 bp, Artificial Sequence
  Synthetic Polynucleotide
taatacgactcactatagggacctgtgtttcattgagctccagggtggcgaacagaggagacgccacatgggagctcaaaacctggcggcagcgcaaaagatg

SEQ ID NO: 136564 - DNA, 103 bp, Artificial Sequence
  Synthetic Polynucleotide
taatacgactcactatagggccaaatcttgacctgtgtttcattgagctcaacagaggagagagctcatggaaacacagaacctggcggcagcgcaaaagatg

SEQ ID NO: 136565 - DNA, 103 bp, Artificial Sequence
  Synthetic Polynucleotide
taatacgactcactatagggggttctggaaccaaatcttgacctgtgtttaacagaggagaaaacacatgtcaagatttaacctggcggcagcgcaaaagatg

SEQ ID NO: 136566 - DNA, 103 bp, Artificial Sequence
  Synthetic Polynucleotide
taatacgactcactatagggttcattcgtcggttctggaaccaaatcttgaacagaggagacaagatatggttccagaaaacctggcggcagcgcaaaagatg

SEQ ID NO: 136567 - DNA, 103 bp, Artificial Sequence
  Synthetic Polynucleotide
taatacgactcactatagggcttcttctgcttcattcgtcggttctggaaaacagaggagattccagatgcgacgaatgaacctggcggcagcgcaaaagatg

SEQ ID NO: 136568 - DNA, 103 bp, Artificial Sequence
  Synthetic Polynucleotide
taatacgactcactatagggctcgctcgcgcttcttctgcttcattcgtcaacagaggagagacgaaatgagcagaagaaacctggcggcagcgcaaaagatg

SEQ ID NO: 136569 - DNA, 103 bp, Artificial Sequence
  Synthetic Polynucleotide
taatacgactcactatagggcgaccttcctctcgctcgcgcttcttctgcaacagaggagagcagaaatggcgcgagcgaacctggcggcagcgcaaaagatg

SEQ ID NO: 136570 - DNA, 103 bp, Artificial Sequence
  Synthetic Polynucleotide
taatacgactcactatagggtggggggacccgaccttcctctcgctcgcgaacagaggagacgcgagatggaggaaggtaacctggcggcagcgcaaaagatg

SEQ ID NO: 136571 - DNA, 103 bp, Artificial Sequence
  Synthetic Polynucleotide
taatacgactcactatagggttgggggaaaggaggttggggcgctgtgggaacagaggagacccacaatgccccaacctaacctggcggcagcgcaaaagatg

SEQ ID NO: 136572 - DNA, 103 bp, Artificial Sequence
  Synthetic Polynucleotide
taatacgactcactatagggctggtggggctggggggacccgaccttcctaacagaggagaaggaagatggggtcccccaacctggcggcagcgcaaaagatg

SEQ ID NO: 136573 - DNA, 103 bp, Artificial Sequence
  Synthetic Polynucleotide
taatacgactcactatagggttggggcagcctggtggggctggggggaccaacagaggagaggtcccatgagccccaccaacctggcggcagcgcaaaagatg

SEQ ID NO: 136574 - DNA, 103 bp, Artificial Sequence
  Synthetic Polynucleotide
taatacgactcactatagggagctgcctccttggggcagcctggtggggcaacagaggagagccccaatgggctgccccaacctggcggcagcgcaaaagatg

SEQ ID NO: 136575 - DNA, 103 bp, Artificial Sequence
  Synthetic Polynucleotide
taatacgactcactatagggaggcatctccagctgcctccttggggcagcaacagaggagagctgccatgaggaggcagaacctggcggcagcgcaaaagatg

SEQ ID NO: 136576 - DNA, 103 bp, Artificial Sequence
  Synthetic Polynucleotide
taatacgactcactataggggactggtctgaggcatctccagctgcctccaacagaggagaggaggcatgtggagatgcaacctggcggcagcgcaaaagatg

SEQ ID NO: 136577 - DNA, 103 bp, Artificial Sequence
  Synthetic Polynucleotide
taatacgactcactatagggggtgcatgtcgactggtctgaggcatctccaacagaggagaggagatatgtcagaccagaacctggcggcagcgcaaaagatg

SEQ ID NO: 136578 - DNA, 103 bp, Artificial Sequence
  Synthetic Polynucleotide
taatacgactcactatagggcttccggggaggtgcatgtcgactggtctgaacagaggagacagaccatgcgacatgcaaacctggcggcagcgcaaaagatg

SEQ ID NO: 136579 - DNA, 103 bp, Artificial Sequence
  Synthetic Polynucleotide
taatacgactcactatagggctgggtgaggcttccggggaggtgcatgtcaacagaggagagacatgatgctccccggaaacctggcggcagcgcaaaagatg

SEQ ID NO: 136580 - DNA, 103 bp, Artificial Sequence
  Synthetic Polynucleotide
taatacgactcactatagggggtgacagagctgggtgaggcttccggggaaacagaggagatccccgatggcctcacccaacctggcggcagcgcaaaagatg

SEQ ID NO: 136581 - DNA, 103 bp, Artificial Sequence
  Synthetic Polynucleotide
taatacgactcactatagggtgagccgagcttgggggaaaggaggttgggaacagaggagacccaacatgctttcccccaacctggcggcagcgcaaaagatg

SEQ ID NO: 136582 - DNA, 103 bp, Artificial Sequence
  Synthetic Polynucleotide
taatacgactcactatagggcccaatctccctctcaaattcaaaattcataacagaggagaatgaatatggaatttgagaacctggcggcagcgcaaaagatg

SEQ ID NO: 136583 - DNA, 103 bp, Artificial Sequence
  Synthetic Polynucleotide
taatacgactcactatagggcgactccttgattgatgaagtttgaaatgtaacagaggagaacatttatgacttcatcaaacctggcggcagcgcaaaagatg

SEQ ID NO: 136584 - DNA, 103 bp, Artificial Sequence
  Synthetic Polynucleotide
taatacgactcactatagggctcttcctcggaaaaagggaccgggctgtcaacagaggagagacagcatggtcccttttaacctggcggcagcgcaaaagatg

SEQ ID NO: 136585 - DNA, 103 bp, Artificial Sequence
  Synthetic Polynucleotide
taatacgactcactatagggaaaaatccagctcttcctcggaaaaagggaaacagaggagatcccttatgccgaggaagaacctggcggcagcgcaaaagatg

SEQ ID NO: 136586 - DNA, 103 bp, Artificial Sequence
  Synthetic Polynucleotide
taatacgactcactataggggtactggtgaaaaaatccagctcttcctcgaacagaggagacgaggaatggctggatttaacctggcggcagcgcaaaagatg

SEQ ID NO: 136587 - DNA, 103 bp, Artificial Sequence
  Synthetic Polynucleotide
taatacgactcactatagggggcacagagcgtactggtgaaaaaatccagaacagaggagactggatatgttcaccagtaacctggcggcagcgcaaaagatg

SEQ ID NO: 136588 - DNA, 103 bp, Artificial Sequence
  Synthetic Polynucleotide
taatacgactcactataggggcaggtcgatggcacagagcgtactggtgaaacagaggagatcaccaatgcgctctgtgaacctggcggcagcgcaaaagatg

SEQ ID NO: 136589 - DNA, 103 bp, Artificial Sequence
  Synthetic Polynucleotide
taatacgactcactatagggtagggaaactgcaggtcgatggcacagagcaacagaggagagctctgatgcatcgacctaacctggcggcagcgcaaaagatg

SEQ ID NO: 136590 - DNA, 103 bp, Artificial Sequence
  Synthetic Polynucleotide
taatacgactcactataggggaattaatgtcgactccttgattgatgaagaacagaggagacttcatatgtcaaggagtaacctggcggcagcgcaaaagatg

SEQ ID NO: 136591 - DNA, 103 bp, Artificial Sequence
  Synthetic Polynucleotide
taatacgactcactatagggggaggaggaggaattaatgtcgactccttgaacagaggagacaaggaatggacattaataacctggcggcagcgcaaaagatg

SEQ ID NO: 136592 - DNA, 103 bp, Artificial Sequence
  Synthetic Polynucleotide
taatacgactcactatagggctcgaaaggaggaggaggaggaattaatgtaacagaggagaacattaatgcctcctcctaacctggcggcagcgcaaaagatg

SEQ ID NO: 136593 - DNA, 103 bp, Artificial Sequence
  Synthetic Polynucleotide
taatacgactcactatagggggaaggtttgctcgaaaggaggaggaggagaacagaggagactcctcatgctcctttcgaacctggcggcagcgcaaaagatg

SEQ ID NO: 136594 - DNA, 103 bp, Artificial Sequence
  Synthetic Polynucleotide
taatacgactcactatagggtggaggctggggaaggtttgctcgaaaggaaacagaggagatcctttatggcaaaccttaacctggcggcagcgcaaaagatg

SEQ ID NO: 136595 - DNA, 103 bp, Artificial Sequence
  Synthetic Polynucleotide
taatacgactcactatagggggcgccgggctggaggctggggaaggtttgaacagaggagacaaaccatgcccagcctcaacctggcggcagcgcaaaagatg

SEQ ID NO: 136596 - DNA, 103 bp, Artificial Sequence
  Synthetic Polynucleotide
taatacgactcactataggggaagggtggaggcgccgggctggaggctggaacagaggagaccagccatgagcccggcgaacctggcggcagcgcaaaagatg

SEQ ID NO: 136597 - DNA, 103 bp, Artificial Sequence
  Synthetic Polynucleotide
taatacgactcactatagggctgggtctctgaagggtggaggcgccgggcaacagaggagagcccggatgctccaccctaacctggcggcagcgcaaaagatg

SEQ ID NO: 136598 - DNA, 103 bp, Artificial Sequence
  Synthetic Polynucleotide
taatacgactcactatagggcttttggctcctgggtctctgaagggtggaaacagaggagatccaccatgcagagacccaacctggcggcagcgcaaaagatg

SEQ ID NO: 136599 - DNA, 103 bp, Artificial Sequence
  Synthetic Polynucleotide
taatacgactcactatagggtgtttataaacccaatctccctctcaaattaacagaggagaaatttgatggggagattgaacctggcggcagcgcaaaagatg

SEQ ID NO: 136600 - DNA, 103 bp, Artificial Sequence
  Synthetic Polynucleotide
taatacgactcactatagggcttcggctcgcttttggctcctgggtctctaacagaggagaagagacatgggagccaaaaacctggcggcagcgcaaaagatg

SEQ ID NO: 136601 - DNA, 103 bp, Artificial Sequence
  Synthetic Polynucleotide
taatacgactcactataggggcaggcccatcttcggctcgcttttggctcaacagaggagagagccaatggcgagccgaaacctggcggcagcgcaaaagatg

SEQ ID NO: 136602 - DNA, 103 bp, Artificial Sequence
  Synthetic Polynucleotide
taatacgactcactatagggcggcggcagagcaggcccatcttcggctcgaacagaggagacgagccatggatgggcctaacctggcggcagcgcaaaagatg

SEQ ID NO: 136603 - DNA, 103 bp, Artificial Sequence
  Synthetic Polynucleotide
taatacgactcactataggggcggcggtggcggcggcagagcaggcccataacagaggagaatgggcatgctctgccgcaacctggcggcagcgcaaaagatg

SEQ ID NO: 136604 - DNA, 103 bp, Artificial Sequence
  Synthetic Polynucleotide
taatacgactcactataggggggagtggcggcggcggtggcggcggcagaaacagaggagatctgccatggccaccgccaacctggcggcagcgcaaaagatg

SEQ ID NO: 136605 - DNA, 103 bp, Artificial Sequence
  Synthetic Polynucleotide
taatacgactcactataggggggggcagcggggagtggcggcggcggtggaacagaggagaccaccgatgccgccactcaacctggcggcagcgcaaaagatg

SEQ ID NO: 136606 - DNA, 103 bp, Artificial Sequence
  Synthetic Polynucleotide
taatacgactcactatagggcgggggccgggggggcagcggggagtggcgaacagaggagacgccacatgccgctgcccaacctggcggcagcgcaaaagatg

SEQ ID NO: 136607 - DNA, 103 bp, Artificial Sequence
  Synthetic Polynucleotide
taatacgactcactatagggcaagggaactcgggggccgggggggcagcgaacagaggagacgctgcatgcccggccccaacctggcggcagcgcaaaagatg

SEQ ID NO: 136608 - DNA, 103 bp, Artificial Sequence
  Synthetic Polynucleotide
taatacgactcactatagggctctttcatccaagggaactcgggggccggaacagaggagaccggccatggagttccctaacctggcggcagcgcaaaagatg

SEQ ID NO: 136609 - DNA, 103 bp, Artificial Sequence
  Synthetic Polynucleotide
taatacgactcactatagggcggatttcttctctttcatccaagggaactaacagaggagaagttccatgggatgaaagaacctggcggcagcgcaaaagatg

SEQ ID NO: 136610 - DNA, 103 bp, Artificial Sequence
  Synthetic Polynucleotide
taatacgactcactataggggacggctggctgtttataaacccaatctccaacagaggagaggagatatggtttataaaaacctggcggcagcgcaaaagatg

SEQ ID NO: 136611 - DNA, 103 bp, Artificial Sequence
  Synthetic Polynucleotide
taatacgactcactatagggggtttcttggcggatttcttctctttcatcaacagaggagagatgaaatggaagaaatcaacctggcggcagcgcaaaagatg

SEQ ID NO: 136612 - DNA, 103 bp, Artificial Sequence
  Synthetic Polynucleotide
taatacgactcactatagggggattggctgggtttcttggcggatttcttaacagaggagaaagaaaatggccaagaaaaacctggcggcagcgcaaaagatg

SEQ ID NO: 136613 - DNA, 103 bp, Artificial Sequence
  Synthetic Polynucleotide
taatacgactcactataggggagacgtggcggattggctgggtttcttggaacagaggagaccaagaatgccagccaataacctggcggcagcgcaaaagatg

SEQ ID NO: 136614 - DNA, 103 bp, Artificial Sequence
  Synthetic Polynucleotide
taatacgactcactataggggccggagaaggagacgtggcggattggctgaacagaggagacagccaatgcgccacgtcaacctggcggcagcgcaaaagatg

SEQ ID NO: 136615 - DNA, 103 bp, Artificial Sequence
  Synthetic Polynucleotide
taatacgactcactatagggggcggaggcggccggagaaggagacgtggcaacagaggagagccacgatgccttctccgaacctggcggcagcgcaaaagatg

SEQ ID NO: 136616 - DNA, 103 bp, Artificial Sequence
  Synthetic Polynucleotide
taatacgactcactatagggaggccggaacggcggaggcggccggagaagaacagaggagacttctcatgccgcctccgaacctggcggcagcgcaaaagatg

SEQ ID NO: 136617 - DNA, 103 bp, Artificial Sequence
  Synthetic Polynucleotide
taatacgactcactatagggccgaccccggaggccggaacggcggaggcgaacagaggagacgcctcatgcgttccggcaacctggcggcagcgcaaaagatg

SEQ ID NO: 136618 - DNA, 103 bp, Artificial Sequence
  Synthetic Polynucleotide
taatacgactcactatagggtgcaggcgatccgaccccggaggccggaacaacagaggagagttccgatgtccggggtcaacctggcggcagcgcaaaagatg

SEQ ID NO: 136619 - DNA, 103 bp, Artificial Sequence
  Synthetic Polynucleotide
taatacgactcactatagggccaggccatctgcaggcgatccgaccccggaacagaggagaccggggatggatcgcctgaacctggcggcagcgcaaaagatg

SEQ ID NO: 136620 - DNA, 103 bp, Artificial Sequence
  Synthetic Polynucleotide
taatacgactcactatagggtccggcagtcccaggccatctgcaggcgataacagaggagaatcgccatgagatggcctaacctggcggcagcgcaaaagatg

SEQ ID NO: 136621 - DNA, 103 bp, Artificial Sequence
  Synthetic Polynucleotide
taatacgactcactatagggctcggcgagcgacggctggctgtttataaaaacagaggagatttataatgagccagccgaacctggcggcagcgcaaaagatg

SEQ ID NO: 136622 - DNA, 103 bp, Artificial Sequence
  Synthetic Polynucleotide
taatacgactcactataggggccaccagcctccggcagtcccaggccatcaacagaggagagatggcatgggactgccgaacctggcggcagcgcaaaagatg

SEQ ID NO: 136623 - DNA, 103 bp, Artificial Sequence
  Synthetic Polynucleotide
taatacgactcactataggggcgccccgccgccaccagcctccggcagtcaacagaggagagactgcatgaggctggtgaacctggcggcagcgcaaaagatg

SEQ ID NO: 136624 - DNA, 103 bp, Artificial Sequence
  Synthetic Polynucleotide
taatacgactcactatagggcgcagcctgcgcgccccgccgccaccagccaacagaggagaggctggatgcggcggggcaacctggcggcagcgcaaaagatg

SEQ ID NO: 136625 - DNA, 103 bp, Artificial Sequence
  Synthetic Polynucleotide
taatacgactcactataggggtaagccgtgcgcagcctgcgcgccccgccaacagaggagaggcgggatgcgcaggctgaacctggcggcagcgcaaaagatg

SEQ ID NO: 136626 - DNA, 103 bp, Artificial Sequence
  Synthetic Polynucleotide
taatacgactcactataggggcgtgttggtgtaagccgtgcgcagcctgcaacagaggagagcaggcatggcacggcttaacctggcggcagcgcaaaagatg

SEQ ID NO: 136627 - DNA, 103 bp, Artificial Sequence
  Synthetic Polynucleotide
taatacgactcactatagggtccagcagctgcgtgttggtgtaagccgtgaacagaggagacacggcatgcaccaacacaacctggcggcagcgcaaaagatg

SEQ ID NO: 136628 - DNA, 103 bp, Artificial Sequence
  Synthetic Polynucleotide
taatacgactcactatagggcttctccagttccagcagctgcgtgttggtaacagaggagaaccaacatgcagctgctgaacctggcggcagcgcaaaagatg

SEQ ID NO: 136629 - DNA, 103 bp, Artificial Sequence
  Synthetic Polynucleotide
taatacgactcactatagggagtggaattccttctccagttccagcagctaacagaggagaagctgcatgaactggagaaacctggcggcagcgcaaaagatg

SEQ ID NO: 136630 - DNA, 103 bp, Artificial Sequence
  Synthetic Polynucleotide
taatacgactcactatagggtacttattaaagtggaattccttctccagtaacagaggagaactggaatgggaattccaaacctggcggcagcgcaaaagatg

SEQ ID NO: 136631 - DNA, 103 bp, Artificial Sequence
  Synthetic Polynucleotide
taatacgactcactatagggccggcacaggtacttattaaagtggaattcaacagaggagagaattcatgtttaataagaacctggcggcagcgcaaaagatg

SEQ ID NO: 136632 - DNA, 103 bp, Artificial Sequence
  Synthetic Polynucleotide
taatacgactcactatagggaagtcagacactcggcgagcgacggctggcaacagaggagagccagcatgcgctcgccgaacctggcggcagcgcaaaagatg

SEQ ID NO: 136633 - DNA, 103 bp, Artificial Sequence
  Synthetic Polynucleotide
taatacgactcactatagggcgcggcgtggccggcacaggtacttattaaaacagaggagattaataatgacctgtgccaacctggcggcagcgcaaaagatg

SEQ ID NO: 136634 - DNA, 103 bp, Artificial Sequence
  Synthetic Polynucleotide
taatacgactcactataggggcgatctcgacgcggcgtggccggcacaggaacagaggagacctgtgatggccacgccgaacctggcggcagcgcaaaagatg

SEQ ID NO: 136635 - DNA, 103 bp, Artificial Sequence
  Synthetic Polynucleotide
taatacgactcactatagggcagcaaggccgcgatctcgacgcggcgtggaacagaggagaccacgcatggtcgagatcaacctggcggcagcgcaaaagatg

SEQ ID NO: 136636 - DNA, 103 bp, Artificial Sequence
  Synthetic Polynucleotide
taatacgactcactatagggcggtgaggtccagcaaggccgcgatctcgaaacagaggagatcgagaatgcggccttgcaacctggcggcagcgcaaaagatg

SEQ ID NO: 136637 - DNA, 103 bp, Artificial Sequence
  Synthetic Polynucleotide
taatacgactcactatagggacctgcctttcggtgaggtccagcaaggccaacagaggagaggccttatgggacctcacaacctggcggcagcgcaaaagatg

SEQ ID NO: 136638 - DNA, 103 bp, Artificial Sequence
  Synthetic Polynucleotide
taatacgactcactatagggccagactttgacctgcctttcggtgaggtcaacagaggagagacctcatggaaaggcagaacctggcggcagcgcaaaagatg

SEQ ID NO: 136639 - DNA, 103 bp, Artificial Sequence
  Synthetic Polynucleotide
taatacgactcactatagggggttctgaaaccagactttgacctgcctttaacagaggagaaaaggcatgtcaaagtctaacctggcggcagcgcaaaagatg

SEQ ID NO: 136640 - DNA, 103 bp, Artificial Sequence
  Synthetic Polynucleotide
taatacgactcactatagggttcatgcgccggttctgaaaccagactttgaacagaggagacaaagtatggtttcagaaaacctggcggcagcgcaaaagatg

SEQ ID NO: 136641 - DNA, 103 bp, Artificial Sequence
  Synthetic Polynucleotide
taatacgactcactatagggccgcttgtgcttcatgcgccggttctgaaaaacagaggagatttcagatgcggcgcatgaacctggcggcagcgcaaaagatg

SEQ ID NO: 136642 - DNA, 103 bp, Artificial Sequence
  Synthetic Polynucleotide
taatacgactcactataggggctgcgtctgccgcttgtgcttcatgcgccaacagaggagaggcgcaatgagcacaagcaacctggcggcagcgcaaaagatg

SEQ ID NO: 136643 - DNA, 103 bp, Artificial Sequence
  Synthetic Polynucleotide
taatacgactcactataggggcggggaaggaagtcagacactcggcgagcaacagaggagagctcgcatggtgtctgacaacctggcggcagcgcaaaagatg

SEQ ID NO: 136644 - DNA, 103 bp, Artificial Sequence
  Synthetic Polynucleotide
taatacgactcactatagggggctctcggtgctgcgtctgccgcttgtgcaacagaggagagcacaaatggcagacgcaaacctggcggcagcgcaaaagatg

SEQ ID NO: 136645 - DNA, 103 bp, Artificial Sequence
  Synthetic Polynucleotide
taatacgactcactatagggcccatccggcggctctcggtgctgcgtctgaacagaggagacagacgatgcaccgagagaacctggcggcagcgcaaaagatg

SEQ ID NO: 136646 - DNA, 103 bp, Artificial Sequence
  Synthetic Polynucleotide
taatacgactcactatagggaggcaggctccccatccggcggctctcggtaacagaggagaaccgagatgcgccggatgaacctggcggcagcgcaaaagatg

SEQ ID NO: 136647 - DNA, 103 bp, Artificial Sequence
  Synthetic Polynucleotide
taatacgactcactataggggctcccgggcaggcaggctccccatccggcaacagaggagagccggaatgggagcctgcaacctggcggcagcgcaaaagatg

SEQ ID NO: 136648 - DNA, 103 bp, Artificial Sequence
  Synthetic Polynucleotide
taatacgactcactataggggtcctccagggctcccgggcaggcaggctcaacagaggagagagcctatgtgcccgggaaacctggcggcagcgcaaaagatg

SEQ ID NO: 136649 - DNA, 103 bp, Artificial Sequence
  Synthetic Polynucleotide
taatacgactcactatagggggtcgcagatgtcctccagggctcccgggcaacagaggagagcccggatgccctggaggaacctggcggcagcgcaaaagatg

SEQ ID NO: 136650 - DNA, 103 bp, Artificial Sequence
  Synthetic Polynucleotide
taatacgactcactatagggtcctcggcagggtcgcagatgtcctccaggaacagaggagacctggaatgcatctgcgaaacctggcggcagcgcaaaagatg

SEQ ID NO: 136651 - DNA, 103 bp, Artificial Sequence
  Synthetic Polynucleotide
taatacgactcactatagggggccgcgggttcctcggcagggtcgcagataacagaggagaatctgcatgcctgccgagaacctggcggcagcgcaaaagatg

SEQ ID NO: 136652 - DNA, 103 bp, Artificial Sequence
  Synthetic Polynucleotide
taatacgactcactatagggcgcccgggctggccgcgggttcctcggcagaacagaggagactgccgatgaacccgcggaacctggcggcagcgcaaaagatg

SEQ ID NO: 136653 - DNA, 103 bp, Artificial Sequence
  Synthetic Polynucleotide
taatacgactcactataggggcggaggggccgcccgggctggccgcgggtaacagaggagaacccgcatgcagcccgggaacctggcggcagcgcaaaagatg

SEQ ID NO: 136654 - DNA, 103 bp, Artificial Sequence
  Synthetic Polynucleotide
taatacgactcactatagggctccaagacagcggggaaggaagtcagacaaacagaggagatgtctgatgtccttccccaacctggcggcagcgcaaaagatg

SEQ ID NO: 136655 - DNA, 103 bp, Artificial Sequence
  Synthetic Polynucleotide
taatacgactcactatagggcgcccgcgaggcggaggggccgcccgggctaacagaggagaagcccgatgggcccctccaacctggcggcagcgcaaaagatg

SEQ ID NO: 136656 - DNA, 103 bp, Artificial Sequence
  Synthetic Polynucleotide
taatacgactcactatagggcttcccacgccgcccgcgaggcggaggggcaacagaggagagcccctatgcctcgcgggaacctggcggcagcgcaaaagatg

SEQ ID NO: 136657 - DNA, 103 bp, Artificial Sequence
  Synthetic Polynucleotide
taatacgactcactatagggtgacagcaggcttcccacgccgcccgcgagaacagaggagactcgcgatgggcgtgggaaacctggcggcagcgcaaaagatg

SEQ ID NO: 136658 - DNA, 103 bp, Artificial Sequence
  Synthetic Polynucleotide
taatacgactcactatagggctccggcgggtgacagcaggcttcccacgcaacagaggagagcgtggatggcctgctgtaacctggcggcagcgcaaaagatg

SEQ ID NO: 136659 - DNA, 103 bp, Artificial Sequence
  Synthetic Polynucleotide
taatacgactcactatagggccggcaccacctccggcgggtgacagcaggaacagaggagacctgctatgacccgccggaacctggcggcagcgcaaaagatg

SEQ ID NO: 136660 - DNA, 103 bp, Artificial Sequence
  Synthetic Polynucleotide
taatacgactcactatagggcttaaggcccccggcaccacctccggcgggaacagaggagacccgccatgggtggtgccaacctggcggcagcgcaaaagatg

SEQ ID NO: 136661 - DNA, 103 bp, Artificial Sequence
  Synthetic Polynucleotide
taatacgactcactatagggggggtccgcgcttaaggcccccggcaccacaacagaggagagtggtgatgggggccttaaacctggcggcagcgcaaaagatg

SEQ ID NO: 136662 - DNA, 103 bp, Artificial Sequence
  Synthetic Polynucleotide
taatacgactcactatagggctaaaggccgggggtccgcgcttaaggcccaacagaggagagggcctatggcgcggaccaacctggcggcagcgcaaaagatg

SEQ ID NO: 136663 - DNA, 103 bp, Artificial Sequence
  Synthetic Polynucleotide
taatacgactcactatagggaagcgaacggctaaaggccgggggtccgcgaacagaggagacgcggaatgccggcctttaacctggcggcagcgcaaaagatg

SEQ ID NO: 136664 - DNA, 103 bp, Artificial Sequence
  Synthetic Polynucleotide
taatacgactcactatagggtgcgccctctaagcgaacggctaaaggccgaacagaggagacggcctatggccgttcgcaacctggcggcagcgcaaaagatg

SEQ ID NO: 136665 - DNA, 103 bp, Artificial Sequence
  Synthetic Polynucleotide
taatacgactcactatagggtttgaaatgtctccaagacagcggggaaggaacagaggagaccttccatgctgtcttggaacctggcggcagcgcaaaagatg

SEQ ID NO: 136666 - DNA, 103 bp, Artificial Sequence
  Synthetic Polynucleotide
taatacgactcactatagggtcgacgcgcctgcgccctctaagcgaacggaacagaggagaccgttcatgtagagggcgaacctggcggcagcgcaaaagatg

SEQ ID NO: 136667 - DNA, 103 bp, Artificial Sequence
  Synthetic Polynucleotide
taatacgactcactatagggcagccgggactcgacgcgcctgcgccctctaacagaggagaagagggatgaggcgcgtcaacctggcggcagcgcaaaagatg

SEQ ID NO: 136668 - DNA, 103 bp, Artificial Sequence
  Synthetic Polynucleotide
taatacgactcactataggggcgcagcgcgcagccgggactcgacgcgccaacagaggagaggcgcgatgagtcccggcaacctggcggcagcgcaaaagatg

SEQ ID NO: 136669 - DNA, 103 bp, Artificial Sequence
  Synthetic Polynucleotide
taatacgactcactatagggcgccggccccgcgcagcgcgcagccgggacaacagaggagagtcccgatggcgcgctgcaacctggcggcagcgcaaaagatg

SEQ ID NO: 136670 - DNA, 103 bp, Artificial Sequence
  Synthetic Polynucleotide
taatacgactcactatagggggctccagcccgccggccccgcgcagcgcgaacagaggagacgcgctatgcggggccggaacctggcggcagcgcaaaagatg

SEQ ID NO: 136671 - DNA, 103 bp, Artificial Sequence
  Synthetic Polynucleotide
taatacgactcactatagggcaatggcccgggctccagcccgccggccccaacagaggagaggggccatggggctggagaacctggcggcagcgcaaaagatg

SEQ ID NO: 136672 - DNA, 103 bp, Artificial Sequence
  Synthetic Polynucleotide
taatacgactcactatagggcgtcttctggcaatggcccgggctccagccaacagaggagaggctggatgccgggccataacctggcggcagcgcaaaagatg

SEQ ID NO: 136673 - DNA, 103 bp, Artificial Sequence
  Synthetic Polynucleotide
taatacgactcactatagggcccgagaagacgtcttctggcaatggcccgaacagaggagacgggccatggccagaagaaacctggcggcagcgcaaaagatg

SEQ ID NO: 136674 - DNA, 103 bp, Artificial Sequence
  Synthetic Polynucleotide
taatacgactcactatagggatcctggcgccccgagaagacgtcttctggaacagaggagaccagaaatggtcttctcgaacctggcggcagcgcaaaagatg

SEQ ID NO: 136675 - DNA, 103 bp, Artificial Sequence
  Synthetic Polynucleotide
taatacgactcactatagggggaaaggtgaatcctggcgccccgagaagaaacagaggagatcttctatgggcgccaggaacctggcggcagcgcaaaagatg

SEQ ID NO: 136676 - DNA, 103 bp, Artificial Sequence
  Synthetic Polynucleotide
taatacgactcactatagggattgatgaagtttgaaatgtctccaagacaaacagaggagatgtcttatggacatttcaaacctggcggcagcgcaaaagatg

SEQ ID NO: 136677 - DNA, 103 bp, Artificial Sequence
  Synthetic Polynucleotide
taatacgactcactatagggaggtcgggaaggaaaggtgaatcctggcgcaacagaggagagcgccaatgttcacctttaacctggcggcagcgcaaaagatg

SEQ ID NO: 136678 - DNA, 103 bp, Artificial Sequence
  Synthetic Polynucleotide
taatacgactcactataggggaagaagttgaggtcgggaaggaaaggtgaaacagaggagatcacctatgcttcccgacaacctggcggcagcgcaaaagatg

SEQ ID NO: 136679 - DNA, 103 bp, Artificial Sequence
  Synthetic Polynucleotide
taatacgactcactatagggagtcggccgcgaagaagttgaggtcgggaaaacagaggagattcccgatgtcaacttctaacctggcggcagcgcaaaagatg

SEQ ID NO: 136680 - DNA, 103 bp, Artificial Sequence
  Synthetic Polynucleotide
taatacgactcactatagggtggagacaggagtcggccgcgaagaagttgaacagaggagacaacttatgcgcggccgaaacctggcggcagcgcaaaagatg

SEQ ID NO: 136681 - DNA, 103 bp, Artificial Sequence
  Synthetic Polynucleotide
taatacgactcactatagggtccggatagctggagacaggagtcggccgcaacagaggagagcggccatgtcctgtctcaacctggcggcagcgcaaaagatg

SEQ ID NO: 136682 - DNA, 103 bp, Artificial Sequence
  Synthetic Polynucleotide
taatacgactcactataggggggagaggcctccggatagctggagacaggaacagaggagacctgtcatgagctatccgaacctggcggcagcgcaaaagatg

SEQ ID NO: 136683 - DNA, 103 bp, Artificial Sequence
  Synthetic Polynucleotide
taatacgactcactatagggtgtaggctaggggagaggcctccggatagcaacagaggagagctatcatgaggcctctcaacctggcggcagcgcaaaagatg

SEQ ID NO: 136684 - DNA, 103 bp, Artificial Sequence
  Synthetic Polynucleotide
taatacgactcactataggggagagaaccctgtaggctaggggagaggccaacagaggagaggcctcatgcctagcctaaacctggcggcagcgcaaaagatg

SEQ ID NO: 136685 - DNA, 103 bp, Artificial Sequence
  Synthetic Polynucleotide
taatacgactcactatagggccgggctgtcgagagaaccctgtaggctagaacagaggagactagccatgagggttctcaacctggcggcagcgcaaaagatg

SEQ ID NO: 136686 - DNA, 103 bp, Artificial Sequence
  Synthetic Polynucleotide
taatacgactcactataggggaaaaagggaccgggctgtcgagagaacccaacagaggagagggttcatgcgacagcccaacctggcggcagcgcaaaagatg

SEQ ID NO: 136687 - DNA, 103 bp, Artificial Sequence
  Synthetic Polynucleotide
taatacgactcactatagggggcgttgtcgtagtaggtggctttctgcataacagaggagaatgcagatggccacctacaacctggcggcagcgcaaaagatg

SEQ ID NO: 136688 - DNA, 103 bp, Artificial Sequence
  Synthetic Polynucleotide
taatacgactcactatagggggcggcctgaaatgggggttggggggggacaacagaggagagtccccatgcaacccccaaacctggcggcagcgcaaaagatg

SEQ ID NO: 136689 - DNA, 103 bp, Artificial Sequence
  Synthetic Polynucleotide
taatacgactcactatagggggcgcccccgttggcttggaggacgtgcggaacagaggagaccgcacatgctccaagccaacctggcggcagcgcaaaagatg

SEQ ID NO: 136690 - DNA, 103 bp, Artificial Sequence
  Synthetic Polynucleotide
taatacgactcactataggggcgtcccgtaggcgcccccgttggcttggaaacagaggagatccaagatgacgggggcgaacctggcggcagcgcaaaagatg

SEQ ID NO: 136691 - DNA, 103 bp, Artificial Sequence
  Synthetic Polynucleotide
taatacgactcactatagggtgcatggtgggcgtcccgtaggcgcccccgaacagaggagacgggggatgctacgggacaacctggcggcagcgcaaaagatg

SEQ ID NO: 136692 - DNA, 103 bp, Artificial Sequence
  Synthetic Polynucleotide
taatacgactcactatagggcggactgccctgcatggtgggcgtcccgtaaacagaggagatacgggatgcccaccatgaacctggcggcagcgcaaaagatg

SEQ ID NO: 136693 - DNA, 103 bp, Artificial Sequence
  Synthetic Polynucleotide
taatacgactcactatagggccacgtacaccggactgccctgcatggtggaacagaggagaccaccaatgagggcagtcaacctggcggcagcgcaaaagatg

SEQ ID NO: 136694 - DNA, 103 bp, Artificial Sequence
  Synthetic Polynucleotide
taatacgactcactatagggccgcccccgcccacgtacaccggactgcccaacagaggagagggcagatgggtgtacgtaacctggcggcagcgcaaaagatg

SEQ ID NO: 136695 - DNA, 103 bp, Artificial Sequence
  Synthetic Polynucleotide
taatacgactcactatagggatccgcgtagccgcccccgcccacgtacacaacagaggagagtgtacatgggcgggggcaacctggcggcagcgcaaaagatg

SEQ ID NO: 136696 - DNA, 103 bp, Artificial Sequence
  Synthetic Polynucleotide
taatacgactcactataggggcggcagcggatccgcgtagccgcccccgcaacagaggagagcggggatggctacgcggaacctggcggcagcgcaaaagatg

SEQ ID NO: 136697 - DNA, 103 bp, Artificial Sequence
  Synthetic Polynucleotide
taatacgactcactatagggccggcagggggcggcagcggatccgcgtagaacagaggagactacgcatgtccgctgccaacctggcggcagcgcaaaagatg

SEQ ID NO: 136698 - DNA, 103 bp, Artificial Sequence
  Synthetic Polynucleotide
taatacgactcactataggggagggaggggccggcagggggcggcagcggaacagaggagaccgctgatgccccctgccaacctggcggcagcgcaaaagatg

SEQ ID NO: 136699 - DNA, 103 bp, Artificial Sequence
  Synthetic Polynucleotide
taatacgactcactatagggccaggtgcgtggcggcctgaaatgggggttaacagaggagaaaccccatgttcaggccgaacctggcggcagcgcaaaagatg

SEQ ID NO: 136700 - DNA, 103 bp, Artificial Sequence
  Synthetic Polynucleotide
taatacgactcactatagggtgaggccatagagggaggggccggcaggggaacagaggagacccctgatggcccctcccaacctggcggcagcgcaaaagatg

SEQ ID NO: 136701 - DNA, 103 bp, Artificial Sequence
  Synthetic Polynucleotide
taatacgactcactataggggaaaggtggttgaggccatagagggaggggaacagaggagacccctcatgctatggcctaacctggcggcagcgcaaaagatg

SEQ ID NO: 136702 - DNA, 103 bp, Artificial Sequence
  Synthetic Polynucleotide
taatacgactcactatagggagggtgatgggaaaggtggttgaggccataaacagaggagatatggcatgaaccaccttaacctggcggcagcgcaaaagatg

SEQ ID NO: 136703 - DNA, 103 bp, Artificial Sequence
  Synthetic Polynucleotide
taatacgactcactatagggggttcccggaagggtgatgggaaaggtggtaacagaggagaaccaccatgcccatcaccaacctggcggcagcgcaaaagatg

SEQ ID NO: 136704 - DNA, 103 bp, Artificial Sequence
  Synthetic Polynucleotide
taatacgactcactatagggttgtagtccaggttcccggaagggtgatggaacagaggagaccatcaatgttccgggaaaacctggcggcagcgcaaaagatg

SEQ ID NO: 136705 - DNA, 103 bp, Artificial Sequence
  Synthetic Polynucleotide
taatacgactcactataggggggcgccccgttgtagtccaggttcccggaaacagaggagatccgggatgctggactacaacctggcggcagcgcaaaagatg

SEQ ID NO: 136706 - DNA, 103 bp, Artificial Sequence
  Synthetic Polynucleotide
taatacgactcactataggggcgccatagggggcgccccgttgtagtccaaacagaggagatggactatgacggggcgcaacctggcggcagcgcaaaagatg

SEQ ID NO: 136707 - DNA, 103 bp, Artificial Sequence
  Synthetic Polynucleotide
taatacgactcactatagggtgctggctgggcgccatagggggcgccccgaacagaggagacggggcatgccctatggcaacctggcggcagcgcaaaagatg

SEQ ID NO: 136708 - DNA, 103 bp, Artificial Sequence
  Synthetic Polynucleotide
taatacgactcactataggggggtccgtggtgctggctgggcgccataggaacagaggagacctatgatgcccagccagaacctggcggcagcgcaaaagatg

SEQ ID NO: 136709 - DNA, 103 bp, Artificial Sequence
  Synthetic Polynucleotide
taatacgactcactatagggggggttcgcagggtccgtggtgctggctggaacagaggagaccagccatgaccacggacaacctggcggcagcgcaaaagatg

SEQ ID NO: 136710 - DNA, 103 bp, Artificial Sequence
  Synthetic Polynucleotide
taatacgactcactatagggtagtcgccctccaggtgcgtggcggcctgaaacagaggagatcaggcatgcacgcacctaacctggcggcagcgcaaaagatg

SEQ ID NO: 136711 - DNA, 103 bp, Artificial Sequence
  Synthetic Polynucleotide
taatacgactcactatagggtaggtggggtggggttcgcagggtccgtggaacagaggagaccacggatgctgcgaaccaacctggcggcagcgcaaaagatg

SEQ ID NO: 136712 - DNA, 103 bp, Artificial Sequence
  Synthetic Polynucleotide
taatacgactcactataggggaggtctgtgtaggtggggtggggttcgcaaacagaggagatgcgaaatgcaccccaccaacctggcggcagcgcaaaagatg

SEQ ID NO: 136713 - DNA, 103 bp, Artificial Sequence
  Synthetic Polynucleotide
taatacgactcactatagggggtgagaggagaggtctgtgtaggtggggtaacagaggagaaccccaatgacacagaccaacctggcggcagcgcaaaagatg

SEQ ID NO: 136714 - DNA, 103 bp, Artificial Sequence
  Synthetic Polynucleotide
taatacgactcactatagggggaggcgcgtggtgagaggagaggtctgtgaacagaggagacacagaatgctcctctcaaacctggcggcagcgcaaaagatg

SEQ ID NO: 136715 - DNA, 103 bp, Artificial Sequence
  Synthetic Polynucleotide
taatacgactcactatagggaccctgaggaggaggcgcgtggtgagaggaaacagaggagatcctctatgcacgcgcctaacctggcggcagcgcaaaagatg

SEQ ID NO: 136716 - DNA, 103 bp, Artificial Sequence
  Synthetic Polynucleotide
taatacgactcactatagggcttggattctaccctgaggaggaggcgcgtaacagaggagaacgcgcatgctcctcaggaacctggcggcagcgcaaaagatg

SEQ ID NO: 136717 - DNA, 103 bp, Artificial Sequence
  Synthetic Polynucleotide
taatacgactcactatagggttgggcgcttcttggattctaccctgaggaaacagaggagatcctcaatgtagaatccaaacctggcggcagcgcaaaagatg

SEQ ID NO: 136718 - DNA, 103 bp, Artificial Sequence
  Synthetic Polynucleotide
taatacgactcactataggggtgtgttaatttgggcgcttcttggattctaacagaggagaagaatcatggaagcgcccaacctggcggcagcgcaaaagatg

SEQ ID NO: 136719 - DNA, 103 bp, Artificial Sequence
  Synthetic Polynucleotide
taatacgactcactatagggtgagcgctggtagtcgccctccaggtgcgtaacagaggagaacgcacatggagggcgacaacctggcggcagcgcaaaagatg

SEQ ID NO: 136720 - DNA, 103 bp, Artificial Sequence
  Synthetic Polynucleotide
taatacgactcactataggggcgagcaagctgagcgctggtagtcgccctaacagaggagaagggcgatgaccagcgctaacctggcggcagcgcaaaagatg

SEQ ID NO: 136721 - DNA, 103 bp, Artificial Sequence
  Synthetic Polynucleotide
taatacgactcactatagggagggactgcagcgagcaagctgagcgctggaacagaggagaccagcgatgagcttgctcaacctggcggcagcgcaaaagatg

SEQ ID NO: 136722 - DNA, 103 bp, Artificial Sequence
  Synthetic Polynucleotide
taatacgactcactatagggagcgttgcccagggactgcagcgagcaagcaacagaggagagcttgcatgctgcagtccaacctggcggcagcgcaaaagatg

SEQ ID NO: 136723 - DNA, 103 bp, Artificial Sequence
  Synthetic Polynucleotide
taatacgactcactatagggcatgtggggcagcgttgcccagggactgcaaacagaggagatgcagtatgtgggcaacgaacctggcggcagcgcaaaagatg

SEQ ID NO: 136724 - DNA, 103 bp, Artificial Sequence
  Synthetic Polynucleotide
taatacgactcactatagggttgctcttggcatgtggggcagcgttgcccaacagaggagagggcaaatgtgccccacaaacctggcggcagcgcaaaagatg

SEQ ID NO: 136725 - DNA, 103 bp, Artificial Sequence
  Synthetic Polynucleotide
taatacgactcactataggggttgagctccttgctcttggcatgtggggcaacagaggagagccccaatggccaagagcaacctggcggcagcgcaaaagatg

SEQ ID NO: 136726 - DNA, 103 bp, Artificial Sequence
  Synthetic Polynucleotide
taatacgactcactataggggagcagccgcggcgttgtcgtagtaggtggaacagaggagaccacctatgacgacaacgaacctggcggcagcgcaaaagatg

SEQ ID NO: 136727 - DNA, 103 bp, Artificial Sequence
  Synthetic Polynucleotide
taatacgactcactatagggtgcagctgccgttgagctccttgctcttggaacagaggagaccaagaatgaggagctcaaacctggcggcagcgcaaaagatg

SEQ ID NO: 136728 - DNA, 103 bp, Artificial Sequence
  Synthetic Polynucleotide
taatacgactcactatagggcccggcctcatgcagctgccgttgagctccaacagaggagaggagctatgcggcagctgaacctggcggcagcgcaaaagatg

SEQ ID NO: 136729 - DNA, 103 bp, Artificial Sequence
  Synthetic Polynucleotide
taatacgactcactataggggggggccagacccggcctcatgcagctgccaacagaggagaggcagcatgatgaggccgaacctggcggcagcgcaaaagatg

SEQ ID NO: 136730 - DNA, 103 bp, Artificial Sequence
  Synthetic Polynucleotide
taatacgactcactatagggacaggggctcgggggccagacccggcctcaaacagaggagatgaggcatggtctggcccaacctggcggcagcgcaaaagatg

SEQ ID NO: 136731 - DNA, 103 bp, Artificial Sequence
  Synthetic Polynucleotide
taatacgactcactatagggggcggggccgacaggggctcgggggccagaaacagaggagatctggcatgcgagcccctaacctggcggcagcgcaaaagatg

SEQ ID NO: 136732 - DNA, 103 bp, Artificial Sequence
  Synthetic Polynucleotide
taatacgactcactataggggggtgagccaggcggggccgacaggggctcaacagaggagagagcccatgtcggccccgaacctggcggcagcgcaaaagatg

SEQ ID NO: 136733 - DNA, 103 bp, Artificial Sequence
  Synthetic Polynucleotide
taatacgactcactatagggcactgggcgggggtgagccaggcggggccgaacagaggagacggcccatgctggctcacaacctggcggcagcgcaaaagatg

SEQ ID NO: 136734 - DNA, 103 bp, Artificial Sequence
  Synthetic Polynucleotide
taatacgactcactataggggtaggtgcggcactgggcgggggtgagccaaacagaggagatggctcatgcccgcccagaacctggcggcagcgcaaaagatg

SEQ ID NO: 136735 - DNA, 103 bp, Artificial Sequence
  Synthetic Polynucleotide
taatacgactcactatagggagtggcactggtaggtgcggcactgggcggaacagaggagaccgcccatggccgcacctaacctggcggcagcgcaaaagatg

SEQ ID NO: 136736 - DNA, 103 bp, Artificial Sequence
  Synthetic Polynucleotide
taatacgactcactatagggtgctgttgctagtggcactggtaggtgcggaacagaggagaccgcacatgccagtgccaaacctggcggcagcgcaaaagatg

SEQ ID NO: 136737 - DNA, 103 bp, Artificial Sequence
  Synthetic Polynucleotide
taatacgactcactatagggcctccgaagagagcagccgcggcgttgtcgaacagaggagacgacaaatgcgcggctgcaacctggcggcagcgcaaaagatg

SEQ ID NO: 136738 - DNA, 103 bp, Artificial Sequence
  Synthetic Polynucleotide
taatacgactcactatagggcccccattactgctgttgctagtggcactgaacagaggagacagtgcatgtagcaacagaacctggcggcagcgcaaaagatg

SEQ ID NO: 136739 - DNA, 103 bp, Artificial Sequence
  Synthetic Polynucleotide
taatacgactcactataggggctgggcccgcccccattactgctgttgctaacagaggagaagcaacatgagtaatgggaacctggcggcagcgcaaaagatg

SEQ ID NO: 136740 - DNA, 103 bp, Artificial Sequence
  Synthetic Polynucleotide
taatacgactcactataggggaccacttttgctgggcccgcccccattacaacagaggagagtaatgatggcgggcccaaacctggcggcagcgcaaaagatg

SEQ ID NO: 136741 - DNA, 103 bp, Artificial Sequence
  Synthetic Polynucleotide
taatacgactcactatagggcactttgggggaccacttttgctgggcccgaacagaggagacgggccatgcaaaagtggaacctggcggcagcgcaaaagatg

SEQ ID NO: 136742 - DNA, 103 bp, Artificial Sequence
  Synthetic Polynucleotide
taatacgactcactataggggccgggaccgcactttgggggaccacttttaacagaggagaaaaagtatgcccccaaagaacctggcggcagcgcaaaagatg

SEQ ID NO: 136743 - DNA, 103 bp, Artificial Sequence
  Synthetic Polynucleotide
taatacgactcactatagggtggagttggtgccgggaccgcactttggggaacagaggagaccccaaatggcggtcccgaacctggcggcagcgcaaaagatg

SEQ ID NO: 136744 - DNA, 103 bp, Artificial Sequence
  Synthetic Polynucleotide
taatacgactcactatagggttggtgagggtggagttggtgccgggaccgaacagaggagacggtccatgcaccaactcaacctggcggcagcgcaaaagatg

SEQ ID NO: 136745 - DNA, 103 bp, Artificial Sequence
  Synthetic Polynucleotide
taatacgactcactataggggaatatctgtttggtgagggtggagttggtaacagaggagaaccaacatgaccctcaccaacctggcggcagcgcaaaagatg

SEQ ID NO: 136746 - DNA, 103 bp, Artificial Sequence
  Synthetic Polynucleotide
taatacgactcactatagggtcatccaggggaatatctgtttggtgagggaacagaggagaccctcaatgaacagatataacctggcggcagcgcaaaagatg

SEQ ID NO: 136747 - DNA, 103 bp, Artificial Sequence
  Synthetic Polynucleotide
taatacgactcactatagggctcgactctttcatccaggggaatatctgtaacagaggagaacagatatgcccctggataacctggcggcagcgcaaaagatg

SEQ ID NO: 136748 - DNA, 103 bp, Artificial Sequence
  Synthetic Polynucleotide
taatacgactcactatagggcgaggaatagcctccgaagagagcagccgcaacagaggagagcggctatgctcttcggaaacctggcggcagcgcaaaagatg

SEQ ID NO: 136749 - DNA, 103 bp, Artificial Sequence
  Synthetic Polynucleotide
taatacgactcactatagggggacgtttgcctcgactctttcatccagggaacagaggagaccctggatgaaagagtcgaacctggcggcagcgcaaaagatg

SEQ ID NO: 136750 - DNA, 103 bp, Artificial Sequence
  Synthetic Polynucleotide
taatacgactcactatagggttttcagcttggacgtttgcctcgactcttaacagaggagaaagagtatgggcaaacgtaacctggcggcagcgcaaaagatg

SEQ ID NO: 136751 - DNA, 103 bp, Artificial Sequence
  Synthetic Polynucleotide
taatacgactcactatagggggggagttgtttttcagcttggacgtttgcaacagaggagagcaaacatgcaagctgaaaacctggcggcagcgcaaaagatg

SEQ ID NO: 136752 - DNA, 103 bp, Artificial Sequence
  Synthetic Polynucleotide
taatacgactcactatagggtgctgtgccgggggagttgtttttcagcttaacagaggagaaagctgatgaacaactccaacctggcggcagcgcaaaagatg

SEQ ID NO: 136753 - DNA, 103 bp, Artificial Sequence
  Synthetic Polynucleotide
taatacgactcactatagggcacagccctctgctgtgccgggggagttgtaacagaggagaacaactatgccggcacagaacctggcggcagcgcaaaagatg

SEQ ID NO: 136754 - DNA, 103 bp, Artificial Sequence
  Synthetic Polynucleotide
taatacgactcactatagggccgccgccaccacagccctctgctgtgccgaacagaggagacggcacatgagagggctgaacctggcggcagcgcaaaagatg

SEQ ID NO: 136755 - DNA, 103 bp, Artificial Sequence
  Synthetic Polynucleotide
taatacgactcactataggggccgccaccgccgccgccaccacagccctcaacagaggagagagggcatgggtggcggcaacctggcggcagcgcaaaagatg

SEQ ID NO: 136756 - DNA, 103 bp, Artificial Sequence
  Synthetic Polynucleotide
taatacgactcactatagggctccgccgccgccgccaccgccgccgccacaacagaggagagtggcgatggcggtggcgaacctggcggcagcgcaaaagatg

SEQ ID NO: 136757 - DNA, 103 bp, Artificial Sequence
  Synthetic Polynucleotide
taatacgactcactatagggccaccactgcctccgccgccgccgccaccgaacagaggagacggtggatgcggcggcggaacctggcggcagcgcaaaagatg

SEQ ID NO: 136758 - DNA, 103 bp, Artificial Sequence
  Synthetic Polynucleotide
taatacgactcactataggggcccccgctgccaccactgcctccgccgccaacagaggagaggcggcatgggcagtggtaacctggcggcagcgcaaaagatg

SEQ ID NO: 136759 - DNA, 103 bp, Artificial Sequence
  Synthetic Polynucleotide
taatacgactcactatagggtgccagggtacgaggaatagcctccgaagaaacagaggagatcttcgatggctattcctaacctggcggcagcgcaaaagatg

SEQ ID NO: 136760 - DNA, 103 bp, Artificial Sequence
  Synthetic Polynucleotide
taatacgactcactatagggcgccgccaccgcccccgctgccaccactgcaacagaggagagcagtgatggcagcggggaacctggcggcagcgcaaaagatg

SEQ ID NO: 136761 - DNA, 103 bp, Artificial Sequence
  Synthetic Polynucleotide
taatacgactcactatagggcccccgccgccgccgccaccgcccccgctgaacagaggagacagcggatgcggtggcggaacctggcggcagcgcaaaagatg

SEQ ID NO: 136762 - DNA, 103 bp, Artificial Sequence
  Synthetic Polynucleotide
taatacgactcactatagggcttgtcccctcccccgccgccgccgccaccaacagaggagaggtggcatgggcggcgggaacctggcggcagcgcaaaagatg

SEQ ID NO: 136763 - DNA, 103 bp, Artificial Sequence
  Synthetic Polynucleotide
taatacgactcactatagggccggggggctcttgtcccctcccccgccgcaacagaggagagcggcgatggaggggacaaacctggcggcagcgcaaaagatg

SEQ ID NO: 136764 - DNA, 103 bp, Artificial Sequence
  Synthetic Polynucleotide
taatacgactcactataggggccgccgaccccggggggctcttgtcccctaacagaggagaaggggaatggagccccccaacctggcggcagcgcaaaagatg

SEQ ID NO: 136765 - DNA, 103 bp, Artificial Sequence
  Synthetic Polynucleotide
taatacgactcactatagggccgcttggacgccgccgaccccggggggctaacagaggagaagccccatggggtcggcgaacctggcggcagcgcaaaagatg

SEQ ID NO: 136766 - DNA, 103 bp, Artificial Sequence
  Synthetic Polynucleotide
taatacgactcactatagggccgtccgcgcccgcttggacgccgccgaccaacagaggagaggtcggatgcgtccaagcaacctggcggcagcgcaaaagatg

SEQ ID NO: 136767 - DNA, 103 bp, Artificial Sequence
  Synthetic Polynucleotide
taatacgactcactatagggctcgtgtacgccgtccgcgcccgcttggacaacagaggagagtccaaatgggcgcggacaacctggcggcagcgcaaaagatg

SEQ ID NO: 136768 - DNA, 103 bp, Artificial Sequence
  Synthetic Polynucleotide
taatacgactcactatagggcagctgcgcgctcgtgtacgccgtccgcgcaacagaggagagcgcggatggcgtacacgaacctggcggcagcgcaaaagatg

SEQ ID NO: 136769 - DNA, 103 bp, Artificial Sequence
  Synthetic Polynucleotide
taatacgactcactatagggccagctccaccagctgcgcgctcgtgtacgaacagaggagacgtacaatggcgcgcagcaacctggcggcagcgcaaaagatg

SEQ ID NO: 136770 - DNA, 103 bp, Artificial Sequence
  Synthetic Polynucleotide
taatacgactcactatagggaagccattgctgccagggtacgaggaatagaacagaggagactattcatggtaccctggaacctggcggcagcgcaaaagatg

SEQ ID NO: 136771 - DNA, 103 bp, Artificial Sequence
  Synthetic Polynucleotide
taatacgactcactatagggaactccttctccagctccaccagctgcgcgaacagaggagacgcgcaatgggtggagctaacctggcggcagcgcaaaagatg

SEQ ID NO: 136772 - DNA, 103 bp, Artificial Sequence
  Synthetic Polynucleotide
taatacgactcactataggggttaaaatggaactccttctccagctccacaacagaggagagtggagatggagaaggagaacctggcggcagcgcaaaagatg

SEQ ID NO: 136773 - DNA, 103 bp, Artificial Sequence
  Synthetic Polynucleotide
taatacgactcactatagggacaggtagcggttaaaatggaactccttctaacagaggagaagaaggatgtccattttaaacctggcggcagcgcaaaagatg

SEQ ID NO: 136774 - DNA, 103 bp, Artificial Sequence
  Synthetic Polynucleotide
taatacgactcactatagggcgaggccggcacaggtagcggttaaaatggaacagaggagaccatttatgccgctacctaacctggcggcagcgcaaaagatg

SEQ ID NO: 136775 - DNA, 103 bp, Artificial Sequence
  Synthetic Polynucleotide
taatacgactcactatagggctctacacggcgaggccggcacaggtagcgaacagaggagacgctacatgtgccggcctaacctggcggcagcgcaaaagatg

SEQ ID NO: 136776 - DNA, 103 bp, Artificial Sequence
  Synthetic Polynucleotide
taatacgactcactatagggggttggccatctctacacggcgaggccggcaacagaggagagccggcatggccgtgtagaacctggcggcagcgcaaaagatg

SEQ ID NO: 136777 - DNA, 103 bp, Artificial Sequence
  Synthetic Polynucleotide
taatacgactcactatagggaggttcagcaggttggccatctctacacggaacagaggagaccgtgtatggatggccaaaacctggcggcagcgcaaaagatg

SEQ ID NO: 136778 - DNA, 103 bp, Artificial Sequence
  Synthetic Polynucleotide
taatacgactcactatagggccgctcgctgaggttcagcaggttggccataacagaggagaatggccatgctgctgaacaacctggcggcagcgcaaaagatg

SEQ ID NO: 136779 - DNA, 103 bp, Artificial Sequence
  Synthetic Polynucleotide
taatacgactcactatagggtcttgatctgccgctcgctgaggttcagcaaacagaggagatgctgaatgtcagcgagcaacctggcggcagcgcaaaagatg

SEQ ID NO: 136780 - DNA, 103 bp, Artificial Sequence
  Synthetic Polynucleotide
taatacgactcactatagggtggaaccagatcttgatctgccgctcgctgaacagaggagacagcgaatggcagatcaaaacctggcggcagcgcaaaagatg

SEQ ID NO: 136781 - DNA, 103 bp, Artificial Sequence
  Synthetic Polynucleotide
taatacgactcactatagggatcgaagccgaagccattgctgccagggtaaacagaggagataccctatgagcaatggcaacctggcggcagcgcaaaagatg

SEQ ID NO: 136782 - DNA, 103 bp, Artificial Sequence
  Synthetic Polynucleotide
taatacgactcactataggggcgccggttctggaaccagatcttgatctgaacagaggagacagatcatgatctggttcaacctggcggcagcgcaaaagatg

SEQ ID NO: 136783 - DNA, 103 bp, Artificial Sequence
  Synthetic Polynucleotide
taatacgactcactatagggtgtacttcatgcgccggttctggaaccagaaacagaggagatctggtatgagaaccggcaacctggcggcagcgcaaaagatg

SEQ ID NO: 136784 - DNA, 103 bp, Artificial Sequence
  Synthetic Polynucleotide
taatacgactcactatagggtggtccttcttgtacttcatgcgccggttcaacagaggagagaaccgatgcatgaagtaaacctggcggcagcgcaaaagatg

SEQ ID NO: 136785 - DNA, 103 bp, Artificial Sequence
  Synthetic Polynucleotide
taatacgactcactatagggcttggccttctggtccttcttgtacttcataacagaggagaatgaagatgaagaaggacaacctggcggcagcgcaaaagatg

SEQ ID NO: 136786 - DNA, 103 bp, Artificial Sequence
  Synthetic Polynucleotide
taatacgactcactatagggaggccaatcccttggccttctggtccttctaacagaggagaagaaggatgagaaggccaaacctggcggcagcgcaaaagatg

SEQ ID NO: 136787 - DNA, 103 bp, Artificial Sequence
  Synthetic Polynucleotide
taatacgactcactatagggcccgacgacgaggccaatcccttggccttcaacagaggagagaaggcatggggattggcaacctggcggcagcgcaaaagatg

SEQ ID NO: 136788 - DNA, 103 bp, Artificial Sequence
  Synthetic Polynucleotide
taatacgactcactatagggagatgggccccccgacgacgaggccaatccaacagaggagaggattgatgtcgtcgtcgaacctggcggcagcgcaaaagatg

SEQ ID NO: 136789 - DNA, 103 bp, Artificial Sequence
  Synthetic Polynucleotide
taatacgactcactatagggtgccggctggagatgggccccccgacgacgaacagaggagacgtcgtatgggggcccataacctggcggcagcgcaaaagatg

SEQ ID NO: 136790 - DNA, 103 bp, Artificial Sequence
  Synthetic Polynucleotide
taatacgactcactatagggtgcggggggctgccggctggagatgggcccaacagaggagagggcccatgtccagccggaacctggcggcagcgcaaaagatg

SEQ ID NO: 136791 - DNA, 103 bp, Artificial Sequence
  Synthetic Polynucleotide
taatacgactcactatagggctgcatgggctgcggggggctgccggctggaacagaggagaccagccatgagccccccgaacctggcggcagcgcaaaagatg

SEQ ID NO: 136792 - DNA, 103 bp, Artificial Sequence
  Synthetic Polynucleotide
taatacgactcactatagggggggggggacatcgaagccgaagccattgcaacagaggagagcaatgatgtcggcttcgaacctggcggcagcgcaaaagatg

SEQ ID NO: 136793 - DNA, 103 bp, Artificial Sequence
  Synthetic Polynucleotide
taatacgactcactatagggcggccgtggactgcatgggctgcggggggcaacagaggagagcccccatgagcccatgcaacctggcggcagcgcaaaagatg

SEQ ID NO: 136794 - DNA, 103 bp, Artificial Sequence
  Synthetic Polynucleotide
taatacgactcactatagggttcatgaagccggccgtggactgcatgggcaacagaggagagcccatatggtccacggcaacctggcggcagcgcaaaagatg

SEQ ID NO: 136795 - DNA, 103 bp, Artificial Sequence
  Synthetic Polynucleotide
taatacgactcactataggggtgtaaggcgttcatgaagccggccgtggaaacagaggagatccacgatgggcttcatgaacctggcggcagcgcaaaagatg

SEQ ID NO: 136796 - DNA, 103 bp, Artificial Sequence
  Synthetic Polynucleotide
taatacgactcactataggggggtcatggagtgtaaggcgttcatgaagcaacagaggagagcttcaatgacgccttacaacctggcggcagcgcaaaagatg

SEQ ID NO: 136797 - DNA, 103 bp, Artificial Sequence
  Synthetic Polynucleotide
taatacgactcactatagggtcgtagctgggggtcatggagtgtaaggcgaacagaggagacgccttatgctccatgacaacctggcggcagcgcaaaagatg

SEQ ID NO: 136798 - DNA, 103 bp, Artificial Sequence
  Synthetic Polynucleotide
taatacgactcactatagggggacgggctctcgtagctgggggtcatggaaacagaggagatccatgatgcccagctacaacctggcggcagcgcaaaagatg

SEQ ID NO: 136799 - DNA, 103 bp, Artificial Sequence
  Synthetic Polynucleotide
taatacgactcactatagggaggcgggtggggacgggctctcgtagctggaacagaggagaccagctatgagagcccgtaacctggcggcagcgcaaaagatg

SEQ ID NO: 136800 - DNA, 103 bp, Artificial Sequence
  Synthetic Polynucleotide
taatacgactcactataggggctttaccgaaggcgggtggggacgggctcaacagaggagagagcccatgcccacccgcaacctggcggcagcgcaaaagatg

SEQ ID NO: 136801 - DNA, 103 bp, Artificial Sequence
  Synthetic Polynucleotide
taatacgactcactatagggattctggtgggctttaccgaaggcgggtggaacagaggagaccacccatgttcggtaaaaacctggcggcagcgcaaaagatg

SEQ ID NO: 136802 - DNA, 103 bp, Artificial Sequence
  Synthetic Polynucleotide
taatacgactcactataggggcgcgtaggcattctggtgggctttaccgaaacagaggagatcggtaatgcccaccagaaacctggcggcagcgcaaaagatg

SEQ ID NO: 136803 - DNA, 103 bp, Artificial Sequence
  Synthetic Polynucleotide
taatacgactcactatagggaatgggggttggggggggacatcgaagccgaacagaggagacggcttatgtgtccccccaacctggcggcagcgcaaaagatg

SEQ ID NO: 136804 - DNA, 103 bp, Artificial Sequence
  Synthetic Polynucleotide
taatacgactcactatagggttggagggcagcgcgtaggcattctggtggaacagaggagaccaccaatgtgcctacgcaacctggcggcagcgcaaaagatg

SEQ ID NO: 136805 - DNA, 103 bp, Artificial Sequence
  Synthetic Polynucleotide
taatacgactcactataggggggctggtagttggagggcagcgcgtaggcaacagaggagagcctacatgctgccctccaacctggcggcagcgcaaaagatg

SEQ ID NO: 136806 - DNA, 103 bp, Artificial Sequence
  Synthetic Polynucleotide
taatacgactcactatagggctttgagagggggctggtagttggagggcaaacagaggagatgccctatgactaccagcaacctggcggcagcgcaaaagatg

SEQ ID NO: 136807 - DNA, 103 bp, Artificial Sequence
  Synthetic Polynucleotide
taatacgactcactataggggcgccgcagcctttgagagggggctggtagaacagaggagactaccaatgccctctcaaaacctggcggcagcgcaaaagatg

SEQ ID NO: 136808 - DNA, 103 bp, Artificial Sequence
  Synthetic Polynucleotide
taatacgactcactatagggcttctgcggggcgccgcagcctttgagaggaacagaggagacctctcatgggctgcggcaacctggcggcagcgcaaaagatg

SEQ ID NO: 136809 - DNA, 103 bp, Artificial Sequence
  Synthetic Polynucleotide
taatacgactcactatagggtcggagggtacttctgcggggcgccgcagcaacagaggagagctgcgatgccccgcagaaacctggcggcagcgcaaaagatg

SEQ ID NO: 136810 - DNA, 103 bp, Artificial Sequence
  Synthetic Polynucleotide
taatacgactcactatagggggcgccggggtcggagggtacttctgcgggaacagaggagacccgcaatggtaccctccaacctggcggcagcgcaaaagatg

SEQ ID NO: 136811 - DNA, 103 bp, Artificial Sequence
  Synthetic Polynucleotide
taatacgactcactatagggctcatactcgggcgccggggtcggagggtaaacagaggagataccctatgaccccggcgaacctggcggcagcgcaaaagatg

SEQ ID NO: 136812 - DNA, 103 bp, Artificial Sequence
  Synthetic Polynucleotide
taatacgactcactatagggggacgtgcggctcatactcgggcgccggggaacagaggagaccccggatgccgagtatgaacctggcggcagcgcaaaagatg

SEQ ID NO: 136813 - DNA, 103 bp, Artificial Sequence
  Synthetic Polynucleotide
taatacgactcactatagggttggcttggaggacgtgcggctcatactcgaacagaggagacgagtaatggccgcacgtaacctggcggcagcgcaaaagatg

SEQ ID NO: 136814 - DNA, 103 bp, Artificial Sequence
  Synthetic Polynucleotide
taatacgactcactatagggtgagttgatcaaaaaagaactcatagccataacagaggagaatggctatgagttcttttaacctggcggcagcgcaaaagatg

SEQ ID NO: 136815 - DNA, 103 bp, Artificial Sequence
  Synthetic Polynucleotide
taatacgactcactataggggccggcgtagtacccgggcgagtggtcgctaacagaggagaagcgacatgtcgcccgggaacctggcggcagcgcaaaagatg

SEQ ID NO: 136816 - DNA, 103 bp, Artificial Sequence
  Synthetic Polynucleotide
taatacgactcactataggggcctctggccgccggcgtagtacccgggcgaacagaggagacgcccgatgactacgccgaacctggcggcagcgcaaaagatg

SEQ ID NO: 136817 - DNA, 103 bp, Artificial Sequence
  Synthetic Polynucleotide
taatacgactcactatagggctgctctctcgcctctggccgccggcgtagaacagaggagactacgcatgcggccagagaacctggcggcagcgcaaaagatg

SEQ ID NO: 136818 - DNA, 103 bp, Artificial Sequence
  Synthetic Polynucleotide
taatacgactcactatagggcggctggaagctgctctctcgcctctggccaacagaggagaggccagatgcgagagagcaacctggcggcagcgcaaaagatg

SEQ ID NO: 136819 - DNA, 103 bp, Artificial Sequence
  Synthetic Polynucleotide
taatacgactcactatagggagcccgcctccggctggaagctgctctctcaacagaggagagagagaatggcttccagcaacctggcggcagcgcaaaagatg

SEQ ID NO: 136820 - DNA, 103 bp, Artificial Sequence
  Synthetic Polynucleotide
taatacgactcactatagggcgccgcccgaagcccgcctccggctggaagaacagaggagacttccaatgggaggcgggaacctggcggcagcgcaaaagatg

SEQ ID NO: 136821 - DNA, 103 bp, Artificial Sequence
  Synthetic Polynucleotide
taatacgactcactataggggcacgccgcgcgccgcccgaagcccgcctcaacagaggagagaggcgatgttcgggcggaacctggcggcagcgcaaaagatg

SEQ ID NO: 136822 - DNA, 103 bp, Artificial Sequence
  Synthetic Polynucleotide
taatacgactcactataggggctgcacggtgcacgccgcgcgccgcccgaaacagaggagatcgggcatggcgcggcgtaacctggcggcagcgcaaaagatg

SEQ ID NO: 136823 - DNA, 103 bp, Artificial Sequence
  Synthetic Polynucleotide
taatacgactcactataggggccgcgtagcgctgcacggtgcacgccgcgaacagaggagacgcggcatgcaccgtgcaaacctggcggcagcgcaaaagatg

SEQ ID NO: 136824 - DNA, 103 bp, Artificial Sequence
  Synthetic Polynucleotide
taatacgactcactataggggtcccggcaggccgcgtagcgctgcacggtaacagaggagaaccgtgatgcgctacgcgaacctggcggcagcgcaaaagatg

SEQ ID NO: 136825 - DNA, 103 bp, Artificial Sequence
  Synthetic Polynucleotide
taatacgactcactatagggcgacatagtttgagttgatcaaaaaagaacaacagaggagagttcttatgtgatcaactaacctggcggcagcgcaaaagatg

SEQ ID NO: 136826 - DNA, 103 bp, Artificial Sequence
  Synthetic Polynucleotide
taatacgactcactatagggggggcccagggtcccggcaggccgcgtagcaacagaggagagctacgatgcctgccgggaacctggcggcagcgcaaaagatg

SEQ ID NO: 136827 - DNA, 103 bp, Artificial Sequence
  Synthetic Polynucleotide
taatacgactcactatagggggaggcggcgggggcccagggtcccggcagaacagaggagactgccgatgccctgggccaacctggcggcagcgcaaaagatg

SEQ ID NO: 136828 - DNA, 103 bp, Artificial Sequence
  Synthetic Polynucleotide
taatacgactcactataggggggtggtggcggaggcggcgggggcccaggaacagaggagacctgggatgccgccgcctaacctggcggcagcgcaaaagatg

SEQ ID NO: 136829 - DNA, 103 bp, Artificial Sequence
  Synthetic Polynucleotide
taatacgactcactatagggggggcggcgggggtggtggcggaggcggcgaacagaggagacgccgcatgcgccaccacaacctggcggcagcgcaaaagatg

SEQ ID NO: 136830 - DNA, 103 bp, Artificial Sequence
  Synthetic Polynucleotide
taatacgactcactatagggggcggtggcgggggcggcgggggtggtggcaacagaggagagccaccatgcccgccgccaacctggcggcagcgcaaaagatg

SEQ ID NO: 136831 - DNA, 103 bp, Artificial Sequence
  Synthetic Polynucleotide
taatacgactcactatagggggacagaccgggcggtggcgggggcggcggaacagaggagaccgccgatgccgccaccgaacctggcggcagcgcaaaagatg

SEQ ID NO: 136832 - DNA, 103 bp, Artificial Sequence
  Synthetic Polynucleotide
taatacgactcactataggggagcccgaggggacagaccgggcggtggcgaacagaggagacgccacatgccggtctgtaacctggcggcagcgcaaaagatg

SEQ ID NO: 136833 - DNA, 103 bp, Artificial Sequence
  Synthetic Polynucleotide
taatacgactcactatagggggcggcgcaggagcccgaggggacagaccgaacagaggagacggtctatgccctcgggcaacctggcggcagcgcaaaagatg

SEQ ID NO: 136834 - DNA, 103 bp, Artificial Sequence
  Synthetic Polynucleotide
taatacgactcactatagggcccggcgggtggcggcgcaggagcccgaggaacagaggagacctcggatgcctgcgccgaacctggcggcagcgcaaaagatg

SEQ ID NO: 136835 - DNA, 103 bp, Artificial Sequence
  Synthetic Polynucleotide
taatacgactcactatagggggaggagggccccggcgggtggcggcgcagaacagaggagactgcgcatgcacccgccgaacctggcggcagcgcaaaagatg

SEQ ID NO: 136836 - DNA, 103 bp, Artificial Sequence
  Synthetic Polynucleotide
taatacgactcactatagggaacttggggtcgacatagtttgagttgatcaacagaggagagatcaaatgaaactatgtaacctggcggcagcgcaaaagatg

SEQ ID NO: 136837 - DNA, 103 bp, Artificial Sequence
  Synthetic Polynucleotide
taatacgactcactatagggccgggctccgggaggagggccccggcgggtaacagaggagaacccgcatgggccctcctaacctggcggcagcgcaaaagatg

SEQ ID NO: 136838 - DNA, 103 bp, Artificial Sequence
  Synthetic Polynucleotide
taatacgactcactataggggcagcgctggccgggctccgggaggagggcaacagaggagagccctcatgccggagcccaacctggcggcagcgcaaaagatg

SEQ ID NO: 136839 - DNA, 103 bp, Artificial Sequence
  Synthetic Polynucleotide
taatacgactcactatagggtgaccgcctcgcagcgctggccgggctccgaacagaggagacggagcatggccagcgctaacctggcggcagcgcaaaagatg

SEQ ID NO: 136840 - DNA, 103 bp, Artificial Sequence
  Synthetic Polynucleotide
taatacgactcactataggggggctgctgctgaccgcctcgcagcgctggaacagaggagaccagcgatgcgaggcggtaacctggcggcagcgcaaaagatg

SEQ ID NO: 136841 - DNA, 103 bp, Artificial Sequence
  Synthetic Polynucleotide
taatacgactcactatagggaggcggcggggggctgctgctgaccgcctcaacagaggagagaggcgatgagcagcagcaacctggcggcagcgcaaaagatg

SEQ ID NO: 136842 - DNA, 103 bp, Artificial Sequence
  Synthetic Polynucleotide
taatacgactcactataggggggcgcagggaggcggcggggggctgctgcaacagaggagagcagcaatgccccgccgcaacctggcggcagcgcaaaagatg

SEQ ID NO: 136843 - DNA, 103 bp, Artificial Sequence
  Synthetic Polynucleotide
taatacgactcactatagggagggggttctgggcgcagggaggcggcgggaacagaggagacccgccatgtccctgcgcaacctggcggcagcgcaaaagatg

SEQ ID NO: 136844 - DNA, 103 bp, Artificial Sequence
  Synthetic Polynucleotide
taatacgactcactataggggctggggtgcagggggttctgggcgcagggaacagaggagaccctgcatgcagaaccccaacctggcggcagcgcaaaagatg

SEQ ID NO: 136845 - DNA, 103 bp, Artificial Sequence
  Synthetic Polynucleotide
taatacgactcactatagggagtgggacgggctggggtgcagggggttctaacagaggagaagaaccatgtgcaccccaaacctggcggcagcgcaaaagatg

SEQ ID NO: 136846 - DNA, 103 bp, Artificial Sequence
  Synthetic Polynucleotide
taatacgactcactatagggttgcacgcggagtgggacgggctggggtgcaacagaggagagcacccatgcccgtcccaaacctggcggcagcgcaaaagatg

SEQ ID NO: 136847 - DNA, 103 bp, Artificial Sequence
  Synthetic Polynucleotide
taatacgactcactataggggcatggagggaacttggggtcgacatagttaacagaggagaaactatatggaccccaagaacctggcggcagcgcaaaagatg

SEQ ID NO: 136848 - DNA, 103 bp, Artificial Sequence
  Synthetic Polynucleotide
taatacgactcactataggggacgggctctttgcacgcggagtgggacggaacagaggagaccgtccatgtccgcgtgcaacctggcggcagcgcaaaagatg

SEQ ID NO: 136849 - DNA, 103 bp, Artificial Sequence
  Synthetic Polynucleotide
taatacgactcactatagggaggggtagacgacgggctctttgcacgcggaacagaggagaccgcgtatgaagagcccgaacctggcggcagcgcaaaagatg

SEQ ID NO: 136850 - DNA, 103 bp, Artificial Sequence
  Synthetic Polynucleotide
taatacgactcactatagggttgcgcatccaggggtagacgacgggctctaacagaggagaagagccatgcgtctacccaacctggcggcagcgcaaaagatg

SEQ ID NO: 136851 - DNA, 103 bp, Artificial Sequence
  Synthetic Polynucleotide
taatacgactcactatagggcacgtgaactttgcgcatccaggggtagacaacagaggagagtctacatgtggatgcgcaacctggcggcagcgcaaaagatg

SEQ ID NO: 136852 - DNA, 103 bp, Artificial Sequence
  Synthetic Polynucleotide
taatacgactcactatagggttaccgtgctcacgtgaactttgcgcatccaacagaggagaggatgcatgaagttcacgaacctggcggcagcgcaaaagatg

SEQ ID NO: 136853 - DNA, 103 bp, Artificial Sequence
  Synthetic Polynucleotide
taatacgactcactatagggtaattggggtttaccgtgctcacgtgaactaacagaggagaagttcaatggagcacggtaacctggcggcagcgcaaaagatg

SEQ ID NO: 136854 - DNA, 103 bp, Artificial Sequence
  Synthetic Polynucleotide
taatacgactcactatagggcccgccggcgtaattggggtttaccgtgctaacagaggagaagcacgatgaaccccaataacctggcggcagcgcaaaagatg

SEQ ID NO: 136855 - DNA, 103 bp, Artificial Sequence
  Synthetic Polynucleotide
taatacgactcactataggggcttgggctccccgccggcgtaattggggtaacagaggagaaccccaatgacgccggcgaacctggcggcagcgcaaaagatg

SEQ ID NO: 136856 - DNA, 103 bp, Artificial Sequence
  Synthetic Polynucleotide
taatacgactcactataggggtccgagagcgcttgggctccccgccggcgaacagaggagacgccggatgggagcccaaaacctggcggcagcgcaaaagatg

SEQ ID NO: 136857 - DNA, 103 bp, Artificial Sequence
  Synthetic Polynucleotide
taatacgactcactatagggcgtgtaggcggtccgagagcgcttgggctcaacagaggagagagcccatgcgctctcggaacctggcggcagcgcaaaagatg

SEQ ID NO: 136858 - DNA, 103 bp, Artificial Sequence
  Synthetic Polynucleotide
taatacgactcactatagggaatattcctcgcatggagggaacttggggtaacagaggagaaccccaatgtccctccataacctggcggcagcgcaaaagatg

SEQ ID NO: 136859 - DNA, 103 bp, Artificial Sequence
  Synthetic Polynucleotide
taatacgactcactatagggcctgctggcgcgtgtaggcggtccgagagcaacagaggagagctctcatgccgcctacaaacctggcggcagcgcaaaagatg

SEQ ID NO: 136860 - DNA, 103 bp, Artificial Sequence
  Synthetic Polynucleotide
taatacgactcactatagggagctccaagacctgctggcgcgtgtaggcgaacagaggagacgcctaatggcgccagcaaacctggcggcagcgcaaaagatg

SEQ ID NO: 136861 - DNA, 103 bp, Artificial Sequence
  Synthetic Polynucleotide
taatacgactcactatagggttccttctccagctccaagacctgctggcgaacagaggagacgccagatggtcttggagaacctggcggcagcgcaaaagatg

SEQ ID NO: 136862 - DNA, 103 bp, Artificial Sequence
  Synthetic Polynucleotide
taatacgactcactatagggtgtagtgaaattccttctccagctccaagaaacagaggagatcttggatgtggagaaggaacctggcggcagcgcaaaagatg

SEQ ID NO: 136863 - DNA, 103 bp, Artificial Sequence
  Synthetic Polynucleotide
taatacgactcactatagggaggtagcggttgtagtgaaattccttctccaacagaggagaggagaaatgatttcactaaacctggcggcagcgcaaaagatg

SEQ ID NO: 136864 - DNA, 103 bp, Artificial Sequence
  Synthetic Polynucleotide
taatacgactcactataggggcgccgtgtcaggtagcggttgtagtgaaaaacagaggagatttcacatgaaccgctacaacctggcggcagcgcaaaagatg

SEQ ID NO: 136865 - DNA, 103 bp, Artificial Sequence
  Synthetic Polynucleotide
taatacgactcactatagggccaccctccggcgccgtgtcaggtagcggtaacagaggagaaccgctatgtgacacggcaacctggcggcagcgcaaaagatg

SEQ ID NO: 136866 - DNA, 103 bp, Artificial Sequence
  Synthetic Polynucleotide
taatacgactcactatagggtgggcgatctccaccctccggcgccgtgtcaacagaggagagacacgatgccggagggtaacctggcggcagcgcaaaagatg

SEQ ID NO: 136867 - DNA, 103 bp, Artificial Sequence
  Synthetic Polynucleotide
taatacgactcactataggggcagagcgcgtgggcgatctccaccctccgaacagaggagacggaggatggagatcgccaacctggcggcagcgcaaaagatg

SEQ ID NO: 136868 - DNA, 103 bp, Artificial Sequence
  Synthetic Polynucleotide
taatacgactcactataggggctcggagaggcagagcgcgtgggcgatctaacagaggagaagatcgatgacgcgctctaacctggcggcagcgcaaaagatg

SEQ ID NO: 136869 - DNA, 103 bp, Artificial Sequence
  Synthetic Polynucleotide
taatacgactcactatagggtcgctctgtgaatattcctcgcatggagggaacagaggagaccctccatgcgaggaataaacctggcggcagcgcaaaagatg

SEQ ID NO: 136870 - DNA, 103 bp, Artificial Sequence
  Synthetic Polynucleotide
taatacgactcactatagggttgatctggcgctcggagaggcagagcgcgaacagaggagacgcgctatgcctctccgaaacctggcggcagcgcaaaagatg

SEQ ID NO: 136871 - DNA, 103 bp, Artificial Sequence
  Synthetic Polynucleotide
taatacgactcactataggggaaccagatcttgatctggcgctcggagagaacagaggagactctccatgcgccagatcaacctggcggcagcgcaaaagatg

SEQ ID NO: 136872 - DNA, 103 bp, Artificial Sequence
  Synthetic Polynucleotide
taatacgactcactataggggccggttctggaaccagatcttgatctggcaacagaggagagccagaatgagatctggtaacctggcggcagcgcaaaagatg

SEQ ID NO: 136873 - DNA, 103 bp, Artificial Sequence
  Synthetic Polynucleotide
taatacgactcactatagggcacttcatgcgccggttctggaaccagatcaacagaggagagatctgatgccagaaccgaacctggcggcagcgcaaaagatg

SEQ ID NO: 136874 - DNA, 103 bp, Artificial Sequence
  Synthetic Polynucleotide
taatacgactcactataggggtcttttttccacttcatgcgccggttctgaacagaggagacagaacatgcgcatgaagaacctggcggcagcgcaaaagatg

SEQ ID NO: 136875 - DNA, 103 bp, Artificial Sequence
  Synthetic Polynucleotide
taatacgactcactataggggcaacttgtggtcttttttccacttcatgcaacagaggagagcatgaatgggaaaaaagaacctggcggcagcgcaaaagatg

SEQ ID NO: 136876 - DNA, 103 bp, Artificial Sequence
  Synthetic Polynucleotide
taatacgactcactatagggttggtgttgggcaacttgtggtcttttttcaacagaggagagaaaaaatgccacaagttaacctggcggcagcgcaaaagatg

SEQ ID NO: 136877 - DNA, 103 bp, Artificial Sequence
  Synthetic Polynucleotide
taatacgactcactatagggcgagcggatcttggtgttgggcaacttgtgaacagaggagacacaagatgcccaacaccaacctggcggcagcgcaaaagatg

SEQ ID NO: 136878 - DNA, 103 bp, Artificial Sequence
  Synthetic Polynucleotide
taatacgactcactatagggccgcaccacccgagcggatcttggtgttggaacagaggagaccaacaatgagatccgctaacctggcggcagcgcaaaagatg

SEQ ID NO: 136879 - DNA, 103 bp, Artificial Sequence
  Synthetic Polynucleotide
taatacgactcactataggggctgagcctgccgcaccacccgagcggatcaacagaggagagatccgatggggtggtgcaacctggcggcagcgcaaaagatg

SEQ ID NO: 136880 - DNA, 103 bp, Artificial Sequence
  Synthetic Polynucleotide
taatacgactcactataggggggtaggtaatcgctctgtgaatattcctcaacagaggagagaggaaatgtcacagagcaacctggcggcagcgcaaaagatg

SEQ ID NO: 136881 - DNA, 103 bp, Artificial Sequence
  Synthetic Polynucleotide
taatacgactcactataggggggccctccggctgagcctgccgcaccaccaacagaggagaggtggtatggcaggctcaaacctggcggcagcgcaaaagatg

SEQ ID NO: 136882 - DNA, 103 bp, Artificial Sequence
  Synthetic Polynucleotide
taatacgactcactataggggccggccagggggccctccggctgagcctgaacagaggagacaggctatgccggagggcaacctggcggcagcgcaaaagatg

SEQ ID NO: 136883 - DNA, 103 bp, Artificial Sequence
  Synthetic Polynucleotide
taatacgactcactatagggcctccattgggccggccagggggccctccgaacagaggagacggaggatgccctggccgaacctggcggcagcgcaaaagatg

SEQ ID NO: 136884 - DNA, 103 bp, Artificial Sequence
  Synthetic Polynucleotide
taatacgactcactatagggcgcgcgggggcctccattgggccggccaggaacagaggagacctggcatgcccaatggaaacctggcggcagcgcaaaagatg

SEQ ID NO: 136885 - DNA, 103 bp, Artificial Sequence
  Synthetic Polynucleotide
taatacgactcactatagggagtggtcgctgggtaggtaatcgctctgtgaacagaggagacacagaatgattacctacaacctggcggcagcgcaaaagatg

SEQ ID NO: 136886 - DNA, 103 bp, Artificial Sequence
  Synthetic Polynucleotide
taatacgactcactatagggtacccgggcgagtggtcgctgggtaggtaaaacagaggagattacctatgcagcgaccaaacctggcggcagcgcaaaagatg

SEQ ID NO: 136887 - DNA, 103 bp, Artificial Sequence
  Synthetic Polynucleotide
taatacgactcactatagggcgagaaggagtttacaaagtacgagctcataacagaggagaatgagcatgtactttgtaaacctggcggcagcgcaaaagatg

SEQ ID NO: 136888 - DNA, 103 bp, Artificial Sequence
  Synthetic Polynucleotide
taatacgactcactatagggcatggcagcgggatccctgtaagagccgctaacagaggagaagcggcatgtacagggataacctggcggcagcgcaaaagatg

SEQ ID NO: 136889 - DNA, 103 bp, Artificial Sequence
  Synthetic Polynucleotide
taatacgactcactatagggagccggtgtgcatggcagcgggatccctgtaacagaggagaacagggatgccgctgccaaacctggcggcagcgcaaaagatg

SEQ ID NO: 136890 - DNA, 103 bp, Artificial Sequence
  Synthetic Polynucleotide
taatacgactcactatagggtagccgtaagagccggtgtgcatggcagcgaacagaggagacgctgcatggcacaccggaacctggcggcagcgcaaaagatg

SEQ ID NO: 136891 - DNA, 103 bp, Artificial Sequence
  Synthetic Polynucleotide
taatacgactcactatagggattgtaattgtagccgtaagagccggtgtgaacagaggagacacaccatgtcttacggcaacctggcggcagcgcaaaagatg

SEQ ID NO: 136892 - DNA, 103 bp, Artificial Sequence
  Synthetic Polynucleotide
taatacgactcactatagggggtccatcccattgtaattgtagccgtaagaacagaggagacttacgatgacaattacaaacctggcggcagcgcaaaagatg

SEQ ID NO: 136893 - DNA, 103 bp, Artificial Sequence
  Synthetic Polynucleotide
taatacgactcactatagggttgacgctgaggtccatcccattgtaattgaacagaggagacaattaatgtgggatggaaacctggcggcagcgcaaaagatg

SEQ ID NO: 136894 - DNA, 103 bp, Artificial Sequence
  Synthetic Polynucleotide
taatacgactcactatagggcgaggagcggttgacgctgaggtccatcccaacagaggagagggatgatgctcagcgtcaacctggcggcagcgcaaaagatg

SEQ ID NO: 136895 - DNA, 103 bp, Artificial Sequence
  Synthetic Polynucleotide
taatacgactcactatagggtggaggaggccgaggagcggttgacgctgaaacagaggagatcagcgatgaccgctcctaacctggcggcagcgcaaaagatg

SEQ ID NO: 136896 - DNA, 103 bp, Artificial Sequence
  Synthetic Polynucleotide
taatacgactcactatagggccaaagtggctggaggaggccgaggagcggaacagaggagaccgctcatgggcctcctcaacctggcggcagcgcaaaagatg

SEQ ID NO: 136897 - DNA, 103 bp, Artificial Sequence
  Synthetic Polynucleotide
taatacgactcactataggggcccaccgccccaaagtggctggaggaggcaacagaggagagcctccatgagccactttaacctggcggcagcgcaaaagatg

SEQ ID NO: 136898 - DNA, 103 bp, Artificial Sequence
  Synthetic Polynucleotide
taatacgactcactataggggataacgccccgagaaggagtttacaaagtaacagaggagaactttgatgactccttctaacctggcggcagcgcaaaagatg

SEQ ID NO: 136899 - DNA, 103 bp, Artificial Sequence
  Synthetic Polynucleotide
taatacgactcactataggggcgagctctcgcccaccgccccaaagtggcaacagaggagagccactatggggcggtggaacctggcggcagcgcaaaagatg

SEQ ID NO: 136900 - DNA, 103 bp, Artificial Sequence
  Synthetic Polynucleotide
taatacgactcactataggggggaaggcgcgcgagctctcgcccaccgccaacagaggagaggcggtatgcgagagctcaacctggcggcagcgcaaaagatg

SEQ ID NO: 136901 - DNA, 103 bp, Artificial Sequence
  Synthetic Polynucleotide
taatacgactcactatagggggcgggcgcggggaaggcgcgcgagctctcaacagaggagagagagcatgcgcgccttcaacctggcggcagcgcaaaagatg

SEQ ID NO: 136902 - DNA, 103 bp, Artificial Sequence
  Synthetic Polynucleotide
taatacgactcactatagggggggctcctgggcgggcgcggggaaggcgcaacagaggagagcgcctatgccgcgcccgaacctggcggcagcgcaaaagatg

SEQ ID NO: 136903 - DNA, 103 bp, Artificial Sequence
  Synthetic Polynucleotide
taatacgactcactatagggtgcctgaagcggggctcctgggcgggcgcgaacagaggagacgcgccatgccaggagccaacctggcggcagcgcaaaagatg

SEQ ID NO: 136904 - DNA, 103 bp, Artificial Sequence
  Synthetic Polynucleotide
taatacgactcactatagggcgaagccgcttgcctgaagcggggctcctgaacagaggagacaggagatgcgcttcaggaacctggcggcagcgcaaaagatg

SEQ ID NO: 136905 - DNA, 103 bp, Artificial Sequence
  Synthetic Polynucleotide
taatacgactcactataggggggagcagctcgaagccgcttgcctgaagcaacagaggagagcttcaatgaagcggcttaacctggcggcagcgcaaaagatg

SEQ ID NO: 136906 - DNA, 103 bp, Artificial Sequence
  Synthetic Polynucleotide
taatacgactcactatagggggcgaggacagggagcagctcgaagccgctaacagaggagaagcggcatggagctgctcaacctggcggcagcgcaaaagatg

SEQ ID NO: 136907 - DNA, 103 bp, Artificial Sequence
  Synthetic Polynucleotide
taatacgactcactatagggcagggactcgggcgaggacagggagcagctaacagaggagaagctgcatgctgtcctcgaacctggcggcagcgcaaaagatg

SEQ ID NO: 136908 - DNA, 103 bp, Artificial Sequence
  Synthetic Polynucleotide
taatacgactcactatagggtggtgcagggcagggactcgggcgaggacaaacagaggagatgtcctatgccgagtcccaacctggcggcagcgcaaaagatg

SEQ ID NO: 136909 - DNA, 103 bp, Artificial Sequence
  Synthetic Polynucleotide
taatacgactcactataggggggccatttggataacgccccgagaaggagaacagaggagactccttatgggggcgttaaacctggcggcagcgcaaaagatg

SEQ ID NO: 136910 - DNA, 103 bp, Artificial Sequence
  Synthetic Polynucleotide
taatacgactcactatagggctgtcgccgttggtgcagggcagggactcgaacagaggagacgagtcatggccctgcacaacctggcggcagcgcaaaagatg

SEQ ID NO: 136911 - DNA, 103 bp, Artificial Sequence
  Synthetic Polynucleotide
taatacgactcactatagggggcgccgtggctgtcgccgttggtgcagggaacagaggagaccctgcatgaacggcgacaacctggcggcagcgcaaaagatg

SEQ ID NO: 136912 - DNA, 103 bp, Artificial Sequence
  Synthetic Polynucleotide
taatacgactcactatagggcagagggcttggcgccgtggctgtcgccgtaacagaggagaacggcgatggccacggcgaacctggcggcagcgcaaaagatg

SEQ ID NO: 136913 - DNA, 103 bp, Artificial Sequence
  Synthetic Polynucleotide
taatacgactcactatagggggggacgaagcagagggcttggcgccgtggaacagaggagaccacggatgcaagccctcaacctggcggcagcgcaaaagatg

SEQ ID NO: 136914 - DNA, 103 bp, Artificial Sequence
  Synthetic Polynucleotide
taatacgactcactatagggctggtcggagggggacgaagcagagggcttaacagaggagaaagcccatggcttcgtccaacctggcggcagcgcaaaagatg

SEQ ID NO: 136915 - DNA, 103 bp, Artificial Sequence
  Synthetic Polynucleotide
taatacgactcactatagggctgaggtcgcctggtcggagggggacgaagaacagaggagacttcgtatgcctccgaccaacctggcggcagcgcaaaagatg

SEQ ID NO: 136916 - DNA, 103 bp, Artificial Sequence
  Synthetic Polynucleotide
taatacgactcactatagggctggagctggctgaggtcgcctggtcggagaacagaggagactccgaatgggcgacctcaacctggcggcagcgcaaaagatg

SEQ ID NO: 136917 - DNA, 103 bp, Artificial Sequence
  Synthetic Polynucleotide
taatacgactcactataggggaaattggcgctggagctggctgaggtcgcaacagaggagagcgaccatggccagctccaacctggcggcagcgcaaaagatg

SEQ ID NO: 136918 - DNA, 103 bp, Artificial Sequence
  Synthetic Polynucleotide
taatacgactcactatagggctatttcggtgaaattggcgctggagctggaacagaggagaccagctatggcgccaattaacctggcggcagcgcaaaagatg

SEQ ID NO: 136919 - DNA, 103 bp, Artificial Sequence
  Synthetic Polynucleotide
taatacgactcactatagggctggcctcgtctatttcggtgaaattggcgaacagaggagacgccaaatgcaccgaaataacctggcggcagcgcaaaagatg

SEQ ID NO: 136920 - DNA, 103 bp, Artificial Sequence
  Synthetic Polynucleotide
taatacgactcactatagggctgatagtccgggccatttggataacgcccaacagaggagagggcgtatgccaaatggcaacctggcggcagcgcaaaagatg

SEQ ID NO: 136921 - DNA, 103 bp, Artificial Sequence
  Synthetic Polynucleotide
taatacgactcactatagggcgaggacgcgctggcctcgtctatttcggtaacagaggagaaccgaaatggacgaggccaacctggcggcagcgcaaaagatg

SEQ ID NO: 136922 - DNA, 103 bp, Artificial Sequence
  Synthetic Polynucleotide
taatacgactcactatagggcctcaggctccgaggacgcgctggcctcgtaacagaggagaacgaggatggcgcgtcctaacctggcggcagcgcaaaagatg

SEQ ID NO: 136923 - DNA, 103 bp, Artificial Sequence
  Synthetic Polynucleotide
taatacgactcactatagggcttgccgcttcctcaggctccgaggacgcgaacagaggagacgcgtcatgggagcctgaaacctggcggcagcgcaaaagatg

SEQ ID NO: 136924 - DNA, 103 bp, Artificial Sequence
  Synthetic Polynucleotide
taatacgactcactataggggcttagctggcttgccgcttcctcaggctcaacagaggagagagcctatggaagcggcaaacctggcggcagcgcaaaagatg

SEQ ID NO: 136925 - DNA, 103 bp, Artificial Sequence
  Synthetic Polynucleotide
taatacgactcactatagggggctggggctgcttagctggcttgccgcttaacagaggagaaagcggatggccagctaaaacctggcggcagcgcaaaagatg

SEQ ID NO: 136926 - DNA, 103 bp, Artificial Sequence
  Synthetic Polynucleotide
taatacgactcactataggggcccgagctaggctggggctgcttagctggaacagaggagaccagctatgcagccccagaacctggcggcagcgcaaaagatg

SEQ ID NO: 136927 - DNA, 103 bp, Artificial Sequence
  Synthetic Polynucleotide
taatacgactcactatagggctctggctgcgcccgagctaggctggggctaacagaggagaagccccatgctagctcggaacctggcggcagcgcaaaagatg

SEQ ID NO: 136928 - DNA, 103 bp, Artificial Sequence
  Synthetic Polynucleotide
taatacgactcactatagggtggccatgggctctggctgcgcccgagctaaacagaggagatagctcatgcgcagccagaacctggcggcagcgcaaaagatg

SEQ ID NO: 136929 - DNA, 103 bp, Artificial Sequence
  Synthetic Polynucleotide
taatacgactcactataggggctgtggaggtggccatgggctctggctgcaacagaggagagcagccatggcccatggcaacctggcggcagcgcaaaagatg

SEQ ID NO: 136930 - DNA, 103 bp, Artificial Sequence
  Synthetic Polynucleotide
taatacgactcactatagggctcgggcgcggctgtggaggtggccatgggaacagaggagacccatgatgacctccacaaacctggcggcagcgcaaaagatg

SEQ ID NO: 136931 - DNA, 103 bp, Artificial Sequence
  Synthetic Polynucleotide
taatacgactcactatagggaatttagcaactgatagtccgggccatttgaacagaggagacaaatgatgcggactatcaacctggcggcagcgcaaaagatg

SEQ ID NO: 136932 - DNA, 103 bp, Artificial Sequence
  Synthetic Polynucleotide
taatacgactcactataggggagtctgcccctcgggcgcggctgtggaggaacagaggagacctccaatgccgcgcccgaacctggcggcagcgcaaaagatg

SEQ ID NO: 136933 - DNA, 103 bp, Artificial Sequence
  Synthetic Polynucleotide
taatacgactcactatagggaatatttgcggagtctgcccctcgggcgcgaacagaggagacgcgccatgggggcagacaacctggcggcagcgcaaaagatg

SEQ ID NO: 136934 - DNA, 103 bp, Artificial Sequence
  Synthetic Polynucleotide
taatacgactcactatagggcatccaggggaatatttgcggagtctgcccaacagaggagagggcagatgccgcaaataaacctggcggcagcgcaaaagatg

SEQ ID NO: 136935 - DNA, 103 bp, Artificial Sequence
  Synthetic Polynucleotide
taatacgactcactataggggaagcttcctcatccaggggaatatttgcgaacagaggagacgcaaaatgtcccctggaaacctggcggcagcgcaaaagatg

SEQ ID NO: 136936 - DNA, 103 bp, Artificial Sequence
  Synthetic Polynucleotide
taatacgactcactatagggtggctgatgtgaagcttcctcatccaggggaacagaggagacccctgatggaggaagctaacctggcggcagcgcaaaagatg

SEQ ID NO: 136937 - DNA, 103 bp, Artificial Sequence
  Synthetic Polynucleotide
taatacgactcactatagggggtcatatcatggctgatgtgaagcttcctaacagaggagaaggaagatgcacatcagcaacctggcggcagcgcaaaagatg

SEQ ID NO: 136938 - DNA, 103 bp, Artificial Sequence
  Synthetic Polynucleotide
taatacgactcactatagggcgtccggcccggtcatatcatggctgatgtaacagaggagaacatcaatgatgatatgaaacctggcggcagcgcaaaagatg

SEQ ID NO: 136939 - DNA, 103 bp, Artificial Sequence
  Synthetic Polynucleotide
taatacgactcactataggggcccttttcccgtccggcccggtcatatcaaacagaggagatgatatatgcgggccggaaacctggcggcagcgcaaaagatg

SEQ ID NO: 136940 - DNA, 103 bp, Artificial Sequence
  Synthetic Polynucleotide
taatacgactcactatagggcgcggtccgggcccttttcccgtccggcccaacagaggagagggccgatggggaaaaggaacctggcggcagcgcaaaagatg

SEQ ID NO: 136941 - DNA, 103 bp, Artificial Sequence
  Synthetic Polynucleotide
taatacgactcactatagggagcgggtatacgcggtccgggcccttttccaacagaggagaggaaaaatgcccggaccgaacctggcggcagcgcaaaagatg

SEQ ID NO: 136942 - DNA, 103 bp, Artificial Sequence
  Synthetic Polynucleotide
taatacgactcactatagggccactgccataatttagcaactgatagtccaacagaggagaggactaatggttgctaaaaacctggcggcagcgcaaaagatg

SEQ ID NO: 136943 - DNA, 103 bp, Artificial Sequence
  Synthetic Polynucleotide
taatacgactcactatagggagggtctggtagcgggtatacgcggtccggaacagaggagaccggacatggtatacccgaacctggcggcagcgcaaaagatg

SEQ ID NO: 136944 - DNA, 103 bp, Artificial Sequence
  Synthetic Polynucleotide
taatacgactcactatagggttccagctccagggtctggtagcgggtataaacagaggagatataccatgtaccagaccaacctggcggcagcgcaaaagatg

SEQ ID NO: 136945 - DNA, 103 bp, Artificial Sequence
  Synthetic Polynucleotide
taatacgactcactatagggggaactccttttccagctccagggtctggtaacagaggagaaccagaatgtggagctggaacctggcggcagcgcaaaagatg

SEQ ID NO: 136946 - DNA, 103 bp, Artificial Sequence
  Synthetic Polynucleotide
taatacgactcactatagggcggttgaagtggaactccttttccagctccaacagaggagaggagctatgaaaggagttaacctggcggcagcgcaaaagatg

SEQ ID NO: 136947 - DNA, 103 bp, Artificial Sequence
  Synthetic Polynucleotide
taatacgactcactatagggggtcaggtagcggttgaagtggaactccttaacagaggagaaaggagatgcacttcaacaacctggcggcagcgcaaaagatg

SEQ ID NO: 136948 - DNA, 103 bp, Artificial Sequence
  Synthetic Polynucleotide
taatacgactcactataggggccgtcgccgggtcaggtagcggttgaagtaacagaggagaacttcaatggctacctgaaacctggcggcagcgcaaaagatg

SEQ ID NO: 136949 - DNA, 103 bp, Artificial Sequence
  Synthetic Polynucleotide
taatacgactcactatagggatctcgatgcgccgtcgccgggtcaggtagaacagaggagactacctatgccggcgacgaacctggcggcagcgcaaaagatg

SEQ ID NO: 136950 - DNA, 103 bp, Artificial Sequence
  Synthetic Polynucleotide
taatacgactcactatagggtgcgtgggcgatctcgatgcgccgtcgccgaacagaggagacggcgaatgcgcatcgagaacctggcggcagcgcaaaagatg

SEQ ID NO: 136951 - DNA, 103 bp, Artificial Sequence
  Synthetic Polynucleotide
taatacgactcactatagggacaggcagagtgcgtgggcgatctcgatgcaacagaggagagcatcgatgtcgcccacgaacctggcggcagcgcaaaagatg

SEQ ID NO: 136952 - DNA, 103 bp, Artificial Sequence
  Synthetic Polynucleotide
taatacgactcactatagggtggcgctcggacaggcagagtgcgtgggcgaacagaggagacgcccaatgactctgcctaacctggcggcagcgcaaaagatg

SEQ ID NO: 136953 - DNA, 103 bp, Artificial Sequence
  Synthetic Polynucleotide
taatacgactcactatagggcagagagctgccactgccataatttagcaaaacagaggagattgctaatgtatggcagtaacctggcggcagcgcaaaagatg

SEQ ID NO: 136954 - DNA, 103 bp, Artificial Sequence
  Synthetic Polynucleotide
taatacgactcactataggggatcttgatctggcgctcggacaggcagagaacagaggagactctgcatgtccgagcgcaacctggcggcagcgcaaaagatg

SEQ ID NO: 136955 - DNA, 103 bp, Artificial Sequence
  Synthetic Polynucleotide
taatacgactcactatagggtctggaaccagatcttgatctggcgctcggaacagaggagaccgagcatgagatcaagaaacctggcggcagcgcaaaagatg

SEQ ID NO: 136956 - DNA, 103 bp, Artificial Sequence
  Synthetic Polynucleotide
taatacgactcactatagggatgcgccggttctggaaccagatcttgatcaacagaggagagatcaaatgctggttccaaacctggcggcagcgcaaaagatg

SEQ ID NO: 136957 - DNA, 103 bp, Artificial Sequence
  Synthetic Polynucleotide
taatacgactcactatagggcttccacttcatgcgccggttctggaaccaaacagaggagatggttcatgaaccggcgcaacctggcggcagcgcaaaagatg

SEQ ID NO: 136958 - DNA, 103 bp, Artificial Sequence
  Synthetic Polynucleotide
taatacgactcactatagggtgttgtccttcttccacttcatgcgccggtaacagaggagaaccggcatgtgaagtggaaacctggcggcagcgcaaaagatg

SEQ ID NO: 136959 - DNA, 103 bp, Artificial Sequence
  Synthetic Polynucleotide
taatacgactcactatagggcttttcaatttgttgtccttcttccacttcaacagaggagagaagtgatggaaggacaaaacctggcggcagcgcaaaagatg

SEQ ID NO: 136960 - DNA, 103 bp, Artificial Sequence
  Synthetic Polynucleotide
taatacgactcactatagggcaggctcatacttttcaatttgttgtccttaacagaggagaaaggacatgaaattgaaaaacctggcggcagcgcaaaagatg

SEQ ID NO: 136961 - DNA, 103 bp, Artificial Sequence
  Synthetic Polynucleotide
taatacgactcactatagggcagctgtagccaggctcatacttttcaattaacagaggagaaattgaatggtatgagccaacctggcggcagcgcaaaagatg

SEQ ID NO: 136962 - DNA, 103 bp, Artificial Sequence
  Synthetic Polynucleotide
taatacgactcactatagggaaggcgctgccagctgtagccaggctcataaacagaggagatatgagatgggctacagcaacctggcggcagcgcaaaagatg

SEQ ID NO: 136963 - DNA, 103 bp, Artificial Sequence
  Synthetic Polynucleotide
taatacgactcactatagggtcagggctggaaggcgctgccagctgtagcaacagaggagagctacaatgggcagcgccaacctggcggcagcgcaaaagatg

SEQ ID NO: 136964 - DNA, 103 bp, Artificial Sequence
  Synthetic Polynucleotide
taatacgactcactatagggaagagccgctcagagagctgccactgccataacagaggagaatggcaatggcagctctcaacctggcggcagcgcaaaagatg

SEQ ID NO: 136965 - DNA, 103 bp, Artificial Sequence
  Synthetic Polynucleotide
taatacgactcactatagggggatccctgtaagagccgctcagagagctgaacagaggagacagctcatggagcggctcaacctggcggcagcgcaaaagatg

SEQ ID NO: 136966 - DNA, 103 bp, Artificial Sequence
  Synthetic Polynucleotide
taatacgactcactataggggaaggtggagttcacgaaataggaactcataacagaggagaatgagtatgtatttcgtgaacctggcggcagcgcaaaagatg

SEQ ID NO: 136967 - DNA, 103 bp, Artificial Sequence
  Synthetic Polynucleotide
taatacgactcactatagggggggtaatgtctcagcgggtccgcatagccaacagaggagaggctatatggacccgctgaacctggcggcagcgcaaaagatg

SEQ ID NO: 136968 - DNA, 103 bp, Artificial Sequence
  Synthetic Polynucleotide
taatacgactcactatagggcgtagggcgcggggtaatgtctcagcgggtaacagaggagaacccgcatggacattaccaacctggcggcagcgcaaaagatg

SEQ ID NO: 136969 - DNA, 103 bp, Artificial Sequence
  Synthetic Polynucleotide
taatacgactcactatagggggccctggcccgtagggcgcggggtaatgtaacagaggagaacattaatgcgcgccctaaacctggcggcagcgcaaaagatg

SEQ ID NO: 136970 - DNA, 103 bp, Artificial Sequence
  Synthetic Polynucleotide
taatacgactcactataggggtcctggcccggccctggcccgtagggcgcaacagaggagagcgcccatggggccagggaacctggcggcagcgcaaaagatg

SEQ ID NO: 136971 - DNA, 103 bp, Artificial Sequence
  Synthetic Polynucleotide
taatacgactcactatagggcaaagcccttgtcctggcccggccctggccaacagaggagaggccagatgcgggccaggaacctggcggcagcgcaaaagatg

SEQ ID NO: 136972 - DNA, 103 bp, Artificial Sequence
  Synthetic Polynucleotide
taatacgactcactataggggaggaagtggcaaagcccttgtcctggcccaacagaggagagggccaatgcaagggcttaacctggcggcagcgcaaaagatg

SEQ ID NO: 136973 - DNA, 103 bp, Artificial Sequence
  Synthetic Polynucleotide
taatacgactcactatagggcgggtaataggaggaagtggcaaagcccttaacagaggagaaagggcatggccacttccaacctggcggcagcgcaaaagatg

SEQ ID NO: 136974 - DNA, 103 bp, Artificial Sequence
  Synthetic Polynucleotide
taatacgactcactatagggcgcccgccggcgggtaataggaggaagtggaacagaggagaccacttatgcctattaccaacctggcggcagcgcaaaagatg

SEQ ID NO: 136975 - DNA, 103 bp, Artificial Sequence
  Synthetic Polynucleotide
taatacgactcactatagggccgtagccaccgcccgccggcgggtaatagaacagaggagactattaatggccggcgggaacctggcggcagcgcaaaagatg

SEQ ID NO: 136976 - DNA, 103 bp, Artificial Sequence
  Synthetic Polynucleotide
taatacgactcactatagggcgccgctcggccgtagccaccgcccgccggaacagaggagaccggcgatgggtggctacaacctggcggcagcgcaaaagatg

SEQ ID NO: 136977 - DNA, 103 bp, Artificial Sequence
  Synthetic Polynucleotide
taatacgactcactataggggagtgacggggaaggtggagttcacgaaataacagaggagaatttcgatgactccacctaacctggcggcagcgcaaaagatg

SEQ ID NO: 136978 - DNA, 103 bp, Artificial Sequence
  Synthetic Polynucleotide
taatacgactcactatagggagtcgcagggcgccgctcggccgtagccacaacagaggagagtggctatggccgagcggaacctggcggcagcgcaaaagatg

SEQ ID NO: 136979 - DNA, 103 bp, Artificial Sequence
  Synthetic Polynucleotide
taatacgactcactataggggccggcccgtagtcgcagggcgccgctcggaacagaggagaccgagcatggccctgcgaaacctggcggcagcgcaaaagatg

SEQ ID NO: 136980 - DNA, 103 bp, Artificial Sequence
  Synthetic Polynucleotide
taatacgactcactataggggaaggccggcgccggcccgtagtcgcagggaacagaggagaccctgcatgtacgggccgaacctggcggcagcgcaaaagatg

SEQ ID NO: 136981 - DNA, 103 bp, Artificial Sequence
  Synthetic Polynucleotide
taatacgactcactatagggtctcgcggtagaaggccggcgccggcccgtaacagaggagaacgggcatgcgccggcctaacctggcggcagcgcaaaagatg

SEQ ID NO: 136982 - DNA, 103 bp, Artificial Sequence
  Synthetic Polynucleotide
taatacgactcactataggggccgactctttctcgcggtagaaggccggcaacagaggagagccggcatgctaccgcgaaacctggcggcagcgcaaaagatg

SEQ ID NO: 136983 - DNA, 103 bp, Artificial Sequence
  Synthetic Polynucleotide
taatacgactcactataggggagtgcgcaggccgactctttctcgcggtaaacagaggagataccgcatgaaagagtcgaacctggcggcagcgcaaaagatg

SEQ ID NO: 136984 - DNA, 103 bp, Artificial Sequence
  Synthetic Polynucleotide
taatacgactcactatagggcggcgccggagagtgcgcaggccgactcttaacagaggagaaagagtatgcctgcgcacaacctggcggcagcgcaaaagatg

SEQ ID NO: 136985 - DNA, 103 bp, Artificial Sequence
  Synthetic Polynucleotide
taatacgactcactatagggggctgctcgtcggcgccggagagtgcgcagaacagaggagactgcgcatgctccggcgcaacctggcggcagcgcaaaagatg

SEQ ID NO: 136986 - DNA, 103 bp, Artificial Sequence
  Synthetic Polynucleotide
taatacgactcactataggggtggaacgggggctgctcgtcggcgccggaaacagaggagatccggcatggacgagcagaacctggcggcagcgcaaaagatg

SEQ ID NO: 136987 - DNA, 103 bp, Artificial Sequence
  Synthetic Polynucleotide
taatacgactcactataggggcggctcggggtggaacgggggctgctcgtaacagaggagaacgagcatgccccgttccaacctggcggcagcgcaaaagatg

SEQ ID NO: 136988 - DNA, 103 bp, Artificial Sequence
  Synthetic Polynucleotide
taatacgactcactatagggccgctggccagagtgacggggaaggtggagaacagaggagactccacatgccccgtcacaacctggcggcagcgcaaaagatg

SEQ ID NO: 136989 - DNA, 103 bp, Artificial Sequence
  Synthetic Polynucleotide
taatacgactcactatagggtccgacttccgcggctcggggtggaacgggaacagaggagacccgttatgccccgagccaacctggcggcagcgcaaaagatg

SEQ ID NO: 136990 - DNA, 103 bp, Artificial Sequence
  Synthetic Polynucleotide
taatacgactcactatagggctgcgcgcagtccgacttccgcggctcgggaacagaggagacccgagatgcggaagtcgaacctggcggcagcgcaaaagatg

SEQ ID NO: 136991 - DNA, 103 bp, Artificial Sequence
  Synthetic Polynucleotide
taatacgactcactatagggcgctcttgtcctgcgcgcagtccgacttccaacagaggagaggaagtatgactgcgcgcaacctggcggcagcgcaaaagatg

SEQ ID NO: 136992 - DNA, 103 bp, Artificial Sequence
  Synthetic Polynucleotide
taatacgactcactatagggtcgccgaacacgctcttgtcctgcgcgcagaacagaggagactgcgcatgggacaagagaacctggcggcagcgcaaaagatg

SEQ ID NO: 136993 - DNA, 103 bp, Artificial Sequence
  Synthetic Polynucleotide
taatacgactcactatagggctcttctgtctcgccgaacacgctcttgtcaacagaggagagacaagatggtgttcggcaacctggcggcagcgcaaaagatg

SEQ ID NO: 136994 - DNA, 103 bp, Artificial Sequence
  Synthetic Polynucleotide
taatacgactcactatagggagcacttctgctcttctgtctcgccgaacaaacagaggagatgttcgatgagacagaagaacctggcggcagcgcaaaagatg

SEQ ID NO: 136995 - DNA, 103 bp, Artificial Sequence
  Synthetic Polynucleotide
taatacgactcactatagggaccggagtggagcacttctgctcttctgtcaacagaggagagacagaatggcagaagtgaacctggcggcagcgcaaaagatg

SEQ ID NO: 136996 - DNA, 103 bp, Artificial Sequence
  Synthetic Polynucleotide
taatacgactcactatagggccacgggtagaccggagtggagcacttctgaacagaggagacagaagatgtccactccgaacctggcggcagcgcaaaagatg

SEQ ID NO: 136997 - DNA, 103 bp, Artificial Sequence
  Synthetic Polynucleotide
taatacgactcactatagggtccgctgcatccacgggtagaccggagtggaacagaggagaccactcatgtctacccgtaacctggcggcagcgcaaaagatg

SEQ ID NO: 136998 - DNA, 103 bp, Artificial Sequence
  Synthetic Polynucleotide
taatacgactcactatagggcacgaattcatccgctgcatccacgggtagaacagaggagactacccatggatgcagcgaacctggcggcagcgcaaaagatg

SEQ ID NO: 136999 - DNA, 103 bp, Artificial Sequence
  Synthetic Polynucleotide
taatacgactcactatagggggactcctgcccgctggccagagtgacgggaacagaggagacccgtcatgctggccagcaacctggcggcagcgcaaaagatg

SEQ ID NO: 137000 - DNA, 103 bp, Artificial Sequence
  Synthetic Polynucleotide
taatacgactcactatagggggaactgttgcacgaattcatccgctgcataacagaggagaatgcagatgatgaattcgaacctggcggcagcgcaaaagatg

SEQ ID NO: 137001 - DNA, 103 bp, Artificial Sequence
  Synthetic Polynucleotide
taatacgactcactataggggcccaaaggaggaactgttgcacgaattcaaacagaggagatgaattatggcaacagttaacctggcggcagcgcaaaagatg

SEQ ID NO: 137002 - DNA, 103 bp, Artificial Sequence
  Synthetic Polynucleotide
taatacgactcactatagggcggccgctgggcccaaaggaggaactgttgaacagaggagacaacagatgctcctttggaacctggcggcagcgcaaaagatg

SEQ ID NO: 137003 - DNA, 103 bp, Artificial Sequence
  Synthetic Polynucleotide
taatacgactcactataggggcggcctcgccggccgctgggcccaaaggaaacagaggagatcctttatgcccagcggcaacctggcggcagcgcaaaagatg

SEQ ID NO: 137004 - DNA, 103 bp, Artificial Sequence
  Synthetic Polynucleotide
taatacgactcactatagggtgtatgtctggcggcctcgccggccgctggaacagaggagaccagcgatgggcgaggccaacctggcggcagcgcaaaagatg

SEQ ID NO: 137005 - DNA, 103 bp, Artificial Sequence
  Synthetic Polynucleotide
taatacgactcactatagggtggtaacgtgtgtatgtctggcggcctcgcaacagaggagagcgaggatgccagacataaacctggcggcagcgcaaaagatg

SEQ ID NO: 137006 - DNA, 103 bp, Artificial Sequence
  Synthetic Polynucleotide
taatacgactcactatagggctccagcgtctggtaacgtgtgtatgtctgaacagaggagacagacaatgacacgttacaacctggcggcagcgcaaaagatg

SEQ ID NO: 137007 - DNA, 103 bp, Artificial Sequence
  Synthetic Polynucleotide
taatacgactcactatagggccttctccagctccagcgtctggtaacgtgaacagaggagacacgttatgagacgctggaacctggcggcagcgcaaaagatg

SEQ ID NO: 137008 - DNA, 103 bp, Artificial Sequence
  Synthetic Polynucleotide
taatacgactcactatagggtagtgaaactccttctccagctccagcgtcaacagaggagagacgctatggctggagaaaacctggcggcagcgcaaaagatg

SEQ ID NO: 137009 - DNA, 103 bp, Artificial Sequence
  Synthetic Polynucleotide
taatacgactcactataggggtagcgattgtagtgaaactccttctccagaacagaggagactggagatggagtttcacaacctggcggcagcgcaaaagatg

SEQ ID NO: 137010 - DNA, 103 bp, Artificial Sequence
  Synthetic Polynucleotide
taatacgactcactatagggggcccaggaaggactcctgcccgctggccaaacagaggagatggccaatgggcaggagtaacctggcggcagcgcaaaagatg

SEQ ID NO: 137011 - DNA, 103 bp, Artificial Sequence
  Synthetic Polynucleotide
taatacgactcactataggggccgcgtcaggtagcgattgtagtgaaactaacagaggagaagtttcatgacaatcgctaacctggcggcagcgcaaaagatg

SEQ ID NO: 137012 - DNA, 103 bp, Artificial Sequence
  Synthetic Polynucleotide
taatacgactcactatagggatgcgccgccgccgcgtcaggtagcgattgaacagaggagacaatcgatgcctgacgcgaacctggcggcagcgcaaaagatg

SEQ ID NO: 137013 - DNA, 103 bp, Artificial Sequence
  Synthetic Polynucleotide
taatacgactcactatagggcgcgatctcgatgcgccgccgccgcgtcagaacagaggagactgacgatgcggcggcgcaacctggcggcagcgcaaaagatg

SEQ ID NO: 137014 - DNA, 103 bp, Artificial Sequence
  Synthetic Polynucleotide
taatacgactcactatagggacagggcgtgcgcgatctcgatgcgccgccaacagaggagaggcggcatgtcgagatcgaacctggcggcagcgcaaaagatg

SEQ ID NO: 137015 - DNA, 103 bp, Artificial Sequence
  Synthetic Polynucleotide
taatacgactcactatagggtccgtcaggcacagggcgtgcgcgatctcgaacagaggagacgagatatggcacgccctaacctggcggcagcgcaaaagatg

SEQ ID NO: 137016 - DNA, 103 bp, Artificial Sequence
  Synthetic Polynucleotide
taatacgactcactataggggatctgcctctccgtcaggcacagggcgtgaacagaggagacacgccatgtgcctgacgaacctggcggcagcgcaaaagatg

SEQ ID NO: 137017 - DNA, 103 bp, Artificial Sequence
  Synthetic Polynucleotide
taatacgactcactatagggaccatatcttgatctgcctctccgtcaggcaacagaggagagcctgaatgagaggcagaaacctggcggcagcgcaaaagatg

SEQ ID NO: 137018 - DNA, 103 bp, Artificial Sequence
  Synthetic Polynucleotide
taatacgactcactatagggcggttctggaaccatatcttgatctgcctcaacagaggagagaggcaatgcaagatatgaacctggcggcagcgcaaaagatg

SEQ ID NO: 137019 - DNA, 103 bp, Artificial Sequence
  Synthetic Polynucleotide
taatacgactcactatagggcttcatgcgtcggttctggaaccatatcttaacagaggagaaagataatgttccagaacaacctggcggcagcgcaaaagatg

SEQ ID NO: 137020 - DNA, 103 bp, Artificial Sequence
  Synthetic Polynucleotide
taatacgactcactatagggcctttttccacttcatgcgtcggttctggaaacagaggagatccagaatggacgcatgaaacctggcggcagcgcaaaagatg

SEQ ID NO: 137021 - DNA, 103 bp, Artificial Sequence
  Synthetic Polynucleotide
taatacgactcactatagggagcggtagctggcccaggaaggactcctgcaacagaggagagcaggaatgcttcctgggaacctggcggcagcgcaaaagatg

SEQ ID NO: 137022 - DNA, 103 bp, Artificial Sequence
  Synthetic Polynucleotide
taatacgactcactatagggagtttgctctcctttttccacttcatgcgtaacagaggagaacgcatatggtggaaaaaaacctggcggcagcgcaaaagatg

SEQ ID NO: 137023 - DNA, 103 bp, Artificial Sequence
  Synthetic Polynucleotide
taatacgactcactatagggcgcgctgagcagtttgctctcctttttccaaacagaggagatggaaaatggagagcaaaaacctggcggcagcgcaaaagatg

SEQ ID NO: 137024 - DNA, 103 bp, Artificial Sequence
  Synthetic Polynucleotide
taatacgactcactatagggtgagctgagacgcgctgagcagtttgctctaacagaggagaagagcaatgtgctcagcgaacctggcggcagcgcaaaagatg

SEQ ID NO: 137025 - DNA, 103 bp, Artificial Sequence
  Synthetic Polynucleotide
taatacgactcactatagggtcctcggcactgagctgagacgcgctgagcaacagaggagagctcagatggtctcagctaacctggcggcagcgcaaaagatg

SEQ ID NO: 137026 - DNA, 103 bp, Artificial Sequence
  Synthetic Polynucleotide
taatacgactcactatagggttcttcctcctcctcggcactgagctgagaaacagaggagatctcagatgagtgccgagaacctggcggcagcgcaaaagatg

SEQ ID NO: 137027 - DNA, 103 bp, Artificial Sequence
  Synthetic Polynucleotide
taatacgactcactatagggcggcctgtttttcttcctcctcctcggcacaacagaggagagtgccgatgaggaggaagaacctggcggcagcgcaaaagatg

SEQ ID NO: 137028 - DNA, 103 bp, Artificial Sequence
  Synthetic Polynucleotide
taatacgactcactatagggcgacgaatagagcggtagctggcccaggaaaacagaggagattcctgatgcagctaccgaacctggcggcagcgcaaaagatg

SEQ ID NO: 137029 - DNA, 103 bp, Artificial Sequence
  Synthetic Polynucleotide
taatacgactcactatagggccgcatagcccgacgaatagagcggtagctaacagaggagaagctacatgtctattcgtaacctggcggcagcgcaaaagatg

SEQ ID NO: 137030 - DNA, 103 bp, Artificial Sequence
  Synthetic Polynucleotide
taatacgactcactatagggctcagcgggtccgcatagcccgacgaatagaacagaggagactattcatggggctatgcaacctggcggcagcgcaaaagatg

SEQ ID NO: 137031 - DNA, 103 bp, Artificial Sequence
  Synthetic Polynucleotide
taatacgactcactatagggtaaagtattcgcataatacaatgaactcataacagaggagaatgagtatgttgtattataacctggcggcagcgcaaaagatg

SEQ ID NO: 137032 - DNA, 103 bp, Artificial Sequence
  Synthetic Polynucleotide
taatacgactcactataggggcgctgggggttggaagcaaacgcacaagaaacagaggagatcttgtatgtttgcttccaacctggcggcagcgcaaaagatg

SEQ ID NO: 137033 - DNA, 103 bp, Artificial Sequence
  Synthetic Polynucleotide
taatacgactcactatagggcatagcccgggcgctgggggttggaagcaaaacagaggagattgcttatgacccccagcaacctggcggcagcgcaaaagatg

SEQ ID NO: 137034 - DNA, 103 bp, Artificial Sequence
  Synthetic Polynucleotide
taatacgactcactataggggaacccgctccatagcccgggcgctgggggaacagaggagacccccaatgcccgggctaaacctggcggcagcgcaaaagatg

SEQ ID NO: 137035 - DNA, 103 bp, Artificial Sequence
  Synthetic Polynucleotide
taatacgactcactatagggggaagcgcccgaacccgctccatagcccggaacagaggagaccgggcatgggagcgggtaacctggcggcagcgcaaaagatg

SEQ ID NO: 137036 - DNA, 103 bp, Artificial Sequence
  Synthetic Polynucleotide
taatacgactcactatagggaggcggcgaaggaagcgcccgaacccgctcaacagaggagagagcggatgcgggcgcttaacctggcggcagcgcaaaagatg

SEQ ID NO: 137037 - DNA, 103 bp, Artificial Sequence
  Synthetic Polynucleotide
taatacgactcactatagggccctgcatcgaggcggcgaaggaagcgcccaacagaggagagggcgcatgcttcgccgcaacctggcggcagcgcaaaagatg

SEQ ID NO: 137038 - DNA, 103 bp, Artificial Sequence
  Synthetic Polynucleotide
taatacgactcactatagggggggtacaagccctgcatcgaggcggcgaaaacagaggagattcgccatgtcgatgcagaacctggcggcagcgcaaaagatg

SEQ ID NO: 137039 - DNA, 103 bp, Artificial Sequence
  Synthetic Polynucleotide
taatacgactcactatagggcccccccgccggggtacaagccctgcatcgaacagaggagacgatgcatggcttgtaccaacctggcggcagcgcaaaagatg

SEQ ID NO: 137040 - DNA, 103 bp, Artificial Sequence
  Synthetic Polynucleotide
taatacgactcactatagggcccgccatgccccccccgccggggtacaagaacagaggagacttgtaatgcggcgggggaacctggcggcagcgcaaaagatg

SEQ ID NO: 137041 - DNA, 103 bp, Artificial Sequence
  Synthetic Polynucleotide
taatacgactcactatagggcgcgctctggcccgccatgccccccccgccaacagaggagaggcgggatgggcatggcgaacctggcggcagcgcaaaagatg

SEQ ID NO: 137042 - DNA, 103 bp, Artificial Sequence
  Synthetic Polynucleotide
taatacgactcactatagggatttagaaaataaagtattcgcataatacaaacagaggagatgtattatgcgaatacttaacctggcggcagcgcaaaagatg

SEQ ID NO: 137043 - DNA, 103 bp, Artificial Sequence
  Synthetic Polynucleotide
taatacgactcactatagggagacgccggccgcgctctggcccgccatgcaacagaggagagcatggatggccagagcgaacctggcggcagcgcaaaagatg

SEQ ID NO: 137044 - DNA, 103 bp, Artificial Sequence
  Synthetic Polynucleotide
taatacgactcactatagggccggccgcgtagacgccggccgcgctctggaacagaggagaccagagatgggccggcgtaacctggcggcagcgcaaaagatg

SEQ ID NO: 137045 - DNA, 103 bp, Artificial Sequence
  Synthetic Polynucleotide
taatacgactcactataggggagcccatagccggccgcgtagacgccggcaacagaggagagccggcatgtacgcggccaacctggcggcagcgcaaaagatg

SEQ ID NO: 137046 - DNA, 103 bp, Artificial Sequence
  Synthetic Polynucleotide
taatacgactcactatagggaactcggctcgagcccatagccggccgcgtaacagaggagaacgcggatggctatgggcaacctggcggcagcgcaaaagatg

SEQ ID NO: 137047 - DNA, 103 bp, Artificial Sequence
  Synthetic Polynucleotide
taatacgactcactatagggatgttgaaggaactcggctcgagcccatagaacagaggagactatggatgcgagccgagaacctggcggcagcgcaaaagatg

SEQ ID NO: 137048 - DNA, 103 bp, Artificial Sequence
  Synthetic Polynucleotide
taatacgactcactatagggcgcgcagtgcatgttgaaggaactcggctcaacagaggagagagccgatgtccttcaacaacctggcggcagcgcaaaagatg

SEQ ID NO: 137049 - DNA, 103 bp, Artificial Sequence
  Synthetic Polynucleotide
taatacgactcactataggggctcaaagggcgcgcagtgcatgttgaaggaacagaggagaccttcaatgtgcactgcgaacctggcggcagcgcaaaagatg

SEQ ID NO: 137050 - DNA, 103 bp, Artificial Sequence
  Synthetic Polynucleotide
taatacgactcactataggggagaggttctgctcaaagggcgcgcagtgcaacagaggagagcactgatggccctttgaaacctggcggcagcgcaaaagatg

SEQ ID NO: 137051 - DNA, 103 bp, Artificial Sequence
  Synthetic Polynucleotide
taatacgactcactatagggacacaccccggagaggttctgctcaaagggaacagaggagaccctttatgcagaacctcaacctggcggcagcgcaaaagatg

SEQ ID NO: 137052 - DNA, 103 bp, Artificial Sequence
  Synthetic Polynucleotide
taatacgactcactatagggagtcgccgggacacaccccggagaggttctaacagaggagaagaaccatgccggggtgtaacctggcggcagcgcaaaagatg

SEQ ID NO: 137053 - DNA, 103 bp, Artificial Sequence
  Synthetic Polynucleotide
taatacgactcactataggggaggctggatatttagaaaataaagtattcaacagaggagagaatacatgattttctaaaacctggcggcagcgcaaaagatg

SEQ ID NO: 137054 - DNA, 103 bp, Artificial Sequence
  Synthetic Polynucleotide
taatacgactcactataggggccttggcggagtcgccgggacacaccccgaacagaggagacggggtatgtcccggcgaaacctggcggcagcgcaaaagatg

SEQ ID NO: 137055 - DNA, 103 bp, Artificial Sequence
  Synthetic Polynucleotide
taatacgactcactatagggggcgcccgccgccttggcggagtcgccgggaacagaggagacccggcatgtccgccaagaacctggcggcagcgcaaaagatg

SEQ ID NO: 137056 - DNA, 103 bp, Artificial Sequence
  Synthetic Polynucleotide
taatacgactcactatagggtctgctccttggcgcccgccgccttggcggaacagaggagaccgccaatgcggcgggcgaacctggcggcagcgcaaaagatg

SEQ ID NO: 137057 - DNA, 103 bp, Artificial Sequence
  Synthetic Polynucleotide
taatacgactcactatagggtccgagtccctctgctccttggcgcccgccaacagaggagaggcgggatgcaaggagcaaacctggcggcagcgcaaaagatg

SEQ ID NO: 137058 - DNA, 103 bp, Artificial Sequence
  Synthetic Polynucleotide
taatacgactcactatagggggccgccaagtccgagtccctctgctccttaacagaggagaaaggagatgagggactcgaacctggcggcagcgcaaaagatg

SEQ ID NO: 137059 - DNA, 103 bp, Artificial Sequence
  Synthetic Polynucleotide
taatacgactcactatagggagttactctcggccgccaagtccgagtcccaacagaggagagggactatgacttggcggaacctggcggcagcgcaaaagatg

SEQ ID NO: 137060 - DNA, 103 bp, Artificial Sequence
  Synthetic Polynucleotide
taatacgactcactatagggtagatccggaagttactctcggccgccaagaacagaggagacttggcatgcgagagtaaaacctggcggcagcgcaaaagatg

SEQ ID NO: 137061 - DNA, 103 bp, Artificial Sequence
  Synthetic Polynucleotide
taatacgactcactatagggcatccaggggtagatccggaagttactctcaacagaggagagagagtatgttccggatcaacctggcggcagcgcaaaagatg

SEQ ID NO: 137062 - DNA, 103 bp, Artificial Sequence
  Synthetic Polynucleotide
taatacgactcactatagggctgagcttcgcatccaggggtagatccggaaacagaggagatccggaatgacccctggaaacctggcggcagcgcaaaagatg

SEQ ID NO: 137063 - DNA, 103 bp, Artificial Sequence
  Synthetic Polynucleotide
taatacgactcactatagggcggtcagttcctgagcttcgcatccaggggaacagaggagacccctgatggcgaagctcaacctggcggcagcgcaaaagatg

SEQ ID NO: 137064 - DNA, 103 bp, Artificial Sequence
  Synthetic Polynucleotide
taatacgactcactatagggaaccgaacttgaggctggatatttagaaaaaacagaggagattttctatgtatccagccaacctggcggcagcgcaaaagatg

SEQ ID NO: 137065 - DNA, 103 bp, Artificial Sequence
  Synthetic Polynucleotide
taatacgactcactataggggcctcgtttgcggtcagttcctgagcttcgaacagaggagacgaagcatgggaactgacaacctggcggcagcgcaaaagatg

SEQ ID NO: 137066 - DNA, 103 bp, Artificial Sequence
  Synthetic Polynucleotide
taatacgactcactatagggaggtctggcggcctcgtttgcggtcagttcaacagaggagagaactgatggcaaacgagaacctggcggcagcgcaaaagatg

SEQ ID NO: 137067 - DNA, 103 bp, Artificial Sequence
  Synthetic Polynucleotide
taatacgactcactatagggtagcgggtgtaggtctggcggcctcgtttgaacagaggagacaaacgatgccgccagacaacctggcggcagcgcaaaagatg

SEQ ID NO: 137068 - DNA, 103 bp, Artificial Sequence
  Synthetic Polynucleotide
taatacgactcactatagggcagggtctggtagcgggtgtaggtctggcgaacagaggagacgccagatgtacacccgcaacctggcggcagcgcaaaagatg

SEQ ID NO: 137069 - DNA, 103 bp, Artificial Sequence
  Synthetic Polynucleotide
taatacgactcactatagggtctccagctccagggtctggtagcgggtgtaacagaggagaacacccatgaccagacccaacctggcggcagcgcaaaagatg

SEQ ID NO: 137070 - DNA, 103 bp, Artificial Sequence
  Synthetic Polynucleotide
taatacgactcactatagggtgaaattctttctccagctccagggtctggaacagaggagaccagacatgggagctggaaacctggcggcagcgcaaaagatg

SEQ ID NO: 137071 - DNA, 103 bp, Artificial Sequence
  Synthetic Polynucleotide
taatacgactcactataggggcgattgtagtgaaattctttctccagctcaacagaggagagagctgatgaaagaatttaacctggcggcagcgcaaaagatg

SEQ ID NO: 137072 - DNA, 103 bp, Artificial Sequence
  Synthetic Polynucleotide
taatacgactcactataggggcgtcaggtagcgattgtagtgaaattcttaacagaggagaaagaatatgactacaatcaacctggcggcagcgcaaaagatg

SEQ ID NO: 137073 - DNA, 103 bp, Artificial Sequence
  Synthetic Polynucleotide
taatacgactcactatagggcgccgccgccgcgtcaggtagcgattgtagaacagaggagactacaaatgctacctgacaacctggcggcagcgcaaaagatg

SEQ ID NO: 137074 - DNA, 103 bp, Artificial Sequence
  Synthetic Polynucleotide
taatacgactcactataggggatctcgatgcgccgccgccgcgtcaggtaaacagaggagatacctgatgcggcggcggaacctggcggcagcgcaaaagatg

SEQ ID NO: 137075 - DNA, 103 bp, Artificial Sequence
  Synthetic Polynucleotide
taatacgactcactatagggcggtagcgaaaaccgaacttgaggctggataacagaggagaatccagatgcaagttcggaacctggcggcagcgcaaaagatg

SEQ ID NO: 137076 - DNA, 103 bp, Artificial Sequence
  Synthetic Polynucleotide
taatacgactcactataggggcgtgtgcgcgatctcgatgcgccgccgccaacagaggagaggcggcatggcatcgagaaacctggcggcagcgcaaaagatg

SEQ ID NO: 137077 - DNA, 103 bp, Artificial Sequence
  Synthetic Polynucleotide
taatacgactcactataggggtgaggcagagcgtgtgcgcgatctcgatgaacagaggagacatcgaatgcgcgcacacaacctggcggcagcgcaaaagatg

SEQ ID NO: 137078 - DNA, 103 bp, Artificial Sequence
  Synthetic Polynucleotide
taatacgactcactatagggctgtctttccgtgaggcagagcgtgtgcgcaacagaggagagcgcacatgctctgcctcaacctggcggcagcgcaaaagatg

SEQ ID NO: 137079 - DNA, 103 bp, Artificial Sequence
  Synthetic Polynucleotide
taatacgactcactatagggaaatcttgatctgtctttccgtgaggcagaaacagaggagatctgccatgcggaaagacaacctggcggcagcgcaaaagatg

SEQ ID NO: 137080 - DNA, 103 bp, Artificial Sequence
  Synthetic Polynucleotide
taatacgactcactatagggttctgaaaccaaatcttgatctgtctttccaacagaggagaggaaagatggatcaagataacctggcggcagcgcaaaagatg

SEQ ID NO: 137081 - DNA, 103 bp, Artificial Sequence
  Synthetic Polynucleotide
taatacgactcactatagggcatgcgccggttctgaaaccaaatcttgataacagaggagaatcaagatgtggtttcagaacctggcggcagcgcaaaagatg

SEQ ID NO: 137082 - DNA, 103 bp, Artificial Sequence
  Synthetic Polynucleotide
taatacgactcactatagggttttccacttcatgcgccggttctgaaaccaacagaggagaggtttcatgaccggcgcaaacctggcggcagcgcaaaagatg

SEQ ID NO: 137083 - DNA, 103 bp, Artificial Sequence
  Synthetic Polynucleotide
taatacgactcactatagggttgttctcctttttccacttcatgcgccggaacagaggagaccggcgatggaagtggaaaacctggcggcagcgcaaaagatg

SEQ ID NO: 137084 - DNA, 103 bp, Artificial Sequence
  Synthetic Polynucleotide
taatacgactcactataggggcccgcggtcttgttctcctttttccacttaacagaggagaaagtggatgaaggagaacaacctggcggcagcgcaaaagatg

SEQ ID NO: 137085 - DNA, 103 bp, Artificial Sequence
  Synthetic Polynucleotide
taatacgactcactatagggtggtccccgggcccgcggtcttgttctcctaacagaggagaaggagaatgagaccgcggaacctggcggcagcgcaaaagatg

SEQ ID NO: 137086 - DNA, 103 bp, Artificial Sequence
  Synthetic Polynucleotide
taatacgactcactataggggggaaggctccggtagcgaaaaccgaacttaacagaggagaaagttcatgtttcgctacaacctggcggcagcgcaaaagatg

SEQ ID NO: 137087 - DNA, 103 bp, Artificial Sequence
  Synthetic Polynucleotide
taatacgactcactatagggtcttggccggtggtccccgggcccgcggtcaacagaggagagaccgcatgcccggggacaacctggcggcagcgcaaaagatg

SEQ ID NO: 137088 - DNA, 103 bp, Artificial Sequence
  Synthetic Polynucleotide
taatacgactcactatagggttcagccctgtcttggccggtggtccccggaacagaggagaccggggatgaccggccaaaacctggcggcagcgcaaaagatg

SEQ ID NO: 137089 - DNA, 103 bp, Artificial Sequence
  Synthetic Polynucleotide
taatacgactcactatagggcctcctctgcttcagccctgtcttggccggaacagaggagaccggccatgacagggctgaacctggcggcagcgcaaaagatg

SEQ ID NO: 137090 - DNA, 103 bp, Artificial Sequence
  Synthetic Polynucleotide
taatacgactcactatagggtcttcctcttcctcctctgcttcagccctgaacagaggagacagggcatgagcagaggaaacctggcggcagcgcaaaagatg

SEQ ID NO: 137091 - DNA, 103 bp, Artificial Sequence
  Synthetic Polynucleotide
taatacgactcactatagggagtttgttctgggaaggctccggtagcgaaaacagaggagattcgctatgggagccttcaacctggcggcagcgcaaaagatg

SEQ ID NO: 137092 - DNA, 103 bp, Artificial Sequence
  Synthetic Polynucleotide
taatacgactcactatagggacgcacaagaagtttgttctgggaaggctcaacagaggagagagcctatgcagaacaaaaacctggcggcagcgcaaaagatg

SEQ ID NO: 137093 - DNA, 103 bp, Artificial Sequence
  Synthetic Polynucleotide
taatacgactcactatagggttggaagcaaacgcacaagaagtttgttctaacagaggagaagaacaatgttcttgtgcaacctggcggcagcgcaaaagatg

SEQ ID NO: 137094 - DNA, 103 bp, Artificial Sequence
  Synthetic Polynucleotide
taatacgactcactatagggatagctgctaagcgtcccagaaatggacataacagaggagaatgtccatgtctgggacgaacctggcggcagcgcaaaagatg

SEQ ID NO: 137095 - DNA, 103 bp, Artificial Sequence
  Synthetic Polynucleotide
taatacgactcactataggggcccggctgccgcgagctcgcgtactggccaacagaggagaggccagatggcgagctcgaacctggcggcagcgcaaaagatg

SEQ ID NO: 137096 - DNA, 103 bp, Artificial Sequence
  Synthetic Polynucleotide
taatacgactcactataggggctccgcgtggcccggctgccgcgagctcgaacagaggagacgagctatgggcagccggaacctggcggcagcgcaaaagatg

SEQ ID NO: 137097 - DNA, 103 bp, Artificial Sequence
  Synthetic Polynucleotide
taatacgactcactatagggaactccaggtgctccgcgtggcccggctgcaacagaggagagcagccatgccacgcggaaacctggcggcagcgcaaaagatg

SEQ ID NO: 137098 - DNA, 103 bp, Artificial Sequence
  Synthetic Polynucleotide
taatacgactcactataggggcacgaggggaactccaggtgctccgcgtgaacagaggagacacgcgatgcacctggagaacctggcggcagcgcaaaagatg

SEQ ID NO: 137099 - DNA, 103 bp, Artificial Sequence
  Synthetic Polynucleotide
taatacgactcactataggggctggaagctgcacgaggggaactccaggtaacagaggagaacctggatgtcccctcgtaacctggcggcagcgcaaaagatg

SEQ ID NO: 137100 - DNA, 103 bp, Artificial Sequence
  Synthetic Polynucleotide
taatacgactcactatagggggcgctttgggctggaagctgcacgaggggaacagaggagacccctcatgcagcttccaaacctggcggcagcgcaaaagatg

SEQ ID NO: 137101 - DNA, 103 bp, Artificial Sequence
  Synthetic Polynucleotide
taatacgactcactataggggccgaacaccggcgctttgggctggaagctaacagaggagaagcttcatgcccaaagcgaacctggcggcagcgcaaaagatg

SEQ ID NO: 137102 - DNA, 103 bp, Artificial Sequence
  Synthetic Polynucleotide
taatacgactcactatagggcccaggaggcgccgaacaccggcgctttggaacagaggagaccaaagatgcggtgttcgaacctggcggcagcgcaaaagatg

SEQ ID NO: 137103 - DNA, 103 bp, Artificial Sequence
  Synthetic Polynucleotide
taatacgactcactatagggctcagcggcgcccaggaggcgccgaacaccaacagaggagaggtgttatgcgcctcctgaacctggcggcagcgcaaaagatg

SEQ ID NO: 137104 - DNA, 103 bp, Artificial Sequence
  Synthetic Polynucleotide
taatacgactcactatagggcgcgtgcgggctcagcggcgcccaggaggcaacagaggagagcctccatggcgccgctgaacctggcggcagcgcaaaagatg

SEQ ID NO: 137105 - DNA, 103 bp, Artificial Sequence
  Synthetic Polynucleotide
taatacgactcactatagggagtcgacataatagctgctaagcgtcccagaacagaggagactgggaatgttagcagctaacctggcggcagcgcaaaagatg

SEQ ID NO: 137106 - DNA, 103 bp, Artificial Sequence
  Synthetic Polynucleotide
taatacgactcactatagggggctcccggacgcgtgcgggctcagcggcgaacagaggagacgccgcatggcccgcacgaacctggcggcagcgcaaaagatg

SEQ ID NO: 137107 - DNA, 103 bp, Artificial Sequence
  Synthetic Polynucleotide
taatacgactcactatagggacggacggcaggctcccggacgcgtgcgggaacagaggagacccgcaatggtccgggagaacctggcggcagcgcaaaagatg

SEQ ID NO: 137108 - DNA, 103 bp, Artificial Sequence
  Synthetic Polynucleotide
taatacgactcactatagggagggtggtagacggacggcaggctcccggaaacagaggagatccgggatgctgccgtccaacctggcggcagcgcaaaagatg

SEQ ID NO: 137109 - DNA, 103 bp, Artificial Sequence
  Synthetic Polynucleotide
taatacgactcactataggggctggatgtaagggtggtagacggacggcaaacagaggagatgccgtatgtctaccaccaacctggcggcagcgcaaaagatg

SEQ ID NO: 137110 - DNA, 103 bp, Artificial Sequence
  Synthetic Polynucleotide
taatacgactcactatagggacgccctggggctggatgtaagggtggtagaacagaggagactaccaatgttacatccaaacctggcggcagcgcaaaagatg

SEQ ID NO: 137111 - DNA, 103 bp, Artificial Sequence
  Synthetic Polynucleotide
taatacgactcactatagggggccggcgggacgccctggggctggatgtaaacagaggagatacatcatgccccagggcaacctggcggcagcgcaaaagatg

SEQ ID NO: 137112 - DNA, 103 bp, Artificial Sequence
  Synthetic Polynucleotide
taatacgactcactatagggacctgctctcggccggcgggacgccctgggaacagaggagacccaggatgtcccgccggaacctggcggcagcgcaaaagatg

SEQ ID NO: 137113 - DNA, 103 bp, Artificial Sequence
  Synthetic Polynucleotide
taatacgactcactataggggtgcggaggtacctgctctcggccggcgggaacagaggagacccgccatgcgagagcagaacctggcggcagcgcaaaagatg

SEQ ID NO: 137114 - DNA, 103 bp, Artificial Sequence
  Synthetic Polynucleotide
taatacgactcactatagggctccagccaggtgcggaggtacctgctctcaacagaggagagagagcatgtacctccgcaacctggcggcagcgcaaaagatg

SEQ ID NO: 137115 - DNA, 103 bp, Artificial Sequence
  Synthetic Polynucleotide
taatacgactcactataggggcggcgccggctccagccaggtgcggaggtaacagaggagaacctccatgcctggctggaacctggcggcagcgcaaaagatg

SEQ ID NO: 137116 - DNA, 103 bp, Artificial Sequence
  Synthetic Polynucleotide
taatacgactcactatagggcttatgatcgagtcgacataatagctgctaaacagaggagatagcagatgttatgtcgaaacctggcggcagcgcaaaagatg

SEQ ID NO: 137117 - DNA, 103 bp, Artificial Sequence
  Synthetic Polynucleotide
taatacgactcactataggggcttcgccgcgcggcgccggctccagccagaacagaggagactggctatggccggcgccaacctggcggcagcgcaaaagatg

SEQ ID NO: 137118 - DNA, 103 bp, Artificial Sequence
  Synthetic Polynucleotide
taatacgactcactatagggccccggggccgcttcgccgcgcggcgccggaacagaggagaccggcgatgcgcggcgaaaacctggcggcagcgcaaaagatg

SEQ ID NO: 137119 - DNA, 103 bp, Artificial Sequence
  Synthetic Polynucleotide
taatacgactcactatagggcctggccctgccccggggccgcttcgccgcaacagaggagagcggcgatgcggccccggaacctggcggcagcgcaaaagatg

SEQ ID NO: 137120 - DNA, 103 bp, Artificial Sequence
  Synthetic Polynucleotide
taatacgactcactatagggttcaccgccgcctggccctgccccggggccaacagaggagaggccccatggcagggccaaacctggcggcagcgcaaaagatg

SEQ ID NO: 137121 - DNA, 103 bp, Artificial Sequence
  Synthetic Polynucleotide
taatacgactcactatagggcggctccgccttcaccgccgcctggccctgaacagaggagacagggcatggcggcggtgaacctggcggcagcgcaaaagatg

SEQ ID NO: 137122 - DNA, 103 bp, Artificial Sequence
  Synthetic Polynucleotide
taatacgactcactatagggcgcccagcagcggctccgccttcaccgccgaacagaggagacggcggatgaggcggagcaacctggcggcagcgcaaaagatg

SEQ ID NO: 137123 - DNA, 103 bp, Artificial Sequence
  Synthetic Polynucleotide
taatacgactcactatagggtccccaggcgcgcccagcagcggctccgccaacagaggagaggcggaatggctgctgggaacctggcggcagcgcaaaagatg

SEQ ID NO: 137124 - DNA, 103 bp, Artificial Sequence
  Synthetic Polynucleotide
taatacgactcactatagggtttgagcagctccccaggcgcgcccagcagaacagaggagactgctgatggcgcctgggaacctggcggcagcgcaaaagatg

SEQ ID NO: 137125 - DNA, 103 bp, Artificial Sequence
  Synthetic Polynucleotide
taatacgactcactataggggcgtgccctgtttgagcagctccccaggcgaacagaggagacgcctgatgagctgctcaaacctggcggcagcgcaaaagatg

SEQ ID NO: 137126 - DNA, 103 bp, Artificial Sequence
  Synthetic Polynucleotide
taatacgactcactatagggctgtactcgggcgtgccctgtttgagcagcaacagaggagagctgctatgacagggcacaacctggcggcagcgcaaaagatg

SEQ ID NO: 137127 - DNA, 103 bp, Artificial Sequence
  Synthetic Polynucleotide
taatacgactcactatagggactctcgtgacttatgatcgagtcgacataaacagaggagatatgtcatgtcgatcataaacctggcggcagcgcaaaagatg

SEQ ID NO: 137128 - DNA, 103 bp, Artificial Sequence
  Synthetic Polynucleotide
taatacgactcactatagggagtttccaaactgtactcgggcgtgccctgaacagaggagacagggcatgcccgagtacaacctggcggcagcgcaaaagatg

SEQ ID NO: 137129 - DNA, 103 bp, Artificial Sequence
  Synthetic Polynucleotide
taatacgactcactatagggtgcccgccgaagtttccaaactgtactcggaacagaggagaccgagtatggtttggaaaaacctggcggcagcgcaaaagatg

SEQ ID NO: 137130 - DNA, 103 bp, Artificial Sequence
  Synthetic Polynucleotide
taatacgactcactatagggacggcctccctgcccgccgaagtttccaaaaacagaggagatttggaatgttcggcgggaacctggcggcagcgcaaaagatg

SEQ ID NO: 137131 - DNA, 103 bp, Artificial Sequence
  Synthetic Polynucleotide
taatacgactcactatagggattagacagcacggcctccctgcccgccgaaacagaggagatcggcgatgagggaggccaacctggcggcagcgcaaaagatg

SEQ ID NO: 137132 - DNA, 103 bp, Artificial Sequence
  Synthetic Polynucleotide
taatacgactcactatagggcgggtctttgattagacagcacggcctcccaacagaggagagggaggatgtgctgtctaaacctggcggcagcgcaaaagatg

SEQ ID NO: 137133 - DNA, 103 bp, Artificial Sequence
  Synthetic Polynucleotide
taatacgactcactatagggtccccgtagccgggtctttgattagacagcaacagaggagagctgtcatgtcaaagaccaacctggcggcagcgcaaaagatg

SEQ ID NO: 137134 - DNA, 103 bp, Artificial Sequence
  Synthetic Polynucleotide
taatacgactcactatagggaattttattgtccccgtagccgggtctttgaacagaggagacaaagaatgggctacgggaacctggcggcagcgcaaaagatg

SEQ ID NO: 137135 - DNA, 103 bp, Artificial Sequence
  Synthetic Polynucleotide
taatacgactcactatagggttccttcgcaaattttattgtccccgtagcaacagaggagagctacgatgacaataaaaaacctggcggcagcgcaaaagatg

SEQ ID NO: 137136 - DNA, 103 bp, Artificial Sequence
  Synthetic Polynucleotide
taatacgactcactatagggttgtcctcgcttccttcgcaaattttattgaacagaggagacaataaatgttgcgaaggaacctggcggcagcgcaaaagatg

SEQ ID NO: 137137 - DNA, 103 bp, Artificial Sequence
  Synthetic Polynucleotide
taatacgactcactatagggcggcctctctttgtcctcgcttccttcgcaaacagaggagatgcgaaatgagcgaggacaacctggcggcagcgcaaaagatg

SEQ ID NO: 137138 - DNA, 103 bp, Artificial Sequence
  Synthetic Polynucleotide
taatacgactcactataggggcgcgtcctcactctcgtgacttatgatcgaacagaggagacgatcaatggtcacgagaaacctggcggcagcgcaaaagatg

SEQ ID NO: 137139 - DNA, 103 bp, Artificial Sequence
  Synthetic Polynucleotide
taatacgactcactatagggtggtttgatccggcctctctttgtcctcgcaacagaggagagcgaggatgaagagaggcaacctggcggcagcgcaaaagatg

SEQ ID NO: 137140 - DNA, 103 bp, Artificial Sequence
  Synthetic Polynucleotide
taatacgactcactataggggcggaggggttggtttgatccggcctctctaacagaggagaagagagatgggatcaaacaacctggcggcagcgcaaaagatg

SEQ ID NO: 137141 - DNA, 103 bp, Artificial Sequence
  Synthetic Polynucleotide
taatacgactcactatagggcagccagttggcggaggggttggtttgatcaacagaggagagatcaaatgaacccctccaacctggcggcagcgcaaaagatg

SEQ ID NO: 137142 - DNA, 103 bp, Artificial Sequence
  Synthetic Polynucleotide
taatacgactcactatagggagcgagcgtgcagccagttggcggaggggtaacagaggagaacccctatgccaactggcaacctggcggcagcgcaaaagatg

SEQ ID NO: 137143 - DNA, 103 bp, Artificial Sequence
  Synthetic Polynucleotide
taatacgactcactatagggttccgggaagagcgagcgtgcagccagttgaacagaggagacaactgatggcacgctcgaacctggcggcagcgcaaaagatg

SEQ ID NO: 137144 - DNA, 103 bp, Artificial Sequence
  Synthetic Polynucleotide
taatacgactcactatagggacagcgctttttccgggaagagcgagcgtgaacagaggagacacgctatgtcttcccggaacctggcggcagcgcaaaagatg

SEQ ID NO: 137145 - DNA, 103 bp, Artificial Sequence
  Synthetic Polynucleotide
taatacgactcactatagggtggtgtagggacagcgctttttccgggaagaacagaggagacttcccatgaaaagcgctaacctggcggcagcgcaaaagatg

SEQ ID NO: 137146 - DNA, 103 bp, Artificial Sequence
  Synthetic Polynucleotide
taatacgactcactataggggtctggtatttggtgtagggacagcgctttaacagaggagaaaagcgatgtccctacacaacctggcggcagcgcaaaagatg

SEQ ID NO: 137147 - DNA, 103 bp, Artificial Sequence
  Synthetic Polynucleotide
taatacgactcactatagggtagctccagcgtctggtatttggtgtagggaacagaggagaccctacatgaaataccagaacctggcggcagcgcaaaagatg

SEQ ID NO: 137148 - DNA, 103 bp, Artificial Sequence
  Synthetic Polynucleotide
taatacgactcactatagggactccttctctagctccagcgtctggtattaacagaggagaaataccatgcgctggagcaacctggcggcagcgcaaaagatg

SEQ ID NO: 137149 - DNA, 103 bp, Artificial Sequence
  Synthetic Polynucleotide
taatacgactcactatagggttggctggaggcgcgtcctcactctcgtgaaacagaggagatcacgaatgtgaggacgcaacctggcggcagcgcaaaagatg

SEQ ID NO: 137150 - DNA, 103 bp, Artificial Sequence
  Synthetic Polynucleotide
taatacgactcactatagggttgaacagaaactccttctctagctccagcaacagaggagagctggaatgagagaaggaaacctggcggcagcgcaaaagatg

SEQ ID NO: 137151 - DNA, 103 bp, Artificial Sequence
  Synthetic Polynucleotide
taatacgactcactataggggaggtacatattgaacagaaactccttctcaacagaggagagagaagatgtttctgttcaacctggcggcagcgcaaaagatg

SEQ ID NO: 137152 - DNA, 103 bp, Artificial Sequence
  Synthetic Polynucleotide
taatacgactcactatagggggtccctggtgaggtacatattgaacagaaaacagaggagattctgtatgatatgtaccaacctggcggcagcgcaaaagatg

SEQ ID NO: 137153 - DNA, 103 bp, Artificial Sequence
  Synthetic Polynucleotide
taatacgactcactatagggtcgtgcctacggtccctggtgaggtacataaacagaggagatatgtaatgcaccagggaaacctggcggcagcgcaaaagatg

SEQ ID NO: 137154 - DNA, 103 bp, Artificial Sequence
  Synthetic Polynucleotide
taatacgactcactatagggtctggccacttcgtgcctacggtccctggtaacagaggagaaccaggatgcgtaggcacaacctggcggcagcgcaaaagatg

SEQ ID NO: 137155 - DNA, 103 bp, Artificial Sequence
  Synthetic Polynucleotide
taatacgactcactataggggattgaggagtctggccacttcgtgcctacaacagaggagagtaggcatgaagtggccaaacctggcggcagcgcaaaagatg

SEQ ID NO: 137156 - DNA, 103 bp, Artificial Sequence
  Synthetic Polynucleotide
taatacgactcactatagggctctcactcagattgaggagtctggccactaacagaggagaagtggcatgactcctcaaaacctggcggcagcgcaaaagatg

SEQ ID NO: 137157 - DNA, 103 bp, Artificial Sequence
  Synthetic Polynucleotide
taatacgactcactatagggtttgacttgtctctcactcagattgaggagaacagaggagactcctcatgctgagtgagaacctggcggcagcgcaaaagatg

SEQ ID NO: 137158 - DNA, 103 bp, Artificial Sequence
  Synthetic Polynucleotide
taatacgactcactataggggaaaccagattttgacttgtctctcactcaaacagaggagatgagtgatggacaagtcaaacctggcggcagcgcaaaagatg

SEQ ID NO: 137159 - DNA, 103 bp, Artificial Sequence
  Synthetic Polynucleotide
taatacgactcactatagggcgccggttctgaaaccagattttgacttgtaacagaggagaacaagtatgaatctggttaacctggcggcagcgcaaaagatg

SEQ ID NO: 137160 - DNA, 103 bp, Artificial Sequence
  Synthetic Polynucleotide
taatacgactcactatagggagaaggaaacttggctggaggcgcgtcctcaacagaggagagaggacatgcctccagccaacctggcggcagcgcaaaagatg

SEQ ID NO: 137161 - DNA, 103 bp, Artificial Sequence
  Synthetic Polynucleotide
taatacgactcactatagggcattttcatccgccggttctgaaaccagataacagaggagaatctggatgcagaaccggaacctggcggcagcgcaaaagatg

SEQ ID NO: 137162 - DNA, 103 bp, Artificial Sequence
  Synthetic Polynucleotide
taatacgactcactatagggtcattttcttcattttcatccgccggttctaacagaggagaagaaccatgggatgaaaaaacctggcggcagcgcaaaagatg

SEQ ID NO: 137163 - DNA, 103 bp, Artificial Sequence
  Synthetic Polynucleotide
taatacgactcactatagggtgctccttattcattttcttcattttcatcaacagaggagagatgaaatggaagaaaataacctggcggcagcgcaaaagatg

SEQ ID NO: 137164 - DNA, 103 bp, Artificial Sequence
  Synthetic Polynucleotide
taatacgactcactatagggctctttgccctgctccttattcattttcttaacagaggagaaagaaaatgaataaggagaacctggcggcagcgcaaaagatg

SEQ ID NO: 137165 - DNA, 103 bp, Artificial Sequence
  Synthetic Polynucleotide
taatacgactcactatagggcgtactggccagaaggaaacttggctggagaacagaggagactccagatgagtttccttaacctggcggcagcgcaaaagatg

SEQ ID NO: 137166 - DNA, 103 bp, Artificial Sequence
  Synthetic Polynucleotide
taatacgactcactatagggcgcgagctcgcgtactggccagaaggaaacaacagaggagagtttccatgtggccagtaaacctggcggcagcgcaaaagatg

SEQ ID NO: 137167 - DNA, 103 bp, Artificial Sequence
  Synthetic Polynucleotide
taatacgactcactataggggttcggagttacattgcgagggcatgtcataacagaggagaatgacaatgcctcgcaataacctggcggcagcgcaaaagatg

SEQ ID NO: 137168 - DNA, 103 bp, Artificial Sequence
  Synthetic Polynucleotide
taatacgactcactatagggattgaagtcactcccagactgcatatacataacagaggagaatgtatatgcagtctgggaacctggcggcagcgcaaaagatg

SEQ ID NO: 137169 - DNA, 103 bp, Artificial Sequence
  Synthetic Polynucleotide
taatacgactcactatagggattaaaattggaggtcagttcccggatccgaacagaggagacggatcatggaactgaccaacctggcggcagcgcaaaagatg

SEQ ID NO: 137170 - DNA, 103 bp, Artificial Sequence
  Synthetic Polynucleotide
taatacgactcactatagggtcaccccgcaattgaagtcactcccagactaacagaggagaagtctgatggtgacttcaaacctggcggcagcgcaaaagatg

SEQ ID NO: 137171 - DNA, 103 bp, Artificial Sequence
  Synthetic Polynucleotide
taatacgactcactatagggcagcccctcatcaccccgcaattgaagtcaaacagaggagatgacttatgttgcggggtaacctggcggcagcgcaaaagatg

SEQ ID NO: 137172 - DNA, 103 bp, Artificial Sequence
  Synthetic Polynucleotide
taatacgactcactatagggcgcgagcccgcagcccctcatcaccccgcaaacagaggagatgcgggatgatgaggggcaacctggcggcagcgcaaaagatg

SEQ ID NO: 137173 - DNA, 103 bp, Artificial Sequence
  Synthetic Polynucleotide
taatacgactcactatagggagagcgagggcgcgagcccgcagcccctcaaacagaggagatgagggatggcgggctcgaacctggcggcagcgcaaaagatg

SEQ ID NO: 137174 - DNA, 103 bp, Artificial Sequence
  Synthetic Polynucleotide
taatacgactcactatagggtccctcttggagagcgagggcgcgagcccgaacagaggagacgggctatggccctcgctaacctggcggcagcgcaaaagatg

SEQ ID NO: 137175 - DNA, 103 bp, Artificial Sequence
  Synthetic Polynucleotide
taatacgactcactataggggctgccctcgtccctcttggagagcgagggaacagaggagaccctcgatgtccaagaggaacctggcggcagcgcaaaagatg

SEQ ID NO: 137176 - DNA, 103 bp, Artificial Sequence
  Synthetic Polynucleotide
taatacgactcactatagggggctggggctgctgccctcgtccctcttggaacagaggagaccaagaatgacgagggcaaacctggcggcagcgcaaaagatg

SEQ ID NO: 137177 - DNA, 103 bp, Artificial Sequence
  Synthetic Polynucleotide
taatacgactcactatagggttgagggcgaggctggggctgctgccctcgaacagaggagacgagggatgcagccccagaacctggcggcagcgcaaaagatg

SEQ ID NO: 137178 - DNA, 103 bp, Artificial Sequence
  Synthetic Polynucleotide
taatacgactcactatagggcggataggtgttgagggcgaggctggggctaacagaggagaagccccatgctcgccctcaacctggcggcagcgcaaaagatg

SEQ ID NO: 137179 - DNA, 103 bp, Artificial Sequence
  Synthetic Polynucleotide
taatacgactcactatagggccgcgtacgagttcggagttacattgcgagaacagaggagactcgcaatgtaactccgaaacctggcggcagcgcaaaagatg

SEQ ID NO: 137180 - DNA, 103 bp, Artificial Sequence
  Synthetic Polynucleotide
taatacgactcactatagggagaggtaggacggataggtgttgagggcgaaacagaggagatcgcccatgacacctatcaacctggcggcagcgcaaaagatg

SEQ ID NO: 137181 - DNA, 103 bp, Artificial Sequence
  Synthetic Polynucleotide
taatacgactcactatagggtccagctgcgagaggtaggacggataggtgaacagaggagacacctaatggtcctacctaacctggcggcagcgcaaaagatg

SEQ ID NO: 137182 - DNA, 103 bp, Artificial Sequence
  Synthetic Polynucleotide
taatacgactcactataggggccccaggagtccagctgcgagaggtaggaaacagaggagatcctacatgtcgcagctgaacctggcggcagcgcaaaagatg

SEQ ID NO: 137183 - DNA, 103 bp, Artificial Sequence
  Synthetic Polynucleotide
taatacgactcactatagggctttggggtcgccccaggagtccagctgcgaacagaggagacgcagcatgactcctgggaacctggcggcagcgcaaaagatg

SEQ ID NO: 137184 - DNA, 103 bp, Artificial Sequence
  Synthetic Polynucleotide
taatacgactcactatagggcgataggcggctttggggtcgccccaggagaacagaggagactcctgatgcgaccccaaaacctggcggcagcgcaaaagatg

SEQ ID NO: 137185 - DNA, 103 bp, Artificial Sequence
  Synthetic Polynucleotide
taatacgactcactatagggttgttccaggcgataggcggctttggggtcaacagaggagagaccccatggccgcctataacctggcggcagcgcaaaagatg

SEQ ID NO: 137186 - DNA, 103 bp, Artificial Sequence
  Synthetic Polynucleotide
taatacgactcactatagggtgccaacaggttgttccaggcgataggcggaacagaggagaccgcctatggcctggaacaacctggcggcagcgcaaaagatg

SEQ ID NO: 137187 - DNA, 103 bp, Artificial Sequence
  Synthetic Polynucleotide
taatacgactcactataggggacagcggcctgccaacaggttgttccaggaacagaggagacctggaatgacctgttggaacctggcggcagcgcaaaagatg

SEQ ID NO: 137188 - DNA, 103 bp, Artificial Sequence
  Synthetic Polynucleotide
taatacgactcactatagggggagcaggaggacagcggcctgccaacaggaacagaggagacctgttatgaggccgctgaacctggcggcagcgcaaaagatg

SEQ ID NO: 137189 - DNA, 103 bp, Artificial Sequence
  Synthetic Polynucleotide
taatacgactcactatagggtaggtgggtaggagcaggaggacagcggccaacagaggagaggccgcatgcctcctgctaacctggcggcagcgcaaaagatg

SEQ ID NO: 137190 - DNA, 103 bp, Artificial Sequence
  Synthetic Polynucleotide
taatacgactcactataggggccaagggctccgcgtacgagttcggagttaacagaggagaaactccatgctcgtacgcaacctggcggcagcgcaaaagatg

SEQ ID NO: 137191 - DNA, 103 bp, Artificial Sequence
  Synthetic Polynucleotide
taatacgactcactatagggtccttgacactaggtgggtaggagcaggagaacagaggagactcctgatgctacccaccaacctggcggcagcgcaaaagatg

SEQ ID NO: 137192 - DNA, 103 bp, Artificial Sequence
  Synthetic Polynucleotide
taatacgactcactataggggacattctcctccttgacactaggtgggtaaacagaggagatacccaatgagtgtcaagaacctggcggcagcgcaaaagatg

SEQ ID NO: 137193 - DNA, 103 bp, Artificial Sequence
  Synthetic Polynucleotide
taatacgactcactatagggacatgcagcagacattctcctccttgacacaacagaggagagtgtcaatgaggagaatgaacctggcggcagcgcaaaagatg

SEQ ID NO: 137194 - DNA, 103 bp, Artificial Sequence
  Synthetic Polynucleotide
taatacgactcactatagggtctgcgctgtacatgcagcagacattctccaacagaggagaggagaaatgctgctgcataacctggcggcagcgcaaaagatg

SEQ ID NO: 137195 - DNA, 103 bp, Artificial Sequence
  Synthetic Polynucleotide
taatacgactcactatagggcgcccgcttctctgcgctgtacatgcagcaaacagaggagatgctgcatgtacagcgcaaacctggcggcagcgcaaaagatg

SEQ ID NO: 137196 - DNA, 103 bp, Artificial Sequence
  Synthetic Polynucleotide
taatacgactcactatagggggccacttttcgcccgcttctctgcgctgtaacagaggagaacagcgatgagaagcgggaacctggcggcagcgcaaaagatg

SEQ ID NO: 137197 - DNA, 103 bp, Artificial Sequence
  Synthetic Polynucleotide
taatacgactcactataggggctgcctcggggccacttttcgcccgcttcaacagaggagagaagcgatggaaaagtggaacctggcggcagcgcaaaagatg

SEQ ID NO: 137198 - DNA, 103 bp, Artificial Sequence
  Synthetic Polynucleotide
taatacgactcactatagggggagtagagagctgcctcggggccacttttaacagaggagaaaaagtatgcccgaggcaaacctggcggcagcgcaaaagatg

SEQ ID NO: 137199 - DNA, 103 bp, Artificial Sequence
  Synthetic Polynucleotide
taatacgactcactataggggcaaggggtgggagtagagagctgcctcggaacagaggagaccgaggatgctctctactaacctggcggcagcgcaaaagatg

SEQ ID NO: 137200 - DNA, 103 bp, Artificial Sequence
  Synthetic Polynucleotide
taatacgactcactatagggcaggactccggcaaggggtgggagtagagaaacagaggagatctctaatgccaccccttaacctggcggcagcgcaaaagatg

SEQ ID NO: 137201 - DNA, 103 bp, Artificial Sequence
  Synthetic Polynucleotide
taatacgactcactataggggccgggcgcagccaagggctccgcgtacgaaacagaggagatcgtacatggagcccttgaacctggcggcagcgcaaaagatg

SEQ ID NO: 137202 - DNA, 103 bp, Artificial Sequence
  Synthetic Polynucleotide
taatacgactcactatagggctccccaaggcaggactccggcaaggggtgaacagaggagacaccccatgccggagtccaacctggcggcagcgcaaaagatg

SEQ ID NO: 137203 - DNA, 103 bp, Artificial Sequence
  Synthetic Polynucleotide
taatacgactcactataggggtacctcgtgctccccaaggcaggactccgaacagaggagacggagtatggccttggggaacctggcggcagcgcaaaagatg

SEQ ID NO: 137204 - DNA, 103 bp, Artificial Sequence
  Synthetic Polynucleotide
taatacgactcactatagggctgggcacgggtacctcgtgctccccaaggaacagaggagaccttggatggcacgaggtaacctggcggcagcgcaaaagatg

SEQ ID NO: 137205 - DNA, 103 bp, Artificial Sequence
  Synthetic Polynucleotide
taatacgactcactataggggcggtagtagctgggcacgggtacctcgtgaacagaggagacacgagatgcccgtgcccaacctggcggcagcgcaaaagatg

SEQ ID NO: 137206 - DNA, 103 bp, Artificial Sequence
  Synthetic Polynucleotide
taatacgactcactatagggtcgggctggcgcggtagtagctgggcacggaacagaggagaccgtgcatggctactaccaacctggcggcagcgcaaaagatg

SEQ ID NO: 137207 - DNA, 103 bp, Artificial Sequence
  Synthetic Polynucleotide
taatacgactcactataggggcggagtagctcgggctggcgcggtagtagaacagaggagactactaatgcgccagcccaacctggcggcagcgcaaaagatg

SEQ ID NO: 137208 - DNA, 103 bp, Artificial Sequence
  Synthetic Polynucleotide
taatacgactcactatagggcttgtccagcgcggagtagctcgggctggcaacagaggagagccagcatgagctactccaacctggcggcagcgcaaaagatg

SEQ ID NO: 137209 - DNA, 103 bp, Artificial Sequence
  Synthetic Polynucleotide
taatacgactcactatagggagtggggcgtcttgtccagcgcggagtagcaacagaggagagctactatgcgctggacaaacctggcggcagcgcaaaagatg

SEQ ID NO: 137210 - DNA, 103 bp, Artificial Sequence
  Synthetic Polynucleotide
taatacgactcactataggggccccagaacagtggggcgtcttgtccagcaacagaggagagctggaatggacgccccaaacctggcggcagcgcaaaagatg

SEQ ID NO: 137211 - DNA, 103 bp, Artificial Sequence
  Synthetic Polynucleotide
taatacgactcactataggggaagtcgttggccccagaacagtggggcgtaacagaggagaacgcccatgtgttctgggaacctggcggcagcgcaaaagatg

SEQ ID NO: 137212 - DNA, 103 bp, Artificial Sequence
  Synthetic Polynucleotide
taatacgactcactataggggctctcctccgccgggcgcagccaagggctaacagaggagaagccctatgctgcgcccgaacctggcggcagcgcaaaagatg

SEQ ID NO: 137213 - DNA, 103 bp, Artificial Sequence
  Synthetic Polynucleotide
taatacgactcactatagggaaggggcttcgaagtcgttggccccagaacaacagaggagagttctgatgccaacgactaacctggcggcagcgcaaaagatg

SEQ ID NO: 137214 - DNA, 103 bp, Artificial Sequence
  Synthetic Polynucleotide
taatacgactcactatagggcgctgctcgaaaggggcttcgaagtcgttgaacagaggagacaacgaatgcgaagccccaacctggcggcagcgcaaaagatg

SEQ ID NO: 137215 - DNA, 103 bp, Artificial Sequence
  Synthetic Polynucleotide
taatacgactcactataggggagactggcccgctgctcgaaaggggcttcaacagaggagagaagccatgttcgagcagaacctggcggcagcgcaaaagatg

SEQ ID NO: 137216 - DNA, 103 bp, Artificial Sequence
  Synthetic Polynucleotide
taatacgactcactatagggcgcgcgggttgagactggcccgctgctcgaaacagaggagatcgagcatggggccagtcaacctggcggcagcgcaaaagatg

SEQ ID NO: 137217 - DNA, 103 bp, Artificial Sequence
  Synthetic Polynucleotide
taatacgactcactatagggagatgttcggcgcgcgggttgagactggccaacagaggagaggccagatgcaacccgcgaacctggcggcagcgcaaaagatg

SEQ ID NO: 137218 - DNA, 103 bp, Artificial Sequence
  Synthetic Polynucleotide
taatacgactcactatagggaggcgattccagatgttcggcgcgcgggttaacagaggagaaacccgatggccgaacataacctggcggcagcgcaaaagatg

SEQ ID NO: 137219 - DNA, 103 bp, Artificial Sequence
  Synthetic Polynucleotide
taatacgactcactatagggcccccagctgaggcgattccagatgttcggaacagaggagaccgaacatgtggaatcgcaacctggcggcagcgcaaaagatg

SEQ ID NO: 137220 - DNA, 103 bp, Artificial Sequence
  Synthetic Polynucleotide
taatacgactcactatagggctcactttgccccccagctgaggcgattccaacagaggagaggaatcatgtcagctgggaacctggcggcagcgcaaaagatg

SEQ ID NO: 137221 - DNA, 103 bp, Artificial Sequence
  Synthetic Polynucleotide
taatacgactcactatagggctcagggaaactcactttgccccccagctgaacagaggagacagctgatgggcaaagtgaacctggcggcagcgcaaaagatg

SEQ ID NO: 137222 - DNA, 103 bp, Artificial Sequence
  Synthetic Polynucleotide
taatacgactcactatagggacttgggggtctcagggaaactcactttgcaacagaggagagcaaagatggtttccctgaacctggcggcagcgcaaaagatg

SEQ ID NO: 137223 - DNA, 103 bp, Artificial Sequence
  Synthetic Polynucleotide
taatacgactcactatagggcggctatagcgctctcctccgccgggcgcaaacagaggagatgcgccatgcggaggagaaacctggcggcagcgcaaaagatg

SEQ ID NO: 137224 - DNA, 103 bp, Artificial Sequence
  Synthetic Polynucleotide
taatacgactcactatagggtggctgtcggacttgggggtctcagggaaaaacagaggagatttcccatggacccccaaaacctggcggcagcgcaaaagatg

SEQ ID NO: 137225 - DNA, 103 bp, Artificial Sequence
  Synthetic Polynucleotide
taatacgactcactataggggctgggggtctggctgtcggacttgggggtaacagaggagaacccccatgtccgacagcaacctggcggcagcgcaaaagatg

SEQ ID NO: 137226 - DNA, 103 bp, Artificial Sequence
  Synthetic Polynucleotide
taatacgactcactatagggtttcattggggctgggggtctggctgtcggaacagaggagaccgacaatgagacccccaaacctggcggcagcgcaaaagatg

SEQ ID NO: 137227 - DNA, 103 bp, Artificial Sequence
  Synthetic Polynucleotide
taatacgactcactatagggtccgtcttgatttcattggggctgggggtcaacagaggagagaccccatgccccaatgaaacctggcggcagcgcaaaagatg

SEQ ID NO: 137228 - DNA, 103 bp, Artificial Sequence
  Synthetic Polynucleotide
taatacgactcactatagggcaggctctgctccgtcttgatttcattgggaacagaggagacccaatatgatcaagacgaacctggcggcagcgcaaaagatg

SEQ ID NO: 137229 - DNA, 103 bp, Artificial Sequence
  Synthetic Polynucleotide
taatacgactcactatagggtagggcccgccaggctctgctccgtcttgaaacagaggagatcaagaatgagcagagccaacctggcggcagcgcaaaagatg

SEQ ID NO: 137230 - DNA, 103 bp, Artificial Sequence
  Synthetic Polynucleotide
taatacgactcactataggggggctccctttagggcccgccaggctctgcaacagaggagagcagagatgggcgggcccaacctggcggcagcgcaaaagatg

SEQ ID NO: 137231 - DNA, 103 bp, Artificial Sequence
  Synthetic Polynucleotide
taatacgactcactataggggctctccgaggggctccctttagggcccgcaacagaggagagcgggcatgaaagggagcaacctggcggcagcgcaaaagatg

SEQ ID NO: 137232 - DNA, 103 bp, Artificial Sequence
  Synthetic Polynucleotide
taatacgactcactatagggtctccttttcgctctccgaggggctcccttaacagaggagaaagggaatgcctcggagaaacctggcggcagcgcaaaagatg

SEQ ID NO: 137233 - DNA, 103 bp, Artificial Sequence
  Synthetic Polynucleotide
taatacgactcactataggggctttggccctctccttttcgctctccgagaacagaggagactcggaatgcgaaaaggaaacctggcggcagcgcaaaagatg

SEQ ID NO: 137234 - DNA, 103 bp, Artificial Sequence
  Synthetic Polynucleotide
taatacgactcactataggggcctgcgctccggctatagcgctctcctccaacagaggagaggaggaatgcgctatagcaacctggcggcagcgcaaaagatg

SEQ ID NO: 137235 - DNA, 103 bp, Artificial Sequence
  Synthetic Polynucleotide
taatacgactcactatagggggagtcggcagctttggccctctccttttcaacagaggagagaaaagatgagggccaaaaacctggcggcagcgcaaaagatg

SEQ ID NO: 137236 - DNA, 103 bp, Artificial Sequence
  Synthetic Polynucleotide
taatacgactcactatagggtgtctgggctggagtcggcagctttggcccaacagaggagagggccaatgctgccgactaacctggcggcagcgcaaaagatg

SEQ ID NO: 137237 - DNA, 103 bp, Artificial Sequence
  Synthetic Polynucleotide
taatacgactcactatagggttatccgaggtgtctgggctggagtcggcaaacagaggagatgccgaatgcagcccagaaacctggcggcagcgcaaaagatg

SEQ ID NO: 137238 - DNA, 103 bp, Artificial Sequence
  Synthetic Polynucleotide
taatacgactcactatagggtttcgcttcgttatccgaggtgtctgggctaacagaggagaagcccaatgacctcggataacctggcggcagcgcaaaagatg

SEQ ID NO: 137239 - DNA, 103 bp, Artificial Sequence
  Synthetic Polynucleotide
taatacgactcactatagggttatctcctctttcgcttcgttatccgaggaacagaggagacctcggatgacgaagcgaaacctggcggcagcgcaaaagatg

SEQ ID NO: 137240 - DNA, 103 bp, Artificial Sequence
  Synthetic Polynucleotide
taatacgactcactatagggttttctgcctttatctcctctttcgcttcgaacagaggagacgaagcatgagaggagataacctggcggcagcgcaaaagatg

SEQ ID NO: 137241 - DNA, 103 bp, Artificial Sequence
  Synthetic Polynucleotide
taatacgactcactatagggtcctgtggtgttttctgcctttatctcctcaacagaggagagaggagatgaaggcagaaaacctggcggcagcgcaaaagatg

SEQ ID NO: 137242 - DNA, 103 bp, Artificial Sequence
  Synthetic Polynucleotide
taatacgactcactatagggtcagccaatttcctgtggtgttttctgcctaacagaggagaaggcagatgacaccacagaacctggcggcagcgcaaaagatg

SEQ ID NO: 137243 - DNA, 103 bp, Artificial Sequence
  Synthetic Polynucleotide
taatacgactcactatagggctctttgctgtcagccaatttcctgtggtgaacagaggagacaccacatgaaattggctaacctggcggcagcgcaaaagatg

SEQ ID NO: 137244 - DNA, 103 bp, Artificial Sequence
  Synthetic Polynucleotide
taatacgactcactatagggcttccttccgctctttgctgtcagccaattaacagaggagaaattggatgacagcaaagaacctggcggcagcgcaaaagatg

SEQ ID NO: 137245 - DNA, 103 bp, Artificial Sequence
  Synthetic Polynucleotide
taatacgactcactataggggcatatacatgcctgcgctccggctatagcaacagaggagagctataatgggagcgcagaacctggcggcagcgcaaaagatg

SEQ ID NO: 137246 - DNA, 103 bp, Artificial Sequence
  Synthetic Polynucleotide
taatacgactcactatagggggcacctcttcttccttccgctctttgctgaacagaggagacagcaaatggcggaaggaaacctggcggcagcgcaaaagatg

SEQ ID NO: 137247 - DNA, 103 bp, Artificial Sequence
  Synthetic Polynucleotide
taatacgactcactatagggttagtataggggcacctcttcttccttccgaacagaggagacggaagatggaagaggtgaacctggcggcagcgcaaaagatg

SEQ ID NO: 137248 - DNA, 103 bp, Artificial Sequence
  Synthetic Polynucleotide
taatacgactcactatagggcgtctggtgtttagtataggggcacctcttaacagaggagaaagaggatgccctatactaacctggcggcagcgcaaaagatg

SEQ ID NO: 137249 - DNA, 103 bp, Artificial Sequence
  Synthetic Polynucleotide
taatacgactcactatagggccaattccagcgtctggtgtttagtataggaacagaggagacctataatgaacaccagaaacctggcggcagcgcaaaagatg

SEQ ID NO: 137250 - DNA, 103 bp, Artificial Sequence
  Synthetic Polynucleotide
taatacgactcactatagggaattctttctccaattccagcgtctggtgtaacagaggagaacaccaatggctggaattaacctggcggcagcgcaaaagatg

SEQ ID NO: 137251 - DNA, 103 bp, Artificial Sequence
  Synthetic Polynucleotide
taatacgactcactatagggattgaacagaaattctttctccaattccagaacagaggagactggaaatggagaaagaaaacctggcggcagcgcaaaagatg

SEQ ID NO: 137252 - DNA, 103 bp, Artificial Sequence
  Synthetic Polynucleotide
taatacgactcactatagggtcaaatacatattgaacagaaattctttctaacagaggagaagaaagatgttctgttcaaacctggcggcagcgcaaaagatg

SEQ ID NO: 137253 - DNA, 103 bp, Artificial Sequence
  Synthetic Polynucleotide
taatacgactcactatagggcgctctcgcgtcaaatacatattgaacagaaacagaggagatctgttatgtatgtatttaacctggcggcagcgcaaaagatg

SEQ ID NO: 137254 - DNA, 103 bp, Artificial Sequence
  Synthetic Polynucleotide
taatacgactcactatagggctccaggcggcgctctcgcgtcaaatacataacagaggagaatgtatatgacgcgagagaacctggcggcagcgcaaaagatg

SEQ ID NO: 137255 - DNA, 103 bp, Artificial Sequence
  Synthetic Polynucleotide
taatacgactcactatagggtcttgctaatctccaggcggcgctctcgcgaacagaggagacgcgagatggccgcctggaacctggcggcagcgcaaaagatg

SEQ ID NO: 137256 - DNA, 103 bp, Artificial Sequence
  Synthetic Polynucleotide
taatacgactcactatagggctcccagactgcatatacatgcctgcgctcaacagaggagagagcgcatgcatgtatataacctggcggcagcgcaaaagatg

SEQ ID NO: 137257 - DNA, 103 bp, Artificial Sequence
  Synthetic Polynucleotide
taatacgactcactatagggaggttaatggtcttgctaatctccaggcggaacagaggagaccgcctatggattagcaaaacctggcggcagcgcaaaagatg

SEQ ID NO: 137258 - DNA, 103 bp, Artificial Sequence
  Synthetic Polynucleotide
taatacgactcactatagggtctgtctgtaaggttaatggtcttgctaataacagaggagaattagcatgaccattaacaacctggcggcagcgcaaaagatg

SEQ ID NO: 137259 - DNA, 103 bp, Artificial Sequence
  Synthetic Polynucleotide
taatacgactcactatagggttttgacttgtctgtctgtaaggttaatggaacagaggagaccattaatgttacagacaaacctggcggcagcgcaaaagatg

SEQ ID NO: 137260 - DNA, 103 bp, Artificial Sequence
  Synthetic Polynucleotide
taatacgactcactatagggtgaaaccagattttgacttgtctgtctgtaaacagaggagatacagaatgacaagtcaaaacctggcggcagcgcaaaagatg

SEQ ID NO: 137261 - DNA, 103 bp, Artificial Sequence
  Synthetic Polynucleotide
taatacgactcactatagggtctgcgattttgaaaccagattttgacttgaacagaggagacaagtcatgatctggtttaacctggcggcagcgcaaaagatg

SEQ ID NO: 137262 - DNA, 103 bp, Artificial Sequence
  Synthetic Polynucleotide
taatacgactcactatagggtgagtttcattctgcgattttgaaaccagaaacagaggagatctggtatgaaaatcgcaaacctggcggcagcgcaaaagatg

SEQ ID NO: 137263 - DNA, 103 bp, Artificial Sequence
  Synthetic Polynucleotide
taatacgactcactatagggttcattttcttgagtttcattctgcgatttaacagaggagaaaatcgatgaatgaaactaacctggcggcagcgcaaaagatg

SEQ ID NO: 137264 - DNA, 103 bp, Artificial Sequence
  Synthetic Polynucleotide
taatacgactcactatagggattctctcggttcattttcttgagtttcataacagaggagaatgaaaatgaagaaaatgaacctggcggcagcgcaaaagatg

SEQ ID NO: 137265 - DNA, 103 bp, Artificial Sequence
  Synthetic Polynucleotide
taatacgactcactatagggcccggatccgattctctcggttcattttctaacagaggagaagaaaaatgaccgagagaaacctggcggcagcgcaaaagatg

SEQ ID NO: 137266 - DNA, 103 bp, Artificial Sequence
  Synthetic Polynucleotide
taatacgactcactataggggaggtcagttcccggatccgattctctcggaacagaggagaccgagaatgtcggatccgaacctggcggcagcgcaaaagatg

SEQ ID NO: 137267 - DNA, 103 bp, Artificial Sequence
  Synthetic Polynucleotide
taatacgactcactataggggaagttgcccaggttgaccgagttaaacataacagaggagaatgtttatgtcggtcaacaacctggcggcagcgcaaaagatg

SEQ ID NO: 137268 - DNA, 103 bp, Artificial Sequence
  Synthetic Polynucleotide
taatacgactcactataggggtagtaagtgcaactgggcagatagaggttaacagaggagaaacctcatgctgcccagtaacctggcggcagcgcaaaagatg

SEQ ID NO: 137269 - DNA, 103 bp, Artificial Sequence
  Synthetic Polynucleotide
taatacgactcactatagggactcgggcatgtagtaagtgcaactgggcaaacagaggagatgcccaatggcacttactaacctggcggcagcgcaaaagatg

SEQ ID NO: 137270 - DNA, 103 bp, Artificial Sequence
  Synthetic Polynucleotide
taatacgactcactatagggaccgtggagaactcgggcatgtagtaagtgaacagaggagacacttaatgcatgcccgaaacctggcggcagcgcaaaagatg

SEQ ID NO: 137271 - DNA, 103 bp, Artificial Sequence
  Synthetic Polynucleotide
taatacgactcactataggggaaggaggagaccgtggagaactcgggcataacagaggagaatgcccatgttctccacgaacctggcggcagcgcaaaagatg

SEQ ID NO: 137272 - DNA, 103 bp, Artificial Sequence
  Synthetic Polynucleotide
taatacgactcactatagggcctggggcaggaaggaggagaccgtggagaaacagaggagatctccaatgtctcctcctaacctggcggcagcgcaaaagatg

SEQ ID NO: 137273 - DNA, 103 bp, Artificial Sequence
  Synthetic Polynucleotide
taatacgactcactatagggcgagagggggcctggggcaggaaggaggagaacagaggagactcctcatgcctgccccaaacctggcggcagcgcaaaagatg

SEQ ID NO: 137274 - DNA, 103 bp, Artificial Sequence
  Synthetic Polynucleotide
taatacgactcactatagggggagatctgacgagagggggcctggggcagaacagaggagactgcccatggccccctctaacctggcggcagcgcaaaagatg

SEQ ID NO: 137275 - DNA, 103 bp, Artificial Sequence
  Synthetic Polynucleotide
taatacgactcactatagggagtagggataggagatctgacgagagggggaacagaggagaccccctatggtcagatctaacctggcggcagcgcaaaagatg

SEQ ID NO: 137276 - DNA, 103 bp, Artificial Sequence
  Synthetic Polynucleotide
taatacgactcactatagggacttgggccgagtagggataggagatctgaaacagaggagatcagatatgctatccctaaacctggcggcagcgcaaaagatg

SEQ ID NO: 137277 - DNA, 103 bp, Artificial Sequence
  Synthetic Polynucleotide
taatacgactcactataggggaccgggggcacttgggccgagtagggataaacagaggagatatcccatgtcggcccaaaacctggcggcagcgcaaaagatg

SEQ ID NO: 137278 - DNA, 103 bp, Artificial Sequence
  Synthetic Polynucleotide
taatacgactcactatagggacggagagcagaagttgcccaggttgaccgaacagaggagacggtcaatgtgggcaactaacctggcggcagcgcaaaagatg

SEQ ID NO: 137279 - DNA, 103 bp, Artificial Sequence
  Synthetic Polynucleotide
taatacgactcactatagggagacctcccggaccgggggcacttgggccgaacagaggagacggcccatgtgcccccggaacctggcggcagcgcaaaagatg

SEQ ID NO: 137280 - DNA, 103 bp, Artificial Sequence
  Synthetic Polynucleotide
taatacgactcactatagggaggccgtaggagacctcccggaccgggggcaacagaggagagcccccatgccgggaggtaacctggcggcagcgcaaaagatg

SEQ ID NO: 137281 - DNA, 103 bp, Artificial Sequence
  Synthetic Polynucleotide
taatacgactcactatagggggatggctccaggccgtaggagacctcccgaacagaggagacgggagatgtcctacggcaacctggcggcagcgcaaaagatg

SEQ ID NO: 137282 - DNA, 103 bp, Artificial Sequence
  Synthetic Polynucleotide
taatacgactcactataggggccacttgccggatggctccaggccgtaggaacagaggagacctacgatgtggagccataacctggcggcagcgcaaaagatg

SEQ ID NO: 137283 - DNA, 103 bp, Artificial Sequence
  Synthetic Polynucleotide
taatacgactcactatagggttccgatggtgccacttgccggatggctccaacagaggagaggagccatgcggcaagtgaacctggcggcagcgcaaaagatg

SEQ ID NO: 137284 - DNA, 103 bp, Artificial Sequence
  Synthetic Polynucleotide
taatacgactcactatagggggagtagctgttccgatggtgccacttgccaacagaggagaggcaagatgcaccatcggaacctggcggcagcgcaaaagatg

SEQ ID NO: 137285 - DNA, 103 bp, Artificial Sequence
  Synthetic Polynucleotide
taatacgactcactatagggcatagcaggaggagtagctgttccgatggtaacagaggagaaccatcatgacagctactaacctggcggcagcgcaaaagatg

SEQ ID NO: 137286 - DNA, 103 bp, Artificial Sequence
  Synthetic Polynucleotide
taatacgactcactatagggtcggccgccgcatagcaggaggagtagctgaacagaggagacagctaatgctcctgctaaacctggcggcagcgcaaaagatg

SEQ ID NO: 137287 - DNA, 103 bp, Artificial Sequence
  Synthetic Polynucleotide
taatacgactcactatagggcataagctcgtcggccgccgcatagcaggaaacagaggagatcctgcatggcggcggccaacctggcggcagcgcaaaagatg

SEQ ID NO: 137288 - DNA, 103 bp, Artificial Sequence
  Synthetic Polynucleotide
taatacgactcactatagggactcccggtgcataagctcgtcggccgccgaacagaggagacggcggatgacgagcttaaacctggcggcagcgcaaaagatg

SEQ ID NO: 137289 - DNA, 103 bp, Artificial Sequence
  Synthetic Polynucleotide
taatacgactcactatagggtccttgcgcgacggagagcagaagttgcccaacagaggagagggcaaatgctgctctccaacctggcggcagcgcaaaagatg

SEQ ID NO: 137290 - DNA, 103 bp, Artificial Sequence
  Synthetic Polynucleotide
taatacgactcactatagggggaggcaggcactcccggtgcataagctcgaacagaggagacgagctatggcaccgggaaacctggcggcagcgcaaaagatg

SEQ ID NO: 137291 - DNA, 103 bp, Artificial Sequence
  Synthetic Polynucleotide
taatacgactcactataggggacggtggaaggaggcaggcactcccggtgaacagaggagacaccggatgtgcctgcctaacctggcggcagcgcaaaagatg

SEQ ID NO: 137292 - DNA, 103 bp, Artificial Sequence
  Synthetic Polynucleotide
taatacgactcactatagggggatctcggtgacggtggaaggaggcaggcaacagaggagagcctgcatgcttccaccgaacctggcggcagcgcaaaagatg

SEQ ID NO: 137293 - DNA, 103 bp, Artificial Sequence
  Synthetic Polynucleotide
taatacgactcactatagggtttttcatgaggatctcggtgacggtggaaaacagaggagattccacatgcaccgagataacctggcggcagcgcaaaagatg

SEQ ID NO: 137294 - DNA, 103 bp, Artificial Sequence
  Synthetic Polynucleotide
taatacgactcactatagggggagccttcgtttttcatgaggatctcggtaacagaggagaaccgagatgctcatgaaaaacctggcggcagcgcaaaagatg

SEQ ID NO: 137295 - DNA, 103 bp, Artificial Sequence
  Synthetic Polynucleotide
taatacgactcactatagggggccgccgtaggagccttcgtttttcatgaaacagaggagatcatgaatgacgaaggctaacctggcggcagcgcaaaagatg

SEQ ID NO: 137296 - DNA, 103 bp, Artificial Sequence
  Synthetic Polynucleotide
taatacgactcactataggggggtggtggtggccgccgtaggagccttcgaacagaggagacgaaggatgctacggcggaacctggcggcagcgcaaaagatg

SEQ ID NO: 137297 - DNA, 103 bp, Artificial Sequence
  Synthetic Polynucleotide
taatacgactcactatagggcggggcgctggggtggtggtggccgccgtaaacagaggagatacggcatgcaccaccacaacctggcggcagcgcaaaagatg

SEQ ID NO: 137298 - DNA, 103 bp, Artificial Sequence
  Synthetic Polynucleotide
taatacgactcactataggggggttgcgtgcggggcgctggggtggtggtaacagaggagaaccaccatgccagcgcccaacctggcggcagcgcaaaagatg

SEQ ID NO: 137299 - DNA, 103 bp, Artificial Sequence
  Synthetic Polynucleotide
taatacgactcactatagggaagccggcgggggttgcgtgcggggcgctgaacagaggagacagcgcatggcacgcaacaacctggcggcagcgcaaaagatg

SEQ ID NO: 137300 - DNA, 103 bp, Artificial Sequence
  Synthetic Polynucleotide
taatacgactcactatagggtgcgcccctctccttgcgcgacggagagcaaacagaggagatgctctatgtcgcgcaagaacctggcggcagcgcaaaagatg

SEQ ID NO: 137301 - DNA, 103 bp, Artificial Sequence
  Synthetic Polynucleotide
taatacgactcactatagggtgaggagtagaagccggcgggggttgcgtgaacagaggagacacgcaatgcccgccggcaacctggcggcagcgcaaaagatg

SEQ ID NO: 137302 - DNA, 103 bp, Artificial Sequence
  Synthetic Polynucleotide
taatacgactcactatagggtcttgttgactgaggagtagaagccggcggaacagaggagaccgccgatgtctactcctaacctggcggcagcgcaaaagatg

SEQ ID NO: 137303 - DNA, 103 bp, Artificial Sequence
  Synthetic Polynucleotide
taatacgactcactatagggaggacgctgttcttgttgactgaggagtagaacagaggagactactcatgagtcaacaaaacctggcggcagcgcaaaagatg

SEQ ID NO: 137304 - DNA, 103 bp, Artificial Sequence
  Synthetic Polynucleotide
taatacgactcactatagggggcttgaggcaggacgctgttcttgttgacaacagaggagagtcaacatgaacagcgtcaacctggcggcagcgcaaaagatg

SEQ ID NO: 137305 - DNA, 103 bp, Artificial Sequence
  Synthetic Polynucleotide
taatacgactcactatagggaacggtcgaaggcttgaggcaggacgctgtaacagaggagaacagcgatgtgcctcaagaacctggcggcagcgcaaaagatg

SEQ ID NO: 137306 - DNA, 103 bp, Artificial Sequence
  Synthetic Polynucleotide
taatacgactcactatagggttgtcgaagaaacggtcgaaggcttgaggcaacagaggagagcctcaatgcttcgaccgaacctggcggcagcgcaaaagatg

SEQ ID NO: 137307 - DNA, 103 bp, Artificial Sequence
  Synthetic Polynucleotide
taatacgactcactataggggcagtaggcgttgtcgaagaaacggtcgaaaacagaggagattcgacatgttcttcgacaacctggcggcagcgcaaaagatg

SEQ ID NO: 137308 - DNA, 103 bp, Artificial Sequence
  Synthetic Polynucleotide
taatacgactcactatagggcgccgccaccgcagtaggcgttgtcgaagaaacagaggagatcttcgatgacgcctactaacctggcggcagcgcaaaagatg

SEQ ID NO: 137309 - DNA, 103 bp, Artificial Sequence
  Synthetic Polynucleotide
taatacgactcactataggggcgggcgggtcgccgccaccgcagtaggcgaacagaggagacgcctaatgcggtggcggaacctggcggcagcgcaaaagatg

SEQ ID NO: 137310 - DNA, 103 bp, Artificial Sequence
  Synthetic Polynucleotide
taatacgactcactatagggggggggctcggcgggcgggtcgccgccaccaacagaggagaggtggcatggacccgcccaacctggcggcagcgcaaaagatg

SEQ ID NO: 137311 - DNA, 103 bp, Artificial Sequence
  Synthetic Polynucleotide
taatacgactcactatagggcgccgaaatctgcgcccctctccttgcgcgaacagaggagacgcgcaatgagaggggcgaacctggcggcagcgcaaaagatg

SEQ ID NO: 137312 - DNA, 103 bp, Artificial Sequence
  Synthetic Polynucleotide
taatacgactcactatagggtgccggagcaggggggctcggcgggcgggtaacagaggagaacccgcatgccgagccccaacctggcggcagcgcaaaagatg

SEQ ID NO: 137313 - DNA, 103 bp, Artificial Sequence
  Synthetic Polynucleotide
taatacgactcactataggggcctcgcccttgccggagcaggggggctcgaacagaggagacgagccatgctgctccggaacctggcggcagcgcaaaagatg

SEQ ID NO: 137314 - DNA, 103 bp, Artificial Sequence
  Synthetic Polynucleotide
taatacgactcactatagggctcccccttggcctcgcccttgccggagcaaacagaggagatgctccatgaagggcgagaacctggcggcagcgcaaaagatg

SEQ ID NO: 137315 - DNA, 103 bp, Artificial Sequence
  Synthetic Polynucleotide
taatacgactcactataggggtgcctcgggctcccccttggcctcgccctaacagaggagaagggcgatgccaagggggaacctggcggcagcgcaaaagatg

SEQ ID NO: 137316 - DNA, 103 bp, Artificial Sequence
  Synthetic Polynucleotide
taatacgactcactataggggaggccgggggtgcctcgggctcccccttgaacagaggagacaagggatggcccgaggcaacctggcggcagcgcaaaagatg

SEQ ID NO: 137317 - DNA, 103 bp, Artificial Sequence
  Synthetic Polynucleotide
taatacgactcactatagggcgccagtcccgaggccgggggtgcctcgggaacagaggagacccgagatgcccccggccaacctggcggcagcgcaaaagatg

SEQ ID NO: 137318 - DNA, 103 bp, Artificial Sequence
  Synthetic Polynucleotide
taatacgactcactatagggcagcccgggacgccagtcccgaggccggggaacagaggagaccccggatgcgggactggaacctggcggcagcgcaaaagatg

SEQ ID NO: 137319 - DNA, 103 bp, Artificial Sequence
  Synthetic Polynucleotide
taatacgactcactataggggcacccgcctcagcccgggacgccagtcccaacagaggagagggactatggtcccgggcaacctggcggcagcgcaaaagatg

SEQ ID NO: 137320 - DNA, 103 bp, Artificial Sequence
  Synthetic Polynucleotide
taatacgactcactatagggctccgcctcggcacccgcctcagcccgggaaacagaggagatcccggatggaggcgggtaacctggcggcagcgcaaaagatg

SEQ ID NO: 137321 - DNA, 103 bp, Artificial Sequence
  Synthetic Polynucleotide
taatacgactcactatagggcctcctcagcctccgcctcggcacccgcctaacagaggagaaggcggatgccgaggcggaacctggcggcagcgcaaaagatg

SEQ ID NO: 137322 - DNA, 103 bp, Artificial Sequence
  Synthetic Polynucleotide
taatacgactcactatagggctccctcgctcgccgaaatctgcgcccctcaacagaggagagaggggatgagatttcggaacctggcggcagcgcaaaagatg

SEQ ID NO: 137323 - DNA, 103 bp, Artificial Sequence
  Synthetic Polynucleotide
taatacgactcactatagggtttgtgttctcctcctcagcctccgcctcgaacagaggagacgaggcatgggctgaggaaacctggcggcagcgcaaaagatg

SEQ ID NO: 137324 - DNA, 103 bp, Artificial Sequence
  Synthetic Polynucleotide
taatacgactcactatagggcgagctgggatttgtgttctcctcctcagcaacagaggagagctgagatggagaacacaaacctggcggcagcgcaaaagatg

SEQ ID NO: 137325 - DNA, 103 bp, Artificial Sequence
  Synthetic Polynucleotide
taatacgactcactatagggctgaaccggacgagctgggatttgtgttctaacagaggagaagaacaatgatcccagctaacctggcggcagcgcaaaagatg

SEQ ID NO: 137326 - DNA, 103 bp, Artificial Sequence
  Synthetic Polynucleotide
taatacgactcactatagggacggagtgggctgaaccggacgagctgggaaacagaggagatcccagatggtccggttcaacctggcggcagcgcaaaagatg

SEQ ID NO: 137327 - DNA, 103 bp, Artificial Sequence
  Synthetic Polynucleotide
taatacgactcactatagggctccttggccacggagtgggctgaaccggaaacagaggagatccggtatggcccactccaacctggcggcagcgcaaaagatg

SEQ ID NO: 137328 - DNA, 103 bp, Artificial Sequence
  Synthetic Polynucleotide
taatacgactcactatagggctttggccggctccttggccacggagtgggaacagaggagacccactatgtggccaaggaacctggcggcagcgcaaaagatg

SEQ ID NO: 137329 - DNA, 103 bp, Artificial Sequence
  Synthetic Polynucleotide
taatacgactcactatagggggggcggctcctttggccggctccttggccaacagaggagaggccaaatggccggccaaaacctggcggcagcgcaaaagatg

SEQ ID NO: 137330 - DNA, 103 bp, Artificial Sequence
  Synthetic Polynucleotide
taatacgactcactataggggggggcgttgggggcggctcctttggccggaacagaggagaccggccatgggagccgccaacctggcggcagcgcaaaagatg

SEQ ID NO: 137331 - DNA, 103 bp, Artificial Sequence
  Synthetic Polynucleotide
taatacgactcactatagggtgcgggtgcggggggcgttgggggcggctcaacagaggagagagccgatgccaacgcccaacctggcggcagcgcaaaagatg

SEQ ID NO: 137332 - DNA, 103 bp, Artificial Sequence
  Synthetic Polynucleotide
taatacgactcactatagggcagcgcttcttgcgggtgcggggggcgttgaacagaggagacaacgcatgccgcacccgaacctggcggcagcgcaaaagatg

SEQ ID NO: 137333 - DNA, 103 bp, Artificial Sequence
  Synthetic Polynucleotide
taatacgactcactatagggggaggcgcagctccctcgctcgccgaaatcaacagaggagagatttcatggagcgagggaacctggcggcagcgcaaaagatg

SEQ ID NO: 137334 - DNA, 103 bp, Artificial Sequence
  Synthetic Polynucleotide
taatacgactcactatagggcgaataagggcagcgcttcttgcgggtgcgaacagaggagacgcaccatgaagaagcgcaacctggcggcagcgcaaaagatg

SEQ ID NO: 137335 - DNA, 103 bp, Artificial Sequence
  Synthetic Polynucleotide
taatacgactcactatagggtctggaatttcgaataagggcagcgcttctaacagaggagaagaagcatggcccttattaacctggcggcagcgcaaaagatg

SEQ ID NO: 137336 - DNA, 103 bp, Artificial Sequence
  Synthetic Polynucleotide
taatacgactcactatagggagttcccggatctggaatttcgaataagggaacagaggagacccttaatggaaattccaaacctggcggcagcgcaaaagatg

SEQ ID NO: 137337 - DNA, 103 bp, Artificial Sequence
  Synthetic Polynucleotide
taatacgactcactatagggctctcgctccagttcccggatctggaatttaacagaggagaaaattcatgatccgggaaaacctggcggcagcgcaaaagatg

SEQ ID NO: 137338 - DNA, 103 bp, Artificial Sequence
  Synthetic Polynucleotide
taatacgactcactatagggtgaagaaaaactctcgctccagttcccggaaacagaggagatccgggatgtggagcgagaacctggcggcagcgcaaaagatg

SEQ ID NO: 137339 - DNA, 103 bp, Artificial Sequence
  Synthetic Polynucleotide
taatacgactcactatagggatatacacgttgaagaaaaactctcgctccaacagaggagaggagcgatggtttttcttaacctggcggcagcgcaaaagatg

SEQ ID NO: 137340 - DNA, 103 bp, Artificial Sequence
  Synthetic Polynucleotide
taatacgactcactatagggctctttgttgatatacacgttgaagaaaaaaacagaggagatttttcatgaacgtgtataacctggcggcagcgcaaaagatg

SEQ ID NO: 137341 - DNA, 103 bp, Artificial Sequence
  Synthetic Polynucleotide
taatacgactcactataggggcagccgcttctctttgttgatatacacgtaacagaggagaacgtgtatgtcaacaaagaacctggcggcagcgcaaaagatg

SEQ ID NO: 137342 - DNA, 103 bp, Artificial Sequence
  Synthetic Polynucleotide
taatacgactcactatagggcgggacagctgcagccgcttctctttgttgaacagaggagacaacaaatggaagcggctaacctggcggcagcgcaaaagatg

SEQ ID NO: 137343 - DNA, 103 bp, Artificial Sequence
  Synthetic Polynucleotide
taatacgactcactataggggttcagcatccgggacagctgcagccgcttaacagaggagaaagcggatgcagctgtccaacctggcggcagcgcaaaagatg

SEQ ID NO: 137344 - DNA, 103 bp, Artificial Sequence
  Synthetic Polynucleotide
taatacgactcactataggggatagaggttggaggcgcagctccctcgctaacagaggagaagcgagatggctgcgcctaacctggcggcagcgcaaaagatg

SEQ ID NO: 137345 - DNA, 103 bp, Artificial Sequence
  Synthetic Polynucleotide
taatacgactcactatagggggtccgtcaggttcagcatccgggacagctaacagaggagaagctgtatgggatgctgaaacctggcggcagcgcaaaagatg

SEQ ID NO: 137346 - DNA, 103 bp, Artificial Sequence
  Synthetic Polynucleotide
taatacgactcactatagggttcacttgtcggtccgtcaggttcagcatcaacagaggagagatgctatgcctgacggaaacctggcggcagcgcaaaagatg

SEQ ID NO: 137347 - DNA, 103 bp, Artificial Sequence
  Synthetic Polynucleotide
taatacgactcactatagggaaaccaaattttcacttgtcggtccgtcagaacagaggagactgacgatgcgacaagtgaacctggcggcagcgcaaaagatg

SEQ ID NO: 137348 - DNA, 103 bp, Artificial Sequence
  Synthetic Polynucleotide
taatacgactcactatagggttctgttctgaaaccaaattttcacttgtcaacagaggagagacaagatgaaatttggtaacctggcggcagcgcaaaagatg

SEQ ID NO: 137349 - DNA, 103 bp, Artificial Sequence
  Synthetic Polynucleotide
taatacgactcactatagggtctttcatccttctgttctgaaaccaaattaacagaggagaaatttgatgtcagaacagaacctggcggcagcgcaaaagatg

SEQ ID NO: 137350 - DNA, 103 bp, Artificial Sequence
  Synthetic Polynucleotide
taatacgactcactatagggcagtttcttttctttcatccttctgttctgaacagaggagacagaacatgaggatgaaaaacctggcggcagcgcaaaagatg

SEQ ID NO: 137351 - DNA, 103 bp, Artificial Sequence
  Synthetic Polynucleotide
taatacgactcactatagggggtctctgctcagtttcttttctttcatccaacagaggagaggatgaatgaaaagaaacaacctggcggcagcgcaaaagatg

SEQ ID NO: 137352 - DNA, 103 bp, Artificial Sequence
  Synthetic Polynucleotide
taatacgactcactatagggtactgcagccggtctctgctcagtttctttaacagaggagaaaagaaatggagcagagaaacctggcggcagcgcaaaagatg

SEQ ID NO: 137353 - DNA, 103 bp, Artificial Sequence
  Synthetic Polynucleotide
taatacgactcactatagggtcccgagaaatactgcagccggtctctgctaacagaggagaagcagaatgcggctgcagaacctggcggcagcgcaaaagatg

SEQ ID NO: 137354 - DNA, 103 bp, Artificial Sequence
  Synthetic Polynucleotide
taatacgactcactataggggcagaggatttcccgagaaatactgcagccaacagaggagaggctgcatgatttctcggaacctggcggcagcgcaaaagatg

SEQ ID NO: 137355 - DNA, 103 bp, Artificial Sequence
  Synthetic Polynucleotide
taatacgactcactatagggcaactgggcagatagaggttggaggcgcagaacagaggagactgcgcatgcaacctctaaacctggcggcagcgcaaaagatg

SEQ ID NO: 137356 - DNA, 103 bp, Artificial Sequence
  Synthetic Polynucleotide
taatacgactcactatagggagagtccatcaaatacgagctcatgatcataacagaggagaatgatcatgagctcgtataacctggcggcagcgcaaaagatg

SEQ ID NO: 137357 - DNA, 103 bp, Artificial Sequence
  Synthetic Polynucleotide
taatacgactcactatagggggtccggccgtaatattccggactgtgttcaacagaggagagaacacatgccggaatataacctggcggcagcgcaaaagatg

SEQ ID NO: 137358 - DNA, 103 bp, Artificial Sequence
  Synthetic Polynucleotide
taatacgactcactatagggccgattccctggtccggccgtaatattccgaacagaggagacggaatatgacggccggaaacctggcggcagcgcaaaagatg

SEQ ID NO: 137359 - DNA, 103 bp, Artificial Sequence
  Synthetic Polynucleotide
taatacgactcactatagggtgctggaatcccgattccctggtccggccgaacagaggagacggccgatgcagggaatcaacctggcggcagcgcaaaagatg

SEQ ID NO: 137360 - DNA, 103 bp, Artificial Sequence
  Synthetic Polynucleotide
taatacgactcactatagggctggtggtgatgctggaatcccgattccctaacagaggagaagggaaatgggattccagaacctggcggcagcgcaaaagatg

SEQ ID NO: 137361 - DNA, 103 bp, Artificial Sequence
  Synthetic Polynucleotide
taatacgactcactatagggggtacagctcctggtggtgatgctggaatcaacagaggagagattccatgatcaccaccaacctggcggcagcgcaaaagatg

SEQ ID NO: 137362 - DNA, 103 bp, Artificial Sequence
  Synthetic Polynucleotide
taatacgactcactatagggggcggtggtgggtacagctcctggtggtgaaacagaggagatcaccaatgggagctgtaaacctggcggcagcgcaaaagatg

SEQ ID NO: 137363 - DNA, 103 bp, Artificial Sequence
  Synthetic Polynucleotide
taatacgactcactatagggagggcgcggaggcggtggtgggtacagctcaacagaggagagagctgatgccaccaccgaacctggcggcagcgcaaaagatg

SEQ ID NO: 137364 - DNA, 103 bp, Artificial Sequence
  Synthetic Polynucleotide
taatacgactcactatagggcagggtagctagggcgcggaggcggtggtgaacagaggagacaccacatgctccgcgccaacctggcggcagcgcaaaagatg

SEQ ID NO: 137365 - DNA, 103 bp, Artificial Sequence
  Synthetic Polynucleotide
taatacgactcactatagggtactggcgctcagggtagctagggcgcggaaacagaggagatccgcgatgtagctacccaacctggcggcagcgcaaaagatg

SEQ ID NO: 137366 - DNA, 103 bp, Artificial Sequence
  Synthetic Polynucleotide
taatacgactcactatagggggtgcagctatactggcgctcagggtagctaacagaggagaagctacatggagcgccagaacctggcggcagcgcaaaagatg

SEQ ID NO: 137367 - DNA, 103 bp, Artificial Sequence
  Synthetic Polynucleotide
taatacgactcactatagggcgatgtagttagagtccatcaaatacgagcaacagaggagagctcgtatgtgatggactaacctggcggcagcgcaaaagatg

SEQ ID NO: 137368 - DNA, 103 bp, Artificial Sequence
  Synthetic Polynucleotide
taatacgactcactatagggcctggagactggtgcagctatactggcgctaacagaggagaagcgccatgatagctgcaaacctggcggcagcgcaaaagatg

SEQ ID NO: 137369 - DNA, 103 bp, Artificial Sequence
  Synthetic Polynucleotide
taatacgactcactatagggttgccgggcccctggagactggtgcagctaaacagaggagatagctgatgcagtctccaaacctggcggcagcgcaaaagatg

SEQ ID NO: 137370 - DNA, 103 bp, Artificial Sequence
  Synthetic Polynucleotide
taatacgactcactataggggcctcgcgaattgccgggcccctggagactaacagaggagaagtctcatggggcccggcaacctggcggcagcgcaaaagatg

SEQ ID NO: 137371 - DNA, 103 bp, Artificial Sequence
  Synthetic Polynucleotide
taatacgactcactatagggccggcccgtggcctcgcgaattgccgggccaacagaggagaggcccgatgattcgcgagaacctggcggcagcgcaaaagatg

SEQ ID NO: 137372 - DNA, 103 bp, Artificial Sequence
  Synthetic Polynucleotide
taatacgactcactatagggcccgcctgggccggcccgtggcctcgcgaaaacagaggagattcgcgatgccacgggccaacctggcggcagcgcaaaagatg

SEQ ID NO: 137373 - DNA, 103 bp, Artificial Sequence
  Synthetic Polynucleotide
taatacgactcactataggggtggtggtggcccgcctgggccggcccgtgaacagaggagacacgggatggcccaggcgaacctggcggcagcgcaaaagatg

SEQ ID NO: 137374 - DNA, 103 bp, Artificial Sequence
  Synthetic Polynucleotide
taatacgactcactatagggatttctcggggtggtggtggcccgcctgggaacagaggagacccaggatggccaccaccaacctggcggcagcgcaaaagatg

SEQ ID NO: 137375 - DNA, 103 bp, Artificial Sequence
  Synthetic Polynucleotide
taatacgactcactatagggagcgactgtgatttctcggggtggtggtggaacagaggagaccaccaatgccccgagaaaacctggcggcagcgcaaaagatg

SEQ ID NO: 137376 - DNA, 103 bp, Artificial Sequence
  Synthetic Polynucleotide
taatacgactcactatagggcggctcgcagagcgactgtgatttctcgggaacagaggagacccgagatgtcacagtcgaacctggcggcagcgcaaaagatg

SEQ ID NO: 137377 - DNA, 103 bp, Artificial Sequence
  Synthetic Polynucleotide
taatacgactcactatagggagagaggcgccggctcgcagagcgactgtgaacagaggagacacagtatgtctgcgagcaacctggcggcagcgcaaaagatg

SEQ ID NO: 137378 - DNA, 103 bp, Artificial Sequence
  Synthetic Polynucleotide
taatacgactcactatagggaatttcggatcgatgtagttagagtccatcaacagaggagagatggaatgtaactacataacctggcggcagcgcaaaagatg

SEQ ID NO: 137379 - DNA, 103 bp, Artificial Sequence
  Synthetic Polynucleotide
taatacgactcactataggggaggcgcctgagagaggcgccggctcgcagaacagaggagactgcgaatgggcgcctctaacctggcggcagcgcaaaagatg

SEQ ID NO: 137380 - DNA, 103 bp, Artificial Sequence
  Synthetic Polynucleotide
taatacgactcactatagggcggggaggcggaggcgcctgagagaggcgcaacagaggagagcgcctatgtcaggcgccaacctggcggcagcgcaaaagatg

SEQ ID NO: 137381 - DNA, 103 bp, Artificial Sequence
  Synthetic Polynucleotide
taatacgactcactataggggggctggggacggggaggcggaggcgcctgaacagaggagacaggcgatgccgcctcccaacctggcggcagcgcaaaagatg

SEQ ID NO: 137382 - DNA, 103 bp, Artificial Sequence
  Synthetic Polynucleotide
taatacgactcactatagggcaggctggcggggctggggacggggaggcgaacagaggagacgcctcatggtccccagcaacctggcggcagcgcaaaagatg

SEQ ID NO: 137383 - DNA, 103 bp, Artificial Sequence
  Synthetic Polynucleotide
taatacgactcactatagggtggctggctgcaggctggcggggctggggaaacagaggagatccccaatgccgccagccaacctggcggcagcgcaaaagatg

SEQ ID NO: 137384 - DNA, 103 bp, Artificial Sequence
  Synthetic Polynucleotide
taatacgactcactatagggggtcgggggctggctggctgcaggctggcgaacagaggagacgccagatggcagccagcaacctggcggcagcgcaaaagatg

SEQ ID NO: 137385 - DNA, 103 bp, Artificial Sequence
  Synthetic Polynucleotide
taatacgactcactatagggctggagggatggtcgggggctggctggctgaacagaggagacagccaatgagcccccgaaacctggcggcagcgcaaaagatg

SEQ ID NO: 137386 - DNA, 103 bp, Artificial Sequence
  Synthetic Polynucleotide
taatacgactcactataggggctggcggcgctggagggatggtcgggggcaacagaggagagcccccatgcatccctccaacctggcggcagcgcaaaagatg

SEQ ID NO: 137387 - DNA, 103 bp, Artificial Sequence
  Synthetic Polynucleotide
taatacgactcactatagggtgggttgcttgctggcggcgctggagggataacagaggagaatccctatggcgccgccaaacctggcggcagcgcaaaagatg

SEQ ID NO: 137388 - DNA, 103 bp, Artificial Sequence
  Synthetic Polynucleotide
taatacgactcactataggggggtagactatgggttgcttgctggcggcgaacagaggagacgccgcatgcaagcaaccaacctggcggcagcgcaaaagatg

SEQ ID NO: 137389 - DNA, 103 bp, Artificial Sequence
  Synthetic Polynucleotide
taatacgactcactataggggcatggaggaaatttcggatcgatgtagttaacagaggagaaactacatggatccgaaaaacctggcggcagcgcaaaagatg

SEQ ID NO: 137390 - DNA, 103 bp, Artificial Sequence
  Synthetic Polynucleotide
taatacgactcactatagggtttcatccatgggtagactatgggttgcttaacagaggagaaagcaaatgatagtctacaacctggcggcagcgcaaaagatg

SEQ ID NO: 137391 - DNA, 103 bp, Artificial Sequence
  Synthetic Polynucleotide
taatacgactcactatagggcgtgaatttttttcatccatgggtagactaaacagaggagatagtctatgcatggatgaaacctggcggcagcgcaaaagatg

SEQ ID NO: 137392 - DNA, 103 bp, Artificial Sequence
  Synthetic Polynucleotide
taatacgactcactatagggaccgtgctaacgtgaatttttttcatccataacagaggagaatggatatgaaaaattcaaacctggcggcagcgcaaaagatg

SEQ ID NO: 137393 - DNA, 103 bp, Artificial Sequence
  Synthetic Polynucleotide
taatacgactcactatagggattggggttcaccgtgctaacgtgaattttaacagaggagaaaaattatggttagcacgaacctggcggcagcgcaaaagatg

SEQ ID NO: 137394 - DNA, 103 bp, Artificial Sequence
  Synthetic Polynucleotide
taatacgactcactatagggctccgttataattggggttcaccgtgctaaaacagaggagattagcaatgtgaaccccaaacctggcggcagcgcaaaagatg

SEQ ID NO: 137395 - DNA, 103 bp, Artificial Sequence
  Synthetic Polynucleotide
taatacgactcactatagggttgggttcccctccgttataattggggttcaacagaggagagaacccatgttataacggaacctggcggcagcgcaaaagatg

SEQ ID NO: 137396 - DNA, 103 bp, Artificial Sequence
  Synthetic Polynucleotide
taatacgactcactatagggcctcgagcgcttgggttcccctccgttataaacagaggagatataacatgggggaacccaacctggcggcagcgcaaaagatg

SEQ ID NO: 137397 - DNA, 103 bp, Artificial Sequence
  Synthetic Polynucleotide
taatacgactcactatagggtataggctgtcctcgagcgcttgggttcccaacagaggagagggaacatgagcgctcgaaacctggcggcagcgcaaaagatg

SEQ ID NO: 137398 - DNA, 103 bp, Artificial Sequence
  Synthetic Polynucleotide
taatacgactcactatagggtgctgccgggtataggctgtcctcgagcgcaacagaggagagcgctcatggacagcctaaacctggcggcagcgcaaaagatg

SEQ ID NO: 137399 - DNA, 103 bp, Artificial Sequence
  Synthetic Polynucleotide
taatacgactcactatagggttccaggacttgctgccgggtataggctgtaacagaggagaacagccatgacccggcagaacctggcggcagcgcaaaagatg

SEQ ID NO: 137400 - DNA, 103 bp, Artificial Sequence
  Synthetic Polynucleotide
taatacgactcactatagggaatattcttcgcatggaggaaatttcggataacagaggagaatccgaatgttcctccataacctggcggcagcgcaaaagatg

SEQ ID NO: 137401 - DNA, 103 bp, Artificial Sequence
  Synthetic Polynucleotide
taatacgactcactatagggctttctctaattccaggacttgctgccgggaacagaggagacccggcatgaagtcctggaacctggcggcagcgcaaaagatg

SEQ ID NO: 137402 - DNA, 103 bp, Artificial Sequence
  Synthetic Polynucleotide
taatacgactcactatagggtaatgaaactctttctctaattccaggactaacagaggagaagtcctatgattagagaaaacctggcggcagcgcaaaagatg

SEQ ID NO: 137403 - DNA, 103 bp, Artificial Sequence
  Synthetic Polynucleotide
taatacgactcactataggggtagcggttgtaatgaaactctttctctaaaacagaggagattagagatggagtttcataacctggcggcagcgcaaaagatg

SEQ ID NO: 137404 - DNA, 103 bp, Artificial Sequence
  Synthetic Polynucleotide
taatacgactcactatagggttcgggtcaggtagcggttgtaatgaaactaacagaggagaagtttcatgacaaccgctaacctggcggcagcgcaaaagatg

SEQ ID NO: 137405 - DNA, 103 bp, Artificial Sequence
  Synthetic Polynucleotide
taatacgactcactatagggatccttctccttcgggtcaggtagcggttgaacagaggagacaaccgatgcctgacccgaacctggcggcagcgcaaaagatg

SEQ ID NO: 137406 - DNA, 103 bp, Artificial Sequence
  Synthetic Polynucleotide
taatacgactcactatagggggcgatctcgatccttctccttcgggtcagaacagaggagactgaccatgaggagaaggaacctggcggcagcgcaaaagatg

SEQ ID NO: 137407 - DNA, 103 bp, Artificial Sequence
  Synthetic Polynucleotide
taatacgactcactatagggacagcgagtgggcgatctcgatccttctccaacagaggagaggagaaatgtcgagatcgaacctggcggcagcgcaaaagatg

SEQ ID NO: 137408 - DNA, 103 bp, Artificial Sequence
  Synthetic Polynucleotide
taatacgactcactatagggtcagagaggcacagcgagtgggcgatctcgaacagaggagacgagatatgccactcgctaacctggcggcagcgcaaaagatg

SEQ ID NO: 137409 - DNA, 103 bp, Artificial Sequence
  Synthetic Polynucleotide
taatacgactcactataggggatctgcctctcagagaggcacagcgagtgaacagaggagacactcgatgtgcctctctaacctggcggcagcgcaaaagatg

SEQ ID NO: 137410 - DNA, 103 bp, Artificial Sequence
  Synthetic Polynucleotide
taatacgactcactatagggaccagattttgatctgcctctcagagaggcaacagaggagagcctctatgagaggcagaaacctggcggcagcgcaaaagatg

SEQ ID NO: 137411 - DNA, 103 bp, Artificial Sequence
  Synthetic Polynucleotide
taatacgactcactatagggctattttgcgaatattcttcgcatggaggaaacagaggagatcctccatgcgaagaataaacctggcggcagcgcaaaagatg

SEQ ID NO: 137412 - DNA, 103 bp, Artificial Sequence
  Synthetic Polynucleotide
taatacgactcactatagggcggttttggaaccagattttgatctgcctcaacagaggagagaggcaatgcaaaatctgaacctggcggcagcgcaaaagatg

SEQ ID NO: 137413 - DNA, 103 bp, Artificial Sequence
  Synthetic Polynucleotide
taatacgactcactatagggtttcatgcgacggttttggaaccagattttaacagaggagaaaaatcatgttccaaaacaacctggcggcagcgcaaaagatg

SEQ ID NO: 137414 - DNA, 103 bp, Artificial Sequence
  Synthetic Polynucleotide
taatacgactcactatagggccttcttccatttcatgcgacggttttggaaacagaggagatccaaaatggtcgcatgaaacctggcggcagcgcaaaagatg

SEQ ID NO: 137415 - DNA, 103 bp, Artificial Sequence
  Synthetic Polynucleotide
taatacgactcactatagggagtcggtggtccttcttccatttcatgcgaaacagaggagatcgcatatgatggaagaaaacctggcggcagcgcaaaagatg

SEQ ID NO: 137416 - DNA, 103 bp, Artificial Sequence
  Synthetic Polynucleotide
taatacgactcactatagggggtgttggggagtcggtggtccttcttccaaacagaggagatggaagatggaccaccgaaacctggcggcagcgcaaaagatg

SEQ ID NO: 137417 - DNA, 103 bp, Artificial Sequence
  Synthetic Polynucleotide
taatacgactcactatagggacctgactttggtgttggggagtcggtggtaacagaggagaaccaccatgtccccaacaaacctggcggcagcgcaaaagatg

SEQ ID NO: 137418 - DNA, 103 bp, Artificial Sequence
  Synthetic Polynucleotide
taatacgactcactataggggggggtgctgacctgactttggtgttggggaacagaggagaccccaaatgcaaagtcagaacctggcggcagcgcaaaagatg

SEQ ID NO: 137419 - DNA, 103 bp, Artificial Sequence
  Synthetic Polynucleotide
taatacgactcactatagggagcgccggccgggggtgctgacctgactttaacagaggagaaaagtcatgtcagcacccaacctggcggcagcgcaaaagatg

SEQ ID NO: 137420 - DNA, 103 bp, Artificial Sequence
  Synthetic Polynucleotide
taatacgactcactatagggtgctgggcgcagcgccggccgggggtgctgaacagaggagacagcacatgcggccggcgaacctggcggcagcgcaaaagatg

SEQ ID NO: 137421 - DNA, 103 bp, Artificial Sequence
  Synthetic Polynucleotide
taatacgactcactataggggccgaaagggtgctgggcgcagcgccggccaacagaggagaggccggatgtgcgcccagaacctggcggcagcgcaaaagatg

SEQ ID NO: 137422 - DNA, 103 bp, Artificial Sequence
  Synthetic Polynucleotide
taatacgactcactatagggagggatgtagctattttgcgaatattcttcaacagaggagagaagaaatgtcgcaaaataacctggcggcagcgcaaaagatg

SEQ ID NO: 137423 - DNA, 103 bp, Artificial Sequence
  Synthetic Polynucleotide
taatacgactcactatagggcggggtagctgccgaaagggtgctgggcgcaacagaggagagcgcccatgaccctttcgaacctggcggcagcgcaaaagatg

SEQ ID NO: 137424 - DNA, 103 bp, Artificial Sequence
  Synthetic Polynucleotide
taatacgactcactatagggcagaagtacccggggtagctgccgaaagggaacagaggagaccctttatgcagctacccaacctggcggcagcgcaaaagatg

SEQ ID NO: 137425 - DNA, 103 bp, Artificial Sequence
  Synthetic Polynucleotide
taatacgactcactataggggagtggtcttcagaagtacccggggtagctaacagaggagaagctacatggggtacttcaacctggcggcagcgcaaaagatg

SEQ ID NO: 137426 - DNA, 103 bp, Artificial Sequence
  Synthetic Polynucleotide
taatacgactcactatagggggcgctctgggagtggtcttcagaagtaccaacagaggagaggtactatggaagaccacaacctggcggcagcgcaaaagatg

SEQ ID NO: 137427 - DNA, 103 bp, Artificial Sequence
  Synthetic Polynucleotide
taatacgactcactatagggccggcggcgtggcgctctgggagtggtcttaacagaggagaaagaccatgcccagagcgaacctggcggcagcgcaaaagatg

SEQ ID NO: 137428 - DNA, 103 bp, Artificial Sequence
  Synthetic Polynucleotide
taatacgactcactatagggcgttgctgctccggcggcgtggcgctctggaacagaggagaccagagatgcacgccgccaacctggcggcagcgcaaaagatg

SEQ ID NO: 137429 - DNA, 103 bp, Artificial Sequence
  Synthetic Polynucleotide
taatacgactcactataggggtcctctgcccgttgctgctccggcggcgtaacagaggagaacgccgatggagcagcaaaacctggcggcagcgcaaaagatg

SEQ ID NO: 137430 - DNA, 103 bp, Artificial Sequence
  Synthetic Polynucleotide
taatacgactcactatagggacctggtaatgtcctctgcccgttgctgctaacagaggagaagcagcatggggcagaggaacctggcggcagcgcaaaagatg

SEQ ID NO: 137431 - DNA, 103 bp, Artificial Sequence
  Synthetic Polynucleotide
taatacgactcactataggggactgtgttcagggatgtagctattttgcgaacagaggagacgcaaaatggctacatccaacctggcggcagcgcaaaagatg

SEQ ID NO: 137432 - DNA, 103 bp, Artificial Sequence
  Synthetic Polynucleotide
taatacgactcactatagggtaatattccggactgtgttcagggatgtagaacagaggagactacatatgtgaacacagaacctggcggcagcgcaaaagatg

SEQ ID NO: 137433 - DNA, 103 bp, Artificial Sequence
  Synthetic Polynucleotide
taatacgactcactatagggatagaatgaattggctacgtaggagctcataacagaggagaatgagcatgtacgtagccaacctggcggcagcgcaaaagatg

SEQ ID NO: 137434 - DNA, 103 bp, Artificial Sequence
  Synthetic Polynucleotide
taatacgactcactataggggtagcagtacctggatgcctgcacctctgaaacagaggagatcagagatgcaggcatccaacctggcggcagcgcaaaagatg

SEQ ID NO: 137435 - DNA, 103 bp, Artificial Sequence
  Synthetic Polynucleotide
taatacgactcactatagggccaatccgccgtagcagtacctggatgcctaacagaggagaaggcatatgggtactgctaacctggcggcagcgcaaaagatg

SEQ ID NO: 137436 - DNA, 103 bp, Artificial Sequence
  Synthetic Polynucleotide
taatacgactcactatagggatgcttaagtccaatccgccgtagcagtacaacagaggagagtactgatgcggcggattaacctggcggcagcgcaaaagatg

SEQ ID NO: 137437 - DNA, 103 bp, Artificial Sequence
  Synthetic Polynucleotide
taatacgactcactatagggtgggaaagtgatgcttaagtccaatccgccaacagaggagaggcggaatggacttaagcaacctggcggcagcgcaaaagatg

SEQ ID NO: 137438 - DNA, 103 bp, Artificial Sequence
  Synthetic Polynucleotide
taatacgactcactataggggcgcaggcggtgggaaagtgatgcttaagtaacagaggagaacttaaatgtcactttccaacctggcggcagcgcaaaagatg

SEQ ID NO: 137439 - DNA, 103 bp, Artificial Sequence
  Synthetic Polynucleotide
taatacgactcactataggggagttggaaggcgcaggcggtgggaaagtgaacagaggagacactttatgaccgcctgcaacctggcggcagcgcaaaagatg

SEQ ID NO: 137440 - DNA, 103 bp, Artificial Sequence
  Synthetic Polynucleotide
taatacgactcactatagggcccgtggagagagttggaaggcgcaggcggaacagaggagaccgcctatgccttccaacaacctggcggcagcgcaaaagatg

SEQ ID NO: 137441 - DNA, 103 bp, Artificial Sequence
  Synthetic Polynucleotide
taatacgactcactatagggccatgtctaccccgtggagagagttggaagaacagaggagacttccaatgctctccacgaacctggcggcagcgcaaaagatg

SEQ ID NO: 137442 - DNA, 103 bp, Artificial Sequence
  Synthetic Polynucleotide
taatacgactcactataggggggttggcagccatgtctaccccgtggagaaacagaggagatctccaatgggtagacataacctggcggcagcgcaaaagatg

SEQ ID NO: 137443 - DNA, 103 bp, Artificial Sequence
  Synthetic Polynucleotide
taatacgactcactataggggtgagcccgggggttggcagccatgtctacaacagaggagagtagacatggctgccaacaacctggcggcagcgcaaaagatg

SEQ ID NO: 137444 - DNA, 103 bp, Artificial Sequence
  Synthetic Polynucleotide
taatacgactcactatagggggctctgcttatagaatgaattggctacgtaacagaggagaacgtagatgattcattctaacctggcggcagcgcaaaagatg

SEQ ID NO: 137445 - DNA, 103 bp, Artificial Sequence
  Synthetic Polynucleotide
taatacgactcactatagggggcggtcggggtgagcccgggggttggcagaacagaggagactgccaatgcccgggctcaacctggcggcagcgcaaaagatg

SEQ ID NO: 137446 - DNA, 103 bp, Artificial Sequence
  Synthetic Polynucleotide
taatacgactcactatagggctgcaggcggggcggtcggggtgagcccggaacagaggagaccgggcatgccccgaccgaacctggcggcagcgcaaaagatg

SEQ ID NO: 137447 - DNA, 103 bp, Artificial Sequence
  Synthetic Polynucleotide
taatacgactcactatagggggccgcggcgctgcaggcggggcggtcgggaacagaggagacccgacatgcccgcctgcaacctggcggcagcgcaaaagatg

SEQ ID NO: 137448 - DNA, 103 bp, Artificial Sequence
  Synthetic Polynucleotide
taatacgactcactataggggtcccggagcggccgcggcgctgcaggcggaacagaggagaccgcctatggcgccgcggaacctggcggcagcgcaaaagatg

SEQ ID NO: 137449 - DNA, 103 bp, Artificial Sequence
  Synthetic Polynucleotide
taatacgactcactatagggcccggagcgtgtcccggagcggccgcggcgaacagaggagacgccgcatgcgctccgggaacctggcggcagcgcaaaagatg

SEQ ID NO: 137450 - DNA, 103 bp, Artificial Sequence
  Synthetic Polynucleotide
taatacgactcactatagggttcgtctctgcccggagcgtgtcccggagcaacagaggagagctccgatgcacgctccgaacctggcggcagcgcaaaagatg

SEQ ID NO: 137451 - DNA, 103 bp, Artificial Sequence
  Synthetic Polynucleotide
taatacgactcactataggggaggagccgcttcgtctctgcccggagcgtaacagaggagaacgctcatggcagagacgaacctggcggcagcgcaaaagatg

SEQ ID NO: 137452 - DNA, 103 bp, Artificial Sequence
  Synthetic Polynucleotide
taatacgactcactatagggccggggttcagaggagccgcttcgtctctgaacagaggagacagagaatgagcggctccaacctggcggcagcgcaaaagatg

SEQ ID NO: 137453 - DNA, 103 bp, Artificial Sequence
  Synthetic Polynucleotide
taatacgactcactatagggactgtacatcccggggttcagaggagccgcaacagaggagagcggctatgctgaaccccaacctggcggcagcgcaaaagatg

SEQ ID NO: 137454 - DNA, 103 bp, Artificial Sequence
  Synthetic Polynucleotide
taatacgactcactatagggccgccttctgactgtacatcccggggttcaaacagaggagatgaaccatgggatgtacaaacctggcggcagcgcaaaagatg

SEQ ID NO: 137455 - DNA, 103 bp, Artificial Sequence
  Synthetic Polynucleotide
taatacgactcactataggggggatattggggctctgcttatagaatgaaaacagaggagattcattatgtaagcagagaacctggcggcagcgcaaaagatg

SEQ ID NO: 137456 - DNA, 103 bp, Artificial Sequence
  Synthetic Polynucleotide
taatacgactcactataggggccgggcgagccgccttctgactgtacatcaacagaggagagatgtaatgtcagaaggcaacctggcggcagcgcaaaagatg

SEQ ID NO: 137457 - DNA, 103 bp, Artificial Sequence
  Synthetic Polynucleotide
taatacgactcactatagggctcctccagcgccgggcgagccgccttctgaacagaggagacagaagatggctcgcccgaacctggcggcagcgcaaaagatg

SEQ ID NO: 137458 - DNA, 103 bp, Artificial Sequence
  Synthetic Polynucleotide
taatacgactcactatagggtcttagctcgctcctccagcgccgggcgagaacagaggagactcgccatgcgctggaggaacctggcggcagcgcaaaagatg

SEQ ID NO: 137459 - DNA, 103 bp, Artificial Sequence
  Synthetic Polynucleotide
taatacgactcactatagggtccccactgctcttagctcgctcctccagcaacagaggagagctggaatggcgagctaaaacctggcggcagcgcaaaagatg

SEQ ID NO: 137460 - DNA, 103 bp, Artificial Sequence
  Synthetic Polynucleotide
taatacgactcactatagggctctttgatctccccactgctcttagctcgaacagaggagacgagctatgagcagtgggaacctggcggcagcgcaaaagatg

SEQ ID NO: 137461 - DNA, 103 bp, Artificial Sequence
  Synthetic Polynucleotide
taatacgactcactataggggcgcctgctcctctttgatctccccactgcaacagaggagagcagtgatgagatcaaagaacctggcggcagcgcaaaagatg

SEQ ID NO: 137462 - DNA, 103 bp, Artificial Sequence
  Synthetic Polynucleotide
taatacgactcactatagggtgccctgtctgcgcctgctcctctttgatcaacagaggagagatcaaatgggagcaggcaacctggcggcagcgcaaaagatg

SEQ ID NO: 137463 - DNA, 103 bp, Artificial Sequence
  Synthetic Polynucleotide
taatacgactcactatagggtccggcgggctgccctgtctgcgcctgctcaacagaggagagagcagatgcagacagggaacctggcggcagcgcaaaagatg

SEQ ID NO: 137464 - DNA, 103 bp, Artificial Sequence
  Synthetic Polynucleotide
taatacgactcactataggggctggctcagtccggcgggctgccctgtctaacagaggagaagacagatgagcccgccgaacctggcggcagcgcaaaagatg

SEQ ID NO: 137465 - DNA, 103 bp, Artificial Sequence
  Synthetic Polynucleotide
taatacgactcactatagggggggccggtggctggctcagtccggcgggcaacagaggagagcccgcatgactgagccaaacctggcggcagcgcaaaagatg

SEQ ID NO: 137466 - DNA, 103 bp, Artificial Sequence
  Synthetic Polynucleotide
taatacgactcactataggggttataggcagggatattggggctctgcttaacagaggagaaagcagatgcccaatatcaacctggcggcagcgcaaaagatg

SEQ ID NO: 137467 - DNA, 103 bp, Artificial Sequence
  Synthetic Polynucleotide
taatacgactcactatagggaatctgtggcggggccggtggctggctcagaacagaggagactgagcatgccaccggccaacctggcggcagcgcaaaagatg

SEQ ID NO: 137468 - DNA, 103 bp, Artificial Sequence
  Synthetic Polynucleotide
taatacgactcactatagggtccacgggtaaatctgtggcggggccggtgaacagaggagacaccggatgcgccacagaaacctggcggcagcgcaaaagatg

SEQ ID NO: 137469 - DNA, 103 bp, Artificial Sequence
  Synthetic Polynucleotide
taatacgactcactatagggagtttggtcatccacgggtaaatctgtggcaacagaggagagccacaatgttacccgtgaacctggcggcagcgcaaaagatg

SEQ ID NO: 137470 - DNA, 103 bp, Artificial Sequence
  Synthetic Polynucleotide
taatacgactcactataggggctcatgtgcagtttggtcatccacgggtaaacagaggagatacccgatgatgaccaaaaacctggcggcagcgcaaaagatg

SEQ ID NO: 137471 - DNA, 103 bp, Artificial Sequence
  Synthetic Polynucleotide
taatacgactcactatagggccgtctcgtggctcatgtgcagtttggtcaaacagaggagatgaccaatgtgcacatgaaacctggcggcagcgcaaaagatg

SEQ ID NO: 137472 - DNA, 103 bp, Artificial Sequence
  Synthetic Polynucleotide
taatacgactcactatagggcgcttgccgtccgtctcgtggctcatgtgcaacagaggagagcacatatgccacgagacaacctggcggcagcgcaaaagatg

SEQ ID NO: 137473 - DNA, 103 bp, Artificial Sequence
  Synthetic Polynucleotide
taatacgactcactatagggggttcgggaccgcttgccgtccgtctcgtgaacagaggagacacgagatggacggcaagaacctggcggcagcgcaaaagatg

SEQ ID NO: 137474 - DNA, 103 bp, Artificial Sequence
  Synthetic Polynucleotide
taatacgactcactataggggcgtgtaactggttcgggaccgcttgccgtaacagaggagaacggcaatgggtcccgaaaacctggcggcagcgcaaaagatg

SEQ ID NO: 137475 - DNA, 103 bp, Artificial Sequence
  Synthetic Polynucleotide
taatacgactcactataggggtctggtagcgcgtgtaactggttcgggacaacagaggagagtcccgatgcagttacacaacctggcggcagcgcaaaagatg

SEQ ID NO: 137476 - DNA, 103 bp, Artificial Sequence
  Synthetic Polynucleotide
taatacgactcactataggggagttccagagtctggtagcgcgtgtaactaacagaggagaagttacatgcgctaccagaacctggcggcagcgcaaaagatg

SEQ ID NO: 137477 - DNA, 103 bp, Artificial Sequence
  Synthetic Polynucleotide
taatacgactcactatagggaagtttgcatgttataggcagggatattggaacagaggagaccaataatgctgcctataaacctggcggcagcgcaaaagatg

SEQ ID NO: 137478 - DNA, 103 bp, Artificial Sequence
  Synthetic Polynucleotide
taatacgactcactatagggattctttctcgagttccagagtctggtagcaacagaggagagctaccatgctctggaacaacctggcggcagcgcaaaagatg

SEQ ID NO: 137479 - DNA, 103 bp, Artificial Sequence
  Synthetic Polynucleotide
taatacgactcactatagggttaaagtggaattctttctcgagttccagaaacagaggagatctggaatgcgagaaagaaacctggcggcagcgcaaaagatg

SEQ ID NO: 137480 - DNA, 103 bp, Artificial Sequence
  Synthetic Polynucleotide
taatacgactcactataggggaggtagcggttaaagtggaattctttctcaacagaggagagagaaaatgttccactttaacctggcggcagcgcaaaagatg

SEQ ID NO: 137481 - DNA, 103 bp, Artificial Sequence
  Synthetic Polynucleotide
taatacgactcactatagggtgcggcgagtgaggtagcggttaaagtggaaacagaggagatccactatgaccgctaccaacctggcggcagcgcaaaagatg

SEQ ID NO: 137482 - DNA, 103 bp, Artificial Sequence
  Synthetic Polynucleotide
taatacgactcactatagggtctatgcgcctgcggcgagtgaggtagcggaacagaggagaccgctaatgcactcgccgaacctggcggcagcgcaaaagatg

SEQ ID NO: 137483 - DNA, 103 bp, Artificial Sequence
  Synthetic Polynucleotide
taatacgactcactataggggttggcgatctctatgcgcctgcggcgagtaacagaggagaactcgcatgaggcgcataaacctggcggcagcgcaaaagatg

SEQ ID NO: 137484 - DNA, 103 bp, Artificial Sequence
  Synthetic Polynucleotide
taatacgactcactataggggacacaagttgttggcgatctctatgcgccaacagaggagaggcgcaatgagatcgccaaacctggcggcagcgcaaaagatg

SEQ ID NO: 137485 - DNA, 103 bp, Artificial Sequence
  Synthetic Polynucleotide
taatacgactcactatagggctctcattgagacacaagttgttggcgatcaacagaggagagatcgcatgcaacttgtgaacctggcggcagcgcaaaagatg

SEQ ID NO: 137486 - DNA, 103 bp, Artificial Sequence
  Synthetic Polynucleotide
taatacgactcactatagggcttgatctgtctctcattgagacacaagttaacagaggagaaacttgatgctcaatgagaacctggcggcagcgcaaaagatg

SEQ ID NO: 137487 - DNA, 103 bp, Artificial Sequence
  Synthetic Polynucleotide
taatacgactcactatagggggaaccagatcttgatctgtctctcattgaaacagaggagatcaatgatggacagatcaaacctggcggcagcgcaaaagatg

SEQ ID NO: 137488 - DNA, 103 bp, Artificial Sequence
  Synthetic Polynucleotide
taatacgactcactatagggtagttcccacaagtttgcatgttataggcaaacagaggagatgcctaatgcatgcaaacaacctggcggcagcgcaaaagatg

SEQ ID NO: 137489 - DNA, 103 bp, Artificial Sequence
  Synthetic Polynucleotide
taatacgactcactatagggctgcggttctggaaccagatcttgatctgtaacagaggagaacagatatggatctggttaacctggcggcagcgcaaaagatg

SEQ ID NO: 137490 - DNA, 103 bp, Artificial Sequence
  Synthetic Polynucleotide
taatacgactcactatagggccacttcatcctgcggttctggaaccagataacagaggagaatctggatgcagaaccgcaacctggcggcagcgcaaaagatg

SEQ ID NO: 137491 - DNA, 103 bp, Artificial Sequence
  Synthetic Polynucleotide
taatacgactcactatagggaatctttcttccacttcatcctgcggttctaacagaggagaagaaccatgggatgaagtaacctggcggcagcgcaaaagatg

SEQ ID NO: 137492 - DNA, 103 bp, Artificial Sequence
  Synthetic Polynucleotide
taatacgactcactatagggttcattttggaatctttcttccacttcatcaacagaggagagatgaaatggaagaaagaaacctggcggcagcgcaaaagatg

SEQ ID NO: 137493 - DNA, 103 bp, Artificial Sequence
  Synthetic Polynucleotide
taatacgactcactatagggctctttgcttttcattttggaatctttcttaacagaggagaaagaaaatgtccaaaatgaacctggcggcagcgcaaaagatg

SEQ ID NO: 137494 - DNA, 103 bp, Artificial Sequence
  Synthetic Polynucleotide
taatacgactcactatagggggccgatccatagttcccacaagtttgcataacagaggagaatgcaaatgtgtgggaacaacctggcggcagcgcaaaagatg

SEQ ID NO: 137495 - DNA, 103 bp, Artificial Sequence
  Synthetic Polynucleotide
taatacgactcactataggggcacctctgaggccgatccatagttcccacaacagaggagagtgggaatgatggatcggaacctggcggcagcgcaaaagatg

SEQ ID NO: 137496 - DNA, 103 bp, Artificial Sequence
  Synthetic Polynucleotide
taatacgactcactatagggctggatgcctgcacctctgaggccgatccaaacagaggagatggatcatgctcagaggtaacctggcggcagcgcaaaagatg

SEQ ID NO: 137497 - DNA, 103 bp, Artificial Sequence
  Synthetic Polynucleotide
taatacgactcactatagggtaaggaagggttagtgaagtaggaattcataacagaggagaatgaatatgtacttcactaacctggcggcagcgcaaaagatg

SEQ ID NO: 137498 - DNA, 103 bp, Artificial Sequence
  Synthetic Polynucleotide
taatacgactcactatagggataggtcgagaaatgcctcactggatcataaacagaggagatatgatatggtgaggcataacctggcggcagcgcaaaagatg

SEQ ID NO: 137499 - DNA, 103 bp, Artificial Sequence
  Synthetic Polynucleotide
taatacgactcactatagggcggccgctccataggtcgagaaatgcctcaaacagaggagatgaggcatgtctcgacctaacctggcggcagcgcaaaagatg

SEQ ID NO: 137500 - DNA, 103 bp, Artificial Sequence
  Synthetic Polynucleotide
taatacgactcactatagggttctgggcaacggccgctccataggtcgagaacagaggagactcgacatgtggagcggcaacctggcggcagcgcaaaagatg

SEQ ID NO: 137501 - DNA, 103 bp, Artificial Sequence
  Synthetic Polynucleotide
taatacgactcactataggggtagatccggttctgggcaacggccgctccaacagaggagaggagcgatggttgcccagaacctggcggcagcgcaaaagatg

SEQ ID NO: 137502 - DNA, 103 bp, Artificial Sequence
  Synthetic Polynucleotide
taatacgactcactatagggagggagtcgagtagatccggttctgggcaaaacagaggagattgcccatgaccggatctaacctggcggcagcgcaaaagatg

SEQ ID NO: 137503 - DNA, 103 bp, Artificial Sequence
  Synthetic Polynucleotide
taatacgactcactatagggggcgaataaaagggagtcgagtagatccggaacagaggagaccggatatgctcgactccaacctggcggcagcgcaaaagatg

SEQ ID NO: 137504 - DNA, 103 bp, Artificial Sequence
  Synthetic Polynucleotide
taatacgactcactatagggattctcctgtggcgaataaaagggagtcgaaacagaggagatcgactatgttttattcgaacctggcggcagcgcaaaagatg

SEQ ID NO: 137505 - DNA, 103 bp, Artificial Sequence
  Synthetic Polynucleotide
taatacgactcactatagggtgaacacgacattctcctgtggcgaataaaaacagaggagatttattatgcacaggagaaacctggcggcagcgcaaaagatg

SEQ ID NO: 137506 - DNA, 103 bp, Artificial Sequence
  Synthetic Polynucleotide
taatacgactcactatagggcggctggaactgaacacgacattctcctgtaacagaggagaacaggaatgtgtcgtgttaacctggcggcagcgcaaaagatg

SEQ ID NO: 137507 - DNA, 103 bp, Artificial Sequence
  Synthetic Polynucleotide
taatacgactcactatagggatacggcccccggctggaactgaacacgacaacagaggagagtcgtgatgagttccagcaacctggcggcagcgcaaaagatg

SEQ ID NO: 137508 - DNA, 103 bp, Artificial Sequence
  Synthetic Polynucleotide
taatacgactcactatagggggtggcaggataaggaagggttagtgaagtaacagaggagaacttcaatgacccttcctaacctggcggcagcgcaaaagatg

SEQ ID NO: 137509 - DNA, 103 bp, Artificial Sequence
  Synthetic Polynucleotide
taatacgactcactatagggatccatagtcatacggcccccggctggaacaacagaggagagttccaatggggggccgtaacctggcggcagcgcaaaagatg

SEQ ID NO: 137510 - DNA, 103 bp, Artificial Sequence
  Synthetic Polynucleotide
taatacgactcactatagggaaggaattagatccatagtcatacggccccaacagaggagaggggccatgtgactatggaacctggcggcagcgcaaaagatg

SEQ ID NO: 137511 - DNA, 103 bp, Artificial Sequence
  Synthetic Polynucleotide
taatacgactcactatagggctcctggtaaaaggaattagatccatagtcaacagaggagagactatatgtctaattccaacctggcggcagcgcaaaagatg

SEQ ID NO: 137512 - DNA, 103 bp, Artificial Sequence
  Synthetic Polynucleotide
taatacgactcactataggggcatgtctttctcctggtaaaaggaattagaacagaggagactaattatgtttaccaggaacctggcggcagcgcaaaagatg

SEQ ID NO: 137513 - DNA, 103 bp, Artificial Sequence
  Synthetic Polynucleotide
taatacgactcactatagggcagtttgagagcatgtctttctcctggtaaaacagaggagattaccaatggaaagacataacctggcggcagcgcaaaagatg

SEQ ID NO: 137514 - DNA, 103 bp, Artificial Sequence
  Synthetic Polynucleotide
taatacgactcactataggggttttgtctgcagtttgagagcatgtctttaacagaggagaaaagacatgctctcaaacaacctggcggcagcgcaaaagatg

SEQ ID NO: 137515 - DNA, 103 bp, Artificial Sequence
  Synthetic Polynucleotide
taatacgactcactataggggtcctaaggtgttttgtctgcagtttgagaaacagaggagatctcaaatggcagacaaaaacctggcggcagcgcaaaagatg

SEQ ID NO: 137516 - DNA, 103 bp, Artificial Sequence
  Synthetic Polynucleotide
taatacgactcactatagggtgtgtgttatgtcctaaggtgttttgtctgaacagaggagacagacaatgcaccttaggaacctggcggcagcgcaaaagatg

SEQ ID NO: 137517 - DNA, 103 bp, Artificial Sequence
  Synthetic Polynucleotide
taatacgactcactataggggattgaggtctgtgtgttatgtcctaaggtaacagaggagaaccttaatgcataacacaaacctggcggcagcgcaaaagatg

SEQ ID NO: 137518 - DNA, 103 bp, Artificial Sequence
  Synthetic Polynucleotide
taatacgactcactatagggaatcctgagcgattgaggtctgtgtgttataacagaggagaataacaatgagacctcaaaacctggcggcagcgcaaaagatg

SEQ ID NO: 137519 - DNA, 103 bp, Artificial Sequence
  Synthetic Polynucleotide
taatacgactcactatagggcccccggcgaggtggcaggataaggaagggaacagaggagacccttcatgatcctgccaaacctggcggcagcgcaaaagatg

SEQ ID NO: 137520 - DNA, 103 bp, Artificial Sequence
  Synthetic Polynucleotide
taatacgactcactatagggtcagaactaaaatcctgagcgattgaggtcaacagaggagagacctcatgcgctcaggaaacctggcggcagcgcaaaagatg

SEQ ID NO: 137521 - DNA, 103 bp, Artificial Sequence
  Synthetic Polynucleotide
taatacgactcactatagggcctgccctgctcagaactaaaatcctgagcaacagaggagagctcagatgtttagttctaacctggcggcagcgcaaaagatg

SEQ ID NO: 137522 - DNA, 103 bp, Artificial Sequence
  Synthetic Polynucleotide
taatacgactcactatagggggggcgcagtcctgccctgctcagaactaaaacagaggagattagttatgagcagggcaaacctggcggcagcgcaaaagatg

SEQ ID NO: 137523 - DNA, 103 bp, Artificial Sequence
  Synthetic Polynucleotide
taatacgactcactatagggttctggtcctggggcgcagtcctgccctgcaacagaggagagcagggatggactgcgccaacctggcggcagcgcaaaagatg

SEQ ID NO: 137524 - DNA, 103 bp, Artificial Sequence
  Synthetic Polynucleotide
taatacgactcactataggggatactggctttctggtcctggggcgcagtaacagaggagaactgcgatgcaggaccagaacctggcggcagcgcaaaagatg

SEQ ID NO: 137525 - DNA, 103 bp, Artificial Sequence
  Synthetic Polynucleotide
taatacgactcactatagggggtaaatctggatactggctttctggtcctaacagaggagaaggaccatgaagccagtaaacctggcggcagcgcaaaagatg

SEQ ID NO: 137526 - DNA, 103 bp, Artificial Sequence
  Synthetic Polynucleotide
taatacgactcactatagggtgcatccaggggtaaatctggatactggctaacagaggagaagccagatgccagatttaaacctggcggcagcgcaaaagatg

SEQ ID NO: 137527 - DNA, 103 bp, Artificial Sequence
  Synthetic Polynucleotide
taatacgactcactatagggattcattcgctgcatccaggggtaaatctgaacagaggagacagattatgccctggatgaacctggcggcagcgcaaaagatg

SEQ ID NO: 137528 - DNA, 103 bp, Artificial Sequence
  Synthetic Polynucleotide
taatacgactcactatagggcactgtgcgaattcattcgctgcatccaggaacagaggagacctggaatgagcgaatgaaacctggcggcagcgcaaaagatg

SEQ ID NO: 137529 - DNA, 103 bp, Artificial Sequence
  Synthetic Polynucleotide
taatacgactcactatagggtagccgaccccactgtgcgaattcattcgcaacagaggagagcgaatatgttcgcacagaacctggcggcagcgcaaaagatg

SEQ ID NO: 137530 - DNA, 103 bp, Artificial Sequence
  Synthetic Polynucleotide
taatacgactcactataggggacgtcctggcccccggcgaggtggcaggaaacagaggagatcctgcatgctcgccgggaacctggcggcagcgcaaaagatg

SEQ ID NO: 137531 - DNA, 103 bp, Artificial Sequence
  Synthetic Polynucleotide
taatacgactcactataggggtccgctccgtagccgaccccactgtgcgaaacagaggagatcgcacatgggggtcggcaacctggcggcagcgcaaaagatg

SEQ ID NO: 137532 - DNA, 103 bp, Artificial Sequence
  Synthetic Polynucleotide
taatacgactcactatagggcgcgcctccggtccgctccgtagccgacccaacagaggagagggtcgatgacggagcggaacctggcggcagcgcaaaagatg

SEQ ID NO: 137533 - DNA, 103 bp, Artificial Sequence
  Synthetic Polynucleotide
taatacgactcactatagggatctggcggccgcgcctccggtccgctccgaacagaggagacggagcatgccggaggcgaacctggcggcagcgcaaaagatg

SEQ ID NO: 137534 - DNA, 103 bp, Artificial Sequence
  Synthetic Polynucleotide
taatacgactcactatagggccgcgagtagatctggcggccgcgcctccgaacagaggagacggaggatgggccgccagaacctggcggcagcgcaaaagatg

SEQ ID NO: 137535 - DNA, 103 bp, Artificial Sequence
  Synthetic Polynucleotide
taatacgactcactataggggggtctggtaccgcgagtagatctggcggcaacagaggagagccgccatgtctactcgcaacctggcggcagcgcaaaagatg

SEQ ID NO: 137536 - DNA, 103 bp, Artificial Sequence
  Synthetic Polynucleotide
taatacgactcactatagggtccagttccagggtctggtaccgcgagtagaacagaggagactactcatggtaccagacaacctggcggcagcgcaaaagatg

SEQ ID NO: 137537 - DNA, 103 bp, Artificial Sequence
  Synthetic Polynucleotide
taatacgactcactatagggaaattccttctccagttccagggtctggtaaacagaggagataccagatgctggaactgaacctggcggcagcgcaaaagatg

SEQ ID NO: 137538 - DNA, 103 bp, Artificial Sequence
  Synthetic Polynucleotide
taatacgactcactataggggattgaagtgaaattccttctccagttccaaacagaggagatggaacatgagaaggaataacctggcggcagcgcaaaagatg

SEQ ID NO: 137539 - DNA, 103 bp, Artificial Sequence
  Synthetic Polynucleotide
taatacgactcactataggggttaggtagcgattgaagtgaaattccttcaacagaggagagaaggaatgtcacttcaaaacctggcggcagcgcaaaagatg

SEQ ID NO: 137540 - DNA, 103 bp, Artificial Sequence
  Synthetic Polynucleotide
taatacgactcactatagggccggcgccgcgttaggtagcgattgaagtgaacagaggagacacttcatgcgctacctaaacctggcggcagcgcaaaagatg

SEQ ID NO: 137541 - DNA, 103 bp, Artificial Sequence
  Synthetic Polynucleotide
taatacgactcactatagggcgttggggaggacgtcctggcccccggcgaaacagaggagatcgccgatggccaggacgaacctggcggcagcgcaaaagatg

SEQ ID NO: 137542 - DNA, 103 bp, Artificial Sequence
  Synthetic Polynucleotide
taatacgactcactatagggtctcgatgcgccggcgccgcgttaggtagcaacagaggagagctaccatgcgcggcgccaacctggcggcagcgcaaaagatg

SEQ ID NO: 137543 - DNA, 103 bp, Artificial Sequence
  Synthetic Polynucleotide
taatacgactcactataggggcgttggcgatctcgatgcgccggcgccgcaacagaggagagcggcgatggcgcatcgaaacctggcggcagcgcaaaagatg

SEQ ID NO: 137544 - DNA, 103 bp, Artificial Sequence
  Synthetic Polynucleotide
taatacgactcactatagggcaggcaaagcgcgttggcgatctcgatgcgaacagaggagacgcatcatgatcgccaacaacctggcggcagcgcaaaagatg

SEQ ID NO: 137545 - DNA, 103 bp, Artificial Sequence
  Synthetic Polynucleotide
taatacgactcactataggggtcgctcggtcaggcaaagcgcgttggcgaaacagaggagatcgccaatgcgctttgccaacctggcggcagcgcaaaagatg

SEQ ID NO: 137546 - DNA, 103 bp, Artificial Sequence
  Synthetic Polynucleotide
taatacgactcactatagggattttgatctgtcgctcggtcaggcaaagcaacagaggagagctttgatggaccgagcgaacctggcggcagcgcaaaagatg

SEQ ID NO: 137547 - DNA, 103 bp, Artificial Sequence
  Synthetic Polynucleotide
taatacgactcactatagggctggaaccagattttgatctgtcgctcggtaacagaggagaaccgagatgcagatcaaaaacctggcggcagcgcaaaagatg

SEQ ID NO: 137548 - DNA, 103 bp, Artificial Sequence
  Synthetic Polynucleotide
taatacgactcactatagggtccggcggttctggaaccagattttgatctaacagaggagaagatcaatgtctggttccaacctggcggcagcgcaaaagatg

SEQ ID NO: 137549 - DNA, 103 bp, Artificial Sequence
  Synthetic Polynucleotide
taatacgactcactatagggttccacttcatccggcggttctggaaccagaacagaggagactggttatggaaccgccgaacctggcggcagcgcaaaagatg

SEQ ID NO: 137550 - DNA, 103 bp, Artificial Sequence
  Synthetic Polynucleotide
taatacgactcactatagggagattcttttttccacttcatccggcggttaacagaggagaaaccgcatgatgaagtggaacctggcggcagcgcaaaagatg

SEQ ID NO: 137551 - DNA, 103 bp, Artificial Sequence
  Synthetic Polynucleotide
taatacgactcactatagggatgtgagattagattcttttttccacttcaaacagaggagatgaagtatgaaaaagaataacctggcggcagcgcaaaagatg

SEQ ID NO: 137552 - DNA, 103 bp, Artificial Sequence
  Synthetic Polynucleotide
taatacgactcactatagggttgagggcgacgttggggaggacgtcctggaacagaggagaccaggaatgcctccccaaaacctggcggcagcgcaaaagatg

SEQ ID NO: 137553 - DNA, 103 bp, Artificial Sequence
  Synthetic Polynucleotide
taatacgactcactataggggagagagtggatgtgagattagattcttttaacagaggagaaaaagaatgtaatctcacaacctggcggcagcgcaaaagatg

SEQ ID NO: 137554 - DNA, 103 bp, Artificial Sequence
  Synthetic Polynucleotide
taatacgactcactataggggccgccccccgagagagtggatgtgagattaacagaggagaaatctcatgtccactctcaacctggcggcagcgcaaaagatg

SEQ ID NO: 137555 - DNA, 103 bp, Artificial Sequence
  Synthetic Polynucleotide
taatacgactcactatagggtggcccctccgccgccccccgagagagtggaacagaggagaccactcatgcggggggcgaacctggcggcagcgcaaaagatg

SEQ ID NO: 137556 - DNA, 103 bp, Artificial Sequence
  Synthetic Polynucleotide
taatacgactcactatagggctgtcggcggtggcccctccgccgccccccaacagaggagaggggggatgcggaggggcaacctggcggcagcgcaaaagatg

SEQ ID NO: 137557 - DNA, 103 bp, Artificial Sequence
  Synthetic Polynucleotide
taatacgactcactatagggtccgcccaggctgtcggcggtggcccctccaacagaggagaggagggatgaccgccgacaacctggcggcagcgcaaaagatg

SEQ ID NO: 137558 - DNA, 103 bp, Artificial Sequence
  Synthetic Polynucleotide
taatacgactcactatagggtttcctcttttccgcccaggctgtcggcggaacagaggagaccgccgatggcctgggcgaacctggcggcagcgcaaaagatg

SEQ ID NO: 137559 - DNA, 103 bp, Artificial Sequence
  Synthetic Polynucleotide
taatacgactcactatagggtcttcccgcttttcctcttttccgcccaggaacagaggagacctgggatgaaaagaggaaacctggcggcagcgcaaaagatg

SEQ ID NO: 137560 - DNA, 103 bp, Artificial Sequence
  Synthetic Polynucleotide
taatacgactcactatagggctcttctgtctcttcccgcttttcctctttaacagaggagaaaagagatgaagcgggaaaacctggcggcagcgcaaaagatg

SEQ ID NO: 137561 - DNA, 103 bp, Artificial Sequence
  Synthetic Polynucleotide
taatacgactcactatagggtctgcttctcctcttctgtctcttcccgctaacagaggagaagcgggatgagacagaagaacctggcggcagcgcaaaagatg

SEQ ID NO: 137562 - DNA, 103 bp, Artificial Sequence
  Synthetic Polynucleotide
taatacgactcactatagggggcggtggaattgagggcgacgttggggagaacagaggagactccccatggtcgccctcaacctggcggcagcgcaaaagatg

SEQ ID NO: 137563 - DNA, 103 bp, Artificial Sequence
  Synthetic Polynucleotide
taatacgactcactatagggctggatcataggcggtggaattgagggcgaaacagaggagatcgcccatgattccaccgaacctggcggcagcgcaaaagatg

SEQ ID NO: 137564 - DNA, 103 bp, Artificial Sequence
  Synthetic Polynucleotide
taatacgactcactatagggaaatgcctcactggatcataggcggtggaaaacagaggagattccacatgctatgatccaacctggcggcagcgcaaaagatg

SEQ ID NO: 137565 - DNA, 103 bp, Artificial Sequence
  Synthetic Polynucleotide
taatacgactcactatagggagcagcaggagagctgttgggaaaggacataacagaggagaatgtccatgcccaacagcaacctggcggcagcgcaaaagatg

SEQ ID NO: 137566 - DNA, 103 bp, Artificial Sequence
  Synthetic Polynucleotide
taatacgactcactataggggctaggtggtggcatgtacatgctggcgctaacagaggagaagcgccatgatgtacatgaacctggcggcagcgcaaaagatg

SEQ ID NO: 137567 - DNA, 103 bp, Artificial Sequence
  Synthetic Polynucleotide
taatacgactcactatagggagaaaacgtgaggttggcggtcagttctcgaacagaggagacgagaaatgaccgccaacaacctggcggcagcgcaaaagatg

SEQ ID NO: 137568 - DNA, 103 bp, Artificial Sequence
  Synthetic Polynucleotide
taatacgactcactatagggccatgtctgcgctaggtggtggcatgtacaaacagaggagatgtacaatgcaccacctaaacctggcggcagcgcaaaagatg

SEQ ID NO: 137569 - DNA, 103 bp, Artificial Sequence
  Synthetic Polynucleotide
taatacgactcactatagggccataggtccccatgtctgcgctaggtggtaacagaggagaaccaccatgcgcagacataacctggcggcagcgcaaaagatg

SEQ ID NO: 137570 - DNA, 103 bp, Artificial Sequence
  Synthetic Polynucleotide
taatacgactcactatagggggtttgcattccataggtccccatgtctgcaacagaggagagcagacatggggacctataacctggcggcagcgcaaaagatg

SEQ ID NO: 137571 - DNA, 103 bp, Artificial Sequence
  Synthetic Polynucleotide
taatacgactcactataggggcagtccacaggtttgcattccataggtccaacagaggagaggacctatggaatgcaaaaacctggcggcagcgcaaaagatg

SEQ ID NO: 137572 - DNA, 103 bp, Artificial Sequence
  Synthetic Polynucleotide
taatacgactcactatagggagagacgggagcagtccacaggtttgcattaacagaggagaaatgcaatgctgtggactaacctggcggcagcgcaaaagatg

SEQ ID NO: 137573 - DNA, 103 bp, Artificial Sequence
  Synthetic Polynucleotide
taatacgactcactatagggtcttttggccagagacgggagcagtccacaaacagaggagatgtggaatgctcccgtctaacctggcggcagcgcaaaagatg

SEQ ID NO: 137574 - DNA, 103 bp, Artificial Sequence
  Synthetic Polynucleotide
taatacgactcactatagggggttcacttctcttttggccagagacgggaaacagaggagatcccgtatgtggccaaaaaacctggcggcagcgcaaaagatg

SEQ ID NO: 137575 - DNA, 103 bp, Artificial Sequence
  Synthetic Polynucleotide
taatacgactcactatagggatattttggtggttcacttctcttttggccaacagaggagaggccaaatgagaagtgaaaacctggcggcagcgcaaaagatg

SEQ ID NO: 137576 - DNA, 103 bp, Artificial Sequence
  Synthetic Polynucleotide
taatacgactcactatagggattcatacccatattttggtggttcacttcaacagaggagagaagtgatgcaccaaaataacctggcggcagcgcaaaagatg

SEQ ID NO: 137577 - DNA, 103 bp, Artificial Sequence
  Synthetic Polynucleotide
taatacgactcactatagggaaaaagtattagcagcaggagagctgttggaacagaggagaccaacaatgctcctgctgaacctggcggcagcgcaaaagatg

SEQ ID NO: 137578 - DNA, 103 bp, Artificial Sequence
  Synthetic Polynucleotide
taatacgactcactatagggaaggatgcacattcatacccatattttggtaacagaggagaaccaaaatgtgggtatgaaacctggcggcagcgcaaaagatg

SEQ ID NO: 137579 - DNA, 103 bp, Artificial Sequence
  Synthetic Polynucleotide
taatacgactcactatagggtgaggtatataaggatgcacattcatacccaacagaggagagggtatatgtgtgcatccaacctggcggcagcgcaaaagatg

SEQ ID NO: 137580 - DNA, 103 bp, Artificial Sequence
  Synthetic Polynucleotide
taatacgactcactatagggactgtctacttgaggtatataaggatgcacaacagaggagagtgcatatgtatatacctaacctggcggcagcgcaaaagatg

SEQ ID NO: 137581 - DNA, 103 bp, Artificial Sequence
  Synthetic Polynucleotide
taatacgactcactataggggatctgtccaactgtctacttgaggtatataacagaggagaatatacatgaagtagacaaacctggcggcagcgcaaaagatg

SEQ ID NO: 137582 - DNA, 103 bp, Artificial Sequence
  Synthetic Polynucleotide
taatacgactcactataggggatctgttcggatctgtccaactgtctactaacagaggagaagtagaatgttggacagaaacctggcggcagcgcaaaagatg

SEQ ID NO: 137583 - DNA, 103 bp, Artificial Sequence
  Synthetic Polynucleotide
taatacgactcactatagggtattcgacaagatctgttcggatctgtccaaacagaggagatggacaatgccgaacagaaacctggcggcagcgcaaaagatg

SEQ ID NO: 137584 - DNA, 103 bp, Artificial Sequence
  Synthetic Polynucleotide
taatacgactcactatagggcaggttgctctattcgacaagatctgttcgaacagaggagacgaacaatgcttgtcgaaaacctggcggcagcgcaaaagatg

SEQ ID NO: 137585 - DNA, 103 bp, Artificial Sequence
  Synthetic Polynucleotide
taatacgactcactatagggtgctgtgtaacaggttgctctattcgacaaaacagaggagattgtcgatgagagcaaccaacctggcggcagcgcaaaagatg

SEQ ID NO: 137586 - DNA, 103 bp, Artificial Sequence
  Synthetic Polynucleotide
taatacgactcactatagggagtggggacttgctgtgtaacaggttgctcaacagaggagagagcaaatggttacacagaacctggcggcagcgcaaaagatg

SEQ ID NO: 137587 - DNA, 103 bp, Artificial Sequence
  Synthetic Polynucleotide
taatacgactcactatagggtgaaggagcaagtggggacttgctgtgtaaaacagaggagattacacatgaagtccccaaacctggcggcagcgcaaaagatg

SEQ ID NO: 137588 - DNA, 103 bp, Artificial Sequence
  Synthetic Polynucleotide
taatacgactcactataggggaatctactaaaaaagtattagcagcaggaaacagaggagatcctgcatgtaatactttaacctggcggcagcgcaaaagatg

SEQ ID NO: 137589 - DNA, 103 bp, Artificial Sequence
  Synthetic Polynucleotide
taatacgactcactatagggatgttggtggtgaaggagcaagtggggactaacagaggagaagtcccatgttgctccttaacctggcggcagcgcaaaagatg

SEQ ID NO: 137590 - DNA, 103 bp, Artificial Sequence
  Synthetic Polynucleotide
taatacgactcactatagggttcttccttaatgttggtggtgaaggagcaaacagaggagatgctccatgaccaccaacaacctggcggcagcgcaaaagatg

SEQ ID NO: 137591 - DNA, 103 bp, Artificial Sequence
  Synthetic Polynucleotide
taatacgactcactatagggagcaattggattcttccttaatgttggtggaacagaggagaccaccaatgttaaggaagaacctggcggcagcgcaaaagatg

SEQ ID NO: 137592 - DNA, 103 bp, Artificial Sequence
  Synthetic Polynucleotide
taatacgactcactataggggaatacatgcagcaattggattcttccttaaacagaggagataaggaatgatccaattgaacctggcggcagcgcaaaagatg

SEQ ID NO: 137593 - DNA, 103 bp, Artificial Sequence
  Synthetic Polynucleotide
taatacgactcactataggggcgcttatcagaatacatgcagcaattggaaacagaggagatccaatatgtgcatgtataacctggcggcagcgcaaaagatg

SEQ ID NO: 137594 - DNA, 103 bp, Artificial Sequence
  Synthetic Polynucleotide
taatacgactcactatagggtgagtttgttgcgcttatcagaatacatgcaacagaggagagcatgtatgctgataagcaacctggcggcagcgcaaaagatg

SEQ ID NO: 137595 - DNA, 103 bp, Artificial Sequence
  Synthetic Polynucleotide
taatacgactcactatagggtcggccgaaatgagtttgttgcgcttatcaaacagaggagatgataaatgcaacaaactaacctggcggcagcgcaaaagatg

SEQ ID NO: 137596 - DNA, 103 bp, Artificial Sequence
  Synthetic Polynucleotide
taatacgactcactatagggcgaagggacctcggccgaaatgagtttgttaacagaggagaaacaaaatgatttcggccaacctggcggcagcgcaaaagatg

SEQ ID NO: 137597 - DNA, 103 bp, Artificial Sequence
  Synthetic Polynucleotide
taatacgactcactataggggcctctggtacgaagggacctcggccgaaaaacagaggagatttcggatgaggtcccttaacctggcggcagcgcaaaagatg

SEQ ID NO: 137598 - DNA, 103 bp, Artificial Sequence
  Synthetic Polynucleotide
taatacgactcactatagggtcagggaccagcctctggtacgaagggaccaacagaggagaggtcccatggtaccagagaacctggcggcagcgcaaaagatg

SEQ ID NO: 137599 - DNA, 103 bp, Artificial Sequence
  Synthetic Polynucleotide
taatacgactcactatagggactgatcaaggaatctactaaaaaagtattaacagaggagaaatactatgttagtagataacctggcggcagcgcaaaagatg

SEQ ID NO: 137600 - DNA, 103 bp, Artificial Sequence
  Synthetic Polynucleotide
taatacgactcactataggggggacaagactcagggaccagcctctggtaaacagaggagataccagatgctggtccctaacctggcggcagcgcaaaagatg

SEQ ID NO: 137601 - DNA, 103 bp, Artificial Sequence
  Synthetic Polynucleotide
taatacgactcactatagggggttctcaacgggacaagactcagggaccaaacagaggagatggtccatgagtcttgtcaacctggcggcagcgcaaaagatg

SEQ ID NO: 137602 - DNA, 103 bp, Artificial Sequence
  Synthetic Polynucleotide
taatacgactcactatagggggaacctcagggttctcaacgggacaagacaacagaggagagtcttgatgcgttgagaaaacctggcggcagcgcaaaagatg

SEQ ID NO: 137603 - DNA, 103 bp, Artificial Sequence
  Synthetic Polynucleotide
taatacgactcactatagggtccagggacgggaacctcagggttctcaacaacagaggagagttgagatgcctgaggttaacctggcggcagcgcaaaagatg

SEQ ID NO: 137604 - DNA, 103 bp, Artificial Sequence
  Synthetic Polynucleotide
taatacgactcactataggggtctaaaatatccagggacgggaacctcagaacagaggagactgaggatgccgtccctgaacctggcggcagcgcaaaagatg

SEQ ID NO: 137605 - DNA, 103 bp, Artificial Sequence
  Synthetic Polynucleotide
taatacgactcactataggggtctgactcagtctaaaatatccagggacgaacagaggagacgtcccatgatattttagaacctggcggcagcgcaaaagatg

SEQ ID NO: 137606 - DNA, 103 bp, Artificial Sequence
  Synthetic Polynucleotide
taatacgactcactatagggggtggcgtaggtctgactcagtctaaaataaacagaggagatattttatgctgagtcagaacctggcggcagcgcaaaagatg

SEQ ID NO: 137607 - DNA, 103 bp, Artificial Sequence
  Synthetic Polynucleotide
taatacgactcactataggggggttttcccggtggcgtaggtctgactcaaacagaggagatgagtcatgcctacgccaaacctggcggcagcgcaaaagatg

SEQ ID NO: 137608 - DNA, 103 bp, Artificial Sequence
  Synthetic Polynucleotide
taatacgactcactatagggttgtactcttgggttttcccggtggcgtagaacagaggagactacgcatgcgggaaaacaacctggcggcagcgcaaaagatg

SEQ ID NO: 137609 - DNA, 103 bp, Artificial Sequence
  Synthetic Polynucleotide
taatacgactcactatagggggggctattattgtactcttgggttttcccaacagaggagagggaaaatgcaagagtacaacctggcggcagcgcaaaagatg

SEQ ID NO: 137610 - DNA, 103 bp, Artificial Sequence
  Synthetic Polynucleotide
taatacgactcactatagggtcctgcaggcactgatcaaggaatctactaaacagaggagatagtagatgccttgatcaaacctggcggcagcgcaaaagatg

SEQ ID NO: 137611 - DNA, 103 bp, Artificial Sequence
  Synthetic Polynucleotide
taatacgactcactatagggagctgccttcggggctattattgtactcttaacagaggagaaagagtatgataatagccaacctggcggcagcgcaaaagatg

SEQ ID NO: 137612 - DNA, 103 bp, Artificial Sequence
  Synthetic Polynucleotide
taatacgactcactatagggatgacagtggagctgccttcggggctattaaacagaggagataatagatgcgaaggcagaacctggcggcagcgcaaaagatg

SEQ ID NO: 137613 - DNA, 103 bp, Artificial Sequence
  Synthetic Polynucleotide
taatacgactcactataggggagctggagcatgacagtggagctgccttcaacagaggagagaaggcatgtccactgtcaacctggcggcagcgcaaaagatg

SEQ ID NO: 137614 - DNA, 103 bp, Artificial Sequence
  Synthetic Polynucleotide
taatacgactcactatagggcacgagggttgagctggagcatgacagtggaacagaggagaccactgatgtgctccagcaacctggcggcagcgcaaaagatg

SEQ ID NO: 137615 - DNA, 103 bp, Artificial Sequence
  Synthetic Polynucleotide
taatacgactcactatagggttggccgcgccacgagggttgagctggagcaacagaggagagctccaatgcaaccctcgaacctggcggcagcgcaaaagatg

SEQ ID NO: 137616 - DNA, 103 bp, Artificial Sequence
  Synthetic Polynucleotide
taatacgactcactataggggagctgcggcttggccgcgccacgagggttaacagaggagaaaccctatgggcgcggccaacctggcggcagcgcaaaagatg

SEQ ID NO: 137617 - DNA, 103 bp, Artificial Sequence
  Synthetic Polynucleotide
taatacgactcactataggggggcagcggagagctgcggcttggccgcgcaacagaggagagcgcggatgagccgcagcaacctggcggcagcgcaaaagatg

SEQ ID NO: 137618 - DNA, 103 bp, Artificial Sequence
  Synthetic Polynucleotide
taatacgactcactatagggatctgcagctgggcagcggagagctgcggcaacagaggagagccgcaatgctccgctgcaacctggcggcagcgcaaaagatg

SEQ ID NO: 137619 - DNA, 103 bp, Artificial Sequence
  Synthetic Polynucleotide
taatacgactcactatagggcttcttttccatctgcagctgggcagcggaaacagaggagatccgctatgcagctgcagaacctggcggcagcgcaaaagatg

SEQ ID NO: 137620 - DNA, 103 bp, Artificial Sequence
  Synthetic Polynucleotide
taatacgactcactataggggctcgttcatcttcttttccatctgcagctaacagaggagaagctgcatgtggaaaagaaacctggcggcagcgcaaaagatg

SEQ ID NO: 137621 - DNA, 103 bp, Artificial Sequence
  Synthetic Polynucleotide
taatacgactcactatagggaaactgtcactcctgcaggcactgatcaagaacagaggagacttgatatgtgcctgcagaacctggcggcagcgcaaaagatg

SEQ ID NO: 137622 - DNA, 103 bp, Artificial Sequence
  Synthetic Polynucleotide
taatacgactcactatagggccgctcacgggctcgttcatcttcttttccaacagaggagaggaaaaatggatgaacgaaacctggcggcagcgcaaaagatg

SEQ ID NO: 137623 - DNA, 103 bp, Artificial Sequence
  Synthetic Polynucleotide
taatacgactcactataggggggctcctggccgctcacgggctcgttcataacagaggagaatgaacatgcccgtgagcaacctggcggcagcgcaaaagatg

SEQ ID NO: 137624 - DNA, 103 bp, Artificial Sequence
  Synthetic Polynucleotide
taatacgactcactatagggagactttggtgggctcctggccgctcacggaacagaggagaccgtgaatggccaggagcaacctggcggcagcgcaaaagatg

SEQ ID NO: 137625 - DNA, 103 bp, Artificial Sequence
  Synthetic Polynucleotide
taatacgactcactatagggtccacctgggagactttggtgggctcctggaacagaggagaccaggaatgcaccaaagtaacctggcggcagcgcaaaagatg

SEQ ID NO: 137626 - DNA, 103 bp, Artificial Sequence
  Synthetic Polynucleotide
taatacgactcactatagggctcggggctctccacctgggagactttggtaacagaggagaaccaaaatgtcccaggtgaacctggcggcagcgcaaaagatg

SEQ ID NO: 137627 - DNA, 103 bp, Artificial Sequence
  Synthetic Polynucleotide
taatacgactcactatagggcgcctttggcctcggggctctccacctgggaacagaggagacccaggatgagagccccgaacctggcggcagcgcaaaagatg

SEQ ID NO: 137628 - DNA, 103 bp, Artificial Sequence
  Synthetic Polynucleotide
taatacgactcactatagggtcgggaaggccgcctttggcctcggggctcaacagaggagagagcccatgggccaaaggaacctggcggcagcgcaaaagatg

SEQ ID NO: 137629 - DNA, 103 bp, Artificial Sequence
  Synthetic Polynucleotide
taatacgactcactataggggctcctctcttcgggaaggccgcctttggcaacagaggagagccaaaatgggccttcccaacctggcggcagcgcaaaagatg

SEQ ID NO: 137630 - DNA, 103 bp, Artificial Sequence
  Synthetic Polynucleotide
taatacgactcactatagggcagccaggcagctcctctcttcgggaaggcaacagaggagagccttcatgaagagaggaaacctggcggcagcgcaaaagatg

SEQ ID NO: 137631 - DNA, 103 bp, Artificial Sequence
  Synthetic Polynucleotide
taatacgactcactatagggacggagacctcagccaggcagctcctctctaacagaggagaagagagatgctgcctggcaacctggcggcagcgcaaaagatg

SEQ ID NO: 137632 - DNA, 103 bp, Artificial Sequence
  Synthetic Polynucleotide
taatacgactcactataggggctggaataaaaactgtcactcctgcaggcaacagaggagagcctgcatgagtgacagtaacctggcggcagcgcaaaagatg

SEQ ID NO: 137633 - DNA, 103 bp, Artificial Sequence
  Synthetic Polynucleotide
taatacgactcactataggggggactggacacggagacctcagccaggcaaacagaggagatgcctgatggaggtctccaacctggcggcagcgcaaaagatg

SEQ ID NO: 137634 - DNA, 103 bp, Artificial Sequence
  Synthetic Polynucleotide
taatacgactcactatagggcctgcacttcgggactggacacggagacctaacagaggagaaggtctatgtgtccagtcaacctggcggcagcgcaaaagatg

SEQ ID NO: 137635 - DNA, 103 bp, Artificial Sequence
  Synthetic Polynucleotide
taatacgactcactatagggctttccttctcctgcacttcgggactggacaacagaggagagtccagatgcgaagtgcaaacctggcggcagcgcaaaagatg

SEQ ID NO: 137636 - DNA, 103 bp, Artificial Sequence
  Synthetic Polynucleotide
taatacgactcactatagggttcctctttgctttccttctcctgcacttcaacagaggagagaagtgatggagaaggaaaacctggcggcagcgcaaaagatg

SEQ ID NO: 137637 - DNA, 103 bp, Artificial Sequence
  Synthetic Polynucleotide
taatacgactcactatagggcagacttgatttcctctttgctttccttctaacagaggagaagaaggatggcaaagaggaacctggcggcagcgcaaaagatg

SEQ ID NO: 137638 - DNA, 103 bp, Artificial Sequence
  Synthetic Polynucleotide
taatacgactcactataggggttggtgtatcagacttgatttcctctttgaacagaggagacaaagaatgaatcaagtcaacctggcggcagcgcaaaagatg

SEQ ID NO: 137639 - DNA, 103 bp, Artificial Sequence
  Synthetic Polynucleotide
taatacgactcactatagggccaattgctggttggtgtatcagacttgataacagaggagaatcaagatggatacaccaaacctggcggcagcgcaaaagatg

SEQ ID NO: 137640 - DNA, 103 bp, Artificial Sequence
  Synthetic Polynucleotide
taatacgactcactatagggttgcagtgagccaattgctggttggtgtataacagaggagaatacacatgccagcaattaacctggcggcagcgcaaaagatg

SEQ ID NO: 137641 - DNA, 103 bp, Artificial Sequence
  Synthetic Polynucleotide
taatacgactcactatagggctgccactctttgcagtgagccaattgctgaacagaggagacagcaaatggctcactgcaacctggcggcagcgcaaaagatg

SEQ ID NO: 137642 - DNA, 103 bp, Artificial Sequence
  Synthetic Polynucleotide
taatacgactcactatagggcctcttctttctgccactctttgcagtgagaacagaggagactcactatgaagagtggcaacctggcggcagcgcaaaagatg

SEQ ID NO: 137643 - DNA, 103 bp, Artificial Sequence
  Synthetic Polynucleotide
taatacgactcactatagggtgctggcgctgctggaataaaaactgtcacaacagaggagagtgacaatgtttattccaaacctggcggcagcgcaaaagatg

SEQ ID NO: 137644 - DNA, 103 bp, Artificial Sequence
  Synthetic Polynucleotide
taatacgactcactatagggtgtaagggcacctcttctttctgccactctaacagaggagaagagtgatggaaagaagaaacctggcggcagcgcaaaagatg

SEQ ID NO: 137645 - DNA, 103 bp, Artificial Sequence
  Synthetic Polynucleotide
taatacgactcactatagggtggtgcttagtgtaagggcacctcttctttaacagaggagaaaagaaatggtgcccttaaacctggcggcagcgcaaaagatg

SEQ ID NO: 137646 - DNA, 103 bp, Artificial Sequence
  Synthetic Polynucleotide
taatacgactcactatagggttccagcgtttggtgcttagtgtaagggcaaacagaggagatgccctatgactaagcacaacctggcggcagcgcaaaagatg

SEQ ID NO: 137647 - DNA, 103 bp, Artificial Sequence
  Synthetic Polynucleotide
taatacgactcactatagggctttttctaattccagcgtttggtgcttagaacagaggagactaagcatgaaacgctggaacctggcggcagcgcaaaagatg

SEQ ID NO: 137648 - DNA, 103 bp, Artificial Sequence
  Synthetic Polynucleotide
taatacgactcactatagggaacaagaactctttttctaattccagcgttaacagaggagaaacgctatgattagaaaaaacctggcggcagcgcaaaagatg

SEQ ID NO: 137649 - DNA, 103 bp, Artificial Sequence
  Synthetic Polynucleotide
taatacgactcactataggggtacatattgaacaagaactctttttctaaaacagaggagattagaaatggagttcttgaacctggcggcagcgcaaaagatg

SEQ ID NO: 137650 - DNA, 103 bp, Artificial Sequence
  Synthetic Polynucleotide
taatacgactcactatagggcgcgggtgaggtacatattgaacaagaactaacagaggagaagttctatgtcaatatgtaacctggcggcagcgcaaaagatg

SEQ ID NO: 137651 - DNA, 103 bp, Artificial Sequence
  Synthetic Polynucleotide
taatacgactcactatagggaggcggcgctcgcgggtgaggtacatattgaacagaggagacaatatatgcctcacccgaacctggcggcagcgcaaaagatg

SEQ ID NO: 137652 - DNA, 103 bp, Artificial Sequence
  Synthetic Polynucleotide
taatacgactcactatagggactgatctctaggcggcgctcgcgggtgagaacagaggagactcaccatggagcgccgcaacctggcggcagcgcaaaagatg

SEQ ID NO: 137653 - DNA, 103 bp, Artificial Sequence
  Synthetic Polynucleotide
taatacgactcactatagggtaacgctcttactgatctctaggcggcgctaacagaggagaagcgccatgtagagatcaaacctggcggcagcgcaaaagatg

SEQ ID NO: 137654 - DNA, 103 bp, Artificial Sequence
  Synthetic Polynucleotide
taatacgactcactatagggggcatgtacatgctggcgctgctggaataaaacagaggagattattcatgcagcgccagaacctggcggcagcgcaaaagatg

SEQ ID NO: 137655 - DNA, 103 bp, Artificial Sequence
  Synthetic Polynucleotide
taatacgactcactatagggtcggtgaggttaacgctcttactgatctctaacagaggagaagagatatgtaagagcgtaacctggcggcagcgcaaaagatg

SEQ ID NO: 137656 - DNA, 103 bp, Artificial Sequence
  Synthetic Polynucleotide
taatacgactcactataggggacctgcctgtcggtgaggttaacgctcttaacagaggagaaagagcatgaacctcaccaacctggcggcagcgcaaaagatg

SEQ ID NO: 137657 - DNA, 103 bp, Artificial Sequence
  Synthetic Polynucleotide
taatacgactcactatagggaccaaatcttgacctgcctgtcggtgaggtaacagaggagaacctcaatgacaggcaggaacctggcggcagcgcaaaagatg

SEQ ID NO: 137658 - DNA, 103 bp, Artificial Sequence
  Synthetic Polynucleotide
taatacgactcactatagggcggttttgaaaccaaatcttgacctgcctgaacagaggagacaggcaatgcaagatttgaacctggcggcagcgcaaaagatg

SEQ ID NO: 137659 - DNA, 103 bp, Artificial Sequence
  Synthetic Polynucleotide
taatacgactcactatagggtttcattcggcggttttgaaaccaaatcttaacagaggagaaagattatgtttcaaaacaacctggcggcagcgcaaaagatg

SEQ ID NO: 137660 - DNA, 103 bp, Artificial Sequence
  Synthetic Polynucleotide
taatacgactcactatagggtcttcttgagtttcattcggcggttttgaaaacagaggagattcaaaatggccgaatgaaacctggcggcagcgcaaaagatg

SEQ ID NO: 137661 - DNA, 103 bp, Artificial Sequence
  Synthetic Polynucleotide
taatacgactcactatagggtctcggctcatcttcttgagtttcattcggaacagaggagaccgaatatgactcaagaaaacctggcggcagcgcaaaagatg

SEQ ID NO: 137662 - DNA, 103 bp, Artificial Sequence
  Synthetic Polynucleotide
taatacgactcactataggggatccggttctctcggctcatcttcttgagaacagaggagactcaagatgatgagccgaaacctggcggcagcgcaaaagatg

SEQ ID NO: 137663 - DNA, 103 bp, Artificial Sequence
  Synthetic Polynucleotide
taatacgactcactatagggtcagttctcggatccggttctctcggctcaaacagaggagatgagccatgagaaccggaaacctggcggcagcgcaaaagatg

SEQ ID NO: 137664 - DNA, 103 bp, Artificial Sequence
  Synthetic Polynucleotide
taatacgactcactatagggaggttggcggtcagttctcggatccggttcaacagaggagagaaccgatgccgagaactaacctggcggcagcgcaaaagatg

SEQ ID NO: 137665 - DNA, 103 bp, Artificial Sequence
  Synthetic Polynucleotide
taatacgactcactataggggtccatgtcccagctcccggcgcggctcataacagaggagaatgagcatggccgggagcaacctggcggcagcgcaaaagatg

SEQ ID NO: 137666 - DNA, 103 bp, Artificial Sequence
  Synthetic Polynucleotide
taatacgactcactataggggcactggcctgacgccgccgccgccgccacaacagaggagagtggcgatggcggcggcgaacctggcggcagcgcaaaagatg

SEQ ID NO: 137667 - DNA, 103 bp, Artificial Sequence
  Synthetic Polynucleotide
taatacgactcactatagggatctttgagcttggagacaattttcttgtcaacagaggagagacaagatgattgtctccaacctggcggcagcgcaaaagatg

SEQ ID NO: 137668 - DNA, 103 bp, Artificial Sequence
  Synthetic Polynucleotide
taatacgactcactatagggaggagacagtatctttgagcttggagacaaaacagaggagattgtctatgagctcaaagaacctggcggcagcgcaaaagatg

SEQ ID NO: 137669 - DNA, 103 bp, Artificial Sequence
  Synthetic Polynucleotide
taatacgactcactataggggaaagccgcggcactggcctgacgccgccgaacagaggagacggcggatgcaggccagtaacctggcggcagcgcaaaagatg

SEQ ID NO: 137670 - DNA, 103 bp, Artificial Sequence
  Synthetic Polynucleotide
taatacgactcactatagggggcgcggagagaaagccgcggcactggcctaacagaggagaaggccaatgccgcggcttaacctggcggcagcgcaaaagatg

SEQ ID NO: 137671 - DNA, 103 bp, Artificial Sequence
  Synthetic Polynucleotide
taatacgactcactatagggggcgaacacaggcgcggagagaaagccgcgaacagaggagacgcggcatgctctccgcgaacctggcggcagcgcaaaagatg

SEQ ID NO: 137672 - DNA, 103 bp, Artificial Sequence
  Synthetic Polynucleotide
taatacgactcactatagggaatgcgtcccggcgaacacaggcgcggagaaacagaggagatctccgatgctgtgttcgaacctggcggcagcgcaaaagatg

SEQ ID NO: 137673 - DNA, 103 bp, Artificial Sequence
  Synthetic Polynucleotide
taatacgactcactataggggcccgccccgaatgcgtcccggcgaacacaaacagaggagatgtgttatgcgggacgcaaacctggcggcagcgcaaaagatg

SEQ ID NO: 137674 - DNA, 103 bp, Artificial Sequence
  Synthetic Polynucleotide
taatacgactcactatagggcgccgccgccgcccgccccgaatgcgtcccaacagaggagagggacgatgtcggggcggaacctggcggcagcgcaaaagatg

SEQ ID NO: 137675 - DNA, 103 bp, Artificial Sequence
  Synthetic Polynucleotide
taatacgactcactatagggccgccgctgccgccgccgccgcccgccccgaacagaggagacggggcatgcggcggcggaacctggcggcagcgcaaaagatg

SEQ ID NO: 137676 - DNA, 103 bp, Artificial Sequence
  Synthetic Polynucleotide
taatacgactcactataggggccgccgcagccgccgctgccgccgccgccaacagaggagaggcggcatgggcagcggcaacctggcggcagcgcaaaagatg

SEQ ID NO: 137677 - DNA, 103 bp, Artificial Sequence
  Synthetic Polynucleotide
taatacgactcactatagggtgccgccgccgccgccgcagccgccgctgcaacagaggagagcagcgatggctgcggcgaacctggcggcagcgcaaaagatg

SEQ ID NO: 137678 - DNA, 103 bp, Artificial Sequence
  Synthetic Polynucleotide
taatacgactcactatagggcccgcagcccgtccatgtcccagctcccggaacagaggagaccgggaatggggacatggaacctggcggcagcgcaaaagatg

SEQ ID NO: 137679 - DNA, 103 bp, Artificial Sequence
  Synthetic Polynucleotide
taatacgactcactatagggagccggaggctgccgccgccgccgccgcagaacagaggagactgcggatgcggcggcggaacctggcggcagcgcaaaagatg

SEQ ID NO: 137680 - DNA, 103 bp, Artificial Sequence
  Synthetic Polynucleotide
taatacgactcactataggggggtacgcaaagccggaggctgccgccgccaacagaggagaggcggcatgagcctccggaacctggcggcagcgcaaaagatg

SEQ ID NO: 137681 - DNA, 103 bp, Artificial Sequence
  Synthetic Polynucleotide
taatacgactcactatagggagaggtcccggggtacgcaaagccggaggcaacagaggagagcctccatgtttgcgtacaacctggcggcagcgcaaaagatg

SEQ ID NO: 137682 - DNA, 103 bp, Artificial Sequence
  Synthetic Polynucleotide
taatacgactcactatagggccgtgcgctcagaggtcccggggtacgcaaaacagaggagattgcgtatgccgggacctaacctggcggcagcgcaaaagatg

SEQ ID NO: 137683 - DNA, 103 bp, Artificial Sequence
  Synthetic Polynucleotide
taatacgactcactataggggaggaagagcccgtgcgctcagaggtcccgaacagaggagacgggacatgtgagcgcacaacctggcggcagcgcaaaagatg

SEQ ID NO: 137684 - DNA, 103 bp, Artificial Sequence
  Synthetic Polynucleotide
taatacgactcactatagggggacgacgacgaggaagagcccgtgcgctcaacagaggagagagcgcatgggctcttccaacctggcggcagcgcaaaagatg

SEQ ID NO: 137685 - DNA, 103 bp, Artificial Sequence
  Synthetic Polynucleotide
taatacgactcactatagggcggcagaagaggacgacgacgaggaagagcaacagaggagagctcttatgcgtcgtcgtaacctggcggcagcgcaaaagatg

SEQ ID NO: 137686 - DNA, 103 bp, Artificial Sequence
  Synthetic Polynucleotide
taatacgactcactataggggccgctacaacggcagaagaggacgacgacaacagaggagagtcgtcatgctcttctgcaacctggcggcagcgcaaaagatg

SEQ ID NO: 137687 - DNA, 103 bp, Artificial Sequence
  Synthetic Polynucleotide
taatacgactcactatagggctccgggcgcgccgctacaacggcagaagaaacagaggagatcttctatggttgtagcgaacctggcggcagcgcaaaagatg

SEQ ID NO: 137688 - DNA, 103 bp, Artificial Sequence
  Synthetic Polynucleotide
taatacgactcactatagggctgggggagcctccgggcgcgccgctacaaaacagaggagattgtagatgcgcgcccggaacctggcggcagcgcaaaagatg

SEQ ID NO: 137689 - DNA, 103 bp, Artificial Sequence
  Synthetic Polynucleotide
taatacgactcactatagggccgccgtctgcccgcagcccgtccatgtccaacagaggagaggacatatgcgggctgcgaacctggcggcagcgcaaaagatg

SEQ ID NO: 137690 - DNA, 103 bp, Artificial Sequence
  Synthetic Polynucleotide
taatacgactcactatagggcactctttggctgggggagcctccgggcgcaacagaggagagcgcccatgggctcccccaacctggcggcagcgcaaaagatg

SEQ ID NO: 137691 - DNA, 103 bp, Artificial Sequence
  Synthetic Polynucleotide
taatacgactcactataggggggtgctgggcactctttggctgggggagcaacagaggagagctcccatggccaaagagaacctggcggcagcgcaaaagatg

SEQ ID NO: 137692 - DNA, 103 bp, Artificial Sequence
  Synthetic Polynucleotide
taatacgactcactatagggctgcaggcgtgggtgctgggcactctttggaacagaggagaccaaagatggcccagcacaacctggcggcagcgcaaaagatg

SEQ ID NO: 137693 - DNA, 103 bp, Artificial Sequence
  Synthetic Polynucleotide
taatacgactcactataggggcagcggccgctgcaggcgtgggtgctgggaacagaggagacccagcatgcacgcctgcaacctggcggcagcgcaaaagatg

SEQ ID NO: 137694 - DNA, 103 bp, Artificial Sequence
  Synthetic Polynucleotide
taatacgactcactatagggcgggggcgctgcagcggccgctgcaggcgtaacagaggagaacgcctatggcggccgctaacctggcggcagcgcaaaagatg

SEQ ID NO: 137695 - DNA, 103 bp, Artificial Sequence
  Synthetic Polynucleotide
taatacgactcactatagggctggagcgctcgggggcgctgcagcggccgaacagaggagacggccgatgcagcgccccaacctggcggcagcgcaaaagatg

SEQ ID NO: 137696 - DNA, 103 bp, Artificial Sequence
  Synthetic Polynucleotide
taatacgactcactatagggtagcccagcgctggagcgctcgggggcgctaacagaggagaagcgccatggagcgctccaacctggcggcagcgcaaaagatg

SEQ ID NO: 137697 - DNA, 103 bp, Artificial Sequence
  Synthetic Polynucleotide
taatacgactcactataggggtggtagccgtagcccagcgctggagcgctaacagaggagaagcgctatggcgctgggcaacctggcggcagcgcaaaagatg

SEQ ID NO: 137698 - DNA, 103 bp, Artificial Sequence
  Synthetic Polynucleotide
taatacgactcactatagggcgttgccgaagtggtagccgtagcccagcgaacagaggagacgctggatgacggctaccaacctggcggcagcgcaaaagatg

SEQ ID NO: 137699 - DNA, 103 bp, Artificial Sequence
  Synthetic Polynucleotide
taatacgactcactatagggctgtagtagccgttgccgaagtggtagccgaacagaggagacggctaatgcttcggcaaaacctggcggcagcgcaaaagatg

SEQ ID NO: 137700 - DNA, 103 bp, Artificial Sequence
  Synthetic Polynucleotide
taatacgactcactatagggaccggcgcccccgccgtctgcccgcagcccaacagaggagagggctgatggcagacggcaacctggcggcagcgcaaaagatg

SEQ ID NO: 137701 - DNA, 103 bp, Artificial Sequence
  Synthetic Polynucleotide
taatacgactcactatagggcatacggcagctgtagtagccgttgccgaaaacagaggagattcggcatgggctactacaacctggcggcagcgcaaaagatg

SEQ ID NO: 137702 - DNA, 103 bp, Artificial Sequence
  Synthetic Polynucleotide
taatacgactcactatagggcgccgtgcgacatacggcagctgtagtagcaacagaggagagctactatggctgccgtaaacctggcggcagcgcaaaagatg

SEQ ID NO: 137703 - DNA, 103 bp, Artificial Sequence
  Synthetic Polynucleotide
taatacgactcactatagggtgtaagcccacgccgtgcgacatacggcagaacagaggagactgccgatggtcgcacggaacctggcggcagcgcaaaagatg

SEQ ID NO: 137704 - DNA, 103 bp, Artificial Sequence
  Synthetic Polynucleotide
taatacgactcactatagggcgcattctgctgtaagcccacgccgtgcgaaacagaggagatcgcacatggtgggcttaaacctggcggcagcgcaaaagatg

SEQ ID NO: 137705 - DNA, 103 bp, Artificial Sequence
  Synthetic Polynucleotide
taatacgactcactatagggatgacttgagcgcattctgctgtaagcccaaacagaggagatgggctatgagcagaatgaacctggcggcagcgcaaaagatg

SEQ ID NO: 137706 - DNA, 103 bp, Artificial Sequence
  Synthetic Polynucleotide
taatacgactcactataggggcgtgcggcgatgacttgagcgcattctgcaacagaggagagcagaaatggctcaagtcaacctggcggcagcgcaaaagatg

SEQ ID NO: 137707 - DNA, 103 bp, Artificial Sequence
  Synthetic Polynucleotide
taatacgactcactatagggtcccagcgaggcgtgcggcgatgacttgagaacagaggagactcaagatgtcgccgcacaacctggcggcagcgcaaaagatg

SEQ ID NO: 137708 - DNA, 103 bp, Artificial Sequence
  Synthetic Polynucleotide
taatacgactcactatagggcgggaaagcctcccagcgaggcgtgcggcgaacagaggagacgccgcatgcctcgctggaacctggcggcagcgcaaaagatg

SEQ ID NO: 137709 - DNA, 103 bp, Artificial Sequence
  Synthetic Polynucleotide
taatacgactcactatagggtacttctccacgggaaagcctcccagcgagaacagaggagactcgctatgaggctttccaacctggcggcagcgcaaaagatg

SEQ ID NO: 137710 - DNA, 103 bp, Artificial Sequence
  Synthetic Polynucleotide
taatacgactcactatagggcacgtccatgtacttctccacgggaaagccaacagaggagaggctttatggtggagaagaacctggcggcagcgcaaaagatg

SEQ ID NO: 137711 - DNA, 103 bp, Artificial Sequence
  Synthetic Polynucleotide
taatacgactcactatagggccggggcgccaccggcgcccccgccgtctgaacagaggagacagacgatgggggcgccgaacctggcggcagcgcaaaagatg

SEQ ID NO: 137712 - DNA, 103 bp, Artificial Sequence
  Synthetic Polynucleotide
taatacgactcactatagggccaggcctgacacgtccatgtacttctccaaacagaggagatggagaatgacatggacgaacctggcggcagcgcaaaagatg

SEQ ID NO: 137713 - DNA, 103 bp, Artificial Sequence
  Synthetic Polynucleotide
taatacgactcactatagggctgctgctcgccaggcctgacacgtccatgaacagaggagacatggaatggtcaggcctaacctggcggcagcgcaaaagatg

SEQ ID NO: 137714 - DNA, 103 bp, Artificial Sequence
  Synthetic Polynucleotide
taatacgactcactatagggggccggtacgctgctgctcgccaggcctgaaacagaggagatcaggcatggcgagcagcaacctggcggcagcgcaaaagatg

SEQ ID NO: 137715 - DNA, 103 bp, Artificial Sequence
  Synthetic Polynucleotide
taatacgactcactataggggcacctcgttggccggtacgctgctgctcgaacagaggagacgagcaatggcgtaccggaacctggcggcagcgcaaaagatg

SEQ ID NO: 137716 - DNA, 103 bp, Artificial Sequence
  Synthetic Polynucleotide
taatacgactcactataggggctcgcgctggcacctcgttggccggtacgaacagaggagacgtaccatgcaacgaggtaacctggcggcagcgcaaaagatg

SEQ ID NO: 137717 - DNA, 103 bp, Artificial Sequence
  Synthetic Polynucleotide
taatacgactcactatagggtacctccttggctcgcgctggcacctcgttaacagaggagaaacgagatgccagcgcgaaacctggcggcagcgcaaaagatg

SEQ ID NO: 137718 - DNA, 103 bp, Artificial Sequence
  Synthetic Polynucleotide
taatacgactcactatagggggtagaaggatacctccttggctcgcgctgaacagaggagacagcgcatgccaaggaggaacctggcggcagcgcaaaagatg

SEQ ID NO: 137719 - DNA, 103 bp, Artificial Sequence
  Synthetic Polynucleotide
taatacgactcactataggggtatagccctggtagaaggatacctccttgaacagaggagacaaggaatgatccttctaaacctggcggcagcgcaaaagatg

SEQ ID NO: 137720 - DNA, 103 bp, Artificial Sequence
  Synthetic Polynucleotide
taatacgactcactataggggtaagggctcgtatagccctggtagaaggaaacagaggagatccttcatgcagggctataacctggcggcagcgcaaaagatg

SEQ ID NO: 137721 - DNA, 103 bp, Artificial Sequence
  Synthetic Polynucleotide
taatacgactcactataggggcacgtgctggtaagggctcgtatagccctaacagaggagaagggctatgcgagcccttaacctggcggcagcgcaaaagatg

SEQ ID NO: 137722 - DNA, 103 bp, Artificial Sequence
  Synthetic Polynucleotide
taatacgactcactataggggaggaagaggccggggcgccaccggcgcccaacagaggagagggcgcatgtggcgccccaacctggcggcagcgcaaaagatg

SEQ ID NO: 137723 - DNA, 103 bp, Artificial Sequence
  Synthetic Polynucleotide
taatacgactcactatagggatatagccgggcacgtgctggtaagggctcaacagaggagagagcccatgccagcacgtaacctggcggcagcgcaaaagatg

SEQ ID NO: 137724 - DNA, 103 bp, Artificial Sequence
  Synthetic Polynucleotide
taatacgactcactatagggcaccatgtcgatatagccgggcacgtgctgaacagaggagacagcacatgcccggctataacctggcggcagcgcaaaagatg

SEQ ID NO: 137725 - DNA, 103 bp, Artificial Sequence
  Synthetic Polynucleotide
taatacgactcactatagggcgaaagtggacaccatgtcgatatagccggaacagaggagaccggctatgtcgacatggaacctggcggcagcgcaaaagatg

SEQ ID NO: 137726 - DNA, 103 bp, Artificial Sequence
  Synthetic Polynucleotide
taatacgactcactatagggtccccggagccgaaagtggacaccatgtcgaacagaggagacgacatatggtccactttaacctggcggcagcgcaaaagatg

SEQ ID NO: 137727 - DNA, 103 bp, Artificial Sequence
  Synthetic Polynucleotide
taatacgactcactataggggtgccgaggctccccggagccgaaagtggaaacagaggagatccactatgggctccgggaacctggcggcagcgcaaaagatg

SEQ ID NO: 137728 - DNA, 103 bp, Artificial Sequence
  Synthetic Polynucleotide
taatacgactcactatagggtgtaggcctcgtgccgaggctccccggagcaacagaggagagctccgatgagcctcggcaacctggcggcagcgcaaaagatg

SEQ ID NO: 137729 - DNA, 103 bp, Artificial Sequence
  Synthetic Polynucleotide
taatacgactcactatagggtccatggagatgtaggcctcgtgccgaggcaacagaggagagcctcgatgcgaggcctaaacctggcggcagcgcaaaagatg

SEQ ID NO: 137730 - DNA, 103 bp, Artificial Sequence
  Synthetic Polynucleotide
taatacgactcactatagggctggtacccctccatggagatgtaggcctcaacagaggagagaggccatgatctccatgaacctggcggcagcgcaaaagatg

SEQ ID NO: 137731 - DNA, 103 bp, Artificial Sequence
  Synthetic Polynucleotide
taatacgactcactataggggcgtccaggactggtacccctccatggagaaacagaggagatctccaatgaggggtaccaacctggcggcagcgcaaaagatg

SEQ ID NO: 137732 - DNA, 103 bp, Artificial Sequence
  Synthetic Polynucleotide
taatacgactcactatagggccgttagccagcgtccaggactggtaccccaacagaggagaggggtaatggtcctggacaacctggcggcagcgcaaaagatg

SEQ ID NO: 137733 - DNA, 103 bp, Artificial Sequence
  Synthetic Polynucleotide
taatacgactcactatagggcgatgaggaggaggaagaggccggggcgccaacagaggagaggcgccatggcctcttccaacctggcggcagcgcaaaagatg

SEQ ID NO: 137734 - DNA, 103 bp, Artificial Sequence
  Synthetic Polynucleotide
taatacgactcactataggggctgttccacccgttagccagcgtccaggaaacagaggagatcctggatgctggctaacaacctggcggcagcgcaaaagatg

SEQ ID NO: 137735 - DNA, 103 bp, Artificial Sequence
  Synthetic Polynucleotide
taatacgactcactatagggagtacacctggctgttccacccgttagccaaacagaggagatggctaatgggtggaacaaacctggcggcagcgcaaaagatg

SEQ ID NO: 137736 - DNA, 103 bp, Artificial Sequence
  Synthetic Polynucleotide
taatacgactcactatagggtccttggtgcagtacacctggctgttccacaacagaggagagtggaaatgccaggtgtaaacctggcggcagcgcaaaagatg

SEQ ID NO: 137737 - DNA, 103 bp, Artificial Sequence
  Synthetic Polynucleotide
taatacgactcactatagggctgtggctggtccttggtgcagtacacctgaacagaggagacaggtgatgtgcaccaagaacctggcggcagcgcaaaagatg

SEQ ID NO: 137738 - DNA, 103 bp, Artificial Sequence
  Synthetic Polynucleotide
taatacgactcactatagggagtgggacccctgtggctggtccttggtgcaacagaggagagcaccaatgaccagccacaacctggcggcagcgcaaaagatg

SEQ ID NO: 137739 - DNA, 103 bp, Artificial Sequence
  Synthetic Polynucleotide
taatacgactcactataggggatttccaaaagtgggacccctgtggctggaacagaggagaccagccatgggggtcccaaacctggcggcagcgcaaaagatg

SEQ ID NO: 137740 - DNA, 103 bp, Artificial Sequence
  Synthetic Polynucleotide
taatacgactcactatagggtggaaaggaagatttccaaaagtgggacccaacagaggagagggtccatgttttggaaaaacctggcggcagcgcaaaagatg

SEQ ID NO: 137741 - DNA, 103 bp, Artificial Sequence
  Synthetic Polynucleotide
taatacgactcactatagggccacatcccctggaaaggaagatttccaaaaacagaggagatttggaatgcttcctttcaacctggcggcagcgcaaaagatg

SEQ ID NO: 137742 - DNA, 103 bp, Artificial Sequence
  Synthetic Polynucleotide
taatacgactcactatagggtgatttagagccacatcccctggaaaggaaaacagaggagattccttatgaggggatgtaacctggcggcagcgcaaaagatg

SEQ ID NO: 137743 - DNA, 103 bp, Artificial Sequence
  Synthetic Polynucleotide
taatacgactcactatagggcatgtccggctgatttagagccacatccccaacagaggagaggggatatggctctaaataacctggcggcagcgcaaaagatg

SEQ ID NO: 137744 - DNA, 103 bp, Artificial Sequence
  Synthetic Polynucleotide
taatacgactcactatagggccgccgccaccgatgaggaggaggaagaggaacagaggagacctcttatgcctcctcataacctggcggcagcgcaaaagatg

SEQ ID NO: 137745 - DNA, 103 bp, Artificial Sequence
  Synthetic Polynucleotide
taatacgactcactatagggggtagacgcacatgtccggctgatttagagaacagaggagactctaaatgagccggacaaacctggcggcagcgcaaaagatg

SEQ ID NO: 137746 - DNA, 103 bp, Artificial Sequence
  Synthetic Polynucleotide
taatacgactcactatagggctccctcttcggtagacgcacatgtccggcaacagaggagagccggaatggtgcgtctaaacctggcggcagcgcaaaagatg

SEQ ID NO: 137747 - DNA, 103 bp, Artificial Sequence
  Synthetic Polynucleotide
taatacgactcactatagggtctcttcttcctccctcttcggtagacgcaaacagaggagatgcgtcatgcgaagagggaacctggcggcagcgcaaaagatg

SEQ ID NO: 137748 - DNA, 103 bp, Artificial Sequence
  Synthetic Polynucleotide
taatacgactcactatagggtgtaaggcactctcttcttcctccctcttcaacagaggagagaagagatgggaagaagaaacctggcggcagcgcaaaagatg

SEQ ID NO: 137749 - DNA, 103 bp, Artificial Sequence
  Synthetic Polynucleotide
taatacgactcactatagggtgcagtttggtgtaaggcactctcttcttcaacagaggagagaagaaatgagtgccttaaacctggcggcagcgcaaaagatg

SEQ ID NO: 137750 - DNA, 103 bp, Artificial Sequence
  Synthetic Polynucleotide
taatacgactcactatagggttctttaagctgcagtttggtgtaaggcacaacagaggagagtgcctatgaccaaactgaacctggcggcagcgcaaaagatg

SEQ ID NO: 137751 - DNA, 103 bp, Artificial Sequence
  Synthetic Polynucleotide
taatacgactcactatagggcgttctccagttctttaagctgcagtttggaacagaggagaccaaacatgagcttaaagaacctggcggcagcgcaaaagatg

SEQ ID NO: 137752 - DNA, 103 bp, Artificial Sequence
  Synthetic Polynucleotide
taatacgactcactatagggatggcatactcgttctccagttctttaagcaacagaggagagcttaaatgactggagaaaacctggcggcagcgcaaaagatg

SEQ ID NO: 137753 - DNA, 103 bp, Artificial Sequence
  Synthetic Polynucleotide
taatacgactcactataggggaatttgttaatggcatactcgttctccagaacagaggagactggagatggagtatgccaacctggcggcagcgcaaaagatg

SEQ ID NO: 137754 - DNA, 103 bp, Artificial Sequence
  Synthetic Polynucleotide
taatacgactcactatagggccttgttaatgaatttgttaatggcatactaacagaggagaagtatgatgttaacaaataacctggcggcagcgcaaaagatg

SEQ ID NO: 137755 - DNA, 103 bp, Artificial Sequence
  Synthetic Polynucleotide
taatacgactcactataggggacgccgccgccgccgccaccgatgaggagaacagaggagactcctcatgggtggcggcaacctggcggcagcgcaaaagatg

SEQ ID NO: 137756 - DNA, 103 bp, Artificial Sequence
  Synthetic Polynucleotide
taatacgactcactatagggcgccgcttgtccttgttaatgaatttgttaaacagaggagataacaaatgcattaacaaaacctggcggcagcgcaaaagatg

SEQ ID NO: 137757 - DNA, 103 bp, Artificial Sequence
  Synthetic Polynucleotide
taatacgactcactatagggcgagatacgccgccgcttgtccttgttaataacagaggagaattaacatggacaagcggaacctggcggcagcgcaaaagatg

SEQ ID NO: 137758 - DNA, 103 bp, Artificial Sequence
  Synthetic Polynucleotide
taatacgactcactatagggtcgtagcagccgagatacgccgccgcttgtaacagaggagaacaagcatgggcgtatctaacctggcggcagcgcaaaagatg

SEQ ID NO: 137759 - DNA, 103 bp, Artificial Sequence
  Synthetic Polynucleotide
taatacgactcactatagggtcagataggttcgtagcagccgagatacgcaacagaggagagcgtatatgggctgctacaacctggcggcagcgcaaaagatg

SEQ ID NO: 137760 - DNA, 103 bp, Artificial Sequence
  Synthetic Polynucleotide
taatacgactcactatagggcacttgtctctcagataggttcgtagcagcaacagaggagagctgctatgaacctatctaacctggcggcagcgcaaaagatg

SEQ ID NO: 137761 - DNA, 103 bp, Artificial Sequence
  Synthetic Polynucleotide
taatacgactcactatagggaccaaatggtcacttgtctctcagataggtaacagaggagaacctatatgagagacaagaacctggcggcagcgcaaaagatg

SEQ ID NO: 137762 - DNA, 103 bp, Artificial Sequence
  Synthetic Polynucleotide
taatacgactcactatagggcggttctgaaaccaaatggtcacttgtctcaacagaggagagagacaatggaccatttgaacctggcggcagcgcaaaagatg

SEQ ID NO: 137763 - DNA, 103 bp, Artificial Sequence
  Synthetic Polynucleotide
taatacgactcactatagggcttcactcttcggttctgaaaccaaatggtaacagaggagaaccattatgtttcagaacaacctggcggcagcgcaaaagatg

SEQ ID NO: 137764 - DNA, 103 bp, Artificial Sequence
  Synthetic Polynucleotide
taatacgactcactatagggttttcttgtccttcactcttcggttctgaaaacagaggagattcagaatggaagagtgaaacctggcggcagcgcaaaagatg

SEQ ID NO: 137765 - DNA, 103 bp, Artificial Sequence
  Synthetic Polynucleotide
taatacgactcactatagggttggagacaattttcttgtccttcactcttaacagaggagaaagagtatgggacaagaaaacctggcggcagcgcaaaagatg

SEQ ID NO: 137766 - DNA, 103 bp, Artificial Sequence
  Synthetic Polynucleotide
taatacgactcactatagggcagggcctgctgaccctgctcaaataacataacagaggagaatgttaatggagcagggtaacctggcggcagcgcaaaagatg

SEQ ID NO: 137767 - DNA, 103 bp, Artificial Sequence
  Synthetic Polynucleotide
taatacgactcactatagggagtgtccgtagttttgctgtagccatagccaacagaggagaggctatatgtacagcaaaaacctggcggcagcgcaaaagatg

SEQ ID NO: 137768 - DNA, 103 bp, Artificial Sequence
  Synthetic Polynucleotide
taatacgactcactatagggcgccatgggatggggctcgaactccggcgcaacagaggagagcgccgatgttcgagcccaacctggcggcagcgcaaaagatg

SEQ ID NO: 137769 - DNA, 103 bp, Artificial Sequence
  Synthetic Polynucleotide
taatacgactcactatagggcgccgttgctcgccatgggatggggctcgaaacagaggagatcgagcatgatcccatggaacctggcggcagcgcaaaagatg

SEQ ID NO: 137770 - DNA, 103 bp, Artificial Sequence
  Synthetic Polynucleotide
taatacgactcactataggggcgaagccgccgccgttgctcgccatgggaaacagaggagatcccatatggagcaacggaacctggcggcagcgcaaaagatg

SEQ ID NO: 137771 - DNA, 103 bp, Artificial Sequence
  Synthetic Polynucleotide
taatacgactcactataggggttggcgctggcgaagccgccgccgttgctaacagaggagaagcaacatgggcggcttcaacctggcggcagcgcaaaagatg

SEQ ID NO: 137772 - DNA, 103 bp, Artificial Sequence
  Synthetic Polynucleotide
taatacgactcactatagggtgccctgcaagttggcgctggcgaagccgcaacagaggagagcggctatgccagcgccaaacctggcggcagcgcaaaagatg

SEQ ID NO: 137773 - DNA, 103 bp, Artificial Sequence
  Synthetic Polynucleotide
taatacgactcactatagggtacaccgggctgccctgcaagttggcgctgaacagaggagacagcgcatgcttgcagggaacctggcggcagcgcaaaagatg

SEQ ID NO: 137774 - DNA, 103 bp, Artificial Sequence
  Synthetic Polynucleotide
taatacgactcactataggggccgcccacgtacaccgggctgccctgcaaaacagaggagattgcagatgagcccggtgaacctggcggcagcgcaaaagatg

SEQ ID NO: 137775 - DNA, 103 bp, Artificial Sequence
  Synthetic Polynucleotide
taatacgactcactatagggcgacgaagttgccgcccacgtacaccgggcaacagaggagagcccggatgacgtgggcgaacctggcggcagcgcaaaagatg

SEQ ID NO: 137776 - DNA, 103 bp, Artificial Sequence
  Synthetic Polynucleotide
taatacgactcactataggggccatggactcgacgaagttgccgcccacgaacagaggagacgtgggatgcaacttcgtaacctggcggcagcgcaaaagatg

SEQ ID NO: 137777 - DNA, 103 bp, Artificial Sequence
  Synthetic Polynucleotide
taatacgactcactatagggggacgcgggcgccatggactcgacgaagttaacagaggagaaacttcatggagtccatgaacctggcggcagcgcaaaagatg

SEQ ID NO: 137778 - DNA, 103 bp, Artificial Sequence
  Synthetic Polynucleotide
taatacgactcactatagggtgtagccgtaagtgtccgtagttttgctgtaacagaggagaacagcaatgctacggacaaacctggcggcagcgcaaaagatg

SEQ ID NO: 137779 - DNA, 103 bp, Artificial Sequence
  Synthetic Polynucleotide
taatacgactcactatagggagacaggcccggacgcgggcgccatggactaacagaggagaagtccaatgcgcccgcgtaacctggcggcagcgcaaaagatg

SEQ ID NO: 137780 - DNA, 103 bp, Artificial Sequence
  Synthetic Polynucleotide
taatacgactcactatagggcccaggttgaagacaggcccggacgcgggcaacagaggagagcccgcatgcgggcctgtaacctggcggcagcgcaaaagatg

SEQ ID NO: 137781 - DNA, 103 bp, Artificial Sequence
  Synthetic Polynucleotide
taatacgactcactatagggcgagaggtggcccaggttgaagacaggcccaacagaggagagggcctatgttcaacctgaacctggcggcagcgcaaaagatg

SEQ ID NO: 137782 - DNA, 103 bp, Artificial Sequence
  Synthetic Polynucleotide
taatacgactcactatagggacgacgggtgcgagaggtggcccaggttgaaacagaggagatcaaccatggccacctctaacctggcggcagcgcaaaagatg

SEQ ID NO: 137783 - DNA, 103 bp, Artificial Sequence
  Synthetic Polynucleotide
taatacgactcactatagggacgctggccgacgacgggtgcgagaggtggaacagaggagaccacctatggcacccgtcaacctggcggcagcgcaaaagatg

SEQ ID NO: 137784 - DNA, 103 bp, Artificial Sequence
  Synthetic Polynucleotide
taatacgactcactatagggactgtagtccacgctggccgacgacgggtgaacagaggagacacccgatgtcggccagcaacctggcggcagcgcaaaagatg

SEQ ID NO: 137785 - DNA, 103 bp, Artificial Sequence
  Synthetic Polynucleotide
taatacgactcactataggggcgcggcgcaactgtagtccacgctggccgaacagaggagacggccaatgtggactacaaacctggcggcagcgcaaaagatg

SEQ ID NO: 137786 - DNA, 103 bp, Artificial Sequence
  Synthetic Polynucleotide
taatacgactcactatagggcctggaatctgcgcggcgcaactgtagtccaacagaggagaggactaatgttgcgccgcaacctggcggcagcgcaaaagatg

SEQ ID NO: 137787 - DNA, 103 bp, Artificial Sequence
  Synthetic Polynucleotide
taatacgactcactataggggtggtggttgcctggaatctgcgcggcgcaaacagaggagatgcgccatgcagattccaaacctggcggcagcgcaaaagatg

SEQ ID NO: 137788 - DNA, 103 bp, Artificial Sequence
  Synthetic Polynucleotide
taatacgactcactatagggaaggtccatggtggtggttgcctggaatctaacagaggagaagattcatggcaaccaccaacctggcggcagcgcaaaagatg

SEQ ID NO: 137789 - DNA, 103 bp, Artificial Sequence
  Synthetic Polynucleotide
taatacgactcactatagggtggggggtgctgtagccgtaagtgtccgtaaacagaggagatacggaatgttacggctaaacctggcggcagcgcaaaagatg

SEQ ID NO: 137790 - DNA, 103 bp, Artificial Sequence
  Synthetic Polynucleotide
taatacgactcactatagggtgagggtcgcaaggtccatggtggtggttgaacagaggagacaaccaatgccatggaccaacctggcggcagcgcaaaagatg

SEQ ID NO: 137791 - DNA, 103 bp, Artificial Sequence
  Synthetic Polynucleotide
taatacgactcactataggggtaggtgggatgagggtcgcaaggtccatgaacagaggagacatggaatgtgcgaccctaacctggcggcagcgcaaaagatg

SEQ ID NO: 137792 - DNA, 103 bp, Artificial Sequence
  Synthetic Polynucleotide
taatacgactcactatagggagagatctgtgtaggtgggatgagggtcgcaacagaggagagcgaccatgatcccacctaacctggcggcagcgcaaaagatg

SEQ ID NO: 137793 - DNA, 103 bp, Artificial Sequence
  Synthetic Polynucleotide
taatacgactcactatagggtggtgggccgagagatctgtgtaggtgggaaacagaggagatcccacatgcacagatctaacctggcggcagcgcaaaagatg

SEQ ID NO: 137794 - DNA, 103 bp, Artificial Sequence
  Synthetic Polynucleotide
taatacgactcactatagggctgagacgagtggtgggccgagagatctgtaacagaggagaacagatatgtcggcccacaacctggcggcagcgcaaaagatg

SEQ ID NO: 137795 - DNA, 103 bp, Artificial Sequence
  Synthetic Polynucleotide
taatacgactcactataggggcagtcgtccctgagacgagtggtgggccgaacagaggagacggcccatgactcgtctcaacctggcggcagcgcaaaagatg

SEQ ID NO: 137796 - DNA, 103 bp, Artificial Sequence
  Synthetic Polynucleotide
taatacgactcactatagggggagcctccggcagtcgtccctgagacgagaacagaggagactcgtcatggggacgactaacctggcggcagcgcaaaagatg

SEQ ID NO: 137797 - DNA, 103 bp, Artificial Sequence
  Synthetic Polynucleotide
taatacgactcactatagggcgtcagtttgggagcctccggcagtcgtccaacagaggagaggacgaatgccggaggctaacctggcggcagcgcaaaagatg

SEQ ID NO: 137798 - DNA, 103 bp, Artificial Sequence
  Synthetic Polynucleotide
taatacgactcactataggggtagggctggtggggggtgctgtagccgtaaacagaggagatacggcatgagcacccccaacctggcggcagcgcaaaagatg

SEQ ID NO: 137799 - DNA, 103 bp, Artificial Sequence
  Synthetic Polynucleotide
taatacgactcactatagggcagggggtgggtagggctggtggggggtgcaacagaggagagcacccatgaccagccctaacctggcggcagcgcaaaagatg

SEQ ID NO: 137800 - DNA, 103 bp, Artificial Sequence
  Synthetic Polynucleotide
taatacgactcactatagggctggcagcagcagggggtgggtagggctggaacagaggagaccagccatgcccacccccaacctggcggcagcgcaaaagatg

SEQ ID NO: 137801 - DNA, 103 bp, Artificial Sequence
  Synthetic Polynucleotide
taatacgactcactataggggtccagggagctggcagcagcagggggtggaacagaggagaccacccatggctgctgccaacctggcggcagcgcaaaagatg

SEQ ID NO: 137802 - DNA, 103 bp, Artificial Sequence
  Synthetic Polynucleotide
taatacgactcactataggggatagtcagtgtccagggagctggcagcagaacagaggagactgctgatggctccctggaacctggcggcagcgcaaaagatg

SEQ ID NO: 137803 - DNA, 103 bp, Artificial Sequence
  Synthetic Polynucleotide
taatacgactcactataggggcagaacctggatagtcagtgtccagggagaacagaggagactccctatgcactgactaaacctggcggcagcgcaaaagatg

SEQ ID NO: 137804 - DNA, 103 bp, Artificial Sequence
  Synthetic Polynucleotide
taatacgactcactataggggatggagcaggcagaacctggatagtcagtaacagaggagaactgacatgccaggttctaacctggcggcagcgcaaaagatg

SEQ ID NO: 137805 - DNA, 103 bp, Artificial Sequence
  Synthetic Polynucleotide
taatacgactcactatagggcaggaagctccagggcctgctgaccctgctaacagaggagaagcaggatgagcaggcccaacctggcggcagcgcaaaagatg

SEQ ID NO: 137806 - DNA, 103 bp, Artificial Sequence
  Synthetic Polynucleotide
taatacgactcactatagggcagagctctggatggagcaggcagaacctgaacagaggagacaggttatgcctgctccaaacctggcggcagcgcaaaagatg

SEQ ID NO: 137807 - DNA, 103 bp, Artificial Sequence
  Synthetic Polynucleotide
taatacgactcactatagggctcagaggggcagagctctggatggagcagaacagaggagactgctcatgccagagctcaacctggcggcagcgcaaaagatg

SEQ ID NO: 137808 - DNA, 103 bp, Artificial Sequence
  Synthetic Polynucleotide
taatacgactcactatagggggctggggctctcagaggggcagagctctgaacagaggagacagagcatggcccctctgaacctggcggcagcgcaaaagatg

SEQ ID NO: 137809 - DNA, 103 bp, Artificial Sequence
  Synthetic Polynucleotide
taatacgactcactatagggctcctttgtgggctggggctctcagaggggaacagaggagacccctcatggagccccagaacctggcggcagcgcaaaagatg

SEQ ID NO: 137810 - DNA, 103 bp, Artificial Sequence
  Synthetic Polynucleotide
taatacgactcactatagggttgagttcagctcctttgtgggctggggctaacagaggagaagccccatgccacaaaggaacctggcggcagcgcaaaagatg

SEQ ID NO: 137811 - DNA, 103 bp, Artificial Sequence
  Synthetic Polynucleotide
taatacgactcactataggggcagctgccattgagttcagctcctttgtgaacagaggagacacaaaatggctgaactcaacctggcggcagcgcaaaagatg

SEQ ID NO: 137812 - DNA, 103 bp, Artificial Sequence
  Synthetic Polynucleotide
taatacgactcactatagggccggccgcatgcagctgccattgagttcagaacagaggagactgaacatgatggcagctaacctggcggcagcgcaaaagatg

SEQ ID NO: 137813 - DNA, 103 bp, Artificial Sequence
  Synthetic Polynucleotide
taatacgactcactatagggttcccagtgcccggccgcatgcagctgccaaacagaggagatggcagatgcatgcggccaacctggcggcagcgcaaaagatg

SEQ ID NO: 137814 - DNA, 103 bp, Artificial Sequence
  Synthetic Polynucleotide
taatacgactcactatagggaccctggctgttcccagtgcccggccgcataacagaggagaatgcggatgggcactgggaacctggcggcagcgcaaaagatg

SEQ ID NO: 137815 - DNA, 103 bp, Artificial Sequence
  Synthetic Polynucleotide
taatacgactcactatagggcaccacccccaccctggctgttcccagtgcaacagaggagagcactgatgacagccaggaacctggcggcagcgcaaaagatg

SEQ ID NO: 137816 - DNA, 103 bp, Artificial Sequence
  Synthetic Polynucleotide
taatacgactcactatagggattgtgcactcaggaagctccagggcctgcaacagaggagagcaggcatgggagcttccaacctggcggcagcgcaaaagatg

SEQ ID NO: 137817 - DNA, 103 bp, Artificial Sequence
  Synthetic Polynucleotide
taatacgactcactatagggggctggctgccaccacccccaccctggctgaacagaggagacagccaatgtgggggtggaacctggcggcagcgcaaaagatg

SEQ ID NO: 137818 - DNA, 103 bp, Artificial Sequence
  Synthetic Polynucleotide
taatacgactcactatagggcagaccaggaggctggctgccaccacccccaacagaggagagggggtatgggcagccagaacctggcggcagcgcaaaagatg

SEQ ID NO: 137819 - DNA, 103 bp, Artificial Sequence
  Synthetic Polynucleotide
taatacgactcactataggggctctgagttcagaccaggaggctggctgcaacagaggagagcagccatgctcctggtcaacctggcggcagcgcaaaagatg

SEQ ID NO: 137820 - DNA, 103 bp, Artificial Sequence
  Synthetic Polynucleotide
taatacgactcactatagggggtggctgctgctctgagttcagaccaggaaacagaggagatcctggatggaactcagaaacctggcggcagcgcaaaagatg

SEQ ID NO: 137821 - DNA, 103 bp, Artificial Sequence
  Synthetic Polynucleotide
taatacgactcactatagggagggggttgtggtggctgctgctctgagttaacagaggagaaactcaatgcagcagccaaacctggcggcagcgcaaaagatg

SEQ ID NO: 137822 - DNA, 103 bp, Artificial Sequence
  Synthetic Polynucleotide
taatacgactcactataggggtggtggaggagggggttgtggtggctgctaacagaggagaagcagcatgcacaaccccaacctggcggcagcgcaaaagatg

SEQ ID NO: 137823 - DNA, 103 bp, Artificial Sequence
  Synthetic Polynucleotide
taatacgactcactatagggggcagggtcggtggtggaggagggggttgtaacagaggagaacaaccatgtcctccaccaacctggcggcagcgcaaaagatg

SEQ ID NO: 137824 - DNA, 103 bp, Artificial Sequence
  Synthetic Polynucleotide
taatacgactcactatagggtgaagatgggggcagggtcggtggtggaggaacagaggagacctccaatgccgaccctgaacctggcggcagcgcaaaagatg

SEQ ID NO: 137825 - DNA, 103 bp, Artificial Sequence
  Synthetic Polynucleotide
taatacgactcactataggggattggtgggtgaagatgggggcagggtcgaacagaggagacgacccatgccccatcttaacctggcggcagcgcaaaagatg

SEQ ID NO: 137826 - DNA, 103 bp, Artificial Sequence
  Synthetic Polynucleotide
taatacgactcactatagggccacctccaggattggtgggtgaagatgggaacagaggagacccatcatgacccaccaaaacctggcggcagcgcaaaagatg

SEQ ID NO: 137827 - DNA, 103 bp, Artificial Sequence
  Synthetic Polynucleotide
taatacgactcactatagggagccttctgcattgtgcactcaggaagctcaacagaggagagagcttatggagtgcacaaacctggcggcagcgcaaaagatg

SEQ ID NO: 137828 - DNA, 103 bp, Artificial Sequence
  Synthetic Polynucleotide
taatacgactcactatagggggcaggcactccacctccaggattggtgggaacagaggagacccaccatgcctggaggtaacctggcggcagcgcaaaagatg

SEQ ID NO: 137829 - DNA, 103 bp, Artificial Sequence
  Synthetic Polynucleotide
taatacgactcactatagggtgggcttcttggcaggcactccacctccagaacagaggagactggagatggagtgcctgaacctggcggcagcgcaaaagatg

SEQ ID NO: 137830 - DNA, 103 bp, Artificial Sequence
  Synthetic Polynucleotide
taatacgactcactatagggggcccacctttgggcttcttggcaggcactaacagaggagaagtgccatgcaagaagccaacctggcggcagcgcaaaagatg

SEQ ID NO: 137831 - DNA, 103 bp, Artificial Sequence
  Synthetic Polynucleotide
taatacgactcactatagggagaagcattgggcccacctttgggcttcttaacagaggagaaagaagatgaaaggtgggaacctggcggcagcgcaaaagatg

SEQ ID NO: 137832 - DNA, 103 bp, Artificial Sequence
  Synthetic Polynucleotide
taatacgactcactatagggctgaggagctagaagcattgggcccaccttaacagaggagaaaggtgatgccaatgcttaacctggcggcagcgcaaaagatg

SEQ ID NO: 137833 - DNA, 103 bp, Artificial Sequence
  Synthetic Polynucleotide
taatacgactcactatagggctgatggtggctgaggagctagaagcattgaacagaggagacaatgcatgtagctcctcaacctggcggcagcgcaaaagatg

SEQ ID NO: 137834 - DNA, 103 bp, Artificial Sequence
  Synthetic Polynucleotide
taatacgactcactataggggatctgcttgctgatggtggctgaggagctaacagaggagaagctccatggccaccatcaacctggcggcagcgcaaaagatg

SEQ ID NO: 137835 - DNA, 103 bp, Artificial Sequence
  Synthetic Polynucleotide
taatacgactcactatagggtccaggggaagatctgcttgctgatggtggaacagaggagaccaccaatggcaagcagaaacctggcggcagcgcaaaagatg

SEQ ID NO: 137836 - DNA, 103 bp, Artificial Sequence
  Synthetic Polynucleotide
taatacgactcactataggggactctttcatccaggggaagatctgcttgaacagaggagacaagcaatgcttcccctgaacctggcggcagcgcaaaagatg

SEQ ID NO: 137837 - DNA, 103 bp, Artificial Sequence
  Synthetic Polynucleotide
taatacgactcactataggggttctgtcgagactctttcatccaggggaaaacagaggagattccccatgatgaaagagaacctggcggcagcgcaaaagatg

SEQ ID NO: 137838 - DNA, 103 bp, Artificial Sequence
  Synthetic Polynucleotide
taatacgactcactatagggcatagtaagcagccttctgcattgtgcactaacagaggagaagtgcaatgtgcagaaggaacctggcggcagcgcaaaagatg

SEQ ID NO: 137839 - DNA, 103 bp, Artificial Sequence
  Synthetic Polynucleotide
taatacgactcactatagggtctgcttggagttctgtcgagactctttcaaacagaggagatgaaagatgctcgacagaaacctggcggcagcgcaaaagatg

SEQ ID NO: 137840 - DNA, 103 bp, Artificial Sequence
  Synthetic Polynucleotide
taatacgactcactatagggcagctgttcttctgcttggagttctgtcgaaacagaggagatcgacaatgctccaagcaaacctggcggcagcgcaaaagatg

SEQ ID NO: 137841 - DNA, 103 bp, Artificial Sequence
  Synthetic Polynucleotide
taatacgactcactatagggtgcagtggcacagctgttcttctgcttggaaacagaggagatccaagatgaagaacagcaacctggcggcagcgcaaaagatg

SEQ ID NO: 137842 - DNA, 103 bp, Artificial Sequence
  Synthetic Polynucleotide
taatacgactcactatagggagctctctcctgcagtggcacagctgttctaacagaggagaagaacaatggtgccactgaacctggcggcagcgcaaaagatg

SEQ ID NO: 137843 - DNA, 103 bp, Artificial Sequence
  Synthetic Polynucleotide
taatacgactcactatagggttgtcctcgcagctctctcctgcagtggcaaacagaggagatgccacatgaggagagagaacctggcggcagcgcaaaagatg

SEQ ID NO: 137844 - DNA, 103 bp, Artificial Sequence
  Synthetic Polynucleotide
taatacgactcactatagggtggcgggctcttgtcctcgcagctctctccaacagaggagaggagagatgtgcgaggacaacctggcggcagcgcaaaagatg

SEQ ID NO: 137845 - DNA, 103 bp, Artificial Sequence
  Synthetic Polynucleotide
taatacgactcactatagggatgctgggcctggcgggctcttgtcctcgcaacagaggagagcgaggatgagagcccgcaacctggcggcagcgcaaaagatg

SEQ ID NO: 137846 - DNA, 103 bp, Artificial Sequence
  Synthetic Polynucleotide
taatacgactcactatagggacccgcttggatgctgggcctggcgggctcaacagaggagagagcccatgaggcccagcaacctggcggcagcgcaaaagatg

SEQ ID NO: 137847 - DNA, 103 bp, Artificial Sequence
  Synthetic Polynucleotide
taatacgactcactatagggtgccgtgcgtacccgcttggatgctgggccaacagaggagaggcccaatgtccaagcggaacctggcggcagcgcaaaagatg

SEQ ID NO: 137848 - DNA, 103 bp, Artificial Sequence
  Synthetic Polynucleotide
taatacgactcactatagggcgctcgtgtatgccgtgcgtacccgcttggaacagaggagaccaagcatgtacgcacggaacctggcggcagcgcaaaagatg

SEQ ID NO: 137849 - DNA, 103 bp, Artificial Sequence
  Synthetic Polynucleotide
taatacgactcactatagggcctgggttttcatagtaagcagccttctgcaacagaggagagcagaaatgtgcttactaaacctggcggcagcgcaaaagatg

SEQ ID NO: 137850 - DNA, 103 bp, Artificial Sequence
  Synthetic Polynucleotide
taatacgactcactatagggaccagctgcgcgctcgtgtatgccgtgcgtaacagaggagaacgcacatgatacacgagaacctggcggcagcgcaaaagatg

SEQ ID NO: 137851 - DNA, 103 bp, Artificial Sequence
  Synthetic Polynucleotide
taatacgactcactatagggttccaattccaccagctgcgcgctcgtgtaaacagaggagatacacgatggcgcagctgaacctggcggcagcgcaaaagatg

SEQ ID NO: 137852 - DNA, 103 bp, Artificial Sequence
  Synthetic Polynucleotide
taatacgactcactatagggggaattccttttccaattccaccagctgcgaacagaggagacgcagcatgtggaattggaacctggcggcagcgcaaaagatg

SEQ ID NO: 137853 - DNA, 103 bp, Artificial Sequence
  Synthetic Polynucleotide
taatacgactcactatagggcggttgaagtggaattccttttccaattccaacagaggagaggaattatgaaaggaattaacctggcggcagcgcaaaagatg

SEQ ID NO: 137854 - DNA, 103 bp, Artificial Sequence
  Synthetic Polynucleotide
taatacgactcactataggggcacaagtagcggttgaagtggaattccttaacagaggagaaaggaaatgcacttcaacaacctggcggcagcgcaaaagatg

SEQ ID NO: 137855 - DNA, 103 bp, Artificial Sequence
  Synthetic Polynucleotide
taatacgactcactatagggggcgcggccggcacaagtagcggttgaagtaacagaggagaacttcaatggctacttgtaacctggcggcagcgcaaaagatg

SEQ ID NO: 137856 - DNA, 103 bp, Artificial Sequence
  Synthetic Polynucleotide
taatacgactcactatagggatctccacgcggcgcggccggcacaagtagaacagaggagactacttatgccggccgcgaacctggcggcagcgcaaaagatg

SEQ ID NO: 137857 - DNA, 103 bp, Artificial Sequence
  Synthetic Polynucleotide
taatacgactcactatagggcaggttggccatctccacgcggcgcggccgaacagaggagacggccgatgcgcgtggagaacctggcggcagcgcaaaagatg

SEQ ID NO: 137858 - DNA, 103 bp, Artificial Sequence
  Synthetic Polynucleotide
taatacgactcactatagggtgagattcagcaggttggccatctccacgcaacagaggagagcgtggatgtggccaaccaacctggcggcagcgcaaaagatg

SEQ ID NO: 137859 - DNA, 103 bp, Artificial Sequence
  Synthetic Polynucleotide
taatacgactcactatagggtggcgttccgtgagattcagcaggttggccaacagaggagaggccaaatggctgaatctaacctggcggcagcgcaaaagatg

SEQ ID NO: 137860 - DNA, 103 bp, Artificial Sequence
  Synthetic Polynucleotide
taatacgactcactatagggtccaaacagtcctgggttttcatagtaagcaacagaggagagcttacatggaaaacccaaacctggcggcagcgcaaaagatg

SEQ ID NO: 137861 - DNA, 103 bp, Artificial Sequence
  Synthetic Polynucleotide
taatacgactcactataggggatcttgatctggcgttccgtgagattcagaacagaggagactgaatatgacggaacgcaacctggcggcagcgcaaaagatg

SEQ ID NO: 137862 - DNA, 103 bp, Artificial Sequence
  Synthetic Polynucleotide
taatacgactcactatagggtctggaaccagatcttgatctggcgttccgaacagaggagacggaacatgagatcaagaaacctggcggcagcgcaaaagatg

SEQ ID NO: 137863 - DNA, 103 bp, Artificial Sequence; identical to SEQ ID NO: 136956
  Synthetic Polynucleotide

SEQ ID NO: 137864 - DNA, 103 bp, Artificial Sequence
  Synthetic Polynucleotide
taatacgactcactatagggcttgtacttcatgcgccggttctggaaccaaacagaggagatggttcatgaaccggcgcaacctggcggcagcgcaaaagatg

SEQ ID NO: 137865 - DNA, 103 bp, Artificial Sequence
  Synthetic Polynucleotide
taatacgactcactatagggtctggtccttcttgtacttcatgcgccggtaacagaggagaaccggcatgtgaagtacaaacctggcggcagcgcaaaagatg

SEQ ID NO: 137866 - DNA, 103 bp, Artificial Sequence
  Synthetic Polynucleotide
taatacgactcactatagggcccttggccttctggtccttcttgtacttcaacagaggagagaagtaatggaaggaccaaacctggcggcagcgcaaaagatg

SEQ ID NO: 137867 - DNA, 103 bp, Artificial Sequence
  Synthetic Polynucleotide
taatacgactcactataggggtgcaggatgcccttggccttctggtccttaacagaggagaaaggacatgaaggccaagaacctggcggcagcgcaaaagatg

SEQ ID NO: 137868 - DNA, 103 bp, Artificial Sequence
  Synthetic Polynucleotide
taatacgactcactatagggtagccggcgagtgcaggatgcccttggcctaacagaggagaaggccaatggcatcctgcaacctggcggcagcgcaaaagatg

SEQ ID NO: 137869 - DNA, 103 bp, Artificial Sequence
  Synthetic Polynucleotide
taatacgactcactatagggggggactggctagccggcgagtgcaggatgaacagaggagacatcctatgctcgccggcaacctggcggcagcgcaaaagatg

SEQ ID NO: 137870 - DNA, 103 bp, Artificial Sequence
  Synthetic Polynucleotide
taatacgactcactataggggctgcgctcaggggactggctagccggcgaaacagaggagatcgccgatgagccagtccaacctggcggcagcgcaaaagatg

SEQ ID NO: 137871 - DNA, 103 bp, Artificial Sequence
  Synthetic Polynucleotide
taatacgactcactatagggagccatagcctccaaacagtcctgggttttaacagaggagaaaaaccatggactgtttgaacctggcggcagcgcaaaagatg

SEQ ID NO: 137872 - DNA, 103 bp, Artificial Sequence
  Synthetic Polynucleotide
taatacgactcactatagggcgagcggtgggctgcgctcaggggactggcaacagaggagagccagtatgctgagcgcaaacctggcggcagcgcaaaagatg

SEQ ID NO: 137873 - DNA, 103 bp, Artificial Sequence
  Synthetic Polynucleotide
taatacgactcactataggggcggcgccgccgagcggtgggctgcgctcaaacagaggagatgagcgatgcccaccgctaacctggcggcagcgcaaaagatg

SEQ ID NO: 137874 - DNA, 103 bp, Artificial Sequence
  Synthetic Polynucleotide
taatacgactcactatagggcacgtggccagcggcgccgccgagcggtggaacagaggagaccaccgatgggcggcgccaacctggcggcagcgcaaaagatg

SEQ ID NO: 137875 - DNA, 103 bp, Artificial Sequence
  Synthetic Polynucleotide
taatacgactcactatagggcggagtaggccacgtggccagcggcgccgcaacagaggagagcggcgatgctggccacgaacctggcggcagcgcaaaagatg

SEQ ID NO: 137876 - DNA, 103 bp, Artificial Sequence
  Synthetic Polynucleotide
taatacgactcactatagggggcagctggccggagtaggccacgtggccaaacagaggagatggccaatgggcctactcaacctggcggcagcgcaaaagatg

SEQ ID NO: 137877 - DNA, 103 bp, Artificial Sequence
  Synthetic Polynucleotide
taatacgactcactataggggggcactggcggcagctggccggagtaggcaacagaggagagcctacatgggccagctgaacctggcggcagcgcaaaagatg

SEQ ID NO: 137878 - DNA, 103 bp, Artificial Sequence
  Synthetic Polynucleotide
taatacgactcactatagggaggccaggccgggcactggcggcagctggcaacagaggagagccagcatgcgccagtgcaacctggcggcagcgcaaaagatg

SEQ ID NO: 137879 - DNA, 103 bp, Artificial Sequence
  Synthetic Polynucleotide
taatacgactcactatagggggcgcgtcgtaggccaggccgggcactggcaacagaggagagccagtatgcggcctggcaacctggcggcagcgcaaaagatg

SEQ ID NO: 137880 - DNA, 103 bp, Artificial Sequence
  Synthetic Polynucleotide
taatacgactcactatagggaggcggcgagggcgcgtcgtaggccaggccaacagaggagaggcctgatgtacgacgcgaacctggcggcagcgcaaaagatg

SEQ ID NO: 137881 - DNA, 103 bp, Artificial Sequence
  Synthetic Polynucleotide
taatacgactcactatagggtggcgaaagcaggcggcgagggcgcgtcgtaacagaggagaacgacgatgcctcgccgcaacctggcggcagcgcaaaagatg

SEQ ID NO: 137882 - DNA, 103 bp, Artificial Sequence
  Synthetic Polynucleotide
taatacgactcactataggggttttgctgtagccatagcctccaaacagtaacagaggagaactgttatgaggctatggaacctggcggcagcgcaaaagatg

SEQ ID NO: 137883 - DNA, 103 bp, Artificial Sequence
  Synthetic Polynucleotide
taatacgactcactatagggggctgtgatttggcgaaagcaggcggcgagaacagaggagactcgccatgtgctttcgcaacctggcggcagcgcaaaagatg

SEQ ID NO: 137884 - DNA, 103 bp, Artificial Sequence
  Synthetic Polynucleotide
taatacgactcactataggggtacatattgggctgtgatttggcgaaagcaacagaggagagctttcatgaaatcacagaacctggcggcagcgcaaaagatg

SEQ ID NO: 137885 - DNA, 103 bp, Artificial Sequence
  Synthetic Polynucleotide
taatacgactcactatagggcggccaggccgtacatattgggctgtgattaacagaggagaaatcacatgccaatatgtaacctggcggcagcgcaaaagatg

SEQ ID NO: 137886 - DNA, 103 bp, Artificial Sequence
  Synthetic Polynucleotide
taatacgactcactataggggccgtgtaggcggccaggccgtacatattgaacagaggagacaatatatgcggcctggcaacctggcggcagcgcaaaagatg

SEQ ID NO: 137887 - DNA, 103 bp, Artificial Sequence
  Synthetic Polynucleotide
taatacgactcactataggggctgagtggcgccgtgtaggcggccaggccaacagaggagaggcctgatggcctacacgaacctggcggcagcgcaaaagatg

SEQ ID NO: 137888 - DNA, 103 bp, Artificial Sequence
  Synthetic Polynucleotide
taatacgactcactataggggcaggcagctgctgagtggcgccgtgtaggaacagaggagacctacaatgcgccactcaaacctggcggcagcgcaaaagatg

SEQ ID NO: 137889 - DNA, 103 bp, Artificial Sequence
  Synthetic Polynucleotide
taatacgactcactatagggttctgttgtggcaggcagctgctgagtggcaacagaggagagccactatgcagctgcctaacctggcggcagcgcaaaagatg

SEQ ID NO: 137890 - DNA, 103 bp, Artificial Sequence
  Synthetic Polynucleotide
taatacgactcactatagggtgcgtagcgcttctgttgtggcaggcagctaacagaggagaagctgcatgccacaacagaacctggcggcagcgcaaaagatg

SEQ ID NO: 137891 - DNA, 103 bp, Artificial Sequence
  Synthetic Polynucleotide
taatacgactcactatagggactccggcgctgcgtagcgcttctgttgtgaacagaggagacacaacatgagcgctacgaacctggcggcagcgcaaaagatg

SEQ ID NO: 137892 - DNA, 103 bp, Artificial Sequence
  Synthetic Polynucleotide
taatacgactcactatagggtggggctcgaactccggcgctgcgtagcgcaacagaggagagcgctaatgagcgccggaaacctggcggcagcgcaaaagatg

SEQ ID NO: 137893 - DNA, 103 bp, Artificial Sequence; identical to SEQ ID NO: 85424
  Synthetic Polynucleotide

SEQ ID NO: 137894 - DNA, 103 bp, Artificial Sequence; identical to SEQ ID NO: 85425
  Synthetic Polynucleotide

SEQ ID NO: 137895 - DNA, 103 bp, Artificial Sequence; identical to SEQ ID NO: 85426
  Synthetic Polynucleotide

SEQ ID NO: 137896 - DNA, 103 bp, Artificial Sequence; identical to SEQ ID NO: 85427
  Synthetic Polynucleotide

SEQ ID NO: 137897 - DNA, 103 bp, Artificial Sequence; identical to SEQ ID NO: 85428
  Synthetic Polynucleotide

SEQ ID NO: 137898 - DNA, 103 bp, Artificial Sequence; identical to SEQ ID NO: 85429
  Synthetic Polynucleotide

SEQ ID NO: 137899 - DNA, 103 bp, Artificial Sequence; identical to SEQ ID NO: 85430
  Synthetic Polynucleotide

SEQ ID NO: 137900 - DNA, 103 bp, Artificial Sequence; identical to SEQ ID NO: 85431
  Synthetic Polynucleotide

SEQ ID NO: 137901 - DNA, 103 bp, Artificial Sequence; identical to SEQ ID NO: 85432
  Synthetic Polynucleotide

SEQ ID NO: 137902 - DNA, 103 bp, Artificial Sequence; identical to SEQ ID NO: 85433
  Synthetic Polynucleotide

SEQ ID NO: 137903 - DNA, 103 bp, Artificial Sequence; identical to SEQ ID NO: 85434
  Synthetic Polynucleotide

SEQ ID NO: 137904 - DNA, 103 bp, Artificial Sequence; identical to SEQ ID NO: 85435
  Synthetic Polynucleotide

SEQ ID NO: 137905 - DNA, 103 bp, Artificial Sequence; identical to SEQ ID NO: 85436
  Synthetic Polynucleotide

SEQ ID NO: 137906 - DNA, 103 bp, Artificial Sequence; identical to SEQ ID NO: 85437
  Synthetic Polynucleotide

SEQ ID NO: 137907 - DNA, 103 bp, Artificial Sequence; identical to SEQ ID NO: 85438
  Synthetic Polynucleotide

SEQ ID NO: 137908 - DNA, 103 bp, Artificial Sequence; identical to SEQ ID NO: 85439
  Synthetic Polynucleotide

SEQ ID NO: 137909 - DNA, 103 bp, Artificial Sequence; identical to SEQ ID NO: 85440
  Synthetic Polynucleotide

SEQ ID NO: 137910 - DNA, 103 bp, Artificial Sequence; identical to SEQ ID NO: 85441
  Synthetic Polynucleotide

SEQ ID NO: 137911 - DNA, 103 bp, Artificial Sequence; identical to SEQ ID NO: 85442
  Synthetic Polynucleotide

SEQ ID NO: 137912 - DNA, 103 bp, Artificial Sequence; identical to SEQ ID NO: 85443
  Synthetic Polynucleotide

SEQ ID NO: 137913 - DNA, 103 bp, Artificial Sequence; identical to SEQ ID NO: 85444
  Synthetic Polynucleotide

SEQ ID NO: 137914 - DNA, 103 bp, Artificial Sequence; identical to SEQ ID NO: 85445
  Synthetic Polynucleotide

SEQ ID NO: 137915 - DNA, 103 bp, Artificial Sequence; identical to SEQ ID NO: 85446
  Synthetic Polynucleotide

SEQ ID NO: 137916 - DNA, 103 bp, Artificial Sequence; identical to SEQ ID NO: 85447
  Synthetic Polynucleotide

SEQ ID NO: 137917 - DNA, 103 bp, Artificial Sequence; identical to SEQ ID NO: 85448
  Synthetic Polynucleotide

SEQ ID NO: 137918 - DNA, 103 bp, Artificial Sequence; identical to SEQ ID NO: 85449
  Synthetic Polynucleotide

SEQ ID NO: 137919 - DNA, 103 bp, Artificial Sequence; identical to SEQ ID NO: 85450
  Synthetic Polynucleotide

SEQ ID NO: 137920 - DNA, 103 bp, Artificial Sequence; identical to SEQ ID NO: 85451
  Synthetic Polynucleotide

SEQ ID NO: 137921 - DNA, 103 bp, Artificial Sequence; identical to SEQ ID NO: 85452
  Synthetic Polynucleotide

SEQ ID NO: 137922 - DNA, 103 bp, Artificial Sequence; identical to SEQ ID NO: 85453
  Synthetic Polynucleotide

SEQ ID NO: 137923 - DNA, 103 bp, Artificial Sequence; identical to SEQ ID NO: 85454
  Synthetic Polynucleotide

SEQ ID NO: 137924 - DNA, 103 bp, Artificial Sequence; identical to SEQ ID NO: 85455
  Synthetic Polynucleotide

SEQ ID NO: 137925 - DNA, 103 bp, Artificial Sequence; identical to SEQ ID NO: 85456
  Synthetic Polynucleotide

SEQ ID NO: 137926 - DNA, 103 bp, Artificial Sequence; identical to SEQ ID NO: 85457
  Synthetic Polynucleotide

SEQ ID NO: 137927 - DNA, 103 bp, Artificial Sequence; identical to SEQ ID NO: 85458
  Synthetic Polynucleotide

SEQ ID NO: 137928 - DNA, 103 bp, Artificial Sequence; identical to SEQ ID NO: 85459
  Synthetic Polynucleotide

SEQ ID NO: 137929 - DNA, 103 bp, Artificial Sequence
  Synthetic Polynucleotide
taatacgactcactataggggggttcaccgaattcacgtgcaccttcttcaacagaggagagaagaaatggcacgtgaaaacctggcggcagcgcaaaagatg

SEQ ID NO: 137930 - DNA, 103 bp, Artificial Sequence
  Synthetic Polynucleotide
taatacgactcactatagggggtgtagttggggttcaccgaattcacgtgaacagaggagacacgtgatgtcggtgaacaacctggcggcagcgcaaaagatg

SEQ ID NO: 137931 - DNA, 103 bp, Artificial Sequence
  Synthetic Polynucleotide
taatacgactcactataggggttccccaccggtgtagttggggttcaccgaacagaggagacggtgaatgccaactacaaacctggcggcagcgcaaaagatg

SEQ ID NO: 137932 - DNA, 103 bp, Artificial Sequence
  Synthetic Polynucleotide
taatacgactcactataggggaccgcttgggttccccaccggtgtagttgaacagaggagacaactaatgcggtggggaaacctggcggcagcgcaaaagatg

SEQ ID NO: 137933 - DNA, 103 bp, Artificial Sequence
  Synthetic Polynucleotide
taatacgactcactatagggggccgttcgggaccgcttgggttccccaccaacagaggagaggtgggatgcccaagcggaacctggcggcagcgcaaaagatg

SEQ ID NO: 137934 - DNA, 103 bp, Artificial Sequence
  Synthetic Polynucleotide
taatacgactcactataggggccgggtgtaggccgttcgggaccgcttggaacagaggagaccaagcatgcccgaacggaacctggcggcagcgcaaaagatg

SEQ ID NO: 137935 - DNA, 103 bp, Artificial Sequence
  Synthetic Polynucleotide
taatacgactcactatagggaggacttgctgccgggtgtaggccgttcggaacagaggagaccgaacatgctacacccgaacctggcggcagcgcaaaagatg

SEQ ID NO: 137936 - DNA, 103 bp, Artificial Sequence
  Synthetic Polynucleotide
taatacgactcactatagggttccagttctaggacttgctgccgggtgtaaacagaggagatacaccatgcagcaagtcaacctggcggcagcgcaaaagatg

SEQ ID NO: 137937 - DNA, 103 bp, Artificial Sequence; identical to SEQ ID NO: 85461
  Synthetic Polynucleotide

SEQ ID NO: 137938 - DNA, 103 bp, Artificial Sequence
  Synthetic Polynucleotide
taatacgactcactataggggaaattctttttccagttctaggacttgctaacagaggagaagcaagatgtagaactggaacctggcggcagcgcaaaagatg

SEQ ID NO: 137939 - DNA, 103 bp, Artificial Sequence
  Synthetic Polynucleotide
taatacgactcactatagggctgttaaaatgaaattctttttccagttctaacagaggagaagaactatgaaaagaattaacctggcggcagcgcaaaagatg

SEQ ID NO: 137940 - DNA, 103 bp, Artificial Sequence
  Synthetic Polynucleotide
taatacgactcactatagggtgtcagatacctgttaaaatgaaattctttaacagaggagaaaagaaatgcattttaacaacctggcggcagcgcaaaagatg

SEQ ID NO: 137941 - DNA, 103 bp, Artificial Sequence
  Synthetic Polynucleotide
taatacgactcactataggggacggcgccttgtcagatacctgttaaaataacagaggagaattttaatgggtatctgaaacctggcggcagcgcaaaagatg

SEQ ID NO: 137942 - DNA, 103 bp, Artificial Sequence
  Synthetic Polynucleotide
taatacgactcactatagggatttcaatccgacggcgccttgtcagatacaacagaggagagtatctatgaaggcgccgaacctggcggcagcgcaaaagatg

SEQ ID NO: 137943 - DNA, 103 bp, Artificial Sequence
  Synthetic Polynucleotide
taatacgactcactatagggggtgtgagcgatttcaatccgacggcgcctaacagaggagaaggcgcatgcggattgaaaacctggcggcagcgcaaaagatg

SEQ ID NO: 137944 - DNA, 103 bp, Artificial Sequence
  Synthetic Polynucleotide
taatacgactcactatagggacagacacagggtgtgagcgatttcaatccaacagaggagaggattgatgtcgctcacaaacctggcggcagcgcaaaagatg

SEQ ID NO: 137945 - DNA, 103 bp, Artificial Sequence
  Synthetic Polynucleotide
taatacgactcactatagggtggcgctccgacagacacagggtgtgagcgaacagaggagacgctcaatgcctgtgtctaacctggcggcagcgcaaaagatg

SEQ ID NO: 137946 - DNA, 103 bp, Artificial Sequence
  Synthetic Polynucleotide
taatacgactcactataggggatcttgatctggcgctccgacagacacagaacagaggagactgtgtatgtcggagcgcaacctggcggcagcgcaaaagatg

SEQ ID NO: 137947 - DNA, 103 bp, Artificial Sequence
  Synthetic Polynucleotide
taatacgactcactatagggtctggaaccagatcttgatctggcgctccgaacagaggagacggagcatgagatcaagaaacctggcggcagcgcaaaagatg

SEQ ID NO: 137948 - DNA, 103 bp, Artificial Sequence; identical to SEQ ID NO: 85462
  Synthetic Polynucleotide

SEQ ID NO: 137949 - DNA, 103 bp, Artificial Sequence
  Synthetic Polynucleotide
taatacgactcactatagggatcctccggttctggaaccagatcttgatcaacagaggagagatcaaatgctggttccaaacctggcggcagcgcaaaagatg

SEQ ID NO: 137950 - DNA, 103 bp, Artificial Sequence
  Synthetic Polynucleotide
taatacgactcactatagggtttccacttcatcctccggttctggaaccaaacagaggagatggttcatgaaccggaggaacctggcggcagcgcaaaagatg

SEQ ID NO: 137951 - DNA, 103 bp, Artificial Sequence
  Synthetic Polynucleotide
taatacgactcactatagggtatgatcttttttccacttcatcctccggtaacagaggagaaccggaatgtgaagtggaaacctggcggcagcgcaaaagatg

SEQ ID NO: 137952 - DNA, 103 bp, Artificial Sequence
  Synthetic Polynucleotide
taatacgactcactatagggttgggcagcttatgatcttttttccacttcaacagaggagagaagtgatgaaaagatcaaacctggcggcagcgcaaaagatg

SEQ ID NO: 137953 - DNA, 103 bp, Artificial Sequence
  Synthetic Polynucleotide
taatacgactcactataggggcctttagtgttgggcagcttatgatctttaacagaggagaaaagatatgaagctgcccaacctggcggcagcgcaaaagatg

SEQ ID NO: 137954 - DNA, 103 bp, Artificial Sequence
  Synthetic Polynucleotide
taatacgactcactatagggacgatgacctgcctttagtgttgggcagctaacagaggagaagctgcatgacactaaagaacctggcggcagcgcaaaagatg

SEQ ID NO: 137955 - DNA, 103 bp, Artificial Sequence
  Synthetic Polynucleotide
taatacgactcactataggggaagatgaggacgatgacctgcctttagtgaacagaggagacactaaatgcaggtcatcaacctggcggcagcgcaaaagatg

SEQ ID NO: 137956 - DNA, 103 bp, Artificial Sequence
  Synthetic Polynucleotide
taatacgactcactatagggagatgaggaggaagatgaggacgatgacctaacagaggagaaggtcaatgtcctcatctaacctggcggcagcgcaaaagatg

SEQ ID NO: 137957 - DNA, 103 bp, Artificial Sequence
  Synthetic Polynucleotide
taatacgactcactatagggaggaggagcaagatgaggaggaagatgaggaacagaggagacctcatatgcctcctcataacctggcggcagcgcaaaagatg

SEQ ID NO: 137958 - DNA, 103 bp, Artificial Sequence
  Synthetic Polynucleotide
taatacgactcactatagggggggcgactgaggaggagcaagatgaggagaacagaggagactcctcatgttgctcctcaacctggcggcagcgcaaaagatg

SEQ ID NO: 137959 - DNA, 103 bp, Artificial Sequence; identical to SEQ ID NO: 85463
  Synthetic Polynucleotide

SEQ ID NO: 137960 - DNA, 103 bp, Artificial Sequence
  Synthetic Polynucleotide
taatacgactcactatagggatgctggctgggggcgactgaggaggagcaaacagaggagatgctccatgtcagtcgccaacctggcggcagcgcaaaagatg

SEQ ID NO: 137961 - DNA, 103 bp, Artificial Sequence
  Synthetic Polynucleotide
taatacgactcactatagggtcggctgtaaatgctggctgggggcgactgaacagaggagacagtcgatgccagccagcaacctggcggcagcgcaaaagatg

SEQ ID NO: 137962 - DNA, 103 bp, Artificial Sequence
  Synthetic Polynucleotide
taatacgactcactatagggtctttggccatcggctgtaaatgctggctgaacagaggagacagccaatgtttacagccaacctggcggcagcgcaaaagatg

SEQ ID NO: 137963 - DNA, 103 bp, Artificial Sequence
  Synthetic Polynucleotide
taatacgactcactatagggcgtgtggtggtctttggccatcggctgtaaaacagaggagattacagatgatggccaaaaacctggcggcagcgcaaaagatg

SEQ ID NO: 137964 - DNA, 103 bp, Artificial Sequence
  Synthetic Polynucleotide
taatacgactcactatagggtcgtcaggtccgtgtggtggtctttggccaaacagaggagatggccaatgaccaccacaaacctggcggcagcgcaaaagatg

SEQ ID NO: 137965 - DNA, 103 bp, Artificial Sequence; identical to SEQ ID NO: 85464
  Synthetic Polynucleotide

SEQ ID NO: 137966 - DNA, 103 bp, Artificial Sequence; identical to SEQ ID NO: 85465
  Synthetic Polynucleotide

SEQ ID NO: 137967 - DNA, 103 bp, Artificial Sequence
  Synthetic Polynucleotide
taatacgactcactataggggtacagcgggttcacgaagtacgaactcataacagaggagaatgagtatgtacttcgtgaacctggcggcagcgcaaaagatg

SEQ ID NO: 137968 - DNA, 103 bp, Artificial Sequence
  Synthetic Polynucleotide
taatacgactcactataggggacctcgggcgcgaagtgacagtcgtagtaaacagaggagatactacatgtgtcacttcaacctggcggcagcgcaaaagatg

SEQ ID NO: 137969 - DNA, 103 bp, Artificial Sequence
  Synthetic Polynucleotide
taatacgactcactataggggacggccgccgacctcgggcgcgaagtgacaacagaggagagtcactatgcgcccgaggaacctggcggcagcgcaaaagatg

SEQ ID NO: 137970 - DNA, 103 bp, Artificial Sequence
  Synthetic Polynucleotide
taatacgactcactataggggcggcggcgtgacggccgccgacctcgggcaacagaggagagcccgaatgcggcggccgaacctggcggcagcgcaaaagatg

SEQ ID NO: 137971 - DNA, 103 bp, Artificial Sequence
  Synthetic Polynucleotide
taatacgactcactatagggggctgctgcggcggcggcgtgacggccgccaacagaggagaggcggcatgcacgccgccaacctggcggcagcgcaaaagatg

SEQ ID NO: 137972 - DNA, 103 bp, Artificial Sequence
  Synthetic Polynucleotide
taatacgactcactatagggagagctgcagggctgctgcggcggcggcgtaacagaggagaacgccgatgccgcagcagaacctggcggcagcgcaaaagatg

SEQ ID NO: 137973 - DNA, 103 bp, Artificial Sequence
  Synthetic Polynucleotide
taatacgactcactatagggctgttgccatagagctgcagggctgctgcgaacagaggagacgcagcatgcctgcagctaacctggcggcagcgcaaaagatg

SEQ ID NO: 137974 - DNA, 103 bp, Artificial Sequence
  Synthetic Polynucleotide
taatacgactcactataggggccggcggcgctgttgccatagagctgcagaacagaggagactgcagatgtatggcaacaacctggcggcagcgcaaaagatg

SEQ ID NO: 137975 - DNA, 103 bp, Artificial Sequence
  Synthetic Polynucleotide
taatacgactcactatagggcgtgcgggaagccggcggcgctgttgccataacagaggagaatggcaatggcgccgccgaacctggcggcagcgcaaaagatg

SEQ ID NO: 137976 - DNA, 103 bp, Artificial Sequence
  Synthetic Polynucleotide
taatacgactcactatagggtgcgggggcgcgtgcgggaagccggcggcgaacagaggagacgccgcatgcttcccgcaaacctggcggcagcgcaaaagatg

SEQ ID NO: 137977 - DNA, 103 bp, Artificial Sequence
  Synthetic Polynucleotide
taatacgactcactatagggcgcgtgcgcctgcgggggcgcgtgcgggaaaacagaggagattcccgatggcgcccccgaacctggcggcagcgcaaaagatg

SEQ ID NO: 137978 - DNA, 103 bp, Artificial Sequence
  Synthetic Polynucleotide
taatacgactcactatagggtgtacttggagtacagcgggttcacgaagtaacagaggagaacttcgatgacccgctgtaacctggcggcagcgcaaaagatg

SEQ ID NO: 137979 - DNA, 103 bp, Artificial Sequence
  Synthetic Polynucleotide
taatacgactcactatagggggtgcgggtgcgcgtgcgcctgcgggggcgaacagaggagacgccccatgaggcgcacgaacctggcggcagcgcaaaagatg

SEQ ID NO: 137980 - DNA, 103 bp, Artificial Sequence
  Synthetic Polynucleotide
taatacgactcactatagggggcggggacgggtgcgggtgcgcgtgcgccaacagaggagaggcgcaatggcacccgcaaacctggcggcagcgcaaaagatg

SEQ ID NO: 137981 - DNA, 103 bp, Artificial Sequence
  Synthetic Polynucleotide
taatacgactcactatagggcccggagggcggcggggacgggtgcgggtgaacagaggagacacccgatgccgtccccgaacctggcggcagcgcaaaagatg

SEQ ID NO: 137982 - DNA, 103 bp, Artificial Sequence
  Synthetic Polynucleotide
taatacgactcactatagggcgcacccagtcccggagggcggcggggacgaacagaggagacgtcccatgcgccctccgaacctggcggcagcgcaaaagatg

SEQ ID NO: 137983 - DNA, 103 bp, Artificial Sequence
  Synthetic Polynucleotide
taatacgactcactatagggtccctaccgccgcacccagtcccggagggcaacagaggagagccctcatggactgggtgaacctggcggcagcgcaaaagatg

SEQ ID NO: 137984 - DNA, 103 bp, Artificial Sequence
  Synthetic Polynucleotide
taatacgactcactataggggccccggccttccctaccgccgcacccagtaacagaggagaactgggatgggcggtaggaacctggcggcagcgcaaaagatg

SEQ ID NO: 137985 - DNA, 103 bp, Artificial Sequence
  Synthetic Polynucleotide
taatacgactcactatagggagtactcctggccccggccttccctaccgcaacagaggagagcggtaatgaaggccgggaacctggcggcagcgcaaaagatg

SEQ ID NO: 137986 - DNA, 103 bp, Artificial Sequence
  Synthetic Polynucleotide
taatacgactcactatagggccggggtggaagtactcctggccccggcctaacagaggagaaggccgatgccaggagtaaacctggcggcagcgcaaaagatg

SEQ ID NO: 137987 - DNA, 103 bp, Artificial Sequence
  Synthetic Polynucleotide
taatacgactcactataggggctgcccccgccggggtggaagtactcctgaacagaggagacaggagatgttccaccccaacctggcggcagcgcaaaagatg

SEQ ID NO: 137988 - DNA, 103 bp, Artificial Sequence
  Synthetic Polynucleotide
taatacgactcactatagggcagcggccgggctgcccccgccggggtggaaacagaggagatccaccatggcgggggcaaacctggcggcagcgcaaaagatg

SEQ ID NO: 137989 - DNA, 103 bp, Artificial Sequence
  Synthetic Polynucleotide
taatacgactcactataggggccgccgccttgtacttggagtacagcgggaacagaggagacccgctatgctccaagtaaacctggcggcagcgcaaaagatg

SEQ ID NO: 137990 - DNA, 103 bp, Artificial Sequence
  Synthetic Polynucleotide
taatacgactcactataggggcctggtaggcagcggccgggctgcccccgaacagaggagacgggggatgcccggccgcaacctggcggcagcgcaaaagatg

SEQ ID NO: 137991 - DNA, 103 bp, Artificial Sequence
  Synthetic Polynucleotide
taatacgactcactatagggagggggggcggcctggtaggcagcggccggaacagaggagaccggccatggcctaccagaacctggcggcagcgcaaaagatg

SEQ ID NO: 137992 - DNA, 103 bp, Artificial Sequence
  Synthetic Polynucleotide
taatacgactcactataggggcggaggaggagggggggcggcctggtaggaacagaggagacctaccatgccgccccccaacctggcggcagcgcaaaagatg

SEQ ID NO: 137993 - DNA, 103 bp, Artificial Sequence
  Synthetic Polynucleotide
taatacgactcactatagggggcggaggatgcggaggaggagggggggcgaacagaggagacgccccatgtcctcctccaacctggcggcagcgcaaaagatg

SEQ ID NO: 137994 - DNA, 103 bp, Artificial Sequence
  Synthetic Polynucleotide
taatacgactcactatagggtggcggcggaggcggaggatgcggaggaggaacagaggagacctcctatgcatcctccgaacctggcggcagcgcaaaagatg

SEQ ID NO: 137995 - DNA, 103 bp, Artificial Sequence
  Synthetic Polynucleotide
taatacgactcactatagggaggggggaggtggcggcggaggcggaggataacagaggagaatcctcatgctccgccgcaacctggcggcagcgcaaaagatg

SEQ ID NO: 137996 - DNA, 103 bp, Artificial Sequence
  Synthetic Polynucleotide
taatacgactcactatagggatcccgccgcaggggggaggtggcggcggaaacagaggagatccgccatgacctcccccaacctggcggcagcgcaaaagatg

SEQ ID NO: 137997 - DNA, 103 bp, Artificial Sequence
  Synthetic Polynucleotide
taatacgactcactataggggtgacaggcaatcccgccgcaggggggaggaacagaggagacctcccatgtgcggcgggaacctggcggcagcgcaaaagatg

SEQ ID NO: 137998 - DNA, 103 bp, Artificial Sequence
  Synthetic Polynucleotide
taatacgactcactatagggcgggctccccgtgacaggcaatcccgccgcaacagaggagagcggcgatgttgcctgtcaacctggcggcagcgcaaaagatg

SEQ ID NO: 137999 - DNA, 103 bp, Artificial Sequence
  Synthetic Polynucleotide
taatacgactcactatagggtaaaacttcgcgggctccccgtgacaggcaaacagaggagatgcctgatgcggggagccaacctggcggcagcgcaaaagatg

SEQ ID NO: 138000 - DNA, 103 bp, Artificial Sequence
  Synthetic Polynucleotide
taatacgactcactatagggcgccgccgcagccgccgccttgtacttggaaacagaggagatccaagatgaaggcggcgaacctggcggcagcgcaaaagatg

SEQ ID NO: 138001 - DNA, 103 bp, Artificial Sequence
  Synthetic Polynucleotide
taatacgactcactatagggatcgtatccgtaaaacttcgcgggctccccaacagaggagaggggagatggcgaagtttaacctggcggcagcgcaaaagatg

SEQ ID NO: 138002 - DNA, 103 bp, Artificial Sequence
  Synthetic Polynucleotide
taatacgactcactatagggtctgtaagttatcgtatccgtaaaacttcgaacagaggagacgaagtatgacggatacgaacctggcggcagcgcaaaagatg

SEQ ID NO: 138003 - DNA, 103 bp, Artificial Sequence
  Synthetic Polynucleotide
taatacgactcactatagggatcggctgtctctgtaagttatcgtatccgaacagaggagacggataatgtaacttacaaacctggcggcagcgcaaaagatg

SEQ ID NO: 138004 - DNA, 103 bp, Artificial Sequence
  Synthetic Polynucleotide
taatacgactcactatagggggtcgtaaaaatcggctgtctctgtaagttaacagaggagaaacttaatgagacagccgaacctggcggcagcgcaaaagatg

SEQ ID NO: 138005 - DNA, 103 bp, Artificial Sequence
  Synthetic Polynucleotide
taatacgactcactatagggcctcttgctgggtcgtaaaaatcggctgtcaacagaggagagacagcatgtttttacgaaacctggcggcagcgcaaaagatg

SEQ ID NO: 138006 - DNA, 103 bp, Artificial Sequence
  Synthetic Polynucleotide
taatacgactcactatagggaccagctcggcctcttgctgggtcgtaaaaaacagaggagattttacatgccagcaagaaacctggcggcagcgcaaaagatg

SEQ ID NO: 138007 - DNA, 103 bp, Artificial Sequence
  Synthetic Polynucleotide
taatacgactcactatagggaggatattgtaccagctcggcctcttgctgaacagaggagacagcaaatggccgagctgaacctggcggcagcgcaaaagatg

SEQ ID NO: 138008 - DNA, 103 bp, Artificial Sequence
  Synthetic Polynucleotide
taatacgactcactatagggatttacagtcaggatattgtaccagctcggaacagaggagaccgagcatgtacaatatcaacctggcggcagcgcaaaagatg

SEQ ID NO: 138009 - DNA, 103 bp, Artificial Sequence
  Synthetic Polynucleotide
taatacgactcactatagggccactggacgatttacagtcaggatattgtaacagaggagaacaataatgtgactgtaaaacctggcggcagcgcaaaagatg

SEQ ID NO: 138010 - DNA, 103 bp, Artificial Sequence
  Synthetic Polynucleotide
taatacgactcactataggggccaatattaccactggacgatttacagtcaacagaggagagactgtatgtcgtccagtaacctggcggcagcgcaaaagatg

SEQ ID NO: 138011 - DNA, 103 bp, Artificial Sequence
  Synthetic Polynucleotide
taatacgactcactatagggccgccgccgccgccgccgcagccgccgcctaacagaggagaaggcggatgctgcggcggaacctggcggcagcgcaaaagatg

SEQ ID NO: 138012 - DNA, 103 bp, Artificial Sequence
  Synthetic Polynucleotide
taatacgactcactatagggctgggtcctcgccaatattaccactggacgaacagaggagacgtccaatggtaatattgaacctggcggcagcgcaaaagatg

SEQ ID NO: 138013 - DNA, 103 bp, Artificial Sequence
  Synthetic Polynucleotide
taatacgactcactatagggtttaagtggtctgggtcctcgccaatattaaacagaggagataatatatgcgaggacccaacctggcggcagcgcaaaagatg

SEQ ID NO: 138014 - DNA, 103 bp, Artificial Sequence
  Synthetic Polynucleotide
taatacgactcactatagggcgagctctgatttaagtggtctgggtcctcaacagaggagagaggacatggaccacttaaacctggcggcagcgcaaaagatg

SEQ ID NO: 138015 - DNA, 103 bp, Artificial Sequence
  Synthetic Polynucleotide
taatacgactcactataggggagaaggagacgagctctgatttaagtggtaacagaggagaaccactatgatcagagctaacctggcggcagcgcaaaagatg

SEQ ID NO: 138016 - DNA, 103 bp, Artificial Sequence
  Synthetic Polynucleotide
taatacgactcactatagggggaaacatttgagaaggagacgagctctgaaacagaggagatcagagatggtctccttcaacctggcggcagcgcaaaagatg

SEQ ID NO: 138017 - DNA, 103 bp, Artificial Sequence
  Synthetic Polynucleotide
taatacgactcactatagggtctcatccacggaaacatttgagaaggagaaacagaggagatctcctatgcaaatgtttaacctggcggcagcgcaaaagatg

SEQ ID NO: 138018 - DNA, 103 bp, Artificial Sequence
  Synthetic Polynucleotide
taatacgactcactatagggctgcttgtggtctcatccacggaaacatttaacagaggagaaaatgtatgcgtggatgaaacctggcggcagcgcaaaagatg

SEQ ID NO: 138019 - DNA, 103 bp, Artificial Sequence
  Synthetic Polynucleotide
taatacgactcactatagggctaccaggagctgcttgtggtctcatccacaacagaggagagtggatatgaccacaagcaacctggcggcagcgcaaaagatg

SEQ ID NO: 138020 - DNA, 103 bp, Artificial Sequence
  Synthetic Polynucleotide
taatacgactcactatagggtcctcttcgtctaccaggagctgcttgtggaacagaggagaccacaaatggctcctggtaacctggcggcagcgcaaaagatg

SEQ ID NO: 138021 - DNA, 103 bp, Artificial Sequence
  Synthetic Polynucleotide
taatacgactcactatagggaggtttgtcttcctcttcgtctaccaggagaacagaggagactcctgatggacgaagagaacctggcggcagcgcaaaagatg

SEQ ID NO: 138022 - DNA, 103 bp, Artificial Sequence
  Synthetic Polynucleotide
taatacgactcactatagggatggcctcgcccgccgccgccgccgccgcaaacagaggagatgcggcatgggcggcggcaacctggcggcagcgcaaaagatg

SEQ ID NO: 138023 - DNA, 103 bp, Artificial Sequence
  Synthetic Polynucleotide
taatacgactcactatagggaagcgactgtaggtttgtcttcctcttcgtaacagaggagaacgaagatgaagacaaacaacctggcggcagcgcaaaagatg

SEQ ID NO: 138024 - DNA, 103 bp, Artificial Sequence
  Synthetic Polynucleotide
taatacgactcactatagggtagagtttggaagcgactgtaggtttgtctaacagaggagaagacaaatgtacagtcgcaacctggcggcagcgcaaaagatg

SEQ ID NO: 138025 - DNA, 103 bp, Artificial Sequence
  Synthetic Polynucleotide
taatacgactcactatagggtttccaactctagagtttggaagcgactgtaacagaggagaacagtcatgtccaaactcaacctggcggcagcgcaaaagatg

SEQ ID NO: 138026 - DNA, 103 bp, Artificial Sequence
  Synthetic Polynucleotide
taatacgactcactatagggagaaattccttttccaactctagagtttggaacagaggagaccaaacatgagagttggaaacctggcggcagcgcaaaagatg

SEQ ID NO: 138027 - DNA, 103 bp, Artificial Sequence
  Synthetic Polynucleotide
taatacgactcactatagggggggttaaaaagaaattccttttccaactcaacagaggagagagttgatgaaggaatttaacctggcggcagcgcaaaagatg

SEQ ID NO: 138028 - DNA, 103 bp, Artificial Sequence
  Synthetic Polynucleotide
taatacgactcactatagggtggtcagataggggttaaaaagaaattcctaacagaggagaaggaatatgtttttaaccaacctggcggcagcgcaaaagatg

SEQ ID NO: 138029 - DNA, 103 bp, Artificial Sequence
  Synthetic Polynucleotide
taatacgactcactatagggcttcttttcctggtcagataggggttaaaaaacagaggagattttaaatgctatctgacaacctggcggcagcgcaaaagatg

SEQ ID NO: 138030 - DNA, 103 bp, Artificial Sequence
  Synthetic Polynucleotide
taatacgactcactatagggaacctcgattcttcttttcctggtcagataaacagaggagatatctgatgaggaaaagaaacctggcggcagcgcaaaagatg

SEQ ID NO: 138031 - DNA, 103 bp, Artificial Sequence
  Synthetic Polynucleotide
taatacgactcactataggggggcgtgggaaacctcgattcttcttttccaacagaggagaggaaaaatggaatcgaggaacctggcggcagcgcaaaagatg

SEQ ID NO: 138032 - DNA, 103 bp, Artificial Sequence
  Synthetic Polynucleotide
taatacgactcactataggggtgagggctagggcgtgggaaacctcgattaacagaggagaaatcgaatgttcccacgcaacctggcggcagcgcaaaagatg

SEQ ID NO: 138033 - DNA, 103 bp, Artificial Sequence
  Synthetic Polynucleotide
taatacgactcactatagggagtgggattgatggcctcgcccgccgccgcaacagaggagagcggcgatgggcgaggccaacctggcggcagcgcaaaagatg

SEQ ID NO: 138034 - DNA, 103 bp, Artificial Sequence
  Synthetic Polynucleotide
taatacgactcactatagggctgtctctcggtgagggctagggcgtgggaaacagaggagatcccacatgctagccctcaacctggcggcagcgcaaaagatg

SEQ ID NO: 138035 - DNA, 103 bp, Artificial Sequence
  Synthetic Polynucleotide
taatacgactcactatagggagatttttacctgtctctcggtgagggctaaacagaggagatagcccatgccgagagacaacctggcggcagcgcaaaagatg

SEQ ID NO: 138036 - DNA, 103 bp, Artificial Sequence
  Synthetic Polynucleotide
taatacgactcactatagggttctggaaccagatttttacctgtctctcgaacagaggagacgagagatgggtaaaaataacctggcggcagcgcaaaagatg

SEQ ID NO: 138037 - DNA, 103 bp, Artificial Sequence
  Synthetic Polynucleotide
taatacgactcactatagggcattctcctgttctggaaccagatttttacaacagaggagagtaaaaatgtggttccagaacctggcggcagcgcaaaagatg

SEQ ID NO: 138038 - DNA, 103 bp, Artificial Sequence
  Synthetic Polynucleotide
taatacgactcactatagggttttccatttcattctcctgttctggaaccaacagaggagaggttccatgacaggagaaaacctggcggcagcgcaaaagatg

SEQ ID NO: 138039 - DNA, 103 bp, Artificial Sequence
  Synthetic Polynucleotide
taatacgactcactatagggttgttttcctttttccatttcattctcctgaacagaggagacaggagatggaaatggaaaacctggcggcagcgcaaaagatg

SEQ ID NO: 138040 - DNA, 103 bp, Artificial Sequence
  Synthetic Polynucleotide
taatacgactcactatagggtttgtccttgttgttttcctttttccatttaacagaggagaaaatggatgaaggaaaacaacctggcggcagcgcaaaagatg

SEQ ID NO: 138041 - DNA, 103 bp, Artificial Sequence
  Synthetic Polynucleotide
taatacgactcactatagggaaacgggaaatttgtccttgttgttttcctaacagaggagaaggaaaatgacaaggacaaacctggcggcagcgcaaaagatg

SEQ ID NO: 138042 - DNA, 103 bp, Artificial Sequence
  Synthetic Polynucleotide
taatacgactcactatagggtcctgccgggaaacgggaaatttgtccttgaacagaggagacaaggaatgatttcccgtaacctggcggcagcgcaaaagatg

SEQ ID NO: 138043 - DNA, 103 bp, Artificial Sequence
  Synthetic Polynucleotide
taatacgactcactataggggtccttcacctcctgccgggaaacgggaaaaacagaggagatttcccatgtcccggcagaacctggcggcagcgcaaaagatg

SEQ ID NO: 138044 - DNA, 103 bp, Artificial Sequence
  Synthetic Polynucleotide
taatacgactcactatagggagtcgtagtaagtgggattgatggcctcgcaacagaggagagcgaggatgtcaatcccaaacctggcggcagcgcaaaagatg

SEQ ID NO: 138045 - DNA, 103 bp, Artificial Sequence
  Synthetic Polynucleotide
taatacgactcactatagggtcgtttccccgtccttcacctcctgccgggaacagaggagacccggcatgaggtgaaggaacctggcggcagcgcaaaagatg

SEQ ID NO: 138046 - DNA, 103 bp, Artificial Sequence
  Synthetic Polynucleotide
taatacgactcactataggggcttcctttttcgtttccccgtccttcaccaacagaggagaggtgaaatgcggggaaacaacctggcggcagcgcaaaagatg

SEQ ID NO: 138047 - DNA, 103 bp, Artificial Sequence
  Synthetic Polynucleotide
taatacgactcactatagggcagctcttgggcttcctttttcgtttccccaacagaggagaggggaaatgaaaaaggaaaacctggcggcagcgcaaaagatg

SEQ ID NO: 138048 - DNA, 103 bp, Artificial Sequence
  Synthetic Polynucleotide
taatacgactcactatagggtgtcttcctccagctcttgggcttccttttaacagaggagaaaaaggatgcccaagagcaacctggcggcagcgcaaaagatg

SEQ ID NO: 138049 - DNA, 103 bp, Artificial Sequence
  Synthetic Polynucleotide
taatacgactcactatagggccttcggctctgtcttcctccagctcttggaacagaggagaccaagaatgggaggaagaaacctggcggcagcgcaaaagatg

SEQ ID NO: 138050 - DNA, 103 bp, Artificial Sequence
  Synthetic Polynucleotide
taatacgactcactatagggatttgtcaggccttcggctctgtcttcctcaacagaggagagaggaaatgagagccgaaaacctggcggcagcgcaaaagatg

SEQ ID NO: 138051 - DNA, 103 bp, Artificial Sequence
  Synthetic Polynucleotide
taatacgactcactataggggcgaagtgacagtcgtagtaagtgggattgaacagaggagacaatccatgttactacgaaacctggcggcagcgcaaaagatg

SEQ ID NO: 138052 - DNA, 103 bp, Artificial Sequence
  Synthetic Polynucleotide
taatacgactcactatagggtttgaggcgtcccgcactcccacccaacataacagaggagaatgttgatggggagtgcgaacctggcggcagcgcaaaagatg

SEQ ID NO: 138053 - DNA, 103 bp, Artificial Sequence
  Synthetic Polynucleotide
taatacgactcactatagggcggcccgaagcgcgccgcgaacacctcgtcaacagaggagagacgagatgttcgcggcgaacctggcggcagcgcaaaagatg

SEQ ID NO: 138054 - DNA, 103 bp, Artificial Sequence
  Synthetic Polynucleotide
taatacgactcactatagggcattttcatcctacggttctgaaaccagataacagaggagaatctggatgcagaaccgtaacctggcggcagcgcaaaagatg

SEQ ID NO: 138055 - DNA, 103 bp, Artificial Sequence
  Synthetic Polynucleotide
taatacgactcactatagggtcatctttttcattttcatcctacggttctaacagaggagaagaaccatgggatgaaaaaacctggcggcagcgcaaaagatg

SEQ ID NO: 138056 - DNA, 103 bp, Artificial Sequence
  Synthetic Polynucleotide
taatacgactcactatagggttctccttgctcatctttttcattttcatcaacagaggagagatgaaatggaaaaagataacctggcggcagcgcaaaagatg

SEQ ID NO: 138057 - DNA, 103 bp, Artificial Sequence
  Synthetic Polynucleotide
taatacgactcactatagggtttggggcatttctccttgctcatctttttaacagaggagaaaaaagatgagcaaggagaacctggcggcagcgcaaaagatg

SEQ ID NO: 138058 - DNA, 103 bp, Artificial Sequence
  Synthetic Polynucleotide
taatacgactcactatagggctggccccggcggcccgaagcgcgccgcgaaacagaggagatcgcggatggcttcgggcaacctggcggcagcgcaaaagatg

SEQ ID NO: 138059 - DNA, 103 bp, Artificial Sequence
  Synthetic Polynucleotide
taatacgactcactatagggccctgcgcgcctggccccggcggcccgaagaacagaggagacttcggatggccggggccaacctggcggcagcgcaaaagatg

SEQ ID NO: 138060 - DNA, 103 bp, Artificial Sequence
  Synthetic Polynucleotide
taatacgactcactatagggtgcaggccggccctgcgcgcctggccccggaacagaggagaccggggatgggcgcgcagaacctggcggcagcgcaaaagatg

SEQ ID NO: 138061 - DNA, 103 bp, Artificial Sequence
  Synthetic Polynucleotide
taatacgactcactatagggcagccacacctgcaggccggccctgcgcgcaacagaggagagcgcgcatggccggcctgaacctggcggcagcgcaaaagatg

SEQ ID NO: 138062 - DNA, 103 bp, Artificial Sequence
  Synthetic Polynucleotide
taatacgactcactataggggccgggccatcagccacacctgcaggccggaacagaggagaccggccatgaggtgtggcaacctggcggcagcgcaaaagatg

SEQ ID NO: 138063 - DNA, 103 bp, Artificial Sequence
  Synthetic Polynucleotide
taatacgactcactatagggggcggtggcggccgggccatcagccacaccaacagaggagaggtgtgatggatggcccgaacctggcggcagcgcaaaagatg

SEQ ID NO: 138064 - DNA, 103 bp, Artificial Sequence
  Synthetic Polynucleotide
taatacgactcactatagggcgaactcggcggcggtggcggccgggccataacagaggagaatggccatgccgccaccgaacctggcggcagcgcaaaagatg

SEQ ID NO: 138065 - DNA, 103 bp, Artificial Sequence
  Synthetic Polynucleotide
taatacgactcactatagggctacacgaggcgaactcggcggcggtggcgaacagaggagacgccacatgcgccgagttaacctggcggcagcgcaaaagatg

SEQ ID NO: 138066 - DNA, 103 bp, Artificial Sequence
  Synthetic Polynucleotide
taatacgactcactataggggggggcaaaactacacgaggcgaactcggcaacagaggagagccgagatggcctcgtgtaacctggcggcagcgcaaaagatg

SEQ ID NO: 138067 - DNA, 103 bp, Artificial Sequence
  Synthetic Polynucleotide
taatacgactcactatagggtggaagacattttgaggcgtcccgcactccaacagaggagaggagtgatggacgcctcaaacctggcggcagcgcaaaagatg

SEQ ID NO: 138068 - DNA, 103 bp, Artificial Sequence
  Synthetic Polynucleotide
taatacgactcactatagggcggccgatctgggggcaaaactacacgaggaacagaggagacctcgtatggttttgcccaacctggcggcagcgcaaaagatg

SEQ ID NO: 138069 - DNA, 103 bp, Artificial Sequence
  Synthetic Polynucleotide
taatacgactcactataggggcagagaacacggccgatctgggggcaaaaaacagaggagattttgcatgcagatcggcaacctggcggcagcgcaaaagatg

SEQ ID NO: 138070 - DNA, 103 bp, Artificial Sequence
  Synthetic Polynucleotide
taatacgactcactatagggggaccacgaggcagagaacacggccgatctaacagaggagaagatcgatggtgttctctaacctggcggcagcgcaaaagatg

SEQ ID NO: 138071 - DNA, 103 bp, Artificial Sequence
  Synthetic Polynucleotide
taatacgactcactatagggagggcaccgcggaccacgaggcagagaacaaacagaggagatgttctatgcctcgtggtaacctggcggcagcgcaaaagatg

SEQ ID NO: 138072 - DNA, 103 bp, Artificial Sequence
  Synthetic Polynucleotide
taatacgactcactataggggggggctgggagggcaccgcggaccacgagaacagaggagactcgtgatgcgcggtgccaacctggcggcagcgcaaaagatg

SEQ ID NO: 138073 - DNA, 103 bp, Artificial Sequence
  Synthetic Polynucleotide
taatacgactcactatagggcgccgctgccgggggctgggagggcaccgcaacagaggagagcggtgatgtcccagcccaacctggcggcagcgcaaaagatg

SEQ ID NO: 138074 - DNA, 103 bp, Artificial Sequence
  Synthetic Polynucleotide
taatacgactcactatagggcgctcatcgccgccgctgccgggggctgggaacagaggagacccagcatgcggcagcggaacctggcggcagcgcaaaagatg

SEQ ID NO: 138075 - DNA, 103 bp, Artificial Sequence
  Synthetic Polynucleotide
taatacgactcactatagggtggtagaggccgctcatcgccgccgctgccaacagaggagaggcagcatgggcgatgagaacctggcggcagcgcaaaagatg

SEQ ID NO: 138076 - DNA, 103 bp, Artificial Sequence
  Synthetic Polynucleotide
taatacgactcactatagggaacgtacgggtggtagaggccgctcatcgcaacagaggagagcgatgatgggcctctacaacctggcggcagcgcaaaagatg

SEQ ID NO: 138077 - DNA, 103 bp, Artificial Sequence
  Synthetic Polynucleotide
taatacgactcactataggggcggcgggggaacgtacgggtggtagaggcaacagaggagagcctctatgacccgtacgaacctggcggcagcgcaaaagatg

SEQ ID NO: 138078 - DNA, 103 bp, Artificial Sequence
  Synthetic Polynucleotide
taatacgactcactatagggagggtgccactggaagacattttgaggcgtaacagaggagaacgcctatgaatgtcttcaacctggcggcagcgcaaaagatg

SEQ ID NO: 138079 - DNA, 103 bp, Artificial Sequence
  Synthetic Polynucleotide
taatacgactcactataggggcggccaggggcggcgggggaacgtacgggaacagaggagacccgtaatgtcccccgccaacctggcggcagcgcaaaagatg

SEQ ID NO: 138080 - DNA, 103 bp, Artificial Sequence
  Synthetic Polynucleotide
taatacgactcactatagggggaggcagaggcggccaggggcggcgggggaacagaggagacccccgatgcccctggccaacctggcggcagcgcaaaagatg

SEQ ID NO: 138081 - DNA, 103 bp, Artificial Sequence
  Synthetic Polynucleotide
taatacgactcactatagggggccgggctcggaggcagaggcggccagggaacagaggagaccctggatgcctctgcctaacctggcggcagcgcaaaagatg

SEQ ID NO: 138082 - DNA, 103 bp, Artificial Sequence
  Synthetic Polynucleotide
taatacgactcactatagggcgcacgtagcggccgggctcggaggcagagaacagaggagactctgcatgcgagcccggaacctggcggcagcgcaaaagatg

SEQ ID NO: 138083 - DNA, 103 bp, Artificial Sequence
  Synthetic Polynucleotide
taatacgactcactatagggcatccaggagcgcacgtagcggccgggctcaacagaggagagagcccatgcgctacgtgaacctggcggcagcgcaaaagatg

SEQ ID NO: 138084 - DNA, 103 bp, Artificial Sequence
  Synthetic Polynucleotide
taatacgactcactataggggcagcggctccatccaggagcgcacgtagcaacagaggagagctacgatggctcctggaaacctggcggcagcgcaaaagatg

SEQ ID NO: 138085 - DNA, 103 bp, Artificial Sequence
  Synthetic Polynucleotide
taatacgactcactataggggggaagccgggcagcggctccatccaggagaacagaggagactcctgatgggagccgctaacctggcggcagcgcaaaagatg

SEQ ID NO: 138086 - DNA, 103 bp, Artificial Sequence
  Synthetic Polynucleotide
taatacgactcactatagggcgcaccgcccgggaagccgggcagcggctcaacagaggagagagccgatgcccggcttcaacctggcggcagcgcaaaagatg

SEQ ID NO: 138087 - DNA, 103 bp, Artificial Sequence
  Synthetic Polynucleotide
taatacgactcactatagggcgccaccgcccgcaccgcccgggaagccggaacagaggagaccggctatgcgggcggtgaacctggcggcagcgcaaaagatg

SEQ ID NO: 138088 - DNA, 103 bp, Artificial Sequence
  Synthetic Polynucleotide
taatacgactcactatagggccaccaccaccgccaccgcccgcaccgcccaacagaggagagggcggatggggcggtggaacctggcggcagcgcaaaagatg

SEQ ID NO: 138089 - DNA, 103 bp, Artificial Sequence
  Synthetic Polynucleotide
taatacgactcactataggggtagttgctgagggtgccactggaagacataacagaggagaatgtctatgagtggcaccaacctggcggcagcgcaaaagatg

SEQ ID NO: 138090 - DNA, 103 bp, Artificial Sequence
  Synthetic Polynucleotide
taatacgactcactatagggaccgccgcctccaccaccaccgccaccgccaacagaggagaggcggtatgggtggtggtaacctggcggcagcgcaaaagatg

SEQ ID NO: 138091 - DNA, 103 bp, Artificial Sequence
  Synthetic Polynucleotide
taatacgactcactatagggcgcggcccggaccgccgcctccaccaccacaacagaggagagtggtgatggaggcggcgaacctggcggcagcgcaaaagatg

SEQ ID NO: 138092 - DNA, 103 bp, Artificial Sequence
  Synthetic Polynucleotide
taatacgactcactataggggggctgggaccgcggcccggaccgccgcctaacagaggagaaggcggatgtccgggccgaacctggcggcagcgcaaaagatg

SEQ ID NO: 138093 - DNA, 103 bp, Artificial Sequence
  Synthetic Polynucleotide
taatacgactcactataggggctggggccagggctgggaccgcggcccggaacagaggagaccgggcatgggtcccagcaacctggcggcagcgcaaaagatg

SEQ ID NO: 138094 - DNA, 103 bp, Artificial Sequence
  Synthetic Polynucleotide
taatacgactcactatagggtggctgggccgctggggccagggctgggacaacagaggagagtcccaatgctggccccaaacctggcggcagcgcaaaagatg

SEQ ID NO: 138095 - DNA, 103 bp, Artificial Sequence
  Synthetic Polynucleotide
taatacgactcactatagggtggcgcccgttggctgggccgctggggccaaacagaggagatggcccatgcggcccagcaacctggcggcagcgcaaaagatg

SEQ ID NO: 138096 - DNA, 103 bp, Artificial Sequence
  Synthetic Polynucleotide
taatacgactcactatagggaatcccgtagtggcgcccgttggctgggccaacagaggagaggcccaatgaacgggcgcaacctggcggcagcgcaaaagatg

SEQ ID NO: 138097 - DNA, 103 bp, Artificial Sequence
  Synthetic Polynucleotide
taatacgactcactatagggtttcaggcttaatcccgtagtggcgcccgtaacagaggagaacgggcatgactacgggaaacctggcggcagcgcaaaagatg

SEQ ID NO: 138098 - DNA, 103 bp, Artificial Sequence
  Synthetic Polynucleotide
taatacgactcactataggggccgctcgggtttcaggcttaatcccgtagaacagaggagactacggatgtaagcctgaaacctggcggcagcgcaaaagatg

SEQ ID NO: 138099 - DNA, 103 bp, Artificial Sequence
  Synthetic Polynucleotide
taatacgactcactataggggggggccggggccgctcgggtttcaggcttaacagaggagaaagcctatgacccgagcgaacctggcggcagcgcaaaagatg

SEQ ID NO: 138100 - DNA, 103 bp, Artificial Sequence
  Synthetic Polynucleotide
taatacgactcactatagggagtccacgtagtagttgctgagggtgccacaacagaggagagtggcaatgtcagcaactaacctggcggcagcgcaaaagatg

SEQ ID NO: 138101 - DNA, 103 bp, Artificial Sequence
  Synthetic Polynucleotide
taatacgactcactatagggcggccgtggcgggggccggggccgctcgggaacagaggagacccgagatgccccggcccaacctggcggcagcgcaaaagatg

SEQ ID NO: 138102 - DNA, 103 bp, Artificial Sequence
  Synthetic Polynucleotide
taatacgactcactataggggtggtggaggcggccgtggcgggggccgggaacagaggagacccggcatgcgccacggcaacctggcggcagcgcaaaagatg

SEQ ID NO: 138103 - DNA, 103 bp, Artificial Sequence
  Synthetic Polynucleotide
taatacgactcactatagggggaggaggaggtggtggaggcggccgtggcaacagaggagagccacgatggcctccaccaacctggcggcagcgcaaaagatg

SEQ ID NO: 138104 - DNA, 103 bp, Artificial Sequence
  Synthetic Polynucleotide
taatacgactcactatagggaggaagtggaggaggaggaggtggtggaggaacagaggagacctccaatgcctcctcctaacctggcggcagcgcaaaagatg

SEQ ID NO: 138105 - DNA, 103 bp, Artificial Sequence
  Synthetic Polynucleotide
taatacgactcactataggggaggaggataaggaagtggaggaggaggagaacagaggagactcctcatgctccacttcaacctggcggcagcgcaaaagatg

SEQ ID NO: 138106 - DNA, 103 bp, Artificial Sequence
  Synthetic Polynucleotide
taatacgactcactatagggccgtttggaggaggaggataaggaagtggaaacagaggagatccactatgttatcctccaacctggcggcagcgcaaaagatg

SEQ ID NO: 138107 - DNA, 103 bp, Artificial Sequence
  Synthetic Polynucleotide
taatacgactcactatagggagcactcagtccgtttggaggaggaggataaacagaggagatatcctatgcctccaaacaacctggcggcagcgcaaaagatg

SEQ ID NO: 138108 - DNA, 103 bp, Artificial Sequence
  Synthetic Polynucleotide
taatacgactcactatagggcgggccacggagcactcagtccgtttggagaacagaggagactccaaatggactgagtgaacctggcggcagcgcaaaagatg

SEQ ID NO: 138109 - DNA, 103 bp, Artificial Sequence
  Synthetic Polynucleotide
taatacgactcactatagggctgggactcccgggccacggagcactcagtaacagaggagaactgagatgtccgtggccaacctggcggcagcgcaaaagatg

SEQ ID NO: 138110 - DNA, 103 bp, Artificial Sequence
  Synthetic Polynucleotide
taatacgactcactatagggcgctgctcccctgggactcccgggccacggaacagaggagaccgtggatggggagtcccaacctggcggcagcgcaaaagatg

SEQ ID NO: 138111 - DNA, 103 bp, Artificial Sequence
  Synthetic Polynucleotide
taatacgactcactatagggcctataagcgagtccacgtagtagttgctgaacagaggagacagcaaatgctacgtggaaacctggcggcagcgcaaaagatg

SEQ ID NO: 138112 - DNA, 103 bp, Artificial Sequence
  Synthetic Polynucleotide
taatacgactcactatagggaactcggggccgctgctcccctgggactccaacagaggagaggagtcatgggggagcagaacctggcggcagcgcaaaagatg

SEQ ID NO: 138113 - DNA, 103 bp, Artificial Sequence
  Synthetic Polynucleotide
taatacgactcactataggggttgcacgagaactcggggccgctgctcccaacagaggagagggagcatgggccccgagaacctggcggcagcgcaaaagatg

SEQ ID NO: 138114 - DNA, 103 bp, Artificial Sequence
  Synthetic Polynucleotide
taatacgactcactataggggcaggaacgagttgcacgagaactcggggcaacagaggagagccccgatgtctcgtgcaaacctggcggcagcgcaaaagatg

SEQ ID NO: 138115 - DNA, 103 bp, Artificial Sequence
  Synthetic Polynucleotide
taatacgactcactataggggccttctcctgcaggaacgagttgcacgagaacagaggagactcgtgatgctcgttcctaacctggcggcagcgcaaaagatg

SEQ ID NO: 138116 - DNA, 103 bp, Artificial Sequence
  Synthetic Polynucleotide
taatacgactcactatagggcgccgctgccgccttctcctgcaggaacgaaacagaggagatcgttcatgcaggagaagaacctggcggcagcgcaaaagatg

SEQ ID NO: 138117 - DNA, 103 bp, Artificial Sequence
  Synthetic Polynucleotide
taatacgactcactatagggttccccccgtcgccgctgccgccttctcctaacagaggagaaggagaatgcggcagcggaacctggcggcagcgcaaaagatg

SEQ ID NO: 138118 - DNA, 103 bp, Artificial Sequence
  Synthetic Polynucleotide
taatacgactcactatagggccaggcccggttccccccgtcgccgctgccaacagaggagaggcagcatggacggggggaacctggcggcagcgcaaaagatg

SEQ ID NO: 138119 - DNA, 103 bp, Artificial Sequence
  Synthetic Polynucleotide
taatacgactcactataggggatccctgccccaggcccggttccccccgtaacagaggagaacggggatgaccgggcctaacctggcggcagcgcaaaagatg

SEQ ID NO: 138120 - DNA, 103 bp, Artificial Sequence
  Synthetic Polynucleotide
taatacgactcactatagggtcgcggccccgatccctgccccaggcccggaacagaggagaccgggcatggggcagggaaacctggcggcagcgcaaaagatg

SEQ ID NO: 138121 - DNA, 103 bp, Artificial Sequence
  Synthetic Polynucleotide
taatacgactcactatagggcccgtcccagtcgcggccccgatccctgccaacagaggagaggcaggatgcggggccgcaacctggcggcagcgcaaaagatg

SEQ ID NO: 138122 - DNA, 103 bp, Artificial Sequence
  Synthetic Polynucleotide
taatacgactcactataggggccctcatggcctataagcgagtccacgtaaacagaggagatacgtgatgtcgcttataaacctggcggcagcgcaaaagatg

SEQ ID NO: 138123 - DNA, 103 bp, Artificial Sequence
  Synthetic Polynucleotide
taatacgactcactatagggcgacgagccgcccgtcccagtcgcggccccaacagaggagaggggccatgactgggacgaacctggcggcagcgcaaaagatg

SEQ ID NO: 138124 - DNA, 103 bp, Artificial Sequence
  Synthetic Polynucleotide
taatacgactcactatagggctgagggctccgacgagccgcccgtcccagaacagaggagactgggaatggcggctcgtaacctggcggcagcgcaaaagatg

SEQ ID NO: 138125 - DNA, 103 bp, Artificial Sequence
  Synthetic Polynucleotide
taatacgactcactatagggtcgctgcaagctgagggctccgacgagccgaacagaggagacggctcatgggagccctcaacctggcggcagcgcaaaagatg

SEQ ID NO: 138126 - DNA, 103 bp, Artificial Sequence
  Synthetic Polynucleotide
taatacgactcactataggggatcgggtggtcgctgcaagctgagggctcaacagaggagagagcccatggcttgcagcaacctggcggcagcgcaaaagatg

SEQ ID NO: 138127 - DNA, 103 bp, Artificial Sequence
  Synthetic Polynucleotide
taatacgactcactatagggaacagcctgggatcgggtggtcgctgcaagaacagaggagacttgcaatgaccacccgaaacctggcggcagcgcaaaagatg

SEQ ID NO: 138128 - DNA, 103 bp, Artificial Sequence
  Synthetic Polynucleotide
taatacgactcactatagggtccttcagcgaacagcctgggatcgggtggaacagaggagaccacccatgcccaggctgaacctggcggcagcgcaaaagatg

SEQ ID NO: 138129 - DNA, 103 bp, Artificial Sequence
  Synthetic Polynucleotide
taatacgactcactatagggcttctcctcctccttcagcgaacagcctggaacagaggagaccaggcatgtcgctgaagaacctggcggcagcgcaaaagatg

SEQ ID NO: 138130 - DNA, 103 bp, Artificial Sequence
  Synthetic Polynucleotide
taatacgactcactataggggcgaatgctgcttctcctcctccttcagcgaacagaggagacgctgaatgaggaggagaaacctggcggcagcgcaaaagatg

SEQ ID NO: 138131 - DNA, 103 bp, Artificial Sequence
  Synthetic Polynucleotide
taatacgactcactatagggtgctgcggctgcgaatgctgcttctcctccaacagaggagaggaggaatggcagcattcaacctggcggcagcgcaaaagatg

SEQ ID NO: 138132 - DNA, 103 bp, Artificial Sequence
  Synthetic Polynucleotide
taatacgactcactatagggaagttgctgctgctgcggctgcgaatgctgaacagaggagacagcatatgcagccgcagaacctggcggcagcgcaaaagatg

SEQ ID NO: 138133 - DNA, 103 bp, Artificial Sequence
  Synthetic Polynucleotide
taatacgactcactatagggacacctcgtcgccctcatggcctataagcgaacagaggagacgcttaatggccatgaggaacctggcggcagcgcaaaagatg

SEQ ID NO: 138134 - DNA, 103 bp, Artificial Sequence
  Synthetic Polynucleotide
taatacgactcactatagggtgtttgggtcaagttgctgctgctgcggctaacagaggagaagccgcatgagcagcaacaacctggcggcagcgcaaaagatg

SEQ ID NO: 138135 - DNA, 103 bp, Artificial Sequence
  Synthetic Polynucleotide
taatacgactcactataggggcggcggggttgtttgggtcaagttgctgcaacagaggagagcagcaatgtgacccaaaaacctggcggcagcgcaaaagatg

SEQ ID NO: 138136 - DNA, 103 bp, Artificial Sequence
  Synthetic Polynucleotide
taatacgactcactataggggatccagttcgcggcggggttgtttgggtcaacagaggagagacccaatgaaccccgccaacctggcggcagcgcaaaagatg

SEQ ID NO: 138137 - DNA, 103 bp, Artificial Sequence
  Synthetic Polynucleotide
taatacgactcactatagggagcgagcgtggatccagttcgcggcggggtaacagaggagaaccccgatgcgaactggaaacctggcggcagcgcaaaagatg

SEQ ID NO: 138138 - DNA, 103 bp, Artificial Sequence
  Synthetic Polynucleotide
taatacgactcactatagggttccgggtggagcgagcgtggatccagttcaacagaggagagaactgatgccacgctcgaacctggcggcagcgcaaaagatg

SEQ ID NO: 138139 - DNA, 103 bp, Artificial Sequence
  Synthetic Polynucleotide
taatacgactcactatagggacagcgctttttccgggtggagcgagcgtgaacagaggagacacgctatgtccacccggaacctggcggcagcgcaaaagatg

SEQ ID NO: 138140 - DNA, 103 bp, Artificial Sequence
  Synthetic Polynucleotide
taatacgactcactatagggtggtgtagggacagcgctttttccgggtggaacagaggagaccacccatgaaaagcgctaacctggcggcagcgcaaaagatg

SEQ ID NO: 138141 - DNA, 103 bp, Artificial Sequence; identical to SEQ ID NO: 137146
  Synthetic Polynucleotide

SEQ ID NO: 138142 - DNA, 103 bp, Artificial Sequence
  Synthetic Polynucleotide
taatacgactcactatagggcagctcaagcgtctggtatttggtgtagggaacagaggagaccctacatgaaataccagaacctggcggcagcgcaaaagatg

SEQ ID NO: 138143 - DNA, 103 bp, Artificial Sequence
  Synthetic Polynucleotide
taatacgactcactatagggattctttctccagctcaagcgtctggtattaacagaggagaaataccatgcgcttgagcaacctggcggcagcgcaaaagatg

SEQ ID NO: 138144 - DNA, 103 bp, Artificial Sequence
  Synthetic Polynucleotide
taatacgactcactatagggcgcgccgcgaacacctcgtcgccctcatggaacagaggagaccatgaatgcgacgaggtaacctggcggcagcgcaaaagatg

SEQ ID NO: 138145 - DNA, 103 bp, Artificial Sequence
  Synthetic Polynucleotide
taatacgactcactatagggttgaagaggaattctttctccagctcaagcaacagaggagagcttgaatgggagaaagaaacctggcggcagcgcaaaagatg

SEQ ID NO: 138146 - DNA, 103 bp, Artificial Sequence
  Synthetic Polynucleotide
taatacgactcactataggggaggtacatgttgaagaggaattctttctcaacagaggagagagaaaatgttcctcttcaacctggcggcagcgcaaaagatg

SEQ ID NO: 138147 - DNA, 103 bp, Artificial Sequence
  Synthetic Polynucleotide
taatacgactcactatagggggtcccgggtgaggtacatgttgaagaggaaacagaggagatcctctatgacatgtaccaacctggcggcagcgcaaaagatg

SEQ ID NO: 138148 - DNA, 103 bp, Artificial Sequence
  Synthetic Polynucleotide
taatacgactcactatagggtcgtagcgccggtcccgggtgaggtacatgaacagaggagacatgtaatgcacccgggaaacctggcggcagcgcaaaagatg

SEQ ID NO: 138149 - DNA, 103 bp, Artificial Sequence
  Synthetic Polynucleotide
taatacgactcactatagggcctggccacctcgtagcgccggtcccgggtaacagaggagaacccggatgcggcgctacaacctggcggcagcgcaaaagatg

SEQ ID NO: 138150 - DNA, 103 bp, Artificial Sequence
  Synthetic Polynucleotide
taatacgactcactatagggggttgagaatcctggccacctcgtagcgccaacagaggagaggcgctatgaggtggccaaacctggcggcagcgcaaaagatg

SEQ ID NO: 138151 - DNA, 103 bp, Artificial Sequence
  Synthetic Polynucleotide
taatacgactcactatagggctctctgttaggttgagaatcctggccaccaacagaggagaggtggcatggattctcaaaacctggcggcagcgcaaaagatg

SEQ ID NO: 138152 - DNA, 103 bp, Artificial Sequence
  Synthetic Polynucleotide
taatacgactcactatagggtttgacctgtctctctgttaggttgagaataacagaggagaattctcatgctaacagagaacctggcggcagcgcaaaagatg

SEQ ID NO: 138153 - DNA, 103 bp, Artificial Sequence
  Synthetic Polynucleotide
taatacgactcactataggggaaaccagattttgacctgtctctctgttaaacagaggagataacagatggacaggtcaaacctggcggcagcgcaaaagatg

SEQ ID NO: 138154 - DNA, 103 bp, Artificial Sequence
  Synthetic Polynucleotide
taatacgactcactatagggctacggttctgaaaccagattttgacctgtaacagaggagaacaggtatgaatctggttaacctggcggcagcgcaaaagatg

SEQ ID NO: 138155 - DNA, 103 bp, Artificial Sequence
  Synthetic Polynucleotide
taatacgactcactataggggcccttcaggaagctgggcgtactctccataacagaggagaatggagatgacgcccagcaacctggcggcagcgcaaaagatg

SEQ ID NO: 138156 - DNA, 103 bp, Artificial Sequence
  Synthetic Polynucleotide
taatacgactcactatagggcggcccatggtgcagtccatctcgaggcggaacagaggagaccgcctatggatggactgaacctggcggcagcgcaaaagatg

SEQ ID NO: 138157 - DNA, 103 bp, Artificial Sequence
  Synthetic Polynucleotide
taatacgactcactatagggagggccaagacccccacctttagtgggtggaacagaggagaccacccatgaaaggtgggaacctggcggcagcgcaaaagatg

SEQ ID NO: 138158 - DNA, 103 bp, Artificial Sequence
  Synthetic Polynucleotide
taatacgactcactatagggacttcccacaagggccaagacccccaccttaacagaggagaaaggtgatggtcttggccaacctggcggcagcgcaaaagatg

SEQ ID NO: 138159 - DNA, 103 bp, Artificial Sequence
  Synthetic Polynucleotide
taatacgactcactatagggccctcctggcacttcccacaagggccaagaaacagaggagatcttggatgttgtgggaaaacctggcggcagcgcaaaagatg

SEQ ID NO: 138160 - DNA, 103 bp, Artificial Sequence
  Synthetic Polynucleotide
taatacgactcactatagggcccctccaggccctcctggcacttcccacaaacagaggagatgtgggatgtgccaggagaacctggcggcagcgcaaaagatg

SEQ ID NO: 138161 - DNA, 103 bp, Artificial Sequence
  Synthetic Polynucleotide
taatacgactcactatagggcactggcacccccctccaggccctcctggcaacagaggagagccaggatggcctggaggaacctggcggcagcgcaaaagatg

SEQ ID NO: 138162 - DNA, 103 bp, Artificial Sequence
  Synthetic Polynucleotide
taatacgactcactatagggtcgctggctccactggcacccccctccaggaacagaggagacctggaatggggtgccagaacctggcggcagcgcaaaagatg

SEQ ID NO: 138163 - DNA, 103 bp, Artificial Sequence
  Synthetic Polynucleotide
taatacgactcactatagggctcgctgggttcgctggctccactggcaccaacagaggagaggtgccatgggagccagcaacctggcggcagcgcaaaagatg

SEQ ID NO: 138164 - DNA, 103 bp, Artificial Sequence
  Synthetic Polynucleotide
taatacgactcactatagggtgttcacttcctcgctgggttcgctggctcaacagaggagagagccaatgaacccagcgaacctggcggcagcgcaaaagatg

SEQ ID NO: 138165 - DNA, 103 bp, Artificial Sequence
  Synthetic Polynucleotide
taatacgactcactatagggccagaggccttgttcacttcctcgctgggtaacagaggagaacccagatgggaagtgaaaacctggcggcagcgcaaaagatg

SEQ ID NO: 138166 - DNA, 103 bp, Artificial Sequence
  Synthetic Polynucleotide
taatacgactcactatagggggccctggggccagaggccttgttcacttcaacagaggagagaagtgatgaaggcctctaacctggcggcagcgcaaaagatg

SEQ ID NO: 138167 - DNA, 103 bp, Artificial Sequence
  Synthetic Polynucleotide
taatacgactcactatagggccaggcacagcggcccatggtgcagtccataacagaggagaatggacatgaccatgggcaacctggcggcagcgcaaaagatg

SEQ ID NO: 138168 - DNA, 103 bp, Artificial Sequence
  Synthetic Polynucleotide
taatacgactcactatagggtggggggacaggccctggggccagaggcctaacagaggagaaggcctatggccccagggaacctggcggcagcgcaaaagatg

SEQ ID NO: 138169 - DNA, 103 bp, Artificial Sequence
  Synthetic Polynucleotide
taatacgactcactataggggtgtggtggctggggggacaggccctggggaacagaggagaccccagatgctgtcccccaacctggcggcagcgcaaaagatg

SEQ ID NO: 138170 - DNA, 103 bp, Artificial Sequence
  Synthetic Polynucleotide
taatacgactcactatagggcttcagcttggtgtggtggctggggggacaaacagaggagatgtcccatgagccaccacaacctggcggcagcgcaaaagatg

SEQ ID NO: 138171 - DNA, 103 bp, Artificial Sequence
  Synthetic Polynucleotide
taatacgactcactataggggccatgtcttcttcagcttggtgtggtggcaacagaggagagccaccatgccaagctgaaacctggcggcagcgcaaaagatg

SEQ ID NO: 138172 - DNA, 103 bp, Artificial Sequence
  Synthetic Polynucleotide
taatacgactcactatagggtgccgtgtgagccatgtcttcttcagcttgaacagaggagacaagctatggaagacatgaacctggcggcagcgcaaaagatg

SEQ ID NO: 138173 - DNA, 103 bp, Artificial Sequence
  Synthetic Polynucleotide
taatacgactcactatagggctgctccgagtgccgtgtgagccatgtcttaacagaggagaaagacaatgctcacacggaacctggcggcagcgcaaaagatg

SEQ ID NO: 138174 - DNA, 103 bp, Artificial Sequence
  Synthetic Polynucleotide
taatacgactcactataggggacattcaaactgctccgagtgccgtgtgaaacagaggagatcacacatgactcggagcaacctggcggcagcgcaaaagatg

SEQ ID NO: 138175 - DNA, 103 bp, Artificial Sequence
  Synthetic Polynucleotide
taatacgactcactatagggcagccgcgtggacattcaaactgctccgagaacagaggagactcggaatggtttgaatgaacctggcggcagcgcaaaagatg

SEQ ID NO: 138176 - DNA, 103 bp, Artificial Sequence
  Synthetic Polynucleotide
taatacgactcactataggggacctcagggcagccgcgtggacattcaaaaacagaggagatttgaaatgccacgcggcaacctggcggcagcgcaaaagatg

SEQ ID NO: 138177 - DNA, 103 bp, Artificial Sequence
  Synthetic Polynucleotide
taatacgactcactataggggcctctcctcgacctcagggcagccgcgtgaacagaggagacacgcgatggccctgaggaacctggcggcagcgcaaaagatg

SEQ ID NO: 138178 - DNA, 103 bp, Artificial Sequence
  Synthetic Polynucleotide
taatacgactcactataggggcaggctctcccaggcacagcggcccatggaacagaggagaccatggatggctgtgcctaacctggcggcagcgcaaaagatg

SEQ ID NO: 138179 - DNA, 103 bp, Artificial Sequence
  Synthetic Polynucleotide
taatacgactcactatagggcgagcaaccggcctctcctcgacctcagggaacagaggagaccctgaatgcgaggagagaacctggcggcagcgcaaaagatg

SEQ ID NO: 138180 - DNA, 103 bp, Artificial Sequence
  Synthetic Polynucleotide
taatacgactcactatagggggcccggagccgagcaaccggcctctcctcaacagaggagagaggagatgccggttgctaacctggcggcagcgcaaaagatg

SEQ ID NO: 138181 - DNA, 103 bp, Artificial Sequence
  Synthetic Polynucleotide
taatacgactcactatagggcccttttgagggcccggagccgagcaaccgaacagaggagacggttgatgggctccgggaacctggcggcagcgcaaaagatg

SEQ ID NO: 138182 - DNA, 103 bp, Artificial Sequence
  Synthetic Polynucleotide
taatacgactcactataggggggctgcctgcccttttgagggcccggagcaacagaggagagctccgatgcctcaaaagaacctggcggcagcgcaaaagatg

SEQ ID NO: 138183 - DNA, 103 bp, Artificial Sequence
  Synthetic Polynucleotide
taatacgactcactatagggctggacctcggggctgcctgcccttttgagaacagaggagactcaaaatggcaggcagcaacctggcggcagcgcaaaagatg

SEQ ID NO: 138184 - DNA, 103 bp, Artificial Sequence
  Synthetic Polynucleotide
taatacgactcactatagggccattgctccctggacctcggggctgcctgaacagaggagacaggcaatgccgaggtccaacctggcggcagcgcaaaagatg

SEQ ID NO: 138185 - DNA, 103 bp, Artificial Sequence
  Synthetic Polynucleotide
taatacgactcactataggggctggactgcccattgctccctggacctcgaacagaggagacgaggtatggggagcaataacctggcggcagcgcaaaagatg

SEQ ID NO: 138186 - DNA, 103 bp, Artificial Sequence
  Synthetic Polynucleotide
taatacgactcactatagggccgcttgggggctggactgcccattgctccaacagaggagaggagcaatgggcagtccaaacctggcggcagcgcaaaagatg

SEQ ID NO: 138187 - DNA, 103 bp, Artificial Sequence
  Synthetic Polynucleotide
taatacgactcactatagggggtccggtggccgcttgggggctggactgcaacagaggagagcagtcatgcccccaagcaacctggcggcagcgcaaaagatg

SEQ ID NO: 138188 - DNA, 103 bp, Artificial Sequence
  Synthetic Polynucleotide
taatacgactcactatagggcctggaaaagggtccggtggccgcttggggaacagaggagaccccaaatggccaccggaaacctggcggcagcgcaaaagatg

SEQ ID NO: 138189 - DNA, 103 bp, Artificial Sequence
  Synthetic Polynucleotide
taatacgactcactatagggccaaaagggagcaggctctcccaggcacagaacagaggagactgtgcatgggagagcctaacctggcggcagcgcaaaagatg

SEQ ID NO: 138190 - DNA, 103 bp, Artificial Sequence
  Synthetic Polynucleotide
taatacgactcactatagggttctgcagtgcctggaaaagggtccggtggaacagaggagaccaccgatgccttttccaaacctggcggcagcgcaaaagatg

SEQ ID NO: 138191 - DNA, 103 bp, Artificial Sequence
  Synthetic Polynucleotide
taatacgactcactatagggcagccccctgttctgcagtgcctggaaaagaacagaggagacttttcatggcactgcagaacctggcggcagcgcaaaagatg

SEQ ID NO: 138192 - DNA, 103 bp, Artificial Sequence
  Synthetic Polynucleotide
taatacgactcactatagggtgccaacccccagccccctgttctgcagtgaacagaggagacactgcatgacagggggcaacctggcggcagcgcaaaagatg

SEQ ID NO: 138193 - DNA, 103 bp, Artificial Sequence
  Synthetic Polynucleotide
taatacgactcactatagggccgcacctcctgccaacccccagccccctgaacagaggagacaggggatggggggttggaacctggcggcagcgcaaaagatg

SEQ ID NO: 138194 - DNA, 103 bp, Artificial Sequence
  Synthetic Polynucleotide
taatacgactcactatagggtcgatgtgtcccgcacctcctgccaaccccaacagaggagaggggttatgaggaggtgcaacctggcggcagcgcaaaagatg

SEQ ID NO: 138195 - DNA, 103 bp, Artificial Sequence
  Synthetic Polynucleotide
taatacgactcactatagggttgttccctatcgatgtgtcccgcacctccaacagaggagaggaggtatgggacacatcaacctggcggcagcgcaaaagatg

SEQ ID NO: 138196 - DNA, 103 bp, Artificial Sequence
  Synthetic Polynucleotide
taatacgactcactataggggtccacatccttgttccctatcgatgtgtcaacagaggagagacacaatgatagggaacaacctggcggcagcgcaaaagatg

SEQ ID NO: 138197 - DNA, 103 bp, Artificial Sequence
  Synthetic Polynucleotide
taatacgactcactataggggctgtcccgagtccacatccttgttccctaaacagaggagatagggaatgaggatgtggaacctggcggcagcgcaaaagatg

SEQ ID NO: 138198 - DNA, 103 bp, Artificial Sequence
  Synthetic Polynucleotide
taatacgactcactatagggtgctcatcatgctgtcccgagtccacatccaacagaggagaggatgtatgctcgggacaaacctggcggcagcgcaaaagatg

SEQ ID NO: 138199 - DNA, 103 bp, Artificial Sequence
  Synthetic Polynucleotide
taatacgactcactataggggggtcctttctgctcatcatgctgtcccgaaacagaggagatcgggaatgcatgatgagaacctggcggcagcgcaaaagatg

SEQ ID NO: 138200 - DNA, 103 bp, Artificial Sequence
  Synthetic Polynucleotide
taatacgactcactatagggggacgcccctccaaaagggagcaggctctcaacagaggagagagagcatgctcccttttaacctggcggcagcgcaaaagatg

SEQ ID NO: 138201 - DNA, 103 bp, Artificial Sequence
  Synthetic Polynucleotide
taatacgactcactatagggggccatcttggggtcctttctgctcatcataacagaggagaatgatgatgagaaaggacaacctggcggcagcgcaaaagatg

SEQ ID NO: 138202 - DNA, 103 bp, Artificial Sequence
  Synthetic Polynucleotide
taatacgactcactatagggagactggcctggccatcttggggtcctttcaacagaggagagaaaggatgccaagatggaacctggcggcagcgcaaaagatg

SEQ ID NO: 138203 - DNA, 103 bp, Artificial Sequence
  Synthetic Polynucleotide
taatacgactcactatagggcgggtcctggagactggcctggccatcttgaacagaggagacaagatatgcaggccagtaacctggcggcagcgcaaaagatg

SEQ ID NO: 138204 - DNA, 103 bp, Artificial Sequence
  Synthetic Polynucleotide
taatacgactcactatagggcctgaagtcccgggtcctggagactggcctaacagaggagaaggccaatgtccaggaccaacctggcggcagcgcaaaagatg

SEQ ID NO: 138205 - DNA, 103 bp, Artificial Sequence
  Synthetic Polynucleotide
taatacgactcactatagggcatggtatgtcctgaagtcccgggtcctggaacagaggagaccaggaatggggacttcaaacctggcggcagcgcaaaagatg

SEQ ID NO: 138206 - DNA, 103 bp, Artificial Sequence
  Synthetic Polynucleotide
taatacgactcactataggggagagccaggcatggtatgtcctgaagtccaacagaggagaggacttatggacataccaaacctggcggcagcgcaaaagatg

SEQ ID NO: 138207 - DNA, 103 bp, Artificial Sequence
  Synthetic Polynucleotide
taatacgactcactataggggttttgcagggagagccaggcatggtatgtaacagaggagaacatacatggcctggctcaacctggcggcagcgcaaaagatg

SEQ ID NO: 138208 - DNA, 103 bp, Artificial Sequence
  Synthetic Polynucleotide
taatacgactcactatagggcattgagccagttttgcagggagagccaggaacagaggagacctggcatgccctgcaaaaacctggcggcagcgcaaaagatg

SEQ ID NO: 138209 - DNA, 103 bp, Artificial Sequence
  Synthetic Polynucleotide
taatacgactcactatagggacaactttggcattgagccagttttgcaggaacagaggagacctgcaatgctggctcaaaacctggcggcagcgcaaaagatg

SEQ ID NO: 138210 - DNA, 103 bp, Artificial Sequence
  Synthetic Polynucleotide
taatacgactcactatagggctgcctgggcacaactttggcattgagccaaacagaggagatggctcatggccaaagttaacctggcggcagcgcaaaagatg

SEQ ID NO: 138211 - DNA, 103 bp, Artificial Sequence
  Synthetic Polynucleotide
taatacgactcactatagggggggtgctcaggacgcccctccaaaagggaaacagaggagatcccttatggaggggcgtaacctggcggcagcgcaaaagatg

SEQ ID NO: 138212 - DNA, 103 bp, Artificial Sequence
  Synthetic Polynucleotide
taatacgactcactatagggccctctccagctgcctgggcacaactttggaacagaggagaccaaagatgtgcccaggcaacctggcggcagcgcaaaagatg

SEQ ID NO: 138213 - DNA, 103 bp, Artificial Sequence
  Synthetic Polynucleotide
taatacgactcactataggggtgccctcctccctctccagctgcctgggcaacagaggagagcccagatggctggagagaacctggcggcagcgcaaaagatg

SEQ ID NO: 138214 - DNA, 103 bp, Artificial Sequence
  Synthetic Polynucleotide
taatacgactcactatagggagtggcaggcgtgccctcctccctctccagaacagaggagactggagatggaggagggcaacctggcggcagcgcaaaagatg

SEQ ID NO: 138215 - DNA, 103 bp, Artificial Sequence
  Synthetic Polynucleotide
taatacgactcactatagggacttgctgagagtggcaggcgtgccctcctaacagaggagaaggaggatgcgcctgccaaacctggcggcagcgcaaaagatg

SEQ ID NO: 138216 - DNA, 103 bp, Artificial Sequence
  Synthetic Polynucleotide
taatacgactcactatagggcgatctccgcacttgctgagagtggcaggcaacagaggagagcctgcatgtctcagcaaaacctggcggcagcgcaaaagatg

SEQ ID NO: 138217 - DNA, 103 bp, Artificial Sequence
  Synthetic Polynucleotide
taatacgactcactatagggctcccagaggcgatctccgcacttgctgagaacagaggagactcagcatgtgcggagataacctggcggcagcgcaaaagatg

SEQ ID NO: 138218 - DNA, 103 bp, Artificial Sequence
  Synthetic Polynucleotide
taatacgactcactatagggtgcagctcccctcccagaggcgatctccgcaacagaggagagcggagatggcctctgggaacctggcggcagcgcaaaagatg

SEQ ID NO: 138219 - DNA, 103 bp, Artificial Sequence
  Synthetic Polynucleotide
taatacgactcactatagggttcctcctgctgcagctcccctcccagaggaacagaggagacctctgatgggggagctgaacctggcggcagcgcaaaagatg

SEQ ID NO: 138220 - DNA, 103 bp, Artificial Sequence
  Synthetic Polynucleotide
taatacgactcactatagggtggctgtgtcttcctcctgctgcagctcccaacagaggagagggagcatgagcaggaggaacctggcggcagcgcaaaagatg

SEQ ID NO: 138221 - DNA, 103 bp, Artificial Sequence
  Synthetic Polynucleotide
taatacgactcactatagggctggagttggtggctgtgtcttcctcctgcaacagaggagagcaggaatgagacacagcaacctggcggcagcgcaaaagatg

SEQ ID NO: 138222 - DNA, 103 bp, Artificial Sequence
  Synthetic Polynucleotide
taatacgactcactatagggccaggagtctggggtgctcaggacgcccctaacagaggagaaggggcatgctgagcaccaacctggcggcagcgcaaaagatg

SEQ ID NO: 138223 - DNA, 103 bp, Artificial Sequence
  Synthetic Polynucleotide
taatacgactcactatagggttcctcagagctggagttggtggctgtgtcaacagaggagagacacaatgaccaactccaacctggcggcagcgcaaaagatg

SEQ ID NO: 138224 - DNA, 103 bp, Artificial Sequence
  Synthetic Polynucleotide
taatacgactcactatagggaccctgggccttcctcagagctggagttggaacagaggagaccaactatggctctgaggaacctggcggcagcgcaaaagatg

SEQ ID NO: 138225 - DNA, 103 bp, Artificial Sequence
  Synthetic Polynucleotide
taatacgactcactatagggtcagggccggaccctgggccttcctcagagaacagaggagactctgaatgaggcccaggaacctggcggcagcgcaaaagatg

SEQ ID NO: 138226 - DNA, 103 bp, Artificial Sequence
  Synthetic Polynucleotide
taatacgactcactataggggagccggctgtcagggccggaccctgggccaacagaggagaggcccaatgtccggccctaacctggcggcagcgcaaaagatg

SEQ ID NO: 138227 - DNA, 103 bp, Artificial Sequence
  Synthetic Polynucleotide
taatacgactcactatagggggcctgtgctgagccggctgtcagggccggaacagaggagaccggccatgacagccggcaacctggcggcagcgcaaaagatg

SEQ ID NO: 138228 - DNA, 103 bp, Artificial Sequence
  Synthetic Polynucleotide
taatacgactcactatagggtgcttggcgaggcctgtgctgagccggctgaacagaggagacagccgatgcagcacaggaacctggcggcagcgcaaaagatg

SEQ ID NO: 138229 - DNA, 103 bp, Artificial Sequence
  Synthetic Polynucleotide
taatacgactcactatagggactgagcaggtgcttggcgaggcctgtgctaacagaggagaagcacaatgctcgccaagaacctggcggcagcgcaaaagatg

SEQ ID NO: 138230 - DNA, 103 bp, Artificial Sequence
  Synthetic Polynucleotide
taatacgactcactatagggcccccaaaccactgagcaggtgcttggcgaaacagaggagatcgccaatgacctgctcaaacctggcggcagcgcaaaagatg

SEQ ID NO: 138231 - DNA, 103 bp, Artificial Sequence
  Synthetic Polynucleotide
taatacgactcactatagggcacagtcggtcccccaaaccactgagcaggaacagaggagacctgctatgtggtttgggaacctggcggcagcgcaaaagatg

SEQ ID NO: 138232 - DNA, 103 bp, Artificial Sequence
  Synthetic Polynucleotide
taatacgactcactatagggcagcaggcggcacagtcggtcccccaaaccaacagaggagaggtttgatggaccgactgaacctggcggcagcgcaaaagatg

SEQ ID NO: 138233 - DNA, 103 bp, Artificial Sequence
  Synthetic Polynucleotide
taatacgactcactatagggcagggggaagccaggagtctggggtgctcaaacagaggagatgagcaatgcagactcctaacctggcggcagcgcaaaagatg

SEQ ID NO: 138234 - DNA, 103 bp, Artificial Sequence
  Synthetic Polynucleotide
taatacgactcactataggggctccctccgcagcaggcggcacagtcggtaacagaggagaaccgacatggccgcctgcaacctggcggcagcgcaaaagatg

SEQ ID NO: 138235 - DNA, 103 bp, Artificial Sequence
  Synthetic Polynucleotide
taatacgactcactatagggagggcctcccgctccctccgcagcaggcggaacagaggagaccgcctatggcggagggaaacctggcggcagcgcaaaagatg

SEQ ID NO: 138236 - DNA, 103 bp, Artificial Sequence
  Synthetic Polynucleotide
taatacgactcactatagggggcccaagccagggcctcccgctccctccgaacagaggagacggaggatgcgggaggccaacctggcggcagcgcaaaagatg

SEQ ID NO: 138237 - DNA, 103 bp, Artificial Sequence
  Synthetic Polynucleotide
taatacgactcactatagggcttcccgctgggcccaagccagggcctcccaacagaggagagggaggatgtggcttgggaacctggcggcagcgcaaaagatg

SEQ ID NO: 138238 - DNA, 103 bp, Artificial Sequence
  Synthetic Polynucleotide
taatacgactcactatagggggcccttggccttcccgctgggcccaagccaacagaggagaggcttgatgccagcgggaaacctggcggcagcgcaaaagatg

SEQ ID NO: 138239 - DNA, 103 bp, Artificial Sequence
  Synthetic Polynucleotide
taatacgactcactatagggtgtcacggctggcccttggccttcccgctgaacagaggagacagcggatgggccaagggaacctggcggcagcgcaaaagatg

SEQ ID NO: 138240 - DNA, 103 bp, Artificial Sequence
  Synthetic Polynucleotide
taatacgactcactatagggggctgtcctctgtcacggctggcccttggcaacagaggagagccaagatgcagccgtgaaacctggcggcagcgcaaaagatg

SEQ ID NO: 138241 - DNA, 103 bp, Artificial Sequence
  Synthetic Polynucleotide
taatacgactcactatagggggaatgcctgggctgtcctctgtcacggctaacagaggagaagccgtatgagaggacagaacctggcggcagcgcaaaagatg

SEQ ID NO: 138242 - DNA, 103 bp, Artificial Sequence
  Synthetic Polynucleotide
taatacgactcactataggggcagcagcgtggaatgcctgggctgtcctcaacagaggagagaggacatgccaggcattaacctggcggcagcgcaaaagatg

SEQ ID NO: 138243 - DNA, 103 bp, Artificial Sequence
  Synthetic Polynucleotide
taatacgactcactatagggggcaacggctgcagcagcgtggaatgcctgaacagaggagacaggcaatgcacgctgctaacctggcggcagcgcaaaagatg

SEQ ID NO: 138244 - DNA, 103 bp, Artificial Sequence
  Synthetic Polynucleotide
taatacgactcactatagggtgggggaagccagggggaagccaggagtctaacagaggagaagactcatggcttcccccaacctggcggcagcgcaaaagatg

SEQ ID NO: 138245 - DNA, 103 bp, Artificial Sequence
  Synthetic Polynucleotide
taatacgactcactatagggagtccatggtggcaacggctgcagcagcgtaacagaggagaacgctgatgcagccgttgaacctggcggcagcgcaaaagatg

SEQ ID NO: 138246 - DNA, 103 bp, Artificial Sequence
  Synthetic Polynucleotide
taatacgactcactatagggggtgttgaagagtccatggtggcaacggctaacagaggagaagccgtatgcaccatggaaacctggcggcagcgcaaaagatg

SEQ ID NO: 138247 - DNA, 103 bp, Artificial Sequence
  Synthetic Polynucleotide
taatacgactcactatagggatcgccagtgggtgttgaagagtccatggtaacagaggagaaccatgatgtcttcaacaaacctggcggcagcgcaaaagatg

SEQ ID NO: 138248 - DNA, 103 bp, Artificial Sequence
  Synthetic Polynucleotide
taatacgactcactatagggcagcggggacatcgccagtgggtgttgaagaacagaggagacttcaaatgccactggcgaacctggcggcagcgcaaaagatg

SEQ ID NO: 138249 - DNA, 103 bp, Artificial Sequence
  Synthetic Polynucleotide
taatacgactcactatagggccggtggctgcagcggggacatcgccagtgaacagaggagacactggatgtgtccccgcaacctggcggcagcgcaaaagatg

SEQ ID NO: 138250 - DNA, 103 bp, Artificial Sequence
  Synthetic Polynucleotide
taatacgactcactatagggccacacacagccggtggctgcagcggggacaacagaggagagtccccatggcagccaccaacctggcggcagcgcaaaagatg

SEQ ID NO: 138251 - DNA, 103 bp, Artificial Sequence
  Synthetic Polynucleotide
taatacgactcactatagggcgaccacaggccacacacagccggtggctgaacagaggagacagccaatggctgtgtgtaacctggcggcagcgcaaaagatg

SEQ ID NO: 138252 - DNA, 103 bp, Artificial Sequence
  Synthetic Polynucleotide
taatacgactcactataggggcctgccacacgaccacaggccacacacagaacagaggagactgtgtatggcctgtggtaacctggcggcagcgcaaaagatg

SEQ ID NO: 138253 - DNA, 103 bp, Artificial Sequence
  Synthetic Polynucleotide
taatacgactcactatagggcccgcccagtgcctgccacacgaccacaggaacagaggagacctgtgatggtgtggcagaacctggcggcagcgcaaaagatg

SEQ ID NO: 138254 - DNA, 103 bp, Artificial Sequence
  Synthetic Polynucleotide
taatacgactcactatagggttctccctggcccgcccagtgcctgccacaaacagaggagatgtggcatgcactgggcgaacctggcggcagcgcaaaagatg

SEQ ID NO: 138255 - DNA, 103 bp, Artificial Sequence
  Synthetic Polynucleotide
taatacgactcactatagggcttggggccctgggggaagccagggggaagaacagaggagacttcccatgggcttccccaacctggcggcagcgcaaaagatg

SEQ ID NO: 138256 - DNA, 103 bp, Artificial Sequence
  Synthetic Polynucleotide
taatacgactcactatagggaaagcctgctttctccctggcccgcccagtaacagaggagaactgggatggccagggagaacctggcggcagcgcaaaagatg

SEQ ID NO: 138257 - DNA, 103 bp, Artificial Sequence
  Synthetic Polynucleotide
taatacgactcactatagggactgctcctgaaagcctgctttctccctggaacagaggagaccagggatgaagcaggctaacctggcggcagcgcaaaagatg

SEQ ID NO: 138258 - DNA, 103 bp, Artificial Sequence
  Synthetic Polynucleotide
taatacgactcactatagggtcctccgcggactgctcctgaaagcctgctaacagaggagaagcaggatgtcaggagcaaacctggcggcagcgcaaaagatg

SEQ ID NO: 138259 - DNA, 103 bp, Artificial Sequence
  Synthetic Polynucleotide
taatacgactcactatagggctgcgtgcactcctccgcggactgctcctgaacagaggagacaggagatgtccgcggagaacctggcggcagcgcaaaagatg

SEQ ID NO: 138260 - DNA, 103 bp, Artificial Sequence
  Synthetic Polynucleotide
taatacgactcactataggggcccggcctcctgcgtgcactcctccgcggaacagaggagaccgcggatgagtgcacgcaacctggcggcagcgcaaaagatg

SEQ ID NO: 138261 - DNA, 103 bp, Artificial Sequence
  Synthetic Polynucleotide
taatacgactcactatagggcaggcagcgtgcccggcctcctgcgtgcacaacagaggagagtgcacatgggaggccggaacctggcggcagcgcaaaagatg

SEQ ID NO: 138262 - DNA, 103 bp, Artificial Sequence
  Synthetic Polynucleotide
taatacgactcactatagggcatcagggaacaggcagcgtgcccggcctcaacagaggagagaggccatgcacgctgccaacctggcggcagcgcaaaagatg

SEQ ID NO: 138263 - DNA, 103 bp, Artificial Sequence
  Synthetic Polynucleotide
taatacgactcactatagggactgggtcagcatcagggaacaggcagcgtaacagaggagaacgctgatggttccctgaaacctggcggcagcgcaaaagatg

SEQ ID NO: 138264 - DNA, 103 bp, Artificial Sequence
  Synthetic Polynucleotide
taatacgactcactatagggctggagacaaactgggtcagcatcagggaaaacagaggagattccctatggctgacccaaacctggcggcagcgcaaaagatg

SEQ ID NO: 138265 - DNA, 103 bp, Artificial Sequence
  Synthetic Polynucleotide
taatacgactcactatagggcaaagcctggctggagacaaactgggtcagaacagaggagactgaccatgtttgtctccaacctggcggcagcgcaaaagatg

SEQ ID NO: 138266 - DNA, 103 bp, Artificial Sequence
  Synthetic Polynucleotide
taatacgactcactatagggaggttggggtgcccttcaggaagctgggcgaacagaggagacgcccaatgtcctgaaggaacctggcggcagcgcaaaagatg

SEQ ID NO: 138267 - DNA, 103 bp, Artificial Sequence
  Synthetic Polynucleotide
taatacgactcactatagggggagcatgtccttggggccctgggggaagcaacagaggagagcttccatgagggccccaaacctggcggcagcgcaaaagatg

SEQ ID NO: 138268 - DNA, 103 bp, Artificial Sequence
  Synthetic Polynucleotide
taatacgactcactatagggtcagctctgccaaagcctggctggagacaaaacagaggagattgtctatggccaggcttaacctggcggcagcgcaaaagatg

SEQ ID NO: 138269 - DNA, 103 bp, Artificial Sequence
  Synthetic Polynucleotide
taatacgactcactatagggattgcagtgctcagctctgccaaagcctggaacagaggagaccaggcatgggcagagctaacctggcggcagcgcaaaagatg

SEQ ID NO: 138270 - DNA, 103 bp, Artificial Sequence
  Synthetic Polynucleotide
taatacgactcactataggggacctggtgcattgcagtgctcagctctgcaacagaggagagcagagatgagcactgcaaacctggcggcagcgcaaaagatg

SEQ ID NO: 138271 - DNA, 103 bp, Artificial Sequence
  Synthetic Polynucleotide
taatacgactcactatagggacttgacccagacctggtgcattgcagtgcaacagaggagagcactgatgtgcaccaggaacctggcggcagcgcaaaagatg

SEQ ID NO: 138272 - DNA, 103 bp, Artificial Sequence
  Synthetic Polynucleotide
taatacgactcactatagggcggatatcaaacttgacccagacctggtgcaacagaggagagcaccaatgctgggtcaaaacctggcggcagcgcaaaagatg

SEQ ID NO: 138273 - DNA, 103 bp, Artificial Sequence
  Synthetic Polynucleotide
taatacgactcactataggggcagtgcccccggatatcaaacttgacccaaacagaggagatgggtcatgtttgatatcaacctggcggcagcgcaaaagatg

SEQ ID NO: 138274 - DNA, 103 bp, Artificial Sequence
  Synthetic Polynucleotide
taatacgactcactatagggcttggcaggggcagtgcccccggatatcaaaacagaggagattgataatggggggcactaacctggcggcagcgcaaaagatg

SEQ ID NO: 138275 - DNA, 103 bp, Artificial Sequence
  Synthetic Polynucleotide
taatacgactcactatagggcgggcatcagcttggcaggggcagtgccccaacagaggagaggggcaatgcccctgccaaacctggcggcagcgcaaaagatg

SEQ ID NO: 138276 - DNA, 103 bp, Artificial Sequence
  Synthetic Polynucleotide
taatacgactcactatagggggcccatacccgggcatcagcttggcagggaacagaggagaccctgcatggctgatgccaacctggcggcagcgcaaaagatg

SEQ ID NO: 138277 - DNA, 103 bp, Artificial Sequence
  Synthetic Polynucleotide
taatacgactcactatagggcatccccgggggcccatacccgggcatcagaacagaggagactgatgatggggtatgggaacctggcggcagcgcaaaagatg

SEQ ID NO: 138278 - DNA, 103 bp, Artificial Sequence
  Synthetic Polynucleotide
taatacgactcactatagggtccacaagtgggagcatgtccttggggcccaacagaggagagggcccatgggacatgctaacctggcggcagcgcaaaagatg

SEQ ID NO: 138279 - DNA, 103 bp, Artificial Sequence
  Synthetic Polynucleotide
taatacgactcactatagggtgctggcctgcatccccgggggcccataccaacagaggagaggtatgatgccccggggaaacctggcggcagcgcaaaagatg

SEQ ID NO: 138280 - DNA, 103 bp, Artificial Sequence
  Synthetic Polynucleotide
taatacgactcactatagggtgattccttctgctggcctgcatccccgggaacagaggagacccgggatggcaggccagaacctggcggcagcgcaaaagatg

SEQ ID NO: 138281 - DNA, 103 bp, Artificial Sequence
  Synthetic Polynucleotide
taatacgactcactatagggttttctgtgttgattccttctgctggcctgaacagaggagacaggccatgagaaggaataacctggcggcagcgcaaaagatg

SEQ ID NO: 138282 - DNA, 103 bp, Artificial Sequence
  Synthetic Polynucleotide
taatacgactcactataggggttgggggcgttttctgtgttgattccttcaacagaggagagaaggaatgaacacagaaaacctggcggcagcgcaaaagatg

SEQ ID NO: 138283 - DNA, 103 bp, Artificial Sequence
  Synthetic Polynucleotide
taatacgactcactatagggaggttgtggagttgggggcgttttctgtgtaacagaggagaacacagatgacgcccccaaacctggcggcagcgcaaaagatg

SEQ ID NO: 138284 - DNA, 103 bp, Artificial Sequence
  Synthetic Polynucleotide
taatacgactcactatagggcattgcaggaaggttgtggagttgggggcgaacagaggagacgccccatgctccacaacaacctggcggcagcgcaaaagatg

SEQ ID NO: 138285 - DNA, 103 bp, Artificial Sequence
  Synthetic Polynucleotide
taatacgactcactatagggtgggtgtcgccattgcaggaaggttgtggaaacagaggagatccacaatgttcctgcaaaacctggcggcagcgcaaaagatg

SEQ ID NO: 138286 - DNA, 103 bp, Artificial Sequence
  Synthetic Polynucleotide
taatacgactcactatagggcttggtcctgtgggtgtcgccattgcaggaaacagaggagatcctgcatgggcgacaccaacctggcggcagcgcaaaagatg

SEQ ID NO: 138287 - DNA, 103 bp, Artificial Sequence
  Synthetic Polynucleotide
taatacgactcactatagggctttgatgctcttggtcctgtgggtgtcgcaacagaggagagcgacaatgacaggaccaaacctggcggcagcgcaaaagatg

SEQ ID NO: 138288 - DNA, 103 bp, Artificial Sequence
  Synthetic Polynucleotide
taatacgactcactatagggggggtctcctctttgatgctcttggtcctgaacagaggagacaggacatggagcatcaaaacctggcggcagcgcaaaagatg

SEQ ID NO: 138289 - DNA, 103 bp, Artificial Sequence
  Synthetic Polynucleotide
taatacgactcactataggggccctcgccctccacaagtgggagcatgtcaacagaggagagacatgatgccacttgtgaacctggcggcagcgcaaaagatg

SEQ ID NO: 138290 - DNA, 103 bp, Artificial Sequence
  Synthetic Polynucleotide
taatacgactcactatagggagcggaatcgggggtctcctctttgatgctaacagaggagaagcatcatggaggagaccaacctggcggcagcgcaaaagatg

SEQ ID NO: 138291 - DNA, 103 bp, Artificial Sequence
  Synthetic Polynucleotide
taatacgactcactatagggctggggtctcagcggaatcgggggtctcctaacagaggagaaggagaatgccgattccgaacctggcggcagcgcaaaagatg

SEQ ID NO: 138292 - DNA, 103 bp, Artificial Sequence
  Synthetic Polynucleotide
taatacgactcactatagggcggtcctctgctggggtctcagcggaatcgaacagaggagacgattcatgtgagaccccaacctggcggcagcgcaaaagatg

SEQ ID NO: 138293 - DNA, 103 bp, Artificial Sequence
  Synthetic Polynucleotide
taatacgactcactatagggtcggccagcacggtcctctgctggggtctcaacagaggagagagaccatggcagaggacaacctggcggcagcgcaaaagatg

SEQ ID NO: 138294 - DNA, 103 bp, Artificial Sequence
  Synthetic Polynucleotide
taatacgactcactataggggcaggggccctcggccagcacggtcctctgaacagaggagacagaggatggtgctggccaacctggcggcagcgcaaaagatg

SEQ ID NO: 138295 - DNA, 103 bp, Artificial Sequence
  Synthetic Polynucleotide
taatacgactcactataggggaaggacaaggcaggggccctcggccagcaaacagaggagatgctggatgagggcccctaacctggcggcagcgcaaaagatg

SEQ ID NO: 138296 - DNA, 103 bp, Artificial Sequence
  Synthetic Polynucleotide
taatacgactcactatagggttcgcagagagaaggacaaggcaggggcccaacagaggagagggcccatgccttgtcctaacctggcggcagcgcaaaagatg

SEQ ID NO: 138297 - DNA, 103 bp, Artificial Sequence
  Synthetic Polynucleotide
taatacgactcactatagggaagccagcagttcgcagagagaaggacaagaacagaggagacttgtcatgctctctgcgaacctggcggcagcgcaaaagatg

SEQ ID NO: 138298 - DNA, 103 bp, Artificial Sequence
  Synthetic Polynucleotide
taatacgactcactatagggaccgcggtagaagccagcagttcgcagagaaacagaggagatctctgatgactgctggcaacctggcggcagcgcaaaagatg

SEQ ID NO: 138299 - DNA, 103 bp, Artificial Sequence
  Synthetic Polynucleotide
taatacgactcactataggggcagagtttgaccgcggtagaagccagcagaacagaggagactgctgatgtctaccgcgaacctggcggcagcgcaaaagatg

SEQ ID NO: 138300 - DNA, 103 bp, Artificial Sequence
  Synthetic Polynucleotide
taatacgactcactatagggcattctgggggccctcgccctccacaagtgaacagaggagacacttgatgagggcgaggaacctggcggcagcgcaaaagatg

SEQ ID NO: 138301 - DNA, 103 bp, Artificial Sequence
  Synthetic Polynucleotide
taatacgactcactatagggcatggcccaagcagagtttgaccgcggtagaacagaggagactaccgatgtcaaactctaacctggcggcagcgcaaaagatg

SEQ ID NO: 138302 - DNA, 103 bp, Artificial Sequence
  Synthetic Polynucleotide
taatacgactcactatagggtgtattcgctcatggcccaagcagagtttgaacagaggagacaaactatgcttgggccaaacctggcggcagcgcaaaagatg

SEQ ID NO: 138303 - DNA, 103 bp, Artificial Sequence
  Synthetic Polynucleotide
taatacgactcactataggggaaggccatgtgtattcgctcatggcccaaaacagaggagattgggcatggagcgaataaacctggcggcagcgcaaaagatg

SEQ ID NO: 138304 - DNA, 103 bp, Artificial Sequence
  Synthetic Polynucleotide
taatacgactcactatagggtgacgggggcgaaggccatgtgtattcgctaacagaggagaagcgaaatgacatggcctaacctggcggcagcgcaaaagatg

SEQ ID NO: 138305 - DNA, 103 bp, Artificial Sequence
  Synthetic Polynucleotide
taatacgactcactatagggagggccggagtgacgggggcgaaggccatgaacagaggagacatggcatgcgcccccgtaacctggcggcagcgcaaaagatg

SEQ ID NO: 138306 - DNA, 103 bp, Artificial Sequence
  Synthetic Polynucleotide
taatacgactcactatagggatcactgggcagggccggagtgacgggggcaacagaggagagcccccatgactccggccaacctggcggcagcgcaaaagatg

SEQ ID NO: 138307 - DNA, 103 bp, Artificial Sequence
  Synthetic Polynucleotide
taatacgactcactatagggtgatgcggtcatcactgggcagggccggagaacagaggagactccggatgtgcccagtgaacctggcggcagcgcaaaagatg

SEQ ID NO: 138308 - DNA, 103 bp, Artificial Sequence
  Synthetic Polynucleotide
taatacgactcactatagggaggatgttggtgatgcggtcatcactgggcaacagaggagagcccagatgtgaccgcataacctggcggcagcgcaaaagatg

SEQ ID NO: 138309 - DNA, 103 bp, Artificial Sequence
  Synthetic Polynucleotide
taatacgactcactatagggaatgctgtccaggatgttggtgatgcggtcaacagaggagagaccgcatgaccaacatcaacctggcggcagcgcaaaagatg

SEQ ID NO: 138310 - DNA, 103 bp, Artificial Sequence
  Synthetic Polynucleotide
taatacgactcactatagggcctgtgcgataatgctgtccaggatgttggaacagaggagaccaacaatgtggacagcaaacctggcggcagcgcaaaagatg

SEQ ID NO: 138311 - DNA, 103 bp, Artificial Sequence
  Synthetic Polynucleotide
taatacgactcactatagggttcctctccccattctgggggccctcgcccaacagaggagagggcgaatgcccccagaaaacctggcggcagcgcaaaagatg

SEQ ID NO: 138312 - DNA, 103 bp, Artificial Sequence
  Synthetic Polynucleotide
taatacgactcactatagggcgttccaccacctgtgcgataatgctgtccaacagaggagaggacagatgtatcgcacaaacctggcggcagcgcaaaagatg

SEQ ID NO: 138313 - DNA, 103 bp, Artificial Sequence
  Synthetic Polynucleotide
taatacgactcactatagggctggatcttccgttccaccacctgtgcgataacagaggagaatcgcaatggtggtggaaaacctggcggcagcgcaaaagatg

SEQ ID NO: 138314 - DNA, 103 bp, Artificial Sequence
  Synthetic Polynucleotide
taatacgactcactataggggggctttctcctggatcttccgttccaccaaacagaggagatggtggatgggaagatccaacctggcggcagcgcaaaagatg

SEQ ID NO: 138315 - DNA, 103 bp, Artificial Sequence
  Synthetic Polynucleotide
taatacgactcactatagggcccggccccagggctttctcctggatcttcaacagaggagagaagatatgggagaaagcaacctggcggcagcgcaaaagatg

SEQ ID NO: 138316 - DNA, 103 bp, Artificial Sequence
  Synthetic Polynucleotide
taatacgactcactatagggagctcgaagccccggccccagggctttctcaacagaggagagagaaaatgctggggccgaacctggcggcagcgcaaaagatg

SEQ ID NO: 138317 - DNA, 103 bp, Artificial Sequence
  Synthetic Polynucleotide
taatacgactcactataggggacccgggccagctcgaagccccggccccaaacagaggagatggggcatgggcttcgagaacctggcggcagcgcaaaagatg

SEQ ID NO: 138318 - DNA, 103 bp, Artificial Sequence
  Synthetic Polynucleotide
taatacgactcactatagggcccttgcgcagacccgggccagctcgaagcaacagaggagagcttcgatgtggcccgggaacctggcggcagcgcaaaagatg

SEQ ID NO: 138319 - DNA, 103 bp, Artificial Sequence
  Synthetic Polynucleotide
taatacgactcactatagggcaggcccaggcccttgcgcagacccgggccaacagaggagaggcccgatgctgcgcaagaacctggcggcagcgcaaaagatg

SEQ ID NO: 138320 - DNA, 103 bp, Artificial Sequence
  Synthetic Polynucleotide
taatacgactcactataggggagagaggggcaggcccaggcccttgcgcaaacagaggagatgcgcaatggcctgggccaacctggcggcagcgcaaaagatg

SEQ ID NO: 138321 - DNA, 103 bp, Artificial Sequence
  Synthetic Polynucleotide
taatacgactcactatagggggccgcactggagagaggggcaggcccaggaacagaggagacctgggatggcccctctcaacctggcggcagcgcaaaagatg

SEQ ID NO: 138322 - DNA, 103 bp, Artificial Sequence
  Synthetic Polynucleotide
taatacgactcactatagggccagttgaccttcctctccccattctggggaacagaggagaccccagatgggggagaggaacctggcggcagcgcaaaagatg

SEQ ID NO: 138323 - DNA, 103 bp, Artificial Sequence
  Synthetic Polynucleotide
taatacgactcactatagggaggcagccggggccgcactggagagaggggaacagaggagacccctcatgccagtgcggaacctggcggcagcgcaaaagatg

SEQ ID NO: 138324 - DNA, 103 bp, Artificial Sequence
  Synthetic Polynucleotide
taatacgactcactatagggcccctgggggaggcagccggggccgcactgaacagaggagacagtgcatgcccggctgcaacctggcggcagcgcaaaagatg

SEQ ID NO: 138325 - DNA, 103 bp, Artificial Sequence
  Synthetic Polynucleotide
taatacgactcactatagggcacagcaaagcccctgggggaggcagccggaacagaggagaccggctatgtcccccaggaacctggcggcagcgcaaaagatg

SEQ ID NO: 138326 - DNA, 103 bp, Artificial Sequence
  Synthetic Polynucleotide
taatacgactcactatagggctcctgcagccacagcaaagcccctgggggaacagaggagacccccaatggctttgctgaacctggcggcagcgcaaaagatg

SEQ ID NO: 138327 - DNA, 103 bp, Artificial Sequence
  Synthetic Polynucleotide
taatacgactcactatagggaaggctggggctcctgcagccacagcaaagaacagaggagactttgcatgggctgcaggaacctggcggcagcgcaaaagatg

SEQ ID NO: 138328 - DNA, 103 bp, Artificial Sequence
  Synthetic Polynucleotide
taatacgactcactatagggcgccgagggcaaggctggggctcctgcagcaacagaggagagctgcaatggccccagccaacctggcggcagcgcaaaagatg

SEQ ID NO: 138329 - DNA, 103 bp, Artificial Sequence
  Synthetic Polynucleotide
taatacgactcactataggggtggaagccacgccgagggcaaggctggggaacagaggagaccccagatgtgccctcggaacctggcggcagcgcaaaagatg

SEQ ID NO: 138330 - DNA, 103 bp, Artificial Sequence
  Synthetic Polynucleotide
taatacgactcactatagggcctggaagaggtggaagccacgccgagggcaacagaggagagccctcatggtggcttccaacctggcggcagcgcaaaagatg

SEQ ID NO: 138331 - DNA, 103 bp, Artificial Sequence
  Synthetic Polynucleotide
taatacgactcactatagggctccagtgctcctggaagaggtggaagccaaacagaggagatggcttatgcctcttccaaacctggcggcagcgcaaaagatg

SEQ ID NO: 138332 - DNA, 103 bp, Artificial Sequence
  Synthetic Polynucleotide
taatacgactcactatagggctggccctgcctccagtgctcctggaagagaacagaggagactcttcatggagcactggaacctggcggcagcgcaaaagatg

SEQ ID NO: 138333 - DNA, 103 bp, Artificial Sequence
  Synthetic Polynucleotide
taatacgactcactatagggtgctgcccagccagttgaccttcctctcccaacagaggagagggagaatgaggtcaactaacctggcggcagcgcaaaagatg

SEQ ID NO: 138334 - DNA, 103 bp, Artificial Sequence
  Synthetic Polynucleotide
taatacgactcactatagggccaacacaggctggccctgcctccagtgctaacagaggagaagcactatgggcagggccaacctggcggcagcgcaaaagatg

SEQ ID NO: 138335 - DNA, 103 bp, Artificial Sequence
  Synthetic Polynucleotide
taatacgactcactatagggatccctgacaccaacacaggctggccctgcaacagaggagagcagggatggcctgtgttaacctggcggcagcgcaaaagatg

SEQ ID NO: 138336 - DNA, 103 bp, Artificial Sequence
  Synthetic Polynucleotide
taatacgactcactatagggtgtcctttggatccctgacaccaacacaggaacagaggagacctgtgatggtgtcagggaacctggcggcagcgcaaaagatg

SEQ ID NO: 138337 - DNA, 103 bp, Artificial Sequence
  Synthetic Polynucleotide
taatacgactcactatagggtgccctgcaatgtcctttggatccctgacaaacagaggagatgtcagatgtccaaaggaaacctggcggcagcgcaaaagatg

SEQ ID NO: 138338 - DNA, 103 bp, Artificial Sequence
  Synthetic Polynucleotide
taatacgactcactatagggccccacaggttgccctgcaatgtcctttggaacagaggagaccaaagatgattgcagggaacctggcggcagcgcaaaagatg

SEQ ID NO: 138339 - DNA, 103 bp, Artificial Sequence
  Synthetic Polynucleotide
taatacgactcactatagggagcttctgtcccccacaggttgccctgcaaaacagaggagattgcagatgaacctgtggaacctggcggcagcgcaaaagatg

SEQ ID NO: 138340 - DNA, 103 bp, Artificial Sequence
  Synthetic Polynucleotide
taatacgactcactataggggtgccccaagagcttctgtcccccacaggtaacagaggagaacctgtatgggacagaagaacctggcggcagcgcaaaagatg

SEQ ID NO: 138341 - DNA, 103 bp, Artificial Sequence
  Synthetic Polynucleotide
taatacgactcactatagggtggcctccaagtgccccaagagcttctgtcaacagaggagagacagaatgtcttggggcaacctggcggcagcgcaaaagatg

SEQ ID NO: 138342 - DNA, 103 bp, Artificial Sequence
  Synthetic Polynucleotide
taatacgactcactatagggcgcctgcacctggcctccaagtgccccaagaacagaggagacttgggatgcttggaggcaacctggcggcagcgcaaaagatg

SEQ ID NO: 138343 - DNA, 103 bp, Artificial Sequence
  Synthetic Polynucleotide
taatacgactcactataggggggggctcagcgcctgcacctggcctccaaaacagaggagattggagatgaggtgcaggaacctggcggcagcgcaaaagatg

SEQ ID NO: 138344 - DNA, 103 bp, Artificial Sequence
  Synthetic Polynucleotide
taatacgactcactatagggagtccctctttgctgcccagccagttgaccaacagaggagaggtcaaatggctgggcagaacctggcggcagcgcaaaagatg

SEQ ID NO: 138345 - DNA, 103 bp, Artificial Sequence
  Synthetic Polynucleotide
taatacgactcactatagggggaggtccgagggggctcagcgcctgcaccaacagaggagaggtgcaatggctgagcccaacctggcggcagcgcaaaagatg

SEQ ID NO: 138346 - DNA, 103 bp, Artificial Sequence
  Synthetic Polynucleotide
taatacgactcactataggggctgggctggggaggtccgagggggctcagaacagaggagactgagcatgctcggacctaacctggcggcagcgcaaaagatg

SEQ ID NO: 138347 - DNA, 103 bp, Artificial Sequence
  Synthetic Polynucleotide
taatacgactcactatagggtgcccaggctgctgggctggggaggtccgaaacagaggagatcggacatgcccagcccaaacctggcggcagcgcaaaagatg

SEQ ID NO: 138348 - DNA, 103 bp, Artificial Sequence
  Synthetic Polynucleotide
taatacgactcactatagggaatgttgtgctgcccaggctgctgggctggaacagaggagaccagccatgcagcctgggaacctggcggcagcgcaaaagatg

SEQ ID NO: 138349 - DNA, 103 bp, Artificial Sequence
  Synthetic Polynucleotide
taatacgactcactataggggccctcccagaatgttgtgctgcccaggctaacagaggagaagcctgatgagcacaacaaacctggcggcagcgcaaaagatg

SEQ ID NO: 138350 - DNA, 103 bp, Artificial Sequence
  Synthetic Polynucleotide
taatacgactcactataggggccaggagaagccctcccagaatgttgtgcaacagaggagagcacaaatgtctgggaggaacctggcggcagcgcaaaagatg

SEQ ID NO: 138351 - DNA, 103 bp, Artificial Sequence
  Synthetic Polynucleotide
taatacgactcactatagggcgaagctcaggccaggagaagccctcccagaacagaggagactgggaatgcttctcctgaacctggcggcagcgcaaaagatg

SEQ ID NO: 138352 - DNA, 103 bp, Artificial Sequence
  Synthetic Polynucleotide
taatacgactcactatagggtgactttgggcgaagctcaggccaggagaaaacagaggagattctccatgcctgagcttaacctggcggcagcgcaaaagatg

SEQ ID NO: 138353 - DNA, 103 bp, Artificial Sequence
  Synthetic Polynucleotide
taatacgactcactatagggagccctcgtctgactttgggcgaagctcagaacagaggagactgagcatggcccaaagtaacctggcggcagcgcaaaagatg

SEQ ID NO: 138354 - DNA, 103 bp, Artificial Sequence
  Synthetic Polynucleotide
taatacgactcactatagggaggaggacagagccctcgtctgactttgggaacagaggagacccaaaatgagacgagggaacctggcggcagcgcaaaagatg

SEQ ID NO: 138355 - DNA, 103 bp, Artificial Sequence
  Synthetic Polynucleotide
taatacgactcactatagggcttccagcgcagtccctctttgctgcccagaacagaggagactgggcatgaaagagggaaacctggcggcagcgcaaaagatg

SEQ ID NO: 138356 - DNA, 103 bp, Artificial Sequence
  Synthetic Polynucleotide
taatacgactcactatagggtcggtgcagcaggaggacagagccctcgtcaacagaggagagacgagatgtctgtcctcaacctggcggcagcgcaaaagatg

SEQ ID NO: 138357 - DNA, 103 bp, Artificial Sequence
  Synthetic Polynucleotide
taatacgactcactatagggcccccaaagctcggtgcagcaggaggacagaacagaggagactgtccatgtgctgcaccaacctggcggcagcgcaaaagatg

SEQ ID NO: 138358 - DNA, 103 bp, Artificial Sequence
  Synthetic Polynucleotide
taatacgactcactataggggtgtcctcatcccccaaagctcggtgcagcaacagaggagagctgcaatgagctttgggaacctggcggcagcgcaaaagatg

SEQ ID NO: 138359 - DNA, 103 bp, Artificial Sequence
  Synthetic Polynucleotide
taatacgactcactatagggcaccctgctggtgtcctcatcccccaaagcaacagaggagagctttgatggatgaggacaacctggcggcagcgcaaaagatg

SEQ ID NO: 138360 - DNA, 103 bp, Artificial Sequence
  Synthetic Polynucleotide
taatacgactcactatagggctaggttctccaccctgctggtgtcctcataacagaggagaatgaggatgccagcagggaacctggcggcagcgcaaaagatg

SEQ ID NO: 138361 - DNA, 103 bp, Artificial Sequence
  Synthetic Polynucleotide
taatacgactcactatagggagactggcagctaggttctccaccctgctgaacagaggagacagcagatgggagaacctaacctggcggcagcgcaaaagatg

SEQ ID NO: 138362 - DNA, 103 bp, Artificial Sequence
  Synthetic Polynucleotide
taatacgactcactatagggcggaagtggcagactggcagctaggttctcaacagaggagagagaacatggctgccagtaacctggcggcagcgcaaaagatg

SEQ ID NO: 138363 - DNA, 103 bp, Artificial Sequence
  Synthetic Polynucleotide
taatacgactcactatagggcgcagtactccggaagtggcagactggcagaacagaggagactgccaatgtgccacttcaacctggcggcagcgcaaaagatg

SEQ ID NO: 138364 - DNA, 103 bp, Artificial Sequence
  Synthetic Polynucleotide
taatacgactcactatagggccatggagggcgcagtactccggaagtggcaacagaggagagccactatgggagtactgaacctggcggcagcgcaaaagatg

SEQ ID NO: 138365 - DNA, 103 bp, Artificial Sequence
  Synthetic Polynucleotide
taatacgactcactataggggttgagttttccatggagggcgcagtactcaacagaggagagagtacatggccctccataacctggcggcagcgcaaaagatg

SEQ ID NO: 138366 - DNA, 103 bp, Artificial Sequence
  Synthetic Polynucleotide
taatacgactcactataggggcatggcctccttccagcgcagtccctcttaacagaggagaaagaggatgtgcgctggaaacctggcggcagcgcaaaagatg

SEQ ID NO: 138367 - DNA, 103 bp, Artificial Sequence
  Synthetic Polynucleotide
taatacgactcactatagggaggaagccaggttgagttttccatggagggaacagaggagaccctccatggaaaactcaaacctggcggcagcgcaaaagatg

SEQ ID NO: 138368 - DNA, 103 bp, Artificial Sequence
  Synthetic Polynucleotide
taatacgactcactatagggggtgggaggtaggaagccaggttgagttttaacagaggagaaaaactatgcctggcttcaacctggcggcagcgcaaaagatg

SEQ ID NO: 138369 - DNA, 103 bp, Artificial Sequence
  Synthetic Polynucleotide
taatacgactcactatagggggcaaggcccggtgggaggtaggaagccagaacagaggagactggctatgtacctcccaaacctggcggcagcgcaaaagatg

SEQ ID NO: 138370 - DNA, 103 bp, Artificial Sequence
  Synthetic Polynucleotide
taatacgactcactataggggtggacgcagggcaaggcccggtgggaggtaacagaggagaacctccatgcgggccttgaacctggcggcagcgcaaaagatg

SEQ ID NO: 138371 - DNA, 103 bp, Artificial Sequence
  Synthetic Polynucleotide
taatacgactcactatagggtggggctccagtggacgcagggcaaggcccaacagaggagagggcctatgcctgcgtccaacctggcggcagcgcaaaagatg

SEQ ID NO: 138372 - DNA, 103 bp, Artificial Sequence
  Synthetic Polynucleotide
taatacgactcactatagggtgcccagagctggggctccagtggacgcagaacagaggagactgcgtatgctggagcccaacctggcggcagcgcaaaagatg

SEQ ID NO: 138373 - DNA, 103 bp, Artificial Sequence
  Synthetic Polynucleotide
taatacgactcactatagggcaccataggctgcccagagctggggctccaaacagaggagatggagcatgagctctgggaacctggcggcagcgcaaaagatg

SEQ ID NO: 138374 - DNA, 103 bp, Artificial Sequence
  Synthetic Polynucleotide
taatacgactcactatagggtgcgggctcacaccataggctgcccagagcaacagaggagagctctgatgagcctatggaacctggcggcagcgcaaaagatg

SEQ ID NO: 138375 - DNA, 103 bp, Artificial Sequence
  Synthetic Polynucleotide
taatacgactcactataggggtgtccccggtgcgggctcacaccataggcaacagaggagagcctatatggtgagcccgaacctggcggcagcgcaaaagatg

SEQ ID NO: 138376 - DNA, 103 bp, Artificial Sequence
  Synthetic Polynucleotide
taatacgactcactatagggtggtccccaggtgtccccggtgcgggctcaaacagaggagatgagccatgaccggggacaacctggcggcagcgcaaaagatg

SEQ ID NO: 138377 - DNA, 103 bp, Artificial Sequence
  Synthetic Polynucleotide
taatacgactcactataggggtcttctcccaggttggggtgcccttcaggaacagaggagacctgaaatgcaccccaacaacctggcggcagcgcaaaagatg

SEQ ID NO: 138378 - DNA, 103 bp, Artificial Sequence
  Synthetic Polynucleotide
taatacgactcactatagggggatgggtaagcatggcctccttccagcgcaacagaggagagcgctgatgggaggccataacctggcggcagcgcaaaagatg

SEQ ID NO: 138379 - DNA, 103 bp, Artificial Sequence
  Synthetic Polynucleotide
taatacgactcactatagggcagaggttcttggtccccaggtgtccccggaacagaggagaccggggatgcctggggacaacctggcggcagcgcaaaagatg

SEQ ID NO: 138380 - DNA, 103 bp, Artificial Sequence
  Synthetic Polynucleotide
taatacgactcactatagggcacctccacacagaggttcttggtccccagaacagaggagactggggatgaagaacctcaacctggcggcagcgcaaaagatg

SEQ ID NO: 138381 - DNA, 103 bp, Artificial Sequence
  Synthetic Polynucleotide
taatacgactcactatagggccaggtcggccacctccacacagaggttctaacagaggagaagaaccatggtgtggaggaacctggcggcagcgcaaaagatg

SEQ ID NO: 138382 - DNA, 103 bp, Artificial Sequence
  Synthetic Polynucleotide
taatacgactcactatagggaggatgctgaccaggtcggccacctccacaaacagaggagatgtggaatgggccgacctaacctggcggcagcgcaaaagatg

SEQ ID NO: 138383 - DNA, 103 bp, Artificial Sequence
  Synthetic Polynucleotide
taatacgactcactatagggggcatgcaccaggatgctgaccaggtcggcaacagaggagagccgacatggtcagcatcaacctggcggcagcgcaaaagatg

SEQ ID NO: 138384 - DNA, 103 bp, Artificial Sequence
  Synthetic Polynucleotide
taatacgactcactataggggtggtgtgtcggcatgcaccaggatgctgaaacagaggagatcagcaatgtggtgcatgaacctggcggcagcgcaaaagatg

SEQ ID NO: 138385 - DNA, 103 bp, Artificial Sequence
  Synthetic Polynucleotide
taatacgactcactatagggcaggcaggcagtggtgtgtcggcatgcaccaacagaggagaggtgcaatgcgacacaccaacctggcggcagcgcaaaagatg

SEQ ID NO: 138386 - DNA, 103 bp, Artificial Sequence
  Synthetic Polynucleotide
taatacgactcactatagggtgcccggtgccaggcaggcagtggtgtgtcaacagaggagagacacaatgctgcctgccaacctggcggcagcgcaaaagatg

SEQ ID NO: 138387 - DNA, 103 bp, Artificial Sequence
  Synthetic Polynucleotide
taatacgactcactatagggagtctttctgtgcccggtgccaggcaggcaaacagaggagatgcctgatgggcaccgggaacctggcggcagcgcaaaagatg

SEQ ID NO: 138388 - DNA, 103 bp, Artificial Sequence
  Synthetic Polynucleotide
taatacgactcactatagggcctgaaaggaagtctttctgtgcccggtgcaacagaggagagcaccgatgacagaaagaaacctggcggcagcgcaaaagatg

SEQ ID NO: 138389 - DNA, 103 bp, Artificial Sequence
  Synthetic Polynucleotide
taatacgactcactataggggaatgccagcggatgggtaagcatggcctcaacagaggagagaggccatgcttacccataacctggcggcagcgcaaaagatg

SEQ ID NO: 138390 - DNA, 103 bp, Artificial Sequence
  Synthetic Polynucleotide
taatacgactcactatagggcccgtccaggcctgaaaggaagtctttctgaacagaggagacagaaaatgttcctttcaaacctggcggcagcgcaaaagatg

SEQ ID NO: 138391 - DNA, 103 bp, Artificial Sequence
  Synthetic Polynucleotide
taatacgactcactatagggagagcccctccccgtccaggcctgaaaggaaacagaggagatcctttatggcctggacgaacctggcggcagcgcaaaagatg

SEQ ID NO: 138392 - DNA, 103 bp, Artificial Sequence
  Synthetic Polynucleotide
taatacgactcactatagggcccggagaccagagcccctccccgtccaggaacagaggagacctggaatgggaggggctaacctggcggcagcgcaaaagatg

SEQ ID NO: 138393 - DNA, 103 bp, Artificial Sequence
  Synthetic Polynucleotide
taatacgactcactataggggacctggctgcccggagaccagagcccctcaacagaggagagaggggatgtggtctccgaacctggcggcagcgcaaaagatg

SEQ ID NO: 138394 - DNA, 103 bp, Artificial Sequence
  Synthetic Polynucleotide
taatacgactcactatagggacacagtgctgacctggctgcccggagaccaacagaggagaggtctcatggcagccaggaacctggcggcagcgcaaaagatg

SEQ ID NO: 138395 - DNA, 103 bp, Artificial Sequence
  Synthetic Polynucleotide
taatacgactcactatagggaacacgtgccacacagtgctgacctggctgaacagaggagacagccaatgcagcactgtaacctggcggcagcgcaaaagatg

SEQ ID NO: 138396 - DNA, 103 bp, Artificial Sequence
  Synthetic Polynucleotide
taatacgactcactatagggctgtgcccggaacacgtgccacacagtgctaacagaggagaagcactatgtggcacgtgaacctggcggcagcgcaaaagatg

SEQ ID NO: 138397 - DNA, 103 bp, Artificial Sequence
  Synthetic Polynucleotide
taatacgactcactataggggctgggcgtcctgtgcccggaacacgtgccaacagaggagaggcacgatgtccgggcacaacctggcggcagcgcaaaagatg

SEQ ID NO: 138398 - DNA, 103 bp, Artificial Sequence
  Synthetic Polynucleotide
taatacgactcactatagggcggcggatgcgctgggcgtcctgtgcccggaacagaggagaccgggcatgggacgcccaaacctggcggcagcgcaaaagatg

SEQ ID NO: 138399 - DNA, 103 bp, Artificial Sequence
  Synthetic Polynucleotide
taatacgactcactatagggctggagaaagcggcggatgcgctgggcgtcaacagaggagagacgccatgcgcatccgcaacctggcggcagcgcaaaagatg

SEQ ID NO: 138400 - DNA, 103 bp, Artificial Sequence
  Synthetic Polynucleotide
taatacgactcactatagggctggcccgcagaatgccagcggatgggtaaaacagaggagattacccatgcgctggcataacctggcggcagcgcaaaagatg

SEQ ID NO: 138401 - DNA, 103 bp, Artificial Sequence
  Synthetic Polynucleotide
taatacgactcactatagggcctgcaccatctggagaaagcggcggatgcaacagaggagagcatccatggctttctccaacctggcggcagcgcaaaagatg

SEQ ID NO: 138402 - DNA, 103 bp, Artificial Sequence
  Synthetic Polynucleotide
taatacgactcactatagggctcaccaggccctgcaccatctggagaaagaacagaggagactttctatggatggtgcaaacctggcggcagcgcaaaagatg

SEQ ID NO: 138403 - DNA, 103 bp, Artificial Sequence
  Synthetic Polynucleotide
taatacgactcactataggggctgactgtgctcaccaggccctgcaccataacagaggagaatggtgatgggcctggtgaacctggcggcagcgcaaaagatg

SEQ ID NO: 138404 - DNA, 103 bp, Artificial Sequence
  Synthetic Polynucleotide
taatacgactcactataggggctgagtgacgctgactgtgctcaccaggcaacagaggagagcctggatggcacagtcaaacctggcggcagcgcaaaagatg

SEQ ID NO: 138405 - DNA, 103 bp, Artificial Sequence
  Synthetic Polynucleotide
taatacgactcactataggggagaggaagtgctgagtgacgctgactgtgaacagaggagacacagtatgcgtcactcaaacctggcggcagcgcaaaagatg

SEQ ID NO: 138406 - DNA, 103 bp, Artificial Sequence
  Synthetic Polynucleotide
taatacgactcactatagggggtctcaggggagaggaagtgctgagtgacaacagaggagagtcactatgcacttcctcaacctggcggcagcgcaaaagatg

SEQ ID NO: 138407 - DNA, 103 bp, Artificial Sequence
  Synthetic Polynucleotide
taatacgactcactatagggagagggcagaggtctcaggggagaggaagtaacagaggagaacttccatgcccctgagaaacctggcggcagcgcaaaagatg

SEQ ID NO: 138408 - DNA, 103 bp, Artificial Sequence
  Synthetic Polynucleotide
taatacgactcactatagggagctgagcagagagggcagaggtctcagggaacagaggagaccctgaatgctctgccctaacctggcggcagcgcaaaagatg

SEQ ID NO: 138409 - DNA, 103 bp, Artificial Sequence
  Synthetic Polynucleotide
taatacgactcactatagggctggtggcagagctgagcagagagggcagaaacagaggagatctgccatgtctgctcagaacctggcggcagcgcaaaagatg

SEQ ID NO: 138410 - DNA, 103 bp, Artificial Sequence
  Synthetic Polynucleotide
taatacgactcactatagggggctgggtccctggtggcagagctgagcagaacagaggagactgctcatgtctgccaccaacctggcggcagcgcaaaagatg

SEQ ID NO: 138411 - DNA, 103 bp, Artificial Sequence
  Synthetic Polynucleotide
taatacgactcactatagggggtgggcacgctggcccgcagaatgccagcaacagaggagagctggcatgctgcgggccaacctggcggcagcgcaaaagatg

SEQ ID NO: 138412 - DNA, 103 bp, Artificial Sequence
  Synthetic Polynucleotide
taatacgactcactatagggtcagggggaaggctgggtccctggtggcagaacagaggagactgccaatggggacccagaacctggcggcagcgcaaaagatg

SEQ ID NO: 138413 - DNA, 103 bp, Artificial Sequence
  Synthetic Polynucleotide
taatacgactcactatagggcaggtggcagtcagggggaaggctgggtccaacagaggagaggacccatgcttccccctaacctggcggcagcgcaaaagatg

SEQ ID NO: 138414 - DNA, 103 bp, Artificial Sequence
  Synthetic Polynucleotide
taatacgactcactataggggggcataaagcaggtggcagtcagggggaaaacagaggagattccccatgactgccaccaacctggcggcagcgcaaaagatg

SEQ ID NO: 138415 - DNA, 103 bp, Artificial Sequence
  Synthetic Polynucleotide
taatacgactcactatagggcagtccatctgggcataaagcaggtggcagaacagaggagactgccaatggctttatgcaacctggcggcagcgcaaaagatg

SEQ ID NO: 138416 - DNA, 103 bp, Artificial Sequence
  Synthetic Polynucleotide
taatacgactcactataggggaacacagcccagtccatctgggcataaagaacagaggagactttatatgcagatggacaacctggcggcagcgcaaaagatg

SEQ ID NO: 138417 - DNA, 103 bp, Artificial Sequence
  Synthetic Polynucleotide
taatacgactcactatagggtcactgcttggaacacagcccagtccatctaacagaggagaagatggatggggctgtgtaacctggcggcagcgcaaaagatg

SEQ ID NO: 138418 - DNA, 103 bp, Artificial Sequence
  Synthetic Polynucleotide
taatacgactcactatagggacggccaccttcactgcttggaacacagccaacagaggagaggctgtatgccaagcagtaacctggcggcagcgcaaaagatg

SEQ ID NO: 138419 - DNA, 103 bp, Artificial Sequence
  Synthetic Polynucleotide
taatacgactcactatagggtaatgtccccacggccaccttcactgcttgaacagaggagacaagcaatgaaggtggccaacctggcggcagcgcaaaagatg

SEQ ID NO: 138420 - DNA, 103 bp, Artificial Sequence
  Synthetic Polynucleotide
taatacgactcactatagggtggcctcctgtaatgtccccacggccacctaacagaggagaaggtggatgtggggacataacctggcggcagcgcaaaagatg

SEQ ID NO: 138421 - DNA, 103 bp, Artificial Sequence
  Synthetic Polynucleotide
taatacgactcactataggggccacagcgaggtgggcacgctggcccgcaaacagaggagatgcgggatggcgtgcccaaacctggcggcagcgcaaaagatg

SEQ ID NO: 138422 - DNA, 103 bp, Artificial Sequence
  Synthetic Polynucleotide
taatacgactcactataggggcatcagggggccacagcgaggtgggcacgaacagaggagacgtgccatgctcgctgtgaacctggcggcagcgcaaaagatg

SEQ ID NO: 138423 - DNA, 103 bp, Artificial Sequence
  Synthetic Polynucleotide
taatacgactcactatagggctatgctcaggcatcagggggccacagcgaaacagaggagatcgctgatgccccctgataacctggcggcagcgcaaaagatg

SEQ ID NO: 138424 - DNA, 103 bp, Artificial Sequence
  Synthetic Polynucleotide
taatacgactcactatagggatggccaccactatgctcaggcatcaggggaacagaggagacccctgatgcctgagcataacctggcggcagcgcaaaagatg

SEQ ID NO: 138425 - DNA, 103 bp, Artificial Sequence
  Synthetic Polynucleotide
taatacgactcactatagggcactcttgagatggccaccactatgctcagaacagaggagactgagcatggtggtggccaacctggcggcagcgcaaaagatg

SEQ ID NO: 138426 - DNA, 103 bp, Artificial Sequence
  Synthetic Polynucleotide
taatacgactcactataggggccacagggtcactcttgagatggccaccaaacagaggagatggtggatgtctcaagagaacctggcggcagcgcaaaagatg

SEQ ID NO: 138427 - DNA, 103 bp, Artificial Sequence
  Synthetic Polynucleotide
taatacgactcactatagggctctggggccgtcttctcccaggttggggtaacagaggagaaccccaatgtgggagaagaacctggcggcagcgcaaaagatg

SEQ ID NO: 138428 - DNA, 103 bp, Artificial Sequence
  Synthetic Polynucleotide
taatacgactcactataggggggccggaaggccacagggtcactcttgagaacagaggagactcaagatggaccctgtgaacctggcggcagcgcaaaagatg

SEQ ID NO: 138429 - DNA, 103 bp, Artificial Sequence
  Synthetic Polynucleotide
taatacgactcactatagggggcagtgccagggccggaaggccacagggtaacagaggagaaccctgatgccttccggcaacctggcggcagcgcaaaagatg

SEQ ID NO: 138430 - DNA, 103 bp, Artificial Sequence
  Synthetic Polynucleotide
taatacgactcactatagggagaaggaaagggcagtgccagggccggaagaacagaggagacttccgatgctggcactgaacctggcggcagcgcaaaagatg

SEQ ID NO: 138431 - DNA, 103 bp, Artificial Sequence
  Synthetic Polynucleotide
taatacgactcactatagggcttggtctccagaaggaaagggcagtgccaaacagaggagatggcacatgcctttccttaacctggcggcagcgcaaaagatg

SEQ ID NO: 138432 - DNA, 103 bp, Artificial Sequence
  Synthetic Polynucleotide
taatacgactcactataggggctccaggatcttggtctccagaaggaaagaacagaggagactttccatgtggagaccaaacctggcggcagcgcaaaagatg

SEQ ID NO: 138433 - DNA, 103 bp, Artificial Sequence
  Synthetic Polynucleotide
taatacgactcactatagggaagggagctcgctccaggatcttggtctccaacagaggagaggagacatggatcctggaaacctggcggcagcgcaaaagatg

SEQ ID NO: 138434 - DNA, 103 bp, Artificial Sequence
  Synthetic Polynucleotide
taatacgactcactataggggggcacccagaagggagctcgctccaggataacagaggagaatcctgatgcgagctcccaacctggcggcagcgcaaaagatg

SEQ ID NO: 138435 - DNA, 103 bp, Artificial Sequence
  Synthetic Polynucleotide
taatacgactcactataggggcaagcaggtgggcacccagaagggagctcaacagaggagagagctcatgtctgggtgcaacctggcggcagcgcaaaagatg

SEQ ID NO: 138436 - DNA, 103 bp, Artificial Sequence
  Synthetic Polynucleotide
taatacgactcactatagggaggtagggtggcaagcaggtgggcacccagaacagaggagactgggtatgcacctgcttaacctggcggcagcgcaaaagatg

SEQ ID NO: 138437 - DNA, 103 bp, Artificial Sequence
  Synthetic Polynucleotide
taatacgactcactataggggccagacactaggtagggtggcaagcaggtaacagaggagaacctgcatgccaccctacaacctggcggcagcgcaaaagatg

SEQ ID NO: 138438 - DNA, 103 bp, Artificial Sequence
  Synthetic Polynucleotide
taatacgactcactatagggcgatgccgttctctggggccgtcttctcccaacagaggagagggagaatgcggccccagaacctggcggcagcgcaaaagatg

SEQ ID NO: 138439 - DNA, 103 bp, Artificial Sequence
  Synthetic Polynucleotide
taatacgactcactatagggctgggggcaggccagacactaggtagggtgaacagaggagacaccctatgtagtgtctgaacctggcggcagcgcaaaagatg

SEQ ID NO: 138440 - DNA, 103 bp, Artificial Sequence
  Synthetic Polynucleotide
taatacgactcactatagggcatggatgctctgggggcaggccagacactaacagaggagaagtgtcatgcctgcccccaacctggcggcagcgcaaaagatg

SEQ ID NO: 138441 - DNA, 103 bp, Artificial Sequence
  Synthetic Polynucleotide
taatacgactcactataggggggccagtcacatggatgctctgggggcagaacagaggagactgcccatggagcatccaaacctggcggcagcgcaaaagatg

SEQ ID NO: 138442 - DNA, 103 bp, Artificial Sequence
  Synthetic Polynucleotide
taatacgactcactataggggcggggtcaggggccagtcacatggatgctaacagaggagaagcatcatggtgactggcaacctggcggcagcgcaaaagatg

SEQ ID NO: 138443 - DNA, 103 bp, Artificial Sequence
  Synthetic Polynucleotide
taatacgactcactatagggacccaggggtgcggggtcaggggccagtcaaacagaggagatgactgatgcctgaccccaacctggcggcagcgcaaaagatg

SEQ ID NO: 138444 - DNA, 103 bp, Artificial Sequence
  Synthetic Polynucleotide
taatacgactcactatagggcccggagtatacccaggggtgcggggtcagaacagaggagactgaccatgcacccctggaacctggcggcagcgcaaaagatg

SEQ ID NO: 138445 - DNA, 103 bp, Artificial Sequence
  Synthetic Polynucleotide
taatacgactcactatagggtgggctggcccccggagtatacccaggggtaacagaggagaacccctatgtatactccgaacctggcggcagcgcaaaagatg

SEQ ID NO: 138446 - DNA, 103 bp, Artificial Sequence
  Synthetic Polynucleotide
taatacgactcactataggggagggcactttgggctggcccccggagtataacagaggagaatactcatggggccagccaacctggcggcagcgcaaaagatg

SEQ ID NO: 138447 - DNA, 103 bp, Artificial Sequence
  Synthetic Polynucleotide
taatacgactcactataggggctgaaggcagagggcactttgggctggccaacagaggagaggccagatgaaagtgcccaacctggcggcagcgcaaaagatg

SEQ ID NO: 138448 - DNA, 103 bp, Artificial Sequence
  Synthetic Polynucleotide
taatacgactcactatagggtgctgcctaagctgaaggcagagggcacttaacagaggagaaagtgcatgctgccttcaaacctggcggcagcgcaaaagatg

SEQ ID NO: 138449 - DNA, 103 bp, Artificial Sequence
  Synthetic Polynucleotide
taatacgactcactatagggtcctgtctcacgatgccgttctctggggccaacagaggagaggccccatggaacggcataacctggcggcagcgcaaaagatg

SEQ ID NO: 138450 - DNA, 103 bp, Artificial Sequence
  Synthetic Polynucleotide
taatacgactcactatagggtaaaagcccttgctgcctaagctgaaggcaaacagaggagatgccttatgcttaggcagaacctggcggcagcgcaaaagatg

SEQ ID NO: 138451 - DNA, 103 bp, Artificial Sequence
  Synthetic Polynucleotide
taatacgactcactatagggatccttgtagtaaaagcccttgctgcctaaaacagaggagattaggcatgaagggctttaacctggcggcagcgcaaaagatg

SEQ ID NO: 138452 - DNA, 103 bp, Artificial Sequence
  Synthetic Polynucleotide
taatacgactcactataggggaatgctcggatccttgtagtaaaagccctaacagaggagaagggctatgactacaaggaacctggcggcagcgcaaaagatg

SEQ ID NO: 138453 - DNA, 103 bp, Artificial Sequence
  Synthetic Polynucleotide
taatacgactcactataggggccaacctgggaatgctcggatccttgtagaacagaggagactacaaatgtccgagcataacctggcggcagcgcaaaagatg

SEQ ID NO: 138454 - DNA, 103 bp, Artificial Sequence
  Synthetic Polynucleotide
taatacgactcactataggggggctcctttgccaacctgggaatgctcggaacagaggagaccgagcatgcccaggttgaacctggcggcagcgcaaaagatg

SEQ ID NO: 138455 - DNA, 103 bp, Artificial Sequence
  Synthetic Polynucleotide
taatacgactcactatagggcagctgccaagggctcctttgccaacctggaacagaggagaccaggtatgcaaaggagcaacctggcggcagcgcaaaagatg

SEQ ID NO: 138456 - DNA, 103 bp, Artificial Sequence
  Synthetic Polynucleotide
taatacgactcactatagggccaggttccgcagctgccaagggctcctttaacagaggagaaaaggaatgcttggcagcaacctggcggcagcgcaaaagatg

SEQ ID NO: 138457 - DNA, 103 bp, Artificial Sequence
  Synthetic Polynucleotide
taatacgactcactataggggccaaacaacccaggttccgcagctgccaaaacagaggagattggcaatggcggaacctaacctggcggcagcgcaaaagatg

SEQ ID NO: 138458 - DNA, 103 bp, Artificial Sequence
  Synthetic Polynucleotide
taatacgactcactatagggcagagtttaagccaaacaacccaggttccgaacagaggagacggaacatgggttgtttgaacctggcggcagcgcaaaagatg

SEQ ID NO: 138459 - DNA, 103 bp, Artificial Sequence
  Synthetic Polynucleotide
taatacgactcactatagggaggtgcccaccagagtttaagccaaacaacaacagaggagagttgttatgcttaaactcaacctggcggcagcgcaaaagatg

SEQ ID NO: 138460 - DNA, 103 bp, Artificial Sequence
  Synthetic Polynucleotide
taatacgactcactataggggctgccgggctcctgtctcacgatgccgttaacagaggagaaacggcatggtgagacagaacctggcggcagcgcaaaagatg

SEQ ID NO: 138461 - DNA, 103 bp, Artificial Sequence
  Synthetic Polynucleotide
taatacgactcactatagggggctctctgcaggtgcccaccagagtttaaaacagaggagattaaacatgggtgggcacaacctggcggcagcgcaaaagatg

SEQ ID NO: 138462 - DNA, 103 bp, Artificial Sequence
  Synthetic Polynucleotide
taatacgactcactatagggcggcctccccggctctctgcaggtgcccacaacagaggagagtgggcatgtgcagagagaacctggcggcagcgcaaaagatg

SEQ ID NO: 138463 - DNA, 103 bp, Artificial Sequence
  Synthetic Polynucleotide
taatacgactcactataggggaagggcgttcggcctccccggctctctgcaacagaggagagcagagatgcggggaggcaacctggcggcagcgcaaaagatg

SEQ ID NO: 138464 - DNA, 103 bp, Artificial Sequence
  Synthetic Polynucleotide
taatacgactcactatagggctggtgcagtgaagggcgttcggcctccccaacagaggagaggggagatggaacgccctaacctggcggcagcgcaaaagatg

SEQ ID NO: 138465 - DNA, 103 bp, Artificial Sequence
  Synthetic Polynucleotide
taatacgactcactatagggctccatccctctggtgcagtgaagggcgttaacagaggagaaacgccatgcactgcaccaacctggcggcagcgcaaaagatg

SEQ ID NO: 138466 - DNA, 103 bp, Artificial Sequence
  Synthetic Polynucleotide
taatacgactcactataggggctcccatctctccatccctctggtgcagtaacagaggagaactgcaatggagggatggaacctggcggcagcgcaaaagatg

SEQ ID NO: 138467 - DNA, 103 bp, Artificial Sequence
  Synthetic Polynucleotide
taatacgactcactatagggctgccggccagctcccatctctccatccctaacagaggagaagggatatggagatgggaaacctggcggcagcgcaaaagatg

SEQ ID NO: 138468 - DNA, 103 bp, Artificial Sequence
  Synthetic Polynucleotide
taatacgactcactatagggaaggattctgctgccggccagctcccatctaacagaggagaagatggatgctggccggcaacctggcggcagcgcaaaagatg

SEQ ID NO: 138469 - DNA, 103 bp, Artificial Sequence
  Synthetic Polynucleotide
taatacgactcactatagggaagagcgggcaaggattctgctgccggccaaacagaggagatggccgatggcagaatccaacctggcggcagcgcaaaagatg

SEQ ID NO: 138470 - DNA, 103 bp, Artificial Sequence
  Synthetic Polynucleotide
taatacgactcactatagggctgccccaggaagagcgggcaaggattctgaacagaggagacagaatatgtgcccgctcaacctggcggcagcgcaaaagatg

SEQ ID NO: 138471 - DNA, 103 bp, Artificial Sequence
  Synthetic Polynucleotide
taatacgactcactatagggctcgaggcgggctgccgggctcctgtctcaaacagaggagatgagacatgagcccggcaaacctggcggcagcgcaaaagatg

SEQ ID NO: 138472 - DNA, 103 bp, Artificial Sequence
  Synthetic Polynucleotide
taatacgactcactatagggcagtgtctggctgccccaggaagagcgggcaacagaggagagcccgcatgtcctggggcaacctggcggcagcgcaaaagatg

SEQ ID NO: 138473 - DNA, 103 bp, Artificial Sequence
  Synthetic Polynucleotide
taatacgactcactataggggtccagggcacagtgtctggctgccccaggaacagaggagacctgggatggccagacacaacctggcggcagcgcaaaagatg

SEQ ID NO: 138474 - DNA, 103 bp, Artificial Sequence
  Synthetic Polynucleotide
taatacgactcactataggggggccaggaggtccagggcacagtgtctggaacagaggagaccagacatggtgccctggaacctggcggcagcgcaaaagatg

SEQ ID NO: 138475 - DNA, 103 bp, Artificial Sequence
  Synthetic Polynucleotide
taatacgactcactatagggggggacaagcgggccaggaggtccagggcaaacagaggagatgccctatgcctcctggcaacctggcggcagcgcaaaagatg

SEQ ID NO: 138476 - DNA, 103 bp, Artificial Sequence
  Synthetic Polynucleotide
taatacgactcactatagggacaaggcctgggggacaagcgggccaggagaacagaggagactcctgatgcgcttgtccaacctggcggcagcgcaaaagatg

SEQ ID NO: 138477 - DNA, 103 bp, Artificial Sequence
  Synthetic Polynucleotide
taatacgactcactatagggaagagtatgaacaaggcctgggggacaagcaacagaggagagcttgtatgccaggccttaacctggcggcagcgcaaaagatg

SEQ ID NO: 138478 - DNA, 103 bp, Artificial Sequence
  Synthetic Polynucleotide
taatacgactcactatagggagacgttgccaagagtatgaacaaggcctgaacagaggagacaggccatgttcatactcaacctggcggcagcgcaaaagatg

SEQ ID NO: 138479 - DNA, 103 bp, Artificial Sequence
  Synthetic Polynucleotide
taatacgactcactatagggggcccagcccagacgttgccaagagtatgaaacagaggagatcatacatgtggcaacgtaacctggcggcagcgcaaaagatg

SEQ ID NO: 138480 - DNA, 103 bp, Artificial Sequence
  Synthetic Polynucleotide
taatacgactcactatagggcccatcgcctggcccagcccagacgttgccaacagaggagaggcaacatgtgggctgggaacctggcggcagcgcaaaagatg

SEQ ID NO: 138481 - DNA, 103 bp, Artificial Sequence
  Synthetic Polynucleotide
taatacgactcactatagggacccaaggttcccatcgcctggcccagcccaacagaggagagggctgatgcaggcgatgaacctggcggcagcgcaaaagatg

SEQ ID NO: 138482 - DNA, 103 bp, Artificial Sequence
  Synthetic Polynucleotide
taatacgactcactatagggtgcagtccatctcgaggcgggctgccgggcaacagaggagagcccggatgcccgcctcgaacctggcggcagcgcaaaagatg

SEQ ID NO: 138483 - DNA, 103 bp, Artificial Sequence
  Synthetic Polynucleotide
taatacgactcactatagggcccagctggtacccaaggttcccatcgcctaacagaggagaaggcgaatggaaccttggaacctggcggcagcgcaaaagatg

SEQ ID NO: 138484 - DNA, 103 bp, Artificial Sequence
  Synthetic Polynucleotide
taatacgactcactatagggtgctggtggccccagctggtacccaaggttaacagaggagaaaccttatgtaccagctgaacctggcggcagcgcaaaagatg

SEQ ID NO: 138485 - DNA, 103 bp, Artificial Sequence
  Synthetic Polynucleotide
taatacgactcactatagggaccttggtgttgctggtggccccagctggtaacagaggagaaccagcatgggccaccagaacctggcggcagcgcaaaagatg

SEQ ID NO: 138486 - DNA, 103 bp, Artificial Sequence
  Synthetic Polynucleotide
taatacgactcactatagggggagaggggcaccttggtgttgctggtggcaacagaggagagccaccatgaacaccaagaacctggcggcagcgcaaaagatg

SEQ ID NO: 138487 - DNA, 103 bp, Artificial Sequence
  Synthetic Polynucleotide
taatacgactcactatagggaggcggctcaggagaggggcaccttggtgtaacagaggagaacaccaatgtgcccctctaacctggcggcagcgcaaaagatg

SEQ ID NO: 138488 - DNA, 103 bp, Artificial Sequence
  Synthetic Polynucleotide
taatacgactcactataggggctgggtgacaggcggctcaggagaggggcaacagaggagagcccctatgctgagccgcaacctggcggcagcgcaaaagatg

SEQ ID NO: 138489 - DNA, 103 bp, Artificial Sequence
  Synthetic Polynucleotide
taatacgactcactatagggcagcagccccgctgggtgacaggcggctcaaacagaggagatgagccatgtgtcacccaaacctggcggcagcgcaaaagatg

SEQ ID NO: 138490 - DNA, 103 bp, Artificial Sequence
  Synthetic Polynucleotide
taatacgactcactataggggtaggatgaacagcagccccgctgggtgacaacagaggagagtcaccatgcggggctgcaacctggcggcagcgcaaaagatg

SEQ ID NO: 138491 - DNA, 103 bp, Artificial Sequence
  Synthetic Polynucleotide
taatacgactcactatagggtagtgggtgggtaggatgaacagcagccccaacagaggagaggggctatggttcatcctaacctggcggcagcgcaaaagatg

SEQ ID NO: 138492 - DNA, 103 bp, Artificial Sequence
  Synthetic Polynucleotide
taatacgactcactatagggcccccacctttagtgggtgggtaggatgaaaacagaggagattcatcatgcccacccacaacctggcggcagcgcaaaagatg

SEQ ID NO: 138493 - DNA, 103 bp, Artificial Sequence
  Synthetic Polynucleotide
taatacgactcactatagggcgccgcgccggggcccacgggcagatccataacagaggagaatggatatgcccgtgggcaacctggcggcagcgcaaaagatg

SEQ ID NO: 138494 - DNA, 103 bp, Artificial Sequence
  Synthetic Polynucleotide
taatacgactcactataggggctcgggctccagcagatgagcgcgtcggtaacagaggagaaccgacatgctcatctgcaacctggcggcagcgcaaaagatg

SEQ ID NO: 138495 - DNA, 103 bp, Artificial Sequence
  Synthetic Polynucleotide
taatacgactcactatagggaggttcactctcccgcaggatggagtcaataacagaggagaattgacatgatcctgcggaacctggcggcagcgcaaaagatg

SEQ ID NO: 138496 - DNA, 103 bp, Artificial Sequence
  Synthetic Polynucleotide
taatacgactcactatagggaggcgggggcaggttcactctcccgcaggaaacagaggagatcctgcatgagagtgaacaacctggcggcagcgcaaaagatg

SEQ ID NO: 138497 - DNA, 103 bp, Artificial Sequence
  Synthetic Polynucleotide
taatacgactcactataggggctgtgacggaggcgggggcaggttcactcaacagaggagagagtgaatgtgcccccgcaacctggcggcagcgcaaaagatg

SEQ ID NO: 138498 - DNA, 103 bp, Artificial Sequence
  Synthetic Polynucleotide
taatacgactcactataggggtccgtgagggctgtgacggaggcgggggcaacagaggagagcccccatgtccgtcacaaacctggcggcagcgcaaaagatg

SEQ ID NO: 138499 - DNA, 103 bp, Artificial Sequence
  Synthetic Polynucleotide
taatacgactcactatagggggcccctggcgtccgtgagggctgtgacggaacagaggagaccgtcaatgccctcacggaacctggcggcagcgcaaaagatg

SEQ ID NO: 138500 - DNA, 103 bp, Artificial Sequence
  Synthetic Polynucleotide
taatacgactcactataggggtgtccgtgtggcccctggcgtccgtgaggaacagaggagacctcacatgcgccaggggaacctggcggcagcgcaaaagatg

SEQ ID NO: 138501 - DNA, 103 bp, Artificial Sequence
  Synthetic Polynucleotide
taatacgactcactatagggccggccctcggtgtccgtgtggcccctggcaacagaggagagccaggatgcacacggacaacctggcggcagcgcaaaagatg

SEQ ID NO: 138502 - DNA, 103 bp, Artificial Sequence
  Synthetic Polynucleotide
taatacgactcactataggggggagggaggccggccctcggtgtccgtgtaacagaggagaacacggatgccgagggccaacctggcggcagcgcaaaagatg

SEQ ID NO: 138503 - DNA, 103 bp, Artificial Sequence
  Synthetic Polynucleotide
taatacgactcactataggggtgggcgggggggagggaggccggccctcgaacagaggagacgagggatggcctccctcaacctggcggcagcgcaaaagatg

SEQ ID NO: 138504 - DNA, 103 bp, Artificial Sequence
  Synthetic Polynucleotide
taatacgactcactatagggaggggtggaggtgggcgggggggagggaggaacagaggagacctcccatgcccccgcccaacctggcggcagcgcaaaagatg

SEQ ID NO: 138505 - DNA, 103 bp, Artificial Sequence
  Synthetic Polynucleotide
taatacgactcactatagggagctgttcccgctcgggctccagcagatgaaacagaggagatcatctatgggagcccgaaacctggcggcagcgcaaaagatg

SEQ ID NO: 138506 - DNA, 103 bp, Artificial Sequence
  Synthetic Polynucleotide
taatacgactcactatagggggcacttttcaggggtggaggtgggcggggaacagaggagaccccgcatgcctccacccaacctggcggcagcgcaaaagatg

SEQ ID NO: 138507 - DNA, 103 bp, Artificial Sequence
  Synthetic Polynucleotide
taatacgactcactataggggctacgctgaggcacttttcaggggtggagaacagaggagactccacatgtgaaaagtgaacctggcggcagcgcaaaagatg

SEQ ID NO: 138508 - DNA, 103 bp, Artificial Sequence
  Synthetic Polynucleotide
taatacgactcactataggggtccaggcaggctacgctgaggcacttttcaacagaggagagaaaagatgctcagcgtaaacctggcggcagcgcaaaagatg

SEQ ID NO: 138509 - DNA, 103 bp, Artificial Sequence
  Synthetic Polynucleotide
taatacgactcactataggggctcattcttgtccaggcaggctacgctgaaacagaggagatcagcgatgcctgcctggaacctggcggcagcgcaaaagatg

SEQ ID NO: 138510 - DNA, 103 bp, Artificial Sequence
  Synthetic Polynucleotide
taatacgactcactatagggtggtcactgagctcattcttgtccaggcagaacagaggagactgcctatgcaagaatgaaacctggcggcagcgcaaaagatg

SEQ ID NO: 138511 - DNA, 103 bp, Artificial Sequence
  Synthetic Polynucleotide
taatacgactcactatagggagcatccaagtggtcactgagctcattcttaacagaggagaaagaatatgctcagtgacaacctggcggcagcgcaaaagatg

SEQ ID NO: 138512 - DNA, 103 bp, Artificial Sequence
  Synthetic Polynucleotide
taatacgactcactatagggtggagtccatagcatccaagtggtcactgaaacagaggagatcagtgatgacttggatgaacctggcggcagcgcaaaagatg

SEQ ID NO: 138513 - DNA, 103 bp, Artificial Sequence
  Synthetic Polynucleotide
taatacgactcactatagggttatccaggttggagtccatagcatccaagaacagaggagacttggaatgtatggactcaacctggcggcagcgcaaaagatg

SEQ ID NO: 138514 - DNA, 103 bp, Artificial Sequence
  Synthetic Polynucleotide
taatacgactcactatagggggtctgcaggttatccaggttggagtccataacagaggagaatggacatgaacctggataacctggcggcagcgcaaaagatg

SEQ ID NO: 138515 - DNA, 103 bp, Artificial Sequence
  Synthetic Polynucleotide
taatacgactcactatagggtgctcagcatggtctgcaggttatccaggtaacagaggagaacctggatgacctgcagaaacctggcggcagcgcaaaagatg

SEQ ID NO: 138516 - DNA, 103 bp, Artificial Sequence
  Synthetic Polynucleotide
taatacgactcactatagggaacacgtggaagctgttcccgctcgggctcaacagaggagagagcccatgcgggaacagaacctggcggcagcgcaaaagatg

SEQ ID NO: 138517 - DNA, 103 bp, Artificial Sequence
  Synthetic Polynucleotide
taatacgactcactatagggaagccgtggctgctcagcatggtctgcaggaacagaggagacctgcaatgcatgctgagaacctggcggcagcgcaaaagatg

SEQ ID NO: 138518 - DNA, 103 bp, Artificial Sequence
  Synthetic Polynucleotide
taatacgactcactataggggtccacgctgaagccgtggctgctcagcataacagaggagaatgctgatgagccacggcaacctggcggcagcgcaaaagatg

SEQ ID NO: 138519 - DNA, 103 bp, Artificial Sequence
  Synthetic Polynucleotide
taatacgactcactataggggggcactggtgtccacgctgaagccgtggcaacagaggagagccacgatgtcagcgtggaacctggcggcagcgcaaaagatg

SEQ ID NO: 138520 - DNA, 103 bp, Artificial Sequence
  Synthetic Polynucleotide
taatacgactcactatagggaggtccagcagggcactggtgtccacgctgaacagaggagacagcgtatgcaccagtgcaacctggcggcagcgcaaaagatg

SEQ ID NO: 138521 - DNA, 103 bp, Artificial Sequence
  Synthetic Polynucleotide
taatacgactcactatagggggggctgaacaggtccagcagggcactggtaacagaggagaaccagtatgctgctggacaacctggcggcagcgcaaaagatg

SEQ ID NO: 138522 - DNA, 103 bp, Artificial Sequence
  Synthetic Polynucleotide
taatacgactcactatagggcggtcaccgaggggctgaacaggtccagcaaacagaggagatgctggatgtgttcagccaacctggcggcagcgcaaaagatg

SEQ ID NO: 138523 - DNA, 103 bp, Artificial Sequence
  Synthetic Polynucleotide
taatacgactcactatagggatgtcgggcacggtcaccgaggggctgaacaacagaggagagttcagatgctcggtgacaacctggcggcagcgcaaaagatg

SEQ ID NO: 138524 - DNA, 103 bp, Artificial Sequence
  Synthetic Polynucleotide
taatacgactcactatagggaggcaggctcatgtcgggcacggtcaccgaaacagaggagatcggtgatggtgcccgacaacctggcggcagcgcaaaagatg

SEQ ID NO: 138525 - DNA, 103 bp, Artificial Sequence
  Synthetic Polynucleotide
taatacgactcactatagggtgtcaaggtcaggcaggctcatgtcgggcaaacagaggagatgcccgatgtgagcctgcaacctggcggcagcgcaaaagatg

SEQ ID NO: 138526 - DNA, 103 bp, Artificial Sequence
  Synthetic Polynucleotide
taatacgactcactataggggccaggctgctgtcaaggtcaggcaggctcaacagaggagagagcctatgtgaccttgaaacctggcggcagcgcaaaagatg

SEQ ID NO: 138527 - DNA, 103 bp, Artificial Sequence
  Synthetic Polynucleotide
taatacgactcactataggggccctggtcgaacacgtggaagctgttcccaacagaggagagggaacatgttccacgtgaacctggcggcagcgcaaaagatg

SEQ ID NO: 138528 - DNA, 103 bp, Artificial Sequence
  Synthetic Polynucleotide
taatacgactcactatagggttggatactggccaggctgctgtcaaggtcaacagaggagagaccttatgagcagcctgaacctggcggcagcgcaaaagatg

SEQ ID NO: 138529 - DNA, 103 bp, Artificial Sequence
  Synthetic Polynucleotide
taatacgactcactatagggacaggagctcttggatactggccaggctgcaacagaggagagcagccatgccagtatccaacctggcggcagcgcaaaagatg

SEQ ID NO: 138530 - DNA, 103 bp, Artificial Sequence
  Synthetic Polynucleotide
taatacgactcactatagggtcctggggagacaggagctcttggatactgaacagaggagacagtatatgagagctcctaacctggcggcagcgcaaaagatg

SEQ ID NO: 138531 - DNA, 103 bp, Artificial Sequence
  Synthetic Polynucleotide
taatacgactcactatagggcctggggggctcctggggagacaggagctcaacagaggagagagctcatgtctccccagaacctggcggcagcgcaaaagatg

SEQ ID NO: 138532 - DNA, 103 bp, Artificial Sequence
  Synthetic Polynucleotide
taatacgactcactatagggcctcgggaggcctggggggctcctggggagaacagaggagactccccatgagccccccaaacctggcggcagcgcaaaagatg

SEQ ID NO: 138533 - DNA, 103 bp, Artificial Sequence
  Synthetic Polynucleotide
taatacgactcactatagggctgttctctgcctcgggaggcctggggggcaacagaggagagcccccatggcctcccgaaacctggcggcagcgcaaaagatg

SEQ ID NO: 138534 - DNA, 103 bp, Artificial Sequence
  Synthetic Polynucleotide
taatacgactcactatagggatccgggctgctgttctctgcctcgggaggaacagaggagacctcccatggcagagaacaacctggcggcagcgcaaaagatg

SEQ ID NO: 138535 - DNA, 103 bp, Artificial Sequence
  Synthetic Polynucleotide
taatacgactcactataggggcttccctgaatccgggctgctgttctctgaacagaggagacagagaatggcagcccggaacctggcggcagcgcaaaagatg

SEQ ID NO: 138536 - DNA, 103 bp, Artificial Sequence
  Synthetic Polynucleotide
taatacgactcactatagggtgcaccagctgcttccctgaatccgggctgaacagaggagacagcccatgttcagggaaaacctggcggcagcgcaaaagatg

SEQ ID NO: 138537 - DNA, 103 bp, Artificial Sequence
  Synthetic Polynucleotide
taatacgactcactatagggcgctgtgtagtgcaccagctgcttccctgaaacagaggagatcagggatgcagctggtgaacctggcggcagcgcaaaagatg

SEQ ID NO: 138538 - DNA, 103 bp, Artificial Sequence
  Synthetic Polynucleotide
taatacgactcactatagggtggcaaactggccctggtcgaacacgtggaaacagaggagatccacgatgtcgaccaggaacctggcggcagcgcaaaagatg

SEQ ID NO: 138539 - DNA, 103 bp, Artificial Sequence
  Synthetic Polynucleotide
taatacgactcactatagggacagcggctgcgctgtgtagtgcaccagctaacagaggagaagctggatgactacacagaacctggcggcagcgcaaaagatg

SEQ ID NO: 138540 - DNA, 103 bp, Artificial Sequence
  Synthetic Polynucleotide
taatacgactcactatagggtccagcaggaacagcggctgcgctgtgtagaacagaggagactacacatggcagccgctaacctggcggcagcgcaaaagatg

SEQ ID NO: 138541 - DNA, 103 bp, Artificial Sequence
  Synthetic Polynucleotide
taatacgactcactatagggggagccggggtccagcaggaacagcggctgaacagaggagacagccgatgttcctgctgaacctggcggcagcgcaaaagatg

SEQ ID NO: 138542 - DNA, 103 bp, Artificial Sequence
  Synthetic Polynucleotide
taatacgactcactatagggcggtgtccacggagccggggtccagcaggaaacagaggagatcctgcatgaccccggctaacctggcggcagcgcaaaagatg

SEQ ID NO: 138543 - DNA, 103 bp, Artificial Sequence
  Synthetic Polynucleotide
taatacgactcactatagggtcgttgctcccggtgtccacggagccggggaacagaggagaccccggatgcgtggacacaacctggcggcagcgcaaaagatg

SEQ ID NO: 138544 - DNA, 103 bp, Artificial Sequence
  Synthetic Polynucleotide
taatacgactcactatagggcaccggcaggtcgttgctcccggtgtccacaacagaggagagtggacatggggagcaacaacctggcggcagcgcaaaagatg

SEQ ID NO: 138545 - DNA, 103 bp, Artificial Sequence
  Synthetic Polynucleotide
taatacgactcactataggggctcaaacagcaccggcaggtcgttgctccaacagaggagaggagcaatgacctgccggaacctggcggcagcgcaaaagatg

SEQ ID NO: 138546 - DNA, 103 bp, Artificial Sequence
  Synthetic Polynucleotide
taatacgactcactatagggccctctcccagctcaaacagcaccggcaggaacagaggagacctgccatggctgtttgaaacctggcggcagcgcaaaagatg

SEQ ID NO: 138547 - DNA, 103 bp, Artificial Sequence
  Synthetic Polynucleotide
taatacgactcactataggggaagtaggagccctctcccagctcaaacagaacagaggagactgtttatgctgggagagaacctggcggcagcgcaaaagatg

SEQ ID NO: 138548 - DNA, 103 bp, Artificial Sequence
  Synthetic Polynucleotide
taatacgactcactatagggccccttcggagaagtaggagccctctcccaaacagaggagatgggagatggctcctactaacctggcggcagcgcaaaagatg

SEQ ID NO: 138549 - DNA, 103 bp, Artificial Sequence
  Synthetic Polynucleotide
taatacgactcactatagggagcacctccttggcaaactggccctggtcgaacagaggagacgaccaatgccagtttgcaacctggcggcagcgcaaaagatg

SEQ ID NO: 138550 - DNA, 103 bp, Artificial Sequence
  Synthetic Polynucleotide
taatacgactcactataggggcgaagccgtccccttcggagaagtaggagaacagaggagactcctaatgctccgaaggaacctggcggcagcgcaaaagatg

SEQ ID NO: 138551 - DNA, 103 bp, Artificial Sequence
  Synthetic Polynucleotide
taatacgactcactatagggggggtcctcggcgaagccgtccccttcggaaacagaggagatccgaaatggacggcttcaacctggcggcagcgcaaaagatg

SEQ ID NO: 138552 - DNA, 103 bp, Artificial Sequence
  Synthetic Polynucleotide
taatacgactcactataggggggagatggtggggtcctcggcgaagccgtaacagaggagaacggctatgccgaggaccaacctggcggcagcgcaaaagatg

SEQ ID NO: 138553 - DNA, 103 bp, Artificial Sequence
  Synthetic Polynucleotide
taatacgactcactatagggcctgtcagcagggagatggtggggtcctcgaacagaggagacgaggaatgcaccatctcaacctggcggcagcgcaaaagatg

SEQ ID NO: 138554 - DNA, 103 bp, Artificial Sequence
  Synthetic Polynucleotide
taatacgactcactatagggaggctccgagcctgtcagcagggagatggtaacagaggagaaccatcatgctgctgacaaacctggcggcagcgcaaaagatg

SEQ ID NO: 138555 - DNA, 103 bp, Artificial Sequence
  Synthetic Polynucleotide
taatacgactcactatagggtggctttgggaggctccgagcctgtcagcaaacagaggagatgctgaatggctcggagcaacctggcggcagcgcaaaagatg

SEQ ID NO: 138556 - DNA, 103 bp, Artificial Sequence
  Synthetic Polynucleotide
taatacgactcactataggggtggggtccttggctttgggaggctccgagaacagaggagactcggaatgtcccaaagcaacctggcggcagcgcaaaagatg

SEQ ID NO: 138557 - DNA, 103 bp, Artificial Sequence
  Synthetic Polynucleotide
taatacgactcactatagggctaggagacagtggggtccttggctttgggaacagaggagacccaaaatgaaggaccccaacctggcggcagcgcaaaagatg

SEQ ID NO: 138558 - DNA, 103 bp, Artificial Sequence
  Synthetic Polynucleotide
taatacgactcactataggggtacttgggcagcacctccttggcaaactgaacagaggagacagtttatgaaggaggtgaacctggcggcagcgcaaaagatg

SEQ ID NO: 138559 - DNA, 103 bp, Artificial Sequence
  Synthetic Polynucleotide
taatacgactcactatagggtgtgcttgaagtacttgggcagcacctcctaacagaggagaaggaggatgtgcccaagtaacctggcggcagcgcaaaagatg

SEQ ID NO: 138560 - DNA, 103 bp, Artificial Sequence
  Synthetic Polynucleotide
taatacgactcactataggggccatgttgttgtgcttgaagtacttgggcaacagaggagagcccaaatgcttcaagcaaacctggcggcagcgcaaaagatg

SEQ ID NO: 138561 - DNA, 103 bp, Artificial Sequence
  Synthetic Polynucleotide
taatacgactcactatagggcacgaagctggccatgttgttgtgcttgaaaacagaggagattcaagatgaacaacatgaacctggcggcagcgcaaaagatg

SEQ ID NO: 138562 - DNA, 103 bp, Artificial Sequence
  Synthetic Polynucleotide
taatacgactcactatagggtgctgggccccgccgcgccggggcccacggaacagaggagaccgtggatgccggcgcggaacctggcggcagcgcaaaagatg

SEQ ID NO: 138563 - DNA, 103 bp, Artificial Sequence
  Synthetic Polynucleotide
taatacgactcactatagggtgagctgccgcacgaagctggccatgttgtaacagaggagaacaacaatgccagcttcgaacctggcggcagcgcaaaagatg

SEQ ID NO: 138564 - DNA, 103 bp, Artificial Sequence
  Synthetic Polynucleotide
taatacgactcactatagggccatacatgttgagctgccgcacgaagctgaacagaggagacagcttatggcggcagctaacctggcggcagcgcaaaagatg

SEQ ID NO: 138565 - DNA, 103 bp, Artificial Sequence
  Synthetic Polynucleotide
taatacgactcactatagggtttccggaagccatacatgttgagctgccgaacagaggagacggcagatgaacatgtataacctggcggcagcgcaaaagatg

SEQ ID NO: 138566 - DNA, 103 bp, Artificial Sequence
  Synthetic Polynucleotide
taatacgactcactatagggtgtggaccactttccggaagccatacatgtaacagaggagaacatgtatggcttccggaaacctggcggcagcgcaaaagatg

SEQ ID NO: 138567 - DNA, 103 bp, Artificial Sequence
  Synthetic Polynucleotide
taatacgactcactatagggccctgctcgatgtggaccactttccggaagaacagaggagacttccgatgagtggtccaaacctggcggcagcgcaaaagatg

SEQ ID NO: 138568 - DNA, 103 bp, Artificial Sequence
  Synthetic Polynucleotide
taatacgactcactataggggaccaggccgccctgctcgatgtggaccacaacagaggagagtggtcatgatcgagcagaacctggcggcagcgcaaaagatg

SEQ ID NO: 138569 - DNA, 103 bp, Artificial Sequence
  Synthetic Polynucleotide
taatacgactcactatagggtctctggcttgaccaggccgccctgctcgaaacagaggagatcgagcatggcggcctggaacctggcggcagcgcaaaagatg

SEQ ID NO: 138570 - DNA, 103 bp, Artificial Sequence
  Synthetic Polynucleotide
taatacgactcactataggggtgtcgtctctctctggcttgaccaggccgaacagaggagacggcctatgcaagccagaaacctggcggcagcgcaaaagatg

SEQ ID NO: 138571 - DNA, 103 bp, Artificial Sequence
  Synthetic Polynucleotide
taatacgactcactatagggctggaactccgtgtcgtctctctctggcttaacagaggagaaagccaatgagagacgacaacctggcggcagcgcaaaagatg

SEQ ID NO: 138572 - DNA, 103 bp, Artificial Sequence
  Synthetic Polynucleotide
taatacgactcactatagggagcatgggtgctggaactccgtgtcgtctcaacagaggagagagacgatgcggagttccaacctggcggcagcgcaaaagatg

SEQ ID NO: 138573 - DNA, 103 bp, Artificial Sequence
  Synthetic Polynucleotide
taatacgactcactataggggccgggacgttgctgggccccgccgcgccgaacagaggagacggcgcatgggggcccagaacctggcggcagcgcaaaagatg

SEQ ID NO: 138574 - DNA, 103 bp, Artificial Sequence
  Synthetic Polynucleotide
taatacgactcactatagggccacgcaggaagcatgggtgctggaactccaacagaggagaggagttatggcacccatgaacctggcggcagcgcaaaagatg

SEQ ID NO: 138575 - DNA, 103 bp, Artificial Sequence
  Synthetic Polynucleotide
taatacgactcactatagggctgctcctggccacgcaggaagcatgggtgaacagaggagacacccaatgttcctgcgtaacctggcggcagcgcaaaagatg

SEQ ID NO: 138576 - DNA, 103 bp, Artificial Sequence
  Synthetic Polynucleotide
taatacgactcactatagggtctcaaggagctgctcctggccacgcaggaaacagaggagatcctgcatggccaggagcaacctggcggcagcgcaaaagatg

SEQ ID NO: 138577 - DNA, 103 bp, Artificial Sequence
  Synthetic Polynucleotide
taatacgactcactatagggctcttgatgttctcaaggagctgctcctggaacagaggagaccaggaatggctccttgaaacctggcggcagcgcaaaagatg

SEQ ID NO: 138578 - DNA, 103 bp, Artificial Sequence
  Synthetic Polynucleotide
taatacgactcactatagggggtcactttcctcttgatgttctcaaggagaacagaggagactccttatgaacatcaagaacctggcggcagcgcaaaagatg

SEQ ID NO: 138579 - DNA, 103 bp, Artificial Sequence
  Synthetic Polynucleotide
taatacgactcactatagggtggacacactggtcactttcctcttgatgtaacagaggagaacatcaatgggaaagtgaaacctggcggcagcgcaaaagatg

SEQ ID NO: 138580 - DNA, 103 bp, Artificial Sequence
  Synthetic Polynucleotide
taatacgactcactatagggctcttcagggtggacacactggtcactttcaacagaggagagaaagtatgcagtgtgtcaacctggcggcagcgcaaaagatg

SEQ ID NO: 138581 - DNA, 103 bp, Artificial Sequence
  Synthetic Polynucleotide
taatacgactcactatagggtatgtcttcactcttcagggtggacacactaacagaggagaagtgtgatgaccctgaagaacctggcggcagcgcaaaagatg

SEQ ID NO: 138582 - DNA, 103 bp, Artificial Sequence
  Synthetic Polynucleotide
taatacgactcactatagggggcggatctttatgtcttcactcttcagggaacagaggagaccctgaatggtgaagacaaacctggcggcagcgcaaaagatg

SEQ ID NO: 138583 - DNA, 103 bp, Artificial Sequence
  Synthetic Polynucleotide
taatacgactcactatagggacgctgtcctggcggatctttatgtcttcaaacagaggagatgaagaatgaaagatccgaacctggcggcagcgcaaaagatg

SEQ ID NO: 138584 - DNA, 103 bp, Artificial Sequence
  Synthetic Polynucleotide
taatacgactcactatagggggtcaggaaggccgggacgttgctgggcccaacagaggagagggcccatgaacgtcccgaacctggcggcagcgcaaaagatg

SEQ ID NO: 138585 - DNA, 103 bp, Artificial Sequence
  Synthetic Polynucleotide
taatacgactcactatagggcagcttggtgacgctgtcctggcggatcttaacagaggagaaagatcatgcaggacagcaacctggcggcagcgcaaaagatg

SEQ ID NO: 138586 - DNA, 103 bp, Artificial Sequence
  Synthetic Polynucleotide
taatacgactcactatagggcgtccgtcagcagcttggtgacgctgtcctaacagaggagaaggacaatgtcaccaagcaacctggcggcagcgcaaaagatg

SEQ ID NO: 138587 - DNA, 103 bp, Artificial Sequence
  Synthetic Polynucleotide
taatacgactcactatagggatcagctgcacgtccgtcagcagcttggtgaacagaggagacaccaaatggctgacggaaacctggcggcagcgcaaaagatg

SEQ ID NO: 138588 - DNA, 103 bp, Artificial Sequence
  Synthetic Polynucleotide
taatacgactcactatagggcttccccttcatcagctgcacgtccgtcagaacagaggagactgacgatggtgcagctgaacctggcggcagcgcaaaagatg

SEQ ID NO: 138589 - DNA, 103 bp, Artificial Sequence
  Synthetic Polynucleotide
taatacgactcactatagggtgcactcctgcttccccttcatcagctgcaaacagaggagatgcagcatgtgaaggggaaacctggcggcagcgcaaaagatg

SEQ ID NO: 138590 - DNA, 103 bp, Artificial Sequence
  Synthetic Polynucleotide
taatacgactcactatagggttggagtccatgcactcctgcttccccttcaacagaggagagaagggatggcaggagtgaacctggcggcagcgcaaaagatg

SEQ ID NO: 138591 - DNA, 103 bp, Artificial Sequence
  Synthetic Polynucleotide
taatacgactcactatagggggccaggagcttggagtccatgcactcctgaacagaggagacaggagatgatggactccaacctggcggcagcgcaaaagatg

SEQ ID NO: 138592 - DNA, 103 bp, Artificial Sequence
  Synthetic Polynucleotide
taatacgactcactatagggcatgcttcatggccaggagcttggagtccaaacagaggagatggactatgagctcctggaacctggcggcagcgcaaaagatg

SEQ ID NO: 138593 - DNA, 103 bp, Artificial Sequence
  Synthetic Polynucleotide
taatacgactcactataggggcctcattctcatgcttcatggccaggagcaacagaggagagctcctatgcatgaagcaaacctggcggcagcgcaaaagatg

SEQ ID NO: 138594 - DNA, 103 bp, Artificial Sequence
  Synthetic Polynucleotide
taatacgactcactatagggccgccacagagcctcattctcatgcttcataacagaggagaatgaagatggagaatgagaacctggcggcagcgcaaaagatg

SEQ ID NO: 138595 - DNA, 103 bp, Artificial Sequence
  Synthetic Polynucleotide
taatacgactcactatagggtccacagcttggtcaggaaggccgggacgtaacagaggagaacgtccatgccttcctgaaacctggcggcagcgcaaaagatg

SEQ ID NO: 138596 - DNA, 103 bp, Artificial Sequence
  Synthetic Polynucleotide
taatacgactcactatagggtggccacctcccgccacagagcctcattctaacagaggagaagaatgatgctctgtggcaacctggcggcagcgcaaaagatg

SEQ ID NO: 138597 - DNA, 103 bp, Artificial Sequence
  Synthetic Polynucleotide
taatacgactcactatagggtgccgaaggctggccacctcccgccacagaaacagaggagatctgtgatgggaggtggcaacctggcggcagcgcaaaagatg

SEQ ID NO: 138598 - DNA, 103 bp, Artificial Sequence
  Synthetic Polynucleotide
taatacgactcactatagggggcatgcttctgccgaaggctggccacctcaacagaggagagaggtgatgagccttcggaacctggcggcagcgcaaaagatg

SEQ ID NO: 138599 - DNA, 103 bp, Artificial Sequence
  Synthetic Polynucleotide
taatacgactcactatagggtctgttgctgggcatgcttctgccgaaggcaacagaggagagccttcatgagaagcatgaacctggcggcagcgcaaaagatg

SEQ ID NO: 138600 - DNA, 103 bp, Artificial Sequence
  Synthetic Polynucleotide
taatacgactcactatagggttgacgactttctgttgctgggcatgcttcaacagaggagagaagcaatgccagcaacaaacctggcggcagcgcaaaagatg

SEQ ID NO: 138601 - DNA, 103 bp, Artificial Sequence
  Synthetic Polynucleotide
taatacgactcactatagggaatgagcttgttgacgactttctgttgctgaacagaggagacagcaaatgaaagtcgtcaacctggcggcagcgcaaaagatg

SEQ ID NO: 138602 - DNA, 103 bp, Artificial Sequence
  Synthetic Polynucleotide
taatacgactcactatagggtcaggaactgaatgagcttgttgacgacttaacagaggagaaagtcgatgacaagctcaaacctggcggcagcgcaaaagatg

SEQ ID NO: 138603 - DNA, 103 bp, Artificial Sequence
  Synthetic Polynucleotide
taatacgactcactatagggaccagtgagatcaggaactgaatgagcttgaacagaggagacaagctatgtcagttcctaacctggcggcagcgcaaaagatg

SEQ ID NO: 138604 - DNA, 103 bp, Artificial Sequence
  Synthetic Polynucleotide
taatacgactcactataggggtttgactgcaccagtgagatcaggaactgaacagaggagacagttcatgatctcactgaacctggcggcagcgcaaaagatg

SEQ ID NO: 138605 - DNA, 103 bp, Artificial Sequence
  Synthetic Polynucleotide
taatacgactcactatagggccaggatccggtttgactgcaccagtgagaaacagaggagatctcacatgtgcagtcaaaacctggcggcagcgcaaaagatg

SEQ ID NO: 138606 - DNA, 103 bp, Artificial Sequence
  Synthetic Polynucleotide
taatacgactcactatagggctcacgagggtccacagcttggtcaggaagaacagaggagacttcctatgcaagctgtgaacctggcggcagcgcaaaagatg

SEQ ID NO: 138607 - DNA, 103 bp, Artificial Sequence
  Synthetic Polynucleotide
taatacgactcactatagggctcttcacccccaggatccggtttgactgcaacagaggagagcagtcatgccggatcctaacctggcggcagcgcaaaagatg

SEQ ID NO: 138608 - DNA, 103 bp, Artificial Sequence
  Synthetic Polynucleotide
taatacgactcactatagggggggatctttctcttcacccccaggatccgaacagaggagacggatcatgggggtgaagaacctggcggcagcgcaaaagatg

SEQ ID NO: 138609 - DNA, 103 bp, Artificial Sequence
  Synthetic Polynucleotide
taatacgactcactatagggtcagcatcagggggatctttctcttcacccaacagaggagagggtgaatggaaagatccaacctggcggcagcgcaaaagatg

SEQ ID NO: 138610 - DNA, 103 bp, Artificial Sequence
  Synthetic Polynucleotide
taatacgactcactatagggccactgtcgttcagcatcagggggatctttaacagaggagaaaagatatgcctgatgctaacctggcggcagcgcaaaagatg

SEQ ID NO: 138611 - DNA, 103 bp, Artificial Sequence
  Synthetic Polynucleotide
taatacgactcactatagggatgtgctgagccactgtcgttcagcatcagaacagaggagactgatgatgaacgacagtaacctggcggcagcgcaaaagatg

SEQ ID NO: 138612 - DNA, 103 bp, Artificial Sequence
  Synthetic Polynucleotide
taatacgactcactatagggtgggcatggaatgtgctgagccactgtcgtaacagaggagaacgacaatggctcagcacaacctggcggcagcgcaaaagatg

SEQ ID NO: 138613 - DNA, 103 bp, Artificial Sequence
  Synthetic Polynucleotide
taatacgactcactatagggcggctatacttgggcatggaatgtgctgagaacagaggagactcagcatgttccatgccaacctggcggcagcgcaaaagatg

SEQ ID NO: 138614 - DNA, 103 bp, Artificial Sequence
  Synthetic Polynucleotide
taatacgactcactatagggggagaactgccggctatacttgggcatggaaacagaggagatccatgatgaagtatagcaacctggcggcagcgcaaaagatg

SEQ ID NO: 138615 - DNA, 103 bp, Artificial Sequence
  Synthetic Polynucleotide
taatacgactcactatagggcgtgctccagggagaactgccggctatactaacagaggagaagtataatgggcagttctaacctggcggcagcgcaaaagatg

SEQ ID NO: 138616 - DNA, 103 bp, Artificial Sequence
  Synthetic Polynucleotide
taatacgactcactataggggagccgtggacgtgctccagggagaactgcaacagaggagagcagttatgcctggagcaaacctggcggcagcgcaaaagatg

SEQ ID NO: 138617 - DNA, 103 bp, Artificial Sequence
  Synthetic Polynucleotide
taatacgactcactataggggtccgggtcgctcacgagggtccacagcttaacagaggagaaagctgatgaccctcgtgaacctggcggcagcgcaaaagatg

SEQ ID NO: 138618 - DNA, 103 bp, Artificial Sequence
  Synthetic Polynucleotide
taatacgactcactataggggtaggggcccgagccgtggacgtgctccagaacagaggagactggagatggtccacggcaacctggcggcagcgcaaaagatg

SEQ ID NO: 138619 - DNA, 103 bp, Artificial Sequence
  Synthetic Polynucleotide
taatacgactcactatagggagggggccgagtaggggcccgagccgtggaaacagaggagatccacgatgcgggcccctaacctggcggcagcgcaaaagatg

SEQ ID NO: 138620 - DNA, 103 bp, Artificial Sequence
  Synthetic Polynucleotide
taatacgactcactatagggtaggctggggagggggccgagtaggggcccaacagaggagagggcccatgctcggccccaacctggcggcagcgcaaaagatg

SEQ ID NO: 138621 - DNA, 103 bp, Artificial Sequence
  Synthetic Polynucleotide
taatacgactcactatagggggagctgctgtaggctggggagggggccgaaacagaggagatcggccatgtccccagccaacctggcggcagcgcaaaagatg

SEQ ID NO: 138622 - DNA, 103 bp, Artificial Sequence
  Synthetic Polynucleotide
taatacgactcactatagggcgtagaggctggagctgctgtaggctggggaacagaggagaccccagatgacagcagctaacctggcggcagcgcaaaagatg

SEQ ID NO: 138623 - DNA, 103 bp, Artificial Sequence
  Synthetic Polynucleotide
taatacgactcactataggggcatcaggggcgtagaggctggagctgctgaacagaggagacagcagatgcagcctctaaacctggcggcagcgcaaaagatg

SEQ ID NO: 138624 - DNA, 103 bp, Artificial Sequence
  Synthetic Polynucleotide
taatacgactcactataggggctggccacagcatcaggggcgtagaggctaacagaggagaagcctcatggcccctgataacctggcggcagcgcaaaagatg

SEQ ID NO: 138625 - DNA, 103 bp, Artificial Sequence
  Synthetic Polynucleotide
taatacgactcactatagggtgggtccagagctggccacagcatcaggggaacagaggagacccctgatgctgtggccaaacctggcggcagcgcaaaagatg

SEQ ID NO: 138626 - DNA, 103 bp, Artificial Sequence
  Synthetic Polynucleotide
taatacgactcactatagggtcggagatgatgggtccagagctggccacaaacagaggagatgtggcatgctctggaccaacctggcggcagcgcaaaagatg

SEQ ID NO: 138627 - DNA, 103 bp, Artificial Sequence
  Synthetic Polynucleotide
taatacgactcactatagggctcggtgatgtcggagatgatgggtccagaaacagaggagatctggaatgatcatctccaacctggcggcagcgcaaaagatg

SEQ ID NO: 138628 - DNA, 103 bp, Artificial Sequence
  Synthetic Polynucleotide
taatacgactcactataggggcgcgtcggtgtccgggtcgctcacgagggaacagaggagaccctcgatggcgacccggaacctggcggcagcgcaaaagatg

SEQ ID NO: 138629 - DNA, 103 bp, Artificial Sequence
  Synthetic Polynucleotide
taatacgactcactatagggcaggagccagctcggtgatgtcggagatgaaacagaggagatcatctatgacatcaccgaacctggcggcagcgcaaaagatg

SEQ ID NO: 138630 - DNA, 103 bp, Artificial Sequence
  Synthetic Polynucleotide
taatacgactcactatagggatggggctggcaggagccagctcggtgatgaacagaggagacatcacatggctggctccaacctggcggcagcgcaaaagatg

SEQ ID NO: 138631 - DNA, 103 bp, Artificial Sequence
  Synthetic Polynucleotide
taatacgactcactataggggggggaggccatggggctggcaggagccagaacagaggagactggctatggccagccccaacctggcggcagcgcaaaagatg

SEQ ID NO: 138632 - DNA, 103 bp, Artificial Sequence
  Synthetic Polynucleotide
taatacgactcactatagggtgctcccgccgggggaggccatggggctggaacagaggagaccagccatgtggcctcccaacctggcggcagcgcaaaagatg

SEQ ID NO: 138633 - DNA, 103 bp, Artificial Sequence
  Synthetic Polynucleotide
taatacgactcactatagggctctcgtctatgctcccgccgggggaggccaacagaggagaggcctcatgcggcgggagaacctggcggcagcgcaaaagatg

SEQ ID NO: 138634 - DNA, 103 bp, Artificial Sequence
  Synthetic Polynucleotide
taatacgactcactatagggggataggggcctctcgtctatgctcccgccaacagaggagaggcgggatgatagacgagaacctggcggcagcgcaaaagatg

SEQ ID NO: 138635 - DNA, 103 bp, Artificial Sequence
  Synthetic Polynucleotide
taatacgactcactataggggggggctgctggataggggcctctcgtctaaacagaggagatagacgatgggcccctataacctggcggcagcgcaaaagatg

SEQ ID NO: 138636 - DNA, 103 bp, Artificial Sequence
  Synthetic Polynucleotide
taatacgactcactatagggacacgcaccagggggctgctggataggggcaacagaggagagcccctatgcagcagcccaacctggcggcagcgcaaaagatg

SEQ ID NO: 138637 - DNA, 103 bp, Artificial Sequence
  Synthetic Polynucleotide
taatacgactcactatagggctcctccttgacacgcaccagggggctgctaacagaggagaagcagcatgctggtgcgtaacctggcggcagcgcaaaagatg

SEQ ID NO: 138638 - DNA, 103 bp, Artificial Sequence
  Synthetic Polynucleotide
taatacgactcactatagggggctggggggctcctccttgacacgcaccaaacagaggagatggtgcatgtcaaggaggaacctggcggcagcgcaaaagatg

SEQ ID NO: 138639 - DNA, 103 bp, Artificial Sequence
  Synthetic Polynucleotide
taatacgactcactatagggcagcagatgagcgcgtcggtgtccgggtcgaacagaggagacgacccatgcaccgacgcaacctggcggcagcgcaaaagatg

SEQ ID NO: 138640 - DNA, 103 bp, Artificial Sequence
  Synthetic Polynucleotide
taatacgactcactatagggctctgaggcgggctggggggctcctccttgaacagaggagacaaggaatggccccccagaacctggcggcagcgcaaaagatg

SEQ ID NO: 138641 - DNA, 103 bp, Artificial Sequence
  Synthetic Polynucleotide
taatacgactcactatagggtacccgggggctctgaggcgggctggggggaacagaggagaccccccatgccgcctcagaacctggcggcagcgcaaaagatg

SEQ ID NO: 138642 - DNA, 103 bp, Artificial Sequence
  Synthetic Polynucleotide
taatacgactcactatagggtcgcctcctctacccgggggctctgaggcgaacagaggagacgcctcatggcccccgggaacctggcggcagcgcaaaagatg

SEQ ID NO: 138643 - DNA, 103 bp, Artificial Sequence
  Synthetic Polynucleotide
taatacgactcactatagggcgcccgggactcgcctcctctacccgggggaacagaggagacccccgatgagaggaggcaacctggcggcagcgcaaaagatg

SEQ ID NO: 138644 - DNA, 103 bp, Artificial Sequence
  Synthetic Polynucleotide
taatacgactcactatagggggaagatgggcgcccgggactcgcctcctcaacagaggagagaggagatgagtcccgggaacctggcggcagcgcaaaagatg

SEQ ID NO: 138645 - DNA, 103 bp, Artificial Sequence
  Synthetic Polynucleotide
taatacgactcactataggggggtgtccacggaagatgggcgcccgggacaacagaggagagtcccgatggcccatcttaacctggcggcagcgcaaaagatg

SEQ ID NO: 138646 - DNA, 103 bp, Artificial Sequence
  Synthetic Polynucleotide
taatacgactcactatagggggggacaagagggtgtccacggaagatgggaacagaggagacccatcatgcgtggacacaacctggcggcagcgcaaaagatg

SEQ ID NO: 138647 - DNA, 103 bp, Artificial Sequence
  Synthetic Polynucleotide
taatacgactcactataggggagggcggtcggggacaagagggtgtccacaacagaggagagtggacatgctcttgtccaacctggcggcagcgcaaaagatg

SEQ ID NO: 138648 - DNA, 103 bp, Artificial Sequence
  Synthetic Polynucleotide
taatacgactcactatagggtggagtcaatgagggcggtcggggacaagaaacagaggagatcttgtatgcgaccgcccaacctggcggcagcgcaaaagatg

SEQ ID NO: 138649 - DNA, 103 bp, Artificial Sequence
  Synthetic Polynucleotide
taatacgactcactatagggtcccgcaggatggagtcaatgagggcggtcaacagaggagagaccgcatgcattgactcaacctggcggcagcgcaaaagatg

SEQ ID NO: 138650 - DNA, 103 bp, Artificial Sequence
  Synthetic Polynucleotide
taatacgactcactataggggaaagccggcacgttcgaactctgcttcataacagaggagaatgaagatgagttcgaacaacctggcggcagcgcaaaagatg

SEQ ID NO: 138651 - DNA, 103 bp, Artificial Sequence
  Synthetic Polynucleotide
taatacgactcactatagggatccaagaccagaaaactttggccattctgaacagaggagacagaatatgcaaagttttaacctggcggcagcgcaaaagatg

SEQ ID NO: 138652 - DNA, 103 bp, Artificial Sequence
  Synthetic Polynucleotide
taatacgactcactatagggtggatcttctgaggtcagactggatgagccaacagaggagaggctcaatgagtctgaccaacctggcggcagcgcaaaagatg

SEQ ID NO: 138653 - DNA, 103 bp, Artificial Sequence
  Synthetic Polynucleotide
taatacgactcactatagggtcatggtcactggatcttctgaggtcagacaacagaggagagtctgaatgcagaagatcaacctggcggcagcgcaaaagatg

SEQ ID NO: 138654 - DNA, 103 bp, Artificial Sequence
  Synthetic Polynucleotide
taatacgactcactatagggatggaatccatcatggtcactggatcttctaacagaggagaagaagaatgagtgaccataacctggcggcagcgcaaaagatg

SEQ ID NO: 138655 - DNA, 103 bp, Artificial Sequence
  Synthetic Polynucleotide
taatacgactcactatagggatcattcaaaatggaatccatcatggtcacaacagaggagagtgaccatgatggattccaacctggcggcagcgcaaaagatg

SEQ ID NO: 138656 - DNA, 103 bp, Artificial Sequence
  Synthetic Polynucleotide
taatacgactcactataggggattgatgttatcattcaaaatggaatccaaacagaggagatggattatgttttgaatgaacctggcggcagcgcaaaagatg

SEQ ID NO: 138657 - DNA, 103 bp, Artificial Sequence
  Synthetic Polynucleotide
taatacgactcactatagggtttcccaaaagattgatgttatcattcaaaaacagaggagatttgaaatgtaacatcaaaacctggcggcagcgcaaaagatg

SEQ ID NO: 138658 - DNA, 103 bp, Artificial Sequence
  Synthetic Polynucleotide
taatacgactcactatagggcagctcaacctttcccaaaagattgatgttaacagaggagaaacatcatgcttttgggaaacctggcggcagcgcaaaagatg

SEQ ID NO: 138659 - DNA, 103 bp, Artificial Sequence
  Synthetic Polynucleotide
taatacgactcactataggggataatccaacagctcaacctttcccaaaaaacagaggagattttggatgaggttgagcaacctggcggcagcgcaaaagatg

SEQ ID NO: 138660 - DNA, 103 bp, Artificial Sequence
  Synthetic Polynucleotide
taatacgactcactatagggatactgtcaagataatccaacagctcaaccaacagaggagaggttgaatggttggattaaacctggcggcagcgcaaaagatg

SEQ ID NO: 138661 - DNA, 103 bp, Artificial Sequence
  Synthetic Polynucleotide
taatacgactcactatagggactgcagtcaatactgtcaagataatccaaaacagaggagattggatatgcttgacagtaacctggcggcagcgcaaaagatg

SEQ ID NO: 138662 - DNA, 103 bp, Artificial Sequence
  Synthetic Polynucleotide
taatacgactcactatagggatcgttgctcatccaagaccagaaaactttaacagaggagaaaagttatgtggtcttggaacctggcggcagcgcaaaagatg

SEQ ID NO: 138663 - DNA, 103 bp, Artificial Sequence
  Synthetic Polynucleotide
taatacgactcactatagggagtcctctaaactgcagtcaatactgtcaaaacagaggagattgacaatgttgactgcaaacctggcggcagcgcaaaagatg

SEQ ID NO: 138664 - DNA, 103 bp, Artificial Sequence
  Synthetic Polynucleotide
taatacgactcactatagggatggcctggaagtcctctaaactgcagtcaaacagaggagatgactgatgtttagaggaaacctggcggcagcgcaaaagatg

SEQ ID NO: 138665 - DNA, 103 bp, Artificial Sequence
  Synthetic Polynucleotide
taatacgactcactatagggtcctgatagcatggcctggaagtcctctaaaacagaggagattagagatgttccaggccaacctggcggcagcgcaaaagatg

SEQ ID NO: 138666 - DNA, 103 bp, Artificial Sequence
  Synthetic Polynucleotide
taatacgactcactatagggtaaattgtcttcctgatagcatggcctggaaacagaggagatccaggatgtgctatcagaacctggcggcagcgcaaaagatg

SEQ ID NO: 138667 - DNA, 103 bp, Artificial Sequence
  Synthetic Polynucleotide
taatacgactcactataggggggtctatgctaaattgtcttcctgatagcaacagaggagagctatcatgaagacaattaacctggcggcagcgcaaaagatg

SEQ ID NO: 138668 - DNA, 103 bp, Artificial Sequence
  Synthetic Polynucleotide
taatacgactcactatagggcaggagatctgggtctatgctaaattgtctaacagaggagaagacaaatgagcatagacaacctggcggcagcgcaaaagatg

SEQ ID NO: 138669 - DNA, 103 bp, Artificial Sequence
  Synthetic Polynucleotide
taatacgactcactatagggaaagatcaaccaggagatctgggtctatgcaacagaggagagcatagatgcagatctccaacctggcggcagcgcaaaagatg

SEQ ID NO: 138670 - DNA, 103 bp, Artificial Sequence
  Synthetic Polynucleotide
taatacgactcactataggggaactagtgaaaagatcaaccaggagatctaacagaggagaagatctatgggttgatctaacctggcggcagcgcaaaagatg

SEQ ID NO: 138671 - DNA, 103 bp, Artificial Sequence
  Synthetic Polynucleotide
taatacgactcactatagggcatctgcacagaactagtgaaaagatcaacaacagaggagagttgatatgttcactagtaacctggcggcagcgcaaaagatg

SEQ ID NO: 138672 - DNA, 103 bp, Artificial Sequence
  Synthetic Polynucleotide
taatacgactcactatagggctgtgggattcatctgcacagaactagtgaaacagaggagatcactaatgctgtgcagaaacctggcggcagcgcaaaagatg

SEQ ID NO: 138673 - DNA, 103 bp, Artificial Sequence
  Synthetic Polynucleotide
taatacgactcactatagggtcttttgcaaatcgttgctcatccaagaccaacagaggagaggtcttatgtgagcaacgaacctggcggcagcgcaaaagatg

SEQ ID NO: 138674 - DNA, 103 bp, Artificial Sequence
  Synthetic Polynucleotide
taatacgactcactatagggttgatgtaatctgtgggattcatctgcacaaacagaggagatgtgcaatggaatcccacaacctggcggcagcgcaaaagatg

SEQ ID NO: 138675 - DNA, 103 bp, Artificial Sequence
  Synthetic Polynucleotide
taatacgactcactatagggttttgtattattgatgtaatctgtgggattaacagaggagaaatcccatggattacatcaacctggcggcagcgcaaaagatg

SEQ ID NO: 138676 - DNA, 103 bp, Artificial Sequence
  Synthetic Polynucleotide
taatacgactcactatagggtattctcagattttgtattattgatgtaataacagaggagaattacaatgataatacaaaacctggcggcagcgcaaaagatg

SEQ ID NO: 138677 - DNA, 103 bp, Artificial Sequence
  Synthetic Polynucleotide
taatacgactcactatagggtctaatcctttattctcagattttgtattaaacagaggagataatacatgatctgagaaaacctggcggcagcgcaaaagatg

SEQ ID NO: 138678 - DNA, 103 bp, Artificial Sequence
  Synthetic Polynucleotide
taatacgactcactatagggcttggtagtttctaatcctttattctcagaaacagaggagatctgagatgaaaggattaaacctggcggcagcgcaaaagatg

SEQ ID NO: 138679 - DNA, 103 bp, Artificial Sequence
  Synthetic Polynucleotide
taatacgactcactatagggctacattgttcttggtagtttctaatccttaacagaggagaaaggatatgaaactaccaaacctggcggcagcgcaaaagatg

SEQ ID NO: 138680 - DNA, 103 bp, Artificial Sequence
  Synthetic Polynucleotide
taatacgactcactatagggactggctgaactacattgttcttggtagttaacagaggagaaactacatggaacaatgtaacctggcggcagcgcaaaagatg

SEQ ID NO: 138681 - DNA, 103 bp, Artificial Sequence
  Synthetic Polynucleotide
taatacgactcactatagggctcttccgaaactggctgaactacattgttaacagaggagaaacaatatggttcagccaaacctggcggcagcgcaaaagatg

SEQ ID NO: 138682 - DNA, 103 bp, Artificial Sequence
  Synthetic Polynucleotide
taatacgactcactatagggattttcttccctcttccgaaactggctgaaaacagaggagattcagcatgtttcggaagaacctggcggcagcgcaaaagatg

SEQ ID NO: 138683 - DNA, 103 bp, Artificial Sequence
  Synthetic Polynucleotide
taatacgactcactatagggttggatttagattttcttccctcttccgaaaacagaggagattcggaatggggaagaaaaacctggcggcagcgcaaaagatg

SEQ ID NO: 138684 - DNA, 103 bp, Artificial Sequence
  Synthetic Polynucleotide
taatacgactcactataggggggaagaatttcttttgcaaatcgttgctcaacagaggagagagcaaatgtttgcaaaaaacctggcggcagcgcaaaagatg

SEQ ID NO: 138685 - DNA, 103 bp, Artificial Sequence
  Synthetic Polynucleotide
taatacgactcactatagggcttatctggtttggatttagattttcttccaacagaggagaggaagaatgtctaaatccaacctggcggcagcgcaaaagatg

SEQ ID NO: 138686 - DNA, 103 bp, Artificial Sequence
  Synthetic Polynucleotide
taatacgactcactatagggggataagctgcttatctggtttggatttagaacagaggagactaaatatgaaccagataaacctggcggcagcgcaaaagatg

SEQ ID NO: 138687 - DNA, 103 bp, Artificial Sequence
  Synthetic Polynucleotide
taatacgactcactataggggcggtatactggataagctgcttatctggtaacagaggagaaccagaatggcagcttataacctggcggcagcgcaaaagatg

SEQ ID NO: 138688 - DNA, 103 bp, Artificial Sequence
  Synthetic Polynucleotide
taatacgactcactatagggaagtggaaaggcggtatactggataagctgaacagaggagacagcttatgcagtataccaacctggcggcagcgcaaaagatg

SEQ ID NO: 138689 - DNA, 103 bp, Artificial Sequence
  Synthetic Polynucleotide
taatacgactcactatagggggaatgcaagaagtggaaaggcggtatactaacagaggagaagtataatgcctttccacaacctggcggcagcgcaaaagatg

SEQ ID NO: 138690 - DNA, 103 bp, Artificial Sequence
  Synthetic Polynucleotide
taatacgactcactatagggttcccatcgaggaatgcaagaagtggaaagaacagaggagactttccatgtcttgcattaacctggcggcagcgcaaaagatg

SEQ ID NO: 138691 - DNA, 103 bp, Artificial Sequence
  Synthetic Polynucleotide
taatacgactcactatagggagaagcagggttcccatcgaggaatgcaagaacagaggagacttgcaatgctcgatgggaacctggcggcagcgcaaaagatg

SEQ ID NO: 138692 - DNA, 103 bp, Artificial Sequence
  Synthetic Polynucleotide
taatacgactcactataggggttcaacagaagaagcagggttcccatcgaaacagaggagatcgatgatgaccctgcttaacctggcggcagcgcaaaagatg

SEQ ID NO: 138693 - DNA, 103 bp, Artificial Sequence
  Synthetic Polynucleotide
taatacgactcactataggggtactcgcctgttcaacagaagaagcagggaacagaggagaccctgcatgttctgttgaaacctggcggcagcgcaaaagatg

SEQ ID NO: 138694 - DNA, 103 bp, Artificial Sequence
  Synthetic Polynucleotide
taatacgactcactatagggtgatgctgttgtactcgcctgttcaacagaaacagaggagatctgttatgcaggcgagtaacctggcggcagcgcaaaagatg

SEQ ID NO: 138695 - DNA, 103 bp, Artificial Sequence
  Synthetic Polynucleotide
taatacgactcactatagggtgaaatatttgggaagaatttcttttgcaaaacagaggagattgcaaatgaaattcttcaacctggcggcagcgcaaaagatg

SEQ ID NO: 138696 - DNA, 103 bp, Artificial Sequence
  Synthetic Polynucleotide
taatacgactcactatagggaaacttctgatgatgctgttgtactcgcctaacagaggagaaggcgaatgcaacagcataacctggcggcagcgcaaaagatg

SEQ ID NO: 138697 - DNA, 103 bp, Artificial Sequence
  Synthetic Polynucleotide
taatacgactcactatagggacagaggacaaaacttctgatgatgctgttaacagaggagaaacagcatgatcagaagtaacctggcggcagcgcaaaagatg

SEQ ID NO: 138698 - DNA, 103 bp, Artificial Sequence
  Synthetic Polynucleotide
taatacgactcactataggggggtttatctacagaggacaaaacttctgaaacagaggagatcagaaatgttgtcctctaacctggcggcagcgcaaaagatg

SEQ ID NO: 138699 - DNA, 103 bp, Artificial Sequence
  Synthetic Polynucleotide
taatacgactcactatagggcaacttctatgggtttatctacagaggacaaacagaggagatgtcctatgtagataaacaacctggcggcagcgcaaaagatg

SEQ ID NO: 138700 - DNA, 103 bp, Artificial Sequence
  Synthetic Polynucleotide
taatacgactcactatagggagaagctcatcaacttctatgggtttatctaacagaggagaagataaatgcatagaagtaacctggcggcagcgcaaaagatg

SEQ ID NO: 138701 - DNA, 103 bp, Artificial Sequence
  Synthetic Polynucleotide
taatacgactcactataggggctgctatccagaagctcatcaacttctataacagaggagaatagaaatggatgagcttaacctggcggcagcgcaaaagatg

SEQ ID NO: 138702 - DNA, 103 bp, Artificial Sequence
  Synthetic Polynucleotide
taatacgactcactatagggctgggtctaggctgctatccagaagctcataacagaggagaatgagcatgtggatagcaaacctggcggcagcgcaaaagatg

SEQ ID NO: 138703 - DNA, 103 bp, Artificial Sequence
  Synthetic Polynucleotide
taatacgactcactatagggtgggttggttctgggtctaggctgctatccaacagaggagaggatagatgcctagacccaacctggcggcagcgcaaaagatg

SEQ ID NO: 138704 - DNA, 103 bp, Artificial Sequence
  Synthetic Polynucleotide
taatacgactcactatagggaagcttactttgggttggttctgggtctagaacagaggagactagacatggaaccaaccaacctggcggcagcgcaaaagatg

SEQ ID NO: 138705 - DNA, 103 bp, Artificial Sequence
  Synthetic Polynucleotide
taatacgactcactatagggccaggcgaacaagcttactttgggttggttaacagaggagaaaccaaatgaaagtaagcaacctggcggcagcgcaaaagatg

SEQ ID NO: 138706 - DNA, 103 bp, Artificial Sequence
  Synthetic Polynucleotide
taatacgactcactatagggttattgtgcttgaaatatttgggaagaattaacagaggagaaattctatgcaaatatttaacctggcggcagcgcaaaagatg

SEQ ID NO: 138707 - DNA, 103 bp, Artificial Sequence
  Synthetic Polynucleotide
taatacgactcactataggggtcaatggctccaggcgaacaagcttacttaacagaggagaaagtaaatgtgttcgcctaacctggcggcagcgcaaaagatg

SEQ ID NO: 138708 - DNA, 103 bp, Artificial Sequence
  Synthetic Polynucleotide
taatacgactcactatagggttcagcttcagtcaatggctccaggcgaacaacagaggagagttcgcatggagccattgaacctggcggcagcgcaaaagatg

SEQ ID NO: 138709 - DNA, 103 bp, Artificial Sequence
  Synthetic Polynucleotide
taatacgactcactatagggcttcactagcttcagcttcagtcaatggctaacagaggagaagccatatgctgaagctgaacctggcggcagcgcaaaagatg

SEQ ID NO: 138710 - DNA, 103 bp, Artificial Sequence
  Synthetic Polynucleotide
taatacgactcactatagggaacagtgtagcttcactagcttcagcttcaaacagaggagatgaagcatgagctagtgaaacctggcggcagcgcaaaagatg

SEQ ID NO: 138711 - DNA, 103 bp, Artificial Sequence
  Synthetic Polynucleotide
taatacgactcactatagggacataaataaaacagtgtagcttcactagcaacagaggagagctagtatggctacactgaacctggcggcagcgcaaaagatg

SEQ ID NO: 138712 - DNA, 103 bp, Artificial Sequence
  Synthetic Polynucleotide
taatacgactcactataggggagcaagttcacataaataaaacagtgtagaacagaggagactacacatgtttatttataacctggcggcagcgcaaaagatg

SEQ ID NO: 138713 - DNA, 103 bp, Artificial Sequence
  Synthetic Polynucleotide
taatacgactcactatagggagaggtgcaggagcaagttcacataaataaaacagaggagattatttatgtgaacttgcaacctggcggcagcgcaaaagatg

SEQ ID NO: 138714 - DNA, 103 bp, Artificial Sequence
  Synthetic Polynucleotide
taatacgactcactatagggatcactatccagaggtgcaggagcaagttcaacagaggagagaacttatgcctgcacctaacctggcggcagcgcaaaagatg

SEQ ID NO: 138715 - DNA, 103 bp, Artificial Sequence
  Synthetic Polynucleotide
taatacgactcactatagggaaagtggcatatcactatccagaggtgcagaacagaggagactgcacatgtggatagtgaacctggcggcagcgcaaaagatg

SEQ ID NO: 138716 - DNA, 103 bp, Artificial Sequence
  Synthetic Polynucleotide
taatacgactcactatagggtagctatctaaaagtggcatatcactatccaacagaggagaggatagatgtatgccactaacctggcggcagcgcaaaagatg

SEQ ID NO: 138717 - DNA, 103 bp, Artificial Sequence
  Synthetic Polynucleotide
taatacgactcactataggggcttgccatattattgtgcttgaaatatttaacagaggagaaaatatatgaagcacaataacctggcggcagcgcaaaagatg

SEQ ID NO: 138718 - DNA, 103 bp, Artificial Sequence
  Synthetic Polynucleotide
taatacgactcactataggggcctcacaaagcttgccatattattgtgctaacagaggagaagcacaatgatatggcaaaacctggcggcagcgcaaaagatg

SEQ ID NO: 138719 - DNA, 103 bp, Artificial Sequence
  Synthetic Polynucleotide
taatacgactcactatagggatattcagttgcctcacaaagcttgccataaacagaggagatatggcatgctttgtgagaacctggcggcagcgcaaaagatg

SEQ ID NO: 138720 - DNA, 103 bp, Artificial Sequence
  Synthetic Polynucleotide
taatacgactcactataggggaaaccatacatattcagttgcctcacaaaaacagaggagatttgtgatgcaactgaataacctggcggcagcgcaaaagatg

SEQ ID NO: 138721 - DNA, 103 bp, Artificial Sequence
  Synthetic Polynucleotide
taatacgactcactataggggcttgctgaggaaagccggcacgttcgaacaacagaggagagttcgaatgtgccggcttaacctggcggcagcgcaaaagatg

SEQ ID NO: 138722 - DNA, 103 bp, Artificial Sequence
  Synthetic Polynucleotide
taatacgactcactatagggctactttacggaaaccatacatattcagttaacagaggagaaactgaatgtgtatggttaacctggcggcagcgcaaaagatg

SEQ ID NO: 138723 - DNA, 103 bp, Artificial Sequence
  Synthetic Polynucleotide
taatacgactcactatagggtcgatatgtactactttacggaaaccatacaacagaggagagtatggatgccgtaaagtaacctggcggcagcgcaaaagatg

SEQ ID NO: 138724 - DNA, 103 bp, Artificial Sequence
  Synthetic Polynucleotide
taatacgactcactatagggaattccagagtcgatatgtactactttacgaacagaggagacgtaaaatggtacatatcaacctggcggcagcgcaaaagatg

SEQ ID NO: 138725 - DNA, 103 bp, Artificial Sequence
  Synthetic Polynucleotide
taatacgactcactatagggcttgctttacaattccagagtcgatatgtaaacagaggagatacataatgactctggaaaacctggcggcagcgcaaaagatg

SEQ ID NO: 138726 - DNA, 103 bp, Artificial Sequence
  Synthetic Polynucleotide
taatacgactcactatagggccatctctttcttgctttacaattccagagaacagaggagactctggatgtgtaaagcaaacctggcggcagcgcaaaagatg

SEQ ID NO: 138727 - DNA, 103 bp, Artificial Sequence
  Synthetic Polynucleotide
taatacgactcactatagggttctacaggaccatctctttcttgctttacaacagaggagagtaaagatggaaagagataacctggcggcagcgcaaaagatg

SEQ ID NO: 138728 - DNA, 103 bp, Artificial Sequence
  Synthetic Polynucleotide
taatacgactcactataggggatgctgaaattctacaggaccatctctttaacagaggagaaaagagatggtcctgtagaacctggcggcagcgcaaaagatg

SEQ ID NO: 138729 - DNA, 103 bp, Artificial Sequence
  Synthetic Polynucleotide
taatacgactcactatagggttgaagtaaggatgctgaaattctacaggaaacagaggagatcctgtatgatttcagcaaacctggcggcagcgcaaaagatg

SEQ ID NO: 138730 - DNA, 103 bp, Artificial Sequence
  Synthetic Polynucleotide
taatacgactcactatagggctgtccttgtttgaagtaaggatgctgaaaaacagaggagatttcagatgccttacttcaacctggcggcagcgcaaaagatg

SEQ ID NO: 138731 - DNA, 103 bp, Artificial Sequence
  Synthetic Polynucleotide
taatacgactcactatagggacaagtcatcctgtccttgtttgaagtaagaacagaggagacttactatgaacaaggacaacctggcggcagcgcaaaagatg

SEQ ID NO: 138732 - DNA, 103 bp, Artificial Sequence
  Synthetic Polynucleotide
taatacgactcactatagggagcgtccacagcttgctgaggaaagccggcaacagaggagagccggcatgcctcagcaaaacctggcggcagcgcaaaagatg

SEQ ID NO: 138733 - DNA, 103 bp, Artificial Sequence
  Synthetic Polynucleotide
taatacgactcactatagggatgttctccaacaagtcatcctgtccttgtaacagaggagaacaaggatgggatgacttaacctggcggcagcgcaaaagatg

SEQ ID NO: 138734 - DNA, 103 bp, Artificial Sequence
  Synthetic Polynucleotide
taatacgactcactatagggcttccttttaatgttctccaacaagtcatcaacagaggagagatgacatgttggagaacaacctggcggcagcgcaaaagatg

SEQ ID NO: 138735 - DNA, 103 bp, Artificial Sequence
  Synthetic Polynucleotide
taatacgactcactatagggaagatgaaaccttccttttaatgttctccaaacagaggagatggagaatgttaaaaggaaacctggcggcagcgcaaaagatg

SEQ ID NO: 138736 - DNA, 103 bp, Artificial Sequence
  Synthetic Polynucleotide
taatacgactcactatagggtctggttttgaagatgaaaccttccttttaaacagaggagataaaagatgggtttcatcaacctggcggcagcgcaaaagatg

SEQ ID NO: 138737 - DNA, 103 bp, Artificial Sequence
  Synthetic Polynucleotide
taatacgactcactatagggtttattttcttctggttttgaagatgaaacaacagaggagagtttcaatgtcaaaaccaaacctggcggcagcgcaaaagatg

SEQ ID NO: 138738 - DNA, 103 bp, Artificial Sequence
  Synthetic Polynucleotide
taatacgactcactatagggcctgacgaattttattttcttctggttttgaacagaggagacaaaacatgaagaaaataaacctggcggcagcgcaaaagatg

SEQ ID NO: 138739 - DNA, 103 bp, Artificial Sequence
  Synthetic Polynucleotide
taatacgactcactataggggttaaatcttcctgacgaattttattttctaacagaggagaagaaaaatgaattcgtcaaacctggcggcagcgcaaaagatg

SEQ ID NO: 138740 - DNA, 103 bp, Artificial Sequence
  Synthetic Polynucleotide
taatacgactcactatagggtataatttttgttaaatcttcctgacgaataacagaggagaattcgtatggaagatttaaacctggcggcagcgcaaaagatg

SEQ ID NO: 138741 - DNA, 103 bp, Artificial Sequence
  Synthetic Polynucleotide
taatacgactcactataggggagcactacttataatttttgttaaatcttaacagaggagaaagattatgcaaaaattaaacctggcggcagcgcaaaagatg

SEQ ID NO: 138742 - DNA, 103 bp, Artificial Sequence
  Synthetic Polynucleotide
taatacgactcactatagggtgaaccttctgagcactacttataatttttaacagaggagaaaaaatatgaagtagtgcaacctggcggcagcgcaaaagatg

SEQ ID NO: 138743 - DNA, 103 bp, Artificial Sequence
  Synthetic Polynucleotide
taatacgactcactatagggttcctccacaagcgtccacagcttgctgagaacagaggagactcagcatgctgtggacgaacctggcggcagcgcaaaagatg

SEQ ID NO: 138744 - DNA, 103 bp, Artificial Sequence
  Synthetic Polynucleotide
taatacgactcactatagggctgttttatctgaaccttctgagcactactaacagaggagaagtagtatgcagaaggttaacctggcggcagcgcaaaagatg

SEQ ID NO: 138745 - DNA, 103 bp, Artificial Sequence
  Synthetic Polynucleotide
taatacgactcactatagggcaatagtttcctgttttatctgaaccttctaacagaggagaagaaggatgagataaaacaacctggcggcagcgcaaaagatg

SEQ ID NO: 138746 - DNA, 103 bp, Artificial Sequence
  Synthetic Polynucleotide
taatacgactcactatagggagcctggactcaatagtttcctgttttatcaacagaggagagataaaatgggaaactataacctggcggcagcgcaaaagatg

SEQ ID NO: 138747 - DNA, 103 bp, Artificial Sequence
  Synthetic Polynucleotide
taatacgactcactatagggtaattcagaaagcctggactcaatagtttcaacagaggagagaaactatggagtccaggaacctggcggcagcgcaaaagatg

SEQ ID NO: 138748 - DNA, 103 bp, Artificial Sequence
  Synthetic Polynucleotide
taatacgactcactatagggtctcactttttaattcagaaagcctggactaacagaggagaagtccaatgtttctgaataacctggcggcagcgcaaaagatg

SEQ ID NO: 138749 - DNA, 103 bp, Artificial Sequence
  Synthetic Polynucleotide
taatacgactcactatagggagggactcattctcactttttaattcagaaaacagaggagattctgaatgaaaaagtgaaacctggcggcagcgcaaaagatg

SEQ ID NO: 138750 - DNA, 103 bp, Artificial Sequence
  Synthetic Polynucleotide
taatacgactcactatagggctccttccaaagggactcattctcacttttaacagaggagaaaaagtatgaatgagtccaacctggcggcagcgcaaaagatg

SEQ ID NO: 138751 - DNA, 103 bp, Artificial Sequence
  Synthetic Polynucleotide
taatacgactcactatagggattctgacacctccttccaaagggactcataacagaggagaatgagtatgtttggaaggaacctggcggcagcgcaaaagatg

SEQ ID NO: 138752 - DNA, 103 bp, Artificial Sequence
  Synthetic Polynucleotide
taatacgactcactatagggtttgctcgtaattctgacacctccttccaaaacagaggagattggaaatgggtgtcagaaacctggcggcagcgcaaaagatg

SEQ ID NO: 138753 - DNA, 103 bp, Artificial Sequence
  Synthetic Polynucleotide
taatacgactcactatagggttgtgcatgctttgctcgtaattctgacacaacagaggagagtgtcaatgttacgagcaaacctggcggcagcgcaaaagatg

SEQ ID NO: 138754 - DNA, 103 bp, Artificial Sequence
  Synthetic Polynucleotide
taatacgactcactatagggtagtgtgggtttcctccacaagcgtccacaaacagaggagatgtggaatgttgtggaggaacctggcggcagcgcaaaagatg

SEQ ID NO: 138755 - DNA, 103 bp, Artificial Sequence
  Synthetic Polynucleotide
taatacgactcactatagggcttgttgctgttgtgcatgctttgctcgtaaacagaggagatacgagatgagcatgcacaacctggcggcagcgcaaaagatg

SEQ ID NO: 138756 - DNA, 103 bp, Artificial Sequence
  Synthetic Polynucleotide
taatacgactcactatagggtttcgaataacttgttgctgttgtgcatgcaacagaggagagcatgcatgacagcaacaaacctggcggcagcgcaaaagatg

SEQ ID NO: 138757 - DNA, 103 bp, Artificial Sequence
  Synthetic Polynucleotide
taatacgactcactatagggctggacaatctttcgaataacttgttgctgaacagaggagacagcaaatggttattcgaaacctggcggcagcgcaaaagatg

SEQ ID NO: 138758 - DNA, 103 bp, Artificial Sequence
  Synthetic Polynucleotide
taatacgactcactatagggtaacaataaactggacaatctttcgaataaaacagaggagattattcatgagattgtccaacctggcggcagcgcaaaagatg

SEQ ID NO: 138759 - DNA, 103 bp, Artificial Sequence
  Synthetic Polynucleotide
taatacgactcactatagggtgaaccaatgtaacaataaactggacaatcaacagaggagagattgtatggtttattgtaacctggcggcagcgcaaaagatg

SEQ ID NO: 138760 - DNA, 103 bp, Artificial Sequence
  Synthetic Polynucleotide
taatacgactcactatagggttggttattttgaaccaatgtaacaataaaaacagaggagatttattatgacattggttaacctggcggcagcgcaaaagatg

SEQ ID NO: 138761 - DNA, 103 bp, Artificial Sequence
  Synthetic Polynucleotide
taatacgactcactatagggaactcacaagttggttattttgaaccaatgaacagaggagacattggatgaaaataaccaacctggcggcagcgcaaaagatg

SEQ ID NO: 138762 - DNA, 103 bp, Artificial Sequence
  Synthetic Polynucleotide
taatacgactcactatagggttacgttttaaactcacaagttggttatttaacagaggagaaaataaatgacttgtgagaacctggcggcagcgcaaaagatg

SEQ ID NO: 138763 - DNA, 103 bp, Artificial Sequence
  Synthetic Polynucleotide
taatacgactcactatagggtagaggccttttacgttttaaactcacaagaacagaggagacttgtgatgttaaaacgtaacctggcggcagcgcaaaagatg

SEQ ID NO: 138764 - DNA, 103 bp, Artificial Sequence
  Synthetic Polynucleotide
taatacgactcactatagggtgtttagaagtagaggccttttacgttttaaacagaggagataaaacatgaaaggcctcaacctggcggcagcgcaaaagatg

SEQ ID NO: 138765 - DNA, 103 bp, Artificial Sequence
  Synthetic Polynucleotide
taatacgactcactatagggatgaactcgttagtgtgggtttcctccacaaacagaggagatgtggaatgaacccacacaacctggcggcagcgcaaaagatg

SEQ ID NO: 138766 - DNA, 103 bp, Artificial Sequence
  Synthetic Polynucleotide
taatacgactcactataggggctccattagtgtttagaagtagaggccttaacagaggagaaaggccatgacttctaaaaacctggcggcagcgcaaaagatg

SEQ ID NO: 138767 - DNA, 103 bp, Artificial Sequence
  Synthetic Polynucleotide
taatacgactcactatagggcttcttttgggctccattagtgtttagaagaacagaggagacttctaatgactaatggaaacctggcggcagcgcaaaagatg

SEQ ID NO: 138768 - DNA, 103 bp, Artificial Sequence
  Synthetic Polynucleotide
taatacgactcactataggggaaacaggttcttcttttgggctccattagaacagaggagactaatgatgcccaaaagaaacctggcggcagcgcaaaagatg

SEQ ID NO: 138769 - DNA, 103 bp, Artificial Sequence
  Synthetic Polynucleotide
taatacgactcactatagggactatgtgctgaaacaggttcttcttttggaacagaggagaccaaaaatggaacctgttaacctggcggcagcgcaaaagatg

SEQ ID NO: 138770 - DNA, 103 bp, Artificial Sequence
  Synthetic Polynucleotide
taatacgactcactatagggtggttctttgactatgtgctgaaacaggttaacagaggagaaacctgatgcagcacataaacctggcggcagcgcaaaagatg

SEQ ID NO: 138771 - DNA, 103 bp, Artificial Sequence
  Synthetic Polynucleotide
taatacgactcactataggggattatcagttggttctttgactatgtgctaacagaggagaagcacaatgtcaaagaacaacctggcggcagcgcaaaagatg

SEQ ID NO: 138772 - DNA, 103 bp, Artificial Sequence
  Synthetic Polynucleotide
taatacgactcactatagggttatgatgatgattatcagttggttctttgaacagaggagacaaagaatgaactgataaaacctggcggcagcgcaaaagatg

SEQ ID NO: 138773 - DNA, 103 bp, Artificial Sequence
  Synthetic Polynucleotide
taatacgactcactataggggtgtggaactttatgatgatgattatcagtaacagaggagaactgatatgcatcatcataacctggcggcagcgcaaaagatg

SEQ ID NO: 138774 - DNA, 103 bp, Artificial Sequence
  Synthetic Polynucleotide
taatacgactcactatagggcagtcctactgtgtggaactttatgatgataacagaggagaatcatcatgaagttccacaacctggcggcagcgcaaaagatg

SEQ ID NO: 138775 - DNA, 103 bp, Artificial Sequence
  Synthetic Polynucleotide
taatacgactcactatagggtttaaaccttcagtcctactgtgtggaactaacagaggagaagttccatgcagtaggacaacctggcggcagcgcaaaagatg

SEQ ID NO: 138776 - DNA, 103 bp, Artificial Sequence
  Synthetic Polynucleotide
taatacgactcactataggggctccaggtgatgaactcgttagtgtgggtaacagaggagaacccacatgaacgagttcaacctggcggcagcgcaaaagatg

SEQ ID NO: 138777 - DNA, 103 bp, Artificial Sequence
  Synthetic Polynucleotide
taatacgactcactatagggctcccttggctttaaaccttcagtcctactaacagaggagaagtaggatggaaggtttaaacctggcggcagcgcaaaagatg

SEQ ID NO: 138778 - DNA, 103 bp, Artificial Sequence
  Synthetic Polynucleotide
taatacgactcactatagggctgaaatcctctcccttggctttaaaccttaacagaggagaaaggttatgagccaagggaacctggcggcagcgcaaaagatg

SEQ ID NO: 138779 - DNA, 103 bp, Artificial Sequence
  Synthetic Polynucleotide
taatacgactcactatagggatgatgtcatctgaaatcctctcccttggcaacagaggagagccaagatggaggatttcaacctggcggcagcgcaaaagatg

SEQ ID NO: 138780 - DNA, 103 bp, Artificial Sequence
  Synthetic Polynucleotide
taatacgactcactatagggatcataaataatgatgtcatctgaaatcctaacagaggagaaggattatggatgacatcaacctggcggcagcgcaaaagatg

SEQ ID NO: 138781 - DNA, 103 bp, Artificial Sequence
  Synthetic Polynucleotide
taatacgactcactatagggcatcagtaacatcataaataatgatgtcataacagaggagaatgacaatgttatttatgaacctggcggcagcgcaaaagatg

SEQ ID NO: 138782 - DNA, 103 bp, Artificial Sequence
  Synthetic Polynucleotide
taatacgactcactatagggtctgcattatcatcagtaacatcataaataaacagaggagatatttaatgtgttactgaaacctggcggcagcgcaaaagatg

SEQ ID NO: 138783 - DNA, 103 bp, Artificial Sequence
  Synthetic Polynucleotide
taatacgactcactatagggattttcttcatctgcattatcatcagtaacaacagaggagagttactatggataatgcaaacctggcggcagcgcaaaagatg

SEQ ID NO: 138784 - DNA, 103 bp, Artificial Sequence
  Synthetic Polynucleotide
taatacgactcactatagggtaactgggatattttcttcatctgcattataacagaggagaataatgatgatgaagaaaaacctggcggcagcgcaaaagatg

SEQ ID NO: 138785 - DNA, 103 bp, Artificial Sequence
  Synthetic Polynucleotide
taatacgactcactataggggtttctggaataactgggatattttcttcaaacagaggagatgaagaatgtatcccagtaacctggcggcagcgcaaaagatg

SEQ ID NO: 138786 - DNA, 103 bp, Artificial Sequence
  Synthetic Polynucleotide
taatacgactcactatagggatcctcattagtttctggaataactgggataacagaggagaatcccaatgattccagaaaacctggcggcagcgcaaaagatg

SEQ ID NO: 138787 - DNA, 103 bp, Artificial Sequence
  Synthetic Polynucleotide
taatacgactcactatagggggccattctggctccaggtgatgaactcgtaacagaggagaacgagtatgtcacctggaaacctggcggcagcgcaaaagatg

SEQ ID NO: 138788 - DNA, 103 bp, Artificial Sequence
  Synthetic Polynucleotide
taatacgactcactatagggcagatataacatcctcattagtttctggaaaacagaggagattccagatgctaatgaggaacctggcggcagcgcaaaagatg

SEQ ID NO: 138789 - DNA, 103 bp, Artificial Sequence
  Synthetic Polynucleotide
taatacgactcactatagggttggagggatcagatataacatcctcattaaacagaggagataatgaatgtgttatatcaacctggcggcagcgcaaaagatg

SEQ ID NO: 138790 - DNA, 103 bp, Artificial Sequence
  Synthetic Polynucleotide
taatacgactcactatagggctggctacagttggagggatcagatataacaacagaggagagttataatggatccctccaacctggcggcagcgcaaaagatg

SEQ ID NO: 138791 - DNA, 103 bp, Artificial Sequence
  Synthetic Polynucleotide
taatacgactcactatagggtatcagggtactggctacagttggagggataacagaggagaatccctatgactgtagccaacctggcggcagcgcaaaagatg

SEQ ID NO: 138792 - DNA, 103 bp, Artificial Sequence
  Synthetic Polynucleotide
taatacgactcactatagggacgatgacaatatcagggtactggctacagaacagaggagactgtagatggtaccctgaaacctggcggcagcgcaaaagatg

SEQ ID NO: 138793 - DNA, 103 bp, Artificial Sequence
  Synthetic Polynucleotide
taatacgactcactataggggtcatcttcaacgatgacaatatcagggtaaacagaggagataccctatgattgtcatcaacctggcggcagcgcaaaagatg

SEQ ID NO: 138794 - DNA, 103 bp, Artificial Sequence
  Synthetic Polynucleotide
taatacgactcactatagggcatcttcattgtcatcttcaacgatgacaaaacagaggagattgtcaatgttgaagatgaacctggcggcagcgcaaaagatg

SEQ ID NO: 138795 - DNA, 103 bp, Artificial Sequence
  Synthetic Polynucleotide
taatacgactcactatagggggtgcatactcatcttcattgtcatcttcaaacagaggagatgaagaatgcaatgaagaaacctggcggcagcgcaaaagatg

SEQ ID NO: 138796 - DNA, 103 bp, Artificial Sequence
  Synthetic Polynucleotide
taatacgactcactatagggctgaatgacaggtgcatactcatcttcattaacagaggagaaatgaaatggagtatgcaaacctggcggcagcgcaaaagatg

SEQ ID NO: 138797 - DNA, 103 bp, Artificial Sequence
  Synthetic Polynucleotide
taatacgactcactataggggctctccactctgaatgacaggtgcatactaacagaggagaagtatgatgctgtcattcaacctggcggcagcgcaaaagatg

SEQ ID NO: 138798 - DNA, 103 bp, Artificial Sequence
  Synthetic Polynucleotide
taatacgactcactatagggagaaaactttggccattctggctccaggtgaacagaggagacacctgatgccagaatggaacctggcggcagcgcaaaagatg

SEQ ID NO: 138799 - DNA, 103 bp, Artificial Sequence
  Synthetic Polynucleotide
taatacgactcactatagggggttcattctgctctccactctgaatgacaaacagaggagatgtcatatggagtggagaaacctggcggcagcgcaaaagatg

SEQ ID NO: 138800 - DNA, 103 bp, Artificial Sequence
  Synthetic Polynucleotide
taatacgactcactatagggttctctggctggttcattctgctctccactaacagaggagaagtggaatgcagaatgaaaacctggcggcagcgcaaaagatg

SEQ ID NO: 138801 - DNA, 103 bp, Artificial Sequence
  Synthetic Polynucleotide
taatacgactcactatagggaacttagggattctctggctggttcattctaacagaggagaagaatgatgcagccagagaacctggcggcagcgcaaaagatg

SEQ ID NO: 138802 - DNA, 103 bp, Artificial Sequence
  Synthetic Polynucleotide
taatacgactcactatagggtcactgcctgaacttagggattctctggctaacagaggagaagccagatgatccctaagaacctggcggcagcgcaaaagatg

SEQ ID NO: 138803 - DNA, 103 bp, Artificial Sequence
  Synthetic Polynucleotide
taatacgactcactataggggctgctgccatcactgcctgaacttagggaaacagaggagatccctaatgtcaggcagtaacctggcggcagcgcaaaagatg

SEQ ID NO: 138804 - DNA, 103 bp, Artificial Sequence
  Synthetic Polynucleotide
taatacgactcactatagggacatgagagggctgctgccatcactgcctgaacagaggagacaggcaatgatggcagcaaacctggcggcagcgcaaaagatg

SEQ ID NO: 138805 - DNA, 103 bp, Artificial Sequence
  Synthetic Polynucleotide
taatacgactcactatagggacagcactagacatgagagggctgctgccaaacagaggagatggcagatgccctctcataacctggcggcagcgcaaaagatg

SEQ ID NO: 138806 - DNA, 103 bp, Artificial Sequence
  Synthetic Polynucleotide
taatacgactcactatagggatttagctggacagcactagacatgagaggaacagaggagacctctcatgtctagtgctaacctggcggcagcgcaaaagatg

SEQ ID NO: 138807 - DNA, 103 bp, Artificial Sequence
  Synthetic Polynucleotide
taatacgactcactatagggtggatgagccatttagctggacagcactagaacagaggagactagtgatgtccagctaaaacctggcggcagcgcaaaagatg

SEQ ID NO: 138808 - DNA, 103 bp, Artificial Sequence
  Synthetic Polynucleotide
taatacgactcactataggggaggtcagactggatgagccatttagctggaacagaggagaccagctatgtggctcatcaacctggcggcagcgcaaaagatg

SEQ ID NO: 138809 - DNA, 103 bp, Artificial Sequence
  Synthetic Polynucleotide
taatacgactcactatagggcgtgggcagcgcagctggcgcttcctgcataacagaggagaatgcagatggcgccagctaacctggcggcagcgcaaaagatg

SEQ ID NO: 138810 - DNA, 103 bp, Artificial Sequence
  Synthetic Polynucleotide
taatacgactcactataggggctccagcggatcaggtggtctgtgcctggaacagaggagaccaggcatggaccacctgaacctggcggcagcgcaaaagatg

SEQ ID NO: 138811 - DNA, 103 bp, Artificial Sequence
  Synthetic Polynucleotide
taatacgactcactataggggtccccgctttccaggcccagaggccccctaacagaggagaagggggatgctgggcctgaacctggcggcagcgcaaaagatg

SEQ ID NO: 138812 - DNA, 103 bp, Artificial Sequence
  Synthetic Polynucleotide
taatacgactcactatagggctgggctcctgtccccgctttccaggcccaaacagaggagatgggccatgaaagcggggaacctggcggcagcgcaaaagatg

SEQ ID NO: 138813 - DNA, 103 bp, Artificial Sequence
  Synthetic Polynucleotide
taatacgactcactatagggagcagactctctgggctcctgtccccgcttaacagaggagaaagcggatgcaggagcccaacctggcggcagcgcaaaagatg

SEQ ID NO: 138814 - DNA, 103 bp, Artificial Sequence
  Synthetic Polynucleotide
taatacgactcactatagggcatcggaggcagcagactctctgggctcctaacagaggagaaggagcatggagagtctgaacctggcggcagcgcaaaagatg

SEQ ID NO: 138815 - DNA, 103 bp, Artificial Sequence
  Synthetic Polynucleotide
taatacgactcactataggggctgaagcagcatcggaggcagcagactctaacagaggagaagagtcatgtgcctccgaaacctggcggcagcgcaaaagatg

SEQ ID NO: 138816 - DNA, 103 bp, Artificial Sequence
  Synthetic Polynucleotide
taatacgactcactatagggtcttgagggggctgaagcagcatcggaggcaacagaggagagcctccatggctgcttcaaacctggcggcagcgcaaaagatg

SEQ ID NO: 138817 - DNA, 103 bp, Artificial Sequence
  Synthetic Polynucleotide
taatacgactcactatagggttccacactttcttgagggggctgaagcagaacagaggagactgcttatgccccctcaaaacctggcggcagcgcaaaagatg

SEQ ID NO: 138818 - DNA, 103 bp, Artificial Sequence
  Synthetic Polynucleotide
taatacgactcactataggggccctgcaggttccacactttcttgaggggaacagaggagacccctcatgaaagtgtggaacctggcggcagcgcaaaagatg

SEQ ID NO: 138819 - DNA, 103 bp, Artificial Sequence
  Synthetic Polynucleotide
taatacgactcactatagggacatctagaggccctgcaggttccacacttaacagaggagaaagtgtatgacctgcaggaacctggcggcagcgcaaaagatg

SEQ ID NO: 138820 - DNA, 103 bp, Artificial Sequence
  Synthetic Polynucleotide
taatacgactcactatagggggggcccagcacatctagaggccctgcaggaacagaggagacctgcaatgcctctagataacctggcggcagcgcaaaagatg

SEQ ID NO: 138821 - DNA, 103 bp, Artificial Sequence
  Synthetic Polynucleotide
taatacgactcactatagggtcccgctcgggctccagcggatcaggtggtaacagaggagaaccaccatgtccgctggaaacctggcggcagcgcaaaagatg

SEQ ID NO: 138822 - DNA, 103 bp, Artificial Sequence
  Synthetic Polynucleotide
taatacgactcactatagggcttggagactggggcccagcacatctagagaacagaggagactctagatgtgctgggccaacctggcggcagcgcaaaagatg

SEQ ID NO: 138823 - DNA, 103 bp, Artificial Sequence
  Synthetic Polynucleotide
taatacgactcactatagggcattctcgcccttggagactggggcccagcaacagaggagagctgggatgcagtctccaaacctggcggcagcgcaaaagatg

SEQ ID NO: 138824 - DNA, 103 bp, Artificial Sequence
  Synthetic Polynucleotide
taatacgactcactatagggcatcagggtccattctcgcccttggagactaacagaggagaagtctcatggggcgagaaaacctggcggcagcgcaaaagatg

SEQ ID NO: 138825 - DNA, 103 bp, Artificial Sequence
  Synthetic Polynucleotide
taatacgactcactatagggtgtccaagtccatcagggtccattctcgccaacagaggagaggcgagatgggaccctgaaacctggcggcagcgcaaaagatg

SEQ ID NO: 138826 - DNA, 103 bp, Artificial Sequence
  Synthetic Polynucleotide
taatacgactcactataggggacagctccatgtccaagtccatcagggtcaacagaggagagaccctatgggacttggaaacctggcggcagcgcaaaagatg

SEQ ID NO: 138827 - DNA, 103 bp, Artificial Sequence
  Synthetic Polynucleotide
taatacgactcactatagggctgcatcaaggacagctccatgtccaagtcaacagaggagagacttgatgatggagctgaacctggcggcagcgcaaaagatg

SEQ ID NO: 138828 - DNA, 103 bp, Artificial Sequence
  Synthetic Polynucleotide
taatacgactcactataggggaaccaagggctgcatcaaggacagctccaaacagaggagatggagcatgccttgatgcaacctggcggcagcgcaaaagatg

SEQ ID NO: 138829 - DNA, 103 bp, Artificial Sequence
  Synthetic Polynucleotide
taatacgactcactatagggccccgctctggaaccaagggctgcatcaagaacagaggagacttgatatggcccttggtaacctggcggcagcgcaaaagatg

SEQ ID NO: 138830 - DNA, 103 bp, Artificial Sequence
  Synthetic Polynucleotide
taatacgactcactatagggctcaggctcaccccgctctggaaccaagggaacagaggagacccttgatgccagagcggaacctggcggcagcgcaaaagatg

SEQ ID NO: 138831 - DNA, 103 bp, Artificial Sequence
  Synthetic Polynucleotide
taatacgactcactatagggtgaccgccagctcaggctcaccccgctctgaacagaggagacagagcatggtgagcctgaacctggcggcagcgcaaaagatg

SEQ ID NO: 138832 - DNA, 103 bp, Artificial Sequence
  Synthetic Polynucleotide
taatacgactcactatagggaggaaactggtcccgctcgggctccagcggaacagaggagaccgctgatgcccgagcggaacctggcggcagcgcaaaagatg

SEQ ID NO: 138833 - DNA, 103 bp, Artificial Sequence
  Synthetic Polynucleotide
taatacgactcactatagggtttaaccccttgaccgccagctcaggctcaaacagaggagatgagccatggctggcggtaacctggcggcagcgcaaaagatg

SEQ ID NO: 138834 - DNA, 103 bp, Artificial Sequence
  Synthetic Polynucleotide
taatacgactcactataggggcttggagaatttaaccccttgaccgccagaacagaggagactggcgatgaaggggttaaacctggcggcagcgcaaaagatg

SEQ ID NO: 138835 - DNA, 103 bp, Artificial Sequence
  Synthetic Polynucleotide
taatacgactcactatagggccttccctgggcttggagaatttaacccctaacagaggagaaggggtatgattctccaaaacctggcggcagcgcaaaagatg

SEQ ID NO: 138836 - DNA, 103 bp, Artificial Sequence
  Synthetic Polynucleotide
taatacgactcactatagggagcgtggggtccttccctgggcttggagaaaacagaggagattctccatgcccagggaaaacctggcggcagcgcaaaagatg

SEQ ID NO: 138837 - DNA, 103 bp, Artificial Sequence
  Synthetic Polynucleotide
taatacgactcactatagggtggggccccgagcgtggggtccttccctggaacagaggagaccagggatggaccccacgaacctggcggcagcgcaaaagatg

SEQ ID NO: 138838 - DNA, 103 bp, Artificial Sequence
  Synthetic Polynucleotide
taatacgactcactatagggccagcaggagtggggccccgagcgtggggtaacagaggagaaccccaatgtcggggcccaacctggcggcagcgcaaaagatg

SEQ ID NO: 138839 - DNA, 103 bp, Artificial Sequence
  Synthetic Polynucleotide
taatacgactcactataggggcctggacatccagcaggagtggggccccgaacagaggagacggggcatgactcctgctaacctggcggcagcgcaaaagatg

SEQ ID NO: 138840 - DNA, 103 bp, Artificial Sequence
  Synthetic Polynucleotide
taatacgactcactatagggtcccaaggccgcctggacatccagcaggagaacagaggagactcctgatggatgtccagaacctggcggcagcgcaaaagatg

SEQ ID NO: 138841 - DNA, 103 bp, Artificial Sequence
  Synthetic Polynucleotide
taatacgactcactataggggggctgggcctcccaaggccgcctggacataacagaggagaatgtccatgcggccttggaacctggcggcagcgcaaaagatg

SEQ ID NO: 138842 - DNA, 103 bp, Artificial Sequence
  Synthetic Polynucleotide
taatacgactcactatagggggcaggcccagggctgggcctcccaaggccaacagaggagaggccttatgaggcccagcaacctggcggcagcgcaaaagatg

SEQ ID NO: 138843 - DNA, 103 bp, Artificial Sequence
  Synthetic Polynucleotide
taatacgactcactataggggtcgcttacgaggaaactggtcccgctcggaacagaggagaccgagcatgaccagtttcaacctggcggcagcgcaaaagatg

SEQ ID NO: 138844 - DNA, 103 bp, Artificial Sequence
  Synthetic Polynucleotide
taatacgactcactatagggtaaagccccaggcaggcccagggctgggccaacagaggagaggcccaatgctgggcctgaacctggcggcagcgcaaaagatg

SEQ ID NO: 138845 - DNA, 103 bp, Artificial Sequence
  Synthetic Polynucleotide
taatacgactcactatagggtataaatggttaaagccccaggcaggcccaaacagaggagatgggccatgctggggcttaacctggcggcagcgcaaaagatg

SEQ ID NO: 138846 - DNA, 103 bp, Artificial Sequence
  Synthetic Polynucleotide
taatacgactcactatagggtcaggagtgctataaatggttaaagccccaaacagaggagatggggcatgaaccatttaaacctggcggcagcgcaaaagatg

SEQ ID NO: 138847 - DNA, 103 bp, Artificial Sequence
  Synthetic Polynucleotide
taatacgactcactatagggagtccggctctcaggagtgctataaatggtaacagaggagaaccattatgagcactcctaacctggcggcagcgcaaaagatg

SEQ ID NO: 138848 - DNA, 103 bp, Artificial Sequence
  Synthetic Polynucleotide
taatacgactcactatagggagtaggaggcagtccggctctcaggagtgcaacagaggagagcactcatgagagccggaaacctggcggcagcgcaaaagatg

SEQ ID NO: 138849 - DNA, 103 bp, Artificial Sequence
  Synthetic Polynucleotide
taatacgactcactatagggtccgggcccaagtaggaggcagtccggctcaacagaggagagagccgatgtgcctcctaaacctggcggcagcgcaaaagatg

SEQ ID NO: 138850 - DNA, 103 bp, Artificial Sequence
  Synthetic Polynucleotide
taatacgactcactataggggggactggcttccgggcccaagtaggaggcaacagaggagagcctccatgttgggcccgaacctggcggcagcgcaaaagatg

SEQ ID NO: 138851 - DNA, 103 bp, Artificial Sequence
  Synthetic Polynucleotide
taatacgactcactatagggaacggctctggtcgcttacgaggaaactggaacagaggagaccagttatgtcgtaagcgaacctggcggcagcgcaaaagatg

SEQ ID NO: 138852 - DNA, 103 bp, Artificial Sequence
  Synthetic Polynucleotide
taatacgactcactatagggtccttggcgaaacggctctggtcgcttacgaacagaggagacgtaagatgccagagccgaacctggcggcagcgcaaaagatg

SEQ ID NO: 138853 - DNA, 103 bp, Artificial Sequence
  Synthetic Polynucleotide
taatacgactcactataggggggcagcacttccttggcgaaacggctctgaacagaggagacagagcatgttcgccaagaacctggcggcagcgcaaaagatg

SEQ ID NO: 138854 - DNA, 103 bp, Artificial Sequence
  Synthetic Polynucleotide
taatacgactcactatagggtgaaatactggggcagcacttccttggcgaaacagaggagatcgccaatgaagtgctgcaacctggcggcagcgcaaaagatg

SEQ ID NO: 138855 - DNA, 103 bp, Artificial Sequence
  Synthetic Polynucleotide
taatacgactcactatagggttgctatgcttgaaatactggggcagcactaacagaggagaagtgctatgccagtatttaacctggcggcagcgcaaaagatg

SEQ ID NO: 138856 - DNA, 103 bp, Artificial Sequence
  Synthetic Polynucleotide
taatacgactcactataggggctcgccatgttgctatgcttgaaatactgaacagaggagacagtatatgaagcatagcaacctggcggcagcgcaaaagatg

SEQ ID NO: 138857 - DNA, 103 bp, Artificial Sequence
  Synthetic Polynucleotide
taatacgactcactatagggggcctggctccgtgggcagcgcagctggcgaacagaggagacgccagatgcgctgcccaaacctggcggcagcgcaaaagatg

SEQ ID NO: 138858 - DNA, 103 bp, Artificial Sequence
  Synthetic Polynucleotide
taatacgactcactatagggggcgcacgaagctcgccatgttgctatgctaacagaggagaagcataatgacatggcgaaacctggcggcagcgcaaaagatg

SEQ ID NO: 138859 - DNA, 103 bp, Artificial Sequence
  Synthetic Polynucleotide
taatacgactcactatagggatgttgagttggcgcacgaagctcgccatgaacagaggagacatggcatgcttcgtgcgaacctggcggcagcgcaaaagatg

SEQ ID NO: 138860 - DNA, 103 bp, Artificial Sequence
  Synthetic Polynucleotide
taatacgactcactatagggaaaaccgtacatgttgagttggcgcacgaaaacagaggagattcgtgatgcaactcaacaacctggcggcagcgcaaaagatg

SEQ ID NO: 138861 - DNA, 103 bp, Artificial Sequence
  Synthetic Polynucleotide
taatacgactcactatagggccaccttccgaaaaccgtacatgttgagttaacagaggagaaactcaatgtgtacggttaacctggcggcagcgcaaaagatg

SEQ ID NO: 138862 - DNA, 103 bp, Artificial Sequence
  Synthetic Polynucleotide
taatacgactcactatagggtcgatgctcaccaccttccgaaaaccgtacaacagaggagagtacggatgtcggaaggtaacctggcggcagcgcaaaagatg

SEQ ID NO: 138863 - DNA, 103 bp, Artificial Sequence
  Synthetic Polynucleotide
taatacgactcactataggggccgccctgctcgatgctcaccaccttccgaacagaggagacggaagatggtgagcatcaacctggcggcagcgcaaaagatg

SEQ ID NO: 138864 - DNA, 103 bp, Artificial Sequence
  Synthetic Polynucleotide
taatacgactcactataggggcctaagcaggccgccctgctcgatgctcaaacagaggagatgagcaatgagcagggcgaacctggcggcagcgcaaaagatg

SEQ ID NO: 138865 - DNA, 103 bp, Artificial Sequence
  Synthetic Polynucleotide
taatacgactcactatagggtcgcgctccggcctaagcaggccgccctgcaacagaggagagcagggatgcctgcttagaacctggcggcagcgcaaaagatg

SEQ ID NO: 138866 - DNA, 103 bp, Artificial Sequence
  Synthetic Polynucleotide
taatacgactcactatagggctcgacgtggtcgcgctccggcctaagcagaacagaggagactgcttatgccggagcgcaacctggcggcagcgcaaaagatg

SEQ ID NO: 138867 - DNA, 103 bp, Artificial Sequence
  Synthetic Polynucleotide
taatacgactcactatagggggtgctggaactcgacgtggtcgcgctccgaacagaggagacggagcatgaccacgtcgaacctggcggcagcgcaaaagatg

SEQ ID NO: 138868 - DNA, 103 bp, Artificial Sequence
  Synthetic Polynucleotide
taatacgactcactatagggacggggctggggcctggctccgtgggcagcaacagaggagagctgccatgggagccaggaacctggcggcagcgcaaaagatg

SEQ ID NO: 138869 - DNA, 103 bp, Artificial Sequence
  Synthetic Polynucleotide
taatacgactcactatagggacgaagctcgggtgctggaactcgacgtggaacagaggagaccacgtatggttccagcaaacctggcggcagcgcaaaagatg

SEQ ID NO: 138870 - DNA, 103 bp, Artificial Sequence
  Synthetic Polynucleotide
taatacgactcactataggggcggccgcgcacgaagctcgggtgctggaaaacagaggagattccagatgccgagcttcaacctggcggcagcgcaaaagatg

SEQ ID NO: 138871 - DNA, 103 bp, Artificial Sequence
  Synthetic Polynucleotide
taatacgactcactataggggtagctgctcgcggccgcgcacgaagctcgaacagaggagacgagctatgtgcgcggccaacctggcggcagcgcaaaagatg

SEQ ID NO: 138872 - DNA, 103 bp, Artificial Sequence
  Synthetic Polynucleotide
taatacgactcactatagggacgcgctccagtagctgctcgcggccgcgcaacagaggagagcgcggatgcgagcagctaacctggcggcagcgcaaaagatg

SEQ ID NO: 138873 - DNA, 103 bp, Artificial Sequence
  Synthetic Polynucleotide
taatacgactcactatagggcttgcgccgcacgcgctccagtagctgctcaacagaggagagagcagatgctggagcgcaacctggcggcagcgcaaaagatg

SEQ ID NO: 138874 - DNA, 103 bp, Artificial Sequence
  Synthetic Polynucleotide
taatacgactcactataggggcgcgggcaccttgcgccgcacgcgctccaaacagaggagatggagcatgtgcggcgcaaacctggcggcagcgcaaaagatg

SEQ ID NO: 138875 - DNA, 103 bp, Artificial Sequence
  Synthetic Polynucleotide
taatacgactcactatagggtcgccgcgcagcgcgggcaccttgcgccgcaacagaggagagcggcgatgggtgcccgcaacctggcggcagcgcaaaagatg

SEQ ID NO: 138876 - DNA, 103 bp, Artificial Sequence
  Synthetic Polynucleotide
taatacgactcactataggggcggccgtcgtcgccgcgcagcgcgggcacaacagaggagagtgcccatgctgcgcggcaacctggcggcagcgcaaaagatg

SEQ ID NO: 138877 - DNA, 103 bp, Artificial Sequence
  Synthetic Polynucleotide
taatacgactcactatagggccgggcgccagcggccgtcgtcgccgcgcaaacagaggagatgcgcgatgacgacggccaacctggcggcagcgcaaaagatg

SEQ ID NO: 138878 - DNA, 103 bp, Artificial Sequence
  Synthetic Polynucleotide
taatacgactcactatagggcccaggtcctccgggcgccagcggccgtcgaacagaggagacgacggatgctggcgcccaacctggcggcagcgcaaaagatg

SEQ ID NO: 138879 - DNA, 103 bp, Artificial Sequence
  Synthetic Polynucleotide
taatacgactcactataggggaaggcaggcacggggctggggcctggctcaacagaggagagagccaatgcccagccccaacctggcggcagcgcaaaagatg

SEQ ID NO: 138880 - DNA, 103 bp, Artificial Sequence
  Synthetic Polynucleotide
taatacgactcactatagggcagtagtcgacccaggtcctccgggcgccaaacagaggagatggcgcatggaggacctgaacctggcggcagcgcaaaagatg

SEQ ID NO: 138881 - DNA, 103 bp, Artificial Sequence
  Synthetic Polynucleotide
taatacgactcactataggggcacctcgcccagtagtcgacccaggtcctaacagaggagaaggaccatggtcgactacaacctggcggcagcgcaaaagatg

SEQ ID NO: 138882 - DNA, 103 bp, Artificial Sequence
  Synthetic Polynucleotide
taatacgactcactatagggcgcaaagcctgcacctcgcccagtagtcgaaacagaggagatcgactatggggcgaggtaacctggcggcagcgcaaaagatg

SEQ ID NO: 138883 - DNA, 103 bp, Artificial Sequence
  Synthetic Polynucleotide
taatacgactcactatagggctgcactccccgcaaagcctgcacctcgccaacagaggagaggcgagatgcaggctttgaacctggcggcagcgcaaaagatg

SEQ ID NO: 138884 - DNA, 103 bp, Artificial Sequence
  Synthetic Polynucleotide
taatacgactcactatagggcggtgctctcctgcactccccgcaaagcctaacagaggagaaggcttatgggggagtgcaacctggcggcagcgcaaaagatg

SEQ ID NO: 138885 - DNA, 103 bp, Artificial Sequence
  Synthetic Polynucleotide
taatacgactcactatagggagccgcgcctcggtgctctcctgcactcccaacagaggagagggagtatgggagagcacaacctggcggcagcgcaaaagatg

SEQ ID NO: 138886 - DNA, 103 bp, Artificial Sequence
  Synthetic Polynucleotide
taatacgactcactataggggagctcccgcagccgcgcctcggtgctctcaacagaggagagagagcatggaggcgcggaacctggcggcagcgcaaaagatg

SEQ ID NO: 138887 - DNA, 103 bp, Artificial Sequence
  Synthetic Polynucleotide
taatacgactcactatagggtctgctgcctgagctcccgcagccgcgcctaacagaggagaaggcgcatgtgcgggagcaacctggcggcagcgcaaaagatg

SEQ ID NO: 138888 - DNA, 103 bp, Artificial Sequence
  Synthetic Polynucleotide
taatacgactcactatagggaagatctcgttctgctgcctgagctcccgcaacagaggagagcgggaatgcaggcagcaaacctggcggcagcgcaaaagatg

SEQ ID NO: 138889 - DNA, 103 bp, Artificial Sequence
  Synthetic Polynucleotide
taatacgactcactatagggctcccgccacaagatctcgttctgctgcctaacagaggagaaggcagatgaacgagatcaacctggcggcagcgcaaaagatg

SEQ ID NO: 138890 - DNA, 103 bp, Artificial Sequence
  Synthetic Polynucleotide
taatacgactcactataggggcttgccgaggaaggcaggcacggggctggaacagaggagaccagccatgtgcctgcctaacctggcggcagcgcaaaagatg

SEQ ID NO: 138891 - DNA, 103 bp, Artificial Sequence
  Synthetic Polynucleotide
taatacgactcactataggggtgtcaccacctcccgccacaagatctcgtaacagaggagaacgagaatgtgtggcgggaacctggcggcagcgcaaaagatg

SEQ ID NO: 138892 - DNA, 103 bp, Artificial Sequence
  Synthetic Polynucleotide
taatacgactcactatagggctctgccgaagtgtcaccacctcccgccacaacagaggagagtggcgatgggtggtgacaacctggcggcagcgcaaaagatg

SEQ ID NO: 138893 - DNA, 103 bp, Artificial Sequence
  Synthetic Polynucleotide
taatacgactcactatagggctgaccgtggctctgccgaagtgtcaccacaacagaggagagtggtgatgcttcggcagaacctggcggcagcgcaaaagatg

SEQ ID NO: 138894 - DNA, 103 bp, Artificial Sequence
  Synthetic Polynucleotide
taatacgactcactatagggcccggtgctgctgaccgtggctctgccgaaaacagaggagattcggcatggccacggtcaacctggcggcagcgcaaaagatg

SEQ ID NO: 138895 - DNA, 103 bp, Artificial Sequence
  Synthetic Polynucleotide
taatacgactcactatagggttgccaatgacccggtgctgctgaccgtggaacagaggagaccacggatggcagcaccgaacctggcggcagcgcaaaagatg

SEQ ID NO: 138896 - DNA, 103 bp, Artificial Sequence
  Synthetic Polynucleotide
taatacgactcactatagggctggatcagcttgccaatgacccggtgctgaacagaggagacagcacatggtcattggcaacctggcggcagcgcaaaagatg

SEQ ID NO: 138897 - DNA, 103 bp, Artificial Sequence
  Synthetic Polynucleotide
taatacgactcactatagggcaaagagacactggatcagcttgccaatgaaacagaggagatcattgatgagctgatccaacctggcggcagcgcaaaagatg

SEQ ID NO: 138898 - DNA, 103 bp, Artificial Sequence
  Synthetic Polynucleotide
taatacgactcactatagggtgaagtggcccaaagagacactggatcagcaacagaggagagctgatatggtgtctcttaacctggcggcagcgcaaaagatg

SEQ ID NO: 138899 - DNA, 103 bp, Artificial Sequence
  Synthetic Polynucleotide
taatacgactcactatagggcggccccgcctgaagtggcccaaagagacaaacagaggagatgtctcatggggccacttaacctggcggcagcgcaaaagatg

SEQ ID NO: 138900 - DNA, 103 bp, Artificial Sequence
  Synthetic Polynucleotide
taatacgactcactatagggctgcattgctcggccccgcctgaagtggccaacagaggagaggccacatgaggcggggcaacctggcggcagcgcaaaagatg

SEQ ID NO: 138901 - DNA, 103 bp, Artificial Sequence
  Synthetic Polynucleotide
taatacgactcactatagggagcgcccatagcttgccgaggaaggcaggcaacagaggagagcctgcatgcctcggcaaaacctggcggcagcgcaaaagatg

SEQ ID NO: 138902 - DNA, 103 bp, Artificial Sequence
  Synthetic Polynucleotide
taatacgactcactatagggctcttgcctcctgcattgctcggccccgccaacagaggagaggcgggatggagcaatgcaacctggcggcagcgcaaaagatg

SEQ ID NO: 138903 - DNA, 103 bp, Artificial Sequence
  Synthetic Polynucleotide
taatacgactcactatagggggacagctttctcttgcctcctgcattgctaacagaggagaagcaatatgggaggcaagaacctggcggcagcgcaaaagatg

SEQ ID NO: 138904 - DNA, 103 bp, Artificial Sequence
  Synthetic Polynucleotide
taatacgactcactatagggccagcatcagggacagctttctcttgcctcaacagaggagagaggcaatggaaagctgtaacctggcggcagcgcaaaagatg

SEQ ID NO: 138905 - DNA, 103 bp, Artificial Sequence
  Synthetic Polynucleotide
taatacgactcactatagggctcccctcatccagcatcagggacagctttaacagaggagaaaagctatgcctgatgctaacctggcggcagcgcaaaagatg

SEQ ID NO: 138906 - DNA, 103 bp, Artificial Sequence
  Synthetic Polynucleotide
taatacgactcactatagggtgggcatgagctcccctcatccagcatcagaacagaggagactgatgatggatgaggggaacctggcggcagcgcaaaagatg

SEQ ID NO: 138907 - DNA, 103 bp, Artificial Sequence
  Synthetic Polynucleotide
taatacgactcactatagggtggcaggtgttgggcatgagctcccctcataacagaggagaatgaggatggctcatgccaacctggcggcagcgcaaaagatg

SEQ ID NO: 138908 - DNA, 103 bp, Artificial Sequence
  Synthetic Polynucleotide
taatacgactcactataggggtgttgaacttggcaggtgttgggcatgagaacagaggagactcatgatgaacacctgcaacctggcggcagcgcaaaagatg

SEQ ID NO: 138909 - DNA, 103 bp, Artificial Sequence
  Synthetic Polynucleotide
taatacgactcactatagggtagagggcaggtgttgaacttggcaggtgtaacagaggagaacacctatgaagttcaacaacctggcggcagcgcaaaagatg

SEQ ID NO: 138910 - DNA, 103 bp, Artificial Sequence
  Synthetic Polynucleotide
taatacgactcactataggggggcaccaggtagagggcaggtgttgaactaacagaggagaagttcaatgcctgccctcaacctggcggcagcgcaaaagatg

SEQ ID NO: 138911 - DNA, 103 bp, Artificial Sequence
  Synthetic Polynucleotide
taatacgactcactatagggtcctgcagaagggcaccaggtagagggcagaacagaggagactgcccatgacctggtgcaacctggcggcagcgcaaaagatg

SEQ ID NO: 138912 - DNA, 103 bp, Artificial Sequence
  Synthetic Polynucleotide
taatacgactcactataggggtcccccaccagcgcccatagcttgccgagaacagaggagactcggcatgctatgggcgaacctggcggcagcgcaaaagatg

SEQ ID NO: 138913 - DNA, 103 bp, Artificial Sequence
  Synthetic Polynucleotide
taatacgactcactataggggaagtaggggtcctgcagaagggcaccaggaacagaggagacctggtatgcttctgcagaacctggcggcagcgcaaaagatg

SEQ ID NO: 138914 - DNA, 103 bp, Artificial Sequence
  Synthetic Polynucleotide
taatacgactcactataggggcgactggatgaagtaggggtcctgcagaaaacagaggagattctgcatgacccctactaacctggcggcagcgcaaaagatg

SEQ ID NO: 138915 - DNA, 103 bp, Artificial Sequence
  Synthetic Polynucleotide
taatacgactcactatagggtaagtagaaggcgactggatgaagtaggggaacagaggagacccctaatgcatccagtcaacctggcggcagcgcaaaagatg

SEQ ID NO: 138916 - DNA, 103 bp, Artificial Sequence
  Synthetic Polynucleotide
taatacgactcactatagggggagaggctgtaagtagaaggcgactggataacagaggagaatccagatgccttctactaacctggcggcagcgcaaaagatg

SEQ ID NO: 138917 - DNA, 103 bp, Artificial Sequence
  Synthetic Polynucleotide
taatacgactcactatagggtttgtctctgggagaggctgtaagtagaagaacagaggagacttctaatgacagcctctaacctggcggcagcgcaaaagatg

SEQ ID NO: 138918 - DNA, 103 bp, Artificial Sequence
  Synthetic Polynucleotide
taatacgactcactatagggaaggcccaaatttgtctctgggagaggctgaacagaggagacagcctatgccagagacaaacctggcggcagcgcaaaagatg

SEQ ID NO: 138919 - DNA, 103 bp, Artificial Sequence
  Synthetic Polynucleotide
taatacgactcactatagggtgtgagggctaaggcccaaatttgtctctgaacagaggagacagagaatgatttgggccaacctggcggcagcgcaaaagatg

SEQ ID NO: 138920 - DNA, 103 bp, Artificial Sequence
  Synthetic Polynucleotide
taatacgactcactatagggcccctggccctgtgagggctaaggcccaaaaacagaggagatttgggatgtagccctcaaacctggcggcagcgcaaaagatg

SEQ ID NO: 138921 - DNA, 103 bp, Artificial Sequence
  Synthetic Polynucleotide
taatacgactcactataggggatgatggggcccctggccctgtgagggctaacagaggagaagccctatgagggccaggaacctggcggcagcgcaaaagatg

SEQ ID NO: 138922 - DNA, 103 bp, Artificial Sequence
  Synthetic Polynucleotide
taatacgactcactatagggggatgtcagagatgatggggcccctggcccaacagaggagagggccaatggccccatcaaacctggcggcagcgcaaaagatg

SEQ ID NO: 138923 - DNA, 103 bp, Artificial Sequence
  Synthetic Polynucleotide
taatacgactcactatagggctgtgcctgggtcccccaccagcgcccataaacagaggagatatgggatgtggtgggggaacctggcggcagcgcaaaagatg

SEQ ID NO: 138924 - DNA, 103 bp, Artificial Sequence
  Synthetic Polynucleotide
taatacgactcactataggggagtcttctgggatgtcagagatgatggggaacagaggagaccccatatgctctgacataacctggcggcagcgcaaaagatg

SEQ ID NO: 138925 - DNA, 103 bp, Artificial Sequence
  Synthetic Polynucleotide
taatacgactcactatagggaggggatggagagtcttctgggatgtcagaaacagaggagatctgacatgccagaagacaacctggcggcagcgcaaaagatg

SEQ ID NO: 138926 - DNA, 103 bp, Artificial Sequence
  Synthetic Polynucleotide
taatacgactcactatagggtggtcccctcaggggatggagagtcttctgaacagaggagacagaagatgctccatcccaacctggcggcagcgcaaaagatg

SEQ ID NO: 138927 - DNA, 103 bp, Artificial Sequence
  Synthetic Polynucleotide
taatacgactcactatagggggagaaagcctggtcccctcaggggatggaaacagaggagatccatcatgtgaggggacaacctggcggcagcgcaaaagatg

SEQ ID NO: 138928 - DNA, 103 bp, Artificial Sequence
  Synthetic Polynucleotide
taatacgactcactatagggatcactggagggagaaagcctggtcccctcaacagaggagagaggggatgaggctttctaacctggcggcagcgcaaaagatg

SEQ ID NO: 138929 - DNA, 103 bp, Artificial Sequence
  Synthetic Polynucleotide
taatacgactcactatagggggctcctgccatcactggagggagaaagccaacagaggagaggctttatgcctccagtgaacctggcggcagcgcaaaagatg

SEQ ID NO: 138930 - DNA, 103 bp, Artificial Sequence
  Synthetic Polynucleotide
taatacgactcactataggggtggcgggggggctcctgccatcactggagaacagaggagactccagatgtggcaggagaacctggcggcagcgcaaaagatg

SEQ ID NO: 138931 - DNA, 103 bp, Artificial Sequence
  Synthetic Polynucleotide
taatacgactcactataggggccacaggcagtggcgggggggctcctgccaacagaggagaggcaggatgccccccgccaacctggcggcagcgcaaaagatg

SEQ ID NO: 138932 - DNA, 103 bp, Artificial Sequence
  Synthetic Polynucleotide
taatacgactcactatagggctgcaccacagccacaggcagtggcgggggaacagaggagacccccgatgctgcctgtgaacctggcggcagcgcaaaagatg

SEQ ID NO: 138933 - DNA, 103 bp, Artificial Sequence
  Synthetic Polynucleotide
taatacgactcactatagggccaggatggcctgcaccacagccacaggcaaacagaggagatgcctgatgctgtggtgcaacctggcggcagcgcaaaagatg

SEQ ID NO: 138934 - DNA, 103 bp, Artificial Sequence
  Synthetic Polynucleotide
taatacgactcactatagggatcaggtggtctgtgcctgggtcccccaccaacagaggagaggtgggatgcccaggcacaacctggcggcagcgcaaaagatg

SEQ ID NO: 138935 - DNA, 103 bp, Artificial Sequence
  Synthetic Polynucleotide
taatacgactcactatagggcctttcccttccaggatggcctgcaccacaaacagaggagatgtggtatgggccatcctaacctggcggcagcgcaaaagatg

SEQ ID NO: 138936 - DNA, 103 bp, Artificial Sequence
  Synthetic Polynucleotide
taatacgactcactataggggctgaagctccctttcccttccaggatggcaacagaggagagccatcatggaagggaaaaacctggcggcagcgcaaaagatg

SEQ ID NO: 138937 - DNA, 103 bp, Artificial Sequence
  Synthetic Polynucleotide
taatacgactcactataggggcccctcggggctgaagctccctttcccttaacagaggagaaagggaatgggagcttcaaacctggcggcagcgcaaaagatg

SEQ ID NO: 138938 - DNA, 103 bp, Artificial Sequence
  Synthetic Polynucleotide
taatacgactcactataggggcattcctgggcccctcggggctgaagctcaacagaggagagagcttatgccccgagggaacctggcggcagcgcaaaagatg

SEQ ID NO: 138939 - DNA, 103 bp, Artificial Sequence
  Synthetic Polynucleotide
taatacgactcactatagggaggctgttgggcattcctgggcccctcgggaacagaggagacccgagatgcccaggaataacctggcggcagcgcaaaagatg

SEQ ID NO: 138940 - DNA, 103 bp, Artificial Sequence
  Synthetic Polynucleotide
taatacgactcactatagggcccctggttcaggctgttgggcattcctggaacagaggagaccaggaatgcccaacagcaacctggcggcagcgcaaaagatg

SEQ ID NO: 138941 - DNA, 103 bp, Artificial Sequence
  Synthetic Polynucleotide
taatacgactcactatagggtccctgggatcccctggttcaggctgttggaacagaggagaccaacaatgtgaaccaggaacctggcggcagcgcaaaagatg

SEQ ID NO: 138942 - DNA, 103 bp, Artificial Sequence
  Synthetic Polynucleotide
taatacgactcactataggggtcaggtatctccctgggatcccctggttcaacagaggagagaaccaatggatcccaggaacctggcggcagcgcaaaagatg

SEQ ID NO: 138943 - DNA, 103 bp, Artificial Sequence
  Synthetic Polynucleotide
taatacgactcactataggggaggccccctgtcaggtatctccctgggataacagaggagaatcccaatgagatacctgaacctggcggcagcgcaaaagatg

SEQ ID NO: 138944 - DNA, 103 bp, Artificial Sequence
  Synthetic Polynucleotide
taatacgactcactatagggtccaggcccagaggccccctgtcaggtatcaacagaggagagataccatgcagggggccaacctggcggcagcgcaaaagatg

SEQ ID NO: 138945 - DNA, 103 bp, Artificial Sequence
  Synthetic Polynucleotide
taatacgactcactataggggttgatgggggtggagagcagcgcctccataacagaggagaatggagatgctgctctccaacctggcggcagcgcaaaagatg

SEQ ID NO: 138946 - DNA, 103 bp, Artificial Sequence
  Synthetic Polynucleotide
taatacgactcactatagggaagcagcccctcgccgcggccgtcccagcgaacagaggagacgctggatgggccgcggcaacctggcggcagcgcaaaagatg

SEQ ID NO: 138947 - DNA, 103 bp, Artificial Sequence
  Synthetic Polynucleotide
taatacgactcactatagggctggaagtagttgcagtgtgcataggaagaaacagaggagatcttccatggcacactgcaacctggcggcagcgcaaaagatg

SEQ ID NO: 138948 - DNA, 103 bp, Artificial Sequence
  Synthetic Polynucleotide
taatacgactcactatagggttgaaggattctggaagtagttgcagtgtgaacagaggagacacactatgactacttccaacctggcggcagcgcaaaagatg

SEQ ID NO: 138949 - DNA, 103 bp, Artificial Sequence
  Synthetic Polynucleotide
taatacgactcactataggggaggactgcattgaaggattctggaagtagaacagaggagactacttatggaatccttcaacctggcggcagcgcaaaagatg

SEQ ID NO: 138950 - DNA, 103 bp, Artificial Sequence
  Synthetic Polynucleotide
taatacgactcactatagggaactggataggaggactgcattgaaggattaacagaggagaaatcctatgatgcagtccaacctggcggcagcgcaaaagatg

SEQ ID NO: 138951 - DNA, 103 bp, Artificial Sequence
  Synthetic Polynucleotide
taatacgactcactataggggcaaaaattcaactggataggaggactgcaaacagaggagatgcagtatgcctatccagaacctggcggcagcgcaaaagatg

SEQ ID NO: 138952 - DNA, 103 bp, Artificial Sequence
  Synthetic Polynucleotide
taatacgactcactatagggcaattggaaggcaaaaattcaactggatagaacagaggagactatccatgtgaatttttaacctggcggcagcgcaaaagatg

SEQ ID NO: 138953 - DNA, 103 bp, Artificial Sequence
  Synthetic Polynucleotide
taatacgactcactatagggactgcagggccaattggaaggcaaaaattcaacagaggagagaatttatgccttccaataacctggcggcagcgcaaaagatg

SEQ ID NO: 138954 - DNA, 103 bp, Artificial Sequence
  Synthetic Polynucleotide
taatacgactcactatagggcatcagtagtactgcagggccaattggaagaacagaggagacttccaatgggccctgcaaacctggcggcagcgcaaaagatg

SEQ ID NO: 138955 - DNA, 103 bp, Artificial Sequence
  Synthetic Polynucleotide
taatacgactcactatagggtttgtattttcatcagtagtactgcagggcaacagaggagagccctgatgtactactgaaacctggcggcagcgcaaaagatg

SEQ ID NO: 138956 - DNA, 103 bp, Artificial Sequence
  Synthetic Polynucleotide
taatacgactcactatagggtacttctgtctttgtattttcatcagtagtaacagaggagaactactatggaaaatacaaacctggcggcagcgcaaaagatg

SEQ ID NO: 138957 - DNA, 103 bp, Artificial Sequence
  Synthetic Polynucleotide
taatacgactcactataggggctgatcgataagcagcccctcgccgcggcaacagaggagagccgcgatgaggggctgcaacctggcggcagcgcaaaagatg

SEQ ID NO: 138958 - DNA, 103 bp, Artificial Sequence
  Synthetic Polynucleotide
taatacgactcactatagggcctctaggtttacttctgtctttgtattttaacagaggagaaaaataatgagacagaagaacctggcggcagcgcaaaagatg

SEQ ID NO: 138959 - DNA, 103 bp, Artificial Sequence
  Synthetic Polynucleotide
taatacgactcactatagggtgaaagacagcctctaggtttacttctgtcaacagaggagagacagaatgaaacctagaaacctggcggcagcgcaaaagatg

SEQ ID NO: 138960 - DNA, 103 bp, Artificial Sequence
  Synthetic Polynucleotide
taatacgactcactatagggatcaactatctgaaagacagcctctaggttaacagaggagaaacctaatggctgtctttaacctggcggcagcgcaaaagatg

SEQ ID NO: 138961 - DNA, 103 bp, Artificial Sequence
  Synthetic Polynucleotide
taatacgactcactatagggaatgcaactcatcaactatctgaaagacagaacagaggagactgtctatgagatagttgaacctggcggcagcgcaaaagatg

SEQ ID NO: 138962 - DNA, 103 bp, Artificial Sequence
  Synthetic Polynucleotide
taatacgactcactatagggttaggggaggaatgcaactcatcaactatcaacagaggagagatagtatgtgagttgcaaacctggcggcagcgcaaaagatg

SEQ ID NO: 138963 - DNA, 103 bp, Artificial Sequence
  Synthetic Polynucleotide
taatacgactcactatagggcatctccaatttaggggaggaatgcaactcaacagaggagagagttgatgtcctcccctaacctggcggcagcgcaaaagatg

SEQ ID NO: 138964 - DNA, 103 bp, Artificial Sequence
  Synthetic Polynucleotide
taatacgactcactatagggccacctttaccatctccaatttaggggaggaacagaggagacctcccatgaattggagaaacctggcggcagcgcaaaagatg

SEQ ID NO: 138965 - DNA, 103 bp, Artificial Sequence
  Synthetic Polynucleotide
taatacgactcactatagggtcaacaggctccacctttaccatctccaataacagaggagaattggaatgggtaaaggtaacctggcggcagcgcaaaagatg

SEQ ID NO: 138966 - DNA, 103 bp, Artificial Sequence
  Synthetic Polynucleotide
taatacgactcactataggggcactgattctcaacaggctccacctttacaacagaggagagtaaagatggagcctgttaacctggcggcagcgcaaaagatg

SEQ ID NO: 138967 - DNA, 103 bp, Artificial Sequence
  Synthetic Polynucleotide
taatacgactcactataggggagatgttgggcactgattctcaacaggctaacagaggagaagcctgatgagaatcagtaacctggcggcagcgcaaaagatg

SEQ ID NO: 138968 - DNA, 103 bp, Artificial Sequence
  Synthetic Polynucleotide
taatacgactcactatagggtcgaagagcggctgatcgataagcagccccaacagaggagaggggctatgtatcgatcaaacctggcggcagcgcaaaagatg

SEQ ID NO: 138969 - DNA, 103 bp, Artificial Sequence
  Synthetic Polynucleotide
taatacgactcactatagggctgtaagacggagatgttgggcactgattcaacagaggagagaatcaatgcccaacatcaacctggcggcagcgcaaaagatg

SEQ ID NO: 138970 - DNA, 103 bp, Artificial Sequence
  Synthetic Polynucleotide
taatacgactcactataggggtgttggcctctgtaagacggagatgttggaacagaggagaccaacaatgccgtcttacaacctggcggcagcgcaaaagatg

SEQ ID NO: 138971 - DNA, 103 bp, Artificial Sequence
  Synthetic Polynucleotide
taatacgactcactatagggtagctaaaatgtgttggcctctgtaagacgaacagaggagacgtcttatggaggccaacaacctggcggcagcgcaaaagatg

SEQ ID NO: 138972 - DNA, 103 bp, Artificial Sequence
  Synthetic Polynucleotide
taatacgactcactatagggttgttagaattagctaaaatgtgttggcctaacagaggagaaggccaatgcattttagcaacctggcggcagcgcaaaagatg

SEQ ID NO: 138973 - DNA, 103 bp, Artificial Sequence
  Synthetic Polynucleotide
taatacgactcactatagggtggattgctgttgttagaattagctaaaataacagaggagaattttaatgaattctaacaacctggcggcagcgcaaaagatg

SEQ ID NO: 138974 - DNA, 103 bp, Artificial Sequence
  Synthetic Polynucleotide
taatacgactcactatagggttgcagaacatggattgctgttgttagaataacagaggagaattctaatgacagcaatcaacctggcggcagcgcaaaagatg

SEQ ID NO: 138975 - DNA, 103 bp, Artificial Sequence
  Synthetic Polynucleotide
taatacgactcactatagggctagcctgacttgcagaacatggattgctgaacagaggagacagcaaatgatgttctgcaacctggcggcagcgcaaaagatg

SEQ ID NO: 138976 - DNA, 103 bp, Artificial Sequence
  Synthetic Polynucleotide
taatacgactcactatagggctccagctggctagcctgacttgcagaacaaacagaggagatgttctatgagtcaggctaacctggcggcagcgcaaaagatg

SEQ ID NO: 138977 - DNA, 103 bp, Artificial Sequence
  Synthetic Polynucleotide
taatacgactcactataggggagtaagtggctccagctggctagcctgacaacagaggagagtcaggatggccagctggaacctggcggcagcgcaaaagatg

SEQ ID NO: 138978 - DNA, 103 bp, Artificial Sequence
  Synthetic Polynucleotide
taatacgactcactataggggagcctacaggagtaagtggctccagctggaacagaggagaccagctatggccacttacaacctggcggcagcgcaaaagatg

SEQ ID NO: 138979 - DNA, 103 bp, Artificial Sequence
  Synthetic Polynucleotide
taatacgactcactatagggcagctcggcctcgaagagcggctgatcgataacagaggagaatcgatatgccgctcttcaacctggcggcagcgcaaaagatg

SEQ ID NO: 138980 - DNA, 103 bp, Artificial Sequence
  Synthetic Polynucleotide
taatacgactcactatagggcataatatctgagcctacaggagtaagtggaacagaggagaccacttatgcctgtaggcaacctggcggcagcgcaaaagatg

SEQ ID NO: 138981 - DNA, 103 bp, Artificial Sequence
  Synthetic Polynucleotide
taatacgactcactatagggccacaaaagacataatatctgagcctacagaacagaggagactgtagatgcagatattaaacctggcggcagcgcaaaagatg

SEQ ID NO: 138982 - DNA, 103 bp, Artificial Sequence
  Synthetic Polynucleotide
taatacgactcactatagggtctgttccaaccacaaaagacataatatctaacagaggagaagatatatggtcttttgtaacctggcggcagcgcaaaagatg

SEQ ID NO: 138983 - DNA, 103 bp, Artificial Sequence
  Synthetic Polynucleotide
taatacgactcactatagggaactgcttgttctgttccaaccacaaaagaaacagaggagatcttttatggttggaacaaacctggcggcagcgcaaaagatg

SEQ ID NO: 138984 - DNA, 103 bp, Artificial Sequence
  Synthetic Polynucleotide
taatacgactcactataggggagagcaggcaactgcttgttctgttccaaaacagaggagattggaaatgaacaagcagaacctggcggcagcgcaaaagatg

SEQ ID NO: 138985 - DNA, 103 bp, Artificial Sequence
  Synthetic Polynucleotide
taatacgactcactataggggactgtggtagagagcaggcaactgcttgtaacagaggagaacaagcatgtgcctgctcaacctggcggcagcgcaaaagatg

SEQ ID NO: 138986 - DNA, 103 bp, Artificial Sequence
  Synthetic Polynucleotide
taatacgactcactataggggtactcaggtgactgtggtagagagcaggcaacagaggagagcctgcatgctaccacagaacctggcggcagcgcaaaagatg

SEQ ID NO: 138987 - DNA, 103 bp, Artificial Sequence
  Synthetic Polynucleotide
taatacgactcactatagggtggtatagatgtactcaggtgactgtggtaaacagaggagataccacatgcacctgagtaacctggcggcagcgcaaaagatg

SEQ ID NO: 138988 - DNA, 103 bp, Artificial Sequence
  Synthetic Polynucleotide
taatacgactcactataggggctgtgtggatggtatagatgtactcaggtaacagaggagaacctgaatgcatctatacaacctggcggcagcgcaaaagatg

SEQ ID NO: 138989 - DNA, 103 bp, Artificial Sequence
  Synthetic Polynucleotide
taatacgactcactatagggaacaggctgagctgtgtggatggtatagataacagaggagaatctatatgatccacacaaacctggcggcagcgcaaaagatg

SEQ ID NO: 138990 - DNA, 103 bp, Artificial Sequence
  Synthetic Polynucleotide
taatacgactcactataggggcgggctgagcagctcggcctcgaagagcgaacagaggagacgctctatgaggccgagcaacctggcggcagcgcaaaagatg

SEQ ID NO: 138991 - DNA, 103 bp, Artificial Sequence
  Synthetic Polynucleotide
taatacgactcactatagggtgctattttcaacaggctgagctgtgtggaaacagaggagatccacaatgctcagcctgaacctggcggcagcgcaaaagatg

SEQ ID NO: 138992 - DNA, 103 bp, Artificial Sequence
  Synthetic Polynucleotide
taatacgactcactatagggtcctgtattgtgctattttcaacaggctgaaacagaggagatcagccatgtgaaaatagaacctggcggcagcgcaaaagatg

SEQ ID NO: 138993 - DNA, 103 bp, Artificial Sequence
  Synthetic Polynucleotide
taatacgactcactatagggggctgcagattcctgtattgtgctattttcaacagaggagagaaaatatgacaatacagaacctggcggcagcgcaaaagatg

SEQ ID NO: 138994 - DNA, 103 bp, Artificial Sequence
  Synthetic Polynucleotide
taatacgactcactatagggcttgctggatggctgcagattcctgtattgaacagaggagacaatacatgaatctgcagaacctggcggcagcgcaaaagatg

SEQ ID NO: 138995 - DNA, 103 bp, Artificial Sequence
  Synthetic Polynucleotide
taatacgactcactatagggttgacatgagcttgctggatggctgcagataacagaggagaatctgcatgcatccagcaaacctggcggcagcgcaaaagatg

SEQ ID NO: 138996 - DNA, 103 bp, Artificial Sequence
  Synthetic Polynucleotide
taatacgactcactatagggctccttcagtttgacatgagcttgctggataacagaggagaatccagatggctcatgtcaacctggcggcagcgcaaaagatg

SEQ ID NO: 138997 - DNA, 103 bp, Artificial Sequence
  Synthetic Polynucleotide
taatacgactcactataggggatttaggtgctccttcagtttgacatgagaacagaggagactcatgatgaactgaaggaacctggcggcagcgcaaaagatg

SEQ ID NO: 138998 - DNA, 103 bp, Artificial Sequence
  Synthetic Polynucleotide
taatacgactcactataggggatggattatgatttaggtgctccttcagtaacagaggagaactgaaatggcacctaaaaacctggcggcagcgcaaaagatg

SEQ ID NO: 138999 - DNA, 103 bp, Artificial Sequence
  Synthetic Polynucleotide
taatacgactcactatagggtgaagatggagatggattatgatttaggtgaacagaggagacacctaatgcataatccaaacctggcggcagcgcaaaagatg

SEQ ID NO: 139000 - DNA, 103 bp, Artificial Sequence
  Synthetic Polynucleotide
taatacgactcactatagggcaaatactactgaagatggagatggattataacagaggagaataatcatgctccatcttaacctggcggcagcgcaaaagatg

SEQ ID NO: 139001 - DNA, 103 bp, Artificial Sequence
  Synthetic Polynucleotide
taatacgactcactatagggcccggcccgggcgggctgagcagctcggccaacagaggagaggccgaatggctcagcccaacctggcggcagcgcaaaagatg

SEQ ID NO: 139002 - DNA, 103 bp, Artificial Sequence
  Synthetic Polynucleotide
taatacgactcactatagggccttcctgcacaaatactactgaagatggaaacagaggagatccatcatgagtagtattaacctggcggcagcgcaaaagatg

SEQ ID NO: 139003 - DNA, 103 bp, Artificial Sequence
  Synthetic Polynucleotide
taatacgactcactataggggaatggtggcccttcctgcacaaatactacaacagaggagagtagtaatggtgcaggaaaacctggcggcagcgcaaaagatg

SEQ ID NO: 139004 - DNA, 103 bp, Artificial Sequence
  Synthetic Polynucleotide
taatacgactcactatagggggtgtgtgctgaatggtggcccttcctgcaaacagaggagatgcaggatgggccaccataacctggcggcagcgcaaaagatg

SEQ ID NO: 139005 - DNA, 103 bp, Artificial Sequence
  Synthetic Polynucleotide
taatacgactcactataggggcatccacctggtgtgtgctgaatggtggcaacagaggagagccaccatgcagcacacaaacctggcggcagcgcaaaagatg

SEQ ID NO: 139006 - DNA, 103 bp, Artificial Sequence
  Synthetic Polynucleotide
taatacgactcactatagggttttatgttggcatccacctggtgtgtgctaacagaggagaagcacaatgcaggtggataacctggcggcagcgcaaaagatg

SEQ ID NO: 139007 - DNA, 103 bp, Artificial Sequence
  Synthetic Polynucleotide
taatacgactcactatagggtggtctggcattttatgttggcatccacctaacagaggagaaggtggatgccaacataaaacctggcggcagcgcaaaagatg

SEQ ID NO: 139008 - DNA, 103 bp, Artificial Sequence
  Synthetic Polynucleotide
taatacgactcactatagggtcacgtgaactggtctggcattttatgttgaacagaggagacaacatatgatgccagacaacctggcggcagcgcaaaagatg

SEQ ID NO: 139009 - DNA, 103 bp, Artificial Sequence
  Synthetic Polynucleotide
taatacgactcactatagggcaagatattctcacgtgaactggtctggcaaacagaggagatgccagatgagttcacgtaacctggcggcagcgcaaaagatg

SEQ ID NO: 139010 - DNA, 103 bp, Artificial Sequence
  Synthetic Polynucleotide
taatacgactcactataggggttctgacggcaagatattctcacgtgaacaacagaggagagttcacatgagaatatctaacctggcggcagcgcaaaagatg

SEQ ID NO: 139011 - DNA, 103 bp, Artificial Sequence
  Synthetic Polynucleotide
taatacgactcactatagggaatcccatctgttctgacggcaagatattcaacagaggagagaatatatggccgtcagaaacctggcggcagcgcaaaagatg

SEQ ID NO: 139012 - DNA, 103 bp, Artificial Sequence
  Synthetic Polynucleotide
taatacgactcactataggggccaccgccccccggcccgggcgggctgagaacagaggagactcagcatgcccgggccgaacctggcggcagcgcaaaagatg

SEQ ID NO: 139013 - DNA, 103 bp, Artificial Sequence
  Synthetic Polynucleotide
taatacgactcactatagggtgaaatgaggaatcccatctgttctgacggaacagaggagaccgtcaatgcagatgggaaacctggcggcagcgcaaaagatg

SEQ ID NO: 139014 - DNA, 103 bp, Artificial Sequence
  Synthetic Polynucleotide
taatacgactcactataggggccccatttctgaaatgaggaatcccatctaacagaggagaagatggatgtcctcatttaacctggcggcagcgcaaaagatg

SEQ ID NO: 139015 - DNA, 103 bp, Artificial Sequence
  Synthetic Polynucleotide
taatacgactcactatagggttgctagcaggccccatttctgaaatgaggaacagaggagacctcatatgagaaatgggaacctggcggcagcgcaaaagatg

SEQ ID NO: 139016 - DNA, 103 bp, Artificial Sequence
  Synthetic Polynucleotide
taatacgactcactatagggttcactaggcttgctagcaggccccatttcaacagaggagagaaatgatgcctgctagcaacctggcggcagcgcaaaagatg

SEQ ID NO: 139017 - DNA, 103 bp, Artificial Sequence
  Synthetic Polynucleotide
taatacgactcactatagggaacctgtgtcttcactaggcttgctagcagaacagaggagactgctaatgagcctagtgaacctggcggcagcgcaaaagatg

SEQ ID NO: 139018 - DNA, 103 bp, Artificial Sequence
  Synthetic Polynucleotide
taatacgactcactatagggggagtggctaaacctgtgtcttcactaggcaacagaggagagcctagatgagacacaggaacctggcggcagcgcaaaagatg

SEQ ID NO: 139019 - DNA, 103 bp, Artificial Sequence
  Synthetic Polynucleotide
taatacgactcactataggggtatctggctggagtggctaaacctgtgtcaacagaggagagacacaatgttagccactaacctggcggcagcgcaaaagatg

SEQ ID NO: 139020 - DNA, 103 bp, Artificial Sequence
  Synthetic Polynucleotide
taatacgactcactatagggtgtgctctctgtatctggctggagtggctaaacagaggagatagccaatgcagccagataacctggcggcagcgcaaaagatg

SEQ ID NO: 139021 - DNA, 103 bp, Artificial Sequence
  Synthetic Polynucleotide
taatacgactcactataggggagttgcttctgtgctctctgtatctggctaacagaggagaagccagatgcagagagcaaacctggcggcagcgcaaaagatg

SEQ ID NO: 139022 - DNA, 103 bp, Artificial Sequence
  Synthetic Polynucleotide
taatacgactcactatagggtccttgttgtgagttgcttctgtgctctctaacagaggagaagagagatgagaagcaacaacctggcggcagcgcaaaagatg

SEQ ID NO: 139023 - DNA, 103 bp, Artificial Sequence
  Synthetic Polynucleotide
taatacgactcactatagggccgcagtcccgccaccgccccccggcccggaacagaggagaccgggcatgggggcggtgaacctggcggcagcgcaaaagatg

SEQ ID NO: 139024 - DNA, 103 bp, Artificial Sequence
  Synthetic Polynucleotide
taatacgactcactatagggcaggggactttccttgttgtgagttgcttcaacagaggagagaagcaatgcacaacaagaacctggcggcagcgcaaaagatg

SEQ ID NO: 139025 - DNA, 103 bp, Artificial Sequence
  Synthetic Polynucleotide
taatacgactcactatagggagatgaagatcaggggactttccttgttgtaacagaggagaacaacaatgaaagtccccaacctggcggcagcgcaaaagatg

SEQ ID NO: 139026 - DNA, 103 bp, Artificial Sequence
  Synthetic Polynucleotide
taatacgactcactataggggtccaccagcagatgaagatcaggggacttaacagaggagaaagtccatggatcttcataacctggcggcagcgcaaaagatg

SEQ ID NO: 139027 - DNA, 103 bp, Artificial Sequence
  Synthetic Polynucleotide
taatacgactcactatagggtgcaggccacgtccaccagcagatgaagataacagaggagaatcttcatgtgctggtggaacctggcggcagcgcaaaagatg

SEQ ID NO: 139028 - DNA, 103 bp, Artificial Sequence
  Synthetic Polynucleotide
taatacgactcactatagggcgctcctgcttgcaggccacgtccaccagcaacagaggagagctggtatgcgtggcctgaacctggcggcagcgcaaaagatg

SEQ ID NO: 139029 - DNA, 103 bp, Artificial Sequence
  Synthetic Polynucleotide
taatacgactcactatagggctttggaaagcgctcctgcttgcaggccacaacagaggagagtggccatgaagcaggagaacctggcggcagcgcaaaagatg

SEQ ID NO: 139030 - DNA, 103 bp, Artificial Sequence
  Synthetic Polynucleotide
taatacgactcactatagggattcttcctcctttggaaagcgctcctgctaacagaggagaagcaggatggctttccaaaacctggcggcagcgcaaaagatg

SEQ ID NO: 139031 - DNA, 103 bp, Artificial Sequence
  Synthetic Polynucleotide
taatacgactcactatagggcactcttttaattcttcctcctttggaaagaacagaggagactttccatgggaggaagaaacctggcggcagcgcaaaagatg

SEQ ID NO: 139032 - DNA, 103 bp, Artificial Sequence
  Synthetic Polynucleotide
taatacgactcactataggggccccggcccccgcagtcccgccaccgcccaacagaggagagggcggatgcgggactgcaacctggcggcagcgcaaaagatg

SEQ ID NO: 139033 - DNA, 103 bp, Artificial Sequence
  Synthetic Polynucleotide
taatacgactcactatagggctcgggctcggccccggcccccgcagtcccaacagaggagagggactatgggggccgggaacctggcggcagcgcaaaagatg

SEQ ID NO: 139034 - DNA, 103 bp, Artificial Sequence
  Synthetic Polynucleotide
taatacgactcactatagggagttgttggggttgatgggggtggagagcaaacagaggagatgctctatgcccccatcaaacctggcggcagcgcaaaagatg

SEQ ID NO: 139035 - DNA, 103 bp, Artificial Sequence
  Synthetic Polynucleotide
taatacgactcactatagggttttgaagagctcgggctcggccccggcccaacagaggagagggccgatgccgagcccgaacctggcggcagcgcaaaagatg

SEQ ID NO: 139036 - DNA, 103 bp, Artificial Sequence
  Synthetic Polynucleotide
taatacgactcactatagggaagctggtggttttgaagagctcgggctcgaacagaggagacgagccatggctcttcaaaacctggcggcagcgcaaaagatg

SEQ ID NO: 139037 - DNA, 103 bp, Artificial Sequence
  Synthetic Polynucleotide
taatacgactcactataggggaagctggtgaagctggtggttttgaagagaacagaggagactcttcatgaccaccagcaacctggcggcagcgcaaaagatg

SEQ ID NO: 139038 - DNA, 103 bp, Artificial Sequence
  Synthetic Polynucleotide
taatacgactcactataggggctggcggatgaagctggtgaagctggtggaacagaggagaccaccaatgtcaccagctaacctggcggcagcgcaaaagatg

SEQ ID NO: 139039 - DNA, 103 bp, Artificial Sequence
  Synthetic Polynucleotide
taatacgactcactatagggtagaggttgagctggcggatgaagctggtgaacagaggagacaccagatgcatccgccaaacctggcggcagcgcaaaagatg

SEQ ID NO: 139040 - DNA, 103 bp, Artificial Sequence
  Synthetic Polynucleotide
taatacgactcactataggggcggaagccgtagaggttgagctggcggataacagaggagaatccgcatgctcaacctcaacctggcggcagcgcaaaagatg

SEQ ID NO: 139041 - DNA, 103 bp, Artificial Sequence
  Synthetic Polynucleotide
taatacgactcactataggggcaccaccttgcggaagccgtagaggttgaaacagaggagatcaaccatgacggcttccaacctggcggcagcgcaaaagatg

SEQ ID NO: 139042 - DNA, 103 bp, Artificial Sequence
  Synthetic Polynucleotide
taatacgactcactatagggggcccgcccagcaccaccttgcggaagccgaacagaggagacggcttatgcaaggtggtaacctggcggcagcgcaaaagatg

SEQ ID NO: 139043 - DNA, 103 bp, Artificial Sequence
  Synthetic Polynucleotide
taatacgactcactataggggccgccccccggcccgcccagcaccaccttaacagaggagaaaggtgatgctgggcgggaacctggcggcagcgcaaaagatg

SEQ ID NO: 139044 - DNA, 103 bp, Artificial Sequence
  Synthetic Polynucleotide
taatacgactcactatagggctgccggtttgccgccccccggcccgcccaaacagaggagatgggcgatgcggggggcgaacctggcggcagcgcaaaagatg

SEQ ID NO: 139045 - DNA, 103 bp, Artificial Sequence
  Synthetic Polynucleotide
taatacgactcactatagggttggcggggaagttgttggggttgatggggaacagaggagaccccatatgccccaacaaaacctggcggcagcgcaaaagatg

SEQ ID NO: 139046 - DNA, 103 bp, Artificial Sequence
  Synthetic Polynucleotide
taatacgactcactatagggggcccattgcctgccggtttgccgccccccaacagaggagaggggggatgcaaaccggcaacctggcggcagcgcaaaagatg

SEQ ID NO: 139047 - DNA, 103 bp, Artificial Sequence
  Synthetic Polynucleotide
taatacgactcactataggggtgatggagcggcccattgcctgccggtttaacagaggagaaaaccgatgggcaatgggaacctggcggcagcgcaaaagatg

SEQ ID NO: 139048 - DNA, 103 bp, Artificial Sequence
  Synthetic Polynucleotide
taatacgactcactatagggggttgtggaagtgatggagcggcccattgcaacagaggagagcaatgatgcgctccatcaacctggcggcagcgcaaaagatg

SEQ ID NO: 139049 - DNA, 103 bp, Artificial Sequence
  Synthetic Polynucleotide
taatacgactcactatagggcggaagtgcgggttgtggaagtgatggagcaacagaggagagctccaatgcttccacaaaacctggcggcagcgcaaaagatg

SEQ ID NO: 139050 - DNA, 103 bp, Artificial Sequence
  Synthetic Polynucleotide
taatacgactcactatagggctggtcgcggcggaagtgcgggttgtggaaaacagaggagattccacatgccgcacttcaacctggcggcagcgcaaaagatg

SEQ ID NO: 139051 - DNA, 103 bp, Artificial Sequence
  Synthetic Polynucleotide
taatacgactcactataggggcagctgtggctggtcgcggcggaagtgcgaacagaggagacgcactatggccgcgaccaacctggcggcagcgcaaaagatg

SEQ ID NO: 139052 - DNA, 103 bp, Artificial Sequence
  Synthetic Polynucleotide
taatacgactcactatagggaggtgcacgagcagctgtggctggtcgcggaacagaggagaccgcgaatggccacagctaacctggcggcagcgcaaaagatg

SEQ ID NO: 139053 - DNA, 103 bp, Artificial Sequence
  Synthetic Polynucleotide
taatacgactcactataggggaggcgcttgaggtgcacgagcagctgtggaacagaggagaccacagatgctcgtgcacaacctggcggcagcgcaaaagatg

SEQ ID NO: 139054 - DNA, 103 bp, Artificial Sequence
  Synthetic Polynucleotide
taatacgactcactatagggtggcgctggtgaggcgcttgaggtgcacgaaacagaggagatcgtgcatgtcaagcgccaacctggcggcagcgcaaaagatg

SEQ ID NO: 139055 - DNA, 103 bp, Artificial Sequence
  Synthetic Polynucleotide
taatacgactcactatagggttggccttgttggcgctggtgaggcgcttgaacagaggagacaagcgatgcaccagcgcaacctggcggcagcgcaaaagatg

SEQ ID NO: 139056 - DNA, 103 bp, Artificial Sequence
  Synthetic Polynucleotide
taatacgactcactataggggcgccacagcttggcggggaagttgttgggaacagaggagacccaacatgttccccgccaacctggcggcagcgcaaaagatg

SEQ ID NO: 139057 - DNA, 103 bp, Artificial Sequence
  Synthetic Polynucleotide
taatacgactcactatagggggccgccagcttggccttgttggcgctggtaacagaggagaaccagcatgaacaaggccaacctggcggcagcgcaaaagatg

SEQ ID NO: 139058 - DNA, 103 bp, Artificial Sequence
  Synthetic Polynucleotide
taatacgactcactatagggcctccaggccggccgccagcttggccttgtaacagaggagaacaaggatgagctggcggaacctggcggcagcgcaaaagatg

SEQ ID NO: 139059 - DNA, 103 bp, Artificial Sequence
  Synthetic Polynucleotide
taatacgactcactatagggcggcagggcacctccaggccggccgccagcaacagaggagagctggcatgcggcctggaaacctggcggcagcgcaaaagatg

SEQ ID NO: 139060 - DNA, 103 bp, Artificial Sequence
  Synthetic Polynucleotide
taatacgactcactataggggttgggcgggcggcagggcacctccaggccaacagaggagaggcctgatggtgccctgcaacctggcggcagcgcaaaagatg

SEQ ID NO: 139061 - DNA, 103 bp, Artificial Sequence
  Synthetic Polynucleotide
taatacgactcactataggggctggaagcggttgggcgggcggcagggcaaacagaggagatgccctatggcccgcccaaacctggcggcagcgcaaaagatg

SEQ ID NO: 139062 - DNA, 103 bp, Artificial Sequence
  Synthetic Polynucleotide
taatacgactcactatagggatgagcagccgctggaagcggttgggcgggaacagaggagacccgccatgccgcttccaaacctggcggcagcgcaaaagatg

SEQ ID NO: 139063 - DNA, 103 bp, Artificial Sequence
  Synthetic Polynucleotide
taatacgactcactatagggggccgaggtgatgagcagccgctggaagcgaacagaggagacgcttcatgcggctgctcaacctggcggcagcgcaaaagatg

SEQ ID NO: 139064 - DNA, 103 bp, Artificial Sequence
  Synthetic Polynucleotide
taatacgactcactatagggtggcggcggaggccgaggtgatgagcagccaacagaggagaggctgcatgtcacctcggaacctggcggcagcgcaaaagatg

SEQ ID NO: 139065 - DNA, 103 bp, Artificial Sequence
  Synthetic Polynucleotide
taatacgactcactatagggagtggcgcggtggcggcggaggccgaggtgaacagaggagacacctcatgctccgccgcaacctggcggcagcgcaaaagatg

SEQ ID NO: 139066 - DNA, 103 bp, Artificial Sequence
  Synthetic Polynucleotide
taatacgactcactatagggctggtgctgcagtggcgcggtggcggcggaaacagaggagatccgccatgaccgcgccaaacctggcggcagcgcaaaagatg

SEQ ID NO: 139067 - DNA, 103 bp, Artificial Sequence
  Synthetic Polynucleotide
taatacgactcactatagggtgttcaccaggcgccacagcttggcggggaaacagaggagatccccgatgagctgtggcaacctggcggcagcgcaaaagatg

SEQ ID NO: 139068 - DNA, 103 bp, Artificial Sequence
  Synthetic Polynucleotide
taatacgactcactataggggcggcggctgctggtgctgcagtggcgcggaacagaggagaccgcgcatgtgcagcaccaacctggcggcagcgcaaaagatg

SEQ ID NO: 139069 - DNA, 103 bp, Artificial Sequence
  Synthetic Polynucleotide
taatacgactcactatagggcccgcgggcggcggcggctgctggtgctgcaacagaggagagcagcaatggcagccgccaacctggcggcagcgcaaaagatg

SEQ ID NO: 139070 - DNA, 103 bp, Artificial Sequence
  Synthetic Polynucleotide
taatacgactcactataggggggccggggccccgcgggcggcggcggctgaacagaggagacagccgatgccgcccgcgaacctggcggcagcgcaaaagatg

SEQ ID NO: 139071 - DNA, 103 bp, Artificial Sequence
  Synthetic Polynucleotide
taatacgactcactatagggcgtgcggctcgggccggggccccgcgggcgaacagaggagacgcccgatgggccccggcaacctggcggcagcgcaaaagatg

SEQ ID NO: 139072 - DNA, 103 bp, Artificial Sequence
  Synthetic Polynucleotide
taatacgactcactataggggccactggtccgtgcggctcgggccggggcaacagaggagagccccgatgcgagccgcaaacctggcggcagcgcaaaagatg

SEQ ID NO: 139073 - DNA, 103 bp, Artificial Sequence
  Synthetic Polynucleotide
taatacgactcactatagggttgtcctacagccactggtccgtgcggctcaacagaggagagagccgatgggaccagtgaacctggcggcagcgcaaaagatg

SEQ ID NO: 139074 - DNA, 103 bp, Artificial Sequence
  Synthetic Polynucleotide
taatacgactcactatagggaccggtgaaattgtcctacagccactggtcaacagaggagagaccagatgctgtaggacaacctggcggcagcgcaaaagatg

SEQ ID NO: 139075 - DNA, 103 bp, Artificial Sequence
  Synthetic Polynucleotide
taatacgactcactatagggcgacgaaatgaccggtgaaattgtcctacaaacagaggagatgtaggatgatttcaccgaacctggcggcagcgcaaaagatg

SEQ ID NO: 139076 - DNA, 103 bp, Artificial Sequence
  Synthetic Polynucleotide
taatacgactcactatagggcaaactatctcgacgaaatgaccggtgaaaaacagaggagatttcacatgtcatttcgtaacctggcggcagcgcaaaagatg

SEQ ID NO: 139077 - DNA, 103 bp, Artificial Sequence
  Synthetic Polynucleotide
taatacgactcactatagggagtaaggagacaaactatctcgacgaaatgaacagaggagacatttcatggagatagttaacctggcggcagcgcaaaagatg

SEQ ID NO: 139078 - DNA, 103 bp, Artificial Sequence
  Synthetic Polynucleotide
taatacgactcactatagggtagcgcgggctgttcaccaggcgccacagcaacagaggagagctgtgatgcctggtgaaaacctggcggcagcgcaaaagatg

SEQ ID NO: 139079 - DNA, 103 bp, Artificial Sequence
  Synthetic Polynucleotide
taatacgactcactataggggatacacaggagtaaggagacaaactatctaacagaggagaagatagatggtctccttaaacctggcggcagcgcaaaagatg

SEQ ID NO: 139080 - DNA, 103 bp, Artificial Sequence
  Synthetic Polynucleotide
taatacgactcactatagggggatggagttgatacacaggagtaaggagaaacagaggagatctcctatgtcctgtgtaaacctggcggcagcgcaaaagatg

SEQ ID NO: 139081 - DNA, 103 bp, Artificial Sequence
  Synthetic Polynucleotide
taatacgactcactatagggtgtggtcgtgggatggagttgatacacaggaacagaggagacctgtgatgcaactccataacctggcggcagcgcaaaagatg

SEQ ID NO: 139082 - DNA, 103 bp, Artificial Sequence
  Synthetic Polynucleotide
taatacgactcactataggggggtaagtactgtggtcgtgggatggagttaacagaggagaaactccatgccacgaccaaacctggcggcagcgcaaaagatg

SEQ ID NO: 139083 - DNA, 103 bp, Artificial Sequence
  Synthetic Polynucleotide
taatacgactcactatagggacctttcagagggtaagtactgtggtcgtgaacagaggagacacgacatgagtacttacaacctggcggcagcgcaaaagatg

SEQ ID NO: 139084 - DNA, 103 bp, Artificial Sequence
  Synthetic Polynucleotide
taatacgactcactatagggtccgatctaaacctttcagagggtaagtacaacagaggagagtacttatgctctgaaagaacctggcggcagcgcaaaagatg

SEQ ID NO: 139085 - DNA, 103 bp, Artificial Sequence
  Synthetic Polynucleotide
taatacgactcactatagggggaactggggtccgatctaaacctttcagaaacagaggagatctgaaatgtttagatcgaacctggcggcagcgcaaaagatg

SEQ ID NO: 139086 - DNA, 103 bp, Artificial Sequence
  Synthetic Polynucleotide
taatacgactcactatagggtattctatgaggaactggggtccgatctaaaacagaggagattagatatgaccccagttaacctggcggcagcgcaaaagatg

SEQ ID NO: 139087 - DNA, 103 bp, Artificial Sequence
  Synthetic Polynucleotide
taatacgactcactatagggagttctgccatattctatgaggaactggggaacagaggagaccccagatgctcatagaaaacctggcggcagcgcaaaagatg

SEQ ID NO: 139088 - DNA, 103 bp, Artificial Sequence
  Synthetic Polynucleotide
taatacgactcactatagggattccaagggagttctgccatattctatgaaacagaggagatcatagatgatggcagaaaacctggcggcagcgcaaaagatg

SEQ ID NO: 139089 - DNA, 103 bp, Artificial Sequence
  Synthetic Polynucleotide
taatacgactcactataggggatggagcggtagcgcgggctgttcaccagaacagaggagactggtgatgagcccgcgcaacctggcggcagcgcaaaagatg

SEQ ID NO: 139090 - DNA, 103 bp, Artificial Sequence
  Synthetic Polynucleotide
taatacgactcactatagggtccaggatgcattccaagggagttctgccaaacagaggagatggcagatgtcccttggaaacctggcggcagcgcaaaagatg

SEQ ID NO: 139091 - DNA, 103 bp, Artificial Sequence
  Synthetic Polynucleotide
taatacgactcactatagggtctccacttgtccaggatgcattccaagggaacagaggagacccttgatgtgcatcctgaacctggcggcagcgcaaaagatg

SEQ ID NO: 139092 - DNA, 103 bp, Artificial Sequence
  Synthetic Polynucleotide
taatacgactcactataggggtgggagatgtctccacttgtccaggatgcaacagaggagagcatccatgacaagtggaaacctggcggcagcgcaaaagatg

SEQ ID NO: 139093 - DNA, 103 bp, Artificial Sequence
  Synthetic Polynucleotide
taatacgactcactatagggatctgaaaatgtgggagatgtctccacttgaacagaggagacaagtgatgacatctcccaacctggcggcagcgcaaaagatg

SEQ ID NO: 139094 - DNA, 103 bp, Artificial Sequence
  Synthetic Polynucleotide
taatacgactcactataggggaacccctttatctgaaaatgtgggagatgaacagaggagacatctcatgcattttcagaacctggcggcagcgcaaaagatg

SEQ ID NO: 139095 - DNA, 103 bp, Artificial Sequence
  Synthetic Polynucleotide
taatacgactcactatagggacaggaaacggaacccctttatctgaaaataacagaggagaattttcatgtaaaggggtaacctggcggcagcgcaaaagatg

SEQ ID NO: 139096 - DNA, 103 bp, Artificial Sequence
  Synthetic Polynucleotide
taatacgactcactatagggcctctggagtacaggaaacggaacccctttaacagaggagaaaagggatgccgtttcctaacctggcggcagcgcaaaagatg

SEQ ID NO: 139097 - DNA, 103 bp, Artificial Sequence
  Synthetic Polynucleotide
taatacgactcactatagggcagttggaaacctctggagtacaggaaacgaacagaggagacgtttcatgtactccagaaacctggcggcagcgcaaaagatg

SEQ ID NO: 139098 - DNA, 103 bp, Artificial Sequence
  Synthetic Polynucleotide
taatacgactcactatagggtaggtaacctcagttggaaacctctggagtaacagaggagaactccaatggtttccaacaacctggcggcagcgcaaaagatg

SEQ ID NO: 139099 - DNA, 103 bp, Artificial Sequence
  Synthetic Polynucleotide
taatacgactcactatagggctgcagtgtataggtaacctcagttggaaaaacagaggagatttccaatggaggttaccaacctggcggcagcgcaaaagatg

SEQ ID NO: 139100 - DNA, 103 bp, Artificial Sequence
  Synthetic Polynucleotide
taatacgactcactatagggcgtcccagcggatggagcggtagcgcgggcaacagaggagagcccgcatgaccgctccaaacctggcggcagcgcaaaagatg

SEQ ID NO: 139101 - DNA, 103 bp, Artificial Sequence
  Synthetic Polynucleotide
taatacgactcactatagggtggtgctgggctgcagtgtataggtaacctaacagaggagaaggttaatgatacactgcaacctggcggcagcgcaaaagatg

SEQ ID NO: 139102 - DNA, 103 bp, Artificial Sequence
  Synthetic Polynucleotide
taatacgactcactatagggtgtacagatgtggtgctgggctgcagtgtaaacagaggagatacactatggcccagcacaacctggcggcagcgcaaaagatg

SEQ ID NO: 139103 - DNA, 103 bp, Artificial Sequence
  Synthetic Polynucleotide
taatacgactcactatagggttgttgaacatgtacagatgtggtgctgggaacagaggagacccagcatgacatctgtaaacctggcggcagcgcaaaagatg

SEQ ID NO: 139104 - DNA, 103 bp, Artificial Sequence
  Synthetic Polynucleotide
taatacgactcactatagggtttgaggaccttgttgaacatgtacagatgaacagaggagacatctgatgatgttcaacaacctggcggcagcgcaaaagatg

SEQ ID NO: 139105 - DNA, 103 bp, Artificial Sequence
  Synthetic Polynucleotide
taatacgactcactatagggctgaccattgtttgaggaccttgttgaacaaacagaggagatgttcaatgaggtcctcaaacctggcggcagcgcaaaagatg

SEQ ID NO: 139106 - DNA, 103 bp, Artificial Sequence
  Synthetic Polynucleotide
taatacgactcactatagggttgggaggagctgaccattgtttgaggaccaacagaggagaggtcctatgacaatggtcaacctggcggcagcgcaaaagatg

SEQ ID NO: 139107 - DNA, 103 bp, Artificial Sequence
  Synthetic Polynucleotide
taatacgactcactatagggtactgtatttttgggaggagctgaccattgaacagaggagacaatggatggctcctcccaacctggcggcagcgcaaaagatg

SEQ ID NO: 139108 - DNA, 103 bp, Artificial Sequence
  Synthetic Polynucleotide
taatacgactcactatagggggtgtgtagttactgtatttttgggaggagaacagaggagactcctcatgaaaatacagaacctggcggcagcgcaaaagatg

SEQ ID NO: 139109 - DNA, 103 bp, Artificial Sequence
  Synthetic Polynucleotide
taatacgactcactatagggctgtgctgagggtgtgtagttactgtatttaacagaggagaaaatacatgaactacacaaacctggcggcagcgcaaaagatg

SEQ ID NO: 139110 - DNA, 103 bp, Artificial Sequence
  Synthetic Polynucleotide
taatacgactcactatagggcttgcgagtactgtgctgagggtgtgtagtaacagaggagaactacaatgcctcagcacaacctggcggcagcgcaaaagatg

SEQ ID NO: 139111 - DNA, 103 bp, Artificial Sequence
  Synthetic Polynucleotide
taatacgactcactatagggtcgccgcggccgtcccagcggatggagcggaacagaggagaccgctcatgccgctgggaaacctggcggcagcgcaaaagatg

SEQ ID NO: 139112 - DNA, 103 bp, Artificial Sequence
  Synthetic Polynucleotide
taatacgactcactatagggggatagtaggcttgcgagtactgtgctgagaacagaggagactcagcatggtactcgcaaacctggcggcagcgcaaaagatg

SEQ ID NO: 139113 - DNA, 103 bp, Artificial Sequence
  Synthetic Polynucleotide
taatacgactcactatagggcacagctgttggatagtaggcttgcgagtaaacagaggagatactcgatggcctactataacctggcggcagcgcaaaagatg

SEQ ID NO: 139114 - DNA, 103 bp, Artificial Sequence
  Synthetic Polynucleotide
taatacgactcactatagggagcactgtagcacagctgttggatagtaggaacagaggagacctactatgcaacagctgaacctggcggcagcgcaaaagatg

SEQ ID NO: 139115 - DNA, 103 bp, Artificial Sequence
  Synthetic Polynucleotide
taatacgactcactataggggtaggagaacagcactgtagcacagctgttaacagaggagaaacagcatggctacagtgaacctggcggcagcgcaaaagatg

SEQ ID NO: 139116 - DNA, 103 bp, Artificial Sequence
  Synthetic Polynucleotide
taatacgactcactatagggatccatgtgggtaggagaacagcactgtagaacagaggagactacagatgtgttctcctaacctggcggcagcgcaaaagatg

SEQ ID NO: 139117 - DNA, 103 bp, Artificial Sequence
  Synthetic Polynucleotide
taatacgactcactatagggtacttagagcatccatgtgggtaggagaacaacagaggagagttctcatgcccacatggaacctggcggcagcgcaaaagatg

SEQ ID NO: 139118 - DNA, 103 bp, Artificial Sequence
  Synthetic Polynucleotide
taatacgactcactataggggtgacacaactacttagagcatccatgtggaacagaggagaccacatatgtgctctaagaacctggcggcagcgcaaaagatg

SEQ ID NO: 139119 - DNA, 103 bp, Artificial Sequence
  Synthetic Polynucleotide
taatacgactcactatagggggcagtgggagtgacacaactacttagagcaacagaggagagctctaatgagttgtgtcaacctggcggcagcgcaaaagatg

SEQ ID NO: 139120 - DNA, 103 bp, Artificial Sequence
  Synthetic Polynucleotide
taatacgactcactatagggcataggaagaggcagtgggagtgacacaacaacagaggagagttgtgatgctcccactgaacctggcggcagcgcaaaagatg

SEQ ID NO: 139121 - DNA, 103 bp, Artificial Sequence
  Synthetic Polynucleotide
taatacgactcactatagggttgcagtgtgcataggaagaggcagtgggaaacagaggagatcccacatgctcttcctaaacctggcggcagcgcaaaagatg

SEQ ID NO: 139122 - DNA, 103 bp, Artificial Sequence
  Synthetic Polynucleotide
taatacgactcactatagggagccatactcaatgatcgcttgtcctccataacagaggagaatggagatgaagcgatcaaacctggcggcagcgcaaaagatg

SEQ ID NO: 139123 - DNA, 103 bp, Artificial Sequence
  Synthetic Polynucleotide
taatacgactcactataggggtgaaggtaggtctctgactgcaactggggaacagaggagaccccagatgcagtcagagaacctggcggcagcgcaaaagatg

SEQ ID NO: 139124 - DNA, 103 bp, Artificial Sequence
  Synthetic Polynucleotide
taatacgactcactataggggggaagggccaccacaggcccgtaagaattaacagaggagaaattctatggggcctgtgaacctggcggcagcgcaaaagatg

SEQ ID NO: 139125 - DNA, 103 bp, Artificial Sequence
  Synthetic Polynucleotide
taatacgactcactataggggggacgctgtgggaagggccaccacaggccaacagaggagaggcctgatgtggcccttcaacctggcggcagcgcaaaagatg

SEQ ID NO: 139126 - DNA, 103 bp, Artificial Sequence
  Synthetic Polynucleotide
taatacgactcactatagggagggtactacgggacgctgtgggaagggccaacagaggagaggccctatgcacagcgtcaacctggcggcagcgcaaaagatg

SEQ ID NO: 139127 - DNA, 103 bp, Artificial Sequence
  Synthetic Polynucleotide
taatacgactcactataggggtccatggcaagggtactacgggacgctgtaacagaggagaacagcgatgcgtagtaccaacctggcggcagcgcaaaagatg

SEQ ID NO: 139128 - DNA, 103 bp, Artificial Sequence
  Synthetic Polynucleotide
taatacgactcactataggggtcctgtggtgtccatggcaagggtactacaacagaggagagtagtaatgttgccatggaacctggcggcagcgcaaaagatg

SEQ ID NO: 139129 - DNA, 103 bp, Artificial Sequence
  Synthetic Polynucleotide
taatacgactcactatagggggtgcaggaagtcctgtggtgtccatggcaaacagaggagatgccatatgcaccacaggaacctggcggcagcgcaaaagatg

SEQ ID NO: 139130 - DNA, 103 bp, Artificial Sequence
  Synthetic Polynucleotide
taatacgactcactatagggcagcatgccaggtgcaggaagtcctgtggtaacagaggagaaccacaatgcttcctgcaaacctggcggcagcgcaaaagatg

SEQ ID NO: 139131 - DNA, 103 bp, Artificial Sequence
  Synthetic Polynucleotide
taatacgactcactatagggggcaaaagggcagcatgccaggtgcaggaaaacagaggagattcctgatgctggcatgcaacctggcggcagcgcaaaagatg

SEQ ID NO: 139132 - DNA, 103 bp, Artificial Sequence
  Synthetic Polynucleotide
taatacgactcactatagggacccagagatggcaaaagggcagcatgccaaacagaggagatggcatatggcccttttgaacctggcggcagcgcaaaagatg

SEQ ID NO: 139133 - DNA, 103 bp, Artificial Sequence
  Synthetic Polynucleotide
taatacgactcactatagggggtcaccggtacccagagatggcaaaagggaacagaggagaccctttatgcatctctggaacctggcggcagcgcaaaagatg

SEQ ID NO: 139134 - DNA, 103 bp, Artificial Sequence
  Synthetic Polynucleotide
taatacgactcactataggggatctgctgggtgaaggtaggtctctgactaacagaggagaagtcagatgcctaccttcaacctggcggcagcgcaaaagatg

SEQ ID NO: 139135 - DNA, 103 bp, Artificial Sequence
  Synthetic Polynucleotide
taatacgactcactatagggcagccactagggtcaccggtacccagagataacagaggagaatctctatgtaccggtgaaacctggcggcagcgcaaaagatg

SEQ ID NO: 139136 - DNA, 103 bp, Artificial Sequence
  Synthetic Polynucleotide
taatacgactcactataggggcagccccagcagccactagggtcaccggtaacagaggagaaccggtatgcctagtggcaacctggcggcagcgcaaaagatg

SEQ ID NO: 139137 - DNA, 103 bp, Artificial Sequence
  Synthetic Polynucleotide
taatacgactcactatagggagcaggctgtgcagccccagcagccactagaacagaggagactagtgatggctggggctaacctggcggcagcgcaaaagatg

SEQ ID NO: 139138 - DNA, 103 bp, Artificial Sequence
  Synthetic Polynucleotide
taatacgactcactatagggccatggaggcagcaggctgtgcagccccagaacagaggagactggggatgcacagcctgaacctggcggcagcgcaaaagatg

SEQ ID NO: 139139 - DNA, 103 bp, Artificial Sequence
  Synthetic Polynucleotide
taatacgactcactataggggggaacatgaccatggaggcagcaggctgtaacagaggagaacagccatgtgcctccataacctggcggcagcgcaaaagatg

SEQ ID NO: 139140 - DNA, 103 bp, Artificial Sequence
  Synthetic Polynucleotide
taatacgactcactatagggtgggagatgggggaacatgaccatggaggcaacagaggagagcctccatggtcatgttcaacctggcggcagcgcaaaagatg

SEQ ID NO: 139141 - DNA, 103 bp, Artificial Sequence
  Synthetic Polynucleotide
taatacgactcactatagggggtgcagagctgggagatgggggaacatgaaacagaggagatcatgtatgcccatctccaacctggcggcagcgcaaaagatg

SEQ ID NO: 139142 - DNA, 103 bp, Artificial Sequence
  Synthetic Polynucleotide
taatacgactcactataggggggcaatggtggtgcagagctgggagatggaacagaggagaccatctatgagctctgcaaacctggcggcagcgcaaaagatg

SEQ ID NO: 139143 - DNA, 103 bp, Artificial Sequence
  Synthetic Polynucleotide
taatacgactcactataggggtggctgtgggggcaatggtggtgcagagcaacagaggagagctctgatgcaccattgcaacctggcggcagcgcaaaagatg

SEQ ID NO: 139144 - DNA, 103 bp, Artificial Sequence
  Synthetic Polynucleotide
taatacgactcactataggggtgacgtgcggtggctgtgggggcaatggtaacagaggagaaccattatgcccacagccaacctggcggcagcgcaaaagatg

SEQ ID NO: 139145 - DNA, 103 bp, Artificial Sequence
  Synthetic Polynucleotide
taatacgactcactataggggcaggggaaggatctgctgggtgaaggtagaacagaggagactacctatgcccagcagaaacctggcggcagcgcaaaagatg

SEQ ID NO: 139146 - DNA, 103 bp, Artificial Sequence
  Synthetic Polynucleotide
taatacgactcactatagggggcatgtactgtgacgtgcggtggctgtggaacagaggagaccacagatgccgcacgtcaacctggcggcagcgcaaaagatg

SEQ ID NO: 139147 - DNA, 103 bp, Artificial Sequence
  Synthetic Polynucleotide
taatacgactcactatagggatcgctagctggcatgtactgtgacgtgcgaacagaggagacgcacgatgcagtacatgaacctggcggcagcgcaaaagatg

SEQ ID NO: 139148 - DNA, 103 bp, Artificial Sequence
  Synthetic Polynucleotide
taatacgactcactatagggcctggggcccatcgctagctggcatgtactaacagaggagaagtacaatgcagctagcgaacctggcggcagcgcaaaagatg

SEQ ID NO: 139149 - DNA, 103 bp, Artificial Sequence
  Synthetic Polynucleotide
taatacgactcactatagggtctgggtacgcctggggcccatcgctagctaacagaggagaagctagatgtgggccccaaacctggcggcagcgcaaaagatg

SEQ ID NO: 139150 - DNA, 103 bp, Artificial Sequence
  Synthetic Polynucleotide
taatacgactcactataggggtctgcgtagtctgggtacgcctggggcccaacagaggagagggcccatggcgtacccaaacctggcggcagcgcaaaagatg

SEQ ID NO: 139151 - DNA, 103 bp, Artificial Sequence
  Synthetic Polynucleotide
taatacgactcactatagggatgtgctctggtctgcgtagtctgggtacgaacagaggagacgtaccatgactacgcagaacctggcggcagcgcaaaagatg

SEQ ID NO: 139152 - DNA, 103 bp, Artificial Sequence
  Synthetic Polynucleotide
taatacgactcactataggggtcgtcccaggcaggggaaggatctgctggaacagaggagaccagcaatgccttcccctaacctggcggcagcgcaaaagatg

SEQ ID NO: 139153 - DNA, 103 bp, Artificial Sequence
  Synthetic Polynucleotide
taatacgactcactatagggtggaccccgggtcgtcccaggcaggggaagaacagaggagacttcccatgcctgggacgaacctggcggcagcgcaaaagatg

SEQ ID NO: 139154 - DNA, 103 bp, Artificial Sequence
  Synthetic Polynucleotide
taatacgactcactataggggggctcccagtggaccccgggtcgtcccagaacagaggagactgggaatgcccggggtcaacctggcggcagcgcaaaagatg

SEQ ID NO: 139155 - DNA, 103 bp, Artificial Sequence
  Synthetic Polynucleotide
taatacgactcactatagggcctcaagttagggctcccagtggaccccggaacagaggagaccggggatgactgggagcaacctggcggcagcgcaaaagatg

SEQ ID NO: 139156 - DNA, 103 bp, Artificial Sequence
  Synthetic Polynucleotide
taatacgactcactatagggctgtcagcagcctcaagttagggctcccagaacagaggagactgggaatgctaacttgaaacctggcggcagcgcaaaagatg

SEQ ID NO: 139157 - DNA, 103 bp, Artificial Sequence
  Synthetic Polynucleotide
taatacgactcactataggggcgatttcttctgtcagcagcctcaagttaaacagaggagataacttatggctgctgacaacctggcggcagcgcaaaagatg

SEQ ID NO: 139158 - DNA, 103 bp, Artificial Sequence
  Synthetic Polynucleotide
taatacgactcactatagggaggttggaaagcgatttcttctgtcagcagaacagaggagactgctgatggaagaaatcaacctggcggcagcgcaaaagatg

SEQ ID NO: 139159 - DNA, 103 bp, Artificial Sequence
  Synthetic Polynucleotide
taatacgactcactatagggcttcacagcgagccatactcaatgatcgctaacagaggagaagcgatatgtgagtatggaacctggcggcagcgcaaaagatg

SEQ ID NO: 139160 - DNA, 103 bp, Artificial Sequence
  Synthetic Polynucleotide
taatacgactcactatagggcctcggccagaggttggaaagcgatttcttaacagaggagaaagaaaatgctttccaacaacctggcggcagcgcaaaagatg

SEQ ID NO: 139161 - DNA, 103 bp, Artificial Sequence
  Synthetic Polynucleotide
taatacgactcactatagggaacgaagcttcctcggccagaggttggaaaaacagaggagatttccaatgtctggccgaaacctggcggcagcgcaaaagatg

SEQ ID NO: 139162 - DNA, 103 bp, Artificial Sequence
  Synthetic Polynucleotide
taatacgactcactatagggcggccttctgaacgaagcttcctcggccagaacagaggagactggccatggaagcttcgaacctggcggcagcgcaaaagatg

SEQ ID NO: 139163 - DNA, 103 bp, Artificial Sequence
  Synthetic Polynucleotide
taatacgactcactatagggcgtcagggtgcggccttctgaacgaagcttaacagaggagaaagcttatgtcagaaggcaacctggcggcagcgcaaaagatg

SEQ ID NO: 139164 - DNA, 103 bp, Artificial Sequence
  Synthetic Polynucleotide
taatacgactcactataggggggacgtcaccgtcagggtgcggccttctgaacagaggagacagaagatggcaccctgaaacctggcggcagcgcaaaagatg

SEQ ID NO: 139165 - DNA, 103 bp, Artificial Sequence
  Synthetic Polynucleotide
taatacgactcactatagggtccctggggcgggacgtcaccgtcagggtgaacagaggagacaccctatgggtgacgtcaacctggcggcagcgcaaaagatg

SEQ ID NO: 139166 - DNA, 103 bp, Artificial Sequence
  Synthetic Polynucleotide
taatacgactcactataggggattatcttctccctggggcgggacgtcacaacagaggagagtgacgatgcgccccaggaacctggcggcagcgcaaaagatg

SEQ ID NO: 139167 - DNA, 103 bp, Artificial Sequence
  Synthetic Polynucleotide
taatacgactcactatagggagggagaggagattatcttctccctggggcaacagaggagagccccaatgagaagataaaacctggcggcagcgcaaaagatg

SEQ ID NO: 139168 - DNA, 103 bp, Artificial Sequence
  Synthetic Polynucleotide
taatacgactcactatagggtggaaaggggagggagaggagattatcttcaacagaggagagaagatatgctcctctccaacctggcggcagcgcaaaagatg

SEQ ID NO: 139169 - DNA, 103 bp, Artificial Sequence
  Synthetic Polynucleotide
taatacgactcactatagggacagtttctgtggaaaggggagggagaggaaacagaggagatcctctatgtcccctttcaacctggcggcagcgcaaaagatg

SEQ ID NO: 139170 - DNA, 103 bp, Artificial Sequence
  Synthetic Polynucleotide
taatacgactcactataggggaatttctttcttcacagcgagccatactcaacagaggagagagtatatgtcgctgtgaaacctggcggcagcgcaaaagatg

SEQ ID NO: 139171 - DNA, 103 bp, Artificial Sequence
  Synthetic Polynucleotide
taatacgactcactatagggaccagtctccacagtttctgtggaaaggggaacagaggagaccccttatgacagaaactaacctggcggcagcgcaaaagatg

SEQ ID NO: 139172 - DNA, 103 bp, Artificial Sequence
  Synthetic Polynucleotide
taatacgactcactataggggttgctgctgaccagtctccacagtttctgaacagaggagacagaaaatgtggagactgaacctggcggcagcgcaaaagatg

SEQ ID NO: 139173 - DNA, 103 bp, Artificial Sequence
  Synthetic Polynucleotide
taatacgactcactatagggacgaaaactggttgctgctgaccagtctccaacagaggagaggagacatgtcagcagcaaacctggcggcagcgcaaaagatg

SEQ ID NO: 139174 - DNA, 103 bp, Artificial Sequence
  Synthetic Polynucleotide
taatacgactcactatagggcaccagatggacgaaaactggttgctgctgaacagaggagacagcagatgccagttttcaacctggcggcagcgcaaaagatg

SEQ ID NO: 139175 - DNA, 103 bp, Artificial Sequence
  Synthetic Polynucleotide
taatacgactcactatagggactgtcatcccaccagatggacgaaaactgaacagaggagacagtttatgtccatctggaacctggcggcagcgcaaaagatg

SEQ ID NO: 139176 - DNA, 103 bp, Artificial Sequence
  Synthetic Polynucleotide
taatacgactcactatagggtacaagccccactgtcatcccaccagatggaacagaggagaccatctatggggatgacaaacctggcggcagcgcaaaagatg

SEQ ID NO: 139177 - DNA, 103 bp, Artificial Sequence
  Synthetic Polynucleotide
taatacgactcactatagggttgatcactctacaagccccactgtcatccaacagaggagaggatgaatgtggggcttgaacctggcggcagcgcaaaagatg

SEQ ID NO: 139178 - DNA, 103 bp, Artificial Sequence
  Synthetic Polynucleotide
taatacgactcactataggggagtttttgattgatcactctacaagccccaacagaggagaggggctatgagagtgatcaacctggcggcagcgcaaaagatg

SEQ ID NO: 139179 - DNA, 103 bp, Artificial Sequence
  Synthetic Polynucleotide
taatacgactcactatagggccttttcaaagagtttttgattgatcactcaacagaggagagagtgaatgatcaaaaacaacctggcggcagcgcaaaagatg

SEQ ID NO: 139180 - DNA, 103 bp, Artificial Sequence
  Synthetic Polynucleotide
taatacgactcactatagggttgagaatctccttttcaaagagtttttgaaacagaggagatcaaaaatgctttgaaaaaacctggcggcagcgcaaaagatg

SEQ ID NO: 139181 - DNA, 103 bp, Artificial Sequence
  Synthetic Polynucleotide
taatacgactcactatagggctgtcctctcgaatttctttcttcacagcgaacagaggagacgctgtatggaaagaaataacctggcggcagcgcaaaagatg

SEQ ID NO: 139182 - DNA, 103 bp, Artificial Sequence
  Synthetic Polynucleotide
taatacgactcactataggggacgtcccttttgagaatctccttttcaaaaacagaggagatttgaaatggagattctcaacctggcggcagcgcaaaagatg

SEQ ID NO: 139183 - DNA, 103 bp, Artificial Sequence
  Synthetic Polynucleotide
taatacgactcactatagggctttgtgtgcgacgtcccttttgagaatctaacagaggagaagattcatgaaagggacgaacctggcggcagcgcaaaagatg

SEQ ID NO: 139184 - DNA, 103 bp, Artificial Sequence
  Synthetic Polynucleotide
taatacgactcactataggggtggcaaacactttgtgtgcgacgtcccttaacagaggagaaagggaatgcgcacacaaaacctggcggcagcgcaaaagatg

SEQ ID NO: 139185 - DNA, 103 bp, Artificial Sequence
  Synthetic Polynucleotide
taatacgactcactatagggtatcgaagttgtggcaaacactttgtgtgcaacagaggagagcacacatggtgtttgccaacctggcggcagcgcaaaagatg

SEQ ID NO: 139186 - DNA, 103 bp, Artificial Sequence
  Synthetic Polynucleotide
taatacgactcactatagggagaagctctttatcgaagttgtggcaaacaaacagaggagatgtttgatgcaacttcgaaacctggcggcagcgcaaaagatg

SEQ ID NO: 139187 - DNA, 103 bp, Artificial Sequence
  Synthetic Polynucleotide
taatacgactcactatagggagctggcggaagaagctctttatcgaagttaacagaggagaaacttcatgaaagagcttaacctggcggcagcgcaaaagatg

SEQ ID NO: 139188 - DNA, 103 bp, Artificial Sequence
  Synthetic Polynucleotide
taatacgactcactatagggatacaagtttagctggcggaagaagctcttaacagaggagaaagagcatgttccgccagaacctggcggcagcgcaaaagatg

SEQ ID NO: 139189 - DNA, 103 bp, Artificial Sequence
  Synthetic Polynucleotide
taatacgactcactatagggttcggaagccatacaagtttagctggcggaaacagaggagatccgccatgtaaacttgtaacctggcggcagcgcaaaagatg

SEQ ID NO: 139190 - DNA, 103 bp, Artificial Sequence
  Synthetic Polynucleotide
taatacgactcactatagggtgacgccgttttcggaagccatacaagtttaacagaggagaaaacttatgtggcttccgaacctggcggcagcgcaaaagatg

SEQ ID NO: 139191 - DNA, 103 bp, Artificial Sequence
  Synthetic Polynucleotide
taatacgactcactataggggaaagtgcattgacgccgttttcggaagccaacagaggagaggcttcatgaaacggcgtaacctggcggcagcgcaaaagatg

SEQ ID NO: 139192 - DNA, 103 bp, Artificial Sequence
  Synthetic Polynucleotide
taatacgactcactatagggagccatgatcctgtcctctcgaatttctttaacagaggagaaaagaaatgcgagaggacaacctggcggcagcgcaaaagatg

SEQ ID NO: 139193 - DNA, 103 bp, Artificial Sequence
  Synthetic Polynucleotide
taatacgactcactatagggtgaaggtcctgaaagtgcattgacgccgttaacagaggagaaacggcatgaatgcacttaacctggcggcagcgcaaaagatg

SEQ ID NO: 139194 - DNA, 103 bp, Artificial Sequence
  Synthetic Polynucleotide
taatacgactcactatagggaaaatgcgggtgaaggtcctgaaagtgcataacagaggagaatgcacatgcaggaccttaacctggcggcagcgcaaaagatg

SEQ ID NO: 139195 - DNA, 103 bp, Artificial Sequence
  Synthetic Polynucleotide
taatacgactcactatagggttttgcggagaaaatgcgggtgaaggtcctaacagaggagaaggaccatgacccgcattaacctggcggcagcgcaaaagatg

SEQ ID NO: 139196 - DNA, 103 bp, Artificial Sequence
  Synthetic Polynucleotide
taatacgactcactatagggagaccagcctttttgcggagaaaatgcgggaacagaggagacccgcaatgtctccgcaaaacctggcggcagcgcaaaagatg

SEQ ID NO: 139197 - DNA, 103 bp, Artificial Sequence
  Synthetic Polynucleotide
taatacgactcactatagggttcaagatggagaccagcctttttgcggagaacagaggagactccgcatgaaggctggtaacctggcggcagcgcaaaagatg

SEQ ID NO: 139198 - DNA, 103 bp, Artificial Sequence
  Synthetic Polynucleotide
taatacgactcactatagggctctaacttattcaagatggagaccagcctaacagaggagaaggctgatgtccatcttgaacctggcggcagcgcaaaagatg

SEQ ID NO: 139199 - DNA, 103 bp, Artificial Sequence
  Synthetic Polynucleotide
taatacgactcactatagggggcagtagaactctaacttattcaagatggaacagaggagaccatctatgataagttagaacctggcggcagcgcaaaagatg

SEQ ID NO: 139200 - DNA, 103 bp, Artificial Sequence
  Synthetic Polynucleotide
taatacgactcactatagggaagtaaggatggcagtagaactctaacttaaacagaggagataagttatggttctactgaacctggcggcagcgcaaaagatg

SEQ ID NO: 139201 - DNA, 103 bp, Artificial Sequence
  Synthetic Polynucleotide
taatacgactcactataggggtctctttgaaagtaaggatggcagtagaaaacagaggagattctacatgcatccttacaacctggcggcagcgcaaaagatg

SEQ ID NO: 139202 - DNA, 103 bp, Artificial Sequence
  Synthetic Polynucleotide
taatacgactcactatagggggtgaggggagtctctttgaaagtaaggataacagaggagaatccttatgttcaaagagaacctggcggcagcgcaaaagatg

SEQ ID NO: 139203 - DNA, 103 bp, Artificial Sequence
  Synthetic Polynucleotide
taatacgactcactatagggaccctttccaagccatgatcctgtcctctcaacagaggagagagaggatgggatcatggaacctggcggcagcgcaaaagatg

SEQ ID NO: 139204 - DNA, 103 bp, Artificial Sequence
  Synthetic Polynucleotide
taatacgactcactatagggctcacgaggaggtgaggggagtctctttgaaacagaggagatcaaagatgctcccctcaaacctggcggcagcgcaaaagatg

SEQ ID NO: 139205 - DNA, 103 bp, Artificial Sequence
  Synthetic Polynucleotide
taatacgactcactatagggtctcttcatcctcacgaggaggtgaggggaaacagaggagatcccctatgctcctcgtgaacctggcggcagcgcaaaagatg

SEQ ID NO: 139206 - DNA, 103 bp, Artificial Sequence
  Synthetic Polynucleotide
taatacgactcactatagggcacccactcttctcttcatcctcacgaggaaacagaggagatcctcgatgggatgaagaaacctggcggcagcgcaaaagatg

SEQ ID NO: 139207 - DNA, 103 bp, Artificial Sequence
  Synthetic Polynucleotide
taatacgactcactataggggcagacttgacacccactcttctcttcatcaacagaggagagatgaaatgaagagtgggaacctggcggcagcgcaaaagatg

SEQ ID NO: 139208 - DNA, 103 bp, Artificial Sequence
  Synthetic Polynucleotide
taatacgactcactatagggatgtcttggtgcagacttgacacccactctaacagaggagaagagtgatggtcaagtctaacctggcggcagcgcaaaagatg

SEQ ID NO: 139209 - DNA, 103 bp, Artificial Sequence
  Synthetic Polynucleotide
taatacgactcactatagggcctcctcctgatgtcttggtgcagacttgaaacagaggagatcaagtatgcaccaagacaacctggcggcagcgcaaaagatg

SEQ ID NO: 139210 - DNA, 103 bp, Artificial Sequence
  Synthetic Polynucleotide
taatacgactcactatagggtctggcttgtcctcctcctgatgtcttggtaacagaggagaaccaagatgtcaggaggaaacctggcggcagcgcaaaagatg

SEQ ID NO: 139211 - DNA, 103 bp, Artificial Sequence
  Synthetic Polynucleotide
taatacgactcactatagggtccagcagcttctggcttgtcctcctcctgaacagaggagacaggagatggacaagccaaacctggcggcagcgcaaaagatg

SEQ ID NO: 139212 - DNA, 103 bp, Artificial Sequence
  Synthetic Polynucleotide
taatacgactcactatagggccagacaggatccagcagcttctggcttgtaacagaggagaacaagcatgaagctgctgaacctggcggcagcgcaaaagatg

SEQ ID NO: 139213 - DNA, 103 bp, Artificial Sequence
  Synthetic Polynucleotide
taatacgactcactatagggtctgctggtgccagacaggatccagcagctaacagaggagaagctgcatgatcctgtctaacctggcggcagcgcaaaagatg

SEQ ID NO: 139214 - DNA, 103 bp, Artificial Sequence
  Synthetic Polynucleotide
taatacgactcactatagggagggaaaggcaccctttccaagccatgatcaacagaggagagatcatatgttggaaaggaacctggcggcagcgcaaaagatg

SEQ ID NO: 139215 - DNA, 103 bp, Artificial Sequence
  Synthetic Polynucleotide
taatacgactcactatagggttgctcagtgtctgctggtgccagacaggaaacagaggagatcctgtatggcaccagcaaacctggcggcagcgcaaaagatg

SEQ ID NO: 139216 - DNA, 103 bp, Artificial Sequence
  Synthetic Polynucleotide
taatacgactcactatagggtgtgatcttgttgctcagtgtctgctggtgaacagaggagacaccagatgacactgagcaacctggcggcagcgcaaaagatg

SEQ ID NO: 139217 - DNA, 103 bp, Artificial Sequence
  Synthetic Polynucleotide
taatacgactcactatagggttcggagacgtgtgatcttgttgctcagtgaacagaggagacactgaatgacaagatcaaacctggcggcagcgcaaaagatg

SEQ ID NO: 139218 - DNA, 103 bp, Artificial Sequence
  Synthetic Polynucleotide
taatacgactcactataggggtcattctcattcggagacgtgtgatcttgaacagaggagacaagatatgacgtctccgaacctggcggcagcgcaaaagatg

SEQ ID NO: 139219 - DNA, 103 bp, Artificial Sequence
  Synthetic Polynucleotide
taatacgactcactataggggtgtgacctggtcattctcattcggagacgaacagaggagacgtctcatgatgagaatgaacctggcggcagcgcaaaagatg

SEQ ID NO: 139220 - DNA, 103 bp, Artificial Sequence
  Synthetic Polynucleotide
taatacgactcactatagggcggtgttgcggtgtgacctggtcattctcaaacagaggagatgagaaatgccaggtcacaacctggcggcagcgcaaaagatg

SEQ ID NO: 139221 - DNA, 103 bp, Artificial Sequence
  Synthetic Polynucleotide
taatacgactcactatagggggccggttcccggtgttgcggtgtgacctgaacagaggagacaggtcatgccgcaacacaacctggcggcagcgcaaaagatg

SEQ ID NO: 139222 - DNA, 103 bp, Artificial Sequence
  Synthetic Polynucleotide
taatacgactcactatagggtgttgggaccggccggttcccggtgttgcgaacagaggagacgcaacatggggaaccggaacctggcggcagcgcaaaagatg

SEQ ID NO: 139223 - DNA, 103 bp, Artificial Sequence
  Synthetic Polynucleotide
taatacgactcactatagggctgatttgggtgttgggaccggccggttccaacagaggagaggaaccatgcggtcccaaaacctggcggcagcgcaaaagatg

SEQ ID NO: 139224 - DNA, 103 bp, Artificial Sequence
  Synthetic Polynucleotide
taatacgactcactatagggagagccactcctgatttgggtgttgggaccaacagaggagaggtcccatgacccaaatcaacctggcggcagcgcaaaagatg

SEQ ID NO: 139225 - DNA, 103 bp, Artificial Sequence
  Synthetic Polynucleotide
taatacgactcactataggggcaactggggagggaaaggcaccctttccaaacagaggagatggaaaatgtgcctttccaacctggcggcagcgcaaaagatg

SEQ ID NO: 139226 - DNA, 103 bp, Artificial Sequence
  Synthetic Polynucleotide
taatacgactcactatagggctggtggagcagagccactcctgatttgggaacagaggagacccaaaatgggagtggctaacctggcggcagcgcaaaagatg

SEQ ID NO: 139227 - DNA, 103 bp, Artificial Sequence
  Synthetic Polynucleotide
taatacgactcactatagggacaggagttgctggtggagcagagccactcaacagaggagagagtggatgtgctccaccaacctggcggcagcgcaaaagatg

SEQ ID NO: 139228 - DNA, 103 bp, Artificial Sequence
  Synthetic Polynucleotide
taatacgactcactatagggaggcaccatcacaggagttgctggtggagcaacagaggagagctccaatggcaactcctaacctggcggcagcgcaaaagatg

SEQ ID NO: 139229 - DNA, 103 bp, Artificial Sequence
  Synthetic Polynucleotide
taatacgactcactatagggcggcggaatcaggcaccatcacaggagttgaacagaggagacaactcatgtgatggtgcaacctggcggcagcgcaaaagatg

SEQ ID NO: 139230 - DNA, 103 bp, Artificial Sequence
  Synthetic Polynucleotide
taatacgactcactatagggtcactcgccacggcggaatcaggcaccatcaacagaggagagatggtatgtgattccgcaacctggcggcagcgcaaaagatg

SEQ ID NO: 139231 - DNA, 103 bp, Artificial Sequence
  Synthetic Polynucleotide
taatacgactcactatagggtggactgttgtcactcgccacggcggaatcaacagaggagagattccatggtggcgagtaacctggcggcagcgcaaaagatg

SEQ ID NO: 139232 - DNA, 103 bp, Artificial Sequence
  Synthetic Polynucleotide
taatacgactcactataggggctgggtcactggactgttgtcactcgccaaacagaggagatggcgaatgacaacagtcaacctggcggcagcgcaaaagatg

SEQ ID NO: 139233 - DNA, 103 bp, Artificial Sequence
  Synthetic Polynucleotide
taatacgactcactatagggtcgccggccggctgggtcactggactgttgaacagaggagacaacagatgagtgacccaaacctggcggcagcgcaaaagatg

SEQ ID NO: 139234 - DNA, 103 bp, Artificial Sequence
  Synthetic Polynucleotide
taatacgactcactatagggctctgaccactcgccggccggctgggtcacaacagaggagagtgaccatgccggccggcaacctggcggcagcgcaaaagatg

SEQ ID NO: 139235 - DNA, 103 bp, Artificial Sequence
  Synthetic Polynucleotide
taatacgactcactatagggcctggctgccctctgaccactcgccggccgaacagaggagacggccgatgagtggtcagaacctggcggcagcgcaaaagatg

SEQ ID NO: 139236 - DNA, 103 bp, Artificial Sequence
  Synthetic Polynucleotide
taatacgactcactataggggtctctgactgcaactggggagggaaaggcaacagaggagagcctttatgtccccagttaacctggcggcagcgcaaaagatg

SEQ ID NO: 139237 - DNA, 103 bp, Artificial Sequence
  Synthetic Polynucleotide
taatacgactcactataggggtgacgtgagcctggctgccctctgaccacaacagaggagagtggtcatggggcagccaaacctggcggcagcgcaaaagatg

SEQ ID NO: 139238 - DNA, 103 bp, Artificial Sequence
  Synthetic Polynucleotide
taatacgactcactatagggggccaccggagtgacgtgagcctggctgccaacagaggagaggcagcatggctcacgtcaacctggcggcagcgcaaaagatg

SEQ ID NO: 139239 - DNA, 103 bp, Artificial Sequence
  Synthetic Polynucleotide
taatacgactcactatagggcagggacagcggccaccggagtgacgtgagaacagaggagactcacgatgctccggtggaacctggcggcagcgcaaaagatg

SEQ ID NO: 139240 - DNA, 103 bp, Artificial Sequence
  Synthetic Polynucleotide
taatacgactcactataggggctgcaggcccagggacagcggccaccggaaacagaggagatccggtatgcgctgtcccaacctggcggcagcgcaaaagatg

SEQ ID NO: 139241 - DNA, 103 bp, Artificial Sequence
  Synthetic Polynucleotide
taatacgactcactataggggaagggcagcgctgcaggcccagggacagcaacagaggagagctgtcatggggcctgcaaacctggcggcagcgcaaaagatg

SEQ ID NO: 139242 - DNA, 103 bp, Artificial Sequence
  Synthetic Polynucleotide
taatacgactcactatagggggacatagaggaagggcagcgctgcaggccaacagaggagaggcctgatgcgctgccctaacctggcggcagcgcaaaagatg

SEQ ID NO: 139243 - DNA, 103 bp, Artificial Sequence
  Synthetic Polynucleotide
taatacgactcactatagggggagatccagggacatagaggaagggcagcaacagaggagagctgccatgcctctatgtaacctggcggcagcgcaaaagatg

SEQ ID NO: 139244 - DNA, 103 bp, Artificial Sequence
  Synthetic Polynucleotide
taatacgactcactatagggcatctgagtgggagatccagggacatagagaacagaggagactctatatgcctggatctaacctggcggcagcgcaaaagatg

SEQ ID NO: 139245 - DNA, 103 bp, Artificial Sequence
  Synthetic Polynucleotide
taatacgactcactatagggcgtaagaattcatctgagtgggagatccagaacagaggagactggatatgccactcagaaacctggcggcagcgcaaaagatg

SEQ ID NO: 139246 - DNA, 103 bp, Artificial Sequence
  Synthetic Polynucleotide
taatacgactcactatagggaccacaggcccgtaagaattcatctgagtgaacagaggagacactcaatggaattcttaaacctggcggcagcgcaaaagatg

SEQ ID NO: 139247 - DNA, 103 bp, Artificial Sequence; identical to SEQ ID NO: 139122
  Synthetic Polynucleotide

SEQ ID NO: 139248 - DNA, 103 bp, Artificial Sequence; identical to SEQ ID NO: 139123
  Synthetic Polynucleotide

SEQ ID NO: 139249 - DNA, 103 bp, Artificial Sequence; identical to SEQ ID NO: 139124
  Synthetic Polynucleotide

SEQ ID NO: 139250 - DNA, 103 bp, Artificial Sequence; identical to SEQ ID NO: 139125
  Synthetic Polynucleotide

SEQ ID NO: 139251 - DNA, 103 bp, Artificial Sequence; identical to SEQ ID NO: 139126
  Synthetic Polynucleotide

SEQ ID NO: 139252 - DNA, 103 bp, Artificial Sequence; identical to SEQ ID NO: 139127
  Synthetic Polynucleotide

SEQ ID NO: 139253 - DNA, 103 bp, Artificial Sequence; identical to SEQ ID NO: 139128
  Synthetic Polynucleotide

SEQ ID NO: 139254 - DNA, 103 bp, Artificial Sequence; identical to SEQ ID NO: 139129
  Synthetic Polynucleotide

SEQ ID NO: 139255 - DNA, 103 bp, Artificial Sequence; identical to SEQ ID NO: 139130
  Synthetic Polynucleotide

SEQ ID NO: 139256 - DNA, 103 bp, Artificial Sequence; identical to SEQ ID NO: 139131
  Synthetic Polynucleotide

SEQ ID NO: 139257 - DNA, 103 bp, Artificial Sequence; identical to SEQ ID NO: 139132
  Synthetic Polynucleotide

SEQ ID NO: 139258 - DNA, 103 bp, Artificial Sequence; identical to SEQ ID NO: 139133
  Synthetic Polynucleotide

SEQ ID NO: 139259 - DNA, 103 bp, Artificial Sequence; identical to SEQ ID NO: 139134
  Synthetic Polynucleotide

SEQ ID NO: 139260 - DNA, 103 bp, Artificial Sequence; identical to SEQ ID NO: 139135
  Synthetic Polynucleotide

SEQ ID NO: 139261 - DNA, 103 bp, Artificial Sequence; identical to SEQ ID NO: 139136
  Synthetic Polynucleotide

SEQ ID NO: 139262 - DNA, 103 bp, Artificial Sequence; identical to SEQ ID NO: 139137
  Synthetic Polynucleotide

SEQ ID NO: 139263 - DNA, 103 bp, Artificial Sequence; identical to SEQ ID NO: 139138
  Synthetic Polynucleotide

SEQ ID NO: 139264 - DNA, 103 bp, Artificial Sequence; identical to SEQ ID NO: 139139
  Synthetic Polynucleotide

SEQ ID NO: 139265 - DNA, 103 bp, Artificial Sequence; identical to SEQ ID NO: 139140
  Synthetic Polynucleotide

SEQ ID NO: 139266 - DNA, 103 bp, Artificial Sequence; identical to SEQ ID NO: 139141
  Synthetic Polynucleotide

SEQ ID NO: 139267 - DNA, 103 bp, Artificial Sequence; identical to SEQ ID NO: 139142
  Synthetic Polynucleotide

SEQ ID NO: 139268 - DNA, 103 bp, Artificial Sequence; identical to SEQ ID NO: 139143
  Synthetic Polynucleotide

SEQ ID NO: 139269 - DNA, 103 bp, Artificial Sequence; identical to SEQ ID NO: 139144
  Synthetic Polynucleotide

SEQ ID NO: 139270 - DNA, 103 bp, Artificial Sequence; identical to SEQ ID NO: 139145
  Synthetic Polynucleotide

SEQ ID NO: 139271 - DNA, 103 bp, Artificial Sequence; identical to SEQ ID NO: 139146
  Synthetic Polynucleotide

SEQ ID NO: 139272 - DNA, 103 bp, Artificial Sequence; identical to SEQ ID NO: 139147
  Synthetic Polynucleotide

SEQ ID NO: 139273 - DNA, 103 bp, Artificial Sequence; identical to SEQ ID NO: 139148
  Synthetic Polynucleotide

SEQ ID NO: 139274 - DNA, 103 bp, Artificial Sequence; identical to SEQ ID NO: 139149
  Synthetic Polynucleotide

SEQ ID NO: 139275 - DNA, 103 bp, Artificial Sequence; identical to SEQ ID NO: 139150
  Synthetic Polynucleotide

SEQ ID NO: 139276 - DNA, 103 bp, Artificial Sequence; identical to SEQ ID NO: 139151
  Synthetic Polynucleotide

SEQ ID NO: 139277 - DNA, 103 bp, Artificial Sequence; identical to SEQ ID NO: 139152
  Synthetic Polynucleotide

SEQ ID NO: 139278 - DNA, 103 bp, Artificial Sequence; identical to SEQ ID NO: 139153
  Synthetic Polynucleotide

SEQ ID NO: 139279 - DNA, 103 bp, Artificial Sequence; identical to SEQ ID NO: 139154
  Synthetic Polynucleotide

SEQ ID NO: 139280 - DNA, 103 bp, Artificial Sequence; identical to SEQ ID NO: 139155
  Synthetic Polynucleotide

SEQ ID NO: 139281 - DNA, 103 bp, Artificial Sequence; identical to SEQ ID NO: 139156
  Synthetic Polynucleotide

SEQ ID NO: 139282 - DNA, 103 bp, Artificial Sequence; identical to SEQ ID NO: 139157
  Synthetic Polynucleotide

SEQ ID NO: 139283 - DNA, 103 bp, Artificial Sequence; identical to SEQ ID NO: 139158
  Synthetic Polynucleotide

SEQ ID NO: 139284 - DNA, 103 bp, Artificial Sequence; identical to SEQ ID NO: 139159
  Synthetic Polynucleotide

SEQ ID NO: 139285 - DNA, 103 bp, Artificial Sequence; identical to SEQ ID NO: 139160
  Synthetic Polynucleotide

SEQ ID NO: 139286 - DNA, 103 bp, Artificial Sequence; identical to SEQ ID NO: 139161
  Synthetic Polynucleotide

SEQ ID NO: 139287 - DNA, 103 bp, Artificial Sequence; identical to SEQ ID NO: 139162
  Synthetic Polynucleotide

SEQ ID NO: 139288 - DNA, 103 bp, Artificial Sequence; identical to SEQ ID NO: 139163
  Synthetic Polynucleotide

SEQ ID NO: 139289 - DNA, 103 bp, Artificial Sequence; identical to SEQ ID NO: 139164
  Synthetic Polynucleotide

SEQ ID NO: 139290 - DNA, 103 bp, Artificial Sequence; identical to SEQ ID NO: 139165
  Synthetic Polynucleotide

SEQ ID NO: 139291 - DNA, 103 bp, Artificial Sequence; identical to SEQ ID NO: 139166
  Synthetic Polynucleotide

SEQ ID NO: 139292 - DNA, 103 bp, Artificial Sequence; identical to SEQ ID NO: 139167
  Synthetic Polynucleotide

SEQ ID NO: 139293 - DNA, 103 bp, Artificial Sequence; identical to SEQ ID NO: 139168
  Synthetic Polynucleotide

SEQ ID NO: 139294 - DNA, 103 bp, Artificial Sequence; identical to SEQ ID NO: 139169
  Synthetic Polynucleotide

SEQ ID NO: 139295 - DNA, 103 bp, Artificial Sequence; identical to SEQ ID NO: 139170
  Synthetic Polynucleotide

SEQ ID NO: 139296 - DNA, 103 bp, Artificial Sequence; identical to SEQ ID NO: 139171
  Synthetic Polynucleotide

SEQ ID NO: 139297 - DNA, 103 bp, Artificial Sequence; identical to SEQ ID NO: 139172
  Synthetic Polynucleotide

SEQ ID NO: 139298 - DNA, 103 bp, Artificial Sequence; identical to SEQ ID NO: 139173
  Synthetic Polynucleotide

SEQ ID NO: 139299 - DNA, 103 bp, Artificial Sequence; identical to SEQ ID NO: 139174
  Synthetic Polynucleotide

SEQ ID NO: 139300 - DNA, 103 bp, Artificial Sequence; identical to SEQ ID NO: 139175
  Synthetic Polynucleotide

SEQ ID NO: 139301 - DNA, 103 bp, Artificial Sequence; identical to SEQ ID NO: 139176
  Synthetic Polynucleotide

SEQ ID NO: 139302 - DNA, 103 bp, Artificial Sequence; identical to SEQ ID NO: 139177
  Synthetic Polynucleotide

SEQ ID NO: 139303 - DNA, 103 bp, Artificial Sequence; identical to SEQ ID NO: 139178
  Synthetic Polynucleotide

SEQ ID NO: 139304 - DNA, 103 bp, Artificial Sequence; identical to SEQ ID NO: 139179
  Synthetic Polynucleotide

SEQ ID NO: 139305 - DNA, 103 bp, Artificial Sequence; identical to SEQ ID NO: 139180
  Synthetic Polynucleotide

SEQ ID NO: 139306 - DNA, 103 bp, Artificial Sequence
  Synthetic Polynucleotide
taatacgactcactatagggctgtcccctcgaatttctttcttcacagcgaacagaggagacgctgtatggaaagaaataacctggcggcagcgcaaaagatg

SEQ ID NO: 139307 - DNA, 103 bp, Artificial Sequence; identical to SEQ ID NO: 139182
  Synthetic Polynucleotide

SEQ ID NO: 139308 - DNA, 103 bp, Artificial Sequence; identical to SEQ ID NO: 139183
  Synthetic Polynucleotide

SEQ ID NO: 139309 - DNA, 103 bp, Artificial Sequence; identical to SEQ ID NO: 139184
  Synthetic Polynucleotide

SEQ ID NO: 139310 - DNA, 103 bp, Artificial Sequence; identical to SEQ ID NO: 139185
  Synthetic Polynucleotide

SEQ ID NO: 139311 - DNA, 103 bp, Artificial Sequence; identical to SEQ ID NO: 139186
  Synthetic Polynucleotide

SEQ ID NO: 139312 - DNA, 103 bp, Artificial Sequence; identical to SEQ ID NO: 139187
  Synthetic Polynucleotide

SEQ ID NO: 139313 - DNA, 103 bp, Artificial Sequence; identical to SEQ ID NO: 139188
  Synthetic Polynucleotide

SEQ ID NO: 139314 - DNA, 103 bp, Artificial Sequence; identical to SEQ ID NO: 139189
  Synthetic Polynucleotide

SEQ ID NO: 139315 - DNA, 103 bp, Artificial Sequence; identical to SEQ ID NO: 139190
  Synthetic Polynucleotide

SEQ ID NO: 139316 - DNA, 103 bp, Artificial Sequence; identical to SEQ ID NO: 139191
  Synthetic Polynucleotide

SEQ ID NO: 139317 - DNA, 103 bp, Artificial Sequence
  Synthetic Polynucleotide
taatacgactcactatagggagccatgatcctgtcccctcgaatttctttaacagaggagaaaagaaatgcgaggggacaacctggcggcagcgcaaaagatg

SEQ ID NO: 139318 - DNA, 103 bp, Artificial Sequence; identical to SEQ ID NO: 139193
  Synthetic Polynucleotide

SEQ ID NO: 139319 - DNA, 103 bp, Artificial Sequence; identical to SEQ ID NO: 139194
  Synthetic Polynucleotide

SEQ ID NO: 139320 - DNA, 103 bp, Artificial Sequence; identical to SEQ ID NO: 139195
  Synthetic Polynucleotide

SEQ ID NO: 139321 - DNA, 103 bp, Artificial Sequence; identical to SEQ ID NO: 139196
  Synthetic Polynucleotide

SEQ ID NO: 139322 - DNA, 103 bp, Artificial Sequence; identical to SEQ ID NO: 139197
  Synthetic Polynucleotide

SEQ ID NO: 139323 - DNA, 103 bp, Artificial Sequence; identical to SEQ ID NO: 139198
  Synthetic Polynucleotide

SEQ ID NO: 139324 - DNA, 103 bp, Artificial Sequence; identical to SEQ ID NO: 139199
  Synthetic Polynucleotide

SEQ ID NO: 139325 - DNA, 103 bp, Artificial Sequence; identical to SEQ ID NO: 139200
  Synthetic Polynucleotide

SEQ ID NO: 139326 - DNA, 103 bp, Artificial Sequence; identical to SEQ ID NO: 139201
  Synthetic Polynucleotide

SEQ ID NO: 139327 - DNA, 103 bp, Artificial Sequence; identical to SEQ ID NO: 139202
  Synthetic Polynucleotide

SEQ ID NO: 139328 - DNA, 103 bp, Artificial Sequence
  Synthetic Polynucleotide
taatacgactcactatagggaccctttccaagccatgatcctgtcccctcaacagaggagagaggggatgggatcatggaacctggcggcagcgcaaaagatg

SEQ ID NO: 139329 - DNA, 103 bp, Artificial Sequence; identical to SEQ ID NO: 139204
  Synthetic Polynucleotide

SEQ ID NO: 139330 - DNA, 103 bp, Artificial Sequence; identical to SEQ ID NO: 139205
  Synthetic Polynucleotide

SEQ ID NO: 139331 - DNA, 103 bp, Artificial Sequence; identical to SEQ ID NO: 139206
  Synthetic Polynucleotide

SEQ ID NO: 139332 - DNA, 103 bp, Artificial Sequence; identical to SEQ ID NO: 139207
  Synthetic Polynucleotide

SEQ ID NO: 139333 - DNA, 103 bp, Artificial Sequence; identical to SEQ ID NO: 139208
  Synthetic Polynucleotide

SEQ ID NO: 139334 - DNA, 103 bp, Artificial Sequence; identical to SEQ ID NO: 139209
  Synthetic Polynucleotide

SEQ ID NO: 139335 - DNA, 103 bp, Artificial Sequence; identical to SEQ ID NO: 139210
  Synthetic Polynucleotide

SEQ ID NO: 139336 - DNA, 103 bp, Artificial Sequence; identical to SEQ ID NO: 139211
  Synthetic Polynucleotide

SEQ ID NO: 139337 - DNA, 103 bp, Artificial Sequence; identical to SEQ ID NO: 139212
  Synthetic Polynucleotide

SEQ ID NO: 139338 - DNA, 103 bp, Artificial Sequence; identical to SEQ ID NO: 139213
  Synthetic Polynucleotide

SEQ ID NO: 139339 - DNA, 103 bp, Artificial Sequence; identical to SEQ ID NO: 139214
  Synthetic Polynucleotide

SEQ ID NO: 139340 - DNA, 103 bp, Artificial Sequence; identical to SEQ ID NO: 139215
  Synthetic Polynucleotide

SEQ ID NO: 139341 - DNA, 103 bp, Artificial Sequence; identical to SEQ ID NO: 139216
  Synthetic Polynucleotide

SEQ ID NO: 139342 - DNA, 103 bp, Artificial Sequence; identical to SEQ ID NO: 139217
  Synthetic Polynucleotide

SEQ ID NO: 139343 - DNA, 103 bp, Artificial Sequence; identical to SEQ ID NO: 139218
  Synthetic Polynucleotide

SEQ ID NO: 139344 - DNA, 103 bp, Artificial Sequence; identical to SEQ ID NO: 139219
  Synthetic Polynucleotide

SEQ ID NO: 139345 - DNA, 103 bp, Artificial Sequence; identical to SEQ ID NO: 139220
  Synthetic Polynucleotide

SEQ ID NO: 139346 - DNA, 103 bp, Artificial Sequence; identical to SEQ ID NO: 139221
  Synthetic Polynucleotide

SEQ ID NO: 139347 - DNA, 103 bp, Artificial Sequence; identical to SEQ ID NO: 139222
  Synthetic Polynucleotide

SEQ ID NO: 139348 - DNA, 103 bp, Artificial Sequence; identical to SEQ ID NO: 139223
  Synthetic Polynucleotide

SEQ ID NO: 139349 - DNA, 103 bp, Artificial Sequence; identical to SEQ ID NO: 139224
  Synthetic Polynucleotide

SEQ ID NO: 139350 - DNA, 103 bp, Artificial Sequence; identical to SEQ ID NO: 139225
  Synthetic Polynucleotide

SEQ ID NO: 139351 - DNA, 103 bp, Artificial Sequence; identical to SEQ ID NO: 139226
  Synthetic Polynucleotide

SEQ ID NO: 139352 - DNA, 103 bp, Artificial Sequence; identical to SEQ ID NO: 139227
  Synthetic Polynucleotide

SEQ ID NO: 139353 - DNA, 103 bp, Artificial Sequence; identical to SEQ ID NO: 139228
  Synthetic Polynucleotide

SEQ ID NO: 139354 - DNA, 103 bp, Artificial Sequence; identical to SEQ ID NO: 139229
  Synthetic Polynucleotide

SEQ ID NO: 139355 - DNA, 103 bp, Artificial Sequence; identical to SEQ ID NO: 139230
  Synthetic Polynucleotide

SEQ ID NO: 139356 - DNA, 103 bp, Artificial Sequence; identical to SEQ ID NO: 139231
  Synthetic Polynucleotide

SEQ ID NO: 139357 - DNA, 103 bp, Artificial Sequence; identical to SEQ ID NO: 139232
  Synthetic Polynucleotide

SEQ ID NO: 139358 - DNA, 103 bp, Artificial Sequence; identical to SEQ ID NO: 139233
  Synthetic Polynucleotide

SEQ ID NO: 139359 - DNA, 103 bp, Artificial Sequence; identical to SEQ ID NO: 139234
  Synthetic Polynucleotide

SEQ ID NO: 139360 - DNA, 103 bp, Artificial Sequence; identical to SEQ ID NO: 139235
  Synthetic Polynucleotide

SEQ ID NO: 139361 - DNA, 103 bp, Artificial Sequence; identical to SEQ ID NO: 139236
  Synthetic Polynucleotide

SEQ ID NO: 139362 - DNA, 103 bp, Artificial Sequence; identical to SEQ ID NO: 139237
  Synthetic Polynucleotide

SEQ ID NO: 139363 - DNA, 103 bp, Artificial Sequence; identical to SEQ ID NO: 139238
  Synthetic Polynucleotide

SEQ ID NO: 139364 - DNA, 103 bp, Artificial Sequence; identical to SEQ ID NO: 139239
  Synthetic Polynucleotide

SEQ ID NO: 139365 - DNA, 103 bp, Artificial Sequence; identical to SEQ ID NO: 139240
  Synthetic Polynucleotide

SEQ ID NO: 139366 - DNA, 103 bp, Artificial Sequence; identical to SEQ ID NO: 139241
  Synthetic Polynucleotide

SEQ ID NO: 139367 - DNA, 103 bp, Artificial Sequence; identical to SEQ ID NO: 139242
  Synthetic Polynucleotide

SEQ ID NO: 139368 - DNA, 103 bp, Artificial Sequence; identical to SEQ ID NO: 139243
  Synthetic Polynucleotide

SEQ ID NO: 139369 - DNA, 103 bp, Artificial Sequence; identical to SEQ ID NO: 139244
  Synthetic Polynucleotide

SEQ ID NO: 139370 - DNA, 103 bp, Artificial Sequence; identical to SEQ ID NO: 139245
  Synthetic Polynucleotide

SEQ ID NO: 139371 - DNA, 103 bp, Artificial Sequence; identical to SEQ ID NO: 139246
  Synthetic Polynucleotide

SEQ ID NO: 139372 - DNA, 103 bp, Artificial Sequence
  Synthetic Polynucleotide
taatacgactcactatagggatattcctgttcagtgttctgactcgccataacagaggagaatggcgatgcagaacactaacctggcggcagcgcaaaagatg

SEQ ID NO: 139373 - DNA, 103 bp, Artificial Sequence
  Synthetic Polynucleotide
taatacgactcactatagggctcgctggaatctggatttggatcaggtgaaacagaggagatcacctatgccaaatccaaacctggcggcagcgcaaaagatg

SEQ ID NO: 139374 - DNA, 103 bp, Artificial Sequence
  Synthetic Polynucleotide
taatacgactcactatagggtgtccaaaacctcgctggaatctggatttgaacagaggagacaaatcatgattccagcgaacctggcggcagcgcaaaagatg

SEQ ID NO: 139375 - DNA, 103 bp, Artificial Sequence
  Synthetic Polynucleotide
taatacgactcactatagggtcctcgtgcctgtccaaaacctcgctggaaaacagaggagattccagatgggttttggaaacctggcggcagcgcaaaagatg

SEQ ID NO: 139376 - DNA, 103 bp, Artificial Sequence
  Synthetic Polynucleotide
taatacgactcactatagggcatggcttggtcctcgtgcctgtccaaaacaacagaggagagttttgatgaggcacgagaacctggcggcagcgcaaaagatg

SEQ ID NO: 139377 - DNA, 103 bp, Artificial Sequence
  Synthetic Polynucleotide
taatacgactcactataggggatcttggctcatggcttggtcctcgtgccaacagaggagaggcacgatgaccaagccaaacctggcggcagcgcaaaagatg

SEQ ID NO: 139378 - DNA, 103 bp, Artificial Sequence
  Synthetic Polynucleotide
taatacgactcactatagggtgggagcctggatcttggctcatggcttggaacagaggagaccaagcatggagccaagaaacctggcggcagcgcaaaagatg

SEQ ID NO: 139379 - DNA, 103 bp, Artificial Sequence
  Synthetic Polynucleotide
taatacgactcactatagggtgagttatcttgggagcctggatcttggctaacagaggagaagccaaatgccaggctccaacctggcggcagcgcaaaagatg

SEQ ID NO: 139380 - DNA, 103 bp, Artificial Sequence
  Synthetic Polynucleotide
taatacgactcactatagggcttctggtggtgagttatcttgggagcctgaacagaggagacaggctatgaagataactaacctggcggcagcgcaaaagatg

SEQ ID NO: 139381 - DNA, 103 bp, Artificial Sequence
  Synthetic Polynucleotide
taatacgactcactatagggtggtttcggtcttctggtggtgagttatctaacagaggagaagataaatgaccaccagaaacctggcggcagcgcaaaagatg

SEQ ID NO: 139382 - DNA, 103 bp, Artificial Sequence
  Synthetic Polynucleotide
taatacgactcactataggggaccacgcgttggtttcggtcttctggtggaacagaggagaccaccaatggaccgaaacaacctggcggcagcgcaaaagatg

SEQ ID NO: 139383 - DNA, 103 bp, Artificial Sequence
  Synthetic Polynucleotide
taatacgactcactataggggcttggcttcatattcctgttcagtgttctaacagaggagaagaacaatgaacaggaataacctggcggcagcgcaaaagatg

SEQ ID NO: 139384 - DNA, 103 bp, Artificial Sequence
  Synthetic Polynucleotide
taatacgactcactatagggcttccacgttgaccacgcgttggtttcggtaacagaggagaaccgaaatgaacgcgtggaacctggcggcagcgcaaaagatg

SEQ ID NO: 139385 - DNA, 103 bp, Artificial Sequence
  Synthetic Polynucleotide
taatacgactcactatagggttgtggttgtcttccacgttgaccacgcgtaacagaggagaacgcgtatgcaacgtggaaacctggcggcagcgcaaaagatg

SEQ ID NO: 139386 - DNA, 103 bp, Artificial Sequence
  Synthetic Polynucleotide
taatacgactcactatagggcctaaaaaggttgtggttgtcttccacgttaacagaggagaaacgtgatggacaaccacaacctggcggcagcgcaaaagatg

SEQ ID NO: 139387 - DNA, 103 bp, Artificial Sequence
  Synthetic Polynucleotide
taatacgactcactatagggggaaggagagcctaaaaaggttgtggttgtaacagaggagaacaaccatgacctttttaaacctggcggcagcgcaaaagatg

SEQ ID NO: 139388 - DNA, 103 bp, Artificial Sequence
  Synthetic Polynucleotide
taatacgactcactatagggagctttcttgggaaggagagcctaaaaaggaacagaggagaccttttatggctctccttaacctggcggcagcgcaaaagatg

SEQ ID NO: 139389 - DNA, 103 bp, Artificial Sequence
  Synthetic Polynucleotide
taatacgactcactatagggaatcgtccaaagctttcttgggaaggagagaacagaggagactctccatgccaagaaagaacctggcggcagcgcaaaagatg

SEQ ID NO: 139390 - DNA, 103 bp, Artificial Sequence
  Synthetic Polynucleotide
taatacgactcactatagggcttcctccacaatcgtccaaagctttcttgaacagaggagacaagaaatgtttggacgaaacctggcggcagcgcaaaagatg

SEQ ID NO: 139391 - DNA, 103 bp, Artificial Sequence
  Synthetic Polynucleotide
taatacgactcactatagggttgaatgtgtcttcctccacaatcgtccaaaacagaggagattggacatgtgtggaggaaacctggcggcagcgcaaaagatg

SEQ ID NO: 139392 - DNA, 103 bp, Artificial Sequence
  Synthetic Polynucleotide
taatacgactcactataggggctcacagacttgaatgtgtcttcctccacaacagaggagagtggagatggacacattcaacctggcggcagcgcaaaagatg

SEQ ID NO: 139393 - DNA, 103 bp, Artificial Sequence
  Synthetic Polynucleotide
taatacgactcactatagggcatcgttccagctcacagacttgaatgtgtaacagaggagaacacatatgagtctgtgaaacctggcggcagcgcaaaagatg

SEQ ID NO: 139394 - DNA, 103 bp, Artificial Sequence
  Synthetic Polynucleotide
taatacgactcactataggggatggggccagcttggcttcatattcctgtaacagaggagaacaggaatgtgaagccaaaacctggcggcagcgcaaaagatg

SEQ ID NO: 139395 - DNA, 103 bp, Artificial Sequence
  Synthetic Polynucleotide
taatacgactcactataggggcgtctccatcatcgttccagctcacagacaacagaggagagtctgtatgctggaacgaaacctggcggcagcgcaaaagatg

SEQ ID NO: 139396 - DNA, 103 bp, Artificial Sequence
  Synthetic Polynucleotide
taatacgactcactataggggatgatcacggcgtctccatcatcgttccaaacagaggagatggaacatggatggagacaacctggcggcagcgcaaaagatg

SEQ ID NO: 139397 - DNA, 103 bp, Artificial Sequence
  Synthetic Polynucleotide
taatacgactcactataggggatccttgtcgatgatcacggcgtctccataacagaggagaatggagatgccgtgatcaaacctggcggcagcgcaaaagatg

SEQ ID NO: 139398 - DNA, 103 bp, Artificial Sequence
  Synthetic Polynucleotide
taatacgactcactatagggctctggaagagatccttgtcgatgatcacgaacagaggagacgtgatatgcgacaaggaaacctggcggcagcgcaaaagatg

SEQ ID NO: 139399 - DNA, 103 bp, Artificial Sequence
  Synthetic Polynucleotide
taatacgactcactatagggaagaacctccctctggaagagatccttgtcaacagaggagagacaagatgctcttccagaacctggcggcagcgcaaaagatg

SEQ ID NO: 139400 - DNA, 103 bp, Artificial Sequence
  Synthetic Polynucleotide
taatacgactcactatagggctttccgttgaagaacctccctctggaagaaacagaggagatcttccatggggaggttcaacctggcggcagcgcaaaagatg

SEQ ID NO: 139401 - DNA, 103 bp, Artificial Sequence
  Synthetic Polynucleotide
taatacgactcactatagggctctctgcacctttccgttgaagaacctccaacagaggagaggaggtatgtcaacggaaaacctggcggcagcgcaaaagatg

SEQ ID NO: 139402 - DNA, 103 bp, Artificial Sequence
  Synthetic Polynucleotide
taatacgactcactatagggtttgaagatcctctctgcacctttccgttgaacagaggagacaacggatgggtgcagagaacctggcggcagcgcaaaagatg

SEQ ID NO: 139403 - DNA, 103 bp, Artificial Sequence
  Synthetic Polynucleotide
taatacgactcactatagggagctgtctgttttgaagatcctctctgcacaacagaggagagtgcagatgggatcttcaaacctggcggcagcgcaaaagatg

SEQ ID NO: 139404 - DNA, 103 bp, Artificial Sequence
  Synthetic Polynucleotide
taatacgactcactatagggaaactcgtcaagctgtctgttttgaagatcaacagaggagagatcttatgaacagacagaacctggcggcagcgcaaaagatg

SEQ ID NO: 139405 - DNA, 103 bp, Artificial Sequence
  Synthetic Polynucleotide
taatacgactcactatagggtccaccaacagatggggccagcttggcttcaacagaggagagaagccatgctggccccaaacctggcggcagcgcaaaagatg

SEQ ID NO: 139406 - DNA, 103 bp, Artificial Sequence
  Synthetic Polynucleotide
taatacgactcactatagggctggcgaatgaaactcgtcaagctgtctgtaacagaggagaacagacatgttgacgagtaacctggcggcagcgcaaaagatg

SEQ ID NO: 139407 - DNA, 103 bp, Artificial Sequence
  Synthetic Polynucleotide
taatacgactcactatagggagaggttcagctggcgaatgaaactcgtcaaacagaggagatgacgaatgtcattcgccaacctggcggcagcgcaaaagatg

SEQ ID NO: 139408 - DNA, 103 bp, Artificial Sequence
  Synthetic Polynucleotide
taatacgactcactatagggcagaatccatagaggttcagctggcgaatgaacagaggagacattcgatggctgaacctaacctggcggcagcgcaaaagatg

SEQ ID NO: 139409 - DNA, 103 bp, Artificial Sequence
  Synthetic Polynucleotide
taatacgactcactataggggcgtgttttgcagaatccatagaggttcagaacagaggagactgaacatgtatggattcaacctggcggcagcgcaaaagatg

SEQ ID NO: 139410 - DNA, 103 bp, Artificial Sequence
  Synthetic Polynucleotide
taatacgactcactatagggagttgcttgggcgtgttttgcagaatccataacagaggagaatggatatggcaaaacacaacctggcggcagcgcaaaagatg

SEQ ID NO: 139411 - DNA, 103 bp, Artificial Sequence
  Synthetic Polynucleotide
taatacgactcactatagggtttcctggagagttgcttgggcgtgttttgaacagaggagacaaaacatgcccaagcaaaacctggcggcagcgcaaaagatg

SEQ ID NO: 139412 - DNA, 103 bp, Artificial Sequence
  Synthetic Polynucleotide
taatacgactcactatagggcattttcttgtttcctggagagttgcttggaacagaggagaccaagcatgtctccaggaaacctggcggcagcgcaaaagatg

SEQ ID NO: 139413 - DNA, 103 bp, Artificial Sequence
  Synthetic Polynucleotide
taatacgactcactatagggagtagatcatcattttcttgtttcctggagaacagaggagactccagatgacaagaaaaaacctggcggcagcgcaaaagatg

SEQ ID NO: 139414 - DNA, 103 bp, Artificial Sequence
  Synthetic Polynucleotide
taatacgactcactatagggttggagttgcagtagatcatcattttcttgaacagaggagacaagaaatggatgatctaaacctggcggcagcgcaaaagatg

SEQ ID NO: 139415 - DNA, 103 bp, Artificial Sequence
  Synthetic Polynucleotide
taatacgactcactatagggtctctgaaaattggagttgcagtagatcataacagaggagaatgatcatgtgcaactccaacctggcggcagcgcaaaagatg

SEQ ID NO: 139416 - DNA, 103 bp, Artificial Sequence
  Synthetic Polynucleotide
taatacgactcactatagggttgttggctctccaccaacagatggggccaaacagaggagatggcccatgctgttggtgaacctggcggcagcgcaaaagatg

SEQ ID NO: 139417 - DNA, 103 bp, Artificial Sequence
  Synthetic Polynucleotide
taatacgactcactatagggtgggcttgtctctctgaaaattggagttgcaacagaggagagcaactatgattttcagaaacctggcggcagcgcaaaagatg

SEQ ID NO: 139418 - DNA, 103 bp, Artificial Sequence
  Synthetic Polynucleotide
taatacgactcactatagggtccaggagcctgggcttgtctctctgaaaaaacagaggagattttcaatgagacaagccaacctggcggcagcgcaaaagatg

SEQ ID NO: 139419 - DNA, 103 bp, Artificial Sequence
  Synthetic Polynucleotide
taatacgactcactatagggctggatattctccaggagcctgggcttgtcaacagaggagagacaagatgaggctcctgaacctggcggcagcgcaaaagatg

SEQ ID NO: 139420 - DNA, 103 bp, Artificial Sequence
  Synthetic Polynucleotide
taatacgactcactatagggcatcctttctctggatattctccaggagccaacagaggagaggctccatgagaatatccaacctggcggcagcgcaaaagatg

SEQ ID NO: 139421 - DNA, 103 bp, Artificial Sequence
  Synthetic Polynucleotide
taatacgactcactatagggtttctgagggcatcctttctctggatattcaacagaggagagaatatatggagaaaggaaacctggcggcagcgcaaaagatg

SEQ ID NO: 139422 - DNA, 103 bp, Artificial Sequence
  Synthetic Polynucleotide
taatacgactcactatagggctgagcggtgtttctgagggcatcctttctaacagaggagaagaaagatggccctcagaaacctggcggcagcgcaaaagatg

SEQ ID NO: 139423 - DNA, 103 bp, Artificial Sequence
  Synthetic Polynucleotide
taatacgactcactataggggggtcgcttgctgagcggtgtttctgagggaacagaggagaccctcaatgacaccgctcaacctggcggcagcgcaaaagatg

SEQ ID NO: 139424 - DNA, 103 bp, Artificial Sequence
  Synthetic Polynucleotide
taatacgactcactataggggttgggacacgggtcgcttgctgagcggtgaacagaggagacaccgcatggcaagcgacaacctggcggcagcgcaaaagatg

SEQ ID NO: 139425 - DNA, 103 bp, Artificial Sequence
  Synthetic Polynucleotide
taatacgactcactatagggtctctttggagttgggacacgggtcgcttgaacagaggagacaagcgatgcgtgtcccaaacctggcggcagcgcaaaagatg

SEQ ID NO: 139426 - DNA, 103 bp, Artificial Sequence
  Synthetic Polynucleotide
taatacgactcactatagggccagattctttctctttggagttgggacacaacagaggagagtgtccatgctccaaagaaacctggcggcagcgcaaaagatg

SEQ ID NO: 139427 - DNA, 103 bp, Artificial Sequence
  Synthetic Polynucleotide
taatacgactcactataggggggcccccgcttgttggctctccaccaacaaacagaggagatgttggatgagagccaacaacctggcggcagcgcaaaagatg

SEQ ID NO: 139428 - DNA, 103 bp, Artificial Sequence
  Synthetic Polynucleotide
taatacgactcactatagggcttgtagctaccagattctttctctttggaaacagaggagatccaaaatgaaagaatctaacctggcggcagcgcaaaagatg

SEQ ID NO: 139429 - DNA, 103 bp, Artificial Sequence
  Synthetic Polynucleotide
taatacgactcactatagggtagggagcgtcttgtagctaccagattcttaacagaggagaaagaatatggtagctacaaacctggcggcagcgcaaaagatg

SEQ ID NO: 139430 - DNA, 103 bp, Artificial Sequence
  Synthetic Polynucleotide
taatacgactcactataggggatagatacgtagggagcgtcttgtagctaaacagaggagatagctaatggacgctcccaacctggcggcagcgcaaaagatg

SEQ ID NO: 139431 - DNA, 103 bp, Artificial Sequence
  Synthetic Polynucleotide
taatacgactcactataggggcattgatgtgatagatacgtagggagcgtaacagaggagaacgctcatgacgtatctaaacctggcggcagcgcaaaagatg

SEQ ID NO: 139432 - DNA, 103 bp, Artificial Sequence
  Synthetic Polynucleotide
taatacgactcactatagggttctttcctggcattgatgtgatagatacgaacagaggagacgtatcatgcacatcaataacctggcggcagcgcaaaagatg

SEQ ID NO: 139433 - DNA, 103 bp, Artificial Sequence
  Synthetic Polynucleotide
taatacgactcactatagggttttgattgcttctttcctggcattgatgtaacagaggagaacatcaatgccaggaaagaacctggcggcagcgcaaaagatg

SEQ ID NO: 139434 - DNA, 103 bp, Artificial Sequence
  Synthetic Polynucleotide
taatacgactcactatagggtgctgacacattttgattgcttctttcctgaacagaggagacaggaaatgagcaatcaaaacctggcggcagcgcaaaagatg

SEQ ID NO: 139435 - DNA, 103 bp, Artificial Sequence
  Synthetic Polynucleotide
taatacgactcactataggggggggctccctgctgacacattttgattgcaacagaggagagcaatcatgatgtgtcagaacctggcggcagcgcaaaagatg

SEQ ID NO: 139436 - DNA, 103 bp, Artificial Sequence
  Synthetic Polynucleotide
taatacgactcactatagggcctgaacactgggggctccctgctgacacaaacagaggagatgtgtcatgagggagcccaacctggcggcagcgcaaaagatg

SEQ ID NO: 139437 - DNA, 103 bp, Artificial Sequence
  Synthetic Polynucleotide
taatacgactcactatagggccactgggcccctgaacactgggggctcccaacagaggagagggagcatgcagtgttcaaacctggcggcagcgcaaaagatg

SEQ ID NO: 139438 - DNA, 103 bp, Artificial Sequence
  Synthetic Polynucleotide
taatacgactcactatagggagaaccagatgggcccccgcttgttggctcaacagaggagagagccaatgagcgggggcaacctggcggcagcgcaaaagatg

SEQ ID NO: 139439 - DNA, 103 bp, Artificial Sequence
  Synthetic Polynucleotide
taatacgactcactatagggggactgggtgccactgggcccctgaacactaacagaggagaagtgttatggggcccagtaacctggcggcagcgcaaaagatg

SEQ ID NO: 139440 - DNA, 103 bp, Artificial Sequence
  Synthetic Polynucleotide
taatacgactcactatagggagcgcctgaaggactgggtgccactgggccaacagaggagaggcccaatggcacccagtaacctggcggcagcgcaaaagatg

SEQ ID NO: 139441 - DNA, 103 bp, Artificial Sequence
  Synthetic Polynucleotide
taatacgactcactatagggcacatgccagagcgcctgaaggactgggtgaacagaggagacacccaatgcttcaggcgaacctggcggcagcgcaaaagatg

SEQ ID NO: 139442 - DNA, 103 bp, Artificial Sequence
  Synthetic Polynucleotide
taatacgactcactatagggcttcttggaccacatgccagagcgcctgaaaacagaggagattcaggatgtctggcatgaacctggcggcagcgcaaaagatg

SEQ ID NO: 139443 - DNA, 103 bp, Artificial Sequence
  Synthetic Polynucleotide
taatacgactcactatagggtagtggcactcttcttggaccacatgccagaacagaggagactggcaatgggtccaagaaacctggcggcagcgcaaaagatg

SEQ ID NO: 139444 - DNA, 103 bp, Artificial Sequence
  Synthetic Polynucleotide
taatacgactcactatagggaggggatgcctagtggcactcttcttggacaacagaggagagtccaaatggagtgccacaacctggcggcagcgcaaaagatg

SEQ ID NO: 139445 - DNA, 103 bp, Artificial Sequence
  Synthetic Polynucleotide
taatacgactcactatagggcccatttcccaggggatgcctagtggcactaacagaggagaagtgccatgaggcatcccaacctggcggcagcgcaaaagatg

SEQ ID NO: 139446 - DNA, 103 bp, Artificial Sequence
  Synthetic Polynucleotide
taatacgactcactatagggcctgagggggcccatttcccaggggatgccaacagaggagaggcatcatgtgggaaatgaacctggcggcagcgcaaaagatg

SEQ ID NO: 139447 - DNA, 103 bp, Artificial Sequence
  Synthetic Polynucleotide
taatacgactcactatagggccatttggttcctgagggggcccatttcccaacagaggagagggaaaatggccccctcaaacctggcggcagcgcaaaagatg

SEQ ID NO: 139448 - DNA, 103 bp, Artificial Sequence
  Synthetic Polynucleotide
taatacgactcactatagggccaacttgggccatttggttcctgagggggaacagaggagaccccctatggaaccaaataacctggcggcagcgcaaaagatg

SEQ ID NO: 139449 - DNA, 103 bp, Artificial Sequence
  Synthetic Polynucleotide
taatacgactcactataggggatcaggtgaagaaccagatgggcccccgcaacagaggagagcggggatgcatctggttaacctggcggcagcgcaaaagatg

SEQ ID NO: 139450 - DNA, 103 bp, Artificial Sequence
  Synthetic Polynucleotide
taatacgactcactatagggaggtgccctcccaacttgggccatttggttaacagaggagaaaccaaatggcccaagttaacctggcggcagcgcaaaagatg

SEQ ID NO: 139451 - DNA, 103 bp, Artificial Sequence
  Synthetic Polynucleotide
taatacgactcactatagggacattcccagaggtgccctcccaacttgggaacagaggagacccaagatgggagggcacaacctggcggcagcgcaaaagatg

SEQ ID NO: 139452 - DNA, 103 bp, Artificial Sequence
  Synthetic Polynucleotide
taatacgactcactatagggtgtaaatgtgacattcccagaggtgccctcaacagaggagagagggcatgtctgggaataacctggcggcagcgcaaaagatg

SEQ ID NO: 139453 - DNA, 103 bp, Artificial Sequence
  Synthetic Polynucleotide
taatacgactcactatagggtagccgaagatgtaaatgtgacattcccagaacagaggagactgggaatgtcacatttaaacctggcggcagcgcaaaagatg

SEQ ID NO: 139454 - DNA, 103 bp, Artificial Sequence
  Synthetic Polynucleotide
taatacgactcactatagggatccaggtagtagccgaagatgtaaatgtgaacagaggagacacattatgatcttcggcaacctggcggcagcgcaaaagatg

SEQ ID NO: 139455 - DNA, 103 bp, Artificial Sequence
  Synthetic Polynucleotide
taatacgactcactatagggtgtgccttccatccaggtagtagccgaagaaacagaggagatcttcgatgactacctggaacctggcggcagcgcaaaagatg

SEQ ID NO: 139456 - DNA, 103 bp, Artificial Sequence
  Synthetic Polynucleotide
taatacgactcactatagggtaagaatccctgtgccttccatccaggtagaacagaggagactacctatgtggaaggcaaacctggcggcagcgcaaaagatg

SEQ ID NO: 139457 - DNA, 103 bp, Artificial Sequence
  Synthetic Polynucleotide
taatacgactcactatagggaccagactactaagaatccctgtgccttccaacagaggagaggaaggatgagggattctaacctggcggcagcgcaaaagatg

SEQ ID NO: 139458 - DNA, 103 bp, Artificial Sequence
  Synthetic Polynucleotide
taatacgactcactatagggatctgagtaaaccagactactaagaatcccaacagaggagagggattatgagtagtctgaacctggcggcagcgcaaaagatg

SEQ ID NO: 139459 - DNA, 103 bp, Artificial Sequence
  Synthetic Polynucleotide
taatacgactcactatagggcactaccattatctgagtaaaccagactacaacagaggagagtagtcatgtttactcagaacctggcggcagcgcaaaagatg

SEQ ID NO: 139460 - DNA, 103 bp, Artificial Sequence
  Synthetic Polynucleotide
taatacgactcactatagggtctggatttggatcaggtgaagaaccagataacagaggagaatctggatgttcacctgaaacctggcggcagcgcaaaagatg

SEQ ID NO: 139461 - DNA, 103 bp, Artificial Sequence
  Synthetic Polynucleotide
taatacgactcactatagggaaagacattacactaccattatctgagtaaaacagaggagattactcatgtaatggtagaacctggcggcagcgcaaaagatg

SEQ ID NO: 139462 - DNA, 103 bp, Artificial Sequence
  Synthetic Polynucleotide
taatacgactcactataggggatattgtacaaagacattacactaccattaacagaggagaaatggtatggtaatgtctaacctggcggcagcgcaaaagatg

SEQ ID NO: 139463 - DNA, 103 bp, Artificial Sequence
  Synthetic Polynucleotide
taatacgactcactatagggcatagtaacagatattgtacaaagacattaaacagaggagataatgtatgtgtacaataaacctggcggcagcgcaaaagatg

SEQ ID NO: 139464 - DNA, 103 bp, Artificial Sequence
  Synthetic Polynucleotide
taatacgactcactataggggccaacagagcatagtaacagatattgtacaacagaggagagtacaaatgctgttactaaacctggcggcagcgcaaaagatg

SEQ ID NO: 139465 - DNA, 103 bp, Artificial Sequence
  Synthetic Polynucleotide
taatacgactcactatagggtgagagggaggccaacagagcatagtaacaaacagaggagatgttacatggctctgttgaacctggcggcagcgcaaaagatg

SEQ ID NO: 139466 - DNA, 103 bp, Artificial Sequence
  Synthetic Polynucleotide
taatacgactcactataggggagacatgactgagagggaggccaacagagaacagaggagactctgtatgcctccctctaacctggcggcagcgcaaaagatg

SEQ ID NO: 139467 - DNA, 103 bp, Artificial Sequence
  Synthetic Polynucleotide
taatacgactcactatagggggctcatttggagacatgactgagagggagaacagaggagactccctatgagtcatgtcaacctggcggcagcgcaaaagatg

SEQ ID NO: 139468 - DNA, 103 bp, Artificial Sequence
  Synthetic Polynucleotide
taatacgactcactatagggatcgtcagagggctcatttggagacatgacaacagaggagagtcatgatgccaaatgagaacctggcggcagcgcaaaagatg

SEQ ID NO: 139469 - DNA, 103 bp, Artificial Sequence
  Synthetic Polynucleotide
taatacgactcactatagggactcctcctcatcgtcagagggctcatttgaacagaggagacaaatgatgcctctgacgaacctggcggcagcgcaaaagatg

SEQ ID NO: 139470 - DNA, 103 bp, Artificial Sequence; identical to SEQ ID NO: 139372
  Synthetic Polynucleotide

SEQ ID NO: 139471 - DNA, 103 bp, Artificial Sequence; identical to SEQ ID NO: 139373
  Synthetic Polynucleotide

SEQ ID NO: 139472 - DNA, 103 bp, Artificial Sequence; identical to SEQ ID NO: 139374
  Synthetic Polynucleotide

SEQ ID NO: 139473 - DNA, 103 bp, Artificial Sequence; identical to SEQ ID NO: 139375
  Synthetic Polynucleotide

SEQ ID NO: 139474 - DNA, 103 bp, Artificial Sequence; identical to SEQ ID NO: 139376
  Synthetic Polynucleotide

SEQ ID NO: 139475 - DNA, 103 bp, Artificial Sequence; identical to SEQ ID NO: 139377
  Synthetic Polynucleotide

SEQ ID NO: 139476 - DNA, 103 bp, Artificial Sequence; identical to SEQ ID NO: 139378
  Synthetic Polynucleotide

SEQ ID NO: 139477 - DNA, 103 bp, Artificial Sequence; identical to SEQ ID NO: 139379
  Synthetic Polynucleotide

SEQ ID NO: 139478 - DNA, 103 bp, Artificial Sequence; identical to SEQ ID NO: 139380
  Synthetic Polynucleotide

SEQ ID NO: 139479 - DNA, 103 bp, Artificial Sequence; identical to SEQ ID NO: 139381
  Synthetic Polynucleotide

SEQ ID NO: 139480 - DNA, 103 bp, Artificial Sequence; identical to SEQ ID NO: 139382
  Synthetic Polynucleotide

SEQ ID NO: 139481 - DNA, 103 bp, Artificial Sequence; identical to SEQ ID NO: 139383
  Synthetic Polynucleotide

SEQ ID NO: 139482 - DNA, 103 bp, Artificial Sequence; identical to SEQ ID NO: 139384
  Synthetic Polynucleotide

SEQ ID NO: 139483 - DNA, 103 bp, Artificial Sequence; identical to SEQ ID NO: 139385
  Synthetic Polynucleotide

SEQ ID NO: 139484 - DNA, 103 bp, Artificial Sequence; identical to SEQ ID NO: 139386
  Synthetic Polynucleotide

SEQ ID NO: 139485 - DNA, 103 bp, Artificial Sequence; identical to SEQ ID NO: 139387
  Synthetic Polynucleotide

SEQ ID NO: 139486 - DNA, 103 bp, Artificial Sequence; identical to SEQ ID NO: 139388
  Synthetic Polynucleotide

SEQ ID NO: 139487 - DNA, 103 bp, Artificial Sequence; identical to SEQ ID NO: 139389
  Synthetic Polynucleotide

SEQ ID NO: 139488 - DNA, 103 bp, Artificial Sequence; identical to SEQ ID NO: 139390
  Synthetic Polynucleotide

SEQ ID NO: 139489 - DNA, 103 bp, Artificial Sequence; identical to SEQ ID NO: 139391
  Synthetic Polynucleotide

SEQ ID NO: 139490 - DNA, 103 bp, Artificial Sequence; identical to SEQ ID NO: 139392
  Synthetic Polynucleotide

SEQ ID NO: 139491 - DNA, 103 bp, Artificial Sequence; identical to SEQ ID NO: 139393
  Synthetic Polynucleotide

SEQ ID NO: 139492 - DNA, 103 bp, Artificial Sequence; identical to SEQ ID NO: 139394
  Synthetic Polynucleotide

SEQ ID NO: 139493 - DNA, 103 bp, Artificial Sequence; identical to SEQ ID NO: 139395
  Synthetic Polynucleotide

SEQ ID NO: 139494 - DNA, 103 bp, Artificial Sequence; identical to SEQ ID NO: 139396
  Synthetic Polynucleotide

SEQ ID NO: 139495 - DNA, 103 bp, Artificial Sequence; identical to SEQ ID NO: 139397
  Synthetic Polynucleotide

SEQ ID NO: 139496 - DNA, 103 bp, Artificial Sequence; identical to SEQ ID NO: 139398
  Synthetic Polynucleotide

SEQ ID NO: 139497 - DNA, 103 bp, Artificial Sequence; identical to SEQ ID NO: 139399
  Synthetic Polynucleotide

SEQ ID NO: 139498 - DNA, 103 bp, Artificial Sequence; identical to SEQ ID NO: 139400
  Synthetic Polynucleotide

SEQ ID NO: 139499 - DNA, 103 bp, Artificial Sequence; identical to SEQ ID NO: 139401
  Synthetic Polynucleotide

SEQ ID NO: 139500 - DNA, 103 bp, Artificial Sequence; identical to SEQ ID NO: 139402
  Synthetic Polynucleotide

SEQ ID NO: 139501 - DNA, 103 bp, Artificial Sequence
  Synthetic Polynucleotide
taatacgactcactatagggagttgtctgttttgaagatcctctctgcacaacagaggagagtgcagatgggatcttcaaacctggcggcagcgcaaaagatg

SEQ ID NO: 139502 - DNA, 103 bp, Artificial Sequence
  Synthetic Polynucleotide
taatacgactcactatagggaaactcgtcaagttgtctgttttgaagatcaacagaggagagatcttatgaacagacaaaacctggcggcagcgcaaaagatg

SEQ ID NO: 139503 - DNA, 103 bp, Artificial Sequence; identical to SEQ ID NO: 139405
  Synthetic Polynucleotide

SEQ ID NO: 139504 - DNA, 103 bp, Artificial Sequence
  Synthetic Polynucleotide
taatacgactcactatagggctggcgaatgaaactcgtcaagttgtctgtaacagaggagaacagacatgttgacgagtaacctggcggcagcgcaaaagatg

SEQ ID NO: 139505 - DNA, 103 bp, Artificial Sequence; identical to SEQ ID NO: 139407
  Synthetic Polynucleotide

SEQ ID NO: 139506 - DNA, 103 bp, Artificial Sequence; identical to SEQ ID NO: 139408
  Synthetic Polynucleotide

SEQ ID NO: 139507 - DNA, 103 bp, Artificial Sequence; identical to SEQ ID NO: 139409
  Synthetic Polynucleotide

SEQ ID NO: 139508 - DNA, 103 bp, Artificial Sequence; identical to SEQ ID NO: 139410
  Synthetic Polynucleotide

SEQ ID NO: 139509 - DNA, 103 bp, Artificial Sequence; identical to SEQ ID NO: 139411
  Synthetic Polynucleotide

SEQ ID NO: 139510 - DNA, 103 bp, Artificial Sequence; identical to SEQ ID NO: 139412
  Synthetic Polynucleotide

SEQ ID NO: 139511 - DNA, 103 bp, Artificial Sequence; identical to SEQ ID NO: 139413
  Synthetic Polynucleotide

SEQ ID NO: 139512 - DNA, 103 bp, Artificial Sequence; identical to SEQ ID NO: 139414
  Synthetic Polynucleotide

SEQ ID NO: 139513 - DNA, 103 bp, Artificial Sequence; identical to SEQ ID NO: 139415
  Synthetic Polynucleotide

SEQ ID NO: 139514 - DNA, 103 bp, Artificial Sequence; identical to SEQ ID NO: 139416
  Synthetic Polynucleotide

SEQ ID NO: 139515 - DNA, 103 bp, Artificial Sequence; identical to SEQ ID NO: 139417
  Synthetic Polynucleotide

SEQ ID NO: 139516 - DNA, 103 bp, Artificial Sequence; identical to SEQ ID NO: 139418
  Synthetic Polynucleotide

SEQ ID NO: 139517 - DNA, 103 bp, Artificial Sequence; identical to SEQ ID NO: 139419
  Synthetic Polynucleotide

SEQ ID NO: 139518 - DNA, 103 bp, Artificial Sequence; identical to SEQ ID NO: 139420
  Synthetic Polynucleotide

SEQ ID NO: 139519 - DNA, 103 bp, Artificial Sequence; identical to SEQ ID NO: 139421
  Synthetic Polynucleotide

SEQ ID NO: 139520 - DNA, 103 bp, Artificial Sequence; identical to SEQ ID NO: 139422
  Synthetic Polynucleotide

SEQ ID NO: 139521 - DNA, 103 bp, Artificial Sequence; identical to SEQ ID NO: 139423
  Synthetic Polynucleotide

SEQ ID NO: 139522 - DNA, 103 bp, Artificial Sequence; identical to SEQ ID NO: 139424
  Synthetic Polynucleotide

SEQ ID NO: 139523 - DNA, 103 bp, Artificial Sequence; identical to SEQ ID NO: 139425
  Synthetic Polynucleotide

SEQ ID NO: 139524 - DNA, 103 bp, Artificial Sequence; identical to SEQ ID NO: 139426
  Synthetic Polynucleotide

SEQ ID NO: 139525 - DNA, 103 bp, Artificial Sequence; identical to SEQ ID NO: 139427
  Synthetic Polynucleotide

SEQ ID NO: 139526 - DNA, 103 bp, Artificial Sequence; identical to SEQ ID NO: 139428
  Synthetic Polynucleotide

SEQ ID NO: 139527 - DNA, 103 bp, Artificial Sequence; identical to SEQ ID NO: 139429
  Synthetic Polynucleotide

SEQ ID NO: 139528 - DNA, 103 bp, Artificial Sequence; identical to SEQ ID NO: 139430
  Synthetic Polynucleotide

SEQ ID NO: 139529 - DNA, 103 bp, Artificial Sequence; identical to SEQ ID NO: 139431
  Synthetic Polynucleotide

SEQ ID NO: 139530 - DNA, 103 bp, Artificial Sequence; identical to SEQ ID NO: 139432
  Synthetic Polynucleotide

SEQ ID NO: 139531 - DNA, 103 bp, Artificial Sequence; identical to SEQ ID NO: 139433
  Synthetic Polynucleotide

SEQ ID NO: 139532 - DNA, 103 bp, Artificial Sequence; identical to SEQ ID NO: 139434
  Synthetic Polynucleotide

SEQ ID NO: 139533 - DNA, 103 bp, Artificial Sequence; identical to SEQ ID NO: 139435
  Synthetic Polynucleotide

SEQ ID NO: 139534 - DNA, 103 bp, Artificial Sequence; identical to SEQ ID NO: 139436
  Synthetic Polynucleotide

SEQ ID NO: 139535 - DNA, 103 bp, Artificial Sequence; identical to SEQ ID NO: 139437
  Synthetic Polynucleotide

SEQ ID NO: 139536 - DNA, 103 bp, Artificial Sequence; identical to SEQ ID NO: 139438
  Synthetic Polynucleotide

SEQ ID NO: 139537 - DNA, 103 bp, Artificial Sequence; identical to SEQ ID NO: 139439
  Synthetic Polynucleotide

SEQ ID NO: 139538 - DNA, 103 bp, Artificial Sequence; identical to SEQ ID NO: 139440
  Synthetic Polynucleotide

SEQ ID NO: 139539 - DNA, 103 bp, Artificial Sequence; identical to SEQ ID NO: 139441
  Synthetic Polynucleotide

SEQ ID NO: 139540 - DNA, 103 bp, Artificial Sequence; identical to SEQ ID NO: 139442
  Synthetic Polynucleotide

SEQ ID NO: 139541 - DNA, 103 bp, Artificial Sequence; identical to SEQ ID NO: 139443
  Synthetic Polynucleotide

SEQ ID NO: 139542 - DNA, 103 bp, Artificial Sequence; identical to SEQ ID NO: 139444
  Synthetic Polynucleotide

SEQ ID NO: 139543 - DNA, 103 bp, Artificial Sequence; identical to SEQ ID NO: 139445
  Synthetic Polynucleotide

SEQ ID NO: 139544 - DNA, 103 bp, Artificial Sequence; identical to SEQ ID NO: 139446
  Synthetic Polynucleotide

SEQ ID NO: 139545 - DNA, 103 bp, Artificial Sequence; identical to SEQ ID NO: 139447
  Synthetic Polynucleotide

SEQ ID NO: 139546 - DNA, 103 bp, Artificial Sequence; identical to SEQ ID NO: 139448
  Synthetic Polynucleotide

SEQ ID NO: 139547 - DNA, 103 bp, Artificial Sequence; identical to SEQ ID NO: 139449
  Synthetic Polynucleotide

SEQ ID NO: 139548 - DNA, 103 bp, Artificial Sequence; identical to SEQ ID NO: 139450
  Synthetic Polynucleotide

SEQ ID NO: 139549 - DNA, 103 bp, Artificial Sequence; identical to SEQ ID NO: 139451
  Synthetic Polynucleotide

SEQ ID NO: 139550 - DNA, 103 bp, Artificial Sequence; identical to SEQ ID NO: 139452
  Synthetic Polynucleotide

SEQ ID NO: 139551 - DNA, 103 bp, Artificial Sequence; identical to SEQ ID NO: 139453
  Synthetic Polynucleotide

SEQ ID NO: 139552 - DNA, 103 bp, Artificial Sequence; identical to SEQ ID NO: 139454
  Synthetic Polynucleotide

SEQ ID NO: 139553 - DNA, 103 bp, Artificial Sequence; identical to SEQ ID NO: 139455
  Synthetic Polynucleotide

SEQ ID NO: 139554 - DNA, 103 bp, Artificial Sequence; identical to SEQ ID NO: 139456
  Synthetic Polynucleotide

SEQ ID NO: 139555 - DNA, 103 bp, Artificial Sequence; identical to SEQ ID NO: 139457
  Synthetic Polynucleotide

SEQ ID NO: 139556 - DNA, 103 bp, Artificial Sequence; identical to SEQ ID NO: 139458
  Synthetic Polynucleotide

SEQ ID NO: 139557 - DNA, 103 bp, Artificial Sequence; identical to SEQ ID NO: 139459
  Synthetic Polynucleotide

SEQ ID NO: 139558 - DNA, 103 bp, Artificial Sequence; identical to SEQ ID NO: 139460
  Synthetic Polynucleotide

SEQ ID NO: 139559 - DNA, 103 bp, Artificial Sequence; identical to SEQ ID NO: 139461
  Synthetic Polynucleotide

SEQ ID NO: 139560 - DNA, 103 bp, Artificial Sequence; identical to SEQ ID NO: 139462
  Synthetic Polynucleotide

SEQ ID NO: 139561 - DNA, 103 bp, Artificial Sequence
  Synthetic Polynucleotide
taatacgactcactatagggcgtagtaacagatattgtacaaagacattaaacagaggagataatgtatgtgtacaataaacctggcggcagcgcaaaagatg

SEQ ID NO: 139562 - DNA, 103 bp, Artificial Sequence
  Synthetic Polynucleotide
taatacgactcactataggggccaacagagcgtagtaacagatattgtacaacagaggagagtacaaatgctgttactaaacctggcggcagcgcaaaagatg

SEQ ID NO: 139563 - DNA, 103 bp, Artificial Sequence
  Synthetic Polynucleotide
taatacgactcactatagggtgagagggaggccaacagagcgtagtaacaaacagaggagatgttacatggctctgttgaacctggcggcagcgcaaaagatg

SEQ ID NO: 139564 - DNA, 103 bp, Artificial Sequence; identical to SEQ ID NO: 139466
  Synthetic Polynucleotide

SEQ ID NO: 139565 - DNA, 103 bp, Artificial Sequence; identical to SEQ ID NO: 139467
  Synthetic Polynucleotide

SEQ ID NO: 139566 - DNA, 103 bp, Artificial Sequence; identical to SEQ ID NO: 139468
  Synthetic Polynucleotide

SEQ ID NO: 139567 - DNA, 103 bp, Artificial Sequence; identical to SEQ ID NO: 139469
  Synthetic Polynucleotide

SEQ ID NO: 139568 - DNA, 103 bp, Artificial Sequence
  Synthetic Polynucleotide
taatacgactcactatagggatcttgagtttctgaagaaacatgtgccataacagaggagaatggcaatggtttcttcaaacctggcggcagcgcaaaagatg

SEQ ID NO: 139569 - DNA, 103 bp, Artificial Sequence
  Synthetic Polynucleotide
taatacgactcactatagggccgtaagtctgagtccccagggaaggtgtgaacagaggagacacaccatgcctggggacaacctggcggcagcgcaaaagatg

SEQ ID NO: 139570 - DNA, 103 bp, Artificial Sequence
  Synthetic Polynucleotide
taatacgactcactatagggcaatcattgaccgtaagtctgagtccccagaacagaggagactggggatgcagacttacaacctggcggcagcgcaaaagatg

SEQ ID NO: 139571 - DNA, 103 bp, Artificial Sequence
  Synthetic Polynucleotide
taatacgactcactataggggcatgttcttcaatcattgaccgtaagtctaacagaggagaagacttatggtcaatgataacctggcggcagcgcaaaagatg

SEQ ID NO: 139572 - DNA, 103 bp, Artificial Sequence
  Synthetic Polynucleotide
taatacgactcactatagggaacctgaaaagcatgttcttcaatcattgaaacagaggagatcaatgatggaagaacataacctggcggcagcgcaaaagatg

SEQ ID NO: 139573 - DNA, 103 bp, Artificial Sequence
  Synthetic Polynucleotide
taatacgactcactatagggcttgtgacaaaacctgaaaagcatgttcttaacagaggagaaagaacatgcttttcaggaacctggcggcagcgcaaaagatg

SEQ ID NO: 139574 - DNA, 103 bp, Artificial Sequence
  Synthetic Polynucleotide
taatacgactcactatagggaacaaggatccttgtgacaaaacctgaaaaaacagaggagattttcaatgtttgtcacaaacctggcggcagcgcaaaagatg

SEQ ID NO: 139575 - DNA, 103 bp, Artificial Sequence
  Synthetic Polynucleotide
taatacgactcactatagggtggactttctaacaaggatccttgtgacaaaacagaggagattgtcaatgggatccttgaacctggcggcagcgcaaaagatg

SEQ ID NO: 139576 - DNA, 103 bp, Artificial Sequence
  Synthetic Polynucleotide
taatacgactcactatagggctgtgtaacttggactttctaacaaggatcaacagaggagagatcctatgtagaaagtcaacctggcggcagcgcaaaagatg

SEQ ID NO: 139577 - DNA, 103 bp, Artificial Sequence
  Synthetic Polynucleotide
taatacgactcactataggggagacacaaactgtgtaacttggactttctaacagaggagaagaaagatgaagttacacaacctggcggcagcgcaaaagatg

SEQ ID NO: 139578 - DNA, 103 bp, Artificial Sequence
  Synthetic Polynucleotide
taatacgactcactatagggatctggctcagagacacaaactgtgtaactaacagaggagaagttacatggtttgtgtcaacctggcggcagcgcaaaagatg

SEQ ID NO: 139579 - DNA, 103 bp, Artificial Sequence
  Synthetic Polynucleotide
taatacgactcactatagggtgggggaaacatcttgagtttctgaagaaaaacagaggagatttcttatgaaactcaagaacctggcggcagcgcaaaagatg

SEQ ID NO: 139580 - DNA, 103 bp, Artificial Sequence
  Synthetic Polynucleotide
taatacgactcactatagggcatcatctttatctggctcagagacacaaaaacagaggagatttgtgatgctgagccagaacctggcggcagcgcaaaagatg

SEQ ID NO: 139581 - DNA, 103 bp, Artificial Sequence
  Synthetic Polynucleotide
taatacgactcactataggggaaagaaaatcatcatctttatctggctcaaacagaggagatgagccatgtaaagatgaaacctggcggcagcgcaaaagatg

SEQ ID NO: 139582 - DNA, 103 bp, Artificial Sequence
  Synthetic Polynucleotide
taatacgactcactatagggaaagttcagagaaagaaaatcatcatctttaacagaggagaaaagatatggattttcttaacctggcggcagcgcaaaagatg

SEQ ID NO: 139583 - DNA, 103 bp, Artificial Sequence
  Synthetic Polynucleotide
taatacgactcactataggggtttcctgggaaagttcagagaaagaaaataacagaggagaattttcatgctctgaactaacctggcggcagcgcaaaagatg

SEQ ID NO: 139584 - DNA, 103 bp, Artificial Sequence
  Synthetic Polynucleotide
taatacgactcactatagggattttccaaagtttcctgggaaagttcagaaacagaggagatctgaaatgtcccaggaaaacctggcggcagcgcaaaagatg

SEQ ID NO: 139585 - DNA, 103 bp, Artificial Sequence
  Synthetic Polynucleotide
taatacgactcactatagggactttccactattttccaaagtttcctgggaacagaggagacccaggatgctttggaaaaacctggcggcagcgcaaaagatg

SEQ ID NO: 139586 - DNA, 103 bp, Artificial Sequence
  Synthetic Polynucleotide
taatacgactcactatagggtgaattggtcactttccactattttccaaaaacagaggagatttggaatgtagtggaaaaacctggcggcagcgcaaaagatg

SEQ ID NO: 139587 - DNA, 103 bp, Artificial Sequence
  Synthetic Polynucleotide
taatacgactcactataggggaaatagacttgaattggtcactttccactaacagaggagaagtggaatgtgaccaattaacctggcggcagcgcaaaagatg

SEQ ID NO: 139588 - DNA, 103 bp, Artificial Sequence
  Synthetic Polynucleotide
taatacgactcactatagggctcatcccatgaaatagacttgaattggtcaacagaggagagaccaaatgaagtctattaacctggcggcagcgcaaaagatg

SEQ ID NO: 139589 - DNA, 103 bp, Artificial Sequence
  Synthetic Polynucleotide
taatacgactcactatagggaagttccattctcatcccatgaaatagactaacagaggagaagtctaatgcatgggatgaacctggcggcagcgcaaaagatg

SEQ ID NO: 139590 - DNA, 103 bp, Artificial Sequence
  Synthetic Polynucleotide
taatacgactcactatagggaattcatctttgggggaaacatcttgagttaacagaggagaaactcaatgtgtttccccaacctggcggcagcgcaaaagatg

SEQ ID NO: 139591 - DNA, 103 bp, Artificial Sequence
  Synthetic Polynucleotide
taatacgactcactatagggatcactatgcaagttccattctcatcccataacagaggagaatgggaatggaatggaacaacctggcggcagcgcaaaagatg

SEQ ID NO: 139592 - DNA, 103 bp, Artificial Sequence
  Synthetic Polynucleotide
taatacgactcactatagggttcttcattaatcactatgcaagttccattaacagaggagaaatggaatgtgcatagtgaacctggcggcagcgcaaaagatg

SEQ ID NO: 139593 - DNA, 103 bp, Artificial Sequence
  Synthetic Polynucleotide
taatacgactcactatagggtcttgaagagttcttcattaatcactatgcaacagaggagagcatagatgttaatgaagaacctggcggcagcgcaaaagatg

SEQ ID NO: 139594 - DNA, 103 bp, Artificial Sequence
  Synthetic Polynucleotide
taatacgactcactatagggaaaatttctttcttgaagagttcttcattaaacagaggagataatgaatgactcttcaaaacctggcggcagcgcaaaagatg

SEQ ID NO: 139595 - DNA, 103 bp, Artificial Sequence
  Synthetic Polynucleotide
taatacgactcactatagggctttgtttccaaaatttctttcttgaagagaacagaggagactcttcatgaaagaaattaacctggcggcagcgcaaaagatg

SEQ ID NO: 139596 - DNA, 103 bp, Artificial Sequence
  Synthetic Polynucleotide
taatacgactcactatagggtgtaaggagcctttgtttccaaaatttcttaacagaggagaaagaaaatgtggaaacaaaacctggcggcagcgcaaaagatg

SEQ ID NO: 139597 - DNA, 103 bp, Artificial Sequence
  Synthetic Polynucleotide
taatacgactcactatagggtgaaatattctgtaaggagcctttgtttccaacagaggagaggaaacatgggctccttaaacctggcggcagcgcaaaagatg

SEQ ID NO: 139598 - DNA, 103 bp, Artificial Sequence
  Synthetic Polynucleotide
taatacgactcactatagggagcatcagtttgaaatattctgtaaggagcaacagaggagagctcctatgagaatatttaacctggcggcagcgcaaaagatg

SEQ ID NO: 139599 - DNA, 103 bp, Artificial Sequence
  Synthetic Polynucleotide
taatacgactcactatagggaacttttgatagcatcagtttgaaatattcaacagaggagagaatatatgaaactgatgaacctggcggcagcgcaaaagatg

SEQ ID NO: 139600 - DNA, 103 bp, Artificial Sequence
  Synthetic Polynucleotide
taatacgactcactatagggtgtcgaacaaaacttttgatagcatcagttaacagaggagaaactgaatgtatcaaaagaacctggcggcagcgcaaaagatg

SEQ ID NO: 139601 - DNA, 103 bp, Artificial Sequence
  Synthetic Polynucleotide
taatacgactcactatagggtgaagcagttaattcatctttgggggaaacaacagaggagagtttccatgaaagatgaaaacctggcggcagcgcaaaagatg

SEQ ID NO: 139602 - DNA, 103 bp, Artificial Sequence
  Synthetic Polynucleotide
taatacgactcactatagggaaggttgagctgtcgaacaaaacttttgataacagaggagaatcaaaatgtttgttcgaaacctggcggcagcgcaaaagatg

SEQ ID NO: 139603 - DNA, 103 bp, Artificial Sequence
  Synthetic Polynucleotide
taatacgactcactatagggtaaatccataaaggttgagctgtcgaacaaaacagaggagattgttcatgagctcaaccaacctggcggcagcgcaaaagatg

SEQ ID NO: 139604 - DNA, 103 bp, Artificial Sequence
  Synthetic Polynucleotide
taatacgactcactatagggtgaattttactaaatccataaaggttgagcaacagaggagagctcaaatgttatggattaacctggcggcagcgcaaaagatg

SEQ ID NO: 139605 - DNA, 103 bp, Artificial Sequence
  Synthetic Polynucleotide
taatacgactcactatagggaaaattctgttgaattttactaaatccataaacagaggagatatggaatgagtaaaattaacctggcggcagcgcaaaagatg

SEQ ID NO: 139606 - DNA, 103 bp, Artificial Sequence
  Synthetic Polynucleotide
taatacgactcactatagggcagatctttgaaaattctgttgaattttacaacagaggagagtaaaaatgaacagaattaacctggcggcagcgcaaaagatg

SEQ ID NO: 139607 - DNA, 103 bp, Artificial Sequence
  Synthetic Polynucleotide
taatacgactcactataggggctagaaaggcagatctttgaaaattctgtaacagaggagaacagaaatgtcaaagatcaacctggcggcagcgcaaaagatg

SEQ ID NO: 139608 - DNA, 103 bp, Artificial Sequence
  Synthetic Polynucleotide
taatacgactcactatagggcagaaaggtggctagaaaggcagatctttgaacagaggagacaaagaatggcctttctaaacctggcggcagcgcaaaagatg

SEQ ID NO: 139609 - DNA, 103 bp, Artificial Sequence
  Synthetic Polynucleotide
taatacgactcactatagggtctcttctgacagaaaggtggctagaaaggaacagaggagacctttcatgccacctttcaacctggcggcagcgcaaaagatg

SEQ ID NO: 139610 - DNA, 103 bp, Artificial Sequence
  Synthetic Polynucleotide
taatacgactcactataggggacgattctttctcttctgacagaaaggtgaacagaggagacaccttatggtcagaagaaacctggcggcagcgcaaaagatg

SEQ ID NO: 139611 - DNA, 103 bp, Artificial Sequence
  Synthetic Polynucleotide
taatacgactcactataggggcttaagacagacgattctttctcttctgaaacagaggagatcagaaatgaaagaatcgaacctggcggcagcgcaaaagatg

SEQ ID NO: 139612 - DNA, 103 bp, Artificial Sequence
  Synthetic Polynucleotide
taatacgactcactatagggtggaggcttctgaagcagttaattcatcttaacagaggagaaagatgatgtaactgcttaacctggcggcagcgcaaaagatg

SEQ ID NO: 139613 - DNA, 103 bp, Artificial Sequence
  Synthetic Polynucleotide
taatacgactcactatagggagcgtatcttgcttaagacagacgattcttaacagaggagaaagaatatgctgtcttaaaacctggcggcagcgcaaaagatg

SEQ ID NO: 139614 - DNA, 103 bp, Artificial Sequence
  Synthetic Polynucleotide
taatacgactcactatagggattttggtgaagcgtatcttgcttaagacaaacagaggagatgtcttatgcaagatacgaacctggcggcagcgcaaaagatg

SEQ ID NO: 139615 - DNA, 103 bp, Artificial Sequence
  Synthetic Polynucleotide
taatacgactcactatagggggaaagtttcattttggtgaagcgtatcttaacagaggagaaagataatgttcaccaaaaacctggcggcagcgcaaaagatg

SEQ ID NO: 139616 - DNA, 103 bp, Artificial Sequence
  Synthetic Polynucleotide
taatacgactcactatagggttgaagatctggaaagtttcattttggtgaaacagaggagatcaccaatgtgaaactttaacctggcggcagcgcaaaagatg

SEQ ID NO: 139617 - DNA, 103 bp, Artificial Sequence
  Synthetic Polynucleotide
taatacgactcactatagggttttcataagttgaagatctggaaagtttcaacagaggagagaaactatgcagatcttcaacctggcggcagcgcaaaagatg

SEQ ID NO: 139618 - DNA, 103 bp, Artificial Sequence
  Synthetic Polynucleotide
taatacgactcactatagggtaaatacctgttttcataagttgaagatctaacagaggagaagatctatgacttatgaaaacctggcggcagcgcaaaagatg

SEQ ID NO: 139619 - DNA, 103 bp, Artificial Sequence
  Synthetic Polynucleotide
taatacgactcactatagggagttgcaacataaatacctgttttcataagaacagaggagacttatgatgacaggtattaacctggcggcagcgcaaaagatg

SEQ ID NO: 139620 - DNA, 103 bp, Artificial Sequence
  Synthetic Polynucleotide
taatacgactcactatagggtttaaatgtaagttgcaacataaatacctgaacagaggagacaggtaatgatgttgcaaaacctggcggcagcgcaaaagatg

SEQ ID NO: 139621 - DNA, 103 bp, Artificial Sequence
  Synthetic Polynucleotide
taatacgactcactatagggcgactcatcttttaaatgtaagttgcaacaaacagaggagatgttgcatgttacatttaaacctggcggcagcgcaaaagatg

SEQ ID NO: 139622 - DNA, 103 bp, Artificial Sequence
  Synthetic Polynucleotide
taatacgactcactatagggatgagtaattcgactcatcttttaaatgtaaacagaggagatacattatgaagatgagtaacctggcggcagcgcaaaagatg

SEQ ID NO: 139623 - DNA, 103 bp, Artificial Sequence
  Synthetic Polynucleotide
taatacgactcactatagggggagacctagtggaggcttctgaagcagttaacagaggagaaactgcatgagaagcctcaacctggcggcagcgcaaaagatg

SEQ ID NO: 139624 - DNA, 103 bp, Artificial Sequence
  Synthetic Polynucleotide
taatacgactcactatagggttcacacaatggagacctagtggaggcttcaacagaggagagaagccatgactaggtctaacctggcggcagcgcaaaagatg

SEQ ID NO: 139625 - DNA, 103 bp, Artificial Sequence
  Synthetic Polynucleotide
taatacgactcactatagggggaaggtgtgttcacacaatggagacctagaacagaggagactaggtatgcattgtgtgaacctggcggcagcgcaaaagatg

SEQ ID NO: 139626 - DNA, 103 bp, Artificial Sequence
  Synthetic Polynucleotide
taatacgactcactataggggagtccccagggaaggtgtgttcacacaataacagaggagaattgtgatgacacaccttaacctggcggcagcgcaaaagatg

SEQ ID NO: 139627 - DNA, 103 bp, Artificial Sequence; identical to SEQ ID NO: 139568
  Synthetic Polynucleotide

SEQ ID NO: 139628 - DNA, 103 bp, Artificial Sequence; identical to SEQ ID NO: 139569
  Synthetic Polynucleotide

SEQ ID NO: 139629 - DNA, 103 bp, Artificial Sequence
  Synthetic Polynucleotide
taatacgactcactatagggcactgtcagcccaaaataaccattttgtaaaacagaggagattacaaatgggttattttaacctggcggcagcgcaaaagatg

SEQ ID NO: 139630 - DNA, 103 bp, Artificial Sequence
  Synthetic Polynucleotide
taatacgactcactatagggcagatggttccactgtcagcccaaaataacaacagaggagagttattatgggctgacagaacctggcggcagcgcaaaagatg

SEQ ID NO: 139631 - DNA, 103 bp, Artificial Sequence
  Synthetic Polynucleotide
taatacgactcactataggggtgggaacagcagatggttccactgtcagcaacagaggagagctgacatgggaaccatcaacctggcggcagcgcaaaagatg

SEQ ID NO: 139632 - DNA, 103 bp, Artificial Sequence
  Synthetic Polynucleotide
taatacgactcactatagggaggatatcgtgtgggaacagcagatggttcaacagaggagagaaccaatggctgttcccaacctggcggcagcgcaaaagatg

SEQ ID NO: 139633 - DNA, 103 bp, Artificial Sequence
  Synthetic Polynucleotide
taatacgactcactatagggctgataccagaggatatcgtgtgggaacagaacagaggagactgttcatgcacgatatcaacctggcggcagcgcaaaagatg

SEQ ID NO: 139634 - DNA, 103 bp, Artificial Sequence
  Synthetic Polynucleotide
taatacgactcactataggggcctcattgactgataccagaggatatcgtaacagaggagaacgataatgtctggtatcaacctggcggcagcgcaaaagatg

SEQ ID NO: 139635 - DNA, 103 bp, Artificial Sequence
  Synthetic Polynucleotide
taatacgactcactatagggacgatatggagcctcattgactgataccagaacagaggagactggtaatggtcaatgagaacctggcggcagcgcaaaagatg

SEQ ID NO: 139636 - DNA, 103 bp, Artificial Sequence
  Synthetic Polynucleotide
taatacgactcactataggggtagcatgttacgatatggagcctcattgaaacagaggagatcaatgatgctccatatcaacctggcggcagcgcaaaagatg

SEQ ID NO: 139637 - DNA, 103 bp, Artificial Sequence
  Synthetic Polynucleotide
taatacgactcactatagggttgcctgctggtagcatgttacgatatggaaacagaggagatccataatgtaacatgctaacctggcggcagcgcaaaagatg

SEQ ID NO: 139638 - DNA, 103 bp, Artificial Sequence
  Synthetic Polynucleotide
taatacgactcactatagggcaaccacgggttgcctgctggtagcatgttaacagaggagaaacatgatgccagcaggcaacctggcggcagcgcaaaagatg

SEQ ID NO: 139639 - DNA, 103 bp, Artificial Sequence; identical to SEQ ID NO: 139570
  Synthetic Polynucleotide

SEQ ID NO: 139640 - DNA, 103 bp, Artificial Sequence
  Synthetic Polynucleotide
taatacgactcactatagggtaggcatttgcaaccacgggttgcctgctgaacagaggagacagcagatgacccgtggtaacctggcggcagcgcaaaagatg

SEQ ID NO: 139641 - DNA, 103 bp, Artificial Sequence
  Synthetic Polynucleotide
taatacgactcactatagggtcagcgatcgtaggcatttgcaaccacgggaacagaggagacccgtgatggcaaatgccaacctggcggcagcgcaaaagatg

SEQ ID NO: 139642 - DNA, 103 bp, Artificial Sequence
  Synthetic Polynucleotide
taatacgactcactatagggagctgatctatcagcgatcgtaggcatttgaacagaggagacaaatgatgacgatcgctaacctggcggcagcgcaaaagatg

SEQ ID NO: 139643 - DNA, 103 bp, Artificial Sequence
  Synthetic Polynucleotide
taatacgactcactatagggaatgaggggcagctgatctatcagcgatcgaacagaggagacgatcgatgatagatcagaacctggcggcagcgcaaaagatg

SEQ ID NO: 139644 - DNA, 103 bp, Artificial Sequence
  Synthetic Polynucleotide
taatacgactcactataggggctagcctggaatgaggggcagctgatctaaacagaggagatagatcatgtgcccctcaaacctggcggcagcgcaaaagatg

SEQ ID NO: 139645 - DNA, 103 bp, Artificial Sequence
  Synthetic Polynucleotide
taatacgactcactatagggtggttgaagagctagcctggaatgaggggcaacagaggagagcccctatgtccaggctaaacctggcggcagcgcaaaagatg

SEQ ID NO: 139646 - DNA, 103 bp, Artificial Sequence
  Synthetic Polynucleotide
taatacgactcactatagggccagtggtgatggttgaagagctagcctggaacagaggagaccaggcatgctcttcaacaacctggcggcagcgcaaaagatg

SEQ ID NO: 139647 - DNA, 103 bp, Artificial Sequence
  Synthetic Polynucleotide
taatacgactcactatagggtgatatttgtccagtggtgatggttgaagaaacagaggagatcttcaatgatcaccactaacctggcggcagcgcaaaagatg

SEQ ID NO: 139648 - DNA, 103 bp, Artificial Sequence
  Synthetic Polynucleotide
taatacgactcactataggggtaattagggtgatatttgtccagtggtgaaacagaggagatcaccaatggacaaatataacctggcggcagcgcaaaagatg

SEQ ID NO: 139649 - DNA, 103 bp, Artificial Sequence; identical to SEQ ID NO: 139571
  Synthetic Polynucleotide

SEQ ID NO: 139650 - DNA, 103 bp, Artificial Sequence; identical to SEQ ID NO: 139572
  Synthetic Polynucleotide

SEQ ID NO: 139651 - DNA, 103 bp, Artificial Sequence; identical to SEQ ID NO: 139573
  Synthetic Polynucleotide

SEQ ID NO: 139652 - DNA, 103 bp, Artificial Sequence; identical to SEQ ID NO: 139574
  Synthetic Polynucleotide

SEQ ID NO: 139653 - DNA, 103 bp, Artificial Sequence; identical to SEQ ID NO: 139575
  Synthetic Polynucleotide

SEQ ID NO: 139654 - DNA, 103 bp, Artificial Sequence; identical to SEQ ID NO: 139576
  Synthetic Polynucleotide

SEQ ID NO: 139655 - DNA, 103 bp, Artificial Sequence; identical to SEQ ID NO: 139577
  Synthetic Polynucleotide

SEQ ID NO: 139656 - DNA, 103 bp, Artificial Sequence; identical to SEQ ID NO: 139578
  Synthetic Polynucleotide

SEQ ID NO: 139657 - DNA, 103 bp, Artificial Sequence; identical to SEQ ID NO: 139579
  Synthetic Polynucleotide

SEQ ID NO: 139658 - DNA, 103 bp, Artificial Sequence; identical to SEQ ID NO: 139580
  Synthetic Polynucleotide

SEQ ID NO: 139659 - DNA, 103 bp, Artificial Sequence; identical to SEQ ID NO: 139581
  Synthetic Polynucleotide

SEQ ID NO: 139660 - DNA, 103 bp, Artificial Sequence; identical to SEQ ID NO: 139582
  Synthetic Polynucleotide

SEQ ID NO: 139661 - DNA, 103 bp, Artificial Sequence; identical to SEQ ID NO: 139583
  Synthetic Polynucleotide

SEQ ID NO: 139662 - DNA, 103 bp, Artificial Sequence; identical to SEQ ID NO: 139584
  Synthetic Polynucleotide

SEQ ID NO: 139663 - DNA, 103 bp, Artificial Sequence; identical to SEQ ID NO: 139585
  Synthetic Polynucleotide

SEQ ID NO: 139664 - DNA, 103 bp, Artificial Sequence; identical to SEQ ID NO: 139586
  Synthetic Polynucleotide

SEQ ID NO: 139665 - DNA, 103 bp, Artificial Sequence; identical to SEQ ID NO: 139587
  Synthetic Polynucleotide

SEQ ID NO: 139666 - DNA, 103 bp, Artificial Sequence; identical to SEQ ID NO: 139588
  Synthetic Polynucleotide

SEQ ID NO: 139667 - DNA, 103 bp, Artificial Sequence; identical to SEQ ID NO: 139589
  Synthetic Polynucleotide

SEQ ID NO: 139668 - DNA, 103 bp, Artificial Sequence; identical to SEQ ID NO: 139590
  Synthetic Polynucleotide

SEQ ID NO: 139669 - DNA, 103 bp, Artificial Sequence; identical to SEQ ID NO: 139591
  Synthetic Polynucleotide

SEQ ID NO: 139670 - DNA, 103 bp, Artificial Sequence; identical to SEQ ID NO: 139592
  Synthetic Polynucleotide

SEQ ID NO: 139671 - DNA, 103 bp, Artificial Sequence; identical to SEQ ID NO: 139593
  Synthetic Polynucleotide

SEQ ID NO: 139672 - DNA, 103 bp, Artificial Sequence; identical to SEQ ID NO: 139594
  Synthetic Polynucleotide

SEQ ID NO: 139673 - DNA, 103 bp, Artificial Sequence; identical to SEQ ID NO: 139595
  Synthetic Polynucleotide

SEQ ID NO: 139674 - DNA, 103 bp, Artificial Sequence; identical to SEQ ID NO: 139596
  Synthetic Polynucleotide

SEQ ID NO: 139675 - DNA, 103 bp, Artificial Sequence; identical to SEQ ID NO: 139597
  Synthetic Polynucleotide

SEQ ID NO: 139676 - DNA, 103 bp, Artificial Sequence; identical to SEQ ID NO: 139598
  Synthetic Polynucleotide

SEQ ID NO: 139677 - DNA, 103 bp, Artificial Sequence; identical to SEQ ID NO: 139599
  Synthetic Polynucleotide

SEQ ID NO: 139678 - DNA, 103 bp, Artificial Sequence; identical to SEQ ID NO: 139600
  Synthetic Polynucleotide

SEQ ID NO: 139679 - DNA, 103 bp, Artificial Sequence; identical to SEQ ID NO: 139601
  Synthetic Polynucleotide

SEQ ID NO: 139680 - DNA, 103 bp, Artificial Sequence; identical to SEQ ID NO: 139602
  Synthetic Polynucleotide

SEQ ID NO: 139681 - DNA, 103 bp, Artificial Sequence; identical to SEQ ID NO: 139603
  Synthetic Polynucleotide

SEQ ID NO: 139682 - DNA, 103 bp, Artificial Sequence; identical to SEQ ID NO: 139604
  Synthetic Polynucleotide

SEQ ID NO: 139683 - DNA, 103 bp, Artificial Sequence; identical to SEQ ID NO: 139605
  Synthetic Polynucleotide

SEQ ID NO: 139684 - DNA, 103 bp, Artificial Sequence; identical to SEQ ID NO: 139606
  Synthetic Polynucleotide

SEQ ID NO: 139685 - DNA, 103 bp, Artificial Sequence; identical to SEQ ID NO: 139607
  Synthetic Polynucleotide

SEQ ID NO: 139686 - DNA, 103 bp, Artificial Sequence; identical to SEQ ID NO: 139608
  Synthetic Polynucleotide

SEQ ID NO: 139687 - DNA, 103 bp, Artificial Sequence; identical to SEQ ID NO: 139609
  Synthetic Polynucleotide

SEQ ID NO: 139688 - DNA, 103 bp, Artificial Sequence; identical to SEQ ID NO: 139610
  Synthetic Polynucleotide

SEQ ID NO: 139689 - DNA, 103 bp, Artificial Sequence; identical to SEQ ID NO: 139611
  Synthetic Polynucleotide

SEQ ID NO: 139690 - DNA, 103 bp, Artificial Sequence; identical to SEQ ID NO: 139612
  Synthetic Polynucleotide

SEQ ID NO: 139691 - DNA, 103 bp, Artificial Sequence
  Synthetic Polynucleotide
taatacgactcactatagggactttaacttgcttaagacagacgattcttaacagaggagaaagaatatgctgtcttaaaacctggcggcagcgcaaaagatg

SEQ ID NO: 139692 - DNA, 103 bp, Artificial Sequence
  Synthetic Polynucleotide
taatacgactcactatagggttataatagaactttaacttgcttaagacaaacagaggagatgtcttatgcaagttaaaaacctggcggcagcgcaaaagatg

SEQ ID NO: 139693 - DNA, 103 bp, Artificial Sequence
  Synthetic Polynucleotide
taatacgactcactataggggaaatttggattataatagaactttaacttaacagaggagaaagttaatgttctattataacctggcggcagcgcaaaagatg

SEQ ID NO: 139694 - DNA, 103 bp, Artificial Sequence
  Synthetic Polynucleotide
taatacgactcactatagggagccacgcttgaaatttggattataatagaaacagaggagatctattatgatccaaattaacctggcggcagcgcaaaagatg

SEQ ID NO: 139695 - DNA, 103 bp, Artificial Sequence
  Synthetic Polynucleotide
taatacgactcactatagggagttggggatagccacgcttgaaatttggaaacagaggagatccaaaatgcaagcgtggaacctggcggcagcgcaaaagatg

SEQ ID NO: 139696 - DNA, 103 bp, Artificial Sequence
  Synthetic Polynucleotide
taatacgactcactatagggtcttactaaaagttggggatagccacgcttaacagaggagaaagcgtatgtatccccaaaacctggcggcagcgcaaaagatg

SEQ ID NO: 139697 - DNA, 103 bp, Artificial Sequence
  Synthetic Polynucleotide
taatacgactcactatagggttctcttcactcttactaaaagttggggataacagaggagaatccccatgttttagtaaaacctggcggcagcgcaaaagatg

SEQ ID NO: 139698 - DNA, 103 bp, Artificial Sequence
  Synthetic Polynucleotide
taatacgactcactatagggacaccaattcttctcttcactcttactaaaaacagaggagatttagtatgagtgaagagaacctggcggcagcgcaaaagatg

SEQ ID NO: 139699 - DNA, 103 bp, Artificial Sequence
  Synthetic Polynucleotide
taatacgactcactatagggagcatttttaacaccaattcttctcttcacaacagaggagagtgaagatgagaattggtaacctggcggcagcgcaaaagatg

SEQ ID NO: 139700 - DNA, 103 bp, Artificial Sequence
  Synthetic Polynucleotide
taatacgactcactatagggatataggtgaagcatttttaacaccaattcaacagaggagagaattgatgttaaaaatgaacctggcggcagcgcaaaagatg

SEQ ID NO: 139701 - DNA, 103 bp, Artificial Sequence; identical to SEQ ID NO: 139623
  Synthetic Polynucleotide

SEQ ID NO: 139702 - DNA, 103 bp, Artificial Sequence
  Synthetic Polynucleotide
taatacgactcactatagggaataaagtagatataggtgaagcatttttaaacagaggagataaaaaatgttcacctataacctggcggcagcgcaaaagatg

SEQ ID NO: 139703 - DNA, 103 bp, Artificial Sequence
  Synthetic Polynucleotide
taatacgactcactatagggatcttcgttgaataaagtagatataggtgaaacagaggagatcacctatgtctactttaaacctggcggcagcgcaaaagatg

SEQ ID NO: 139704 - DNA, 103 bp, Artificial Sequence
  Synthetic Polynucleotide
taatacgactcactatagggtcttgttgaaatcttcgttgaataaagtagaacagaggagactacttatgtcaacgaagaacctggcggcagcgcaaaagatg

SEQ ID NO: 139705 - DNA, 103 bp, Artificial Sequence
  Synthetic Polynucleotide
taatacgactcactatagggctaaaatgcttcttgttgaaatcttcgttgaacagaggagacaacgaatgtttcaacaaaacctggcggcagcgcaaaagatg

SEQ ID NO: 139706 - DNA, 103 bp, Artificial Sequence
  Synthetic Polynucleotide
taatacgactcactatagggagcccctgctctaaaatgcttcttgttgaaaacagaggagattcaacatgaagcattttaacctggcggcagcgcaaaagatg

SEQ ID NO: 139707 - DNA, 103 bp, Artificial Sequence
  Synthetic Polynucleotide
taatacgactcactatagggtctccatgttagcccctgctctaaaatgctaacagaggagaagcattatggagcaggggaacctggcggcagcgcaaaagatg

SEQ ID NO: 139708 - DNA, 103 bp, Artificial Sequence
  Synthetic Polynucleotide
taatacgactcactataggggaattatgattctccatgttagcccctgctaacagaggagaagcaggatgtaacatggaaacctggcggcagcgcaaaagatg

SEQ ID NO: 139709 - DNA, 103 bp, Artificial Sequence
  Synthetic Polynucleotide
taatacgactcactatagggagctaaggcagaattatgattctccatgttaacagaggagaaacatgatgaatcataataacctggcggcagcgcaaaagatg

SEQ ID NO: 139710 - DNA, 103 bp, Artificial Sequence
  Synthetic Polynucleotide
taatacgactcactatagggtagcttcagcagctaaggcagaattatgataacagaggagaatcataatgctgccttagaacctggcggcagcgcaaaagatg

SEQ ID NO: 139711 - DNA, 103 bp, Artificial Sequence
  Synthetic Polynucleotide
taatacgactcactatagggctttcttcactagcttcagcagctaaggcaaacagaggagatgccttatgtgctgaagcaacctggcggcagcgcaaaagatg

SEQ ID NO: 139712 - DNA, 103 bp, Artificial Sequence; identical to SEQ ID NO: 139624
  Synthetic Polynucleotide

SEQ ID NO: 139713 - DNA, 103 bp, Artificial Sequence
  Synthetic Polynucleotide
taatacgactcactatagggtgaaaataaactttcttcactagcttcagcaacagaggagagctgaaatgagtgaagaaaacctggcggcagcgcaaaagatg

SEQ ID NO: 139714 - DNA, 103 bp, Artificial Sequence
  Synthetic Polynucleotide
taatacgactcactatagggttttagaggctgaaaataaactttcttcacaacagaggagagtgaagatggtttattttaacctggcggcagcgcaaaagatg

SEQ ID NO: 139715 - DNA, 103 bp, Artificial Sequence
  Synthetic Polynucleotide
taatacgactcactatagggatatttaaatttttagaggctgaaaataaaaacagaggagatttattatgagcctctaaaacctggcggcagcgcaaaagatg

SEQ ID NO: 139716 - DNA, 103 bp, Artificial Sequence
  Synthetic Polynucleotide
taatacgactcactatagggtgttagaggcatatttaaatttttagaggcaacagaggagagcctctatgaatttaaataacctggcggcagcgcaaaagatg

SEQ ID NO: 139717 - DNA, 103 bp, Artificial Sequence
  Synthetic Polynucleotide
taatacgactcactatagggaagattcccttgttagaggcatatttaaataacagaggagaatttaaatgtgcctctaaaacctggcggcagcgcaaaagatg

SEQ ID NO: 139718 - DNA, 103 bp, Artificial Sequence
  Synthetic Polynucleotide
taatacgactcactatagggtgtctgacagaagattcccttgttagaggcaacagaggagagcctctatgaagggaatcaacctggcggcagcgcaaaagatg

SEQ ID NO: 139719 - DNA, 103 bp, Artificial Sequence
  Synthetic Polynucleotide
taatacgactcactatagggtgcaattatctgtctgacagaagattccctaacagaggagaagggaaatgtctgtcagaaacctggcggcagcgcaaaagatg

SEQ ID NO: 139720 - DNA, 103 bp, Artificial Sequence
  Synthetic Polynucleotide
taatacgactcactatagggcagatgaatttgcaattatctgtctgacagaacagaggagactgtcaatgagataattgaacctggcggcagcgcaaaagatg

SEQ ID NO: 139721 - DNA, 103 bp, Artificial Sequence
  Synthetic Polynucleotide
taatacgactcactatagggctaatggggacagatgaatttgcaattatcaacagaggagagataatatgaaattcatcaacctggcggcagcgcaaaagatg

SEQ ID NO: 139722 - DNA, 103 bp, Artificial Sequence
  Synthetic Polynucleotide
taatacgactcactataggggaaaccacttctaatggggacagatgaattaacagaggagaaattcaatggtccccattaacctggcggcagcgcaaaagatg

SEQ ID NO: 139723 - DNA, 103 bp, Artificial Sequence; identical to SEQ ID NO: 139625
  Synthetic Polynucleotide

SEQ ID NO: 139724 - DNA, 103 bp, Artificial Sequence
  Synthetic Polynucleotide
taatacgactcactatagggaaggaggagggaaaccacttctaatggggaaacagaggagatccccaatggaagtggttaacctggcggcagcgcaaaagatg

SEQ ID NO: 139725 - DNA, 103 bp, Artificial Sequence
  Synthetic Polynucleotide
taatacgactcactataggggttgaaggtgaaggaggagggaaaccacttaacagaggagaaagtggatgccctcctccaacctggcggcagcgcaaaagatg

SEQ ID NO: 139726 - DNA, 103 bp, Artificial Sequence
  Synthetic Polynucleotide
taatacgactcactatagggtccaactgaggttgaaggtgaaggaggaggaacagaggagacctcctatgtcaccttcaaacctggcggcagcgcaaaagatg

SEQ ID NO: 139727 - DNA, 103 bp, Artificial Sequence
  Synthetic Polynucleotide
taatacgactcactataggggttctgatggtccaactgaggttgaaggtgaacagaggagacaccttatgcctcagttgaacctggcggcagcgcaaaagatg

SEQ ID NO: 139728 - DNA, 103 bp, Artificial Sequence
  Synthetic Polynucleotide
taatacgactcactataggggttgcaatttgttctgatggtccaactgagaacagaggagactcagtatgaccatcagaaacctggcggcagcgcaaaagatg

SEQ ID NO: 139729 - DNA, 103 bp, Artificial Sequence
  Synthetic Polynucleotide
taatacgactcactatagggatgttgatctgttgcaatttgttctgatggaacagaggagaccatcaatgcaaattgcaaacctggcggcagcgcaaaagatg

SEQ ID NO: 139730 - DNA, 103 bp, Artificial Sequence
  Synthetic Polynucleotide
taatacgactcactatagggttaaaatagcatgttgatctgttgcaatttaacagaggagaaaattgatgcagatcaacaacctggcggcagcgcaaaagatg

SEQ ID NO: 139731 - DNA, 103 bp, Artificial Sequence
  Synthetic Polynucleotide
taatacgactcactataggggtcaactgatttaaaatagcatgttgatctaacagaggagaagatcaatgtgctattttaacctggcggcagcgcaaaagatg

SEQ ID NO: 139732 - DNA, 103 bp, Artificial Sequence
  Synthetic Polynucleotide
taatacgactcactatagggatgaatagtggtcaactgatttaaaatagcaacagaggagagctattatgaatcagttgaacctggcggcagcgcaaaagatg

SEQ ID NO: 139733 - DNA, 103 bp, Artificial Sequence
  Synthetic Polynucleotide
taatacgactcactataggggagagtgcatatgaatagtggtcaactgataacagaggagaatcagtatgccactattcaacctggcggcagcgcaaaagatg

SEQ ID NO: 139734 - DNA, 103 bp, Artificial Sequence; identical to SEQ ID NO: 139626
  Synthetic Polynucleotide

SEQ ID NO: 139735 - DNA, 103 bp, Artificial Sequence
  Synthetic Polynucleotide
taatacgactcactatagggtaggtactatgagagtgcatatgaatagtgaacagaggagacactatatgtatgcactcaacctggcggcagcgcaaaagatg

SEQ ID NO: 139736 - DNA, 103 bp, Artificial Sequence
  Synthetic Polynucleotide
taatacgactcactatagggtgcttgcatgtaggtactatgagagtgcataacagaggagaatgcacatgcatagtaccaacctggcggcagcgcaaaagatg

SEQ ID NO: 139737 - DNA, 103 bp, Artificial Sequence
  Synthetic Polynucleotide
taatacgactcactatagggtgtggccccttgcttgcatgtaggtactataacagaggagaatagtaatgacatgcaagaacctggcggcagcgcaaaagatg

SEQ ID NO: 139738 - DNA, 103 bp, Artificial Sequence
  Synthetic Polynucleotide
taatacgactcactatagggaaattcacaatgtggccccttgcttgcatgaacagaggagacatgcaatgaaggggccaaacctggcggcagcgcaaaagatg

SEQ ID NO: 139739 - DNA, 103 bp, Artificial Sequence
  Synthetic Polynucleotide
taatacgactcactatagggggttgtaataaaattcacaatgtggcccctaacagaggagaaggggcatgattgtgaataacctggcggcagcgcaaaagatg

SEQ ID NO: 139740 - DNA, 103 bp, Artificial Sequence
  Synthetic Polynucleotide
taatacgactcactataggggagaagttgtggttgtaataaaattcacaaaacagaggagattgtgaatgttattacaaaacctggcggcagcgcaaaagatg

SEQ ID NO: 139741 - DNA, 103 bp, Artificial Sequence
  Synthetic Polynucleotide
taatacgactcactatagggatgtggtattgagaagttgtggttgtaataaacagaggagatattacatgcacaacttcaacctggcggcagcgcaaaagatg

SEQ ID NO: 139742 - DNA, 103 bp, Artificial Sequence
  Synthetic Polynucleotide
taatacgactcactataggggggagatatgatgtggtattgagaagttgtaacagaggagaacaactatgcaataccacaacctggcggcagcgcaaaagatg

SEQ ID NO: 139743 - DNA, 103 bp, Artificial Sequence
  Synthetic Polynucleotide
taatacgactcactatagggcattttgtaagggagatatgatgtggtattaacagaggagaaataccatgtcatatctcaacctggcggcagcgcaaaagatg

SEQ ID NO: 139744 - DNA, 103 bp, Artificial Sequence
  Synthetic Polynucleotide
taatacgactcactatagggccaaaataaccattttgtaagggagatatgaacagaggagacatatcatgcttacaaaaaacctggcggcagcgcaaaagatg

SEQ ID NO: 139745 - DNA, 103 bp, Artificial Sequence
  Synthetic Polynucleotide
taatacgactcactataggggatgcgctgtgcctctttctgcacttccataacagaggagaatggaaatgcagaaagagaacctggcggcagcgcaaaagatg

SEQ ID NO: 139746 - DNA, 103 bp, Artificial Sequence
  Synthetic Polynucleotide
taatacgactcactatagggcatgaccagcgacagctgcagactccggtgaacagaggagacaccggatgctgcagctgaacctggcggcagcgcaaaagatg

SEQ ID NO: 139747 - DNA, 103 bp, Artificial Sequence
  Synthetic Polynucleotide
taatacgactcactataggggggcgctgcgcatgaccagcgacagctgcaaacagaggagatgcagcatgcgctggtcaaacctggcggcagcgcaaaagatg

SEQ ID NO: 139748 - DNA, 103 bp, Artificial Sequence
  Synthetic Polynucleotide
taatacgactcactatagggtagagctcccgggcgctgcgcatgaccagcaacagaggagagctggtatggcgcagcgcaacctggcggcagcgcaaaagatg

SEQ ID NO: 139749 - DNA, 103 bp, Artificial Sequence
  Synthetic Polynucleotide
taatacgactcactatagggggccgagaggtagagctcccgggcgctgcgaacagaggagacgcagcatgcgggagctcaacctggcggcagcgcaaaagatg

SEQ ID NO: 139750 - DNA, 103 bp, Artificial Sequence
  Synthetic Polynucleotide
taatacgactcactatagggcctccaccttggccgagaggtagagctcccaacagaggagagggagcatgacctctcggaacctggcggcagcgcaaaagatg

SEQ ID NO: 139751 - DNA, 103 bp, Artificial Sequence
  Synthetic Polynucleotide
taatacgactcactatagggggctcgagggcctccaccttggccgagaggaacagaggagacctctcatgcaaggtggaaacctggcggcagcgcaaaagatg

SEQ ID NO: 139752 - DNA, 103 bp, Artificial Sequence
  Synthetic Polynucleotide
taatacgactcactatagggcgacacctcgggctcgagggcctccaccttaacagaggagaaaggtgatggccctcgagaacctggcggcagcgcaaaagatg

SEQ ID NO: 139753 - DNA, 103 bp, Artificial Sequence
  Synthetic Polynucleotide
taatacgactcactatagggcggccggcaacgacacctcgggctcgagggaacagaggagaccctcgatgccgaggtgtaacctggcggcagcgcaaaagatg

SEQ ID NO: 139754 - DNA, 103 bp, Artificial Sequence
  Synthetic Polynucleotide
taatacgactcactataggggaggggagggcggccggcaacgacacctcgaacagaggagacgaggtatggttgccggcaacctggcggcagcgcaaaagatg

SEQ ID NO: 139755 - DNA, 103 bp, Artificial Sequence
  Synthetic Polynucleotide
taatacgactcactataggggcgagggtcagaggggagggcggccggcaaaacagaggagattgccgatggccctccccaacctggcggcagcgcaaaagatg

SEQ ID NO: 139756 - DNA, 103 bp, Artificial Sequence
  Synthetic Polynucleotide
taatacgactcactatagggacagggtcatgatgcgctgtgcctctttctaacagaggagaagaaagatgcacagcgcaaacctggcggcagcgcaaaagatg

SEQ ID NO: 139757 - DNA, 103 bp, Artificial Sequence
  Synthetic Polynucleotide
taatacgactcactataggggcgggtgcaggcgagggtcagaggggagggaacagaggagaccctccatgctgaccctcaacctggcggcagcgcaaaagatg

SEQ ID NO: 139758 - DNA, 103 bp, Artificial Sequence
  Synthetic Polynucleotide
taatacgactcactataggggcttctcggggcgggtgcaggcgagggtcaaacagaggagatgacccatgcctgcacccaacctggcggcagcgcaaaagatg

SEQ ID NO: 139759 - DNA, 103 bp, Artificial Sequence
  Synthetic Polynucleotide
taatacgactcactatagggcgtggactcggcttctcggggcgggtgcagaacagaggagactgcacatgccccgagaaaacctggcggcagcgcaaaagatg

SEQ ID NO: 139760 - DNA, 103 bp, Artificial Sequence
  Synthetic Polynucleotide
taatacgactcactatagggctgtctcggccgtggactcggcttctcgggaacagaggagacccgagatgccgagtccaaacctggcggcagcgcaaaagatg

SEQ ID NO: 139761 - DNA, 103 bp, Artificial Sequence
  Synthetic Polynucleotide
taatacgactcactatagggtcgggggtcgctgtctcggccgtggactcgaacagaggagacgagtcatgggccgagacaacctggcggcagcgcaaaagatg

SEQ ID NO: 139762 - DNA, 103 bp, Artificial Sequence
  Synthetic Polynucleotide
taatacgactcactataggggtgctcaccgtcgggggtcgctgtctcggcaacagaggagagccgagatggcgacccccaacctggcggcagcgcaaaagatg

SEQ ID NO: 139763 - DNA, 103 bp, Artificial Sequence
  Synthetic Polynucleotide
taatacgactcactatagggccggaaacgggtgctcaccgtcgggggtcgaacagaggagacgacccatgacggtgagcaacctggcggcagcgcaaaagatg

SEQ ID NO: 139764 - DNA, 103 bp, Artificial Sequence
  Synthetic Polynucleotide
taatacgactcactatagggtccattggctccggaaacgggtgctcaccgaacagaggagacggtgaatgcccgtttccaacctggcggcagcgcaaaagatg

SEQ ID NO: 139765 - DNA, 103 bp, Artificial Sequence
  Synthetic Polynucleotide
taatacgactcactatagggctcctgcgtgtccattggctccggaaacggaacagaggagaccgtttatggagccaatgaacctggcggcagcgcaaaagatg

SEQ ID NO: 139766 - DNA, 103 bp, Artificial Sequence
  Synthetic Polynucleotide
taatacgactcactatagggctgtcggcgcctcctgcgtgtccattggctaacagaggagaagccaaatgacacgcaggaacctggcggcagcgcaaaagatg

SEQ ID NO: 139767 - DNA, 103 bp, Artificial Sequence
  Synthetic Polynucleotide
taatacgactcactatagggttccacaccgacagggtcatgatgcgctgtaacagaggagaacagcgatgcatgaccctaacctggcggcagcgcaaaagatg

SEQ ID NO: 139768 - DNA, 103 bp, Artificial Sequence
  Synthetic Polynucleotide
taatacgactcactataggggtctcctcggctgtcggcgcctcctgcgtgaacagaggagacacgcaatgggcgccgacaacctggcggcagcgcaaaagatg

SEQ ID NO: 139769 - DNA, 103 bp, Artificial Sequence
  Synthetic Polynucleotide
taatacgactcactataggggcaggcggaggtctcctcggctgtcggcgcaacagaggagagcgccgatggccgaggagaacctggcggcagcgcaaaagatg

SEQ ID NO: 139770 - DNA, 103 bp, Artificial Sequence
  Synthetic Polynucleotide
taatacgactcactataggggcggggcacagcaggcggaggtctcctcggaacagaggagaccgaggatgcctccgcctaacctggcggcagcgcaaaagatg

SEQ ID NO: 139771 - DNA, 103 bp, Artificial Sequence
  Synthetic Polynucleotide
taatacgactcactatagggttggcggggcgcggggcacagcaggcggagaacagaggagactccgcatgctgtgccccaacctggcggcagcgcaaaagatg

SEQ ID NO: 139772 - DNA, 103 bp, Artificial Sequence
  Synthetic Polynucleotide
taatacgactcactataggggcggctgactttggcggggcgcggggcacaaacagaggagatgtgccatgcgccccgccaacctggcggcagcgcaaaagatg

SEQ ID NO: 139773 - DNA, 103 bp, Artificial Sequence
  Synthetic Polynucleotide
taatacgactcactatagggtgcgtcgtttgcggctgactttggcggggcaacagaggagagccccgatgaagtcagccaacctggcggcagcgcaaaagatg

SEQ ID NO: 139774 - DNA, 103 bp, Artificial Sequence
  Synthetic Polynucleotide
taatacgactcactatagggaggctgctgctgcgtcgtttgcggctgactaacagaggagaagtcagatgcaaacgacgaacctggcggcagcgcaaaagatg

SEQ ID NO: 139775 - DNA, 103 bp, Artificial Sequence
  Synthetic Polynucleotide
taatacgactcactataggggccgtcgctcaggctgctgctgcgtcgtttaacagaggagaaaacgaatgagcagcagcaacctggcggcagcgcaaaagatg

SEQ ID NO: 139776 - DNA, 103 bp, Artificial Sequence
  Synthetic Polynucleotide
taatacgactcactatagggcagcgtccccgccgtcgctcaggctgctgcaacagaggagagcagcaatgtgagcgacgaacctggcggcagcgcaaaagatg

SEQ ID NO: 139777 - DNA, 103 bp, Artificial Sequence
  Synthetic Polynucleotide
taatacgactcactataggggggaccagtccagcgtccccgccgtcgctcaacagaggagagagcgaatgcggggacgcaacctggcggcagcgcaaaagatg

SEQ ID NO: 139778 - DNA, 103 bp, Artificial Sequence
  Synthetic Polynucleotide
taatacgactcactataggggtgatacatcttccacaccgacagggtcataacagaggagaatgaccatgtcggtgtggaacctggcggcagcgcaaaagatg

SEQ ID NO: 139779 - DNA, 103 bp, Artificial Sequence
  Synthetic Polynucleotide
taatacgactcactatagggtttcttgctcgggaccagtccagcgtccccaacagaggagaggggacatgggactggtcaacctggcggcagcgcaaaagatg

SEQ ID NO: 139780 - DNA, 103 bp, Artificial Sequence
  Synthetic Polynucleotide
taatacgactcactatagggccagacgggctttcttgctcgggaccagtcaacagaggagagactggatgcgagcaagaaacctggcggcagcgcaaaagatg

SEQ ID NO: 139781 - DNA, 103 bp, Artificial Sequence
  Synthetic Polynucleotide
taatacgactcactatagggtccttttcttccagacgggctttcttgctcaacagaggagagagcaaatgagcccgtctaacctggcggcagcgcaaaagatg

SEQ ID NO: 139782 - DNA, 103 bp, Artificial Sequence
  Synthetic Polynucleotide
taatacgactcactatagggctcctcttcttccttttcttccagacgggcaacagaggagagcccgtatggaagaaaagaacctggcggcagcgcaaaagatg

SEQ ID NO: 139783 - DNA, 103 bp, Artificial Sequence
  Synthetic Polynucleotide
taatacgactcactatagggatgacgctccctcctcttcttccttttcttaacagaggagaaagaaaatgaagaagaggaacctggcggcagcgcaaaagatg

SEQ ID NO: 139784 - DNA, 103 bp, Artificial Sequence
  Synthetic Polynucleotide
taatacgactcactataggggcgacttcggatgacgctccctcctcttctaacagaggagaagaagaatggggagcgtcaacctggcggcagcgcaaaagatg

SEQ ID NO: 139785 - DNA, 103 bp, Artificial Sequence
  Synthetic Polynucleotide
taatacgactcactatagggcaggcgatcggcgacttcggatgacgctccaacagaggagaggagcgatgtccgaagtcaacctggcggcagcgcaaaagatg

SEQ ID NO: 139786 - DNA, 103 bp, Artificial Sequence
  Synthetic Polynucleotide
taatacgactcactataggggagggggctgcaggcgatcggcgacttcggaacagaggagaccgaagatgccgatcgccaacctggcggcagcgcaaaagatg

SEQ ID NO: 139787 - DNA, 103 bp, Artificial Sequence
  Synthetic Polynucleotide
taatacgactcactataggggcttgcgccggagggggctgcaggcgatcgaacagaggagacgatcgatggcagcccccaacctggcggcagcgcaaaagatg

SEQ ID NO: 139788 - DNA, 103 bp, Artificial Sequence
  Synthetic Polynucleotide
taatacgactcactatagggggcgccctccgcttgcgccggagggggctgaacagaggagacagcccatgccggcgcaaaacctggcggcagcgcaaaagatg

SEQ ID NO: 139789 - DNA, 103 bp, Artificial Sequence
  Synthetic Polynucleotide
taatacgactcactataggggcatgcgggagtgatacatcttccacaccgaacagaggagacggtgtatgagatgtatcaacctggcggcagcgcaaaagatg

SEQ ID NO: 139790 - DNA, 103 bp, Artificial Sequence
  Synthetic Polynucleotide
taatacgactcactatagggggttgggaaaggcgccctccgcttgcgccgaacagaggagacggcgcatgcggagggcgaacctggcggcagcgcaaaagatg

SEQ ID NO: 139791 - DNA, 103 bp, Artificial Sequence
  Synthetic Polynucleotide
taatacgactcactatagggacgcgggccaggttgggaaaggcgccctccaacagaggagaggagggatgctttcccaaaacctggcggcagcgcaaaagatg

SEQ ID NO: 139792 - DNA, 103 bp, Artificial Sequence
  Synthetic Polynucleotide
taatacgactcactatagggcctctgcaggacgcgggccaggttgggaaaaacagaggagatttcccatgctggcccgcaacctggcggcagcgcaaaagatg

SEQ ID NO: 139793 - DNA, 103 bp, Artificial Sequence
  Synthetic Polynucleotide
taatacgactcactatagggcggagaagcgcctctgcaggacgcgggccaaacagaggagatggcccatgtcctgcagaaacctggcggcagcgcaaaagatg

SEQ ID NO: 139794 - DNA, 103 bp, Artificial Sequence
  Synthetic Polynucleotide
taatacgactcactatagggttcaggaggccggagaagcgcctctgcaggaacagaggagacctgcaatggcgcttctcaacctggcggcagcgcaaaagatg

SEQ ID NO: 139795 - DNA, 103 bp, Artificial Sequence
  Synthetic Polynucleotide
taatacgactcactatagggggggctgcagttcaggaggccggagaagcgaacagaggagacgcttcatgggcctcctgaacctggcggcagcgcaaaagatg

SEQ ID NO: 139796 - DNA, 103 bp, Artificial Sequence
  Synthetic Polynucleotide
taatacgactcactataggggaggggccgcggggctgcagttcaggaggcaacagaggagagcctccatgactgcagccaacctggcggcagcgcaaaagatg

SEQ ID NO: 139797 - DNA, 103 bp, Artificial Sequence
  Synthetic Polynucleotide
taatacgactcactatagggggcgccgtcggaggggccgcggggctgcagaacagaggagactgcagatgcgcggccccaacctggcggcagcgcaaaagatg

SEQ ID NO: 139798 - DNA, 103 bp, Artificial Sequence
  Synthetic Polynucleotide
taatacgactcactataggggcacgcgggcggcgccgtcggaggggccgcaacagaggagagcggccatgccgacggcgaacctggcggcagcgcaaaagatg

SEQ ID NO: 139799 - DNA, 103 bp, Artificial Sequence
  Synthetic Polynucleotide
taatacgactcactataggggctttgcctcgcacgcgggcggcgccgtcgaacagaggagacgacggatgcgcccgcgtaacctggcggcagcgcaaaagatg

SEQ ID NO: 139800 - DNA, 103 bp, Artificial Sequence
  Synthetic Polynucleotide
taatacgactcactatagggccaccgcgctgcatgcgggagtgatacatcaacagaggagagatgtaatgctcccgcataacctggcggcagcgcaaaagatg

SEQ ID NO: 139801 - DNA, 103 bp, Artificial Sequence
  Synthetic Polynucleotide
taatacgactcactatagggcggcaagcgggctttgcctcgcacgcgggcaacagaggagagcccgcatgcgaggcaaaaacctggcggcagcgcaaaagatg

SEQ ID NO: 139802 - DNA, 103 bp, Artificial Sequence
  Synthetic Polynucleotide
taatacgactcactataggggtccgccgggcggcaagcgggctttgcctcaacagaggagagaggcaatgcccgcttgcaacctggcggcagcgcaaaagatg

SEQ ID NO: 139803 - DNA, 103 bp, Artificial Sequence
  Synthetic Polynucleotide
taatacgactcactatagggtgagcatgctgtccgccgggcggcaagcggaacagaggagaccgcttatggcccggcggaacctggcggcagcgcaaaagatg

SEQ ID NO: 139804 - DNA, 103 bp, Artificial Sequence
  Synthetic Polynucleotide
taatacgactcactatagggacgagcacgttgagcatgctgtccgccgggaacagaggagacccggcatgcagcatgctaacctggcggcagcgcaaaagatg

SEQ ID NO: 139805 - DNA, 103 bp, Artificial Sequence
  Synthetic Polynucleotide
taatacgactcactatagggcacggcccgcacgagcacgttgagcatgctaacagaggagaagcatgatgaacgtgctcaacctggcggcagcgcaaaagatg

SEQ ID NO: 139806 - DNA, 103 bp, Artificial Sequence
  Synthetic Polynucleotide
taatacgactcactatagggagaaggccaccacggcccgcacgagcacgtaacagaggagaacgtgcatgtgcgggccgaacctggcggcagcgcaaaagatg

SEQ ID NO: 139807 - DNA, 103 bp, Artificial Sequence
  Synthetic Polynucleotide
taatacgactcactatagggcagccgcaggccaccgcgctgcatgcgggaaacagaggagatcccgcatgcagcgcggtaacctggcggcagcgcaaaagatg

SEQ ID NO: 139808 - DNA, 103 bp, Artificial Sequence
  Synthetic Polynucleotide
taatacgactcactataggggactccggtgcagccgcaggccaccgcgctaacagaggagaagcgcgatggcctgcggcaacctggcggcagcgcaaaagatg

SEQ ID NO: 139809 - DNA, 103 bp, Artificial Sequence
  Synthetic Polynucleotide
taatacgactcactataggggacagctgcagactccggtgcagccgcaggaacagaggagacctgcgatggcaccggagaacctggcggcagcgcaaaagatg

SEQ ID NO: 139810 - DNA, 103 bp, Artificial Sequence
  Synthetic Polynucleotide
taatacgactcactatagggtagaacaatgttcttgtatttttttcccataacagaggagaatgggaatgaaatacaagaacctggcggcagcgcaaaagatg

SEQ ID NO: 139811 - DNA, 103 bp, Artificial Sequence
  Synthetic Polynucleotide
taatacgactcactatagggtctcatttttaaattaagttttaaatcgttaacagaggagaaacgatatgaaacttaataacctggcggcagcgcaaaagatg

SEQ ID NO: 139812 - DNA, 103 bp, Artificial Sequence
  Synthetic Polynucleotide
taatacgactcactatagggtctatcatcctgaatttcgtagattgtggtaacagaggagaaccacaatgtacgaaattaacctggcggcagcgcaaaagatg

SEQ ID NO: 139813 - DNA, 103 bp, Artificial Sequence
  Synthetic Polynucleotide
taatacgactcactatagggccatttttcctctatcatcctgaatttcgtaacagaggagaacgaaaatgaggatgataaacctggcggcagcgcaaaagatg

SEQ ID NO: 139814 - DNA, 103 bp, Artificial Sequence
  Synthetic Polynucleotide
taatacgactcactatagggcccactacatccatttttcctctatcatccaacagaggagaggatgaatgaggaaaaataacctggcggcagcgcaaaagatg

SEQ ID NO: 139815 - DNA, 103 bp, Artificial Sequence
  Synthetic Polynucleotide
taatacgactcactatagggttgtcctgtccccactacatccatttttccaacagaggagaggaaaaatggatgtagtgaacctggcggcagcgcaaaagatg

SEQ ID NO: 139816 - DNA, 103 bp, Artificial Sequence
  Synthetic Polynucleotide
taatacgactcactatagggtattgtgacattgtcctgtccccactacataacagaggagaatgtagatgggacaggacaacctggcggcagcgcaaaagatg

SEQ ID NO: 139817 - DNA, 103 bp, Artificial Sequence
  Synthetic Polynucleotide
taatacgactcactatagggtcacaggggatattgtgacattgtcctgtcaacagaggagagacaggatgatgtcacaaaacctggcggcagcgcaaaagatg

SEQ ID NO: 139818 - DNA, 103 bp, Artificial Sequence
  Synthetic Polynucleotide
taatacgactcactatagggatctccttcttcacaggggatattgtgacaaacagaggagatgtcacatgatcccctgtaacctggcggcagcgcaaaagatg

SEQ ID NO: 139819 - DNA, 103 bp, Artificial Sequence
  Synthetic Polynucleotide
taatacgactcactataggggttggagcttatctccttcttcacaggggaaacagaggagatcccctatgaagaaggagaacctggcggcagcgcaaaagatg

SEQ ID NO: 139820 - DNA, 103 bp, Artificial Sequence
  Synthetic Polynucleotide
taatacgactcactatagggaagcagaaaagttggagcttatctccttctaacagaggagaagaaggatgtaagctccaaacctggcggcagcgcaaaagatg

SEQ ID NO: 139821 - DNA, 103 bp, Artificial Sequence
  Synthetic Polynucleotide
taatacgactcactatagggtctaagtcgaaagcagaaaagttggagcttaacagaggagaaagctcatgcttttctgcaacctggcggcagcgcaaaagatg

SEQ ID NO: 139822 - DNA, 103 bp, Artificial Sequence
  Synthetic Polynucleotide
taatacgactcactatagggcatactcttctctcatttttaaattaagttaacagaggagaaacttaatgtaaaaatgaaacctggcggcagcgcaaaagatg

SEQ ID NO: 139823 - DNA, 103 bp, Artificial Sequence
  Synthetic Polynucleotide
taatacgactcactatagggggttcttttttctaagtcgaaagcagaaaaaacagaggagattttctatgttcgacttaaacctggcggcagcgcaaaagatg

SEQ ID NO: 139824 - DNA, 103 bp, Artificial Sequence
  Synthetic Polynucleotide
taatacgactcactatagggtttgacatctggttcttttttctaagtcgaaacagaggagatcgactatgaaaaaagaaaacctggcggcagcgcaaaagatg

SEQ ID NO: 139825 - DNA, 103 bp, Artificial Sequence
  Synthetic Polynucleotide
taatacgactcactatagggtgaaatcagttttgacatctggttctttttaacagaggagaaaaaagatgcagatgtcaaacctggcggcagcgcaaaagatg

SEQ ID NO: 139826 - DNA, 103 bp, Artificial Sequence
  Synthetic Polynucleotide
taatacgactcactatagggtatgcatttctgaaatcagttttgacatctaacagaggagaagatgtatgaactgatttaacctggcggcagcgcaaaagatg

SEQ ID NO: 139827 - DNA, 103 bp, Artificial Sequence
  Synthetic Polynucleotide
taatacgactcactatagggtggataaaactatgcatttctgaaatcagtaacagaggagaactgatatgagaaatgcaaacctggcggcagcgcaaaagatg

SEQ ID NO: 139828 - DNA, 103 bp, Artificial Sequence
  Synthetic Polynucleotide
taatacgactcactatagggtttctttatctggataaaactatgcatttcaacagaggagagaaatgatgagttttatcaacctggcggcagcgcaaaagatg

SEQ ID NO: 139829 - DNA, 103 bp, Artificial Sequence
  Synthetic Polynucleotide
taatacgactcactatagggggtttgtttttttctttatctggataaaacaacagaggagagttttaatgagataaagaaacctggcggcagcgcaaaagatg

SEQ ID NO: 139830 - DNA, 103 bp, Artificial Sequence
  Synthetic Polynucleotide
taatacgactcactatagggttgtttctcgggtttgtttttttctttatcaacagaggagagataaaatgaaaaacaaaaacctggcggcagcgcaaaagatg

SEQ ID NO: 139831 - DNA, 103 bp, Artificial Sequence
  Synthetic Polynucleotide
taatacgactcactatagggcttggggtcattgtttctcgggtttgttttaacagaggagaaaaacaatgccgagaaacaacctggcggcagcgcaaaagatg

SEQ ID NO: 139832 - DNA, 103 bp, Artificial Sequence
  Synthetic Polynucleotide
taatacgactcactataggggcttcatgctcttggggtcattgtttctcgaacagaggagacgagaaatgatgaccccaaacctggcggcagcgcaaaagatg

SEQ ID NO: 139833 - DNA, 103 bp, Artificial Sequence
  Synthetic Polynucleotide
taatacgactcactatagggtgaattttgtcatactcttctctcatttttaacagaggagaaaaaatatgagaagagtaaacctggcggcagcgcaaaagatg

SEQ ID NO: 139834 - DNA, 103 bp, Artificial Sequence
  Synthetic Polynucleotide
taatacgactcactatagggtcctggggtagcttcatgctcttggggtcaaacagaggagatgacccatggagcatgaaaacctggcggcagcgcaaaagatg

SEQ ID NO: 139835 - DNA, 103 bp, Artificial Sequence
  Synthetic Polynucleotide
taatacgactcactatagggctgacgctgttcctggggtagcttcatgctaacagaggagaagcatgatgctaccccagaacctggcggcagcgcaaaagatg

SEQ ID NO: 139836 - DNA, 103 bp, Artificial Sequence
  Synthetic Polynucleotide
taatacgactcactataggggatatggaagctgacgctgttcctggggtaaacagaggagataccccatgaacagcgtcaacctggcggcagcgcaaaagatg

SEQ ID NO: 139837 - DNA, 103 bp, Artificial Sequence
  Synthetic Polynucleotide
taatacgactcactataggggcctctgaaggatatggaagctgacgctgtaacagaggagaacagcgatggcttccataaacctggcggcagcgcaaaagatg

SEQ ID NO: 139838 - DNA, 103 bp, Artificial Sequence
  Synthetic Polynucleotide
taatacgactcactatagggggttgtgctggcctctgaaggatatggaagaacagaggagacttccaatgccttcagagaacctggcggcagcgcaaaagatg

SEQ ID NO: 139839 - DNA, 103 bp, Artificial Sequence
  Synthetic Polynucleotide
taatacgactcactatagggtctcagggaaggttgtgctggcctctgaagaacagaggagacttcagatgccagcacaaaacctggcggcagcgcaaaagatg

SEQ ID NO: 139840 - DNA, 103 bp, Artificial Sequence
  Synthetic Polynucleotide
taatacgactcactatagggcgaagatggctctcagggaaggttgtgctgaacagaggagacagcacatgcttccctgaaacctggcggcagcgcaaaagatg

SEQ ID NO: 139841 - DNA, 103 bp, Artificial Sequence
  Synthetic Polynucleotide
taatacgactcactatagggctgaggagtccgaagatggctctcagggaaaacagaggagattccctatgagccatcttaacctggcggcagcgcaaaagatg

SEQ ID NO: 139842 - DNA, 103 bp, Artificial Sequence
  Synthetic Polynucleotide
taatacgactcactatagggttggtggcatctgaggagtccgaagatggcaacagaggagagccatcatgggactcctcaacctggcggcagcgcaaaagatg

SEQ ID NO: 139843 - DNA, 103 bp, Artificial Sequence
  Synthetic Polynucleotide
taatacgactcactataggggatggagttgttggtggcatctgaggagtcaacagaggagagactccatggatgccaccaacctggcggcagcgcaaaagatg

SEQ ID NO: 139844 - DNA, 103 bp, Artificial Sequence
  Synthetic Polynucleotide
taatacgactcactataggggtcagcaatctgaattttgtcatactcttcaacagaggagagaagagatggacaaaattaacctggcggcagcgcaaaagatg

SEQ ID NO: 139845 - DNA, 103 bp, Artificial Sequence
  Synthetic Polynucleotide
taatacgactcactataggggaaactgctggatggagttgttggtggcataacagaggagaatgccaatgacaactccaaacctggcggcagcgcaaaagatg

SEQ ID NO: 139846 - DNA, 103 bp, Artificial Sequence
  Synthetic Polynucleotide
taatacgactcactatagggtcttggtgaagaaactgctggatggagttgaacagaggagacaactcatgccagcagttaacctggcggcagcgcaaaagatg

SEQ ID NO: 139847 - DNA, 103 bp, Artificial Sequence
  Synthetic Polynucleotide
taatacgactcactatagggtcttcacttttcttggtgaagaaactgctgaacagaggagacagcagatgcttcaccaaaacctggcggcagcgcaaaagatg

SEQ ID NO: 139848 - DNA, 103 bp, Artificial Sequence
  Synthetic Polynucleotide
taatacgactcactatagggggagattgtgtcttcacttttcttggtgaaaacagaggagattcaccatgaaaagtgaaaacctggcggcagcgcaaaagatg

SEQ ID NO: 139849 - DNA, 103 bp, Artificial Sequence
  Synthetic Polynucleotide
taatacgactcactatagggcattcattttggagattgtgtcttcactttaacagaggagaaaagtgatgacacaatctaacctggcggcagcgcaaaagatg

SEQ ID NO: 139850 - DNA, 103 bp, Artificial Sequence
  Synthetic Polynucleotide
taatacgactcactatagggctcatgaagtcattcattttggagattgtgaacagaggagacacaatatgcaaaatgaaaacctggcggcagcgcaaaagatg

SEQ ID NO: 139851 - DNA, 103 bp, Artificial Sequence
  Synthetic Polynucleotide
taatacgactcactatagggtatctgcatcctcatgaagtcattcattttaacagaggagaaaaatgatggacttcatgaacctggcggcagcgcaaaagatg

SEQ ID NO: 139852 - DNA, 103 bp, Artificial Sequence
  Synthetic Polynucleotide
taatacgactcactatagggcttccttcagtatctgcatcctcatgaagtaacagaggagaacttcaatgggatgcagaaacctggcggcagcgcaaaagatg

SEQ ID NO: 139853 - DNA, 103 bp, Artificial Sequence
  Synthetic Polynucleotide
taatacgactcactatagggaaatgactcccttccttcagtatctgcatcaacagaggagagatgcaatgactgaaggaaacctggcggcagcgcaaaagatg

SEQ ID NO: 139854 - DNA, 103 bp, Artificial Sequence
  Synthetic Polynucleotide
taatacgactcactatagggcggtcctggaaaatgactcccttccttcagaacagaggagactgaagatggggagtcataacctggcggcagcgcaaaagatg

SEQ ID NO: 139855 - DNA, 103 bp, Artificial Sequence
  Synthetic Polynucleotide
taatacgactcactatagggcttccatcaagtcagcaatctgaattttgtaacagaggagaacaaaaatgagattgctgaacctggcggcagcgcaaaagatg

SEQ ID NO: 139856 - DNA, 103 bp, Artificial Sequence
  Synthetic Polynucleotide
taatacgactcactatagggtggtcatgaacggtcctggaaaatgactccaacagaggagaggagtcatgttccaggacaacctggcggcagcgcaaaagatg

SEQ ID NO: 139857 - DNA, 103 bp, Artificial Sequence
  Synthetic Polynucleotide
taatacgactcactataggggggcctatgctggtcatgaacggtcctggaaacagaggagatccaggatggttcatgacaacctggcggcagcgcaaaagatg

SEQ ID NO: 139858 - DNA, 103 bp, Artificial Sequence
  Synthetic Polynucleotide
taatacgactcactataggggctctcagctgggcctatgctggtcatgaaaacagaggagattcatgatgagcataggcaacctggcggcagcgcaaaagatg

SEQ ID NO: 139859 - DNA, 103 bp, Artificial Sequence
  Synthetic Polynucleotide
taatacgactcactatagggtgtggggatggctctcagctgggcctatgcaacagaggagagcatagatgcagctgagaaacctggcggcagcgcaaaagatg

SEQ ID NO: 139860 - DNA, 103 bp, Artificial Sequence
  Synthetic Polynucleotide
taatacgactcactatagggatctgaggagtgtggggatggctctcagctaacagaggagaagctgaatgccatccccaaacctggcggcagcgcaaaagatg

SEQ ID NO: 139861 - DNA, 103 bp, Artificial Sequence
  Synthetic Polynucleotide
taatacgactcactatagggtgatggaggcatctgaggagtgtggggatgaacagaggagacatcccatgactcctcagaacctggcggcagcgcaaaagatg

SEQ ID NO: 139862 - DNA, 103 bp, Artificial Sequence
  Synthetic Polynucleotide
taatacgactcactatagggtgcttggtgttgatggaggcatctgaggagaacagaggagactcctcatgtgcctccataacctggcggcagcgcaaaagatg

SEQ ID NO: 139863 - DNA, 103 bp, Artificial Sequence
  Synthetic Polynucleotide
taatacgactcactatagggaagaaactgctgcttggtgttgatggaggcaacagaggagagcctccatgaacaccaagaacctggcggcagcgcaaaagatg

SEQ ID NO: 139864 - DNA, 103 bp, Artificial Sequence
  Synthetic Polynucleotide
taatacgactcactatagggtttcgtggttaagaaactgctgcttggtgtaacagaggagaacaccaatgagcagtttcaacctggcggcagcgcaaaagatg

SEQ ID NO: 139865 - DNA, 103 bp, Artificial Sequence
  Synthetic Polynucleotide
taatacgactcactatagggtgtcttcacttttcgtggttaagaaactgcaacagaggagagcagttatgtaaccacgaaacctggcggcagcgcaaaagatg

SEQ ID NO: 139866 - DNA, 103 bp, Artificial Sequence
  Synthetic Polynucleotide
taatacgactcactatagggcggaacttttcttccatcaagtcagcaatcaacagaggagagattgcatgcttgatggaaacctggcggcagcgcaaaagatg

SEQ ID NO: 139867 - DNA, 103 bp, Artificial Sequence
  Synthetic Polynucleotide
taatacgactcactatagggttggagattgtgtcttcacttttcgtggttaacagaggagaaaccacatgaagtgaagaaacctggcggcagcgcaaaagatg

SEQ ID NO: 139868 - DNA, 103 bp, Artificial Sequence
  Synthetic Polynucleotide
taatacgactcactataggggtcattcattttggagattgtgtcttcactaacagaggagaagtgaaatgacaatctccaacctggcggcagcgcaaaagatg

SEQ ID NO: 139869 - DNA, 103 bp, Artificial Sequence
  Synthetic Polynucleotide
taatacgactcactatagggtcctcatgaagtcattcattttggagattgaacagaggagacaatctatgaaatgaatgaacctggcggcagcgcaaaagatg

SEQ ID NO: 139870 - DNA, 103 bp, Artificial Sequence
  Synthetic Polynucleotide
taatacgactcactatagggagtatctgcatcctcatgaagtcattcattaacagaggagaaatgaaatgcttcatgagaacctggcggcagcgcaaaagatg

SEQ ID NO: 139871 - DNA, 103 bp, Artificial Sequence
  Synthetic Polynucleotide
taatacgactcactatagggcccttccttcagtatctgcatcctcatgaaaacagaggagattcatgatgatgcagataaacctggcggcagcgcaaaagatg

SEQ ID NO: 139872 - DNA, 103 bp, Artificial Sequence
  Synthetic Polynucleotide
taatacgactcactataggggaaaatgactcccttccttcagtatctgcaaacagaggagatgcagaatgtgaaggaagaacctggcggcagcgcaaaagatg

SEQ ID NO: 139873 - DNA, 103 bp, Artificial Sequence
  Synthetic Polynucleotide
taatacgactcactatagggaacggtcctggaaaatgactcccttccttcaacagaggagagaaggaatggagtcatttaacctggcggcagcgcaaaagatg

SEQ ID NO: 139874 - DNA, 103 bp, Artificial Sequence
  Synthetic Polynucleotide
taatacgactcactataggggctggtcatgaacggtcctggaaaatgactaacagaggagaagtcatatgccaggaccgaacctggcggcagcgcaaaagatg

SEQ ID NO: 139875 - DNA, 103 bp, Artificial Sequence
  Synthetic Polynucleotide
taatacgactcactatagggctgggcctatgctggtcatgaacggtcctgaacagaggagacaggacatgtcatgaccaaacctggcggcagcgcaaaagatg

SEQ ID NO: 139876 - DNA, 103 bp, Artificial Sequence
  Synthetic Polynucleotide
taatacgactcactatagggtggctctcagctgggcctatgctggtcatgaacagaggagacatgacatgcataggcccaacctggcggcagcgcaaaagatg

SEQ ID NO: 139877 - DNA, 103 bp, Artificial Sequence
  Synthetic Polynucleotide
taatacgactcactatagggagcatcacctcggaacttttcttccatcaaaacagaggagattgatgatggaaaagttcaacctggcggcagcgcaaaagatg

SEQ ID NO: 139878 - DNA, 103 bp, Artificial Sequence
  Synthetic Polynucleotide
taatacgactcactatagggagtgtggggatggctctcagctgggcctataacagaggagaataggcatggctgagagcaacctggcggcagcgcaaaagatg

SEQ ID NO: 139879 - DNA, 103 bp, Artificial Sequence
  Synthetic Polynucleotide
taatacgactcactataggggcatctgaggagtgtggggatggctctcagaacagaggagactgagaatgatccccacaaacctggcggcagcgcaaaagatg

SEQ ID NO: 139880 - DNA, 103 bp, Artificial Sequence
  Synthetic Polynucleotide
taatacgactcactataggggttgatggaggcatctgaggagtgtggggaaacagaggagatccccaatgtcctcagataacctggcggcagcgcaaaagatg

SEQ ID NO: 139881 - DNA, 103 bp, Artificial Sequence
  Synthetic Polynucleotide
taatacgactcactataggggctgcttggtgttgatggaggcatctgaggaacagaggagacctcagatgcctccatcaaacctggcggcagcgcaaaagatg

SEQ ID NO: 139882 - DNA, 103 bp, Artificial Sequence
  Synthetic Polynucleotide
taatacgactcactatagggttaagaaactgctgcttggtgttgatggagaacagaggagactccatatgcaccaagcaaacctggcggcagcgcaaaagatg

SEQ ID NO: 139883 - DNA, 103 bp, Artificial Sequence
  Synthetic Polynucleotide
taatacgactcactatagggttcaacgtggttaagaaactgctgcttggtaacagaggagaaccaagatgcagtttcttaacctggcggcagcgcaaaagatg

SEQ ID NO: 139884 - DNA, 103 bp, Artificial Sequence
  Synthetic Polynucleotide
taatacgactcactatagggcagtcttggtttcaacgtggttaagaaactaacagaggagaagtttcatgaccacgttgaacctggcggcagcgcaaaagatg

SEQ ID NO: 139885 - DNA, 103 bp, Artificial Sequence
  Synthetic Polynucleotide
taatacgactcactataggggttcagtcttcagtcttggtttcaacgtggaacagaggagaccacgtatgaaccaagacaacctggcggcagcgcaaaagatg

SEQ ID NO: 139886 - DNA, 103 bp, Artificial Sequence
  Synthetic Polynucleotide
taatacgactcactatagggacttcttcaggttcagtcttcagtcttggtaacagaggagaaccaagatggaagactgaaacctggcggcagcgcaaaagatg

SEQ ID NO: 139887 - DNA, 103 bp, Artificial Sequence
  Synthetic Polynucleotide
taatacgactcactatagggttctatggaaacttcttcaggttcagtcttaacagaggagaaagactatgcctgaagaaaacctggcggcagcgcaaaagatg

SEQ ID NO: 139888 - DNA, 103 bp, Artificial Sequence
  Synthetic Polynucleotide
taatacgactcactatagggtgcccaaaccagcatcacctcggaacttttaacagaggagaaaaagtatggaggtgatgaacctggcggcagcgcaaaagatg

SEQ ID NO: 139889 - DNA, 103 bp, Artificial Sequence
  Synthetic Polynucleotide
taatacgactcactataggggggcactgtcttctatggaaacttcttcagaacagaggagactgaagatgtttccatagaacctggcggcagcgcaaaagatg

SEQ ID NO: 139890 - DNA, 103 bp, Artificial Sequence
  Synthetic Polynucleotide
taatacgactcactatagggaggtcactctgggcactgtcttctatggaaaacagaggagattccatatgagacagtgcaacctggcggcagcgcaaaagatg

SEQ ID NO: 139891 - DNA, 103 bp, Artificial Sequence
  Synthetic Polynucleotide
taatacgactcactatagggcacttctttgaggtcactctgggcactgtcaacagaggagagacagtatgcagagtgacaacctggcggcagcgcaaaagatg

SEQ ID NO: 139892 - DNA, 103 bp, Artificial Sequence
  Synthetic Polynucleotide
taatacgactcactatagggtcagcaccatcacttctttgaggtcactctaacagaggagaagagtgatgtcaaagaagaacctggcggcagcgcaaaagatg

SEQ ID NO: 139893 - DNA, 103 bp, Artificial Sequence
  Synthetic Polynucleotide
taatacgactcactatagggtctgttgcgttcagcaccatcacttctttgaacagaggagacaaagaatggatggtgctaacctggcggcagcgcaaaagatg

SEQ ID NO: 139894 - DNA, 103 bp, Artificial Sequence
  Synthetic Polynucleotide
taatacgactcactatagggtacaaatgattctgttgcgttcagcaccataacagaggagaatggtgatgaacgcaacaaacctggcggcagcgcaaaagatg

SEQ ID NO: 139895 - DNA, 103 bp, Artificial Sequence
  Synthetic Polynucleotide
taatacgactcactatagggtgggctcatatacaaatgattctgttgcgtaacagaggagaacgcaaatgaatcatttgaacctggcggcagcgcaaaagatg

SEQ ID NO: 139896 - DNA, 103 bp, Artificial Sequence
  Synthetic Polynucleotide
taatacgactcactatagggttctgctctttgggctcatatacaaatgataacagaggagaatcattatgatatgagccaacctggcggcagcgcaaaagatg

SEQ ID NO: 139897 - DNA, 103 bp, Artificial Sequence
  Synthetic Polynucleotide
taatacgactcactatagggaaacattttcttctgctctttgggctcataaacagaggagatatgagatgaaagagcagaacctggcggcagcgcaaaagatg

SEQ ID NO: 139898 - DNA, 103 bp, Artificial Sequence
  Synthetic Polynucleotide
taatacgactcactatagggctgtggcatgaaacattttcttctgctcttaacagaggagaaagagcatgagaaaatgtaacctggcggcagcgcaaaagatg

SEQ ID NO: 139899 - DNA, 103 bp, Artificial Sequence
  Synthetic Polynucleotide
taatacgactcactatagggtttattagtttgcccaaaccagcatcacctaacagaggagaaggtgaatgtggtttgggaacctggcggcagcgcaaaagatg

SEQ ID NO: 139900 - DNA, 103 bp, Artificial Sequence
  Synthetic Polynucleotide
taatacgactcactatagggtcagttgccactgtggcatgaaacattttcaacagaggagagaaaatatgtcatgccacaacctggcggcagcgcaaaagatg

SEQ ID NO: 139901 - DNA, 103 bp, Artificial Sequence
  Synthetic Polynucleotide
taatacgactcactataggggacttcattctcagttgccactgtggcatgaacagaggagacatgccatggtggcaactaacctggcggcagcgcaaaagatg

SEQ ID NO: 139902 - DNA, 103 bp, Artificial Sequence
  Synthetic Polynucleotide
taatacgactcactatagggtcactcggaagacttcattctcagttgccaaacagaggagatggcaaatgagaatgaagaacctggcggcagcgcaaaagatg

SEQ ID NO: 139903 - DNA, 103 bp, Artificial Sequence
  Synthetic Polynucleotide
taatacgactcactatagggttaaaaaccttcactcggaagacttcattcaacagaggagagaatgaatgcttccgagtaacctggcggcagcgcaaaagatg

SEQ ID NO: 139904 - DNA, 103 bp, Artificial Sequence
  Synthetic Polynucleotide
taatacgactcactatagggtaggtcaatattaaaaaccttcactcggaaaacagaggagattccgaatgaaggtttttaacctggcggcagcgcaaaagatg

SEQ ID NO: 139905 - DNA, 103 bp, Artificial Sequence
  Synthetic Polynucleotide
taatacgactcactatagggacttctcctttaggtcaatattaaaaacctaacagaggagaaggtttatgatattgaccaacctggcggcagcgcaaaagatg

SEQ ID NO: 139906 - DNA, 103 bp, Artificial Sequence
  Synthetic Polynucleotide
taatacgactcactatagggtttggggtgaacttctcctttaggtcaataaacagaggagatattgaatgaaaggagaaaacctggcggcagcgcaaaagatg

SEQ ID NO: 139907 - DNA, 103 bp, Artificial Sequence
  Synthetic Polynucleotide
taatacgactcactatagggaatgatcttctttggggtgaacttctccttaacagaggagaaaggagatgttcaccccaaacctggcggcagcgcaaaagatg

SEQ ID NO: 139908 - DNA, 103 bp, Artificial Sequence
  Synthetic Polynucleotide
taatacgactcactatagggttgctatggcaatgatcttctttggggtgaaacagaggagatcacccatgagaagatcaaacctggcggcagcgcaaaagatg

SEQ ID NO: 139909 - DNA, 103 bp, Artificial Sequence
  Synthetic Polynucleotide
taatacgactcactatagggcaaacataatttgctatggcaatgatcttcaacagaggagagaagatatgtgccatagcaacctggcggcagcgcaaaagatg

SEQ ID NO: 139910 - DNA, 103 bp, Artificial Sequence
  Synthetic Polynucleotide
taatacgactcactatagggttcgaaaatttttattagtttgcccaaaccaacagaggagaggtttgatgaaactaataaacctggcggcagcgcaaaagatg

SEQ ID NO: 139911 - DNA, 103 bp, Artificial Sequence
  Synthetic Polynucleotide
taatacgactcactatagggcccattgcggcaaacataatttgctatggcaacagaggagagccataatgaattatgttaacctggcggcagcgcaaaagatg

SEQ ID NO: 139912 - DNA, 103 bp, Artificial Sequence
  Synthetic Polynucleotide
taatacgactcactatagggcctccaggaacccattgcggcaaacataataacagaggagaattatgatggccgcaatgaacctggcggcagcgcaaaagatg

SEQ ID NO: 139913 - DNA, 103 bp, Artificial Sequence
  Synthetic Polynucleotide
taatacgactcactatagggaaaggatatacctccaggaacccattgcggaacagaggagaccgcaaatggttcctggaaacctggcggcagcgcaaaagatg

SEQ ID NO: 139914 - DNA, 103 bp, Artificial Sequence
  Synthetic Polynucleotide
taatacgactcactatagggcacaagtgtgaaaggatatacctccaggaaaacagaggagattcctgatggtatatcctaacctggcggcagcgcaaaagatg

SEQ ID NO: 139915 - DNA, 103 bp, Artificial Sequence
  Synthetic Polynucleotide
taatacgactcactatagggtcacatcagccacaagtgtgaaaggatataaacagaggagatatatcatgtcacacttgaacctggcggcagcgcaaaagatg

SEQ ID NO: 139916 - DNA, 103 bp, Artificial Sequence
  Synthetic Polynucleotide
taatacgactcactatagggcggtcagcattcacatcagccacaagtgtgaacagaggagacacactatgggctgatgtaacctggcggcagcgcaaaagatg

SEQ ID NO: 139917 - DNA, 103 bp, Artificial Sequence
  Synthetic Polynucleotide
taatacgactcactatagggctccatgtttcggtcagcattcacatcagcaacagaggagagctgatatgaatgctgacaacctggcggcagcgcaaaagatg

SEQ ID NO: 139918 - DNA, 103 bp, Artificial Sequence
  Synthetic Polynucleotide
taatacgactcactatagggcttttgggatctccatgtttcggtcagcataacagaggagaatgctgatggaaacatggaacctggcggcagcgcaaaagatg

SEQ ID NO: 139919 - DNA, 103 bp, Artificial Sequence
  Synthetic Polynucleotide
taatacgactcactatagggctaatcaatccttttgggatctccatgtttaacagaggagaaaacatatggatcccaaaaacctggcggcagcgcaaaagatg

SEQ ID NO: 139920 - DNA, 103 bp, Artificial Sequence
  Synthetic Polynucleotide
taatacgactcactataggggctggcacttctaatcaatccttttgggataacagaggagaatcccaatgggattgattaacctggcggcagcgcaaaagatg

SEQ ID NO: 139921 - DNA, 103 bp, Artificial Sequence
  Synthetic Polynucleotide
taatacgactcactatagggatccttttagtagaacaatgttcttgtattaacagaggagaaatacaatgacattgttcaacctggcggcagcgcaaaagatg

SEQ ID NO: 139922 - DNA, 103 bp, Artificial Sequence
  Synthetic Polynucleotide
taatacgactcactatagggttggtatatcttcgaaaatttttattagttaacagaggagaaactaaatgaaattttcgaacctggcggcagcgcaaaagatg

SEQ ID NO: 139923 - DNA, 103 bp, Artificial Sequence
  Synthetic Polynucleotide
taatacgactcactatagggtaggagttacgctggcacttctaatcaatcaacagaggagagattgaatggaagtgccaaacctggcggcagcgcaaaagatg

SEQ ID NO: 139924 - DNA, 103 bp, Artificial Sequence
  Synthetic Polynucleotide
taatacgactcactatagggtgattgattttaggagttacgctggcacttaacagaggagaaagtgcatgcgtaactccaacctggcggcagcgcaaaagatg

SEQ ID NO: 139925 - DNA, 103 bp, Artificial Sequence
  Synthetic Polynucleotide
taatacgactcactatagggtgagcaaagctgattgattttaggagttacaacagaggagagtaactatgaaaatcaataacctggcggcagcgcaaaagatg

SEQ ID NO: 139926 - DNA, 103 bp, Artificial Sequence
  Synthetic Polynucleotide
taatacgactcactatagggctttagtttgtgagcaaagctgattgatttaacagaggagaaaatcaatgagctttgctaacctggcggcagcgcaaaagatg

SEQ ID NO: 139927 - DNA, 103 bp, Artificial Sequence
  Synthetic Polynucleotide
taatacgactcactatagggacaaaacttcctttagtttgtgagcaaagcaacagaggagagctttgatgacaaactaaaacctggcggcagcgcaaaagatg

SEQ ID NO: 139928 - DNA, 103 bp, Artificial Sequence
  Synthetic Polynucleotide
taatacgactcactatagggcaccccattcacaaaacttcctttagtttgaacagaggagacaaactatgggaagttttaacctggcggcagcgcaaaagatg

SEQ ID NO: 139929 - DNA, 103 bp, Artificial Sequence
  Synthetic Polynucleotide
taatacgactcactataggggtacctcaaacaccccattcacaaaacttcaacagaggagagaagttatgtgaatggggaacctggcggcagcgcaaaagatg

SEQ ID NO: 139930 - DNA, 103 bp, Artificial Sequence
  Synthetic Polynucleotide
taatacgactcactatagggtttttcttatgtacctcaaacaccccattcaacagaggagagaatggatggtttgaggtaacctggcggcagcgcaaaagatg

SEQ ID NO: 139931 - DNA, 103 bp, Artificial Sequence
  Synthetic Polynucleotide
taatacgactcactatagggaccccttacatttttcttatgtacctcaaaaacagaggagatttgagatgcataagaaaaacctggcggcagcgcaaaagatg

SEQ ID NO: 139932 - DNA, 103 bp, Artificial Sequence
  Synthetic Polynucleotide
taatacgactcactatagggaagtgaattcaccccttacatttttcttataacagaggagaataagaatgatgtaagggaacctggcggcagcgcaaaagatg

SEQ ID NO: 139933 - DNA, 103 bp, Artificial Sequence
  Synthetic Polynucleotide
taatacgactcactatagggtcttcaagcgttggtatatcttcgaaaattaacagaggagaaattttatgagatataccaacctggcggcagcgcaaaagatg

SEQ ID NO: 139934 - DNA, 103 bp, Artificial Sequence
  Synthetic Polynucleotide
taatacgactcactatagggatttcataataagtgaattcaccccttacaaacagaggagatgtaagatgtgaattcacaacctggcggcagcgcaaaagatg

SEQ ID NO: 139935 - DNA, 103 bp, Artificial Sequence
  Synthetic Polynucleotide
taatacgactcactatagggattatcttgtatttcataataagtgaattcaacagaggagagaattcatgtattatgaaaacctggcggcagcgcaaaagatg

SEQ ID NO: 139936 - DNA, 103 bp, Artificial Sequence
  Synthetic Polynucleotide
taatacgactcactatagggtcttccctgtattatcttgtatttcataataacagaggagaattatgatgtacaagataaacctggcggcagcgcaaaagatg

SEQ ID NO: 139937 - DNA, 103 bp, Artificial Sequence
  Synthetic Polynucleotide
taatacgactcactatagggaccacttccatcttccctgtattatcttgtaacagaggagaacaagaatgtacagggaaaacctggcggcagcgcaaaagatg

SEQ ID NO: 139938 - DNA, 103 bp, Artificial Sequence
  Synthetic Polynucleotide
taatacgactcactatagggtccatgcaccaccacttccatcttccctgtaacagaggagaacagggatgatggaagtgaacctggcggcagcgcaaaagatg

SEQ ID NO: 139939 - DNA, 103 bp, Artificial Sequence
  Synthetic Polynucleotide
taatacgactcactatagggtggtcagtcgtccatgcaccaccacttccaaacagaggagatggaagatgtggtgcatgaacctggcggcagcgcaaaagatg

SEQ ID NO: 139940 - DNA, 103 bp, Artificial Sequence
  Synthetic Polynucleotide
taatacgactcactatagggcagttgattgtggtcagtcgtccatgcaccaacagaggagaggtgcaatgacgactgacaacctggcggcagcgcaaaagatg

SEQ ID NO: 139941 - DNA, 103 bp, Artificial Sequence
  Synthetic Polynucleotide
taatacgactcactatagggtccttcctcacagttgattgtggtcagtcgaacagaggagacgactgatgacaatcaacaacctggcggcagcgcaaaagatg

SEQ ID NO: 139942 - DNA, 103 bp, Artificial Sequence
  Synthetic Polynucleotide
taatacgactcactatagggtcagtttatctccttcctcacagttgattgaacagaggagacaatcaatggtgaggaagaacctggcggcagcgcaaaagatg

SEQ ID NO: 139943 - DNA, 103 bp, Artificial Sequence
  Synthetic Polynucleotide
taatacgactcactatagggcaggtgagtttcagtttatctccttcctcaaacagaggagatgaggaatgagataaactaacctggcggcagcgcaaaagatg

SEQ ID NO: 139944 - DNA, 103 bp, Artificial Sequence
  Synthetic Polynucleotide
taatacgactcactatagggttcagccaggtcttcaagcgttggtatatcaacagaggagagatataatgacgcttgaaaacctggcggcagcgcaaaagatg

SEQ ID NO: 139945 - DNA, 103 bp, Artificial Sequence
  Synthetic Polynucleotide
taatacgactcactatagggcaattcaaagcaggtgagtttcagtttatcaacagaggagagataaaatgaaactcaccaacctggcggcagcgcaaaagatg

SEQ ID NO: 139946 - DNA, 103 bp, Artificial Sequence
  Synthetic Polynucleotide
taatacgactcactatagggttttcggtgccaattcaaagcaggtgagttaacagaggagaaactcaatggctttgaataacctggcggcagcgcaaaagatg

SEQ ID NO: 139947 - DNA, 103 bp, Artificial Sequence
  Synthetic Polynucleotide
taatacgactcactataggggtattcccacttttcggtgccaattcaaagaacagaggagactttgaatgggcaccgaaaacctggcggcagcgcaaaagatg

SEQ ID NO: 139948 - DNA, 103 bp, Artificial Sequence
  Synthetic Polynucleotide
taatacgactcactatagggcaactccccggtattcccacttttcggtgcaacagaggagagcaccgatgagtgggaataacctggcggcagcgcaaaagatg

SEQ ID NO: 139949 - DNA, 103 bp, Artificial Sequence
  Synthetic Polynucleotide
taatacgactcactatagggttacagatctcaactccccggtattcccacaacagaggagagtgggaatgccggggagtaacctggcggcagcgcaaaagatg

SEQ ID NO: 139950 - DNA, 103 bp, Artificial Sequence
  Synthetic Polynucleotide
taatacgactcactatagggtgactatgaattacagatctcaactccccgaacagaggagacggggaatggagatctgtaacctggcggcagcgcaaaagatg

SEQ ID NO: 139951 - DNA, 103 bp, Artificial Sequence
  Synthetic Polynucleotide
taatacgactcactataggggaccttgatgtgactatgaattacagatctaacagaggagaagatctatgattcatagtaacctggcggcagcgcaaaagatg

SEQ ID NO: 139952 - DNA, 103 bp, Artificial Sequence
  Synthetic Polynucleotide
taatacgactcactatagggtggtcttgatgaccttgatgtgactatgaaaacagaggagattcataatgacatcaaggaacctggcggcagcgcaaaagatg

SEQ ID NO: 139953 - DNA, 103 bp, Artificial Sequence
  Synthetic Polynucleotide
taatacgactcactatagggttgtttttcctggtcttgatgaccttgatgaacagaggagacatcaaatgcatcaagacaacctggcggcagcgcaaaagatg

SEQ ID NO: 139954 - DNA, 103 bp, Artificial Sequence
  Synthetic Polynucleotide
taatacgactcactatagggtatgtctttcttgtttttcctggtcttgataacagaggagaatcaagatgaggaaaaacaacctggcggcagcgcaaaagatg

SEQ ID NO: 139955 - DNA, 103 bp, Artificial Sequence
  Synthetic Polynucleotide
taatacgactcactatagggttttaagagtttcagccaggtcttcaagcgaacagaggagacgcttgatgacctggctgaacctggcggcagcgcaaaagatg

SEQ ID NO: 139956 - DNA, 103 bp, Artificial Sequence
  Synthetic Polynucleotide
taatacgactcactatagggcaggattgagtatgtctttcttgtttttccaacagaggagaggaaaaatgagaaagacaaacctggcggcagcgcaaaagatg

SEQ ID NO: 139957 - DNA, 103 bp, Artificial Sequence
  Synthetic Polynucleotide
taatacgactcactatagggatacttgaatcaggattgagtatgtctttcaacagaggagagaaagaatgactcaatccaacctggcggcagcgcaaaagatg

SEQ ID NO: 139958 - DNA, 103 bp, Artificial Sequence
  Synthetic Polynucleotide
taatacgactcactatagggtgaagtttccatacttgaatcaggattgagaacagaggagactcaatatggattcaagtaacctggcggcagcgcaaaagatg

SEQ ID NO: 139959 - DNA, 103 bp, Artificial Sequence
  Synthetic Polynucleotide
taatacgactcactatagggaaaagtctggtgaagtttccatacttgaataacagaggagaattcaaatgtggaaacttaacctggcggcagcgcaaaagatg

SEQ ID NO: 139960 - DNA, 103 bp, Artificial Sequence
  Synthetic Polynucleotide
taatacgactcactatagggaacttttcttttttaagagtttcagccaggaacagaggagacctggcatgaactcttaaaacctggcggcagcgcaaaagatg

SEQ ID NO: 139961 - DNA, 103 bp, Artificial Sequence
  Synthetic Polynucleotide
taatacgactcactatagggttttacttttaacttttcttttttaagagtaacagaggagaactcttatgaaagaaaagaacctggcggcagcgcaaaagatg

SEQ ID NO: 139962 - DNA, 103 bp, Artificial Sequence
  Synthetic Polynucleotide
taatacgactcactataggggggctggtccttttacttttaacttttcttaacagaggagaaagaaaatgtaaaagtaaaacctggcggcagcgcaaaagatg

SEQ ID NO: 139963 - DNA, 103 bp, Artificial Sequence
  Synthetic Polynucleotide
taatacgactcactatagggtttcttgatagggctggtccttttacttttaacagaggagaaaaagtatgaggaccagcaacctggcggcagcgcaaaagatg

SEQ ID NO: 139964 - DNA, 103 bp, Artificial Sequence
  Synthetic Polynucleotide
taatacgactcactatagggcttcttcctctttcttgatagggctggtccaacagaggagaggaccaatgctatcaagaaacctggcggcagcgcaaaagatg

SEQ ID NO: 139965 - DNA, 103 bp, Artificial Sequence
  Synthetic Polynucleotide
taatacgactcactatagggcatccacttccttcttcctctttcttgataaacagaggagatatcaaatgagaggaagaaacctggcggcagcgcaaaagatg

SEQ ID NO: 139966 - DNA, 103 bp, Artificial Sequence
  Synthetic Polynucleotide
taatacgactcactatagggatgacctctaatccttttagtagaacaatgaacagaggagacattgtatgactaaaaggaacctggcggcagcgcaaaagatg

SEQ ID NO: 139967 - DNA, 103 bp, Artificial Sequence
  Synthetic Polynucleotide
taatacgactcactatagggggtgaagtagcatccacttccttcttcctcaacagaggagagaggaaatgggaagtggaaacctggcggcagcgcaaaagatg

SEQ ID NO: 139968 - DNA, 103 bp, Artificial Sequence
  Synthetic Polynucleotide
taatacgactcactatagggggagggtgcaggtgaagtagcatccacttcaacagaggagagaagtgatggctacttcaaacctggcggcagcgcaaaagatg

SEQ ID NO: 139969 - DNA, 103 bp, Artificial Sequence
  Synthetic Polynucleotide
taatacgactcactatagggtgctgcttgtggagggtgcaggtgaagtagaacagaggagactacttatgctgcaccctaacctggcggcagcgcaaaagatg

SEQ ID NO: 139970 - DNA, 103 bp, Artificial Sequence
  Synthetic Polynucleotide
taatacgactcactataggggttttgacagtgctgcttgtggagggtgcaaacagaggagatgcaccatgcacaagcagaacctggcggcagcgcaaaagatg

SEQ ID NO: 139971 - DNA, 103 bp, Artificial Sequence
  Synthetic Polynucleotide
taatacgactcactatagggtgctccttcagttttgacagtgctgcttgtaacagaggagaacaagcatgactgtcaaaaacctggcggcagcgcaaaagatg

SEQ ID NO: 139972 - DNA, 103 bp, Artificial Sequence
  Synthetic Polynucleotide
taatacgactcactataggggagttgcctctgctccttcagttttgacagaacagaggagactgtcaatgctgaaggagaacctggcggcagcgcaaaagatg

SEQ ID NO: 139973 - DNA, 103 bp, Artificial Sequence
  Synthetic Polynucleotide
taatacgactcactatagggtgagctccaggagttgcctctgctccttcaaacagaggagatgaaggatgagaggcaacaacctggcggcagcgcaaaagatg

SEQ ID NO: 139974 - DNA, 103 bp, Artificial Sequence
  Synthetic Polynucleotide
taatacgactcactatagggttttcttttctgagctccaggagttgcctcaacagaggagagaggcaatgcctggagctaacctggcggcagcgcaaaagatg

SEQ ID NO: 139975 - DNA, 103 bp, Artificial Sequence
  Synthetic Polynucleotide
taatacgactcactatagggtggttgatttttttcttttctgagctccagaacagaggagactggagatgagaaaagaaaacctggcggcagcgcaaaagatg

SEQ ID NO: 139976 - DNA, 103 bp, Artificial Sequence
  Synthetic Polynucleotide
taatacgactcactataggggccttttctttggttgatttttttcttttcaacagaggagagaaaagatgaaaatcaacaacctggcggcagcgcaaaagatg

SEQ ID NO: 139977 - DNA, 103 bp, Artificial Sequence
  Synthetic Polynucleotide
taatacgactcactatagggataatcattgatgacctctaatccttttagaacagaggagactaaaaatgttagaggtcaacctggcggcagcgcaaaagatg

SEQ ID NO: 139978 - DNA, 103 bp, Artificial Sequence
  Synthetic Polynucleotide
taatacgactcactatagggtttgggtccagccttttctttggttgatttaacagaggagaaaatcaatgaaagaaaagaacctggcggcagcgcaaaagatg

SEQ ID NO: 139979 - DNA, 103 bp, Artificial Sequence
  Synthetic Polynucleotide
taatacgactcactatagggccttactccctttgggtccagccttttcttaacagaggagaaagaaaatgctggacccaaacctggcggcagcgcaaaagatg

SEQ ID NO: 139980 - DNA, 103 bp, Artificial Sequence
  Synthetic Polynucleotide
taatacgactcactatagggtcctcggacaccttactccctttgggtccaaacagaggagatggaccatgagggagtaaaacctggcggcagcgcaaaagatg

SEQ ID NO: 139981 - DNA, 103 bp, Artificial Sequence
  Synthetic Polynucleotide
taatacgactcactatagggctgagtctgttcctcggacaccttactcccaacagaggagagggagtatggtgtccgagaacctggcggcagcgcaaaagatg

SEQ ID NO: 139982 - DNA, 103 bp, Artificial Sequence
  Synthetic Polynucleotide
taatacgactcactataggggagagggaggctgagtctgttcctcggacaaacagaggagatgtccgatgaacagactcaacctggcggcagcgcaaaagatg

SEQ ID NO: 139983 - DNA, 103 bp, Artificial Sequence
  Synthetic Polynucleotide
taatacgactcactataggggctcctgcaggagagggaggctgagtctgtaacagaggagaacagacatggcctccctcaacctggcggcagcgcaaaagatg

SEQ ID NO: 139984 - DNA, 103 bp, Artificial Sequence
  Synthetic Polynucleotide
taatacgactcactatagggggacatgccggctcctgcaggagagggaggaacagaggagacctcccatgcctgcaggaaacctggcggcagcgcaaaagatg

SEQ ID NO: 139985 - DNA, 103 bp, Artificial Sequence
  Synthetic Polynucleotide
taatacgactcactatagggccatggctgtggacatgccggctcctgcagaacagaggagactgcagatgccggcatgtaacctggcggcagcgcaaaagatg

SEQ ID NO: 139986 - DNA, 103 bp, Artificial Sequence
  Synthetic Polynucleotide
taatacgactcactatagggggggaacggcccatggctgtggacatgccgaacagaggagacggcatatgcacagccataacctggcggcagcgcaaaagatg

SEQ ID NO: 139987 - DNA, 103 bp, Artificial Sequence
  Synthetic Polynucleotide
taatacgactcactatagggcttgggagatggggaacggcccatggctgtaacagaggagaacagccatgggccgttccaacctggcggcagcgcaaaagatg

SEQ ID NO: 139988 - DNA, 103 bp, Artificial Sequence
  Synthetic Polynucleotide
taatacgactcactatagggttctaaaatgataatcattgatgacctctaaacagaggagatagaggatgtcaatgattaacctggcggcagcgcaaaagatg

SEQ ID NO: 139989 - DNA, 103 bp, Artificial Sequence
  Synthetic Polynucleotide
taatacgactcactatagggacaatgaggtcttgggagatggggaacggcaacagaggagagccgttatgcatctcccaaacctggcggcagcgcaaaagatg

SEQ ID NO: 139990 - DNA, 103 bp, Artificial Sequence
  Synthetic Polynucleotide
taatacgactcactatagggggtggagctgacaatgaggtcttgggagataacagaggagaatctccatggacctcattaacctggcggcagcgcaaaagatg

SEQ ID NO: 139991 - DNA, 103 bp, Artificial Sequence
  Synthetic Polynucleotide
taatacgactcactatagggagaactgttgggtggagctgacaatgaggtaacagaggagaacctcaatgtcagctccaaacctggcggcagcgcaaaagatg

SEQ ID NO: 139992 - DNA, 103 bp, Artificial Sequence
  Synthetic Polynucleotide
taatacgactcactatagggtctcagttgaagaactgttgggtggagctgaacagaggagacagctcatgccaacagttaacctggcggcagcgcaaaagatg

SEQ ID NO: 139993 - DNA, 103 bp, Artificial Sequence
  Synthetic Polynucleotide
taatacgactcactataggggttttcgggttctcagttgaagaactgttgaacagaggagacaacagatgttcaactgaaacctggcggcagcgcaaaagatg

SEQ ID NO: 139994 - DNA, 103 bp, Artificial Sequence
  Synthetic Polynucleotide
taatacgactcactatagggtttggccactgttttcgggttctcagttgaaacagaggagatcaactatgaacccgaaaaacctggcggcagcgcaaaagatg

SEQ ID NO: 139995 - DNA, 103 bp, Artificial Sequence
  Synthetic Polynucleotide
taatacgactcactatagggttacctgacatttggccactgttttcgggtaacagaggagaacccgaatgcagtggccaaacctggcggcagcgcaaaagatg

SEQ ID NO: 139996 - DNA, 103 bp, Artificial Sequence
  Synthetic Polynucleotide
taatacgactcactatagggcttctgggagttacctgacatttggccactaacagaggagaagtggcatgatgtcaggtaacctggcggcagcgcaaaagatg

SEQ ID NO: 139997 - DNA, 103 bp, Artificial Sequence
  Synthetic Polynucleotide
taatacgactcactataggggagaacatttcttctgggagttacctgacaaacagaggagatgtcagatgactcccagaaacctggcggcagcgcaaaagatg

SEQ ID NO: 139998 - DNA, 103 bp, Artificial Sequence
  Synthetic Polynucleotide
taatacgactcactatagggggcgtttttggagaacatttcttctgggagaacagaggagactcccaatggaaatgttcaacctggcggcagcgcaaaagatg

SEQ ID NO: 139999 - DNA, 103 bp, Artificial Sequence
  Synthetic Polynucleotide
taatacgactcactataggggacttaaccattctaaaatgataatcattgaacagaggagacaatgaatgtcattttagaacctggcggcagcgcaaaagatg

SEQ ID NO: 140000 - DNA, 103 bp, Artificial Sequence
  Synthetic Polynucleotide
taatacgactcactatagggactatcactgggcgtttttggagaacatttaacagaggagaaaatgtatgccaaaaacgaacctggcggcagcgcaaaagatg

SEQ ID NO: 140001 - DNA, 103 bp, Artificial Sequence
  Synthetic Polynucleotide
taatacgactcactatagggcagtaccttcactatcactgggcgtttttgaacagaggagacaaaaaatgccagtgataaacctggcggcagcgcaaaagatg

SEQ ID NO: 140002 - DNA, 103 bp, Artificial Sequence
  Synthetic Polynucleotide
taatacgactcactatagggttgttgtactcagtaccttcactatcactgaacagaggagacagtgaatgtgaaggtacaacctggcggcagcgcaaaagatg

SEQ ID NO: 140003 - DNA, 103 bp, Artificial Sequence
  Synthetic Polynucleotide
taatacgactcactatagggtcaaatggctttgttgtactcagtaccttcaacagaggagagaaggtatggagtacaacaacctggcggcagcgcaaaagatg

SEQ ID NO: 140004 - DNA, 103 bp, Artificial Sequence
  Synthetic Polynucleotide
taatacgactcactatagggggtctcatattcaaatggctttgttgtactaacagaggagaagtacaatgaagccatttaacctggcggcagcgcaaaagatg

SEQ ID NO: 140005 - DNA, 103 bp, Artificial Sequence
  Synthetic Polynucleotide
taatacgactcactatagggccatttctggggtctcatattcaaatggctaacagaggagaagccatatgaatatgagaaacctggcggcagcgcaaaagatg

SEQ ID NO: 140006 - DNA, 103 bp, Artificial Sequence
  Synthetic Polynucleotide
taatacgactcactatagggatttttttctccatttctggggtctcatataacagaggagaatatgaatgcccagaaataacctggcggcagcgcaaaagatg

SEQ ID NO: 140007 - DNA, 103 bp, Artificial Sequence
  Synthetic Polynucleotide
taatacgactcactatagggatgaaacattatttttttctccatttctggaacagaggagaccagaaatggagaaaaaaaacctggcggcagcgcaaaagatg

SEQ ID NO: 140008 - DNA, 103 bp, Artificial Sequence
  Synthetic Polynucleotide
taatacgactcactatagggccactgtagcatgaaacattatttttttctaacagaggagaagaaaaatgtaatgtttcaacctggcggcagcgcaaaagatg

SEQ ID NO: 140009 - DNA, 103 bp, Artificial Sequence
  Synthetic Polynucleotide
taatacgactcactataggggtctgtgtagccactgtagcatgaaacattaacagaggagaaatgttatgtgctacagtaacctggcggcagcgcaaaagatg

SEQ ID NO: 140010 - DNA, 103 bp, Artificial Sequence
  Synthetic Polynucleotide
taatacgactcactataggggctcagtaaggacttaaccattctaaaatgaacagaggagacattttatgatggttaagaacctggcggcagcgcaaaagatg

SEQ ID NO: 140011 - DNA, 103 bp, Artificial Sequence
  Synthetic Polynucleotide
taatacgactcactataggggaagaactgtgtctgtgtagccactgtagcaacagaggagagctacaatggctacacagaacctggcggcagcgcaaaagatg

SEQ ID NO: 140012 - DNA, 103 bp, Artificial Sequence
  Synthetic Polynucleotide
taatacgactcactatagggccttcacatggaagaactgtgtctgtgtagaacagaggagactacacatgcacagttctaacctggcggcagcgcaaaagatg

SEQ ID NO: 140013 - DNA, 103 bp, Artificial Sequence
  Synthetic Polynucleotide
taatacgactcactataggggtgtttaaaaccttcacatggaagaactgtaacagaggagaacagttatgccatgtgaaaacctggcggcagcgcaaaagatg

SEQ ID NO: 140014 - DNA, 103 bp, Artificial Sequence
  Synthetic Polynucleotide
taatacgactcactatagggcttcaagctggtgtttaaaaccttcacatgaacagaggagacatgtgatggttttaaacaacctggcggcagcgcaaaagatg

SEQ ID NO: 140015 - DNA, 103 bp, Artificial Sequence
  Synthetic Polynucleotide
taatacgactcactatagggtgaatttctccttcaagctggtgtttaaaaaacagaggagattttaaatgccagcttgaaacctggcggcagcgcaaaagatg

SEQ ID NO: 140016 - DNA, 103 bp, Artificial Sequence
  Synthetic Polynucleotide
taatacgactcactatagggttctttccattgaatttctccttcaagctgaacagaggagacagcttatgggagaaattaacctggcggcagcgcaaaagatg

SEQ ID NO: 140017 - DNA, 103 bp, Artificial Sequence
  Synthetic Polynucleotide
taatacgactcactataggggatgatgattttctttccattgaatttctcaacagaggagagagaaaatgaatggaaagaacctggcggcagcgcaaaagatg

SEQ ID NO: 140018 - DNA, 103 bp, Artificial Sequence
  Synthetic Polynucleotide
taatacgactcactatagggaatctgatatgatgatgattttctttccataacagaggagaatggaaatgaaatcatcaaacctggcggcagcgcaaaagatg

SEQ ID NO: 140019 - DNA, 103 bp, Artificial Sequence
  Synthetic Polynucleotide
taatacgactcactatagggtattccaaataatctgatatgatgatgattaacagaggagaaatcatatgcatatcagaaacctggcggcagcgcaaaagatg

SEQ ID NO: 140020 - DNA, 103 bp, Artificial Sequence
  Synthetic Polynucleotide
taatacgactcactataggggagactatcatattccaaataatctgatataacagaggagaatatcaatgtatttggaaaacctggcggcagcgcaaaagatg

SEQ ID NO: 140021 - DNA, 103 bp, Artificial Sequence
  Synthetic Polynucleotide
taatacgactcactatagggttaaatcgttgctcagtaaggacttaaccaaacagaggagatggttaatgccttactgaaacctggcggcagcgcaaaagatg

SEQ ID NO: 140022 - DNA, 103 bp, Artificial Sequence
  Synthetic Polynucleotide
taatacgactcactatagggtgacctctaggagactatcatattccaaataacagaggagaatttggatgatgatagtcaacctggcggcagcgcaaaagatg

SEQ ID NO: 140023 - DNA, 103 bp, Artificial Sequence
  Synthetic Polynucleotide
taatacgactcactataggggattcttcattgacctctaggagactatcaaacagaggagatgatagatgcctagaggtaacctggcggcagcgcaaaagatg

SEQ ID NO: 140024 - DNA, 103 bp, Artificial Sequence
  Synthetic Polynucleotide
taatacgactcactatagggagatacagtagattcttcattgacctctagaacagaggagactagagatgaatgaagaaaacctggcggcagcgcaaaagatg

SEQ ID NO: 140025 - DNA, 103 bp, Artificial Sequence
  Synthetic Polynucleotide
taatacgactcactataggggaccagcttcagatacagtagattcttcataacagaggagaatgaagatgctactgtataacctggcggcagcgcaaaagatg

SEQ ID NO: 140026 - DNA, 103 bp, Artificial Sequence
  Synthetic Polynucleotide
taatacgactcactataggggtttggttaggaccagcttcagatacagtaaacagaggagatactgtatgtgaagctggaacctggcggcagcgcaaaagatg

SEQ ID NO: 140027 - DNA, 103 bp, Artificial Sequence
  Synthetic Polynucleotide
taatacgactcactatagggaacctcaaacgtttggttaggaccagcttcaacagaggagagaagctatgcctaaccaaaacctggcggcagcgcaaaagatg

SEQ ID NO: 140028 - DNA, 103 bp, Artificial Sequence
  Synthetic Polynucleotide
taatacgactcactatagggttttatttggaacctcaaacgtttggttagaacagaggagactaaccatgcgtttgaggaacctggcggcagcgcaaaagatg

SEQ ID NO: 140029 - DNA, 103 bp, Artificial Sequence
  Synthetic Polynucleotide
taatacgactcactatagggctgttgatgattttatttggaacctcaaacaacagaggagagtttgaatgtccaaataaaacctggcggcagcgcaaaagatg

SEQ ID NO: 140030 - DNA, 103 bp, Artificial Sequence
  Synthetic Polynucleotide
taatacgactcactatagggttcctttgctctgttgatgattttatttggaacagaggagaccaaatatgatcatcaacaacctggcggcagcgcaaaagatg

SEQ ID NO: 140031 - DNA, 103 bp, Artificial Sequence
  Synthetic Polynucleotide
taatacgactcactatagggtcttcagagtttcctttgctctgttgatgaaacagaggagatcatcaatggagcaaaggaacctggcggcagcgcaaaagatg

SEQ ID NO: 140032 - DNA, 103 bp, Artificial Sequence
  Synthetic Polynucleotide
taatacgactcactatagggaaattaagttttaaatcgttgctcagtaagaacagaggagacttactatgcaacgatttaacctggcggcagcgcaaaagatg

SEQ ID NO: 140033 - DNA, 103 bp, Artificial Sequence
  Synthetic Polynucleotide
taatacgactcactatagggagaatatcaatcttcagagtttcctttgctaacagaggagaagcaaaatgaactctgaaaacctggcggcagcgcaaaagatg

SEQ ID NO: 140034 - DNA, 103 bp, Artificial Sequence
  Synthetic Polynucleotide
taatacgactcactatagggttgtttgtgaagaatatcaatcttcagagtaacagaggagaactctgatgattgatattaacctggcggcagcgcaaaagatg

SEQ ID NO: 140035 - DNA, 103 bp, Artificial Sequence
  Synthetic Polynucleotide
taatacgactcactatagggttcctgaagcttgtttgtgaagaatatcaaaacagaggagattgataatgttcacaaacaacctggcggcagcgcaaaagatg

SEQ ID NO: 140036 - DNA, 103 bp, Artificial Sequence
  Synthetic Polynucleotide
taatacgactcactatagggtatacaatatttcctgaagcttgtttgtgaaacagaggagatcacaaatgagcttcaggaacctggcggcagcgcaaaagatg

SEQ ID NO: 140037 - DNA, 103 bp, Artificial Sequence
  Synthetic Polynucleotide
taatacgactcactatagggaaataccccatatacaatatttcctgaagcaacagaggagagcttcaatgaatattgtaaacctggcggcagcgcaaaagatg

SEQ ID NO: 140038 - DNA, 103 bp, Artificial Sequence
  Synthetic Polynucleotide
taatacgactcactatagggtatgtagcataaataccccatatacaatataacagaggagaatattgatgatggggtataacctggcggcagcgcaaaagatg

SEQ ID NO: 140039 - DNA, 103 bp, Artificial Sequence
  Synthetic Polynucleotide
taatacgactcactatagggactgttttcttatgtagcataaataccccaaacagaggagatggggtatgtatgctacaaacctggcggcagcgcaaaagatg

SEQ ID NO: 140040 - DNA, 103 bp, Artificial Sequence
  Synthetic Polynucleotide
taatacgactcactatagggcttctgatttactgttttcttatgtagcataacagaggagaatgctaatgaagaaaacaaacctggcggcagcgcaaaagatg

SEQ ID NO: 140041 - DNA, 103 bp, Artificial Sequence
  Synthetic Polynucleotide
taatacgactcactatagggagattgtggtcttctgatttactgttttctaacagaggagaagaaaaatgtaaatcagaaacctggcggcagcgcaaaagatg

SEQ ID NO: 140042 - DNA, 103 bp, Artificial Sequence
  Synthetic Polynucleotide
taatacgactcactatagggtgaatttcgtagattgtggtcttctgatttaacagaggagaaaatcaatggaccacaataacctggcggcagcgcaaaagatg

SEQ ID NO: 140043 - DNA, 103 bp, Artificial Sequence
  Synthetic Polynucleotide
taatacgactcactatagggggacatgtcttgaccctcatcagcatccataacagaggagaatggatatggatgagggtaacctggcggcagcgcaaaagatg

SEQ ID NO: 140044 - DNA, 103 bp, Artificial Sequence
  Synthetic Polynucleotide
taatacgactcactatagggggtggtggagaggtcctcggggatcggcataacagaggagaatgccgatgcccgaggacaacctggcggcagcgcaaaagatg

SEQ ID NO: 140045 - DNA, 103 bp, Artificial Sequence
  Synthetic Polynucleotide
taatacgactcactatagggcacctcggaaccgcccgggggcgtctgcacaacagaggagagtgcagatgcccccgggcaacctggcggcagcgcaaaagatg

SEQ ID NO: 140046 - DNA, 103 bp, Artificial Sequence
  Synthetic Polynucleotide
taatacgactcactatagggtgaccgggaccacctcggaaccgcccggggaacagaggagaccccggatggttccgaggaacctggcggcagcgcaaaagatg

SEQ ID NO: 140047 - DNA, 103 bp, Artificial Sequence
  Synthetic Polynucleotide
taatacgactcactatagggatcgggctgatgaccgggaccacctcggaaaacagaggagattccgaatgggtcccggtaacctggcggcagcgcaaaagatg

SEQ ID NO: 140048 - DNA, 103 bp, Artificial Sequence
  Synthetic Polynucleotide
taatacgactcactatagggcagctggtacatcgggctgatgaccgggacaacagaggagagtcccgatgatcagcccgaacctggcggcagcgcaaaagatg

SEQ ID NO: 140049 - DNA, 103 bp, Artificial Sequence
  Synthetic Polynucleotide
taatacgactcactataggggcggcttgtgcagctggtacatcgggctgaaacagaggagatcagccatgtgtaccagcaacctggcggcagcgcaaaagatg

SEQ ID NO: 140050 - DNA, 103 bp, Artificial Sequence
  Synthetic Polynucleotide
taatacgactcactatagggccctccgcgagcggcttgtgcagctggtacaacagaggagagtaccaatggcacaagccaacctggcggcagcgcaaaagatg

SEQ ID NO: 140051 - DNA, 103 bp, Artificial Sequence
  Synthetic Polynucleotide
taatacgactcactataggggcgcggggtgccctccgcgagcggcttgtgaacagaggagacacaagatgctcgcggagaacctggcggcagcgcaaaagatg

SEQ ID NO: 140052 - DNA, 103 bp, Artificial Sequence
  Synthetic Polynucleotide
taatacgactcactatagggagtggttggagcgcggggtgccctccgcgaaacagaggagatcgcggatggcaccccgcaacctggcggcagcgcaaaagatg

SEQ ID NO: 140053 - DNA, 103 bp, Artificial Sequence
  Synthetic Polynucleotide
taatacgactcactatagggtcctgggccgagtggttggagcgcggggtgaacagaggagacaccccatgctccaaccaaacctggcggcagcgcaaaagatg

SEQ ID NO: 140054 - DNA, 103 bp, Artificial Sequence
  Synthetic Polynucleotide
taatacgactcactatagggcacggcgctgtcctgggccgagtggttggaaacagaggagatccaacatgtcggcccagaacctggcggcagcgcaaaagatg

SEQ ID NO: 140055 - DNA, 103 bp, Artificial Sequence
  Synthetic Polynucleotide
taatacgactcactataggggtcctcccgaggtggtggagaggtcctcggaacagaggagaccgaggatgtctccaccaaacctggcggcagcgcaaaagatg

SEQ ID NO: 140056 - DNA, 103 bp, Artificial Sequence
  Synthetic Polynucleotide
taatacgactcactataggggcaggttctccacggcgctgtcctgggccgaacagaggagacggcccatgacagcgccgaacctggcggcagcgcaaaagatg

SEQ ID NO: 140057 - DNA, 103 bp, Artificial Sequence
  Synthetic Polynucleotide
taatacgactcactataggggagagcagcagcaggttctccacggcgctgaacagaggagacagcgcatgggagaacctaacctggcggcagcgcaaaagatg

SEQ ID NO: 140058 - DNA, 103 bp, Artificial Sequence
  Synthetic Polynucleotide
taatacgactcactatagggcttggccttggagagcagcagcaggttctcaacagaggagagagaacatgctgctgctcaacctggcggcagcgcaaaagatg

SEQ ID NO: 140059 - DNA, 103 bp, Artificial Sequence
  Synthetic Polynucleotide
taatacgactcactatagggagggcaccaacttggccttggagagcagcaaacagaggagatgctgcatgccaaggccaaacctggcggcagcgcaaaagatg

SEQ ID NO: 140060 - DNA, 103 bp, Artificial Sequence
  Synthetic Polynucleotide
taatacgactcactatagggtcgcgctccgagggcaccaacttggccttgaacagaggagacaaggcatggttggtgccaacctggcggcagcgcaaaagatg

SEQ ID NO: 140061 - DNA, 103 bp, Artificial Sequence
  Synthetic Polynucleotide
taatacgactcactatagggcggggacgcctcgcgctccgagggcaccaaaacagaggagattggtgatgtcggagcgcaacctggcggcagcgcaaaagatg

SEQ ID NO: 140062 - DNA, 103 bp, Artificial Sequence
  Synthetic Polynucleotide
taatacgactcactatagggagctgttgctcggggacgcctcgcgctccgaacagaggagacggagcatgaggcgtcccaacctggcggcagcgcaaaagatg

SEQ ID NO: 140063 - DNA, 103 bp, Artificial Sequence
  Synthetic Polynucleotide
taatacgactcactataggggagtcttggcagctgttgctcggggacgccaacagaggagaggcgtcatggagcaacagaacctggcggcagcgcaaaagatg

SEQ ID NO: 140064 - DNA, 103 bp, Artificial Sequence
  Synthetic Polynucleotide
taatacgactcactatagggggtgtccgtggagtcttggcagctgttgctaacagaggagaagcaacatgtgccaagacaacctggcggcagcgcaaaagatg

SEQ ID NO: 140065 - DNA, 103 bp, Artificial Sequence
  Synthetic Polynucleotide
taatacgactcactatagggtgttgctctcggtgtccgtggagtcttggcaacagaggagagccaagatgccacggacaaacctggcggcagcgcaaaagatg

SEQ ID NO: 140066 - DNA, 103 bp, Artificial Sequence
  Synthetic Polynucleotide
taatacgactcactataggggagctttgctgtcctcccgaggtggtggagaacagaggagactccacatgctcgggaggaacctggcggcagcgcaaaagatg

SEQ ID NO: 140067 - DNA, 103 bp, Artificial Sequence
  Synthetic Polynucleotide
taatacgactcactatagggtgctcctcgttgttgctctcggtgtccgtgaacagaggagacacggaatgcgagagcaaaacctggcggcagcgcaaaagatg

SEQ ID NO: 140068 - DNA, 103 bp, Artificial Sequence
  Synthetic Polynucleotide
taatacgactcactatagggaccgctgcgctgctcctcgttgttgctctcaacagaggagagagagcatgaacgaggagaacctggcggcagcgcaaaagatg

SEQ ID NO: 140069 - DNA, 103 bp, Artificial Sequence
  Synthetic Polynucleotide
taatacgactcactatagggggtagatgagaccgctgcgctgctcctcgtaacagaggagaacgaggatgagcgcagcgaacctggcggcagcgcaaaagatg

SEQ ID NO: 140070 - DNA, 103 bp, Artificial Sequence
  Synthetic Polynucleotide
taatacgactcactatagggtggttggtcaggtagatgagaccgctgcgcaacagaggagagcgcagatgtctcatctaaacctggcggcagcgcaaaagatg

SEQ ID NO: 140071 - DNA, 103 bp, Artificial Sequence
  Synthetic Polynucleotide
taatacgactcactatagggcggggcgatgtggttggtcaggtagatgagaacagaggagactcatcatgctgaccaacaacctggcggcagcgcaaaagatg

SEQ ID NO: 140072 - DNA, 103 bp, Artificial Sequence
  Synthetic Polynucleotide
taatacgactcactatagggtgcgcgcgtgcggggcgatgtggttggtcaaacagaggagatgaccaatgacatcgcccaacctggcggcagcgcaaaagatg

SEQ ID NO: 140073 - DNA, 103 bp, Artificial Sequence
  Synthetic Polynucleotide
taatacgactcactataggggacagcccgttgcgcgcgtgcggggcgatgaacagaggagacatcgcatggcacgcgcgaacctggcggcagcgcaaaagatg

SEQ ID NO: 140074 - DNA, 103 bp, Artificial Sequence
  Synthetic Polynucleotide
taatacgactcactatagggctccttgagcgacagcccgttgcgcgcgtgaacagaggagacacgcgatgaacgggctgaacctggcggcagcgcaaaagatg

SEQ ID NO: 140075 - DNA, 103 bp, Artificial Sequence
  Synthetic Polynucleotide
taatacgactcactatagggcgcggtgctcctccttgagcgacagcccgtaacagaggagaacgggcatgcgctcaaggaacctggcggcagcgcaaaagatg

SEQ ID NO: 140076 - DNA, 103 bp, Artificial Sequence
  Synthetic Polynucleotide
taatacgactcactatagggaggtcgtaggcgcggtgctcctccttgagcaacagaggagagctcaaatgggagcaccgaacctggcggcagcgcaaaagatg

SEQ ID NO: 140077 - DNA, 103 bp, Artificial Sequence
  Synthetic Polynucleotide
taatacgactcactataggggtcactcttggagctttgctgtcctcccgaaacagaggagatcgggaatgcagcaaagcaacctggcggcagcgcaaaagatg

SEQ ID NO: 140078 - DNA, 103 bp, Artificial Sequence
  Synthetic Polynucleotide
taatacgactcactatagggggcgcgcagcaggtcgtaggcgcggtgctcaacagaggagagagcacatggcctacgacaacctggcggcagcgcaaaagatg

SEQ ID NO: 140079 - DNA, 103 bp, Artificial Sequence
  Synthetic Polynucleotide
taatacgactcactatagggtctcggaggcggcgcgcagcaggtcgtaggaacagaggagacctacgatgtgctgcgcgaacctggcggcagcgcaaaagatg

SEQ ID NO: 140080 - DNA, 103 bp, Artificial Sequence
  Synthetic Polynucleotide
taatacgactcactatagggtcctgcgagttctcggaggcggcgcgcagcaacagaggagagctgcgatgcgcctccgaaacctggcggcagcgcaaaagatg

SEQ ID NO: 140081 - DNA, 103 bp, Artificial Sequence
  Synthetic Polynucleotide
taatacgactcactataggggcggagcgcgtcctgcgagttctcggaggcaacagaggagagcctccatgaactcgcagaacctggcggcagcgcaaaagatg

SEQ ID NO: 140082 - DNA, 103 bp, Artificial Sequence
  Synthetic Polynucleotide
taatacgactcactatagggtgctgaccacgcggagcgcgtcctgcgagtaacagaggagaactcgcatgacgcgctccaacctggcggcagcgcaaaagatg

SEQ ID NO: 140083 - DNA, 103 bp, Artificial Sequence
  Synthetic Polynucleotide
taatacgactcactatagggtccccgctggtgctgaccacgcggagcgcgaacagaggagacgcgctatgcgtggtcagaacctggcggcagcgcaaaagatg

SEQ ID NO: 140084 - DNA, 103 bp, Artificial Sequence
  Synthetic Polynucleotide
taatacgactcactatagggcttcatctgctccccgctggtgctgaccacaacagaggagagtggtcatgaccagcgggaacctggcggcagcgcaaaagatg

SEQ ID NO: 140085 - DNA, 103 bp, Artificial Sequence
  Synthetic Polynucleotide
taatacgactcactatagggacttgtacaccttcatctgctccccgctggaacagaggagaccagcgatgagcagatgaaacctggcggcagcgcaaaagatg

SEQ ID NO: 140086 - DNA, 103 bp, Artificial Sequence
  Synthetic Polynucleotide
taatacgactcactatagggcagtgttcgcacttgtacaccttcatctgcaacagaggagagcagatatgggtgtacaaaacctggcggcagcgcaaaagatg

SEQ ID NO: 140087 - DNA, 103 bp, Artificial Sequence
  Synthetic Polynucleotide
taatacgactcactataggggagcacccggcagtgttcgcacttgtacacaacagaggagagtgtacatgtgcgaacacaacctggcggcagcgcaaaagatg

SEQ ID NO: 140088 - DNA, 103 bp, Artificial Sequence
  Synthetic Polynucleotide
taatacgactcactatagggccacgactctgtcactcttggagctttgctaacagaggagaagcaaaatgccaagagtgaacctggcggcagcgcaaaagatg

SEQ ID NO: 140089 - DNA, 103 bp, Artificial Sequence
  Synthetic Polynucleotide
taatacgactcactataggggatccaggaagagcacccggcagtgttcgcaacagaggagagcgaacatggccgggtgcaacctggcggcagcgcaaaagatg

SEQ ID NO: 140090 - DNA, 103 bp, Artificial Sequence
  Synthetic Polynucleotide
taatacgactcactatagggtacatgacgtgatccaggaagagcacccggaacagaggagaccgggtatgcttcctggaaacctggcggcagcgcaaaagatg

SEQ ID NO: 140091 - DNA, 103 bp, Artificial Sequence
  Synthetic Polynucleotide
taatacgactcactataggggtggatggtgtacatgacgtgatccaggaaaacagaggagattcctgatgcacgtcatgaacctggcggcagcgcaaaagatg

SEQ ID NO: 140092 - DNA, 103 bp, Artificial Sequence
  Synthetic Polynucleotide
taatacgactcactatagggggcagcccatgtggatggtgtacatgacgtaacagaggagaacgtcaatgacaccatccaacctggcggcagcgcaaaagatg

SEQ ID NO: 140093 - DNA, 103 bp, Artificial Sequence
  Synthetic Polynucleotide
taatacgactcactatagggcggaagccgtggcagcccatgtggatggtgaacagaggagacaccatatgcatgggctgaacctggcggcagcgcaaaagatg

SEQ ID NO: 140094 - DNA, 103 bp, Artificial Sequence
  Synthetic Polynucleotide
taatacgactcactatagggaaaaggatcacggaagccgtggcagcccataacagaggagaatgggcatgcacggcttcaacctggcggcagcgcaaaagatg

SEQ ID NO: 140095 - DNA, 103 bp, Artificial Sequence
  Synthetic Polynucleotide
taatacgactcactatagggtgttgcactcaaaaggatcacggaagccgtaacagaggagaacggctatggtgatccttaacctggcggcagcgcaaaagatg

SEQ ID NO: 140096 - DNA, 103 bp, Artificial Sequence
  Synthetic Polynucleotide
taatacgactcactatagggtagccgcacatgttgcactcaaaaggatcaaacagaggagatgatccatgtgagtgcaaaacctggcggcagcgcaaaagatg

SEQ ID NO: 140097 - DNA, 103 bp, Artificial Sequence
  Synthetic Polynucleotide
taatacgactcactatagggctggctgtggtagccgcacatgttgcactcaacagaggagagagtgcatgatgtgcggcaacctggcggcagcgcaaaagatg

SEQ ID NO: 140098 - DNA, 103 bp, Artificial Sequence
  Synthetic Polynucleotide
taatacgactcactatagggcgtaccggtcctggctgtggtagccgcacaaacagaggagatgtgcgatgaccacagccaacctggcggcagcgcaaaagatg

SEQ ID NO: 140099 - DNA, 103 bp, Artificial Sequence
  Synthetic Polynucleotide
taatacgactcactatagggacattactggccacgactctgtcactcttgaacagaggagacaagagatgcagagtcgtaacctggcggcagcgcaaaagatg

SEQ ID NO: 140100 - DNA, 103 bp, Artificial Sequence
  Synthetic Polynucleotide
taatacgactcactataggggacgagaactcgtaccggtcctggctgtggaacagaggagaccacagatgggaccggtaaacctggcggcagcgcaaaagatg

SEQ ID NO: 140101 - DNA, 103 bp, Artificial Sequence
  Synthetic Polynucleotide
taatacgactcactatagggcgttatgtgcgacgagaactcgtaccggtcaacagaggagagaccggatggagttctcgaacctggcggcagcgcaaaagatg

SEQ ID NO: 140102 - DNA, 103 bp, Artificial Sequence
  Synthetic Polynucleotide
taatacgactcactataggggctcccctcgcgttatgtgcgacgagaactaacagaggagaagttctatgcgcacataaaacctggcggcagcgcaaaagatg

SEQ ID NO: 140103 - DNA, 103 bp, Artificial Sequence
  Synthetic Polynucleotide
taatacgactcactatagggtggaagcggtgctcccctcgcgttatgtgcaacagaggagagcacatatggcgaggggaaacctggcggcagcgcaaaagatg

SEQ ID NO: 140104 - DNA, 103 bp, Artificial Sequence
  Synthetic Polynucleotide
taatacgactcactatagggttagctcatgtggaagcggtgctcccctcgaacagaggagacgagggatgcaccgcttcaacctggcggcagcgcaaaagatg

SEQ ID NO: 140105 - DNA, 103 bp, Artificial Sequence
  Synthetic Polynucleotide
taatacgactcactatagggctctactttaacattactggccacgactctaacagaggagaagagtcatggccagtaataacctggcggcagcgcaaaagatg

SEQ ID NO: 140106 - DNA, 103 bp, Artificial Sequence
  Synthetic Polynucleotide
taatacgactcactatagggcactctgagtctctactttaacattactggaacagaggagaccagtaatgttaaagtagaacctggcggcagcgcaaaagatg

SEQ ID NO: 140107 - DNA, 103 bp, Artificial Sequence
  Synthetic Polynucleotide
taatacgactcactatagggttctcttcatcactctgagtctctactttaaacagaggagataaagtatggactcagagaacctggcggcagcgcaaaagatg

SEQ ID NO: 140108 - DNA, 103 bp, Artificial Sequence
  Synthetic Polynucleotide
taatacgactcactatagggggcacgcccattctcttcatcactctgagtaacagaggagaactcagatggatgaagagaacctggcggcagcgcaaaagatg

SEQ ID NO: 140109 - DNA, 103 bp, Artificial Sequence
  Synthetic Polynucleotide
taatacgactcactatagggctgaaacttgggacatgtcttgaccctcataacagaggagaatgaggatgaagacatgtaacctggcggcagcgcaaaagatg

SEQ ID NO: 140110 - DNA, 103 bp, Artificial Sequence
  Synthetic Polynucleotide
taatacgactcactatagggtcatttcacaggcacgcccattctcttcataacagaggagaatgaagatgatgggcgtgaacctggcggcagcgcaaaagatg

SEQ ID NO: 140111 - DNA, 103 bp, Artificial Sequence
  Synthetic Polynucleotide
taatacgactcactatagggtcttccccattcatttcacaggcacgcccaaacagaggagatgggcgatgctgtgaaataacctggcggcagcgcaaaagatg

SEQ ID NO: 140112 - DNA, 103 bp, Artificial Sequence
  Synthetic Polynucleotide
taatacgactcactatagggctccgcacattcttccccattcatttcacaaacagaggagatgtgaaatgaatggggaaaacctggcggcagcgcaaaagatg

SEQ ID NO: 140113 - DNA, 103 bp, Artificial Sequence
  Synthetic Polynucleotide
taatacgactcactatagggttcgtaaatcctccgcacattcttccccataacagaggagaatggggatgaatgtgcggaacctggcggcagcgcaaaagatg

SEQ ID NO: 140114 - DNA, 103 bp, Artificial Sequence
  Synthetic Polynucleotide
taatacgactcactataggggcatcaagcattcgtaaatcctccgcacataacagaggagaatgtgcatgggatttacgaacctggcggcagcgcaaaagatg

SEQ ID NO: 140115 - DNA, 103 bp, Artificial Sequence
  Synthetic Polynucleotide
taatacgactcactatagggctctcccgaggcatcaagcattcgtaaatcaacagaggagagatttaatgatgcttgataacctggcggcagcgcaaaagatg

SEQ ID NO: 140116 - DNA, 103 bp, Artificial Sequence
  Synthetic Polynucleotide
taatacgactcactatagggcattcattttctctcccgaggcatcaagcaaacagaggagatgcttgatgcctcgggagaacctggcggcagcgcaaaagatg

SEQ ID NO: 140117 - DNA, 103 bp, Artificial Sequence
  Synthetic Polynucleotide
taatacgactcactatagggctgtgggagccattcattttctctcccgagaacagaggagactcgggatggaaaatgaaaacctggcggcagcgcaaaagatg

SEQ ID NO: 140118 - DNA, 103 bp, Artificial Sequence
  Synthetic Polynucleotide
taatacgactcactataggggccttggtccctgtgggagccattcattttaacagaggagaaaaatgatgggctcccacaacctggcggcagcgcaaaagatg

SEQ ID NO: 140119 - DNA, 103 bp, Artificial Sequence
  Synthetic Polynucleotide
taatacgactcactatagggaagccgagctgccttggtccctgtgggagcaacagaggagagctcccatggggaccaagaacctggcggcagcgcaaaagatg

SEQ ID NO: 140120 - DNA, 103 bp, Artificial Sequence
  Synthetic Polynucleotide
taatacgactcactatagggctttccttccctgaaacttgggacatgtctaacagaggagaagacatatgccaagtttcaacctggcggcagcgcaaaagatg

SEQ ID NO: 140121 - DNA, 103 bp, Artificial Sequence
  Synthetic Polynucleotide
taatacgactcactatagggactcccgacaaagccgagctgccttggtccaacagaggagaggaccaatgcagctcggcaacctggcggcagcgcaaaagatg

SEQ ID NO: 140122 - DNA, 103 bp, Artificial Sequence
  Synthetic Polynucleotide
taatacgactcactatagggaatgcctccaactcccgacaaagccgagctaacagaggagaagctcgatgttgtcgggaaacctggcggcagcgcaaaagatg

SEQ ID NO: 140123 - DNA, 103 bp, Artificial Sequence
  Synthetic Polynucleotide
taatacgactcactatagggtaggaagtcgaatgcctccaactcccgacaaacagaggagatgtcggatgttggaggcaaacctggcggcagcgcaaaagatg

SEQ ID NO: 140124 - DNA, 103 bp, Artificial Sequence
  Synthetic Polynucleotide
taatacgactcactatagggagttttccgttaggaagtcgaatgcctccaaacagaggagatggaggatgtcgacttccaacctggcggcagcgcaaaagatg

SEQ ID NO: 140125 - DNA, 103 bp, Artificial Sequence
  Synthetic Polynucleotide
taatacgactcactatagggatcacactttagttttccgttaggaagtcgaacagaggagacgacttatgaacggaaaaaacctggcggcagcgcaaaagatg

SEQ ID NO: 140126 - DNA, 103 bp, Artificial Sequence
  Synthetic Polynucleotide
taatacgactcactatagggtcccacagatatcacactttagttttccgtaacagaggagaacggaaatgtaaagtgtgaacctggcggcagcgcaaaagatg

SEQ ID NO: 140127 - DNA, 103 bp, Artificial Sequence
  Synthetic Polynucleotide
taatacgactcactatagggatgcaaatgatcccacagatatcacactttaacagaggagaaaagtgatgtatctgtggaacctggcggcagcgcaaaagatg

SEQ ID NO: 140128 - DNA, 103 bp, Artificial Sequence
  Synthetic Polynucleotide
taatacgactcactatagggattgggcccgatgcaaatgatcccacagataacagaggagaatctgtatgatcatttgcaacctggcggcagcgcaaaagatg

SEQ ID NO: 140129 - DNA, 103 bp, Artificial Sequence
  Synthetic Polynucleotide
taatacgactcactatagggccatgagcacattgggcccgatgcaaatgaaacagaggagatcatttatgtcgggcccaaacctggcggcagcgcaaaagatg

SEQ ID NO: 140130 - DNA, 103 bp, Artificial Sequence
  Synthetic Polynucleotide
taatacgactcactatagggcttttgtgaaccatgagcacattgggcccgaacagaggagacgggccatgtgtgctcataacctggcggcagcgcaaaagatg

SEQ ID NO: 140131 - DNA, 103 bp, Artificial Sequence
  Synthetic Polynucleotide
taatacgactcactatagggtacaggggggctttccttccctgaaacttgaacagaggagacaagttatggggaaggaaaacctggcggcagcgcaaaagatg

SEQ ID NO: 140132 - DNA, 103 bp, Artificial Sequence
  Synthetic Polynucleotide
taatacgactcactatagggagtgtggcttcttttgtgaaccatgagcacaacagaggagagtgctcatggttcacaaaaacctggcggcagcgcaaaagatg

SEQ ID NO: 140133 - DNA, 103 bp, Artificial Sequence
  Synthetic Polynucleotide
taatacgactcactataggggccgttctccagtgtggcttcttttgtgaaaacagaggagattcacaatggaagccacaaacctggcggcagcgcaaaagatg

SEQ ID NO: 140134 - DNA, 103 bp, Artificial Sequence
  Synthetic Polynucleotide
taatacgactcactatagggcactggaagggccgttctccagtgtggcttaacagaggagaaagccaatgtggagaacgaacctggcggcagcgcaaaagatg

SEQ ID NO: 140135 - DNA, 103 bp, Artificial Sequence
  Synthetic Polynucleotide
taatacgactcactataggggcactgattgcactggaagggccgttctccaacagaggagaggagaaatgcccttccagaacctggcggcagcgcaaaagatg

SEQ ID NO: 140136 - DNA, 103 bp, Artificial Sequence
  Synthetic Polynucleotide
taatacgactcactatagggatgaggccccgcactgattgcactggaaggaacagaggagaccttccatggcaatcagtaacctggcggcagcgcaaaagatg

SEQ ID NO: 140137 - DNA, 103 bp, Artificial Sequence
  Synthetic Polynucleotide
taatacgactcactatagggttctgggtgaatgaggccccgcactgattgaacagaggagacaatcaatgcggggcctcaacctggcggcagcgcaaaagatg

SEQ ID NO: 140138 - DNA, 103 bp, Artificial Sequence
  Synthetic Polynucleotide
taatacgactcactatagggcaggttgcccttctgggtgaatgaggccccaacagaggagaggggccatgttcacccagaacctggcggcagcgcaaaagatg

SEQ ID NO: 140139 - DNA, 103 bp, Artificial Sequence
  Synthetic Polynucleotide
taatacgactcactatagggtgtgccggagcaggttgcccttctgggtgaaacagaggagatcacccatgagggcaaccaacctggcggcagcgcaaaagatg

SEQ ID NO: 140140 - DNA, 103 bp, Artificial Sequence
  Synthetic Polynucleotide
taatacgactcactatagggtgcagcttgatgtgccggagcaggttgcccaacagaggagagggcaaatggctccggcaaacctggcggcagcgcaaaagatg

SEQ ID NO: 140141 - DNA, 103 bp, Artificial Sequence
  Synthetic Polynucleotide
taatacgactcactatagggctccccggaatgcagcttgatgtgccggagaacagaggagactccggatgatcaagctgaacctggcggcagcgcaaaagatg

SEQ ID NO: 140142 - DNA, 103 bp, Artificial Sequence
  Synthetic Polynucleotide
taatacgactcactataggggagtatcgcttacaggggggctttccttccaacagaggagaggaaggatggcccccctgaacctggcggcagcgcaaaagatg

SEQ ID NO: 140143 - DNA, 103 bp, Artificial Sequence
  Synthetic Polynucleotide
taatacgactcactatagggtgaagggcttctccccggaatgcagcttgaaacagaggagatcaagcatgattccggggaacctggcggcagcgcaaaagatg

SEQ ID NO: 140144 - DNA, 103 bp, Artificial Sequence
  Synthetic Polynucleotide
taatacgactcactatagggaggtggcatttgaagggcttctccccggaaaacagaggagattccggatggaagcccttaacctggcggcagcgcaaaagatg

SEQ ID NO: 140145 - DNA, 103 bp, Artificial Sequence
  Synthetic Polynucleotide
taatacgactcactataggggtagttgcagaggtggcatttgaagggcttaacagaggagaaagcccatgaaatgccacaacctggcggcagcgcaaaagatg

SEQ ID NO: 140146 - DNA, 103 bp, Artificial Sequence
  Synthetic Polynucleotide
taatacgactcactatagggggcggcaggcgtagttgcagaggtggcattaacagaggagaaatgccatgtctgcaactaacctggcggcagcgcaaaagatg

SEQ ID NO: 140147 - DNA, 103 bp, Artificial Sequence
  Synthetic Polynucleotide
taatacgactcactataggggcgtccctccggcggcaggcgtagttgcagaacagaggagactgcaaatgcgcctgccgaacctggcggcagcgcaaaagatg

SEQ ID NO: 140148 - DNA, 103 bp, Artificial Sequence
  Synthetic Polynucleotide
taatacgactcactataggggccagtgagggcgtccctccggcggcaggcaacagaggagagcctgcatgcggagggacaacctggcggcagcgcaaaagatg

SEQ ID NO: 140149 - DNA, 103 bp, Artificial Sequence
  Synthetic Polynucleotide
taatacgactcactatagggtcctcaggtggccagtgagggcgtccctccaacagaggagaggagggatgccctcactgaacctggcggcagcgcaaaagatg

SEQ ID NO: 140150 - DNA, 103 bp, Artificial Sequence
  Synthetic Polynucleotide
taatacgactcactatagggacggagtgcgtcctcaggtggccagtgaggaacagaggagacctcacatgccacctgagaacctggcggcagcgcaaaagatg

SEQ ID NO: 140151 - DNA, 103 bp, Artificial Sequence
  Synthetic Polynucleotide
taatacgactcactatagggaggtttaccaacggagtgcgtcctcaggtgaacagaggagacacctgatgacgcactccaacctggcggcagcgcaaaagatg

SEQ ID NO: 140152 - DNA, 103 bp, Artificial Sequence
  Synthetic Polynucleotide
taatacgactcactatagggcacatttgtgaggtttaccaacggagtgcgaacagaggagacgcactatgttggtaaacaacctggcggcagcgcaaaagatg

SEQ ID NO: 140153 - DNA, 103 bp, Artificial Sequence
  Synthetic Polynucleotide
taatacgactcactatagggccctcatctggagtatcgcttacaggggggaacagaggagaccccccatgaagcgatacaacctggcggcagcgcaaaagatg

SEQ ID NO: 140154 - DNA, 103 bp, Artificial Sequence
  Synthetic Polynucleotide
taatacgactcactatagggccacaatatccacatttgtgaggtttaccaaacagaggagatggtaaatgtcacaaatgaacctggcggcagcgcaaaagatg

SEQ ID NO: 140155 - DNA, 103 bp, Artificial Sequence
  Synthetic Polynucleotide
taatacgactcactatagggatagcttcggccacaatatccacatttgtgaacagaggagacacaaaatgggatattgtaacctggcggcagcgcaaaagatg

SEQ ID NO: 140156 - DNA, 103 bp, Artificial Sequence
  Synthetic Polynucleotide
taatacgactcactatagggttcgctgtttatagcttcggccacaatatcaacagaggagagatattatggccgaagctaacctggcggcagcgcaaaagatg

SEQ ID NO: 140157 - DNA, 103 bp, Artificial Sequence
  Synthetic Polynucleotide
taatacgactcactatagggtctaaagagcttcgctgtttatagcttcggaacagaggagaccgaagatgtaaacagcgaacctggcggcagcgcaaaagatg

SEQ ID NO: 140158 - DNA, 103 bp, Artificial Sequence
  Synthetic Polynucleotide
taatacgactcactatagggtttatgttcctctaaagagcttcgctgtttaacagaggagaaaacagatgagctctttaaacctggcggcagcgcaaaagatg

SEQ ID NO: 140159 - DNA, 103 bp, Artificial Sequence
  Synthetic Polynucleotide
taatacgactcactatagggggcagcgctctttatgttcctctaaagagcaacagaggagagctcttatgaggaacataaacctggcggcagcgcaaaagatg

SEQ ID NO: 140160 - DNA, 103 bp, Artificial Sequence
  Synthetic Polynucleotide
taatacgactcactatagggaagtagttgtggcagcgctctttatgttccaacagaggagaggaacaatgagagcgctgaacctggcggcagcgcaaaagatg

SEQ ID NO: 140161 - DNA, 103 bp, Artificial Sequence
  Synthetic Polynucleotide
taatacgactcactatagggcatgctttccaagtagttgtggcagcgctcaacagaggagagagcgcatgcacaactacaacctggcggcagcgcaaaagatg

SEQ ID NO: 140162 - DNA, 103 bp, Artificial Sequence
  Synthetic Polynucleotide
taatacgactcactatagggccggaaggcccatgctttccaagtagttgtaacagaggagaacaactatgtggaaagcaaacctggcggcagcgcaaaagatg

SEQ ID NO: 140163 - DNA, 103 bp, Artificial Sequence
  Synthetic Polynucleotide
taatacgactcactatagggtacagtgtgcccggaaggcccatgctttccaacagaggagaggaaagatggggccttccaacctggcggcagcgcaaaagatg

SEQ ID NO: 140164 - DNA, 103 bp, Artificial Sequence
  Synthetic Polynucleotide
taatacgactcactataggggggctcatcgccctcatctggagtatcgctaacagaggagaagcgatatgccagatgagaacctggcggcagcgcaaaagatg

SEQ ID NO: 140165 - DNA, 103 bp, Artificial Sequence
  Synthetic Polynucleotide
taatacgactcactatagggaatgactgggtacagtgtgcccggaaggccaacagaggagaggccttatgggcacactgaacctggcggcagcgcaaaagatg

SEQ ID NO: 140166 - DNA, 103 bp, Artificial Sequence
  Synthetic Polynucleotide
taatacgactcactatagggtttcttctttaatgactgggtacagtgtgcaacagaggagagcacacatgacccagtcaaacctggcggcagcgcaaaagatg

SEQ ID NO: 140167 - DNA, 103 bp, Artificial Sequence
  Synthetic Polynucleotide
taatacgactcactatagggctgtgattagtttcttctttaatgactgggaacagaggagacccagtatgtaaagaagaaacctggcggcagcgcaaaagatg

SEQ ID NO: 140168 - DNA, 103 bp, Artificial Sequence
  Synthetic Polynucleotide
taatacgactcactatagggtgccatttcactgtgattagtttcttctttaacagaggagaaaagaaatgactaatcacaacctggcggcagcgcaaaagatg

SEQ ID NO: 140169 - DNA, 103 bp, Artificial Sequence
  Synthetic Polynucleotide
taatacgactcactatagggacaggtcttctgccatttcactgtgattagaacagaggagactaatcatggtgaaatggaacctggcggcagcgcaaaagatg

SEQ ID NO: 140170 - DNA, 103 bp, Artificial Sequence
  Synthetic Polynucleotide
taatacgactcactatagggcctatcttgcacaggtcttctgccatttcaaacagaggagatgaaatatgagaagacctaacctggcggcagcgcaaaagatg

SEQ ID NO: 140171 - DNA, 103 bp, Artificial Sequence
  Synthetic Polynucleotide
taatacgactcactatagggtctctctgatcctatcttgcacaggtcttcaacagaggagagaagacatgtgcaagataaacctggcggcagcgcaaaagatg

SEQ ID NO: 140172 - DNA, 103 bp, Artificial Sequence
  Synthetic Polynucleotide
taatacgactcactataggggcacgagagatctctctgatcctatcttgcaacagaggagagcaagaatggatcagagaaacctggcggcagcgcaaaagatg

SEQ ID NO: 140173 - DNA, 103 bp, Artificial Sequence
  Synthetic Polynucleotide
taatacgactcactatagggagtctgtccagcacgagagatctctctgataacagaggagaatcagaatgatctctcgtaacctggcggcagcgcaaaagatg

SEQ ID NO: 140174 - DNA, 103 bp, Artificial Sequence
  Synthetic Polynucleotide
taatacgactcactataggggttacttgctagtctgtccagcacgagagaaacagaggagatctctcatgctggacagaaacctggcggcagcgcaaaagatg

SEQ ID NO: 140175 - DNA, 103 bp, Artificial Sequence
  Synthetic Polynucleotide
taatacgactcactatagggggatcggcatgggctcatcgccctcatctgaacagaggagacagatgatggcgatgagcaacctggcggcagcgcaaaagatg

SEQ ID NO: 140176 - DNA, 103 bp, Artificial Sequence
  Synthetic Polynucleotide
taatacgactcactataggggtttggcgacgttacttgctagtctgtccaaacagaggagatggacaatgtagcaagtaaacctggcggcagcgcaaaagatg

SEQ ID NO: 140177 - DNA, 103 bp, Artificial Sequence
  Synthetic Polynucleotide
taatacgactcactataggggagctcttacgtttggcgacgttacttgctaacagaggagaagcaagatgcgtcgccaaaacctggcggcagcgcaaaagatg

SEQ ID NO: 140178 - DNA, 103 bp, Artificial Sequence
  Synthetic Polynucleotide
taatacgactcactatagggctgaggcatagagctcttacgtttggcgacaacagaggagagtcgccatgcgtaagagcaacctggcggcagcgcaaaagatg

SEQ ID NO: 140179 - DNA, 103 bp, Artificial Sequence
  Synthetic Polynucleotide
taatacgactcactatagggcaagaaatttctgaggcatagagctcttacaacagaggagagtaagaatgctatgcctcaacctggcggcagcgcaaaagatg

SEQ ID NO: 140180 - DNA, 103 bp, Artificial Sequence
  Synthetic Polynucleotide
taatacgactcactatagggcccttgtccccaagaaatttctgaggcataaacagaggagatatgccatggaaatttctaacctggcggcagcgcaaaagatg

SEQ ID NO: 140181 - DNA, 103 bp, Artificial Sequence
  Synthetic Polynucleotide
taatacgactcactataggggtcggacaggcccttgtccccaagaaatttaacagaggagaaaatttatgggggacaagaacctggcggcagcgcaaaagatg

SEQ ID NO: 140182 - DNA, 103 bp, Artificial Sequence
  Synthetic Polynucleotide
taatacgactcactatagggcgtagggcgtgtcggacaggcccttgtcccaacagaggagagggacaatggcctgtccgaacctggcggcagcgcaaaagatg

SEQ ID NO: 140183 - DNA, 103 bp, Artificial Sequence
  Synthetic Polynucleotide
taatacgactcactataggggcgctgctgtcgtagggcgtgtcggacaggaacagaggagacctgtcatgcacgccctaaacctggcggcagcgcaaaagatg

SEQ ID NO: 140184 - DNA, 103 bp, Artificial Sequence
  Synthetic Polynucleotide
taatacgactcactatagggctcgtagctggcgctgctgtcgtagggcgtaacagaggagaacgcccatggacagcagcaacctggcggcagcgcaaaagatg

SEQ ID NO: 140185 - DNA, 103 bp, Artificial Sequence
  Synthetic Polynucleotide
taatacgactcactatagggcgttctccttctcgtagctggcgctgctgtaacagaggagaacagcaatgccagctacgaacctggcggcagcgcaaaagatg

SEQ ID NO: 140186 - DNA, 103 bp, Artificial Sequence
  Synthetic Polynucleotide
taatacgactcactatagggaggtcctcggggatcggcatgggctcatcgaacagaggagacgatgaatgcatgccgataacctggcggcagcgcaaaagatg

SEQ ID NO: 140187 - DNA, 103 bp, Artificial Sequence
  Synthetic Polynucleotide
taatacgactcactatagggttcatcatttcgttctccttctcgtagctgaacagaggagacagctaatggaaggagaaaacctggcggcagcgcaaaagatg

SEQ ID NO: 140188 - DNA, 103 bp, Artificial Sequence
  Synthetic Polynucleotide
taatacgactcactatagggcacgtgggacttcatcatttcgttctccttaacagaggagaaaggagatggaaatgatgaacctggcggcagcgcaaaagatg

SEQ ID NO: 140189 - DNA, 103 bp, Artificial Sequence
  Synthetic Polynucleotide
taatacgactcactatagggcttggtccatcacgtgggacttcatcatttaacagaggagaaaatgaatgagtcccacgaacctggcggcagcgcaaaagatg

SEQ ID NO: 140190 - DNA, 103 bp, Artificial Sequence
  Synthetic Polynucleotide
taatacgactcactatagggttgttgatggcttggtccatcacgtgggacaacagaggagagtcccaatggatggaccaaacctggcggcagcgcaaaagatg

SEQ ID NO: 140191 - DNA, 103 bp, Artificial Sequence
  Synthetic Polynucleotide
taatacgactcactataggggttgatggcgttgttgatggcttggtccataacagaggagaatggacatggccatcaacaacctggcggcagcgcaaaagatg

SEQ ID NO: 140192 - DNA, 103 bp, Artificial Sequence
  Synthetic Polynucleotide
taatacgactcactatagggcccccaggtagttgatggcgttgttgatggaacagaggagaccatcaatgacgccatcaaacctggcggcagcgcaaaagatg

SEQ ID NO: 140193 - DNA, 103 bp, Artificial Sequence
  Synthetic Polynucleotide
taatacgactcactatagggagggactcggcccccaggtagttgatggcgaacagaggagacgccatatgctacctgggaacctggcggcagcgcaaaagatg

SEQ ID NO: 140194 - DNA, 103 bp, Artificial Sequence
  Synthetic Polynucleotide
taatacgactcactatagggcagcgggcgcagggactcggcccccaggtaaacagaggagatacctgatggccgagtccaacctggcggcagcgcaaaagatg

SEQ ID NO: 140195 - DNA, 103 bp, Artificial Sequence
  Synthetic Polynucleotide
taatacgactcactataggggcgtctgcaccagcgggcgcagggactcggaacagaggagaccgagtatgtgcgcccgcaacctggcggcagcgcaaaagatg

SEQ ID NO: 140196 - DNA, 103 bp, Artificial Sequence
  Synthetic Polynucleotide
taatacgactcactatagggccgcccgggggcgtctgcaccagcgggcgcaacagaggagagcgcccatgggtgcagacaacctggcggcagcgcaaaagatg

SEQ ID NO: 140197 - DNA, 103 bp, Artificial Sequence
  Synthetic Polynucleotide
taatacgactcactatagggtatatagccatcaatagcctctgtttccataacagaggagaatggaaatggaggctattaacctggcggcagcgcaaaagatg

SEQ ID NO: 140198 - DNA, 103 bp, Artificial Sequence
  Synthetic Polynucleotide
taatacgactcactatagggtgaggcatgctgtccattgggtgtgcttgaaacagaggagatcaagcatgcccaatggaaacctggcggcagcgcaaaagatg

SEQ ID NO: 140199 - DNA, 103 bp, Artificial Sequence
  Synthetic Polynucleotide
taatacgactcactatagggtgtgacttggtgaggcatgctgtccattggaacagaggagaccaatgatgagcatgcctaacctggcggcagcgcaaaagatg

SEQ ID NO: 140200 - DNA, 103 bp, Artificial Sequence
  Synthetic Polynucleotide
taatacgactcactatagggctgcttgtcatgtgacttggtgaggcatgcaacagaggagagcatgcatgaccaagtcaaacctggcggcagcgcaaaagatg

SEQ ID NO: 140201 - DNA, 103 bp, Artificial Sequence
  Synthetic Polynucleotide
taatacgactcactatagggtgaaaaagacctgcttgtcatgtgacttggaacagaggagaccaagtatgatgacaagcaacctggcggcagcgcaaaagatg

SEQ ID NO: 140202 - DNA, 103 bp, Artificial Sequence
  Synthetic Polynucleotide
taatacgactcactatagggtgtcacacgttatatagccatcaatagcctaacagaggagaaggctaatgatggctataaacctggcggcagcgcaaaagatg

SEQ ID NO: 140203 - DNA, 103 bp, Artificial Sequence
  Synthetic Polynucleotide
taatacgactcactataggggaaagctcattgtcacacgttatatagccaaacagaggagatggctaatgaacgtgtgaaacctggcggcagcgcaaaagatg

SEQ ID NO: 140204 - DNA, 103 bp, Artificial Sequence
  Synthetic Polynucleotide
taatacgactcactatagggcctttcgggtgaaagctcattgtcacacgtaacagaggagaacgtgtatgaatgagcttaacctggcggcagcgcaaaagatg

SEQ ID NO: 140205 - DNA, 103 bp, Artificial Sequence
  Synthetic Polynucleotide
taatacgactcactatagggtggagtgctccctttcgggtgaaagctcataacagaggagaatgagcatgcacccgaaaaacctggcggcagcgcaaaagatg

SEQ ID NO: 140206 - DNA, 103 bp, Artificial Sequence
  Synthetic Polynucleotide
taatacgactcactatagggattgccatattggagtgctccctttcgggtaacagaggagaacccgaatgggagcactcaacctggcggcagcgcaaaagatg

SEQ ID NO: 140207 - DNA, 103 bp, Artificial Sequence
  Synthetic Polynucleotide
taatacgactcactatagggggtgaggtcaattgccatattggagtgctcaacagaggagagagcacatgaatatggcaaacctggcggcagcgcaaaagatg

SEQ ID NO: 140208 - DNA, 103 bp, Artificial Sequence
  Synthetic Polynucleotide
taatacgactcactataggggtgtgcttgaggtgaggtcaattgccatataacagaggagaatatggatgttgacctcaaacctggcggcagcgcaaaagatg

SEQ ID NO: 140209 - DNA, 103 bp, Artificial Sequence
  Synthetic Polynucleotide
taatacgactcactatagggtgtccattgggtgtgcttgaggtgaggtcaaacagaggagatgacctatgctcaagcacaacctggcggcagcgcaaaagatg

SEQ ID NO: 140210 - DNA, 103 bp, Artificial Sequence
  Synthetic Polynucleotide
taatacgactcactatagggcagttccgcatttgtttgtatatcttccataacagaggagaatggaaatgatacaaacaaacctggcggcagcgcaaaagatg

SEQ ID NO: 140211 - DNA, 103 bp, Artificial Sequence
  Synthetic Polynucleotide
taatacgactcactatagggcacattttccatttcatgagatttggttaaaacagaggagattaaccatgtctcatgaaaacctggcggcagcgcaaaagatg

SEQ ID NO: 140212 - DNA, 103 bp, Artificial Sequence
  Synthetic Polynucleotide
taatacgactcactatagggctccactgtccacattttccatttcatgagaacagaggagactcatgatgtggaaaatgaacctggcggcagcgcaaaagatg

SEQ ID NO: 140213 - DNA, 103 bp, Artificial Sequence
  Synthetic Polynucleotide
taatacgactcactataggggctgggccttctccactgtccacattttccaacagaggagaggaaaaatgggacagtggaacctggcggcagcgcaaaagatg

SEQ ID NO: 140214 - DNA, 103 bp, Artificial Sequence
  Synthetic Polynucleotide
taatacgactcactatagggatcttcattggctgggccttctccactgtcaacagaggagagacagtatggaaggcccaaacctggcggcagcgcaaaagatg

SEQ ID NO: 140215 - DNA, 103 bp, Artificial Sequence
  Synthetic Polynucleotide
taatacgactcactatagggctatgtcttcatcttcattggctgggccttaacagaggagaaaggccatgccaatgaagaacctggcggcagcgcaaaagatg

SEQ ID NO: 140216 - DNA, 103 bp, Artificial Sequence
  Synthetic Polynucleotide
taatacgactcactataggggaatcatctcctatgtcttcatcttcattgaacagaggagacaatgaatgtgaagacataacctggcggcagcgcaaaagatg

SEQ ID NO: 140217 - DNA, 103 bp, Artificial Sequence
  Synthetic Polynucleotide
taatacgactcactatagggcactttcattgaatcatctcctatgtcttcaacagaggagagaagacatgggagatgataacctggcggcagcgcaaaagatg

SEQ ID NO: 140218 - DNA, 103 bp, Artificial Sequence
  Synthetic Polynucleotide
taatacgactcactatagggattcatctttcactttcattgaatcatctcaacagaggagagagatgatgcaatgaaagaacctggcggcagcgcaaaagatg

SEQ ID NO: 140219 - DNA, 103 bp, Artificial Sequence
  Synthetic Polynucleotide
taatacgactcactatagggctttcactgtattcatctttcactttcattaacagaggagaaatgaaatggaaagatgaaacctggcggcagcgcaaaagatg

SEQ ID NO: 140220 - DNA, 103 bp, Artificial Sequence
  Synthetic Polynucleotide
taatacgactcactatagggattctcatctctttcactgtattcatctttaacagaggagaaaagatatgtacagtgaaaacctggcggcagcgcaaaagatg

SEQ ID NO: 140221 - DNA, 103 bp, Artificial Sequence
  Synthetic Polynucleotide
taatacgactcactataggggagtgcttttcagttccgcatttgtttgtaaacagaggagatacaaaatgatgcggaacaacctggcggcagcgcaaaagatg

SEQ ID NO: 140222 - DNA, 103 bp, Artificial Sequence
  Synthetic Polynucleotide
taatacgactcactatagggactttaaaacattctcatctctttcactgtaacagaggagaacagtgatggagatgagaaacctggcggcagcgcaaaagatg

SEQ ID NO: 140223 - DNA, 103 bp, Artificial Sequence
  Synthetic Polynucleotide
taatacgactcactatagggatgggttctgactttaaaacattctcatctaacagaggagaagatgaatgtgttttaaaaacctggcggcagcgcaaaagatg

SEQ ID NO: 140224 - DNA, 103 bp, Artificial Sequence
  Synthetic Polynucleotide
taatacgactcactatagggtgcatttcccatgggttctgactttaaaacaacagaggagagttttaatgtcagaacccaacctggcggcagcgcaaaagatg

SEQ ID NO: 140225 - DNA, 103 bp, Artificial Sequence
  Synthetic Polynucleotide
taatacgactcactatagggcaggctcttctgcatttcccatgggttctgaacagaggagacagaacatgtgggaaatgaacctggcggcagcgcaaaagatg

SEQ ID NO: 140226 - DNA, 103 bp, Artificial Sequence
  Synthetic Polynucleotide
taatacgactcactatagggtaagggatttcaggctcttctgcatttcccaacagaggagagggaaaatgagaagagccaacctggcggcagcgcaaaagatg

SEQ ID NO: 140227 - DNA, 103 bp, Artificial Sequence
  Synthetic Polynucleotide
taatacgactcactatagggtgaatagctgtaagggatttcaggctcttcaacagaggagagaagagatggaaatccctaacctggcggcagcgcaaaagatg

SEQ ID NO: 140228 - DNA, 103 bp, Artificial Sequence
  Synthetic Polynucleotide
taatacgactcactatagggtatattctcttgaatagctgtaagggatttaacagaggagaaaatccatgacagctattaacctggcggcagcgcaaaagatg

SEQ ID NO: 140229 - DNA, 103 bp, Artificial Sequence
  Synthetic Polynucleotide
taatacgactcactatagggtcatattcattatattctcttgaatagctgaacagaggagacagctaatgaagagaataaacctggcggcagcgcaaaagatg

SEQ ID NO: 140230 - DNA, 103 bp, Artificial Sequence
  Synthetic Polynucleotide
taatacgactcactatagggcttaatgttttcatattcattatattctctaacagaggagaagagaaatgaatgaatataacctggcggcagcgcaaaagatg

SEQ ID NO: 140231 - DNA, 103 bp, Artificial Sequence
  Synthetic Polynucleotide
taatacgactcactataggggtctctccaacttaatgttttcatattcataacagaggagaatgaatatgaaaacattaaacctggcggcagcgcaaaagatg

SEQ ID NO: 140232 - DNA, 103 bp, Artificial Sequence
  Synthetic Polynucleotide
taatacgactcactataggggactgctcctgagtgcttttcagttccgcaaacagaggagatgcggaatggaaaagcacaacctggcggcagcgcaaaagatg

SEQ ID NO: 140233 - DNA, 103 bp, Artificial Sequence
  Synthetic Polynucleotide
taatacgactcactataggggagacaacatgtctctccaacttaatgtttaacagaggagaaaacatatggttggagagaacctggcggcagcgcaaaagatg

SEQ ID NO: 140234 - DNA, 103 bp, Artificial Sequence
  Synthetic Polynucleotide
taatacgactcactatagggactatcgaatgagacaacatgtctctccaaaacagaggagattggagatgcatgttgtcaacctggcggcagcgcaaaagatg

SEQ ID NO: 140235 - DNA, 103 bp, Artificial Sequence
  Synthetic Polynucleotide
taatacgactcactatagggttggcctgctactatcgaatgagacaacataacagaggagaatgttgatgcattcgataaacctggcggcagcgcaaaagatg

SEQ ID NO: 140236 - DNA, 103 bp, Artificial Sequence
  Synthetic Polynucleotide
taatacgactcactatagggtttccactggttggcctgctactatcgaataacagaggagaattcgaatgtagcaggccaacctggcggcagcgcaaaagatg

SEQ ID NO: 140237 - DNA, 103 bp, Artificial Sequence
  Synthetic Polynucleotide
taatacgactcactataggggcagttcatctttccactggttggcctgctaacagaggagaagcaggatgaccagtggaaacctggcggcagcgcaaaagatg

SEQ ID NO: 140238 - DNA, 103 bp, Artificial Sequence
  Synthetic Polynucleotide
taatacgactcactatagggcacacacatcgcagttcatctttccactggaacagaggagaccagtgatgagatgaactaacctggcggcagcgcaaaagatg

SEQ ID NO: 140239 - DNA, 103 bp, Artificial Sequence
  Synthetic Polynucleotide
taatacgactcactatagggcaggataatccacacacatcgcagttcatcaacagaggagagatgaaatgcgatgtgtgaacctggcggcagcgcaaaagatg

SEQ ID NO: 140240 - DNA, 103 bp, Artificial Sequence
  Synthetic Polynucleotide
taatacgactcactataggggaagctgatgcaggataatccacacacatcaacagaggagagatgtgatgggattatccaacctggcggcagcgcaaaagatg

SEQ ID NO: 140241 - DNA, 103 bp, Artificial Sequence
  Synthetic Polynucleotide
taatacgactcactatagggttaagacattgaagctgatgcaggataatcaacagaggagagattatatggcatcagctaacctggcggcagcgcaaaagatg

SEQ ID NO: 140242 - DNA, 103 bp, Artificial Sequence
  Synthetic Polynucleotide
taatacgactcactatagggttatgaaccattaagacattgaagctgatgaacagaggagacatcagatgcaatgtcttaacctggcggcagcgcaaaagatg

SEQ ID NO: 140243 - DNA, 103 bp, Artificial Sequence
  Synthetic Polynucleotide
taatacgactcactatagggtgcgggcacagactgctcctgagtgcttttaacagaggagaaaaagcatgcaggagcagaacctggcggcagcgcaaaagatg

SEQ ID NO: 140244 - DNA, 103 bp, Artificial Sequence
  Synthetic Polynucleotide
taatacgactcactatagggatggcttcgcttatgaaccattaagacattaacagaggagaaatgtcatgatggttcataacctggcggcagcgcaaaagatg

SEQ ID NO: 140245 - DNA, 103 bp, Artificial Sequence
  Synthetic Polynucleotide
taatacgactcactataggggttcaccagtatggcttcgcttatgaaccaaacagaggagatggttcatgagcgaagccaacctggcggcagcgcaaaagatg

SEQ ID NO: 140246 - DNA, 103 bp, Artificial Sequence
  Synthetic Polynucleotide
taatacgactcactatagggtggaatgggcgttcaccagtatggcttcgcaacagaggagagcgaagatgtactggtgaaacctggcggcagcgcaaaagatg

SEQ ID NO: 140247 - DNA, 103 bp, Artificial Sequence
  Synthetic Polynucleotide
taatacgactcactatagggctgattacactggaatgggcgttcaccagtaacagaggagaactggtatgcgcccattcaacctggcggcagcgcaaaagatg

SEQ ID NO: 140248 - DNA, 103 bp, Artificial Sequence
  Synthetic Polynucleotide
taatacgactcactatagggatgccccacactgattacactggaatgggcaacagaggagagcccatatgagtgtaatcaacctggcggcagcgcaaaagatg

SEQ ID NO: 140249 - DNA, 103 bp, Artificial Sequence
  Synthetic Polynucleotide
taatacgactcactatagggtgagtaaaagatgccccacactgattacacaacagaggagagtgtaaatggtgtggggcaacctggcggcagcgcaaaagatg

SEQ ID NO: 140250 - DNA, 103 bp, Artificial Sequence
  Synthetic Polynucleotide
taatacgactcactataggggttacctttctgagtaaaagatgccccacaaacagaggagatgtgggatgtcttttactaacctggcggcagcgcaaaagatg

SEQ ID NO: 140251 - DNA, 103 bp, Artificial Sequence
  Synthetic Polynucleotide
taatacgactcactatagggggcggaggaggttacctttctgagtaaaagaacagaggagacttttaatgagaaaggtaaacctggcggcagcgcaaaagatg

SEQ ID NO: 140252 - DNA, 103 bp, Artificial Sequence
  Synthetic Polynucleotide
taatacgactcactatagggagtttaatgtggcggaggaggttacctttcaacagaggagagaaaggatgcctcctccgaacctggcggcagcgcaaaagatg

SEQ ID NO: 140253 - DNA, 103 bp, Artificial Sequence
  Synthetic Polynucleotide
taatacgactcactatagggccctgtgtgcagtttaatgtggcggaggagaacagaggagactcctcatgcacattaaaaacctggcggcagcgcaaaagatg

SEQ ID NO: 140254 - DNA, 103 bp, Artificial Sequence
  Synthetic Polynucleotide
taatacgactcactatagggctgcactttctgcgggcacagactgctcctaacagaggagaaggagcatgctgtgcccgaacctggcggcagcgcaaaagatg

SEQ ID NO: 140255 - DNA, 103 bp, Artificial Sequence
  Synthetic Polynucleotide
taatacgactcactatagggaaggtttttcccctgtgtgcagtttaatgtaacagaggagaacattaatgtgcacacagaacctggcggcagcgcaaaagatg

SEQ ID NO: 140256 - DNA, 103 bp, Artificial Sequence
  Synthetic Polynucleotide
taatacgactcactatagggtgacacttaaaaggtttttcccctgtgtgcaacagaggagagcacacatgggaaaaaccaacctggcggcagcgcaaaagatg

SEQ ID NO: 140257 - DNA, 103 bp, Artificial Sequence
  Synthetic Polynucleotide
taatacgactcactataggggttgcagaggtgacacttaaaaggtttttcaacagaggagagaaaaaatgtttaagtgtaacctggcggcagcgcaaaagatg

SEQ ID NO: 140258 - DNA, 103 bp, Artificial Sequence
  Synthetic Polynucleotide
taatacgactcactatagggggcatgcatagttgcagaggtgacacttaaaacagaggagattaagtatgacctctgcaaacctggcggcagcgcaaaagatg

SEQ ID NO: 140259 - DNA, 103 bp, Artificial Sequence
  Synthetic Polynucleotide
taatacgactcactatagggtctcttctttggcatgcatagttgcagaggaacagaggagacctctgatgctatgcatgaacctggcggcagcgcaaaagatg

SEQ ID NO: 140260 - DNA, 103 bp, Artificial Sequence
  Synthetic Polynucleotide
taatacgactcactatagggcgtgagcgcatctcttctttggcatgcataaacagaggagatatgcaatgcaaagaagaaacctggcggcagcgcaaaagatg

SEQ ID NO: 140261 - DNA, 103 bp, Artificial Sequence
  Synthetic Polynucleotide
taatacgactcactatagggtaagatgccccgtgagcgcatctcttctttaacagaggagaaaagaaatgatgcgctcaaacctggcggcagcgcaaaagatg

SEQ ID NO: 140262 - DNA, 103 bp, Artificial Sequence
  Synthetic Polynucleotide
taatacgactcactataggggaatgtgtcctaagatgccccgtgagcgcaaacagaggagatgcgctatgggggcatctaacctggcggcagcgcaaaagatg

SEQ ID NO: 140263 - DNA, 103 bp, Artificial Sequence
  Synthetic Polynucleotide
taatacgactcactatagggtttctccacagaatgtgtcctaagatgcccaacagaggagagggcatatgaggacacataacctggcggcagcgcaaaagatg

SEQ ID NO: 140264 - DNA, 103 bp, Artificial Sequence
  Synthetic Polynucleotide
taatacgactcactatagggatttgtagggtttctccacagaatgtgtccaacagaggagaggacacatgctgtggagaaacctggcggcagcgcaaaagatg

SEQ ID NO: 140265 - DNA, 103 bp, Artificial Sequence
  Synthetic Polynucleotide
taatacgactcactatagggttcaaaaccgctgcactttctgcgggcacaaacagaggagatgtgccatgagaaagtgcaacctggcggcagcgcaaaagatg

SEQ ID NO: 140266 - DNA, 103 bp, Artificial Sequence
  Synthetic Polynucleotide
taatacgactcactatagggcaaaactcacatttgtagggtttctccacaaacagaggagatgtggaatgaccctacaaaacctggcggcagcgcaaaagatg

SEQ ID NO: 140267 - DNA, 103 bp, Artificial Sequence
  Synthetic Polynucleotide
taatacgactcactatagggactccttccacaaaactcacatttgtagggaacagaggagaccctacatgtgtgagtttaacctggcggcagcgcaaaagatg

SEQ ID NO: 140268 - DNA, 103 bp, Artificial Sequence
  Synthetic Polynucleotide
taatacgactcactatagggtctgcttgtaactccttccacaaaactcacaacagaggagagtgagtatggtggaaggaaacctggcggcagcgcaaaagatg

SEQ ID NO: 140269 - DNA, 103 bp, Artificial Sequence
  Synthetic Polynucleotide
taatacgactcactatagggagggaacttctctgcttgtaactccttccaaacagaggagatggaagatgttacaagcaaacctggcggcagcgcaaaagatg

SEQ ID NO: 140270 - DNA, 103 bp, Artificial Sequence
  Synthetic Polynucleotide
taatacgactcactataggggtgctcctcaagggaacttctctgcttgtaaacagaggagatacaagatgagaagttccaacctggcggcagcgcaaaagatg

SEQ ID NO: 140271 - DNA, 103 bp, Artificial Sequence
  Synthetic Polynucleotide
taatacgactcactatagggagcgctccttgtgctcctcaagggaacttcaacagaggagagaagttatgttgaggagcaacctggcggcagcgcaaaagatg

SEQ ID NO: 140272 - DNA, 103 bp, Artificial Sequence
  Synthetic Polynucleotide
taatacgactcactatagggaatgtacggcagcgctccttgtgctcctcaaacagaggagatgaggaatgcaaggagcgaacctggcggcagcgcaaaagatg

SEQ ID NO: 140273 - DNA, 103 bp, Artificial Sequence
  Synthetic Polynucleotide
taatacgactcactataggggctctgaagaaatgtacggcagcgctccttaacagaggagaaaggagatgtgccgtacaaacctggcggcagcgcaaaagatg

SEQ ID NO: 140274 - DNA, 103 bp, Artificial Sequence
  Synthetic Polynucleotide
taatacgactcactatagggctgggtcagtgctctgaagaaatgtacggcaacagaggagagccgtaatgttcttcagaaacctggcggcagcgcaaaagatg

SEQ ID NO: 140275 - DNA, 103 bp, Artificial Sequence
  Synthetic Polynucleotide
taatacgactcactatagggccagtgtcccctgggtcagtgctctgaagaaacagaggagatcttcaatgcactgacccaacctggcggcagcgcaaaagatg

SEQ ID NO: 140276 - DNA, 103 bp, Artificial Sequence
  Synthetic Polynucleotide
taatacgactcactatagggactgtagtcattcaaaaccgctgcactttcaacagaggagagaaagtatggcggttttgaacctggcggcagcgcaaaagatg

SEQ ID NO: 140277 - DNA, 103 bp, Artificial Sequence
  Synthetic Polynucleotide
taatacgactcactatagggccaaccagtaccagtgtcccctgggtcagtaacagaggagaactgacatgggggacactaacctggcggcagcgcaaaagatg

SEQ ID NO: 140278 - DNA, 103 bp, Artificial Sequence
  Synthetic Polynucleotide
taatacgactcactatagggcgacccatccccaaccagtaccagtgtcccaacagaggagagggacaatggtactggttaacctggcggcagcgcaaaagatg

SEQ ID NO: 140279 - DNA, 103 bp, Artificial Sequence
  Synthetic Polynucleotide
taatacgactcactatagggtgggaaagctcgacccatccccaaccagtaaacagaggagatactggatggggatgggtaacctggcggcagcgcaaaagatg

SEQ ID NO: 140280 - DNA, 103 bp, Artificial Sequence
  Synthetic Polynucleotide
taatacgactcactatagggtatgccgagatgggaaagctcgacccatccaacagaggagaggatggatggagctttccaacctggcggcagcgcaaaagatg

SEQ ID NO: 140281 - DNA, 103 bp, Artificial Sequence
  Synthetic Polynucleotide
taatacgactcactatagggcttgcagtcttatgccgagatgggaaagctaacagaggagaagctttatgatctcggcaaacctggcggcagcgcaaaagatg

SEQ ID NO: 140282 - DNA, 103 bp, Artificial Sequence
  Synthetic Polynucleotide
taatacgactcactatagggacattcaaatcttgcagtcttatgccgagaaacagaggagatctcggatgaagactgcaaacctggcggcagcgcaaaagatg

SEQ ID NO: 140283 - DNA, 103 bp, Artificial Sequence
  Synthetic Polynucleotide
taatacgactcactatagggacaccagggcacattcaaatcttgcagtctaacagaggagaagactgatggatttgaataacctggcggcagcgcaaaagatg

SEQ ID NO: 140284 - DNA, 103 bp, Artificial Sequence
  Synthetic Polynucleotide
taatacgactcactatagggagtgaagccgacaccagggcacattcaaataacagaggagaatttgaatgtgccctggtaacctggcggcagcgcaaaagatg

SEQ ID NO: 140285 - DNA, 103 bp, Artificial Sequence
  Synthetic Polynucleotide
taatacgactcactatagggatttggttaaactgtagtcattcaaaaccgaacagaggagacggtttatgatgactacaaacctggcggcagcgcaaaagatg

SEQ ID NO: 140286 - DNA, 103 bp, Artificial Sequence
  Synthetic Polynucleotide
taatacgactcactatagggatttcatgagatttggttaaactgtagtcaaacagaggagatgactaatgtttaaccaaaacctggcggcagcgcaaaagatg

SEQ ID NO: 140287 - DNA, 103 bp, Artificial Sequence
  Synthetic Polynucleotide
taatacgactcactatagggacggcgagggagtgcgggtggtgtatgcataacagaggagaatgcatatgccacccgcaaacctggcggcagcgcaaaagatg

SEQ ID NO: 140288 - DNA, 103 bp, Artificial Sequence
  Synthetic Polynucleotide
taatacgactcactatagggcggaacacaccctcctgagggatccctctcaacagaggagagagaggatgccctcaggaaacctggcggcagcgcaaaagatg

SEQ ID NO: 140289 - DNA, 103 bp, Artificial Sequence
  Synthetic Polynucleotide
taatacgactcactataggggctgaagcgcatctgcttttcgcctacaaaaacagaggagatttgtaatggaaaagcagaacctggcggcagcgcaaaagatg

SEQ ID NO: 140290 - DNA, 103 bp, Artificial Sequence
  Synthetic Polynucleotide
taatacgactcactatagggggtctgagaggctgaagcgcatctgcttttaacagaggagaaaaagcatgtgcgcttcaaacctggcggcagcgcaaaagatg

SEQ ID NO: 140291 - DNA, 103 bp, Artificial Sequence
  Synthetic Polynucleotide
taatacgactcactatagggtcataggggaggtctgagaggctgaagcgcaacagaggagagcgcttatgcctctcagaaacctggcggcagcgcaaaagatg

SEQ ID NO: 140292 - DNA, 103 bp, Artificial Sequence
  Synthetic Polynucleotide
taatacgactcactatagggcgagttcacatcataggggaggtctgagagaacagaggagactctcaatgctcccctataacctggcggcagcgcaaaagatg

SEQ ID NO: 140293 - DNA, 103 bp, Artificial Sequence
  Synthetic Polynucleotide
taatacgactcactatagggcatagccacccgagttcacatcataggggaaacagaggagatcccctatgatgtgaactaacctggcggcagcgcaaaagatg

SEQ ID NO: 140294 - DNA, 103 bp, Artificial Sequence
  Synthetic Polynucleotide
taatacgactcactatagggacatccttttcatagccacccgagttcacaaacagaggagatgtgaaatggggtggctaaacctggcggcagcgcaaaagatg

SEQ ID NO: 140295 - DNA, 103 bp, Artificial Sequence
  Synthetic Polynucleotide
taatacgactcactatagggcaccaactccacatccttttcatagccaccaacagaggagaggtggcatggaaaaggataacctggcggcagcgcaaaagatg

SEQ ID NO: 140296 - DNA, 103 bp, Artificial Sequence
  Synthetic Polynucleotide
taatacgactcactatagggtgtggtgtgccaccaactccacatccttttaacagaggagaaaaaggatgtggagttggaacctggcggcagcgcaaaagatg

SEQ ID NO: 140297 - DNA, 103 bp, Artificial Sequence
  Synthetic Polynucleotide
taatacgactcactatagggggctctaggctgtggtgtgccaccaactccaacagaggagaggagttatgggcacaccaaacctggcggcagcgcaaaagatg

SEQ ID NO: 140298 - DNA, 103 bp, Artificial Sequence
  Synthetic Polynucleotide
taatacgactcactatagggtccaaagccaggctctaggctgtggtgtgcaacagaggagagcacacatgagcctagagaacctggcggcagcgcaaaagatg

SEQ ID NO: 140299 - DNA, 103 bp, Artificial Sequence
  Synthetic Polynucleotide
taatacgactcactataggggcaagaaatccggaacacaccctcctgaggaacagaggagacctcagatgggtgtgttcaacctggcggcagcgcaaaagatg

SEQ ID NO: 140300 - DNA, 103 bp, Artificial Sequence
  Synthetic Polynucleotide
taatacgactcactatagggccagggaacttccaaagccaggctctaggcaacagaggagagcctagatgctggctttgaacctggcggcagcgcaaaagatg

SEQ ID NO: 140301 - DNA, 103 bp, Artificial Sequence
  Synthetic Polynucleotide
taatacgactcactatagggcccacaaaggccagggaacttccaaagccaaacagaggagatggcttatgaagttccctaacctggcggcagcgcaaaagatg

SEQ ID NO: 140302 - DNA, 103 bp, Artificial Sequence
  Synthetic Polynucleotide
taatacgactcactatagggatgctctgcacccacaaaggccagggaactaacagaggagaagttccatggcctttgtgaacctggcggcagcgcaaaagatg

SEQ ID NO: 140303 - DNA, 103 bp, Artificial Sequence
  Synthetic Polynucleotide
taatacgactcactatagggggggacgcagatgctctgcacccacaaaggaacagaggagacctttgatggtgcagagcaacctggcggcagcgcaaaagatg

SEQ ID NO: 140304 - DNA, 103 bp, Artificial Sequence
  Synthetic Polynucleotide
taatacgactcactatagggggaaggcggaggggacgcagatgctctgcaaacagaggagatgcagaatgtctgcgtccaacctggcggcagcgcaaaagatg

SEQ ID NO: 140305 - DNA, 103 bp, Artificial Sequence
  Synthetic Polynucleotide
taatacgactcactatagggattggtgggtggaaggcggaggggacgcagaacagaggagactgcgtatgctccgccttaacctggcggcagcgcaaaagatg

SEQ ID NO: 140306 - DNA, 103 bp, Artificial Sequence
  Synthetic Polynucleotide
taatacgactcactatagggctgagatgcaattggtgggtggaaggcggaaacagaggagatccgccatgcacccaccaaacctggcggcagcgcaaaagatg

SEQ ID NO: 140307 - DNA, 103 bp, Artificial Sequence
  Synthetic Polynucleotide
taatacgactcactatagggggcgtgagttctgagatgcaattggtgggtaacagaggagaacccacatgttgcatctcaacctggcggcagcgcaaaagatg

SEQ ID NO: 140308 - DNA, 103 bp, Artificial Sequence
  Synthetic Polynucleotide
taatacgactcactataggggctgatgacaggcgtgagttctgagatgcaaacagaggagatgcatcatggaactcacgaacctggcggcagcgcaaaagatg

SEQ ID NO: 140309 - DNA, 103 bp, Artificial Sequence
  Synthetic Polynucleotide
taatacgactcactatagggtgtagacagagctgatgacaggcgtgagttaacagaggagaaactcaatgctgtcatcaaacctggcggcagcgcaaaagatg

SEQ ID NO: 140310 - DNA, 103 bp, Artificial Sequence
  Synthetic Polynucleotide
taatacgactcactatagggtgggcctgaggcaagaaatccggaacacacaacagaggagagtgtgtatgggatttcttaacctggcggcagcgcaaaagatg

SEQ ID NO: 140311 - DNA, 103 bp, Artificial Sequence
  Synthetic Polynucleotide
taatacgactcactatagggtgcatctgggtgtagacagagctgatgacaaacagaggagatgtcatatgctctgtctaaacctggcggcagcgcaaaagatg

SEQ ID NO: 140312 - DNA, 103 bp, Artificial Sequence
  Synthetic Polynucleotide
taatacgactcactatagggagggaggggctgcatctgggtgtagacagaaacagaggagatctgtcatgacccagatgaacctggcggcagcgcaaaagatg

SEQ ID NO: 140313 - DNA, 103 bp, Artificial Sequence
  Synthetic Polynucleotide
taatacgactcactatagggccagtcgaccagggaggggctgcatctgggaacagaggagacccagaatgagcccctccaacctggcggcagcgcaaaagatg

SEQ ID NO: 140314 - DNA, 103 bp, Artificial Sequence
  Synthetic Polynucleotide
taatacgactcactatagggcctggaagctccagtcgaccagggaggggcaacagaggagagcccctatgtggtcgactaacctggcggcagcgcaaaagatg

SEQ ID NO: 140315 - DNA, 103 bp, Artificial Sequence
  Synthetic Polynucleotide
taatacgactcactatagggttctcgggatcctggaagctccagtcgaccaacagaggagaggtcgaatggagcttccaaacctggcggcagcgcaaaagatg

SEQ ID NO: 140316 - DNA, 103 bp, Artificial Sequence
  Synthetic Polynucleotide
taatacgactcactatagggcctcacctgcttctcgggatcctggaagctaacagaggagaagcttcatggatcccgagaacctggcggcagcgcaaaagatg

SEQ ID NO: 140317 - DNA, 103 bp, Artificial Sequence
  Synthetic Polynucleotide
taatacgactcactatagggtcctcaggtccctcacctgcttctcgggataacagaggagaatcccgatgagcaggtgaaacctggcggcagcgcaaaagatg

SEQ ID NO: 140318 - DNA, 103 bp, Artificial Sequence
  Synthetic Polynucleotide
taatacgactcactatagggatcagccaggtcctcaggtccctcacctgcaacagaggagagcaggtatgggacctgagaacctggcggcagcgcaaaagatg

SEQ ID NO: 140319 - DNA, 103 bp, Artificial Sequence
  Synthetic Polynucleotide
taatacgactcactatagggggggacctccatcagccaggtcctcaggtcaacagaggagagacctgatgacctggctgaacctggcggcagcgcaaaagatg

SEQ ID NO: 140320 - DNA, 103 bp, Artificial Sequence
  Synthetic Polynucleotide
taatacgactcactatagggcggtagaggaggggacctccatcagccaggaacagaggagacctggcatgtggaggtccaacctggcggcagcgcaaaagatg

SEQ ID NO: 140321 - DNA, 103 bp, Artificial Sequence
  Synthetic Polynucleotide
taatacgactcactataggggttggagtcttgggcctgaggcaagaaatcaacagaggagagatttcatgcctcaggccaacctggcggcagcgcaaaagatg

SEQ ID NO: 140322 - DNA, 103 bp, Artificial Sequence
  Synthetic Polynucleotide
taatacgactcactataggggcctcggggccggtagaggaggggacctccaacagaggagaggaggtatgctcctctacaacctggcggcagcgcaaaagatg

SEQ ID NO: 140323 - DNA, 103 bp, Artificial Sequence
  Synthetic Polynucleotide
taatacgactcactatagggcagtcagggggcctcggggccggtagaggaaacagaggagatcctctatgggccccgagaacctggcggcagcgcaaaagatg

SEQ ID NO: 140324 - DNA, 103 bp, Artificial Sequence
  Synthetic Polynucleotide
taatacgactcactataggggccccagggtcagtcagggggcctcggggcaacagaggagagccccgatgccccctgacaacctggcggcagcgcaaaagatg

SEQ ID NO: 140325 - DNA, 103 bp, Artificial Sequence
  Synthetic Polynucleotide
taatacgactcactataggggctgggggatgccccagggtcagtcaggggaacagaggagacccctgatggaccctgggaacctggcggcagcgcaaaagatg

SEQ ID NO: 140326 - DNA, 103 bp, Artificial Sequence
  Synthetic Polynucleotide
taatacgactcactatagggggcagccattgctgggggatgccccagggtaacagaggagaaccctgatgcatcccccaaacctggcggcagcgcaaaagatg

SEQ ID NO: 140327 - DNA, 103 bp, Artificial Sequence
  Synthetic Polynucleotide
taatacgactcactataggggtggagtcctggcagccattgctgggggataacagaggagaatccccatgcaatggctgaacctggcggcagcgcaaaagatg

SEQ ID NO: 140328 - DNA, 103 bp, Artificial Sequence
  Synthetic Polynucleotide
taatacgactcactatagggttctgtgtctgtggagtcctggcagccattaacagaggagaaatggcatgcaggactccaacctggcggcagcgcaaaagatg

SEQ ID NO: 140329 - DNA, 103 bp, Artificial Sequence
  Synthetic Polynucleotide
taatacgactcactatagggcgtggttgctttctgtgtctgtggagtcctaacagaggagaaggactatgcagacacagaacctggcggcagcgcaaaagatg

SEQ ID NO: 140330 - DNA, 103 bp, Artificial Sequence
  Synthetic Polynucleotide
taatacgactcactatagggacccgatcttcgtggttgctttctgtgtctaacagaggagaagacacatgaagcaaccaaacctggcggcagcgcaaaagatg

SEQ ID NO: 140331 - DNA, 103 bp, Artificial Sequence
  Synthetic Polynucleotide
taatacgactcactatagggcacccccgcaacccgatcttcgtggttgctaacagaggagaagcaacatggaagatcggaacctggcggcagcgcaaaagatg

SEQ ID NO: 140332 - DNA, 103 bp, Artificial Sequence
  Synthetic Polynucleotide
taatacgactcactatagggttataaaatggttggagtcttgggcctgagaacagaggagactcaggatgaagactccaaacctggcggcagcgcaaaagatg

SEQ ID NO: 140333 - DNA, 103 bp, Artificial Sequence
  Synthetic Polynucleotide
taatacgactcactatagggggagggataccacccccgcaacccgatcttaacagaggagaaagatcatgttgcgggggaacctggcggcagcgcaaaagatg

SEQ ID NO: 140334 - DNA, 103 bp, Artificial Sequence
  Synthetic Polynucleotide
taatacgactcactatagggggaccctgagggagggataccacccccgcaaacagaggagatgcgggatgggtatccctaacctggcggcagcgcaaaagatg

SEQ ID NO: 140335 - DNA, 103 bp, Artificial Sequence
  Synthetic Polynucleotide
taatacgactcactatagggctggggtgggggaccctgagggagggatacaacagaggagagtatccatgcctcagggtaacctggcggcagcgcaaaagatg

SEQ ID NO: 140336 - DNA, 103 bp, Artificial Sequence
  Synthetic Polynucleotide
taatacgactcactatagggtgggaggtggctggggtgggggaccctgagaacagaggagactcaggatgccccaccccaacctggcggcagcgcaaaagatg

SEQ ID NO: 140337 - DNA, 103 bp, Artificial Sequence
  Synthetic Polynucleotide
taatacgactcactatagggaccacaatggtgggaggtggctggggtgggaacagaggagacccaccatggccacctccaacctggcggcagcgcaaaagatg

SEQ ID NO: 140338 - DNA, 103 bp, Artificial Sequence
  Synthetic Polynucleotide
taatacgactcactataggggtgccggcccaccacaatggtgggaggtggaacagaggagaccacctatgaccattgtgaacctggcggcagcgcaaaagatg

SEQ ID NO: 140339 - DNA, 103 bp, Artificial Sequence
  Synthetic Polynucleotide
taatacgactcactatagggaggcaggactgtgccggcccaccacaatggaacagaggagaccattgatgtgggccggcaacctggcggcagcgcaaaagatg

SEQ ID NO: 140340 - DNA, 103 bp, Artificial Sequence
  Synthetic Polynucleotide
taatacgactcactatagggtctttggcgtaggcaggactgtgccggcccaacagaggagagggccgatgcagtcctgcaacctggcggcagcgcaaaagatg

SEQ ID NO: 140341 - DNA, 103 bp, Artificial Sequence
  Synthetic Polynucleotide
taatacgactcactatagggcttggggtcctctttggcgtaggcaggactaacagaggagaagtcctatgtacgccaaaaacctggcggcagcgcaaaagatg

SEQ ID NO: 140342 - DNA, 103 bp, Artificial Sequence
  Synthetic Polynucleotide
taatacgactcactatagggcctcctgtggcttggggtcctctttggcgtaacagaggagaacgccaatgaggaccccaaacctggcggcagcgcaaaagatg

SEQ ID NO: 140343 - DNA, 103 bp, Artificial Sequence
  Synthetic Polynucleotide
taatacgactcactatagggaaagattccattataaaatggttggagtctaacagaggagaagactcatgccattttataacctggcggcagcgcaaaagatg

SEQ ID NO: 140344 - DNA, 103 bp, Artificial Sequence
  Synthetic Polynucleotide
taatacgactcactatagggcgcaataacccctcctgtggcttggggtccaacagaggagaggacccatggccacaggaaacctggcggcagcgcaaaagatg

SEQ ID NO: 140345 - DNA, 103 bp, Artificial Sequence
  Synthetic Polynucleotide
taatacgactcactatagggtggggtgccccgcaataacccctcctgtggaacagaggagaccacagatggggttattgaacctggcggcagcgcaaaagatg

SEQ ID NO: 140346 - DNA, 103 bp, Artificial Sequence
  Synthetic Polynucleotide
taatacgactcactatagggtggaggggcctggggtgccccgcaataaccaacagaggagaggttatatgggggcacccaacctggcggcagcgcaaaagatg

SEQ ID NO: 140347 - DNA, 103 bp, Artificial Sequence
  Synthetic Polynucleotide
taatacgactcactatagggagcacttccttggaggggcctggggtgcccaacagaggagagggcacatgaggcccctcaacctggcggcagcgcaaaagatg

SEQ ID NO: 140348 - DNA, 103 bp, Artificial Sequence
  Synthetic Polynucleotide
taatacgactcactatagggcaccacccgaagcacttccttggaggggccaacagaggagaggccccatgaaggaagtgaacctggcggcagcgcaaaagatg

SEQ ID NO: 140349 - DNA, 103 bp, Artificial Sequence
  Synthetic Polynucleotide
taatacgactcactatagggcactctcgcccaccacccgaagcacttcctaacagaggagaaggaagatgttcgggtggaacctggcggcagcgcaaaagatg

SEQ ID NO: 140350 - DNA, 103 bp, Artificial Sequence
  Synthetic Polynucleotide
taatacgactcactatagggacaggctcaccactctcgcccaccacccgaaacagaggagatcgggtatggggcgagagaacctggcggcagcgcaaaagatg

SEQ ID NO: 140351 - DNA, 103 bp, Artificial Sequence
  Synthetic Polynucleotide
taatacgactcactataggggaaggccttcacaggctcaccactctcgccaacagaggagaggcgagatgggtgagcctaacctggcggcagcgcaaaagatg

SEQ ID NO: 140352 - DNA, 103 bp, Artificial Sequence
  Synthetic Polynucleotide
taatacgactcactataggggctcacacttgaaggccttcacaggctcacaacagaggagagtgagcatgtgaaggcctaacctggcggcagcgcaaaagatg

SEQ ID NO: 140353 - DNA, 103 bp, Artificial Sequence
  Synthetic Polynucleotide
taatacgactcactatagggatacggcagtgctcacacttgaaggccttcaacagaggagagaaggcatgcaagtgtgaaacctggcggcagcgcaaaagatg

SEQ ID NO: 140354 - DNA, 103 bp, Artificial Sequence
  Synthetic Polynucleotide
taatacgactcactatagggttcacaaaataaagattccattataaaatgaacagaggagacattttatgatggaatctaacctggcggcagcgcaaaagatg

SEQ ID NO: 140355 - DNA, 103 bp, Artificial Sequence
  Synthetic Polynucleotide
taatacgactcactatagggcaggaagaggatacggcagtgctcacacttaacagaggagaaagtgtatgcactgccgtaacctggcggcagcgcaaaagatg

SEQ ID NO: 140356 - DNA, 103 bp, Artificial Sequence
  Synthetic Polynucleotide
taatacgactcactatagggtgacgtggtccaggaagaggatacggcagtaacagaggagaactgccatgtcctcttccaacctggcggcagcgcaaaagatg

SEQ ID NO: 140357 - DNA, 103 bp, Artificial Sequence
  Synthetic Polynucleotide
taatacgactcactatagggatagtgaacatgacgtggtccaggaagaggaacagaggagacctcttatgggaccacgtaacctggcggcagcgcaaaagatg

SEQ ID NO: 140358 - DNA, 103 bp, Artificial Sequence
  Synthetic Polynucleotide
taatacgactcactataggggcccatgtggatagtgaacatgacgtggtcaacagaggagagaccacatgatgttcactaacctggcggcagcgcaaaagatg

SEQ ID NO: 140359 - DNA, 103 bp, Artificial Sequence
  Synthetic Polynucleotide
taatacgactcactatagggagccatggcagcccatgtggatagtgaacaaacagaggagatgttcaatgtccacatggaacctggcggcagcgcaaaagatg

SEQ ID NO: 140360 - DNA, 103 bp, Artificial Sequence
  Synthetic Polynucleotide
taatacgactcactataggggggtctctgaagccatggcagcccatgtggaacagaggagaccacatatgctgccatggaacctggcggcagcgcaaaagatg

SEQ ID NO: 140361 - DNA, 103 bp, Artificial Sequence
  Synthetic Polynucleotide
taatacgactcactataggggcactcaaaagggtctctgaagccatggcaaacagaggagatgccatatgttcagagacaacctggcggcagcgcaaaagatg

SEQ ID NO: 140362 - DNA, 103 bp, Artificial Sequence
  Synthetic Polynucleotide
taatacgactcactatagggcacagatgttgcactcaaaagggtctctgaaacagaggagatcagagatgcttttgagtaacctggcggcagcgcaaaagatg

SEQ ID NO: 140363 - DNA, 103 bp, Artificial Sequence
  Synthetic Polynucleotide
taatacgactcactatagggctgtgataaccacagatgttgcactcaaaaaacagaggagattttgaatgcaacatctgaacctggcggcagcgcaaaagatg

SEQ ID NO: 140364 - DNA, 103 bp, Artificial Sequence
  Synthetic Polynucleotide
taatacgactcactatagggccggtcctggctgtgataaccacagatgttaacagaggagaaacatcatgggttatcacaacctggcggcagcgcaaaagatg

SEQ ID NO: 140365 - DNA, 103 bp, Artificial Sequence
  Synthetic Polynucleotide
taatacgactcactatagggccccgctactttcacaaaataaagattccaaacagaggagatggaatatgtattttgtgaacctggcggcagcgcaaaagatg

SEQ ID NO: 140366 - DNA, 103 bp, Artificial Sequence
  Synthetic Polynucleotide
taatacgactcactatagggagaattcgtaccggtcctggctgtgataacaacagaggagagttatcatggccaggaccaacctggcggcagcgcaaaagatg

SEQ ID NO: 140367 - DNA, 103 bp, Artificial Sequence
  Synthetic Polynucleotide
taatacgactcactatagggatgtgggaagagaattcgtaccggtcctggaacagaggagaccaggaatggtacgaattaacctggcggcagcgcaaaagatg

SEQ ID NO: 140368 - DNA, 103 bp, Artificial Sequence
  Synthetic Polynucleotide
taatacgactcactatagggcccccggacaatgtgggaagagaattcgtaaacagaggagatacgaaatgtcttcccacaacctggcggcagcgcaaaagatg

SEQ ID NO: 140369 - DNA, 103 bp, Artificial Sequence
  Synthetic Polynucleotide
taatacgactcactatagggccttatgctccccccggacaatgtgggaagaacagaggagacttcccatgttgtccgggaacctggcggcagcgcaaaagatg

SEQ ID NO: 140370 - DNA, 103 bp, Artificial Sequence
  Synthetic Polynucleotide
taatacgactcactatagggagagatgagtccccgctactttcacaaaataacagaggagaattttgatgaagtagcggaacctggcggcagcgcaaaagatg

SEQ ID NO: 140371 - DNA, 103 bp, Artificial Sequence
  Synthetic Polynucleotide
taatacgactcactatagggctccttctccagagatgagtccccgctactaacagaggagaagtagcatggactcatctaacctggcggcagcgcaaaagatg

SEQ ID NO: 140372 - DNA, 103 bp, Artificial Sequence
  Synthetic Polynucleotide
taatacgactcactatagggcgccttggaaacggcgagggagtgcgggtgaacagaggagacacccgatgtccctcgccaacctggcggcagcgcaaaagatg

SEQ ID NO: 140373 - DNA, 103 bp, Artificial Sequence
  Synthetic Polynucleotide
taatacgactcactatagggccccgaggaactccttctccagagatgagtaacagaggagaactcatatgtggagaaggaacctggcggcagcgcaaaagatg

SEQ ID NO: 140374 - DNA, 103 bp, Artificial Sequence
  Synthetic Polynucleotide
taatacgactcactatagggcccactggggccccgaggaactccttctccaacagaggagaggagaaatggttcctcggaacctggcggcagcgcaaaagatg

SEQ ID NO: 140375 - DNA, 103 bp, Artificial Sequence
  Synthetic Polynucleotide
taatacgactcactatagggcaccgagggccccactggggccccgaggaaaacagaggagattcctcatggccccagtgaacctggcggcagcgcaaaagatg

SEQ ID NO: 140376 - DNA, 103 bp, Artificial Sequence
  Synthetic Polynucleotide
taatacgactcactatagggtgggggtgctcaccgagggccccactggggaacagaggagaccccagatgggccctcggaacctggcggcagcgcaaaagatg

SEQ ID NO: 140377 - DNA, 103 bp, Artificial Sequence
  Synthetic Polynucleotide
taatacgactcactatagggtgctggctgttgggggtgctcaccgagggcaacagaggagagccctcatggagcaccccaacctggcggcagcgcaaaagatg

SEQ ID NO: 140378 - DNA, 103 bp, Artificial Sequence
  Synthetic Polynucleotide
taatacgactcactatagggaggagaagagtgctggctgttgggggtgctaacagaggagaagcaccatgaacagccagaacctggcggcagcgcaaaagatg

SEQ ID NO: 140379 - DNA, 103 bp, Artificial Sequence
  Synthetic Polynucleotide
taatacgactcactataggggtgagcggctaggagaagagtgctggctgtaacagaggagaacagccatgactcttctcaacctggcggcagcgcaaaagatg

SEQ ID NO: 140380 - DNA, 103 bp, Artificial Sequence
  Synthetic Polynucleotide
taatacgactcactatagggttggcactgagtgagcggctaggagaagagaacagaggagactcttcatgtagccgctcaacctggcggcagcgcaaaagatg

SEQ ID NO: 140381 - DNA, 103 bp, Artificial Sequence
  Synthetic Polynucleotide
taatacgactcactatagggcttgatggagttggcactgagtgagcggctaacagaggagaagccgcatgctcagtgccaacctggcggcagcgcaaaagatg

SEQ ID NO: 140382 - DNA, 103 bp, Artificial Sequence
  Synthetic Polynucleotide
taatacgactcactatagggacatctccaccttgatggagttggcactgaaacagaggagatcagtgatgactccatcaaacctggcggcagcgcaaaagatg

SEQ ID NO: 140383 - DNA, 103 bp, Artificial Sequence
  Synthetic Polynucleotide
taatacgactcactatagggacgcggccgccgccttggaaacggcgagggaacagaggagaccctcgatgtttccaaggaacctggcggcagcgcaaaagatg

SEQ ID NO: 140384 - DNA, 103 bp, Artificial Sequence
  Synthetic Polynucleotide
taatacgactcactatagggtcatcgctgtacatctccaccttgatggagaacagaggagactccatatgggtggagataacctggcggcagcgcaaaagatg

SEQ ID NO: 140385 - DNA, 103 bp, Artificial Sequence
  Synthetic Polynucleotide
taatacgactcactataggggcttgactcctcatcgctgtacatctccacaacagaggagagtggagatgtacagcgataacctggcggcagcgcaaaagatg

SEQ ID NO: 140386 - DNA, 103 bp, Artificial Sequence
  Synthetic Polynucleotide
taatacgactcactatagggccagcagtctgcttgactcctcatcgctgtaacagaggagaacagcgatgaggagtcaaaacctggcggcagcgcaaaagatg

SEQ ID NO: 140387 - DNA, 103 bp, Artificial Sequence
  Synthetic Polynucleotide
taatacgactcactatagggtcatctggccccagcagtctgcttgactccaacagaggagaggagtcatgcagactgctaacctggcggcagcgcaaaagatg

SEQ ID NO: 140388 - DNA, 103 bp, Artificial Sequence
  Synthetic Polynucleotide
taatacgactcactatagggcaggagccgctcatctggccccagcagtctaacagaggagaagactgatggggccagataacctggcggcagcgcaaaagatg

SEQ ID NO: 140389 - DNA, 103 bp, Artificial Sequence
  Synthetic Polynucleotide
taatacgactcactatagggcgtccttttccaggagccgctcatctggccaacagaggagaggccagatgagcggctccaacctggcggcagcgcaaaagatg

SEQ ID NO: 140390 - DNA, 103 bp, Artificial Sequence
  Synthetic Polynucleotide
taatacgactcactatagggatcacgctgtcgtccttttccaggagccgcaacagaggagagcggctatgggaaaaggaaacctggcggcagcgcaaaagatg

SEQ ID NO: 140391 - DNA, 103 bp, Artificial Sequence
  Synthetic Polynucleotide
taatacgactcactatagggatcttccacaatcacgctgtcgtccttttcaacagaggagagaaaagatggacagcgtgaacctggcggcagcgcaaaagatg

SEQ ID NO: 140392 - DNA, 103 bp, Artificial Sequence
  Synthetic Polynucleotide
taatacgactcactatagggcagacaatgaatcttccacaatcacgctgtaacagaggagaacagcgatgttgtggaagaacctggcggcagcgcaaaagatg

SEQ ID NO: 140393 - DNA, 103 bp, Artificial Sequence
  Synthetic Polynucleotide
taatacgactcactatagggcccaggggctcagacaatgaatcttccacaaacagaggagatgtggaatgttcattgtcaacctggcggcagcgcaaaagatg

SEQ ID NO: 140394 - DNA, 103 bp, Artificial Sequence
  Synthetic Polynucleotide
taatacgactcactatagggtggggtgcgaacgcggccgccgccttggaaaacagaggagattccaaatgggcggccgcaacctggcggcagcgcaaaagatg

SEQ ID NO: 140395 - DNA, 103 bp, Artificial Sequence
  Synthetic Polynucleotide
taatacgactcactatagggatcacagtagcccaggggctcagacaatgaaacagaggagatcattgatggagcccctgaacctggcggcagcgcaaaagatg

SEQ ID NO: 140396 - DNA, 103 bp, Artificial Sequence
  Synthetic Polynucleotide
taatacgactcactataggggcccactcccatcacagtagcccaggggctaacagaggagaagccccatggctactgtgaacctggcggcagcgcaaaagatg

SEQ ID NO: 140397 - DNA, 103 bp, Artificial Sequence
  Synthetic Polynucleotide
taatacgactcactatagggtgaggctctggcccactcccatcacagtagaacagaggagactactgatgtgggagtggaacctggcggcagcgcaaaagatg

SEQ ID NO: 140398 - DNA, 103 bp, Artificial Sequence
  Synthetic Polynucleotide
taatacgactcactatagggcccaggggagtgaggctctggcccactcccaacagaggagagggagtatgccagagcctaacctggcggcagcgcaaaagatg

SEQ ID NO: 140399 - DNA, 103 bp, Artificial Sequence
  Synthetic Polynucleotide
taatacgactcactataggggccggatgcccccaggggagtgaggctctgaacagaggagacagagcatgactcccctgaacctggcggcagcgcaaaagatg

SEQ ID NO: 140400 - DNA, 103 bp, Artificial Sequence
  Synthetic Polynucleotide
taatacgactcactatagggccattgggcagccggatgcccccaggggagaacagaggagactccccatggggcatccgaacctggcggcagcgcaaaagatg

SEQ ID NO: 140401 - DNA, 103 bp, Artificial Sequence
  Synthetic Polynucleotide
taatacgactcactatagggcttgagcttgccattgggcagccggatgccaacagaggagaggcatcatgctgcccaataacctggcggcagcgcaaaagatg

SEQ ID NO: 140402 - DNA, 103 bp, Artificial Sequence
  Synthetic Polynucleotide
taatacgactcactatagggagacgtcacacttgagcttgccattgggcaaacagaggagatgcccaatggcaagctcaaacctggcggcagcgcaaaagatg

SEQ ID NO: 140403 - DNA, 103 bp, Artificial Sequence
  Synthetic Polynucleotide
taatacgactcactatagggaccatgccgcagacgtcacacttgagcttgaacagaggagacaagctatggtgtgacgtaacctggcggcagcgcaaaagatg

SEQ ID NO: 140404 - DNA, 103 bp, Artificial Sequence
  Synthetic Polynucleotide
taatacgactcactatagggtccaatacagaccatgccgcagacgtcacaaacagaggagatgtgacatgtgcggcatgaacctggcggcagcgcaaaagatg

SEQ ID NO: 140405 - DNA, 103 bp, Artificial Sequence
  Synthetic Polynucleotide
taatacgactcactatagggggtgagaccctggggtgcgaacgcggccgcaacagaggagagcggccatgttcgcacccaacctggcggcagcgcaaaagatg

SEQ ID NO: 140406 - DNA, 103 bp, Artificial Sequence
  Synthetic Polynucleotide
taatacgactcactataggggcacgttgggtccaatacagaccatgccgcaacagaggagagcggcaatgtctgtattgaacctggcggcagcgcaaaagatg

SEQ ID NO: 140407 - DNA, 103 bp, Artificial Sequence
  Synthetic Polynucleotide
taatacgactcactatagggtgcaccatgagcacgttgggtccaatacagaacagaggagactgtatatgacccaacgtaacctggcggcagcgcaaaagatg

SEQ ID NO: 140408 - DNA, 103 bp, Artificial Sequence
  Synthetic Polynucleotide
taatacgactcactatagggactgcgcttgtgcaccatgagcacgttgggaacagaggagacccaacatgctcatggtgaacctggcggcagcgcaaaagatg

SEQ ID NO: 140409 - DNA, 103 bp, Artificial Sequence
  Synthetic Polynucleotide
taatacgactcactatagggcaccagtgtgactgcgcttgtgcaccatgaaacagaggagatcatggatgacaagcgcaaacctggcggcagcgcaaaagatg

SEQ ID NO: 140410 - DNA, 103 bp, Artificial Sequence
  Synthetic Polynucleotide
taatacgactcactatagggaagggcctttcaccagtgtgactgcgcttgaacagaggagacaagcgatgtcacactggaacctggcggcagcgcaaaagatg

SEQ ID NO: 140411 - DNA, 103 bp, Artificial Sequence
  Synthetic Polynucleotide
taatacgactcactataggggttgcaatggaagggcctttcaccagtgtgaacagaggagacacactatggaaaggcccaacctggcggcagcgcaaaagatg

SEQ ID NO: 140412 - DNA, 103 bp, Artificial Sequence
  Synthetic Polynucleotide
taatacgactcactatagggcaccacactggttgcaatggaagggcctttaacagaggagaaaaggcatgtccattgcaaacctggcggcagcgcaaaagatg

SEQ ID NO: 140413 - DNA, 103 bp, Artificial Sequence
  Synthetic Polynucleotide
taatacgactcactataggggtgaaggaggcaccacactggttgcaatggaacagaggagaccattgatgccagtgtggaacctggcggcagcgcaaaagatg

SEQ ID NO: 140414 - DNA, 103 bp, Artificial Sequence
  Synthetic Polynucleotide
taatacgactcactatagggccccttctgggtgaaggaggcaccacactgaacagaggagacagtgtatggcctccttcaacctggcggcagcgcaaaagatg

SEQ ID NO: 140415 - DNA, 103 bp, Artificial Sequence
  Synthetic Polynucleotide
taatacgactcactataggggcagcaggttccccttctgggtgaaggaggaacagaggagacctcctatgcccagaaggaacctggcggcagcgcaaaagatg

SEQ ID NO: 140416 - DNA, 103 bp, Artificial Sequence
  Synthetic Polynucleotide
taatacgactcactatagggttcccttgccggtgagaccctggggtgcgaaacagaggagatcgcacatgagggtctcaaacctggcggcagcgcaaaagatg

SEQ ID NO: 140417 - DNA, 103 bp, Artificial Sequence
  Synthetic Polynucleotide
taatacgactcactatagggttgatgtggcgcagcaggttccccttctggaacagaggagaccagaaatggaacctgctaacctggcggcagcgcaaaagatg

SEQ ID NO: 140418 - DNA, 103 bp, Artificial Sequence
  Synthetic Polynucleotide
taatacgactcactatagggagagtgcagcttgatgtggcgcagcaggttaacagaggagaaacctgatgcgccacatcaacctggcggcagcgcaaaagatg

SEQ ID NO: 140419 - DNA, 103 bp, Artificial Sequence
  Synthetic Polynucleotide
taatacgactcactataggggcttctccccagagtgcagcttgatgtggcaacagaggagagccacaatgagctgcactaacctggcggcagcgcaaaagatg

SEQ ID NO: 140420 - DNA, 103 bp, Artificial Sequence
  Synthetic Polynucleotide
taatacgactcactatagggcatttaaagggcttctccccagagtgcagcaacagaggagagctgcaatgtggggagaaaacctggcggcagcgcaaaagatg

SEQ ID NO: 140421 - DNA, 103 bp, Artificial Sequence
  Synthetic Polynucleotide
taatacgactcactataggggcagaagggacatttaaagggcttctccccaacagaggagaggggagatgccctttaaaaacctggcggcagcgcaaaagatg

SEQ ID NO: 140422 - DNA, 103 bp, Artificial Sequence
  Synthetic Polynucleotide
taatacgactcactatagggaggcatagttgcagaagggacatttaaaggaacagaggagacctttaatggtcccttctaacctggcggcagcgcaaaagatg

SEQ ID NO: 140423 - DNA, 103 bp, Artificial Sequence
  Synthetic Polynucleotide
taatacgactcactatagggcgccggcggcaggcatagttgcagaagggaaacagaggagatcccttatgcaactatgcaacctggcggcagcgcaaaagatg

SEQ ID NO: 140424 - DNA, 103 bp, Artificial Sequence
  Synthetic Polynucleotide
taatacgactcactataggggagtgcatcacgccggcggcaggcatagttaacagaggagaaactatatgtgccgccggaacctggcggcagcgcaaaagatg

SEQ ID NO: 140425 - DNA, 103 bp, Artificial Sequence
  Synthetic Polynucleotide
taatacgactcactatagggggtgaccagtgagtgcatcacgccggcggcaacagaggagagccgccatggtgatgcacaacctggcggcagcgcaaaagatg

SEQ ID NO: 140426 - DNA, 103 bp, Artificial Sequence
  Synthetic Polynucleotide
taatacgactcactatagggtgtgtgcggaggtgaccagtgagtgcatcaaacagaggagatgatgcatgcactggtcaaacctggcggcagcgcaaaagatg

SEQ ID NO: 140427 - DNA, 103 bp, Artificial Sequence
  Synthetic Polynucleotide
taatacgactcactatagggcagattatccttcccttgccggtgagacccaacagaggagagggtctatgcggcaagggaacctggcggcagcgcaaaagatg

SEQ ID NO: 140428 - DNA, 103 bp, Artificial Sequence
  Synthetic Polynucleotide
taatacgactcactatagggggagactgagtgtgtgcggaggtgaccagtaacagaggagaactggtatgctccgcacaaacctggcggcagcgcaaaagatg

SEQ ID NO: 140429 - DNA, 103 bp, Artificial Sequence
  Synthetic Polynucleotide
taatacgactcactatagggctgtgggagaggagactgagtgtgtgcggaaacagaggagatccgcaatgactcagtctaacctggcggcagcgcaaaagatg

SEQ ID NO: 140430 - DNA, 103 bp, Artificial Sequence
  Synthetic Polynucleotide
taatacgactcactatagggggcttgcccactgtgggagaggagactgagaacagaggagactcagtatgctctcccacaacctggcggcagcgcaaaagatg

SEQ ID NO: 140431 - DNA, 103 bp, Artificial Sequence
  Synthetic Polynucleotide
taatacgactcactatagggacacttgtagggcttgcccactgtgggagaaacagaggagatctcccatggtgggcaagaacctggcggcagcgcaaaagatg

SEQ ID NO: 140432 - DNA, 103 bp, Artificial Sequence
  Synthetic Polynucleotide
taatacgactcactatagggcacagtagttacacttgtagggcttgcccaaacagaggagatgggcaatgcctacaagtaacctggcggcagcgcaaaagatg

SEQ ID NO: 140433 - DNA, 103 bp, Artificial Sequence
  Synthetic Polynucleotide
taatacgactcactatagggtagctccggccacagtagttacacttgtagaacagaggagactacaaatgtaactactgaacctggcggcagcgcaaaagatg

SEQ ID NO: 140434 - DNA, 103 bp, Artificial Sequence
  Synthetic Polynucleotide
taatacgactcactatagggctgctgtttgtagctccggccacagtagttaacagaggagaaactacatgggccggagcaacctggcggcagcgcaaaagatg

SEQ ID NO: 140435 - DNA, 103 bp, Artificial Sequence
  Synthetic Polynucleotide
taatacgactcactatagggccagggtactctgctgtttgtagctccggcaacagaggagagccggaatgacaaacagcaacctggcggcagcgcaaaagatg

SEQ ID NO: 140436 - DNA, 103 bp, Artificial Sequence
  Synthetic Polynucleotide
taatacgactcactatagggttgtgctcctccagggtactctgctgtttgaacagaggagacaaacaatggagtaccctaacctggcggcagcgcaaaagatg

SEQ ID NO: 140437 - DNA, 103 bp, Artificial Sequence
  Synthetic Polynucleotide
taatacgactcactataggggcaccgctccttgtgctcctccagggtactaacagaggagaagtaccatggaggagcacaacctggcggcagcgcaaaagatg

SEQ ID NO: 140438 - DNA, 103 bp, Artificial Sequence
  Synthetic Polynucleotide
taatacgactcactataggggatccctctccagattatccttcccttgccaacagaggagaggcaagatgaggataatcaacctggcggcagcgcaaaagatg

SEQ ID NO: 140439 - DNA, 103 bp, Artificial Sequence
  Synthetic Polynucleotide
taatacgactcactatagggggtagttatggcaccgctccttgtgctcctaacagaggagaaggagcatgaggagcggtaacctggcggcagcgcaaaagatg

SEQ ID NO: 140440 - DNA, 103 bp, Artificial Sequence
  Synthetic Polynucleotide
taatacgactcactatagggagactctgtaggtagttatggcaccgctccaacagaggagaggagcgatgccataactaaacctggcggcagcgcaaaagatg

SEQ ID NO: 140441 - DNA, 103 bp, Artificial Sequence
  Synthetic Polynucleotide
taatacgactcactatagggttcagtgctgagactctgtaggtagttatgaacagaggagacataacatgctacagagtaacctggcggcagcgcaaaagatg

SEQ ID NO: 140442 - DNA, 103 bp, Artificial Sequence
  Synthetic Polynucleotide
taatacgactcactatagggaagcttgggcttcagtgctgagactctgtaaacagaggagatacagaatgtcagcactgaacctggcggcagcgcaaaagatg

SEQ ID NO: 140443 - DNA, 103 bp, Artificial Sequence
  Synthetic Polynucleotide
taatacgactcactatagggtggccagccaaagcttgggcttcagtgctgaacagaggagacagcacatgagcccaagcaacctggcggcagcgcaaaagatg

SEQ ID NO: 140444 - DNA, 103 bp, Artificial Sequence
  Synthetic Polynucleotide
taatacgactcactataggggtcacctggttggccagccaaagcttgggcaacagaggagagcccaaatgttggctggcaacctggcggcagcgcaaaagatg

SEQ ID NO: 140445 - DNA, 103 bp, Artificial Sequence
  Synthetic Polynucleotide
taatacgactcactatagggcacgtatttcgtcacctggttggccagccaaacagaggagatggctgatgaaccaggtgaacctggcggcagcgcaaaagatg

SEQ ID NO: 140446 - DNA, 103 bp, Artificial Sequence
  Synthetic Polynucleotide
taatacgactcactatagggatctccaggtcacgtatttcgtcacctggtaacagaggagaaccaggatgcgaaatacgaacctggcggcagcgcaaaagatg

SEQ ID NO: 140447 - DNA, 103 bp, Artificial Sequence
  Synthetic Polynucleotide
taatacgactcactataggggtctggcaccatctccaggtcacgtatttcaacagaggagagaaataatggacctggagaacctggcggcagcgcaaaagatg

SEQ ID NO: 140448 - DNA, 103 bp, Artificial Sequence
  Synthetic Polynucleotide
taatacgactcactataggggcagcatggagtctggcaccatctccaggtaacagaggagaacctggatgtggtgccagaacctggcggcagcgcaaaagatg

SEQ ID NO: 140449 - DNA, 103 bp, Artificial Sequence
  Synthetic Polynucleotide
taatacgactcactatagggcctcctgagggatccctctccagattatccaacagaggagaggataaatgggagagggaaacctggcggcagcgcaaaagatg

SEQ ID NO: 140450 - DNA, 103 bp, Artificial Sequence
  Synthetic Polynucleotide
taatacgactcactataggggaggatgagtgcagcatggagtctggcaccaacagaggagaggtgccatgctccatgctaacctggcggcagcgcaaaagatg

SEQ ID NO: 140451 - DNA, 103 bp, Artificial Sequence
  Synthetic Polynucleotide
taatacgactcactatagggtggccgctcagaggatgagtgcagcatggaaacagaggagatccatgatgcactcatccaacctggcggcagcgcaaaagatg

SEQ ID NO: 140452 - DNA, 103 bp, Artificial Sequence
  Synthetic Polynucleotide
taatacgactcactatagggcgatgaaagttggccgctcagaggatgagtaacagaggagaactcatatgctgagcggcaacctggcggcagcgcaaaagatg

SEQ ID NO: 140453 - DNA, 103 bp, Artificial Sequence
  Synthetic Polynucleotide
taatacgactcactataggggccagacgatcgatgaaagttggccgctcaaacagaggagatgagcgatgaactttcataacctggcggcagcgcaaaagatg

SEQ ID NO: 140454 - DNA, 103 bp, Artificial Sequence
  Synthetic Polynucleotide
taatacgactcactataggggaggctattggccagacgatcgatgaaagtaacagaggagaactttcatggatcgtctgaacctggcggcagcgcaaaagatg

SEQ ID NO: 140455 - DNA, 103 bp, Artificial Sequence
  Synthetic Polynucleotide
taatacgactcactatagggtgcgtttggtgaggctattggccagacgataacagaggagaatcgtcatgccaatagccaacctggcggcagcgcaaaagatg

SEQ ID NO: 140456 - DNA, 103 bp, Artificial Sequence
  Synthetic Polynucleotide
taatacgactcactataggggtggaacgcttgcgtttggtgaggctattgaacagaggagacaatagatgcaccaaacgaacctggcggcagcgcaaaagatg

SEQ ID NO: 140457 - DNA, 103 bp, Artificial Sequence
  Synthetic Polynucleotide
taatacgactcactatagggcttctggggtgtggaacgcttgcgtttggtaacagaggagaaccaaaatgaagcgttccaacctggcggcagcgcaaaagatg

SEQ ID NO: 140458 - DNA, 103 bp, Artificial Sequence
  Synthetic Polynucleotide
taatacgactcactatagggcgcctacaaacttctggggtgtggaacgctaacagaggagaagcgttatgcaccccagaaacctggcggcagcgcaaaagatg

SEQ ID NO: 140459 - DNA, 103 bp, Artificial Sequence
  Synthetic Polynucleotide
taatacgactcactatagggatctgcttttcgcctacaaacttctggggtaacagaggagaaccccaatggtttgtaggaacctggcggcagcgcaaaagatg

SEQ ID NO: 140460 - DNA, 103 bp, Artificial Sequence
  Synthetic Polynucleotide
taatacgactcactataggggtccaaaggctctggttttttttcacccataacagaggagaatgggtatgaaaaaaccaaacctggcggcagcgcaaaagatg

SEQ ID NO: 140461 - DNA, 103 bp, Artificial Sequence
  Synthetic Polynucleotide
taatacgactcactatagggctctgcttctttgtccccactaactgatccaacagaggagaggatcaatgagtggggacaacctggcggcagcgcaaaagatg

SEQ ID NO: 140462 - DNA, 103 bp, Artificial Sequence
  Synthetic Polynucleotide
taatacgactcactatagggagtgctcgtgtgggcacttggctcactgctaacagaggagaagcagtatgccaagtgccaacctggcggcagcgcaaaagatg

SEQ ID NO: 140463 - DNA, 103 bp, Artificial Sequence
  Synthetic Polynucleotide
taatacgactcactatagggctatgctgggagtgctcgtgtgggcacttgaacagaggagacaagtgatgacacgagcaaacctggcggcagcgcaaaagatg

SEQ ID NO: 140464 - DNA, 103 bp, Artificial Sequence
  Synthetic Polynucleotide
taatacgactcactatagggtggctgtttcctatgctgggagtgctcgtgaacagaggagacacgagatgtcccagcataacctggcggcagcgcaaaagatg

SEQ ID NO: 140465 - DNA, 103 bp, Artificial Sequence
  Synthetic Polynucleotide
taatacgactcactatagggggtgcttggctggctgtttcctatgctgggaacagaggagacccagcatgggaaacagcaacctggcggcagcgcaaaagatg

SEQ ID NO: 140466 - DNA, 103 bp, Artificial Sequence
  Synthetic Polynucleotide
taatacgactcactatagggctggggctggggtgcttggctggctgtttcaacagaggagagaaacaatgagccaagcaaacctggcggcagcgcaaaagatg

SEQ ID NO: 140467 - DNA, 103 bp, Artificial Sequence
  Synthetic Polynucleotide
taatacgactcactatagggaccggcagggctggggctggggtgcttggcaacagaggagagccaagatgcccagccccaacctggcggcagcgcaaaagatg

SEQ ID NO: 140468 - DNA, 103 bp, Artificial Sequence
  Synthetic Polynucleotide
taatacgactcactatagggagggtcctggaccggcagggctggggctggaacagaggagaccagccatggccctgccgaacctggcggcagcgcaaaagatg

SEQ ID NO: 140469 - DNA, 103 bp, Artificial Sequence
  Synthetic Polynucleotide
taatacgactcactataggggcagaagctgagggtcctggaccggcagggaacagaggagaccctgcatgtccaggaccaacctggcggcagcgcaaaagatg

SEQ ID NO: 140470 - DNA, 103 bp, Artificial Sequence
  Synthetic Polynucleotide
taatacgactcactatagggtggcagtggtgcagaagctgagggtcctggaacagaggagaccaggaatgtcagcttctaacctggcggcagcgcaaaagatg

SEQ ID NO: 140471 - DNA, 103 bp, Artificial Sequence
  Synthetic Polynucleotide
taatacgactcactatagggatcacagtgctggcagtggtgcagaagctgaacagaggagacagcttatgcaccactgcaacctggcggcagcgcaaaagatg

SEQ ID NO: 140472 - DNA, 103 bp, Artificial Sequence
  Synthetic Polynucleotide
taatacgactcactatagggcctgaagagcctctgcttctttgtccccacaacagaggagagtggggatgaagaagcagaacctggcggcagcgcaaaagatg

SEQ ID NO: 140473 - DNA, 103 bp, Artificial Sequence
  Synthetic Polynucleotide
taatacgactcactatagggcaaagtacatatcacagtgctggcagtggtaacagaggagaaccactatgagcactgtgaacctggcggcagcgcaaaagatg

SEQ ID NO: 140474 - DNA, 103 bp, Artificial Sequence
  Synthetic Polynucleotide
taatacgactcactatagggatgttgtctgcaaagtacatatcacagtgcaacagaggagagcactgatgtatgtacttaacctggcggcagcgcaaaagatg

SEQ ID NO: 140475 - DNA, 103 bp, Artificial Sequence
  Synthetic Polynucleotide
taatacgactcactatagggagtgtaaaggatgttgtctgcaaagtacataacagaggagaatgtacatggcagacaacaacctggcggcagcgcaaaagatg

SEQ ID NO: 140476 - DNA, 103 bp, Artificial Sequence
  Synthetic Polynucleotide
taatacgactcactatagggccatatgaatagtgtaaaggatgttgtctgaacagaggagacagacaatgtcctttacaaacctggcggcagcgcaaaagatg

SEQ ID NO: 140477 - DNA, 103 bp, Artificial Sequence
  Synthetic Polynucleotide
taatacgactcactatagggccatgacatcccatatgaatagtgtaaaggaacagaggagacctttaatgtattcatataacctggcggcagcgcaaaagatg

SEQ ID NO: 140478 - DNA, 103 bp, Artificial Sequence
  Synthetic Polynucleotide
taatacgactcactatagggattttcatacccatgacatcccatatgaataacagaggagaattcatatgggatgtcataacctggcggcagcgcaaaagatg

SEQ ID NO: 140479 - DNA, 103 bp, Artificial Sequence
  Synthetic Polynucleotide
taatacgactcactatagggactgaaaaggattttcatacccatgacatcaacagaggagagatgtcatgggtatgaaaaacctggcggcagcgcaaaagatg

SEQ ID NO: 140480 - DNA, 103 bp, Artificial Sequence
  Synthetic Polynucleotide
taatacgactcactatagggcatatattacactgaaaaggattttcatacaacagaggagagtatgaatgtccttttcaaacctggcggcagcgcaaaagatg

SEQ ID NO: 140481 - DNA, 103 bp, Artificial Sequence
  Synthetic Polynucleotide
taatacgactcactatagggtttgcatccacatatattacactgaaaaggaacagaggagaccttttatgtgtaatataaacctggcggcagcgcaaaagatg

SEQ ID NO: 140482 - DNA, 103 bp, Artificial Sequence
  Synthetic Polynucleotide
taatacgactcactatagggtgtttttacatttgcatccacatatattacaacagaggagagtaataatggtggatgcaaacctggcggcagcgcaaaagatg

SEQ ID NO: 140483 - DNA, 103 bp, Artificial Sequence
  Synthetic Polynucleotide
taatacgactcactataggggttccagctccctgaagagcctctgcttctaacagaggagaagaagcatgggctcttcaaacctggcggcagcgcaaaagatg

SEQ ID NO: 140484 - DNA, 103 bp, Artificial Sequence
  Synthetic Polynucleotide
taatacgactcactatagggaaatcatacttgtttttacatttgcatccaaacagaggagatggatgatgatgtaaaaaaacctggcggcagcgcaaaagatg

SEQ ID NO: 140485 - DNA, 103 bp, Artificial Sequence
  Synthetic Polynucleotide
taatacgactcactatagggatgacaggcaaaatcatacttgtttttacaaacagaggagatgtaaaatgaagtatgataacctggcggcagcgcaaaagatg

SEQ ID NO: 140486 - DNA, 103 bp, Artificial Sequence
  Synthetic Polynucleotide
taatacgactcactatagggctcttgcaaaatgacaggcaaaatcatactaacagaggagaagtatgatgttgcctgtcaacctggcggcagcgcaaaagatg

SEQ ID NO: 140487 - DNA, 103 bp, Artificial Sequence
  Synthetic Polynucleotide
taatacgactcactatagggttatgttgccctcttgcaaaatgacaggcaaacagaggagatgcctgatgttttgcaagaacctggcggcagcgcaaaagatg

SEQ ID NO: 140488 - DNA, 103 bp, Artificial Sequence
  Synthetic Polynucleotide
taatacgactcactatagggtcaatgttggttatgttgccctcttgcaaaaacagaggagatttgcaatggggcaacataacctggcggcagcgcaaaagatg

SEQ ID NO: 140489 - DNA, 103 bp, Artificial Sequence
  Synthetic Polynucleotide
taatacgactcactatagggatcaccatctgttccagctccctgaagagcaacagaggagagctcttatgggagctggaaacctggcggcagcgcaaaagatg

SEQ ID NO: 140490 - DNA, 103 bp, Artificial Sequence
  Synthetic Polynucleotide
taatacgactcactataggggtccattttgatcaccatctgttccagctcaacagaggagagagctgatgcagatggtgaacctggcggcagcgcaaaagatg

SEQ ID NO: 140491 - DNA, 103 bp, Artificial Sequence
  Synthetic Polynucleotide
taatacgactcactataggggggtgatcaagtccattttgatcaccatctaacagaggagaagatggatgtcaaaatggaacctggcggcagcgcaaaagatg

SEQ ID NO: 140492 - DNA, 103 bp, Artificial Sequence
  Synthetic Polynucleotide
taatacgactcactatagggttcaacagatgggtgatcaagtccattttgaacagaggagacaaaatatgcttgatcacaacctggcggcagcgcaaaagatg

SEQ ID NO: 140493 - DNA, 103 bp, Artificial Sequence
  Synthetic Polynucleotide
taatacgactcactatagggccaaggaaacttcaacagatgggtgatcaaaacagaggagattgatcatgcatctgttgaacctggcggcagcgcaaaagatg

SEQ ID NO: 140494 - DNA, 103 bp, Artificial Sequence
  Synthetic Polynucleotide
taatacgactcactataggggagttttcatccaaggaaacttcaacagataacagaggagaatctgtatgagtttccttaacctggcggcagcgcaaaagatg

SEQ ID NO: 140495 - DNA, 103 bp, Artificial Sequence
  Synthetic Polynucleotide
taatacgactcactatagggtaacattcctgagttttcatccaaggaaacaacagaggagagtttccatggatgaaaacaacctggcggcagcgcaaaagatg

SEQ ID NO: 140496 - DNA, 103 bp, Artificial Sequence
  Synthetic Polynucleotide
taatacgactcactatagggctttcacgaagtccaaaggctctggtttttaacagaggagaaaaaacatgagcctttggaacctggcggcagcgcaaaagatg

SEQ ID NO: 140497 - DNA, 103 bp, Artificial Sequence
  Synthetic Polynucleotide
taatacgactcactatagggacccgtctactaacattcctgagttttcataacagaggagaatgaaaatgcaggaatgtaacctggcggcagcgcaaaagatg

SEQ ID NO: 140498 - DNA, 103 bp, Artificial Sequence
  Synthetic Polynucleotide
taatacgactcactataggggtcctttcaaacccgtctactaacattcctaacagaggagaaggaatatgagtagacggaacctggcggcagcgcaaaagatg

SEQ ID NO: 140499 - DNA, 103 bp, Artificial Sequence
  Synthetic Polynucleotide
taatacgactcactatagggcccatcaaaggtcctttcaaacccgtctacaacagaggagagtagacatgtttgaaaggaacctggcggcagcgcaaaagatg

SEQ ID NO: 140500 - DNA, 103 bp, Artificial Sequence
  Synthetic Polynucleotide
taatacgactcactatagggacttaagcttcccatcaaaggtcctttcaaaacagaggagattgaaaatgcctttgatgaacctggcggcagcgcaaaagatg

SEQ ID NO: 140501 - DNA, 103 bp, Artificial Sequence
  Synthetic Polynucleotide
taatacgactcactatagggcagtaccgacacttaagcttcccatcaaagaacagaggagactttgaatggaagcttaaaacctggcggcagcgcaaaagatg

SEQ ID NO: 140502 - DNA, 103 bp, Artificial Sequence
  Synthetic Polynucleotide
taatacgactcactatagggggcatagttgcagtaccgacacttaagcttaacagaggagaaagcttatgtgtcggtacaacctggcggcagcgcaaaagatg

SEQ ID NO: 140503 - DNA, 103 bp, Artificial Sequence
  Synthetic Polynucleotide
taatacgactcactatagggttcctttgctggcatagttgcagtaccgacaacagaggagagtcggtatggcaactatgaacctggcggcagcgcaaaagatg

SEQ ID NO: 140504 - DNA, 103 bp, Artificial Sequence
  Synthetic Polynucleotide
taatacgactcactatagggagccgggctgttcctttgctggcatagttgaacagaggagacaactaatgcagcaaaggaacctggcggcagcgcaaaagatg

SEQ ID NO: 140505 - DNA, 103 bp, Artificial Sequence
  Synthetic Polynucleotide
taatacgactcactataggggtgttcaataagccgggctgttcctttgctaacagaggagaagcaaaatgacagcccggaacctggcggcagcgcaaaagatg

SEQ ID NO: 140506 - DNA, 103 bp, Artificial Sequence
  Synthetic Polynucleotide
taatacgactcactatagggggattctgatgtgttcaataagccgggctgaacagaggagacagcccatgttattgaacaacctggcggcagcgcaaaagatg

SEQ ID NO: 140507 - DNA, 103 bp, Artificial Sequence
  Synthetic Polynucleotide
taatacgactcactatagggtcctgaaaatctttcacgaagtccaaaggcaacagaggagagcctttatgcttcgtgaaaacctggcggcagcgcaaaagatg

SEQ ID NO: 140508 - DNA, 103 bp, Artificial Sequence
  Synthetic Polynucleotide
taatacgactcactatagggtcacctgtgtggattctgatgtgttcaataaacagaggagatattgaatgcatcagaataacctggcggcagcgcaaaagatg

SEQ ID NO: 140509 - DNA, 103 bp, Artificial Sequence
  Synthetic Polynucleotide
taatacgactcactatagggatgaggtttttcacctgtgtggattctgataacagaggagaatcagaatgcacacaggtaacctggcggcagcgcaaaagatg

SEQ ID NO: 140510 - DNA, 103 bp, Artificial Sequence
  Synthetic Polynucleotide
taatacgactcactataggggatgacatcgatgaggtttttcacctgtgtaacagaggagaacacagatgaaaaacctcaacctggcggcagcgcaaaagatg

SEQ ID NO: 140511 - DNA, 103 bp, Artificial Sequence
  Synthetic Polynucleotide
taatacgactcactatagggaatggacaaagatgacatcgatgaggttttaacagaggagaaaaaccatgtcgatgtcaaacctggcggcagcgcaaaagatg

SEQ ID NO: 140512 - DNA, 103 bp, Artificial Sequence
  Synthetic Polynucleotide
taatacgactcactatagggagcagatgcaaatggacaaagatgacatcgaacagaggagacgatgtatgctttgtccaaacctggcggcagcgcaaaagatg

SEQ ID NO: 140513 - DNA, 103 bp, Artificial Sequence
  Synthetic Polynucleotide
taatacgactcactataggggacgctcataagcagatgcaaatggacaaaaacagaggagatttgtcatgttgcatctgaacctggcggcagcgcaaaagatg

SEQ ID NO: 140514 - DNA, 103 bp, Artificial Sequence
  Synthetic Polynucleotide
taatacgactcactataggggcttccagatgacgctcataagcagatgcaaacagaggagatgcatcatgttatgagcgaacctggcggcagcgcaaaagatg

SEQ ID NO: 140515 - DNA, 103 bp, Artificial Sequence
  Synthetic Polynucleotide
taatacgactcactatagggacgcatatgggcttccagatgacgctcataaacagaggagatatgagatgcatctggaaaacctggcggcagcgcaaaagatg

SEQ ID NO: 140516 - DNA, 103 bp, Artificial Sequence
  Synthetic Polynucleotide
taatacgactcactatagggcagtatgagaacgcatatgggcttccagataacagaggagaatctggatgcccatatgcaacctggcggcagcgcaaaagatg

SEQ ID NO: 140517 - DNA, 103 bp, Artificial Sequence
  Synthetic Polynucleotide
taatacgactcactatagggggtttttctccagtatgagaacgcatatggaacagaggagaccatatatgttctcatacaacctggcggcagcgcaaaagatg

SEQ ID NO: 140518 - DNA, 103 bp, Artificial Sequence
  Synthetic Polynucleotide
taatacgactcactatagggagtcaggtattcctgaaaatctttcacgaaaacagaggagattcgtgatggattttcagaacctggcggcagcgcaaaagatg

SEQ ID NO: 140519 - DNA, 103 bp, Artificial Sequence
  Synthetic Polynucleotide
taatacgactcactatagggacatttgtatggtttttctccagtatgagaaacagaggagatctcatatgggagaaaaaaacctggcggcagcgcaaaagatg

SEQ ID NO: 140520 - DNA, 103 bp, Artificial Sequence
  Synthetic Polynucleotide
taatacgactcactatagggaacataattcacatttgtatggtttttctcaacagaggagagagaaaatgcatacaaataacctggcggcagcgcaaaagatg

SEQ ID NO: 140521 - DNA, 103 bp, Artificial Sequence
  Synthetic Polynucleotide
taatacgactcactatagggcagcggaaggaacataattcacatttgtataacagaggagaatacaaatgtgaattatgaacctggcggcagcgcaaaagatg

SEQ ID NO: 140522 - DNA, 103 bp, Artificial Sequence
  Synthetic Polynucleotide
taatacgactcactatagggtcgatcactgcagcggaaggaacataattcaacagaggagagaattaatgtccttccgcaacctggcggcagcgcaaaagatg

SEQ ID NO: 140523 - DNA, 103 bp, Artificial Sequence
  Synthetic Polynucleotide
taatacgactcactatagggacaagttacttcgatcactgcagcggaaggaacagaggagaccttccatggcagtgatcaacctggcggcagcgcaaaagatg

SEQ ID NO: 140524 - DNA, 103 bp, Artificial Sequence
  Synthetic Polynucleotide
taatacgactcactatagggcgatgatgggacaagttacttcgatcactgaacagaggagacagtgaatgaagtaacttaacctggcggcagcgcaaaagatg

SEQ ID NO: 140525 - DNA, 103 bp, Artificial Sequence
  Synthetic Polynucleotide
taatacgactcactatagggcttgcgccttcgatgatgggacaagttactaacagaggagaagtaacatgtcccatcataacctggcggcagcgcaaaagatg

SEQ ID NO: 140526 - DNA, 103 bp, Artificial Sequence
  Synthetic Polynucleotide
taatacgactcactatagggccattttatgcttgcgccttcgatgatgggaacagaggagacccatcatggaaggcgcaaacctggcggcagcgcaaaagatg

SEQ ID NO: 140527 - DNA, 103 bp, Artificial Sequence
  Synthetic Polynucleotide
taatacgactcactatagggttaattggtaccattttatgcttgcgccttaacagaggagaaaggcgatggcataaaataacctggcggcagcgcaaaagatg

SEQ ID NO: 140528 - DNA, 103 bp, Artificial Sequence
  Synthetic Polynucleotide
taatacgactcactatagggcctagtacctttaattggtaccattttatgaacagaggagacataaaatggtaccaattaacctggcggcagcgcaaaagatg

SEQ ID NO: 140529 - DNA, 103 bp, Artificial Sequence
  Synthetic Polynucleotide
taatacgactcactataggggggtctgctgagtcaggtattcctgaaaataacagaggagaattttcatgaatacctgaaacctggcggcagcgcaaaagatg

SEQ ID NO: 140530 - DNA, 103 bp, Artificial Sequence
  Synthetic Polynucleotide
taatacgactcactatagggttaaggaagacctagtacctttaattggtaaacagaggagataccaaatgaaggtactaaacctggcggcagcgcaaaagatg

SEQ ID NO: 140531 - DNA, 103 bp, Artificial Sequence
  Synthetic Polynucleotide
taatacgactcactatagggttcttgctgcttaaggaagacctagtacctaacagaggagaaggtacatggtcttccttaacctggcggcagcgcaaaagatg

SEQ ID NO: 140532 - DNA, 103 bp, Artificial Sequence
  Synthetic Polynucleotide
taatacgactcactatagggcccccacattttcttgctgcttaaggaagaaacagaggagatcttccatgagcagcaagaacctggcggcagcgcaaaagatg

SEQ ID NO: 140533 - DNA, 103 bp, Artificial Sequence
  Synthetic Polynucleotide
taatacgactcactatagggtctgtaaaaccccccacattttcttgctgcaacagaggagagcagcaatgaaatgtgggaacctggcggcagcgcaaaagatg

SEQ ID NO: 140534 - DNA, 103 bp, Artificial Sequence
  Synthetic Polynucleotide
taatacgactcactatagggcttgttttcttctgtaaaaccccccacattaacagaggagaaatgtgatgggttttacaaacctggcggcagcgcaaaagatg

SEQ ID NO: 140535 - DNA, 103 bp, Artificial Sequence
  Synthetic Polynucleotide
taatacgactcactataggggcccagattgcttgttttcttctgtaaaacaacagaggagagttttaatgaagaaaacaaacctggcggcagcgcaaaagatg

SEQ ID NO: 140536 - DNA, 103 bp, Artificial Sequence
  Synthetic Polynucleotide
taatacgactcactatagggttctgctatagcccagattgcttgttttctaacagaggagaagaaaaatggcaatctggaacctggcggcagcgcaaaagatg

SEQ ID NO: 140537 - DNA, 103 bp, Artificial Sequence
  Synthetic Polynucleotide
taatacgactcactatagggattagtgctcttctgctatagcccagattgaacagaggagacaatctatgctatagcagaacctggcggcagcgcaaaagatg

SEQ ID NO: 140538 - DNA, 103 bp, Artificial Sequence
  Synthetic Polynucleotide
taatacgactcactatagggacttaagttgattagtgctcttctgctataaacagaggagatatagcatgagagcactaaacctggcggcagcgcaaaagatg

SEQ ID NO: 140539 - DNA, 103 bp, Artificial Sequence
  Synthetic Polynucleotide
taatacgactcactatagggtggaaggtggacttaagttgattagtgctcaacagaggagagagcacatgtcaacttaaaacctggcggcagcgcaaaagatg

SEQ ID NO: 140540 - DNA, 103 bp, Artificial Sequence
  Synthetic Polynucleotide
taatacgactcactatagggttcacgtgatgggtctgctgagtcaggtataacagaggagaatacctatgtcagcagacaacctggcggcagcgcaaaagatg

SEQ ID NO: 140541 - DNA, 103 bp, Artificial Sequence
  Synthetic Polynucleotide
taatacgactcactatagggtgaaccaccatggaaggtggacttaagttgaacagaggagacaacttatgtccaccttcaacctggcggcagcgcaaaagatg

SEQ ID NO: 140542 - DNA, 103 bp, Artificial Sequence
  Synthetic Polynucleotide
taatacgactcactataggggtctggtttctgaaccaccatggaaggtggaacagaggagaccacctatgatggtggttaacctggcggcagcgcaaaagatg

SEQ ID NO: 140543 - DNA, 103 bp, Artificial Sequence
  Synthetic Polynucleotide
taatacgactcactatagggcgttaaggtagtctggtttctgaaccaccaaacagaggagatggtggatgagaaaccagaacctggcggcagcgcaaaagatg

SEQ ID NO: 140544 - DNA, 103 bp, Artificial Sequence
  Synthetic Polynucleotide
taatacgactcactatagggtgggtaaaatcgttaaggtagtctggtttcaacagaggagagaaaccatgctaccttaaaacctggcggcagcgcaaaagatg

SEQ ID NO: 140545 - DNA, 103 bp, Artificial Sequence
  Synthetic Polynucleotide
taatacgactcactatagggtgggatttcgtgggtaaaatcgttaaggtaaacagaggagataccttatggattttaccaacctggcggcagcgcaaaagatg

SEQ ID NO: 140546 - DNA, 103 bp, Artificial Sequence
  Synthetic Polynucleotide
taatacgactcactatagggtctggatatttgggatttcgtgggtaaaataacagaggagaattttaatgacgaaatccaacctggcggcagcgcaaaagatg

SEQ ID NO: 140547 - DNA, 103 bp, Artificial Sequence
  Synthetic Polynucleotide
taatacgactcactatagggtaggagtcagtctggatatttgggatttcgaacagaggagacgaaatatgaaatatccaaacctggcggcagcgcaaaagatg

SEQ ID NO: 140548 - DNA, 103 bp, Artificial Sequence
  Synthetic Polynucleotide
taatacgactcactatagggcatactttcataggagtcagtctggatattaacagaggagaaatatcatgactgactccaacctggcggcagcgcaaaagatg

SEQ ID NO: 140549 - DNA, 103 bp, Artificial Sequence
  Synthetic Polynucleotide
taatacgactcactatagggtggtttttgccatactttcataggagtcagaacagaggagactgactatgatgaaagtaaacctggcggcagcgcaaaagatg

SEQ ID NO: 140550 - DNA, 103 bp, Artificial Sequence
  Synthetic Polynucleotide
taatacgactcactatagggccagttggtgtggtttttgccatactttcaaacagaggagatgaaagatgggcaaaaacaacctggcggcagcgcaaaagatg

SEQ ID NO: 140551 - DNA, 103 bp, Artificial Sequence
  Synthetic Polynucleotide
taatacgactcactatagggagaaatcatgttcacgtgatgggtctgctgaacagaggagacagcagatgcatcacgtgaacctggcggcagcgcaaaagatg

SEQ ID NO: 140552 - DNA, 103 bp, Artificial Sequence
  Synthetic Polynucleotide
taatacgactcactatagggtggaaggccaccagttggtgtggtttttgcaacagaggagagcaaaaatgacaccaactaacctggcggcagcgcaaaagatg

SEQ ID NO: 140553 - DNA, 103 bp, Artificial Sequence
  Synthetic Polynucleotide
taatacgactcactataggggggggtcccttggaaggccaccagttggtgaacagaggagacaccaaatggtggccttcaacctggcggcagcgcaaaagatg

SEQ ID NO: 140554 - DNA, 103 bp, Artificial Sequence
  Synthetic Polynucleotide
taatacgactcactatagggatgagttcttgggggtcccttggaaggccaaacagaggagatggcctatgaagggacccaacctggcggcagcgcaaaagatg

SEQ ID NO: 140555 - DNA, 103 bp, Artificial Sequence
  Synthetic Polynucleotide
taatacgactcactataggggttatcaaccatgagttcttgggggtccctaacagaggagaagggacatgcaagaactcaacctggcggcagcgcaaaagatg

SEQ ID NO: 140556 - DNA, 103 bp, Artificial Sequence
  Synthetic Polynucleotide
taatacgactcactataggggattcaaagggttatcaaccatgagttcttaacagaggagaaagaacatgtggttgataaacctggcggcagcgcaaaagatg

SEQ ID NO: 140557 - DNA, 103 bp, Artificial Sequence
  Synthetic Polynucleotide
taatacgactcactataggggtcgagagctgattcaaagggttatcaaccaacagaggagaggttgaatgccctttgaaaacctggcggcagcgcaaaagatg

SEQ ID NO: 140558 - DNA, 103 bp, Artificial Sequence
  Synthetic Polynucleotide
taatacgactcactatagggccctgctagagtcgagagctgattcaaaggaacagaggagacctttgatgcagctctcgaacctggcggcagcgcaaaagatg

SEQ ID NO: 140559 - DNA, 103 bp, Artificial Sequence
  Synthetic Polynucleotide
taatacgactcactatagggtggacaactgccctgctagagtcgagagctaacagaggagaagctctatgctctagcagaacctggcggcagcgcaaaagatg

SEQ ID NO: 140560 - DNA, 103 bp, Artificial Sequence
  Synthetic Polynucleotide
taatacgactcactatagggggtggcagactggacaactgccctgctagaaacagaggagatctagcatggcagttgtcaacctggcggcagcgcaaaagatg

SEQ ID NO: 140561 - DNA, 103 bp, Artificial Sequence
  Synthetic Polynucleotide
taatacgactcactatagggttggttttcgggtggcagactggacaactgaacagaggagacagttgatgagtctgccaaacctggcggcagcgcaaaagatg

SEQ ID NO: 140562 - DNA, 103 bp, Artificial Sequence
  Synthetic Polynucleotide
taatacgactcactatagggtaactgatccagaaatcatgttcacgtgataacagaggagaatcacgatgacatgatttaacctggcggcagcgcaaaagatg

SEQ ID NO: 140563 - DNA, 103 bp, Artificial Sequence
  Synthetic Polynucleotide
taatacgactcactatagggatgcagggttttggttttcgggtggcagacaacagaggagagtctgcatgccgaaaaccaacctggcggcagcgcaaaagatg

SEQ ID NO: 140564 - DNA, 103 bp, Artificial Sequence
  Synthetic Polynucleotide
taatacgactcactatagggacatcaggggatgcagggttttggttttcgaacagaggagacgaaaaatgaaaccctgcaacctggcggcagcgcaaaagatg

SEQ ID NO: 140565 - DNA, 103 bp, Artificial Sequence
  Synthetic Polynucleotide
taatacgactcactataggggcagggaactacatcaggggatgcagggttaacagaggagaaaccctatgtcccctgataacctggcggcagcgcaaaagatg

SEQ ID NO: 140566 - DNA, 103 bp, Artificial Sequence
  Synthetic Polynucleotide
taatacgactcactatagggtttcatcagggcagggaactacatcaggggaacagaggagacccctgatgtagttccctaacctggcggcagcgcaaaagatg

SEQ ID NO: 140567 - DNA, 103 bp, Artificial Sequence
  Synthetic Polynucleotide
taatacgactcactatagggatgaaaggcttttcatcagggcagggaactaacagaggagaagttccatgccctgatgaaacctggcggcagcgcaaaagatg

SEQ ID NO: 140568 - DNA, 103 bp, Artificial Sequence
  Synthetic Polynucleotide
taatacgactcactatagggctgctgaatcatgaaaggcttttcatcaggaacagaggagacctgatatgaagcctttcaacctggcggcagcgcaaaagatg

SEQ ID NO: 140569 - DNA, 103 bp, Artificial Sequence
  Synthetic Polynucleotide
taatacgactcactataggggggtagagggctgctgaatcatgaaaggctaacagaggagaagccttatgtgattcagcaacctggcggcagcgcaaaagatg

SEQ ID NO: 140570 - DNA, 103 bp, Artificial Sequence
  Synthetic Polynucleotide
taatacgactcactatagggactactgcttgggtagagggctgctgaatcaacagaggagagattcaatggccctctacaacctggcggcagcgcaaaagatg

SEQ ID NO: 140571 - DNA, 103 bp, Artificial Sequence
  Synthetic Polynucleotide
taatacgactcactatagggtacggcagaaactactgcttgggtagagggaacagaggagaccctctatgcaagcagtaaacctggcggcagcgcaaaagatg

SEQ ID NO: 140572 - DNA, 103 bp, Artificial Sequence
  Synthetic Polynucleotide
taatacgactcactatagggtacttgctgatacggcagaaactactgcttaacagaggagaaagcagatgtttctgccgaacctggcggcagcgcaaaagatg

SEQ ID NO: 140573 - DNA, 103 bp, Artificial Sequence
  Synthetic Polynucleotide
taatacgactcactatagggttgtccccactaactgatccagaaatcatgaacagaggagacatgatatgtggatcagtaacctggcggcagcgcaaaagatg

SEQ ID NO: 140574 - DNA, 103 bp, Artificial Sequence
  Synthetic Polynucleotide
taatacgactcactatagggctctgaggaatacttgctgatacggcagaaaacagaggagattctgcatgatcagcaagaacctggcggcagcgcaaaagatg

SEQ ID NO: 140575 - DNA, 103 bp, Artificial Sequence
  Synthetic Polynucleotide
taatacgactcactataggggggagaggagctctgaggaatacttgctgaaacagaggagatcagcaatgattcctcagaacctggcggcagcgcaaaagatg

SEQ ID NO: 140576 - DNA, 103 bp, Artificial Sequence
  Synthetic Polynucleotide
taatacgactcactatagggctgggcttgtgggagaggagctctgaggaaaacagaggagattcctcatggctcctctcaacctggcggcagcgcaaaagatg

SEQ ID NO: 140577 - DNA, 103 bp, Artificial Sequence
  Synthetic Polynucleotide
taatacgactcactatagggggccgaggttctgggcttgtgggagaggagaacagaggagactcctcatgcacaagcccaacctggcggcagcgcaaaagatg

SEQ ID NO: 140578 - DNA, 103 bp, Artificial Sequence
  Synthetic Polynucleotide
taatacgactcactatagggactatgggatggccgaggttctgggcttgtaacagaggagaacaagcatggaacctcggaacctggcggcagcgcaaaagatg

SEQ ID NO: 140579 - DNA, 103 bp, Artificial Sequence
  Synthetic Polynucleotide
taatacgactcactatagggagttcctttgactatgggatggccgaggttaacagaggagaaacctcatgcatcccataaacctggcggcagcgcaaaagatg

SEQ ID NO: 140580 - DNA, 103 bp, Artificial Sequence
  Synthetic Polynucleotide
taatacgactcactatagggactggactatagttcctttgactatgggataacagaggagaatcccaatgtcaaaggaaaacctggcggcagcgcaaaagatg

SEQ ID NO: 140581 - DNA, 103 bp, Artificial Sequence
  Synthetic Polynucleotide
taatacgactcactatagggtggacctgccactggactatagttcctttgaacagaggagacaaaggatgtatagtccaaacctggcggcagcgcaaaagatg

SEQ ID NO: 140582 - DNA, 103 bp, Artificial Sequence
  Synthetic Polynucleotide
taatacgactcactataggggctcactgcttggacctgccactggactataacagaggagaatagtcatgtggcaggtcaacctggcggcagcgcaaaagatg

SEQ ID NO: 140583 - DNA, 103 bp, Artificial Sequence
  Synthetic Polynucleotide
taatacgactcactatagggtgggcacttggctcactgcttggacctgccaacagaggagaggcaggatgaagcagtgaaacctggcggcagcgcaaaagatg

SEQ ID NO: 140584 - DNA, 103 bp, Artificial Sequence
  Synthetic Polynucleotide
taatacgactcactataggggctgcgcttcaccaggaagccgcggggcataacagaggagaatgcccatgggcttcctgaacctggcggcagcgcaaaagatg

SEQ ID NO: 140585 - DNA, 103 bp, Artificial Sequence
  Synthetic Polynucleotide
taatacgactcactataggggcgggcgcccccgcagctgggcgagagcagaacagaggagactgctcatgcccagctgcaacctggcggcagcgcaaaagatg

SEQ ID NO: 140586 - DNA, 103 bp, Artificial Sequence
  Synthetic Polynucleotide
taatacgactcactatagggccgcgcctcagccctggctgctgcttctggaacagaggagaccagaaatggcagccaggaacctggcggcagcgcaaaagatg

SEQ ID NO: 140587 - DNA, 103 bp, Artificial Sequence
  Synthetic Polynucleotide
taatacgactcactatagggcgggtgcctcccgcgcctcagccctggctgaacagaggagacagccaatgctgaggcgcaacctggcggcagcgcaaaagatg

SEQ ID NO: 140588 - DNA, 103 bp, Artificial Sequence
  Synthetic Polynucleotide
taatacgactcactatagggctgccgccgccgggtgcctcccgcgcctcaaacagaggagatgaggcatgggaggcaccaacctggcggcagcgcaaaagatg

SEQ ID NO: 140589 - DNA, 103 bp, Artificial Sequence
  Synthetic Polynucleotide
taatacgactcactataggggtcccggtcgctgccgccgccgggtgcctcaacagaggagagaggcaatgggcggcggcaacctggcggcagcgcaaaagatg

SEQ ID NO: 140590 - DNA, 103 bp, Artificial Sequence
  Synthetic Polynucleotide
taatacgactcactatagggggctcggcgtgtcccggtcgctgccgccgcaacagaggagagcggcgatggcgaccgggaacctggcggcagcgcaaaagatg

SEQ ID NO: 140591 - DNA, 103 bp, Artificial Sequence
  Synthetic Polynucleotide
taatacgactcactatagggacgccgccggggctcggcgtgtcccggtcgaacagaggagacgaccgatgcacgccgagaacctggcggcagcgcaaaagatg

SEQ ID NO: 140592 - DNA, 103 bp, Artificial Sequence
  Synthetic Polynucleotide
taatacgactcactatagggcgactcggacacgccgccggggctcggcgtaacagaggagaacgccgatgcccggcggcaacctggcggcagcgcaaaagatg

SEQ ID NO: 140593 - DNA, 103 bp, Artificial Sequence
  Synthetic Polynucleotide
taatacgactcactatagggcctcggagcccgactcggacacgccgccggaacagaggagaccggcgatgtgtccgagtaacctggcggcagcgcaaaagatg

SEQ ID NO: 140594 - DNA, 103 bp, Artificial Sequence
  Synthetic Polynucleotide
taatacgactcactatagggtagagcccgtcctcggagcccgactcggacaacagaggagagtccgaatggggctccgaaacctggcggcagcgcaaaagatg

SEQ ID NO: 140595 - DNA, 103 bp, Artificial Sequence
  Synthetic Polynucleotide
taatacgactcactatagggatggcactcgtagagcccgtcctcggagccaacagaggagaggctccatggacgggctcaacctggcggcagcgcaaaagatg

SEQ ID NO: 140596 - DNA, 103 bp, Artificial Sequence
  Synthetic Polynucleotide
taatacgactcactatagggggggctcggcgcgggcgcccccgcagctggaacagaggagaccagctatgggggcgcccaacctggcggcagcgcaaaagatg

SEQ ID NO: 140597 - DNA, 103 bp, Artificial Sequence
  Synthetic Polynucleotide
taatacgactcactatagggtggcgcagtgatggcactcgtagagcccgtaacagaggagaacgggcatgacgagtgccaacctggcggcagcgcaaaagatg

SEQ ID NO: 140598 - DNA, 103 bp, Artificial Sequence
  Synthetic Polynucleotide
taatacgactcactatagggcggaacttcttggcgcagtgatggcactcgaacagaggagacgagtgatgtcactgcgcaacctggcggcagcgcaaaagatg

SEQ ID NO: 140599 - DNA, 103 bp, Artificial Sequence
  Synthetic Polynucleotide
taatacgactcactatagggggcctggcggcggaacttcttggcgcagtgaacagaggagacactgcatgaagaagttcaacctggcggcagcgcaaaagatg

SEQ ID NO: 140600 - DNA, 103 bp, Artificial Sequence
  Synthetic Polynucleotide
taatacgactcactatagggtgcgtaggtaggcctggcggcggaacttctaacagaggagaagaagtatggccgccaggaacctggcggcagcgcaaaagatg

SEQ ID NO: 140601 - DNA, 103 bp, Artificial Sequence
  Synthetic Polynucleotide
taatacgactcactatagggagcaggtgcttgcgtaggtaggcctggcggaacagaggagaccgccaatgctacctacgaacctggcggcagcgcaaaagatg

SEQ ID NO: 140602 - DNA, 103 bp, Artificial Sequence
  Synthetic Polynucleotide
taatacgactcactataggggtggtgcgccagcaggtgcttgcgtaggtaaacagaggagatacctaatgaagcacctgaacctggcggcagcgcaaaagatg

SEQ ID NO: 140603 - DNA, 103 bp, Artificial Sequence
  Synthetic Polynucleotide
taatacgactcactataggggcagcgcctggtggtgcgccagcaggtgctaacagaggagaagcaccatgtggcgcaccaacctggcggcagcgcaaaagatg

SEQ ID NO: 140604 - DNA, 103 bp, Artificial Sequence
  Synthetic Polynucleotide
taatacgactcactatagggcccttggcctgcagcgcctggtggtgcgccaacagaggagaggcgcaatgccaggcgctaacctggcggcagcgcaaaagatg

SEQ ID NO: 140605 - DNA, 103 bp, Artificial Sequence
  Synthetic Polynucleotide
taatacgactcactatagggtagcggcgcgcccttggcctgcagcgcctgaacagaggagacaggcgatgcaggccaagaacctggcggcagcgcaaaagatg

SEQ ID NO: 140606 - DNA, 103 bp, Artificial Sequence
  Synthetic Polynucleotide
taatacgactcactatagggccgggggcgctagcggcgcgcccttggcctaacagaggagaaggccaatggcgcgccgcaacctggcggcagcgcaaaagatg

SEQ ID NO: 140607 - DNA, 103 bp, Artificial Sequence
  Synthetic Polynucleotide
taatacgactcactatagggctcggcgccgggggctcggcgcgggcgcccaacagaggagagggcgcatgcgccgagccaacctggcggcagcgcaaaagatg

SEQ ID NO: 140608 - DNA, 103 bp, Artificial Sequence
  Synthetic Polynucleotide
taatacgactcactatagggaggtcctcggccgggggcgctagcggcgcgaacagaggagacgcgccatgagcgcccccaacctggcggcagcgcaaaagatg

SEQ ID NO: 140609 - DNA, 103 bp, Artificial Sequence
  Synthetic Polynucleotide
taatacgactcactatagggcaaggccagtaggtcctcggccgggggcgcaacagaggagagcgcccatggccgaggacaacctggcggcagcgcaaaagatg

SEQ ID NO: 140610 - DNA, 103 bp, Artificial Sequence
  Synthetic Polynucleotide
taatacgactcactataggggcccggggtacaaggccagtaggtcctcggaacagaggagaccgaggatgtactggcctaacctggcggcagcgcaaaagatg

SEQ ID NO: 140611 - DNA, 103 bp, Artificial Sequence
  Synthetic Polynucleotide
taatacgactcactatagggttctcgtcgggcccggggtacaaggccagtaacagaggagaactggcatggtaccccggaacctggcggcagcgcaaaagatg

SEQ ID NO: 140612 - DNA, 103 bp, Artificial Sequence
  Synthetic Polynucleotide
taatacgactcactatagggctggggcgccttctcgtcgggcccggggtaaacagaggagataccccatgcccgacgagaacctggcggcagcgcaaaagatg

SEQ ID NO: 140613 - DNA, 103 bp, Artificial Sequence
  Synthetic Polynucleotide
taatacgactcactatagggcggccgcctcctggggcgccttctcgtcggaacagaggagaccgacgatgaggcgccccaacctggcggcagcgcaaaagatg

SEQ ID NO: 140614 - DNA, 103 bp, Artificial Sequence
  Synthetic Polynucleotide
taatacgactcactatagggtcgccgtcgccggccgcctcctggggcgccaacagaggagaggcgccatgggaggcggcaacctggcggcagcgcaaaagatg

SEQ ID NO: 140615 - DNA, 103 bp, Artificial Sequence
  Synthetic Polynucleotide
taatacgactcactataggggccggccccctcgccgtcgccggccgcctcaacagaggagagaggcgatgggcgacggcaacctggcggcagcgcaaaagatg

SEQ ID NO: 140616 - DNA, 103 bp, Artificial Sequence
  Synthetic Polynucleotide
taatacgactcactatagggggcccagcacgccggccccctcgccgtcgcaacagaggagagcgacgatgagggggccgaacctggcggcagcgcaaaagatg

SEQ ID NO: 140617 - DNA, 103 bp, Artificial Sequence
  Synthetic Polynucleotide
taatacgactcactataggggacgcactcaggcccagcacgccggcccccaacagaggagagggggcatgcgtgctgggaacctggcggcagcgcaaaagatg

SEQ ID NO: 140618 - DNA, 103 bp, Artificial Sequence
  Synthetic Polynucleotide
taatacgactcactatagggggggaccgggctcggcgccgggggctcggcaacagaggagagccgagatgccggcgccgaacctggcggcagcgcaaaagatg

SEQ ID NO: 140619 - DNA, 103 bp, Artificial Sequence
  Synthetic Polynucleotide
taatacgactcactataggggcactcggcggacgcactcaggcccagcacaacagaggagagtgctgatgctgagtgcgaacctggcggcagcgcaaaagatg

SEQ ID NO: 140620 - DNA, 103 bp, Artificial Sequence
  Synthetic Polynucleotide
taatacgactcactatagggggcacaggtggcactcggcggacgcactcaaacagaggagatgagtgatgccgccgagtaacctggcggcagcgcaaaagatg

SEQ ID NO: 140621 - DNA, 103 bp, Artificial Sequence
  Synthetic Polynucleotide
taatacgactcactatagggccgcacactgggcacaggtggcactcggcgaacagaggagacgccgaatgccacctgtgaacctggcggcagcgcaaaagatg

SEQ ID NO: 140622 - DNA, 103 bp, Artificial Sequence
  Synthetic Polynucleotide
taatacgactcactataggggaacgactctccgcacactgggcacaggtgaacagaggagacacctgatgccagtgtgcaacctggcggcagcgcaaaagatg

SEQ ID NO: 140623 - DNA, 103 bp, Artificial Sequence
  Synthetic Polynucleotide
taatacgactcactatagggccttgctggcgaacgactctccgcacactgaacagaggagacagtgtatggagagtcgtaacctggcggcagcgcaaaagatg

SEQ ID NO: 140624 - DNA, 103 bp, Artificial Sequence
  Synthetic Polynucleotide
taatacgactcactatagggtcctgagcgcccttgctggcgaacgactctaacagaggagaagagtcatgcgccagcaaaacctggcggcagcgcaaaagatg

SEQ ID NO: 140625 - DNA, 103 bp, Artificial Sequence
  Synthetic Polynucleotide
taatacgactcactatagggcaggtggcgctcctgagcgcccttgctggcaacagaggagagccagcatgggcgctcagaacctggcggcagcgcaaaagatg

SEQ ID NO: 140626 - DNA, 103 bp, Artificial Sequence
  Synthetic Polynucleotide
taatacgactcactataggggcagcaggcgcaggtggcgctcctgagcgcaacagaggagagcgctcatgagcgccaccaacctggcggcagcgcaaaagatg

SEQ ID NO: 140627 - DNA, 103 bp, Artificial Sequence
  Synthetic Polynucleotide
taatacgactcactatagggtgggcggcgtgcagcaggcgcaggtggcgcaacagaggagagcgccaatggcgcctgctaacctggcggcagcgcaaaagatg

SEQ ID NO: 140628 - DNA, 103 bp, Artificial Sequence
  Synthetic Polynucleotide
taatacgactcactatagggggggaacacctgggcggcgtgcagcaggcgaacagaggagacgcctgatgcacgccgccaacctggcggcagcgcaaaagatg

SEQ ID NO: 140629 - DNA, 103 bp, Artificial Sequence
  Synthetic Polynucleotide
taatacgactcactataggggcagcggcccggggaccgggctcggcgccgaacagaggagacggcgcatggcccggtccaacctggcggcagcgcaaaagatg

SEQ ID NO: 140630 - DNA, 103 bp, Artificial Sequence
  Synthetic Polynucleotide
taatacgactcactatagggagtacttgcaggggaacacctgggcggcgtaacagaggagaacgccgatgaggtgttccaacctggcggcagcgcaaaagatg

SEQ ID NO: 140631 - DNA, 103 bp, Artificial Sequence
  Synthetic Polynucleotide
taatacgactcactataggggtggccgggcagtacttgcaggggaacaccaacagaggagaggtgttatgctgcaagtaaacctggcggcagcgcaaaagatg

SEQ ID NO: 140632 - DNA, 103 bp, Artificial Sequence
  Synthetic Polynucleotide
taatacgactcactataggggctgtagaaggtggccgggcagtacttgcaaacagaggagatgcaagatgtgcccggccaacctggcggcagcgcaaaagatg

SEQ ID NO: 140633 - DNA, 103 bp, Artificial Sequence
  Synthetic Polynucleotide
taatacgactcactatagggggccgggcgagctgtagaaggtggccgggcaacagaggagagcccggatgccttctacaaacctggcggcagcgcaaaagatg

SEQ ID NO: 140634 - DNA, 103 bp, Artificial Sequence
  Synthetic Polynucleotide
taatacgactcactatagggtgccgcgtaaggccgggcgagctgtagaagaacagaggagacttctaatgctcgcccggaacctggcggcagcgcaaaagatg

SEQ ID NO: 140635 - DNA, 103 bp, Artificial Sequence
  Synthetic Polynucleotide
taatacgactcactatagggcttgttgatgtgccgcgtaaggccgggcgaaacagaggagatcgcccatgcttacgcggaacctggcggcagcgcaaaagatg

SEQ ID NO: 140636 - DNA, 103 bp, Artificial Sequence
  Synthetic Polynucleotide
taatacgactcactatagggatgggtggcacttgttgatgtgccgcgtaaaacagaggagattacgcatgacatcaacaaacctggcggcagcgcaaaagatg

SEQ ID NO: 140637 - DNA, 103 bp, Artificial Sequence
  Synthetic Polynucleotide
taatacgactcactatagggctgttttcggatgggtggcacttgttgatgaacagaggagacatcaaatggtgccacccaacctggcggcagcgcaaaagatg

SEQ ID NO: 140638 - DNA, 103 bp, Artificial Sequence
  Synthetic Polynucleotide
taatacgactcactataggggatcacctgtctgttttcggatgggtggcaaacagaggagatgccacatgtccgaaaacaacctggcggcagcgcaaaagatg

SEQ ID NO: 140639 - DNA, 103 bp, Artificial Sequence
  Synthetic Polynucleotide
taatacgactcactatagggcctgcaggaggatcacctgtctgttttcggaacagaggagaccgaaaatggacaggtgaaacctggcggcagcgcaaaagatg

SEQ ID NO: 140640 - DNA, 103 bp, Artificial Sequence
  Synthetic Polynucleotide
taatacgactcactatagggggcggcggcggcagcggcccggggaccgggaacagaggagacccggtatgcgggccgctaacctggcggcagcgcaaaagatg

SEQ ID NO: 140641 - DNA, 103 bp, Artificial Sequence
  Synthetic Polynucleotide
taatacgactcactatagggcgcacgggcacctgcaggaggatcacctgtaacagaggagaacaggtatgcctcctgcaaacctggcggcagcgcaaaagatg

SEQ ID NO: 140642 - DNA, 103 bp, Artificial Sequence
  Synthetic Polynucleotide
taatacgactcactataggggcaggccgggcgcacgggcacctgcaggagaacagaggagactcctgatggtgcccgtgaacctggcggcagcgcaaaagatg

SEQ ID NO: 140643 - DNA, 103 bp, Artificial Sequence
  Synthetic Polynucleotide
taatacgactcactatagggctccgcgggcggcggcggcggcagcggcccaacagaggagagggccgatgccgccgccgaacctggcggcagcgcaaaagatg

SEQ ID NO: 140644 - DNA, 103 bp, Artificial Sequence
  Synthetic Polynucleotide
taatacgactcactatagggcatgggcgcgctccgcgggcggcggcggcgaacagaggagacgccgcatgcgcccgcggaacctggcggcagcgcaaaagatg

SEQ ID NO: 140645 - DNA, 103 bp, Artificial Sequence
  Synthetic Polynucleotide
taatacgactcactataggggcgagcgctgcatgggcgcgctccgcgggcaacagaggagagcccgcatggcgcgcccaaacctggcggcagcgcaaaagatg

SEQ ID NO: 140646 - DNA, 103 bp, Artificial Sequence
  Synthetic Polynucleotide
taatacgactcactatagggaagcgcggcggcgagcgctgcatgggcgcgaacagaggagacgcgccatggcagcgctcaacctggcggcagcgcaaaagatg

SEQ ID NO: 140647 - DNA, 103 bp, Artificial Sequence
  Synthetic Polynucleotide
taatacgactcactatagggtggacttcttgctgcgcttcaccaggaagcaacagaggagagcttccatgtgaagcgcaaacctggcggcagcgcaaaagatg

SEQ ID NO: 140648 - DNA, 103 bp, Artificial Sequence
  Synthetic Polynucleotide
taatacgactcactataggggcgcgcaggcaagcgcggcggcgagcgctgaacagaggagacagcgcatgccgccgcgcaacctggcggcagcgcaaaagatg

SEQ ID NO: 140649 - DNA, 103 bp, Artificial Sequence
  Synthetic Polynucleotide
taatacgactcactatagggtgcggcccaggcgcgcaggcaagcgcggcgaacagaggagacgccgcatgtgcctgcgcaacctggcggcagcgcaaaagatg

SEQ ID NO: 140650 - DNA, 103 bp, Artificial Sequence
  Synthetic Polynucleotide
taatacgactcactatagggcgggggtggctgcggcccaggcgcgcaggcaacagaggagagcctgcatgcctgggccgaacctggcggcagcgcaaaagatg

SEQ ID NO: 140651 - DNA, 103 bp, Artificial Sequence
  Synthetic Polynucleotide
taatacgactcactataggggcgggccctgcgggggtggctgcggcccagaacagaggagactgggcatgagccaccccaacctggcggcagcgcaaaagatg

SEQ ID NO: 140652 - DNA, 103 bp, Artificial Sequence
  Synthetic Polynucleotide
taatacgactcactatagggtgcgcggcccgcgggccctgcgggggtggcaacagaggagagccaccatggcagggcccaacctggcggcagcgcaaaagatg

SEQ ID NO: 140653 - DNA, 103 bp, Artificial Sequence
  Synthetic Polynucleotide
taatacgactcactataggggttgccgaagtgcgcggcccgcgggccctgaacagaggagacagggcatgcgggccgcgaacctggcggcagcgcaaaagatg

SEQ ID NO: 140654 - DNA, 103 bp, Artificial Sequence
  Synthetic Polynucleotide
taatacgactcactatagggcagcctcggggttgccgaagtgcgcggcccaacagaggagagggccgatgacttcggcaaacctggcggcagcgcaaaagatg

SEQ ID NO: 140655 - DNA, 103 bp, Artificial Sequence
  Synthetic Polynucleotide
taatacgactcactataggggcggggtgcgcagcctcggggttgccgaagaacagaggagacttcggatgccccgaggcaacctggcggcagcgcaaaagatg

SEQ ID NO: 140656 - DNA, 103 bp, Artificial Sequence
  Synthetic Polynucleotide
taatacgactcactataggggtagagcggcgcggggtgcgcagcctcgggaacagaggagacccgagatggcgcaccccaacctggcggcagcgcaaaagatg

SEQ ID NO: 140657 - DNA, 103 bp, Artificial Sequence
  Synthetic Polynucleotide
taatacgactcactataggggcgtgggactgtagagcggcgcggggtgcgaacagaggagacgcaccatgcgccgctctaacctggcggcagcgcaaaagatg

SEQ ID NO: 140658 - DNA, 103 bp, Artificial Sequence
  Synthetic Polynucleotide
taatacgactcactataggggaaacgggcgtggacttcttgctgcgcttcaacagaggagagaagcgatgcaagaagtcaacctggcggcagcgcaaaagatg

SEQ ID NO: 140659 - DNA, 103 bp, Artificial Sequence
  Synthetic Polynucleotide
taatacgactcactatagggctcacgggccgcgtgggactgtagagcggcaacagaggagagccgctatgcagtcccacaacctggcggcagcgcaaaagatg

SEQ ID NO: 140660 - DNA, 103 bp, Artificial Sequence
  Synthetic Polynucleotide
taatacgactcactataggggtgctcgcggctcacgggccgcgtgggactaacagaggagaagtcccatgcggcccgtgaacctggcggcagcgcaaaagatg

SEQ ID NO: 140661 - DNA, 103 bp, Artificial Sequence
  Synthetic Polynucleotide
taatacgactcactatagggtgtgcttctcgtgctcgcggctcacgggccaacagaggagaggcccgatggccgcgagcaacctggcggcagcgcaaaagatg

SEQ ID NO: 140662 - DNA, 103 bp, Artificial Sequence
  Synthetic Polynucleotide
taatacgactcactatagggtcgaagtacttgtgcttctcgtgctcgcggaacagaggagaccgcgaatgcgagaagcaaacctggcggcagcgcaaaagatg

SEQ ID NO: 140663 - DNA, 103 bp, Artificial Sequence
  Synthetic Polynucleotide
taatacgactcactataggggaagctgcgttcgaagtacttgtgcttctcaacagaggagagagaagatgaagtacttcaacctggcggcagcgcaaaagatg

SEQ ID NO: 140664 - DNA, 103 bp, Artificial Sequence
  Synthetic Polynucleotide
taatacgactcactatagggagcccaggttgaagctgcgttcgaagtactaacagaggagaagtactatgaacgcagctaacctggcggcagcgcaaaagatg

SEQ ID NO: 140665 - DNA, 103 bp, Artificial Sequence
  Synthetic Polynucleotide
taatacgactcactataggggagaccggcgagcccaggttgaagctgcgtaacagaggagaacgcagatgcaacctgggaacctggcggcagcgcaaaagatg

SEQ ID NO: 140666 - DNA, 103 bp, Artificial Sequence
  Synthetic Polynucleotide
taatacgactcactatagggggactcggccgagaccggcgagcccaggttaacagaggagaaacctgatgtcgccggtcaacctggcggcagcgcaaaagatg

SEQ ID NO: 140667 - DNA, 103 bp, Artificial Sequence
  Synthetic Polynucleotide
taatacgactcactataggggcgtggggaaggactcggccgagaccggcgaacagaggagacgccggatgcggccgagtaacctggcggcagcgcaaaagatg

SEQ ID NO: 140668 - DNA, 103 bp, Artificial Sequence
  Synthetic Polynucleotide
taatacgactcactatagggagcgcggcgggcgtggggaaggactcggccaacagaggagaggccgaatgcttccccacaacctggcggcagcgcaaaagatg

SEQ ID NO: 140669 - DNA, 103 bp, Artificial Sequence
  Synthetic Polynucleotide
taatacgactcactataggggacccggtaggaaacgggcgtggacttcttaacagaggagaaagaagatgacgcccgttaacctggcggcagcgcaaaagatg

SEQ ID NO: 140670 - DNA, 103 bp, Artificial Sequence
  Synthetic Polynucleotide
taatacgactcactatagggccctccgagcagcgcggcgggcgtggggaaaacagaggagattccccatgcccgccgcgaacctggcggcagcgcaaaagatg

SEQ ID NO: 140671 - DNA, 103 bp, Artificial Sequence
  Synthetic Polynucleotide
taatacgactcactatagggcgccgccgccccctccgagcagcgcggcggaacagaggagaccgccgatgtgctcggagaacctggcggcagcgcaaaagatg

SEQ ID NO: 140672 - DNA, 103 bp, Artificial Sequence
  Synthetic Polynucleotide
taatacgactcactatagggctcgcgccgccgccgccgccccctccgagcaacagaggagagctcggatggggcggcggaacctggcggcagcgcaaaagatg

SEQ ID NO: 140673 - DNA, 103 bp, Artificial Sequence
  Synthetic Polynucleotide
taatacgactcactataggggccagctccgctcgcgccgccgccgccgccaacagaggagaggcggcatgggcggcgcgaacctggcggcagcgcaaaagatg

SEQ ID NO: 140674 - DNA, 103 bp, Artificial Sequence
  Synthetic Polynucleotide
taatacgactcactatagggtgccgcctccgccagctccgctcgcgccgcaacagaggagagcggcgatggcggagctgaacctggcggcagcgcaaaagatg

SEQ ID NO: 140675 - DNA, 103 bp, Artificial Sequence
  Synthetic Polynucleotide
taatacgactcactatagggccgccgcaggtgccgcctccgccagctccgaacagaggagacggagcatgcggaggcggaacctggcggcagcgcaaaagatg

SEQ ID NO: 140676 - DNA, 103 bp, Artificial Sequence
  Synthetic Polynucleotide
taatacgactcactatagggcagcgggtcgccgccgcaggtgccgcctccaacagaggagaggaggcatgacctgcggcaacctggcggcagcgcaaaagatg

SEQ ID NO: 140677 - DNA, 103 bp, Artificial Sequence
  Synthetic Polynucleotide
taatacgactcactataggggcgcgaagagcagcgggtcgccgccgcaggaacagaggagacctgcgatggcgacccgcaacctggcggcagcgcaaaagatg

SEQ ID NO: 140678 - DNA, 103 bp, Artificial Sequence
  Synthetic Polynucleotide
taatacgactcactatagggagctcggcgggcgcgaagagcagcgggtcgaacagaggagacgacccatggctcttcgcaacctggcggcagcgcaaaagatg

SEQ ID NO: 140679 - DNA, 103 bp, Artificial Sequence
  Synthetic Polynucleotide
taatacgactcactataggggcccatcttgagctcggcgggcgcgaagagaacagaggagactcttcatgcccgccgagaacctggcggcagcgcaaaagatg

SEQ ID NO: 140680 - DNA, 103 bp, Artificial Sequence
  Synthetic Polynucleotide
taatacgactcactatagggcgccgccgcggacccggtaggaaacgggcgaacagaggagacgcccgatgcctaccgggaacctggcggcagcgcaaaagatg

SEQ ID NO: 140681 - DNA, 103 bp, Artificial Sequence
  Synthetic Polynucleotide
taatacgactcactatagggagaacgccgtgcccatcttgagctcggcggaacagaggagaccgccgatgtcaagatggaacctggcggcagcgcaaaagatg

SEQ ID NO: 140682 - DNA, 103 bp, Artificial Sequence
  Synthetic Polynucleotide
taatacgactcactataggggcgccagccgagaacgccgtgcccatcttgaacagaggagacaagatatgcacggcgttaacctggcggcagcgcaaaagatg

SEQ ID NO: 140683 - DNA, 103 bp, Artificial Sequence
  Synthetic Polynucleotide
taatacgactcactatagggggccgcctcggcgccagccgagaacgccgtaacagaggagaacggcgatgtcggctggcaacctggcggcagcgcaaaagatg

SEQ ID NO: 140684 - DNA, 103 bp, Artificial Sequence
  Synthetic Polynucleotide
taatacgactcactatagggccgggccgcgggccgcctcggcgccagccgaacagaggagacggctgatgccgaggcggaacctggcggcagcgcaaaagatg

SEQ ID NO: 140685 - DNA, 103 bp, Artificial Sequence
  Synthetic Polynucleotide
taatacgactcactataggggggccggggcccgggccgcgggccgcctcgaacagaggagacgaggcatgccgcggcccaacctggcggcagcgcaaaagatg

SEQ ID NO: 140686 - DNA, 103 bp, Artificial Sequence
  Synthetic Polynucleotide
taatacgactcactataggggggcagtggggggccggggcccgggccgcgaacagaggagacgcggcatgggccccggcaacctggcggcagcgcaaaagatg

SEQ ID NO: 140687 - DNA, 103 bp, Artificial Sequence
  Synthetic Polynucleotide
taatacgactcactatagggcggcggcagggggcagtggggggccggggcaacagaggagagccccgatgccccactgcaacctggcggcagcgcaaaagatg

SEQ ID NO: 140688 - DNA, 103 bp, Artificial Sequence
  Synthetic Polynucleotide
taatacgactcactatagggggccgcagggcggcggcagggggcagtgggaacagaggagacccactatgccctgccgcaacctggcggcagcgcaaaagatg

SEQ ID NO: 140689 - DNA, 103 bp, Artificial Sequence
  Synthetic Polynucleotide
taatacgactcactatagggctttcccgggggccgcagggcggcggcaggaacagaggagacctgccatggccctgcggaacctggcggcagcgcaaaagatg

SEQ ID NO: 140690 - DNA, 103 bp, Artificial Sequence
  Synthetic Polynucleotide
taatacgactcactataggggcgggggccgctttcccgggggccgcagggaacagaggagaccctgcatgccccgggaaaacctggcggcagcgcaaaagatg

SEQ ID NO: 140691 - DNA, 103 bp, Artificial Sequence
  Synthetic Polynucleotide
taatacgactcactatagggtcgccgtcctcgccgccgcggacccggtagaacagaggagactaccgatgccgcggcggaacctggcggcagcgcaaaagatg

SEQ ID NO: 140692 - DNA, 103 bp, Artificial Sequence
  Synthetic Polynucleotide
taatacgactcactataggggcggtagggggcgggggccgctttcccgggaacagaggagacccgggatggcggcccccaacctggcggcagcgcaaaagatg

SEQ ID NO: 140693 - DNA, 103 bp, Artificial Sequence
  Synthetic Polynucleotide
taatacgactcactatagggcggctccgcggcggtagggggcgggggccgaacagaggagacggcccatgccccctaccaacctggcggcagcgcaaaagatg

SEQ ID NO: 140694 - DNA, 103 bp, Artificial Sequence
  Synthetic Polynucleotide
taatacgactcactatagggccttggcgggcggctccgcggcggtaggggaacagaggagacccctaatgccgcggagcaacctggcggcagcgcaaaagatg

SEQ ID NO: 140695 - DNA, 103 bp, Artificial Sequence
  Synthetic Polynucleotide
taatacgactcactataggggccttgactgccttggcgggcggctccgcgaacagaggagacgcggaatggcccgccaaaacctggcggcagcgcaaaagatg

SEQ ID NO: 140696 - DNA, 103 bp, Artificial Sequence
  Synthetic Polynucleotide
taatacgactcactatagggggcgcccggggccttgactgccttggcgggaacagaggagacccgccatggcagtcaagaacctggcggcagcgcaaaagatg

SEQ ID NO: 140697 - DNA, 103 bp, Artificial Sequence
  Synthetic Polynucleotide
taatacgactcactatagggtgggcttcttggcgcccggggccttgactgaacagaggagacagtcaatgccccgggcgaacctggcggcagcgcaaaagatg

SEQ ID NO: 140698 - DNA, 103 bp, Artificial Sequence
  Synthetic Polynucleotide
taatacgactcactatagggcggatggccttgggcttcttggcgcccgggaacagaggagacccgggatgcaagaagccaacctggcggcagcgcaaaagatg

SEQ ID NO: 140699 - DNA, 103 bp, Artificial Sequence
  Synthetic Polynucleotide
taatacgactcactataggggtgcagcttgcggatggccttgggcttcttaacagaggagaaagaagatgaaggccatcaacctggcggcagcgcaaaagatg

SEQ ID NO: 140700 - DNA, 103 bp, Artificial Sequence
  Synthetic Polynucleotide
taatacgactcactatagggcgtcctcgaagtgcagcttgcggatggcctaacagaggagaaggccaatggcaagctgcaacctggcggcagcgcaaaagatg

SEQ ID NO: 140701 - DNA, 103 bp, Artificial Sequence
  Synthetic Polynucleotide
taatacgactcactataggggtggtcacctcgtcctcgaagtgcagcttgaacagaggagacaagctatgcttcgaggaaacctggcggcagcgcaaaagatg

SEQ ID NO: 140702 - DNA, 103 bp, Artificial Sequence
  Synthetic Polynucleotide
taatacgactcactatagggcagtgcgcggtcgccgtcctcgccgccgcgaacagaggagacgcggcatggaggacggcaacctggcggcagcgcaaaagatg

SEQ ID NO: 140703 - DNA, 103 bp, Artificial Sequence
  Synthetic Polynucleotide
taatacgactcactatagggcacgggcgacgtggtcacctcgtcctcgaaaacagaggagattcgagatggaggtgaccaacctggcggcagcgcaaaagatg

SEQ ID NO: 140704 - DNA, 103 bp, Artificial Sequence
  Synthetic Polynucleotide
taatacgactcactatagggtgagccccagcacgggcgacgtggtcacctaacagaggagaaggtgaatgcgtcgcccgaacctggcggcagcgcaaaagatg

SEQ ID NO: 140705 - DNA, 103 bp, Artificial Sequence
  Synthetic Polynucleotide
taatacgactcactatagggtccttgatcttgagccccagcacgggcgacaacagaggagagtcgccatggctggggctaacctggcggcagcgcaaaagatg

SEQ ID NO: 140706 - DNA, 103 bp, Artificial Sequence
  Synthetic Polynucleotide
taatacgactcactatagggcaccgggccctccttgatcttgagccccagaacagaggagactggggatgaagatcaagaacctggcggcagcgcaaaagatg

SEQ ID NO: 140707 - DNA, 103 bp, Artificial Sequence
  Synthetic Polynucleotide
taatacgactcactataggggcggcgcctccaccgggccctccttgatctaacagaggagaagatcaatgagggcccggaacctggcggcagcgcaaaagatg

SEQ ID NO: 140708 - DNA, 103 bp, Artificial Sequence
  Synthetic Polynucleotide
taatacgactcactataggggcgcggccccgcggcgcctccaccgggcccaacagaggagagggcccatgggaggcgccaacctggcggcagcgcaaaagatg

SEQ ID NO: 140709 - DNA, 103 bp, Artificial Sequence
  Synthetic Polynucleotide
taatacgactcactatagggcgcgccccccgcgcggccccgcggcgcctcaacagaggagagaggcgatgcggggccgcaacctggcggcagcgcaaaagatg

SEQ ID NO: 140710 - DNA, 103 bp, Artificial Sequence
  Synthetic Polynucleotide
taatacgactcactataggggcggccgcgccgcgccccccgcgcggccccaacagaggagaggggccatgcggggggcgaacctggcggcagcgcaaaagatg

SEQ ID NO: 140711 - DNA, 103 bp, Artificial Sequence
  Synthetic Polynucleotide
taatacgactcactatagggaactcgcccagcggccgcgccgcgccccccaacagaggagaggggggatgggcgcggccaacctggcggcagcgcaaaagatg

SEQ ID NO: 140712 - DNA, 103 bp, Artificial Sequence
  Synthetic Polynucleotide
taatacgactcactatagggctggcagatgaactcgcccagcggccgcgcaacagaggagagcgcggatgctgggcgagaacctggcggcagcgcaaaagatg

SEQ ID NO: 140713 - DNA, 103 bp, Artificial Sequence
  Synthetic Polynucleotide
taatacgactcactataggggcgagagcagcagtgcgcggtcgccgtcctaacagaggagaaggacgatgaccgcgcacaacctggcggcagcgcaaaagatg

SEQ ID NO: 140714 - DNA, 103 bp, Artificial Sequence
  Synthetic Polynucleotide
taatacgactcactatagggccttgcacagctggcagatgaactcgcccaaacagaggagatgggcgatgtcatctgccaacctggcggcagcgcaaaagatg

SEQ ID NO: 140715 - DNA, 103 bp, Artificial Sequence
  Synthetic Polynucleotide
taatacgactcactataggggcgtactcctccttgcacagctggcagatgaacagaggagacatctgatggctgtgcaaaacctggcggcagcgcaaaagatg

SEQ ID NO: 140716 - DNA, 103 bp, Artificial Sequence
  Synthetic Polynucleotide
taatacgactcactataggggaacgggtcggcgtactcctccttgcacagaacagaggagactgtgcatggaggagtacaacctggcggcagcgcaaaagatg

SEQ ID NO: 140717 - DNA, 103 bp, Artificial Sequence
  Synthetic Polynucleotide
taatacgactcactataggggcgccagcgcgaacgggtcggcgtactcctaacagaggagaaggagtatgccgacccgtaacctggcggcagcgcaaaagatg

SEQ ID NO: 140718 - DNA, 103 bp, Artificial Sequence
  Synthetic Polynucleotide
taatacgactcactatagggcatttgtgctgcgccagcgcgaacgggtcgaacagaggagacgacccatgcgcgctggcaacctggcggcagcgcaaaagatg

SEQ ID NO: 140719 - DNA, 103 bp, Artificial Sequence
  Synthetic Polynucleotide
taatacgactcactataggggatgcgcgagcatttgtgctgcgccagcgcaacagaggagagcgctgatgcagcacaaaaacctggcggcagcgcaaaagatg

SEQ ID NO: 140720 - DNA, 103 bp, Artificial Sequence
  Synthetic Polynucleotide
taatacgactcactatagggccacacgcacgatgcgcgagcatttgtgctaacagaggagaagcacaatggctcgcgcaaacctggcggcagcgcaaaagatg

SEQ ID NO: 140721 - DNA, 103 bp, Artificial Sequence
  Synthetic Polynucleotide
taatacgactcactatagggcagcggtactccacacgcacgatgcgcgagaacagaggagactcgcgatgcgtgcgtgtaacctggcggcagcgcaaaagatg

SEQ ID NO: 140722 - DNA, 103 bp, Artificial Sequence
  Synthetic Polynucleotide
taatacgactcactataggggcactcgggacagcggtactccacacgcacaacagaggagagtgcgtatggagtaccgcaacctggcggcagcgcaaaagatg

SEQ ID NO: 140723 - DNA, 103 bp, Artificial Sequence
  Synthetic Polynucleotide
taatacgactcactatagggagaccttggcgcactcgggacagcggtactaacagaggagaagtaccatggtcccgagtaacctggcggcagcgcaaaagatg

SEQ ID NO: 140724 - DNA, 103 bp, Artificial Sequence
  Synthetic Polynucleotide
taatacgactcactatagggccgcagctgggcgagagcagcagtgcgcggaacagaggagaccgcgcatggctgctctcaacctggcggcagcgcaaaagatg

SEQ ID NO: 140725 - DNA, 103 bp, Artificial Sequence
  Synthetic Polynucleotide
taatacgactcactataggggggcagctgaagaccttggcgcactcgggaaacagaggagatcccgaatgcgccaaggtaacctggcggcagcgcaaaagatg

SEQ ID NO: 140726 - DNA, 103 bp, Artificial Sequence
  Synthetic Polynucleotide
taatacgactcactatagggcaggttggccgggcagctgaagaccttggcaacagaggagagccaagatgttcagctgcaacctggcggcagcgcaaaagatg

SEQ ID NO: 140727 - DNA, 103 bp, Artificial Sequence
  Synthetic Polynucleotide
taatacgactcactatagggggtgcgaggccaggttggccgggcagctgaaacagaggagatcagctatgcggccaaccaacctggcggcagcgcaaaagatg

SEQ ID NO: 140728 - DNA, 103 bp, Artificial Sequence
  Synthetic Polynucleotide
taatacgactcactatagggtgccagcggcggtgcgaggccaggttggccaacagaggagaggccaaatgggcctcgcaaacctggcggcagcgcaaaagatg

SEQ ID NO: 140729 - DNA, 103 bp, Artificial Sequence
  Synthetic Polynucleotide
taatacgactcactatagggccgcggtttgtgccagcggcggtgcgaggcaacagaggagagcctcgatgcgccgctggaacctggcggcagcgcaaaagatg

SEQ ID NO: 140730 - DNA, 103 bp, Artificial Sequence
  Synthetic Polynucleotide
taatacgactcactatagggcgggcgcgggccgcggtttgtgccagcggcaacagaggagagccgctatgacaaaccgcaacctggcggcagcgcaaaagatg

SEQ ID NO: 140731 - DNA, 103 bp, Artificial Sequence
  Synthetic Polynucleotide
taatacgactcactatagggcgggcggcggcgggcgcgggccgcggtttgaacagaggagacaaaccatggcccgcgccaacctggcggcagcgcaaaagatg

SEQ ID NO: 140732 - DNA, 103 bp, Artificial Sequence
  Synthetic Polynucleotide
taatacgactcactatagggctccggcgcgcgggcggcggcgggcgcgggaacagaggagacccgcgatggccgccgccaacctggcggcagcgcaaaagatg

SEQ ID NO: 140733 - DNA, 103 bp, Artificial Sequence
  Synthetic Polynucleotide
taatacgactcactatagggctgcttctggctccggcgcgcgggcggcggaacagaggagaccgccgatggcgcgccggaacctggcggcagcgcaaaagatg

SEQ ID NO: 140734 - DNA, 103 bp, Artificial Sequence
  Synthetic Polynucleotide
taatacgactcactataggggccctggctgctgcttctggctccggcgcgaacagaggagacgcgccatggccagaagcaacctggcggcagcgcaaaagatg

SEQ ID NO: 140735 - DNA, 103 bp, Artificial Sequence
  Synthetic Polynucleotide
taatacgactcactataggggggtctcatgcgcatccgagtgatgggcataacagaggagaatgcccatgactcggatgaacctggcggcagcgcaaaagatg

SEQ ID NO: 140736 - DNA, 103 bp, Artificial Sequence
  Synthetic Polynucleotide
taatacgactcactatagggatgcttccatgggatctggaagatcatctcaacagaggagagagatgatgttccagatcaacctggcggcagcgcaaaagatg

SEQ ID NO: 140737 - DNA, 103 bp, Artificial Sequence
  Synthetic Polynucleotide
taatacgactcactataggggcttggcagcatgcttccatgggatctggaaacagaggagatccagaatgcatggaagcaacctggcggcagcgcaaaagatg

SEQ ID NO: 140738 - DNA, 103 bp, Artificial Sequence
  Synthetic Polynucleotide
taatacgactcactatagggtcccagccatgcttggcagcatgcttccataacagaggagaatggaaatgtgctgccaaaacctggcggcagcgcaaaagatg

SEQ ID NO: 140739 - DNA, 103 bp, Artificial Sequence
  Synthetic Polynucleotide
taatacgactcactatagggcttgttgatgtcccagccatgcttggcagcaacagaggagagctgccatgcatggctggaacctggcggcagcgcaaaagatg

SEQ ID NO: 140740 - DNA, 103 bp, Artificial Sequence
  Synthetic Polynucleotide
taatacgactcactatagggaacaggcatccttgttgatgtcccagccataacagaggagaatggctatgacatcaacaaacctggcggcagcgcaaaagatg

SEQ ID NO: 140741 - DNA, 103 bp, Artificial Sequence
  Synthetic Polynucleotide
taatacgactcactatagggctccggaacaaacaggcatccttgttgatgaacagaggagacatcaaatgggatgcctgaacctggcggcagcgcaaaagatg

SEQ ID NO: 140742 - DNA, 103 bp, Artificial Sequence
  Synthetic Polynucleotide
taatacgactcactatagggaatggcccagctccggaacaaacaggcatcaacagaggagagatgccatgttgttccggaacctggcggcagcgcaaaagatg

SEQ ID NO: 140743 - DNA, 103 bp, Artificial Sequence
  Synthetic Polynucleotide
taatacgactcactatagggggcctgtgtgaatggcccagctccggaacaaacagaggagatgttccatggctgggccaaacctggcggcagcgcaaaagatg

SEQ ID NO: 140744 - DNA, 103 bp, Artificial Sequence
  Synthetic Polynucleotide
taatacgactcactataggggctttgtatcggcctgtgtgaatggcccagaacagaggagactgggcatgtcacacaggaacctggcggcagcgcaaaagatg

SEQ ID NO: 140745 - DNA, 103 bp, Artificial Sequence
  Synthetic Polynucleotide
taatacgactcactatagggcttttcccctgctttgtatcggcctgtgtgaacagaggagacacacaatgcgatacaaaaacctggcggcagcgcaaaagatg

SEQ ID NO: 140746 - DNA, 103 bp, Artificial Sequence
  Synthetic Polynucleotide
taatacgactcactatagggtctctagccagggtctcatgcgcatccgagaacagaggagactcggaatggcatgagacaacctggcggcagcgcaaaagatg

SEQ ID NO: 140747 - DNA, 103 bp, Artificial Sequence
  Synthetic Polynucleotide
taatacgactcactataggggatctggctccttttcccctgctttgtatcaacagaggagagatacaatgcaggggaaaaacctggcggcagcgcaaaagatg

SEQ ID NO: 140748 - DNA, 103 bp, Artificial Sequence
  Synthetic Polynucleotide
taatacgactcactatagggcacgtcttgggatctggctccttttcccctaacagaggagaaggggaatgggagccagaaacctggcggcagcgcaaaagatg

SEQ ID NO: 140749 - DNA, 103 bp, Artificial Sequence
  Synthetic Polynucleotide
taatacgactcactataggggttggccttccacgtcttgggatctggctcaacagaggagagagccaatgcccaagacgaacctggcggcagcgcaaaagatg

SEQ ID NO: 140750 - DNA, 103 bp, Artificial Sequence
  Synthetic Polynucleotide
taatacgactcactatagggcacagcgaaagttggccttccacgtcttggaacagaggagaccaagaatgggaaggccaaacctggcggcagcgcaaaagatg

SEQ ID NO: 140751 - DNA, 103 bp, Artificial Sequence
  Synthetic Polynucleotide
taatacgactcactataggggagttcatggcacagcgaaagttggccttcaacagaggagagaaggcatgctttcgctgaacctggcggcagcgcaaaagatg

SEQ ID NO: 140752 - DNA, 103 bp, Artificial Sequence
  Synthetic Polynucleotide
taatacgactcactatagggatctggcagggagttcatggcacagcgaaaaacagaggagatttcgcatggccatgaacaacctggcggcagcgcaaaagatg

SEQ ID NO: 140753 - DNA, 103 bp, Artificial Sequence
  Synthetic Polynucleotide
taatacgactcactatagggcctcctcgatatctggcagggagttcatggaacagaggagaccatgaatgccctgccagaacctggcggcagcgcaaaagatg

SEQ ID NO: 140754 - DNA, 103 bp, Artificial Sequence
  Synthetic Polynucleotide
taatacgactcactatagggtggtctttcacctcctcgatatctggcaggaacagaggagacctgccatgtatcgaggaaacctggcggcagcgcaaaagatg

SEQ ID NO: 140755 - DNA, 103 bp, Artificial Sequence
  Synthetic Polynucleotide
taatacgactcactataggggttcctgctctggtctttcacctcctcgataacagaggagaatcgagatggtgaaagacaacctggcggcagcgcaaaagatg

SEQ ID NO: 140756 - DNA, 103 bp, Artificial Sequence
  Synthetic Polynucleotide
taatacgactcactatagggagctgcccttgttcctgctctggtctttcaaacagaggagatgaaagatgagagcaggaaacctggcggcagcgcaaaagatg

SEQ ID NO: 140757 - DNA, 103 bp, Artificial Sequence
  Synthetic Polynucleotide
taatacgactcactatagggttaatctgcatctctagccagggtctcatgaacagaggagacatgagatgctggctagaaacctggcggcagcgcaaaagatg

SEQ ID NO: 140758 - DNA, 103 bp, Artificial Sequence
  Synthetic Polynucleotide
taatacgactcactatagggcgcacagctgagctgcccttgttcctgctcaacagaggagagagcagatgcaagggcagaacctggcggcagcgcaaaagatg

SEQ ID NO: 140759 - DNA, 103 bp, Artificial Sequence
  Synthetic Polynucleotide
taatacgactcactatagggccggtacactcgcacagctgagctgcccttaacagaggagaaagggcatgtcagctgtgaacctggcggcagcgcaaaagatg

SEQ ID NO: 140760 - DNA, 103 bp, Artificial Sequence
  Synthetic Polynucleotide
taatacgactcactataggggtggaagcatccggtacactcgcacagctgaacagaggagacagctgatggagtgtaccaacctggcggcagcgcaaaagatg

SEQ ID NO: 140761 - DNA, 103 bp, Artificial Sequence
  Synthetic Polynucleotide
taatacgactcactatagggttggtgagaggtggaagcatccggtacactaacagaggagaagtgtaatggatgcttccaacctggcggcagcgcaaaagatg

SEQ ID NO: 140762 - DNA, 103 bp, Artificial Sequence
  Synthetic Polynucleotide
taatacgactcactatagggtctctggttcttggtgagaggtggaagcataacagaggagaatgcttatgcctctcaccaacctggcggcagcgcaaaagatg

SEQ ID NO: 140763 - DNA, 103 bp, Artificial Sequence
  Synthetic Polynucleotide
taatacgactcactatagggttctttcttttctctggttcttggtgagagaacagaggagactctcaatgagaaccagaaacctggcggcagcgcaaaagatg

SEQ ID NO: 140764 - DNA, 103 bp, Artificial Sequence
  Synthetic Polynucleotide
taatacgactcactataggggacttcgactttctttcttttctctggttcaacagaggagagaaccaatgaaaagaaagaacctggcggcagcgcaaaagatg

SEQ ID NO: 140765 - DNA, 103 bp, Artificial Sequence
  Synthetic Polynucleotide
taatacgactcactatagggatctcggctggacttcgactttctttctttaacagaggagaaaagaaatgaagtcgaagaacctggcggcagcgcaaaagatg

SEQ ID NO: 140766 - DNA, 103 bp, Artificial Sequence
  Synthetic Polynucleotide
taatacgactcactatagggtgctcttagcatctcggctggacttcgactaacagaggagaagtcgaatgccagccgagaacctggcggcagcgcaaaagatg

SEQ ID NO: 140767 - DNA, 103 bp, Artificial Sequence
  Synthetic Polynucleotide
taatacgactcactatagggctcttggccttgctcttagcatctcggctgaacagaggagacagccgatgtgctaagagaacctggcggcagcgcaaaagatg

SEQ ID NO: 140768 - DNA, 103 bp, Artificial Sequence
  Synthetic Polynucleotide
taatacgactcactatagggttggttggaattaatctgcatctctagccaaacagaggagatggctaatgatgcagattaacctggcggcagcgcaaaagatg

SEQ ID NO: 140769 - DNA, 103 bp, Artificial Sequence
  Synthetic Polynucleotide
taatacgactcactatagggacatgacttcctcttggccttgctcttagcaacagaggagagctaagatgaaggccaagaacctggcggcagcgcaaaagatg

SEQ ID NO: 140770 - DNA, 103 bp, Artificial Sequence
  Synthetic Polynucleotide
taatacgactcactatagggtggaatccccacatgacttcctcttggcctaacagaggagaaggccaatgggaagtcataacctggcggcagcgcaaaagatg

SEQ ID NO: 140771 - DNA, 103 bp, Artificial Sequence
  Synthetic Polynucleotide
taatacgactcactataggggtatcagggctggaatccccacatgacttcaacagaggagagaagtcatgtggggattcaacctggcggcagcgcaaaagatg

SEQ ID NO: 140772 - DNA, 103 bp, Artificial Sequence
  Synthetic Polynucleotide
taatacgactcactatagggatcagagaaggtatcagggctggaatccccaacagaggagaggggatatgagccctgataacctggcggcagcgcaaaagatg

SEQ ID NO: 140773 - DNA, 103 bp, Artificial Sequence
  Synthetic Polynucleotide
taatacgactcactatagggtgctgagtccatcagagaaggtatcagggcaacagaggagagccctgatgccttctctgaacctggcggcagcgcaaaagatg

SEQ ID NO: 140774 - DNA, 103 bp, Artificial Sequence
  Synthetic Polynucleotide
taatacgactcactatagggagagtggagctgctgagtccatcagagaagaacagaggagacttctcatgtggactcagaacctggcggcagcgcaaaagatg

SEQ ID NO: 140775 - DNA, 103 bp, Artificial Sequence
  Synthetic Polynucleotide
taatacgactcactataggggtcatcaggcagagtggagctgctgagtccaacagaggagaggactcatgagctccactaacctggcggcagcgcaaaagatg

SEQ ID NO: 140776 - DNA, 103 bp, Artificial Sequence
  Synthetic Polynucleotide
taatacgactcactatagggagctgctgtggtcatcaggcagagtggagcaacagaggagagctccaatgtgcctgatgaacctggcggcagcgcaaaagatg

SEQ ID NO: 140777 - DNA, 103 bp, Artificial Sequence
  Synthetic Polynucleotide
taatacgactcactatagggggaactgtgtagctgctgtggtcatcaggcaacagaggagagcctgaatgccacagcagaacctggcggcagcgcaaaagatg

SEQ ID NO: 140778 - DNA, 103 bp, Artificial Sequence
  Synthetic Polynucleotide
taatacgactcactatagggcatgtagcctggaactgtgtagctgctgtgaacagaggagacacagcatgtacacagttaacctggcggcagcgcaaaagatg

SEQ ID NO: 140779 - DNA, 103 bp, Artificial Sequence
  Synthetic Polynucleotide
taatacgactcactataggggccccgggatttggttggaattaatctgcaaacagaggagatgcagaatgattccaaccaacctggcggcagcgcaaaagatg

SEQ ID NO: 140780 - DNA, 103 bp, Artificial Sequence
  Synthetic Polynucleotide
taatacgactcactatagggccaagtcctgcatgtagcctggaactgtgtaacagaggagaacacagatgcaggctacaaacctggcggcagcgcaaaagatg

SEQ ID NO: 140781 - DNA, 103 bp, Artificial Sequence
  Synthetic Polynucleotide
taatacgactcactatagggtgctccacctccaagtcctgcatgtagcctaacagaggagaaggctaatggcaggacttaacctggcggcagcgcaaaagatg

SEQ ID NO: 140782 - DNA, 103 bp, Artificial Sequence
  Synthetic Polynucleotide
taatacgactcactatagggagtcagggcctgctccacctccaagtcctgaacagaggagacaggacatggaggtggagaacctggcggcagcgcaaaagatg

SEQ ID NO: 140783 - DNA, 103 bp, Artificial Sequence
  Synthetic Polynucleotide
taatacgactcactatagggacagtgctggagtcagggcctgctccacctaacagaggagaaggtggatgaggccctgaaacctggcggcagcgcaaaagatg

SEQ ID NO: 140784 - DNA, 103 bp, Artificial Sequence
  Synthetic Polynucleotide
taatacgactcactataggggcacatggcgacagtgctggagtcagggccaacagaggagaggccctatgtccagcactaacctggcggcagcgcaaaagatg

SEQ ID NO: 140785 - DNA, 103 bp, Artificial Sequence
  Synthetic Polynucleotide
taatacgactcactataggggctgctgacagcacatggcgacagtgctggaacagaggagaccagcaatgtcgccatgtaacctggcggcagcgcaaaagatg

SEQ ID NO: 140786 - DNA, 103 bp, Artificial Sequence
  Synthetic Polynucleotide
taatacgactcactatagggcggggagagtgctgctgacagcacatggcgaacagaggagacgccatatgctgtcagcaaacctggcggcagcgcaaaagatg

SEQ ID NO: 140787 - DNA, 103 bp, Artificial Sequence
  Synthetic Polynucleotide
taatacgactcactatagggatgtgccagtcggggagagtgctgctgacaaacagaggagatgtcagatgcactctcccaacctggcggcagcgcaaaagatg

SEQ ID NO: 140788 - DNA, 103 bp, Artificial Sequence
  Synthetic Polynucleotide
taatacgactcactatagggttccactgggatgtgccagtcggggagagtaacagaggagaactctcatggactggcacaacctggcggcagcgcaaaagatg

SEQ ID NO: 140789 - DNA, 103 bp, Artificial Sequence
  Synthetic Polynucleotide
taatacgactcactatagggccggcacaacttccactgggatgtgccagtaacagaggagaactggcatgtcccagtggaacctggcggcagcgcaaaagatg

SEQ ID NO: 140790 - DNA, 103 bp, Artificial Sequence
  Synthetic Polynucleotide
taatacgactcactatagggatccagatgagccccgggatttggttggaaaacagaggagattccaaatgaatcccgggaacctggcggcagcgcaaaagatg

SEQ ID NO: 140791 - DNA, 103 bp, Artificial Sequence
  Synthetic Polynucleotide
taatacgactcactatagggctggtgctgtccggcacaacttccactgggaacagaggagacccagtatgagttgtgccaacctggcggcagcgcaaaagatg

SEQ ID NO: 140792 - DNA, 103 bp, Artificial Sequence
  Synthetic Polynucleotide
taatacgactcactataggggtacagatcactggtgctgtccggcacaacaacagaggagagttgtgatggacagcaccaacctggcggcagcgcaaaagatg

SEQ ID NO: 140793 - DNA, 103 bp, Artificial Sequence
  Synthetic Polynucleotide
taatacgactcactatagggcctggaagttgtacagatcactggtgctgtaacagaggagaacagcaatggtgatctgtaacctggcggcagcgcaaaagatg

SEQ ID NO: 140794 - DNA, 103 bp, Artificial Sequence
  Synthetic Polynucleotide
taatacgactcactatagggatgggtgacacctggaagttgtacagatcaaacagaggagatgatctatgcaacttccaaacctggcggcagcgcaaaagatg

SEQ ID NO: 140795 - DNA, 103 bp, Artificial Sequence
  Synthetic Polynucleotide
taatacgactcactatagggggtggagggcatgggtgacacctggaagttaacagaggagaaacttcatggtgtcacccaacctggcggcagcgcaaaagatg

SEQ ID NO: 140796 - DNA, 103 bp, Artificial Sequence
  Synthetic Polynucleotide
taatacgactcactatagggtagcttcagaggtggagggcatgggtgacaaacagaggagatgtcacatgtgccctccaaacctggcggcagcgcaaaagatg

SEQ ID NO: 140797 - DNA, 103 bp, Artificial Sequence
  Synthetic Polynucleotide
taatacgactcactatagggtcatctgttgtagcttcagaggtggagggcaacagaggagagccctcatgctctgaagcaacctggcggcagcgcaaaagatg

SEQ ID NO: 140798 - DNA, 103 bp, Artificial Sequence
  Synthetic Polynucleotide
taatacgactcactatagggttcctcatcctcatctgttgtagcttcagaaacagaggagatctgaaatgacaacagataacctggcggcagcgcaaaagatg

SEQ ID NO: 140799 - DNA, 103 bp, Artificial Sequence
  Synthetic Polynucleotide
taatacgactcactataggggtaatttcccttcctcatcctcatctgttgaacagaggagacaacagatgaggatgaggaacctggcggcagcgcaaaagatg

SEQ ID NO: 140800 - DNA, 103 bp, Artificial Sequence
  Synthetic Polynucleotide
taatacgactcactatagggatgtcctcaggtaatttcccttcctcatccaacagaggagaggatgaatgagggaaattaacctggcggcagcgcaaaagatg

SEQ ID NO: 140801 - DNA, 103 bp, Artificial Sequence
  Synthetic Polynucleotide
taatacgactcactatagggctctttattaatccagatgagccccgggataacagaggagaatcccgatgctcatctggaacctggcggcagcgcaaaagatg

SEQ ID NO: 140802 - DNA, 103 bp, Artificial Sequence
  Synthetic Polynucleotide
taatacgactcactataggggagcttcatgatgtcctcaggtaatttcccaacagaggagagggaaaatgcctgaggacaacctggcggcagcgcaaaagatg

SEQ ID NO: 140803 - DNA, 103 bp, Artificial Sequence
  Synthetic Polynucleotide
taatacgactcactatagggactgctccaagagcttcatgatgtcctcagaacagaggagactgaggatgtcatgaagcaacctggcggcagcgcaaaagatg

SEQ ID NO: 140804 - DNA, 103 bp, Artificial Sequence
  Synthetic Polynucleotide
taatacgactcactatagggtgccactccgactgctccaagagcttcatgaacagaggagacatgaaatgcttggagcaaacctggcggcagcgcaaaagatg

SEQ ID NO: 140805 - DNA, 103 bp, Artificial Sequence
  Synthetic Polynucleotide
taatacgactcactataggggtttgttggctgccactccgactgctccaaaacagaggagattggagatgtcggagtggaacctggcggcagcgcaaaagatg

SEQ ID NO: 140806 - DNA, 103 bp, Artificial Sequence
  Synthetic Polynucleotide
taatacgactcactatagggtcccatccacgtttgttggctgccactccgaacagaggagacggagtatgagccaacaaaacctggcggcagcgcaaaagatg

SEQ ID NO: 140807 - DNA, 103 bp, Artificial Sequence
  Synthetic Polynucleotide
taatacgactcactatagggaggtaccccttcccatccacgtttgttggcaacagaggagagccaacatgcgtggatggaacctggcggcagcgcaaaagatg

SEQ ID NO: 140808 - DNA, 103 bp, Artificial Sequence
  Synthetic Polynucleotide
taatacgactcactatagggttcattgagtaggtaccccttcccatccacaacagaggagagtggatatgaaggggtacaacctggcggcagcgcaaaagatg

SEQ ID NO: 140809 - DNA, 103 bp, Artificial Sequence
  Synthetic Polynucleotide
taatacgactcactatagggggactccaggttcattgagtaggtacccctaacagaggagaaggggtatgtactcaatgaacctggcggcagcgcaaaagatg

SEQ ID NO: 140810 - DNA, 103 bp, Artificial Sequence
  Synthetic Polynucleotide
taatacgactcactataggggaggtgggctggactccaggttcattgagtaacagaggagaactcaaatgacctggagtaacctggcggcagcgcaaaagatg

SEQ ID NO: 140811 - DNA, 103 bp, Artificial Sequence
  Synthetic Polynucleotide
taatacgactcactatagggtccatagacagaggtgggctggactccaggaacagaggagacctggaatgcagcccaccaacctggcggcagcgcaaaagatg

SEQ ID NO: 140812 - DNA, 103 bp, Artificial Sequence
  Synthetic Polynucleotide
taatacgactcactatagggagatcatctcctctttattaatccagatgaaacagaggagatcatctatgttaataaagaacctggcggcagcgcaaaagatg

SEQ ID NO: 140813 - DNA, 103 bp, Artificial Sequence
  Synthetic Polynucleotide
taatacgactcactatagggagctaaagtctccatagacagaggtgggctaacagaggagaagcccaatgctgtctatgaacctggcggcagcgcaaaagatg

SEQ ID NO: 140814 - DNA, 103 bp, Artificial Sequence
  Synthetic Polynucleotide
taatacgactcactatagggtcctccttacagctaaagtctccatagacaaacagaggagatgtctaatgagactttagaacctggcggcagcgcaaaagatg

SEQ ID NO: 140815 - DNA, 103 bp, Artificial Sequence
  Synthetic Polynucleotide
taatacgactcactatagggaatttctggctcctccttacagctaaagtcaacagaggagagactttatgtgtaaggagaacctggcggcagcgcaaaagatg

SEQ ID NO: 140816 - DNA, 103 bp, Artificial Sequence
  Synthetic Polynucleotide
taatacgactcactatagggctgggctgtcaatttctggctcctccttacaacagaggagagtaaggatgagccagaaaaacctggcggcagcgcaaaagatg

SEQ ID NO: 140817 - DNA, 103 bp, Artificial Sequence
  Synthetic Polynucleotide
taatacgactcactatagggatatccccccctgggctgtcaatttctggcaacagaggagagccagaatgtgacagcccaacctggcggcagcgcaaaagatg

SEQ ID NO: 140818 - DNA, 103 bp, Artificial Sequence
  Synthetic Polynucleotide
taatacgactcactatagggactcagcccaatatccccccctgggctgtcaacagaggagagacagcatggggggggataacctggcggcagcgcaaaagatg

SEQ ID NO: 140819 - DNA, 103 bp, Artificial Sequence
  Synthetic Polynucleotide
taatacgactcactatagggcacgctgtagactcagcccaatatccccccaacagaggagaggggggatgttgggctgaaacctggcggcagcgcaaaagatg

SEQ ID NO: 140820 - DNA, 103 bp, Artificial Sequence
  Synthetic Polynucleotide
taatacgactcactatagggtctgtgaagacacgctgtagactcagcccaaacagaggagatgggctatgtctacagcgaacctggcggcagcgcaaaagatg

SEQ ID NO: 140821 - DNA, 103 bp, Artificial Sequence
  Synthetic Polynucleotide
taatacgactcactataggggttcttcagatctgtgaagacacgctgtagaacagaggagactacagatggtcttcacaaacctggcggcagcgcaaaagatg

SEQ ID NO: 140822 - DNA, 103 bp, Artificial Sequence
  Synthetic Polynucleotide
taatacgactcactatagggtggcatccatgttcttcagatctgtgaagaaacagaggagatcttcaatgatctgaagaaacctggcggcagcgcaaaagatg

SEQ ID NO: 140823 - DNA, 103 bp, Artificial Sequence
  Synthetic Polynucleotide
taatacgactcactataggggggatctggaagatcatctcctctttattaaacagaggagataataaatgggagatgataacctggcggcagcgcaaaagatg

SEQ ID NO: 140824 - DNA, 103 bp, Artificial Sequence
  Synthetic Polynucleotide
taatacgactcactatagggtccagccaggtggcatccatgttcttcagaaacagaggagatctgaaatgcatggatgcaacctggcggcagcgcaaaagatg

SEQ ID NO: 140825 - DNA, 103 bp, Artificial Sequence
  Synthetic Polynucleotide
taatacgactcactatagggcagcaggctgtccagccaggtggcatccataacagaggagaatggatatgacctggctgaacctggcggcagcgcaaaagatg

SEQ ID NO: 140826 - DNA, 103 bp, Artificial Sequence
  Synthetic Polynucleotide
taatacgactcactatagggggactggggtcagcaggctgtccagccaggaacagaggagacctggcatgacagcctgcaacctggcggcagcgcaaaagatg

SEQ ID NO: 140827 - DNA, 103 bp, Artificial Sequence
  Synthetic Polynucleotide
taatacgactcactataggggagggcaaccggactggggtcagcaggctgaacagaggagacagcctatggaccccagtaacctggcggcagcgcaaaagatg

SEQ ID NO: 140828 - DNA, 103 bp, Artificial Sequence
  Synthetic Polynucleotide
taatacgactcactatagggggcctggatggagggcaaccggactggggtaacagaggagaaccccaatgcggttgcccaacctggcggcagcgcaaaagatg

SEQ ID NO: 140829 - DNA, 103 bp, Artificial Sequence
  Synthetic Polynucleotide
taatacgactcactatagggcacagggaatggcctggatggagggcaaccaacagaggagaggttgcatgccatccaggaacctggcggcagcgcaaaagatg

SEQ ID NO: 140830 - DNA, 103 bp, Artificial Sequence
  Synthetic Polynucleotide
taatacgactcactatagggcgggcgcatgcgcatcctttccaccggcataacagaggagaatgccgatggaaaggatgaacctggcggcagcgcaaaagatg

SEQ ID NO: 140831 - DNA, 103 bp, Artificial Sequence
  Synthetic Polynucleotide
taatacgactcactatagggatgcatccaggggatctgaaaaatcttcttaacagaggagaaagaagatgtttcagatcaacctggcggcagcgcaaaagatg

SEQ ID NO: 140832 - DNA, 103 bp, Artificial Sequence
  Synthetic Polynucleotide
taatacgactcactatagggatccgatgttttcttgatgacgctggcccgaacagaggagacgggccatggtcatcaagaacctggcggcagcgcaaaagatg

SEQ ID NO: 140833 - DNA, 103 bp, Artificial Sequence
  Synthetic Polynucleotide
taatacgactcactatagggcctgggtgatatccgatgttttcttgatgaaacagaggagatcatcaatgaaacatcggaacctggcggcagcgcaaaagatg

SEQ ID NO: 140834 - DNA, 103 bp, Artificial Sequence
  Synthetic Polynucleotide
taatacgactcactatagggttgacgcgggcctgggtgatatccgatgttaacagaggagaaacatcatgtatcacccaaacctggcggcagcgcaaaagatg

SEQ ID NO: 140835 - DNA, 103 bp, Artificial Sequence
  Synthetic Polynucleotide
taatacgactcactatagggttaacagctcttgacgcgggcctgggtgataacagaggagaatcaccatggcccgcgtcaacctggcggcagcgcaaaagatg

SEQ ID NO: 140836 - DNA, 103 bp, Artificial Sequence
  Synthetic Polynucleotide
taatacgactcactataggggtctagccgcatgcatccaggggatctgaaaacagaggagattcagaatgcctggatgcaacctggcggcagcgcaaaagatg

SEQ ID NO: 140837 - DNA, 103 bp, Artificial Sequence
  Synthetic Polynucleotide
taatacgactcactatagggtcccacccatgtctagccgcatgcatccagaacagaggagactggatatgtgcggctagaacctggcggcagcgcaaaagatg

SEQ ID NO: 140838 - DNA, 103 bp, Artificial Sequence
  Synthetic Polynucleotide
taatacgactcactatagggtttttccacatcccacccatgtctagccgcaacagaggagagcggctatgcatgggtggaacctggcggcagcgcaaaagatg

SEQ ID NO: 140839 - DNA, 103 bp, Artificial Sequence
  Synthetic Polynucleotide
taatacgactcactataggggtggtgcatctttttccacatcccacccataacagaggagaatgggtatgatgtggaaaaacctggcggcagcgcaaaagatg

SEQ ID NO: 140840 - DNA, 103 bp, Artificial Sequence
  Synthetic Polynucleotide
taatacgactcactatagggtttctaaagagtggtgcatctttttccacaaacagaggagatgtggaatgagatgcaccaacctggcggcagcgcaaaagatg

SEQ ID NO: 140841 - DNA, 103 bp, Artificial Sequence
  Synthetic Polynucleotide
taatacgactcactataggggattgcccagtttctaaagagtggtgcatcaacagaggagagatgcaatgctctttagaaacctggcggcagcgcaaaagatg

SEQ ID NO: 140842 - DNA, 103 bp, Artificial Sequence
  Synthetic Polynucleotide
taatacgactcactatagggttcctgtatggattgcccagtttctaaagaaacagaggagatctttaatgactgggcaaaacctggcggcagcgcaaaagatg

SEQ ID NO: 140843 - DNA, 103 bp, Artificial Sequence
  Synthetic Polynucleotide
taatacgactcactatagggggttgatgctttcctgtatggattgcccagaacagaggagactgggcatgccatacaggaacctggcggcagcgcaaaagatg

SEQ ID NO: 140844 - DNA, 103 bp, Artificial Sequence
  Synthetic Polynucleotide
taatacgactcactatagggatctactcctggttgatgctttcctgtatgaacagaggagacatacaatgaagcatcaaaacctggcggcagcgcaaaagatg

SEQ ID NO: 140845 - DNA, 103 bp, Artificial Sequence
  Synthetic Polynucleotide
taatacgactcactatagggcctccagccacgggcgcatgcgcatcctttaacagaggagaaaaggaatggcatgcgccaacctggcggcagcgcaaaagatg

SEQ ID NO: 140846 - DNA, 103 bp, Artificial Sequence
  Synthetic Polynucleotide
taatacgactcactataggggatcaggtttatctactcctggttgatgctaacagaggagaagcatcatgcaggagtagaacctggcggcagcgcaaaagatg

SEQ ID NO: 140847 - DNA, 103 bp, Artificial Sequence
  Synthetic Polynucleotide
taatacgactcactatagggcatgttttgggatcaggtttatctactcctaacagaggagaaggagtatgtaaacctgaaacctggcggcagcgcaaaagatg

SEQ ID NO: 140848 - DNA, 103 bp, Artificial Sequence
  Synthetic Polynucleotide
taatacgactcactatagggattcgccttccatgttttgggatcaggtttaacagaggagaaaacctatgcccaaaacaaacctggcggcagcgcaaaagatg

SEQ ID NO: 140849 - DNA, 103 bp, Artificial Sequence
  Synthetic Polynucleotide
taatacgactcactatagggcgcatctgaaattcgccttccatgttttggaacagaggagaccaaaaatgggaaggcgaaacctggcggcagcgcaaaagatg

SEQ ID NO: 140850 - DNA, 103 bp, Artificial Sequence
  Synthetic Polynucleotide
taatacgactcactataggggaattcatggcgcatctgaaattcgccttcaacagaggagagaaggcatgtttcagatgaacctggcggcagcgcaaaagatg

SEQ ID NO: 140851 - DNA, 103 bp, Artificial Sequence
  Synthetic Polynucleotide
taatacgactcactatagggatcaggcaaggaattcatggcgcatctgaaaacagaggagattcagaatggccatgaataacctggcggcagcgcaaaagatg

SEQ ID NO: 140852 - DNA, 103 bp, Artificial Sequence
  Synthetic Polynucleotide
taatacgactcactatagggcttcttcaatatcaggcaaggaattcatggaacagaggagaccatgaatgccttgcctgaacctggcggcagcgcaaaagatg

SEQ ID NO: 140853 - DNA, 103 bp, Artificial Sequence
  Synthetic Polynucleotide
taatacgactcactatagggttatccttgacttcttcaatatcaggcaagaacagaggagacttgccatgtattgaagaaacctggcggcagcgcaaaagatg

SEQ ID NO: 140854 - DNA, 103 bp, Artificial Sequence
  Synthetic Polynucleotide
taatacgactcactatagggctttatgcttttatccttgacttcttcaataacagaggagaattgaaatggtcaaggataacctggcggcagcgcaaaagatg

SEQ ID NO: 140855 - DNA, 103 bp, Artificial Sequence
  Synthetic Polynucleotide
taatacgactcactatagggtatttcctttctttatgcttttatccttgaaacagaggagatcaaggatgaaagcataaaacctggcggcagcgcaaaagatg

SEQ ID NO: 140856 - DNA, 103 bp, Artificial Sequence
  Synthetic Polynucleotide
taatacgactcactatagggtttatctgctcctccagccacgggcgcatgaacagaggagacatgcgatggtggctggaaacctggcggcagcgcaaaagatg

SEQ ID NO: 140857 - DNA, 103 bp, Artificial Sequence
  Synthetic Polynucleotide
taatacgactcactatagggctgaaggcattatttcctttctttatgcttaacagaggagaaagcatatggaaaggaaaaacctggcggcagcgcaaaagatg

SEQ ID NO: 140858 - DNA, 103 bp, Artificial Sequence
  Synthetic Polynucleotide
taatacgactcactatagggtcggtagaccctgaaggcattatttcctttaacagaggagaaaaggaatgaatgccttcaacctggcggcagcgcaaaagatg

SEQ ID NO: 140859 - DNA, 103 bp, Artificial Sequence
  Synthetic Polynucleotide
taatacgactcactatagggggggcagcattcggtagaccctgaaggcataacagaggagaatgcctatggggtctaccaacctggcggcagcgcaaaagatg

SEQ ID NO: 140860 - DNA, 103 bp, Artificial Sequence
  Synthetic Polynucleotide
taatacgactcactatagggcgttctgataggggcagcattcggtagaccaacagaggagaggtctaatgaatgctgccaacctggcggcagcgcaaaagatg

SEQ ID NO: 140861 - DNA, 103 bp, Artificial Sequence
  Synthetic Polynucleotide
taatacgactcactatagggcttagaaggccgttctgataggggcagcataacagaggagaatgctgatgctatcagaaaacctggcggcagcgcaaaagatg

SEQ ID NO: 140862 - DNA, 103 bp, Artificial Sequence
  Synthetic Polynucleotide
taatacgactcactatagggtctttcctttcttagaaggccgttctgataaacagaggagatatcagatgggccttctaaacctggcggcagcgcaaaagatg

SEQ ID NO: 140863 - DNA, 103 bp, Artificial Sequence
  Synthetic Polynucleotide
taatacgactcactataggggtctttggtttctttcctttcttagaaggcaacagaggagagccttcatggaaaggaaaaacctggcggcagcgcaaaagatg

SEQ ID NO: 140864 - DNA, 103 bp, Artificial Sequence
  Synthetic Polynucleotide
taatacgactcactatagggttctttttctgtctttggtttctttcctttaacagaggagaaaaggaatgaaaccaaagaacctggcggcagcgcaaaagatg

SEQ ID NO: 140865 - DNA, 103 bp, Artificial Sequence
  Synthetic Polynucleotide
taatacgactcactatagggtaactttgtcttctttttctgtctttggttaacagaggagaaaccaaatgcagaaaaagaacctggcggcagcgcaaaagatg

SEQ ID NO: 140866 - DNA, 103 bp, Artificial Sequence
  Synthetic Polynucleotide
taatacgactcactatagggttgatgtgcttaactttgtcttctttttctaacagaggagaagaaaaatgagacaaagtaacctggcggcagcgcaaaagatg

SEQ ID NO: 140867 - DNA, 103 bp, Artificial Sequence
  Synthetic Polynucleotide
taatacgactcactatagggcgtgttggagtttatctgctcctccagccaaacagaggagatggctgatggagcagataaacctggcggcagcgcaaaagatg

SEQ ID NO: 140868 - DNA, 103 bp, Artificial Sequence
  Synthetic Polynucleotide
taatacgactcactatagggtggttcttgcttgatgtgcttaactttgtcaacagaggagagacaaaatgaagcacatcaacctggcggcagcgcaaaagatg

SEQ ID NO: 140869 - DNA, 103 bp, Artificial Sequence
  Synthetic Polynucleotide
taatacgactcactatagggatgactcaactggttcttgcttgatgtgctaacagaggagaagcacaatgagcaagaacaacctggcggcagcgcaaaagatg

SEQ ID NO: 140870 - DNA, 103 bp, Artificial Sequence
  Synthetic Polynucleotide
taatacgactcactatagggagccccagagatgactcaactggttcttgcaacagaggagagcaagaatgagttgagtcaacctggcggcagcgcaaaagatg

SEQ ID NO: 140871 - DNA, 103 bp, Artificial Sequence
  Synthetic Polynucleotide
taatacgactcactatagggtccattactaagccccagagatgactcaacaacagaggagagttgagatgtctctggggaacctggcggcagcgcaaaagatg

SEQ ID NO: 140872 - DNA, 103 bp, Artificial Sequence
  Synthetic Polynucleotide
taatacgactcactataggggatcacttactccattactaagccccagagaacagaggagactctggatgttagtaatgaacctggcggcagcgcaaaagatg

SEQ ID NO: 140873 - DNA, 103 bp, Artificial Sequence
  Synthetic Polynucleotide
taatacgactcactatagggtcaggagaaagatcacttactccattactaaacagaggagatagtaaatgagtaagtgaaacctggcggcagcgcaaaagatg

SEQ ID NO: 140874 - DNA, 103 bp, Artificial Sequence
  Synthetic Polynucleotide
taatacgactcactataggggaccgcatactcaggagaaagatcacttacaacagaggagagtaagtatgctttctcctaacctggcggcagcgcaaaagatg

SEQ ID NO: 140875 - DNA, 103 bp, Artificial Sequence
  Synthetic Polynucleotide
taatacgactcactatagggttgaagtcaggaccgcatactcaggagaaaaacagaggagatttctcatgagtatgcggaacctggcggcagcgcaaaagatg

SEQ ID NO: 140876 - DNA, 103 bp, Artificial Sequence
  Synthetic Polynucleotide
taatacgactcactatagggttttttatagttgaagtcaggaccgcatacaacagaggagagtatgcatgcctgacttcaacctggcggcagcgcaaaagatg

SEQ ID NO: 140877 - DNA, 103 bp, Artificial Sequence
  Synthetic Polynucleotide
taatacgactcactatagggatccacttcattttttatagttgaagtcagaacagaggagactgactatgactataaaaaacctggcggcagcgcaaaagatg

SEQ ID NO: 140878 - DNA, 103 bp, Artificial Sequence
  Synthetic Polynucleotide
taatacgactcactataggggccccgggatcgtgttggagtttatctgctaacagaggagaagcagaatgactccaacaaacctggcggcagcgcaaaagatg

SEQ ID NO: 140879 - DNA, 103 bp, Artificial Sequence
  Synthetic Polynucleotide
taatacgactcactatagggtcaccgtactatccacttcattttttatagaacagaggagactataaatgatgaagtggaacctggcggcagcgcaaaagatg

SEQ ID NO: 140880 - DNA, 103 bp, Artificial Sequence
  Synthetic Polynucleotide
taatacgactcactatagggactatgatgttcaccgtactatccacttcaaacagaggagatgaagtatgtagtacggtaacctggcggcagcgcaaaagatg

SEQ ID NO: 140881 - DNA, 103 bp, Artificial Sequence
  Synthetic Polynucleotide
taatacgactcactatagggctgtcctacaactatgatgttcaccgtactaacagaggagaagtacgatgaacatcataaacctggcggcagcgcaaaagatg

SEQ ID NO: 140882 - DNA, 103 bp, Artificial Sequence
  Synthetic Polynucleotide
taatacgactcactatagggccagatgggactgtcctacaactatgatgtaacagaggagaacatcaatgttgtaggacaacctggcggcagcgcaaaagatg

SEQ ID NO: 140883 - DNA, 103 bp, Artificial Sequence
  Synthetic Polynucleotide
taatacgactcactatagggatgttgctgtccagatgggactgtcctacaaacagaggagatgtaggatggtcccatctaacctggcggcagcgcaaaagatg

SEQ ID NO: 140884 - DNA, 103 bp, Artificial Sequence
  Synthetic Polynucleotide
taatacgactcactatagggttgattctcaatgttgctgtccagatgggaaacagaggagatcccatatggacagcaacaacctggcggcagcgcaaaagatg

SEQ ID NO: 140885 - DNA, 103 bp, Artificial Sequence
  Synthetic Polynucleotide
taatacgactcactatagggtgacaatctcttgattctcaatgttgctgtaacagaggagaacagcaatgttgagaatcaacctggcggcagcgcaaaagatg

SEQ ID NO: 140886 - DNA, 103 bp, Artificial Sequence
  Synthetic Polynucleotide
taatacgactcactatagggggcggattggtgacaatctcttgattctcaaacagaggagatgagaaatgagagattgtaacctggcggcagcgcaaaagatg

SEQ ID NO: 140887 - DNA, 103 bp, Artificial Sequence
  Synthetic Polynucleotide
taatacgactcactataggggcaaatgtctggcggattggtgacaatctcaacagaggagagagattatgaccaatccgaacctggcggcagcgcaaaagatg

SEQ ID NO: 140888 - DNA, 103 bp, Artificial Sequence
  Synthetic Polynucleotide
taatacgactcactatagggctacaacttggcaaatgtctggcggattggaacagaggagaccaatcatgcagacatttaacctggcggcagcgcaaaagatg

SEQ ID NO: 140889 - DNA, 103 bp, Artificial Sequence
  Synthetic Polynucleotide
taatacgactcactatagggagccacttgagccccgggatcgtgttggagaacagaggagactccaaatggatcccgggaacctggcggcagcgcaaaagatg

SEQ ID NO: 140890 - DNA, 103 bp, Artificial Sequence
  Synthetic Polynucleotide
taatacgactcactataggggtggtcacctctacaacttggcaaatgtctaacagaggagaagacatatgccaagttgtaacctggcggcagcgcaaaagatg

SEQ ID NO: 140891 - DNA, 103 bp, Artificial Sequence
  Synthetic Polynucleotide
taatacgactcactataggggtcgctctcagtggtcacctctacaacttgaacagaggagacaagttatggaggtgaccaacctggcggcagcgcaaaagatg

SEQ ID NO: 140892 - DNA, 103 bp, Artificial Sequence
  Synthetic Polynucleotide
taatacgactcactatagggccggctgctcgtcgctctcagtggtcacctaacagaggagaaggtgaatgctgagagcgaacctggcggcagcgcaaaagatg

SEQ ID NO: 140893 - DNA, 103 bp, Artificial Sequence
  Synthetic Polynucleotide
taatacgactcactatagggctcatgctgaccggctgctcgtcgctctcaaacagaggagatgagagatgcgagcagccaacctggcggcagcgcaaaagatg

SEQ ID NO: 140894 - DNA, 103 bp, Artificial Sequence
  Synthetic Polynucleotide
taatacgactcactataggggtagagctcgctcatgctgaccggctgctcaacagaggagagagcagatggtcagcatgaacctggcggcagcgcaaaagatg

SEQ ID NO: 140895 - DNA, 103 bp, Artificial Sequence
  Synthetic Polynucleotide
taatacgactcactatagggtctgcagagggtagagctcgctcatgctgaaacagaggagatcagcaatggcgagctctaacctggcggcagcgcaaaagatg

SEQ ID NO: 140896 - DNA, 103 bp, Artificial Sequence
  Synthetic Polynucleotide
taatacgactcactatagggacgggggagatctgcagagggtagagctcgaacagaggagacgagctatgccctctgcaaacctggcggcagcgcaaaagatg

SEQ ID NO: 140897 - DNA, 103 bp, Artificial Sequence
  Synthetic Polynucleotide
taatacgactcactatagggataggaagacacgggggagatctgcagaggaacagaggagacctctgatgatctcccccaacctggcggcagcgcaaaagatg

SEQ ID NO: 140898 - DNA, 103 bp, Artificial Sequence
  Synthetic Polynucleotide
taatacgactcactatagggcgctttctgcataggaagacacgggggagaaacagaggagatctcccatgtgtcttcctaacctggcggcagcgcaaaagatg

SEQ ID NO: 140899 - DNA, 103 bp, Artificial Sequence
  Synthetic Polynucleotide
taatacgactcactatagggtcagtcgtttcgctttctgcataggaagacaacagaggagagtcttcatgtgcagaaagaacctggcggcagcgcaaaagatg

SEQ ID NO: 140900 - DNA, 103 bp, Artificial Sequence
  Synthetic Polynucleotide
taatacgactcactatagggttccttgttaagccacttgagccccgggataacagaggagaatcccgatgctcaagtggaacctggcggcagcgcaaaagatg

SEQ ID NO: 140901 - DNA, 103 bp, Artificial Sequence
  Synthetic Polynucleotide
taatacgactcactataggggggcacactatcagtcgtttcgctttctgcaacagaggagagcagaaatggaaacgactaacctggcggcagcgcaaaagatg

SEQ ID NO: 140902 - DNA, 103 bp, Artificial Sequence
  Synthetic Polynucleotide
taatacgactcactatagggcttcatcgctgggcacactatcagtcgtttaacagaggagaaaacgaatgatagtgtgcaacctggcggcagcgcaaaagatg

SEQ ID NO: 140903 - DNA, 103 bp, Artificial Sequence
  Synthetic Polynucleotide
taatacgactcactatagggtcggcactctcttcatcgctgggcacactaaacagaggagatagtgtatgcagcgatgaaacctggcggcagcgcaaaagatg

SEQ ID NO: 140904 - DNA, 103 bp, Artificial Sequence
  Synthetic Polynucleotide
taatacgactcactatagggtggccgcccctcggcactctcttcatcgctaacagaggagaagcgatatggagagtgccaacctggcggcagcgcaaaagatg

SEQ ID NO: 140905 - DNA, 103 bp, Artificial Sequence
  Synthetic Polynucleotide
taatacgactcactatagggtccgccagtgtggccgcccctcggcactctaacagaggagaagagtgatgaggggcggcaacctggcggcagcgcaaaagatg

SEQ ID NO: 140906 - DNA, 103 bp, Artificial Sequence
  Synthetic Polynucleotide
taatacgactcactatagggatattcctcttccgccagtgtggccgccccaacagaggagaggggcgatgacactggcgaacctggcggcagcgcaaaagatg

SEQ ID NO: 140907 - DNA, 103 bp, Artificial Sequence
  Synthetic Polynucleotide
taatacgactcactatagggtttgccttcaatattcctcttccgccagtgaacagaggagacactggatgaagaggaataacctggcggcagcgcaaaagatg

SEQ ID NO: 140908 - DNA, 103 bp, Artificial Sequence
  Synthetic Polynucleotide
taatacgactcactatagggtgaggtactgtttgccttcaatattcctctaacagaggagaagaggaatgttgaaggcaaacctggcggcagcgcaaaagatg

SEQ ID NO: 140909 - DNA, 103 bp, Artificial Sequence
  Synthetic Polynucleotide
taatacgactcactatagggcccatgttgctgaggtactgtttgccttcaaacagaggagatgaaggatgacagtacctaacctggcggcagcgcaaaagatg

SEQ ID NO: 140910 - DNA, 103 bp, Artificial Sequence
  Synthetic Polynucleotide
taatacgactcactataggggcctcgagtccccatgttgctgaggtactgaacagaggagacagtacatgagcaacatgaacctggcggcagcgcaaaagatg

SEQ ID NO: 140911 - DNA, 103 bp, Artificial Sequence
  Synthetic Polynucleotide
taatacgactcactatagggaaatcttcttttccttgttaagccacttgaaacagaggagatcaagtatgttaacaaggaacctggcggcagcgcaaaagatg

SEQ ID NO: 140912 - DNA, 103 bp, Artificial Sequence
  Synthetic Polynucleotide
taatacgactcactataggggcaggtaggagcctcgagtccccatgttgcaacagaggagagcaacaatgggactcgagaacctggcggcagcgcaaaagatg

SEQ ID NO: 140913 - DNA, 103 bp, Artificial Sequence
  Synthetic Polynucleotide
taatacgactcactatagggatgccgggcagcaggtaggagcctcgagtcaacagaggagagactcgatgctcctacctaacctggcggcagcgcaaaagatg

SEQ ID NO: 140914 - DNA, 103 bp, Artificial Sequence
  Synthetic Polynucleotide
taatacgactcactataggggaaggacgccatgccgggcagcaggtaggaaacagaggagatcctacatgctgcccggcaacctggcggcagcgcaaaagatg

SEQ ID NO: 140915 - DNA, 103 bp, Artificial Sequence
  Synthetic Polynucleotide
taatacgactcactatagggtggaagtgacgaaggacgccatgccgggcaaacagaggagatgcccgatgtggcgtcctaacctggcggcagcgcaaaagatg

SEQ ID NO: 140916 - DNA, 103 bp, Artificial Sequence
  Synthetic Polynucleotide
taatacgactcactatagggtccggtttgttggaagtgacgaaggacgccaacagaggagaggcgtcatgcgtcacttcaacctggcggcagcgcaaaagatg

SEQ ID NO: 140917 - DNA, 103 bp, Artificial Sequence
  Synthetic Polynucleotide
taatacgactcactataggggacctggaggtccggtttgttggaagtgacaacagaggagagtcactatgaacaaaccgaacctggcggcagcgcaaaagatg

SEQ ID NO: 140918 - DNA, 103 bp, Artificial Sequence
  Synthetic Polynucleotide
taatacgactcactatagggctttgatggtgacctggaggtccggtttgtaacagaggagaacaaacatgacctccaggaacctggcggcagcgcaaaagatg

SEQ ID NO: 140919 - DNA, 103 bp, Artificial Sequence
  Synthetic Polynucleotide
taatacgactcactatagggttgctctcctctttgatggtgacctggaggaacagaggagacctccaatgcaccatcaaaacctggcggcagcgcaaaagatg

SEQ ID NO: 140920 - DNA, 103 bp, Artificial Sequence
  Synthetic Polynucleotide
taatacgactcactatagggaggcaccggattgctctcctctttgatggtaacagaggagaaccatcatggaggagagcaacctggcggcagcgcaaaagatg

SEQ ID NO: 140921 - DNA, 103 bp, Artificial Sequence
  Synthetic Polynucleotide
taatacgactcactatagggagctgttgtaaggcaccggattgctctcctaacagaggagaaggagaatgatccggtgcaacctggcggcagcgcaaaagatg

SEQ ID NO: 140922 - DNA, 103 bp, Artificial Sequence
  Synthetic Polynucleotide
taatacgactcactataggggggatctgaaaaatcttcttttccttgttaaacagaggagataacaaatgaaagaagataacctggcggcagcgcaaaagatg

SEQ ID NO: 140923 - DNA, 103 bp, Artificial Sequence
  Synthetic Polynucleotide
taatacgactcactataggggggggccaggagctgttgtaaggcaccggaaacagaggagatccggtatgttacaacagaacctggcggcagcgcaaaagatg

SEQ ID NO: 140924 - DNA, 103 bp, Artificial Sequence
  Synthetic Polynucleotide
taatacgactcactataggggtcttgaaaagggggccaggagctgttgtaaacagaggagatacaacatgtcctggcccaacctggcggcagcgcaaaagatg

SEQ ID NO: 140925 - DNA, 103 bp, Artificial Sequence
  Synthetic Polynucleotide
taatacgactcactatagggaaagggggaggtcttgaaaagggggccaggaacagaggagacctggcatgcttttcaagaacctggcggcagcgcaaaagatg

SEQ ID NO: 140926 - DNA, 103 bp, Artificial Sequence
  Synthetic Polynucleotide
taatacgactcactatagggatggaggaagaaagggggaggtcttgaaaaaacagaggagattttcaatgcctccccctaacctggcggcagcgcaaaagatg

SEQ ID NO: 140927 - DNA, 103 bp, Artificial Sequence
  Synthetic Polynucleotide
taatacgactcactatagggtgctggggtcatggaggaagaaagggggagaacagaggagactccccatgtcttcctccaacctggcggcagcgcaaaagatg

SEQ ID NO: 140928 - DNA, 103 bp, Artificial Sequence
  Synthetic Polynucleotide
taatacgactcactatagggtgctgctggatgctggggtcatggaggaagaacagaggagacttcctatgtgaccccagaacctggcggcagcgcaaaagatg

SEQ ID NO: 140929 - DNA, 103 bp, Artificial Sequence
  Synthetic Polynucleotide
taatacgactcactatagggtctggccgactgctgctggatgctggggtcaacagaggagagaccccatgatccagcagaacctggcggcagcgcaaaagatg

SEQ ID NO: 140930 - DNA, 103 bp, Artificial Sequence
  Synthetic Polynucleotide
taatacgactcactatagggggtctcccggtctggccgactgctgctggaaacagaggagatccagcatgagtcggccaaacctggcggcagcgcaaaagatg

SEQ ID NO: 140931 - DNA, 103 bp, Artificial Sequence
  Synthetic Polynucleotide
taatacgactcactatagggcgctggcccgggtctcccggtctggccgacaacagaggagagtcggcatgaccgggagaaacctggcggcagcgcaaaagatg

SEQ ID NO: 140932 - DNA, 103 bp, Artificial Sequence
  Synthetic Polynucleotide
taatacgactcactatagggttcttgatgacgctggcccgggtctcccggaacagaggagaccgggaatgccgggccagaacctggcggcagcgcaaaagatg

SEQ ID NO: 140933 - DNA, 103 bp, Artificial Sequence
  Synthetic Polynucleotide
taatacgactcactatagggctggcggcgggacgcctgcacagacgccataacagaggagaatggcgatggtgcaggcgaacctggcggcagcgcaaaagatg

SEQ ID NO: 140934 - DNA, 103 bp, Artificial Sequence
  Synthetic Polynucleotide
taatacgactcactatagggctcgaagttcacgcagccgcgacacacggcaacagaggagagccgtgatgcgcggctgcaacctggcggcagcgcaaaagatg

SEQ ID NO: 140935 - DNA, 103 bp, Artificial Sequence
  Synthetic Polynucleotide
taatacgactcactataggggctgcggacgccgtcggtaagcagctcgccaacagaggagaggcgagatgcttaccgacaacctggcggcagcgcaaaagatg

SEQ ID NO: 140936 - DNA, 103 bp, Artificial Sequence
  Synthetic Polynucleotide
taatacgactcactataggggctcgcggaagctgcggacgccgtcggtaaaacagaggagattaccgatggcgtccgcaaacctggcggcagcgcaaaagatg

SEQ ID NO: 140937 - DNA, 103 bp, Artificial Sequence
  Synthetic Polynucleotide
taatacgactcactataggggcgggagctggctcgcggaagctgcggacgaacagaggagacgtccgatgcttccgcgaaacctggcggcagcgcaaaagatg

SEQ ID NO: 140938 - DNA, 103 bp, Artificial Sequence
  Synthetic Polynucleotide
taatacgactcactatagggcagggcctccgcgggagctggctcgcggaaaacagaggagattccgcatgccagctcccaacctggcggcagcgcaaaagatg

SEQ ID NO: 140939 - DNA, 103 bp, Artificial Sequence
  Synthetic Polynucleotide
taatacgactcactatagggactgctggggcagggcctccgcgggagctgaacagaggagacagctcatgcggaggcccaacctggcggcagcgcaaaagatg

SEQ ID NO: 140940 - DNA, 103 bp, Artificial Sequence
  Synthetic Polynucleotide
taatacgactcactatagggggctctgggtactgctggggcagggcctccaacagaggagaggaggcatggccccagcaaacctggcggcagcgcaaaagatg

SEQ ID NO: 140941 - DNA, 103 bp, Artificial Sequence
  Synthetic Polynucleotide
taatacgactcactatagggcgcaggggccggctctgggtactgctggggaacagaggagaccccagatgtacccagagaacctggcggcagcgcaaaagatg

SEQ ID NO: 140942 - DNA, 103 bp, Artificial Sequence
  Synthetic Polynucleotide
taatacgactcactatagggcacagagagccgcaggggccggctctgggtaacagaggagaacccagatgcggcccctgaacctggcggcagcgcaaaagatg

SEQ ID NO: 140943 - DNA, 103 bp, Artificial Sequence
  Synthetic Polynucleotide
taatacgactcactataggggggggtgggccacagagagccgcaggggccaacagaggagaggccccatgggctctctgaacctggcggcagcgcaaaagatg

SEQ ID NO: 140944 - DNA, 103 bp, Artificial Sequence
  Synthetic Polynucleotide
taatacgactcactatagggtggggctcgcgggggtgggccacagagagcaacagaggagagctctcatgggcccacccaacctggcggcagcgcaaaagatg

SEQ ID NO: 140945 - DNA, 103 bp, Artificial Sequence
  Synthetic Polynucleotide
taatacgactcactatagggggtccgcgccctcgaagttcacgcagccgcaacagaggagagcggctatgtgaacttcgaacctggcggcagcgcaaaagatg

SEQ ID NO: 140946 - DNA, 103 bp, Artificial Sequence
  Synthetic Polynucleotide
taatacgactcactatagggggttccgggatggggctcgcgggggtgggcaacagaggagagcccacatgcgcgagcccaacctggcggcagcgcaaaagatg

SEQ ID NO: 140947 - DNA, 103 bp, Artificial Sequence
  Synthetic Polynucleotide
taatacgactcactataggggtgggcgccaggttccgggatggggctcgcaacagaggagagcgagcatgatcccggaaaacctggcggcagcgcaaaagatg

SEQ ID NO: 140948 - DNA, 103 bp, Artificial Sequence
  Synthetic Polynucleotide
taatacgactcactatagggacggcgcggcgtgggcgccaggttccgggaaacagaggagatcccggatgctggcgcccaacctggcggcagcgcaaaagatg

SEQ ID NO: 140949 - DNA, 103 bp, Artificial Sequence
  Synthetic Polynucleotide
taatacgactcactatagggatgccttgcgacggcgcggcgtgggcgccaaacagaggagatggcgcatgcgccgcgccaacctggcggcagcgcaaaagatg

SEQ ID NO: 140950 - DNA, 103 bp, Artificial Sequence
  Synthetic Polynucleotide
taatacgactcactatagggggctcgggggatgccttgcgacggcgcggcaacagaggagagccgcgatgtcgcaaggcaacctggcggcagcgcaaaagatg

SEQ ID NO: 140951 - DNA, 103 bp, Artificial Sequence
  Synthetic Polynucleotide
taatacgactcactatagggctcgccctccggctcgggggatgccttgcgaacagaggagacgcaagatgtcccccgagaacctggcggcagcgcaaaagatg

SEQ ID NO: 140952 - DNA, 103 bp, Artificial Sequence
  Synthetic Polynucleotide
taatacgactcactatagggtcccagccgcctcgccctccggctcgggggaacagaggagacccccgatgcggagggcgaacctggcggcagcgcaaaagatg

SEQ ID NO: 140953 - DNA, 103 bp, Artificial Sequence
  Synthetic Polynucleotide
taatacgactcactataggggtggtcatcttcccagccgcctcgccctccaacagaggagaggagggatgggcggctggaacctggcggcagcgcaaaagatg

SEQ ID NO: 140954 - DNA, 103 bp, Artificial Sequence
  Synthetic Polynucleotide
taatacgactcactatagggctgctcctcggtggtcatcttcccagccgcaacagaggagagcggctatgaagatgaccaacctggcggcagcgcaaaagatg

SEQ ID NO: 140955 - DNA, 103 bp, Artificial Sequence
  Synthetic Polynucleotide
taatacgactcactataggggccgttgctgctgctcctcggtggtcatctaacagaggagaagatgaatgccgaggagcaacctggcggcagcgcaaaagatg

SEQ ID NO: 140956 - DNA, 103 bp, Artificial Sequence
  Synthetic Polynucleotide
taatacgactcactatagggagttcgatgcggtccgcgccctcgaagttcaacagaggagagaacttatggggcgcggaaacctggcggcagcgcaaaagatg

SEQ ID NO: 140957 - DNA, 103 bp, Artificial Sequence
  Synthetic Polynucleotide
taatacgactcactataggggccacccagtgccgttgctgctgctcctcgaacagaggagacgaggaatggcagcaacgaacctggcggcagcgcaaaagatg

SEQ ID NO: 140958 - DNA, 103 bp, Artificial Sequence
  Synthetic Polynucleotide
taatacgactcactataggggccgccgggtgccacccagtgccgttgctgaacagaggagacagcaaatgcactgggtgaacctggcggcagcgcaaaagatg

SEQ ID NO: 140959 - DNA, 103 bp, Artificial Sequence
  Synthetic Polynucleotide
taatacgactcactatagggcggagtacgggccgccgggtgccacccagtaacagaggagaactgggatgcacccggcgaacctggcggcagcgcaaaagatg

SEQ ID NO: 140960 - DNA, 103 bp, Artificial Sequence
  Synthetic Polynucleotide
taatacgactcactatagggggggtctcagcggagtacgggccgccgggtaacagaggagaacccggatgcccgtactcaacctggcggcagcgcaaaagatg

SEQ ID NO: 140961 - DNA, 103 bp, Artificial Sequence
  Synthetic Polynucleotide
taatacgactcactataggggggcacaccaggggtctcagcggagtacggaacagaggagaccgtacatggctgagaccaacctggcggcagcgcaaaagatg

SEQ ID NO: 140962 - DNA, 103 bp, Artificial Sequence
  Synthetic Polynucleotide
taatacgactcactatagggcaatgggcgagggcacaccaggggtctcagaacagaggagactgagaatgctggtgtgcaacctggcggcagcgcaaaagatg

SEQ ID NO: 140963 - DNA, 103 bp, Artificial Sequence
  Synthetic Polynucleotide
taatacgactcactatagggttcagggcggcaatgggcgagggcacaccaaacagaggagatggtgtatgctcgcccataacctggcggcagcgcaaaagatg

SEQ ID NO: 140964 - DNA, 103 bp, Artificial Sequence
  Synthetic Polynucleotide
taatacgactcactatagggggccacattcttcagggcggcaatgggcgaaacagaggagatcgcccatggccgccctgaacctggcggcagcgcaaaagatg

SEQ ID NO: 140965 - DNA, 103 bp, Artificial Sequence
  Synthetic Polynucleotide
taatacgactcactatagggccagggcttcggccacattcttcagggcggaacagaggagaccgcccatgagaatgtggaacctggcggcagcgcaaaagatg

SEQ ID NO: 140966 - DNA, 103 bp, Artificial Sequence
  Synthetic Polynucleotide
taatacgactcactatagggggtgagtggcccagggcttcggccacattcaacagaggagagaatgtatgcgaagccctaacctggcggcagcgcaaaagatg

SEQ ID NO: 140967 - DNA, 103 bp, Artificial Sequence
  Synthetic Polynucleotide
taatacgactcactatagggatcgatgagcagttcgatgcggtccgcgccaacagaggagaggcgcgatgcgcatcgaaaacctggcggcagcgcaaaagatg

SEQ ID NO: 140968 - DNA, 103 bp, Artificial Sequence
  Synthetic Polynucleotide
taatacgactcactatagggagggtccttgggtgagtggcccagggcttcaacagaggagagaagccatgggccactcaaacctggcggcagcgcaaaagatg

SEQ ID NO: 140969 - DNA, 103 bp, Artificial Sequence
  Synthetic Polynucleotide
taatacgactcactatagggcgcctccgccagggtccttgggtgagtggcaacagaggagagccactatgccaaggaccaacctggcggcagcgcaaaagatg

SEQ ID NO: 140970 - DNA, 103 bp, Artificial Sequence
  Synthetic Polynucleotide
taatacgactcactatagggacaggccccccgcctccgccagggtccttgaacagaggagacaaggaatgtggcggaggaacctggcggcagcgcaaaagatg

SEQ ID NO: 140971 - DNA, 103 bp, Artificial Sequence
  Synthetic Polynucleotide
taatacgactcactatagggccctgcacgcacaggccccccgcctccgccaacagaggagaggcggaatgggggggcctaacctggcggcagcgcaaaagatg

SEQ ID NO: 140972 - DNA, 103 bp, Artificial Sequence
  Synthetic Polynucleotide
taatacgactcactatagggggctggcgccccctgcacgcacaggcccccaacagaggagagggggcatgtgcgtgcagaacctggcggcagcgcaaaagatg

SEQ ID NO: 140973 - DNA, 103 bp, Artificial Sequence
  Synthetic Polynucleotide
taatacgactcactataggggaggctgcagggctggcgccccctgcacgcaacagaggagagcgtgcatggggcgccagaacctggcggcagcgcaaaagatg

SEQ ID NO: 140974 - DNA, 103 bp, Artificial Sequence
  Synthetic Polynucleotide
taatacgactcactatagggggccgtggaggaggctgcagggctggcgccaacagaggagaggcgccatgcctgcagccaacctggcggcagcgcaaaagatg

SEQ ID NO: 140975 - DNA, 103 bp, Artificial Sequence
  Synthetic Polynucleotide
taatacgactcactatagggttggcggctgggccgtggaggaggctgcagaacagaggagactgcagatgcctccacggaacctggcggcagcgcaaaagatg

SEQ ID NO: 140976 - DNA, 103 bp, Artificial Sequence
  Synthetic Polynucleotide
taatacgactcactatagggcgatgctgggttggcggctgggccgtggagaacagaggagactccacatgccagccgccaacctggcggcagcgcaaaagatg

SEQ ID NO: 140977 - DNA, 103 bp, Artificial Sequence
  Synthetic Polynucleotide
taatacgactcactatagggggccacaaggcgatgctgggttggcggctgaacagaggagacagccgatgacccagcataacctggcggcagcgcaaaagatg

SEQ ID NO: 140978 - DNA, 103 bp, Artificial Sequence
  Synthetic Polynucleotide
taatacgactcactatagggggcgggcggcatcgatgagcagttcgatgcaacagaggagagcatcgatgtgctcatcgaacctggcggcagcgcaaaagatg

SEQ ID NO: 140979 - DNA, 103 bp, Artificial Sequence
  Synthetic Polynucleotide
taatacgactcactatagggcgccgttgcgggccacaaggcgatgctgggaacagaggagacccagcatggccttgtggaacctggcggcagcgcaaaagatg

SEQ ID NO: 140980 - DNA, 103 bp, Artificial Sequence
  Synthetic Polynucleotide
taatacgactcactatagggacttctgcttcgccgttgcgggccacaaggaacagaggagaccttgtatgccgcaacggaacctggcggcagcgcaaaagatg

SEQ ID NO: 140981 - DNA, 103 bp, Artificial Sequence
  Synthetic Polynucleotide
taatacgactcactatagggtgtgggactgacttctgcttcgccgttgcgaacagaggagacgcaacatggaagcagaaaacctggcggcagcgcaaaagatg

SEQ ID NO: 140982 - DNA, 103 bp, Artificial Sequence
  Synthetic Polynucleotide
taatacgactcactatagggcggcccccgctgtgggactgacttctgcttaacagaggagaaagcagatgtcagtcccaaacctggcggcagcgcaaaagatg

SEQ ID NO: 140983 - DNA, 103 bp, Artificial Sequence
  Synthetic Polynucleotide
taatacgactcactatagggctgacagcttcggcccccgctgtgggactgaacagaggagacagtccatgagcgggggcaacctggcggcagcgcaaaagatg

SEQ ID NO: 140984 - DNA, 103 bp, Artificial Sequence
  Synthetic Polynucleotide
taatacgactcactataggggccacccccgctgacagcttcggcccccgcaacagaggagagcggggatggaagctgtcaacctggcggcagcgcaaaagatg

SEQ ID NO: 140985 - DNA, 103 bp, Artificial Sequence
  Synthetic Polynucleotide
taatacgactcactatagggcagtgccgctgccacccccgctgacagcttaacagaggagaaagctgatggcgggggtgaacctggcggcagcgcaaaagatg

SEQ ID NO: 140986 - DNA, 103 bp, Artificial Sequence
  Synthetic Polynucleotide
taatacgactcactatagggggggtcgccccagtgccgctgccacccccgaacagaggagacgggggatgcagcggcacaacctggcggcagcgcaaaagatg

SEQ ID NO: 140987 - DNA, 103 bp, Artificial Sequence
  Synthetic Polynucleotide
taatacgactcactataggggggggccccaggggtcgccccagtgccgctaacagaggagaagcggcatgggggcgaccaacctggcggcagcgcaaaagatg

SEQ ID NO: 140988 - DNA, 103 bp, Artificial Sequence
  Synthetic Polynucleotide
taatacgactcactatagggtacagcacaggggggccccaggggtcgcccaacagaggagagggcgaatgctggggcccaacctggcggcagcgcaaaagatg

SEQ ID NO: 140989 - DNA, 103 bp, Artificial Sequence
  Synthetic Polynucleotide
taatacgactcactatagggcgcttgagctggcgggcggcatcgatgagcaacagaggagagctcatatgtgccgcccgaacctggcggcagcgcaaaagatg

SEQ ID NO: 140990 - DNA, 103 bp, Artificial Sequence
  Synthetic Polynucleotide
taatacgactcactatagggctgcacagggtacagcacaggggggccccaaacagaggagatggggcatgcctgtgctgaacctggcggcagcgcaaaagatg

SEQ ID NO: 140991 - DNA, 103 bp, Artificial Sequence
  Synthetic Polynucleotide
taatacgactcactatagggtagccgctccctgcacagggtacagcacagaacagaggagactgtgcatgaccctgtgcaacctggcggcagcgcaaaagatg

SEQ ID NO: 140992 - DNA, 103 bp, Artificial Sequence
  Synthetic Polynucleotide
taatacgactcactataggggggtgtcttctagccgctccctgcacagggaacagaggagaccctgtatggggagcggcaacctggcggcagcgcaaaagatg

SEQ ID NO: 140993 - DNA, 103 bp, Artificial Sequence
  Synthetic Polynucleotide
taatacgactcactatagggtggacgaagtgggtgtcttctagccgctccaacagaggagaggagcgatgagaagacacaacctggcggcagcgcaaaagatg

SEQ ID NO: 140994 - DNA, 103 bp, Artificial Sequence
  Synthetic Polynucleotide
taatacgactcactatagggcgaggggcactggacgaagtgggtgtcttcaacagaggagagaagacatgcacttcgtcaacctggcggcagcgcaaaagatg

SEQ ID NO: 140995 - DNA, 103 bp, Artificial Sequence
  Synthetic Polynucleotide
taatacgactcactataggggtccgggcaccgaggggcactggacgaagtaacagaggagaacttcgatgagtgcccctaacctggcggcagcgcaaaagatg

SEQ ID NO: 140996 - DNA, 103 bp, Artificial Sequence
  Synthetic Polynucleotide
taatacgactcactatagggcagaacttgtgtccgggcaccgaggggcacaacagaggagagtgcccatgggtgcccggaacctggcggcagcgcaaaagatg

SEQ ID NO: 140997 - DNA, 103 bp, Artificial Sequence
  Synthetic Polynucleotide
taatacgactcactataggggcagggaaagcagaacttgtgtccgggcacaacagaggagagtgcccatgcacaagttcaacctggcggcagcgcaaaagatg

SEQ ID NO: 140998 - DNA, 103 bp, Artificial Sequence
  Synthetic Polynucleotide
taatacgactcactatagggactcccgggagcagggaaagcagaacttgtaacagaggagaacaagtatggctttccctaacctggcggcagcgcaaaagatg

SEQ ID NO: 140999 - DNA, 103 bp, Artificial Sequence
  Synthetic Polynucleotide
taatacgactcactataggggccttgatgaactcccgggagcagggaaagaacagaggagactttccatgctcccgggaaacctggcggcagcgcaaaagatg

SEQ ID NO: 141000 - DNA, 103 bp, Artificial Sequence
  Synthetic Polynucleotide
taatacgactcactatagggcacgtggctgcgcttgagctggcgggcggcaacagaggagagccgccatgcagctcaagaacctggcggcagcgcaaaagatg

SEQ ID NO: 141001 - DNA, 103 bp, Artificial Sequence
  Synthetic Polynucleotide
taatacgactcactatagggcgggccctgcgccttgatgaactcccgggaaacagaggagatcccggatgttcatcaagaacctggcggcagcgcaaaagatg

SEQ ID NO: 141002 - DNA, 103 bp, Artificial Sequence
  Synthetic Polynucleotide
taatacgactcactatagggcctccccggccgggccctgcgccttgatgaaacagaggagatcatcaatgcgcagggccaacctggcggcagcgcaaaagatg

SEQ ID NO: 141003 - DNA, 103 bp, Artificial Sequence
  Synthetic Polynucleotide
taatacgactcactataggggggcagtacacctccccggccgggccctgcaacagaggagagcagggatgggccggggaaacctggcggcagcgcaaaagatg

SEQ ID NO: 141004 - DNA, 103 bp, Artificial Sequence
  Synthetic Polynucleotide
taatacgactcactataggggtctccgctcgggcagtacacctccccggcaacagaggagagccgggatggtgtactgcaacctggcggcagcgcaaaagatg

SEQ ID NO: 141005 - DNA, 103 bp, Artificial Sequence
  Synthetic Polynucleotide
taatacgactcactataggggcgggcacttgtctccgctcgggcagtacaaacagaggagatgtactatgcgagcggagaacctggcggcagcgcaaaagatg

SEQ ID NO: 141006 - DNA, 103 bp, Artificial Sequence
  Synthetic Polynucleotide
taatacgactcactataggggagccgaccagcgggcacttgtctccgctcaacagaggagagagcggatgcaagtgcccaacctggcggcagcgcaaaagatg

SEQ ID NO: 141007 - DNA, 103 bp, Artificial Sequence
  Synthetic Polynucleotide
taatacgactcactataggggggcacggaggagccgaccagcgggcacttaacagaggagaaagtgcatgctggtcggcaacctggcggcagcgcaaaagatg

SEQ ID NO: 141008 - DNA, 103 bp, Artificial Sequence
  Synthetic Polynucleotide
taatacgactcactatagggtgaaggcccagggcacggaggagccgaccaaacagaggagatggtcgatgcctccgtgcaacctggcggcagcgcaaaagatg

SEQ ID NO: 141009 - DNA, 103 bp, Artificial Sequence
  Synthetic Polynucleotide
taatacgactcactatagggtcgccctgcatgaaggcccagggcacggagaacagaggagactccgtatgctgggccttaacctggcggcagcgcaaaagatg

SEQ ID NO: 141010 - DNA, 103 bp, Artificial Sequence
  Synthetic Polynucleotide
taatacgactcactatagggggtggcgatctcgccctgcatgaaggcccaaacagaggagatgggccatgatgcagggcaacctggcggcagcgcaaaagatg

SEQ ID NO: 141011 - DNA, 103 bp, Artificial Sequence
  Synthetic Polynucleotide
taatacgactcactatagggcctcggggagcacgtggctgcgcttgagctaacagaggagaagctcaatggcagccacgaacctggcggcagcgcaaaagatg

SEQ ID NO: 141012 - DNA, 103 bp, Artificial Sequence
  Synthetic Polynucleotide
taatacgactcactatagggcagcaaggatggtggcgatctcgccctgcaaacagaggagatgcaggatgagatcgccaaacctggcggcagcgcaaaagatg

SEQ ID NO: 141013 - DNA, 103 bp, Artificial Sequence
  Synthetic Polynucleotide
taatacgactcactatagggttgatgtctccagcaaggatggtggcgatcaacagaggagagatcgcatgcatccttgcaacctggcggcagcgcaaaagatg

SEQ ID NO: 141014 - DNA, 103 bp, Artificial Sequence
  Synthetic Polynucleotide
taatacgactcactatagggtttcttaactttgatgtctccagcaaggataacagaggagaatccttatgggagacatcaacctggcggcagcgcaaaagatg

SEQ ID NO: 141015 - DNA, 103 bp, Artificial Sequence
  Synthetic Polynucleotide
taatacgactcactatagggggtcccgttctttcttaactttgatgtctcaacagaggagagagacaatgaagttaagaaacctggcggcagcgcaaaagatg

SEQ ID NO: 141016 - DNA, 103 bp, Artificial Sequence
  Synthetic Polynucleotide
taatacgactcactatagggggcgagcggccctcggggagcacgtggctgaacagaggagacagccaatggctccccgaaacctggcggcagcgcaaaagatg

SEQ ID NO: 141017 - DNA, 103 bp, Artificial Sequence
  Synthetic Polynucleotide
taatacgactcactatagggcgggggcccgggcgagcggccctcggggagaacagaggagactccccatgggccgctcgaacctggcggcagcgcaaaagatg

SEQ ID NO: 141018 - DNA, 103 bp, Artificial Sequence
  Synthetic Polynucleotide
taatacgactcactatagggggtagcaccactggcggcgggacgcctgcaaacagaggagatgcaggatgcccgccgccaacctggcggcagcgcaaaagatg

SEQ ID NO: 141019 - DNA, 103 bp, Artificial Sequence
  Synthetic Polynucleotide
taatacgactcactataggggcttaagggccgggggcccgggcgagcggcaacagaggagagccgctatgccgggccccaacctggcggcagcgcaaaagatg

SEQ ID NO: 141020 - DNA, 103 bp, Artificial Sequence
  Synthetic Polynucleotide
taatacgactcactataggggtggccgggtgcttaagggccgggggcccgaacagaggagacgggccatgggcccttaaaacctggcggcagcgcaaaagatg

SEQ ID NO: 141021 - DNA, 103 bp, Artificial Sequence
  Synthetic Polynucleotide
taatacgactcactatagggcaggtccttggtggccgggtgcttaagggcaacagaggagagcccttatgcacccggccaacctggcggcagcgcaaaagatg

SEQ ID NO: 141022 - DNA, 103 bp, Artificial Sequence
  Synthetic Polynucleotide
taatacgactcactatagggctgccgccgccaggtccttggtggccgggtaacagaggagaacccggatgccaaggaccaacctggcggcagcgcaaaagatg

SEQ ID NO: 141023 - DNA, 103 bp, Artificial Sequence
  Synthetic Polynucleotide
taatacgactcactatagggccctgtgcggctgccgccgccaggtccttgaacagaggagacaaggaatgggcggcggcaacctggcggcagcgcaaaagatg

SEQ ID NO: 141024 - DNA, 103 bp, Artificial Sequence
  Synthetic Polynucleotide
taatacgactcactatagggcagctggggcccctgtgcggctgccgccgcaacagaggagagcggcgatggccgcacagaacctggcggcagcgcaaaagatg

SEQ ID NO: 141025 - DNA, 103 bp, Artificial Sequence
  Synthetic Polynucleotide
taatacgactcactataggggcgggggcggcagctggggcccctgtgcggaacagaggagaccgcacatgggccccagcaacctggcggcagcgcaaaagatg

SEQ ID NO: 141026 - DNA, 103 bp, Artificial Sequence
  Synthetic Polynucleotide
taatacgactcactatagggggctgggcctgcgggggcggcagctggggcaacagaggagagccccaatggccgcccccaacctggcggcagcgcaaaagatg

SEQ ID NO: 141027 - DNA, 103 bp, Artificial Sequence
  Synthetic Polynucleotide
taatacgactcactatagggtgacggctggggctgggcctgcgggggcggaacagaggagaccgcccatgcaggcccagaacctggcggcagcgcaaaagatg

SEQ ID NO: 141028 - DNA, 103 bp, Artificial Sequence
  Synthetic Polynucleotide
taatacgactcactatagggcgccggtccctgacggctggggctgggcctaacagaggagaaggcccatgcccagccgtaacctggcggcagcgcaaaagatg

SEQ ID NO: 141029 - DNA, 103 bp, Artificial Sequence
  Synthetic Polynucleotide
taatacgactcactatagggaggtcgcacaggtagcaccactggcggcggaacagaggagaccgccgatggtggtgctaaacctggcggcagcgcaaaagatg

SEQ ID NO: 141030 - DNA, 103 bp, Artificial Sequence
  Synthetic Polynucleotide
taatacgactcactataggggacacgccgccgccggtccctgacggctggaacagaggagaccagccatgagggaccggaacctggcggcagcgcaaaagatg

SEQ ID NO: 141031 - DNA, 103 bp, Artificial Sequence
  Synthetic Polynucleotide
taatacgactcactataggggtcctggcccgacacgccgccgccggtcccaacagaggagagggaccatgggcggcgtgaacctggcggcagcgcaaaagatg

SEQ ID NO: 141032 - DNA, 103 bp, Artificial Sequence
  Synthetic Polynucleotide
taatacgactcactatagggtgtcatagcggtcctggcccgacacgccgcaacagaggagagcggcgatgcgggccaggaacctggcggcagcgcaaaagatg

SEQ ID NO: 141033 - DNA, 103 bp, Artificial Sequence
  Synthetic Polynucleotide
taatacgactcactataggggatgtggccctgtcatagcggtcctggcccaacagaggagagggccaatgccgctatgaaacctggcggcagcgcaaaagatg

SEQ ID NO: 141034 - DNA, 103 bp, Artificial Sequence
  Synthetic Polynucleotide
taatacgactcactataggggcggcctgatgatgtggccctgtcatagcgaacagaggagacgctatatgagggccacaaacctggcggcagcgcaaaagatg

SEQ ID NO: 141035 - DNA, 103 bp, Artificial Sequence
  Synthetic Polynucleotide
taatacgactcactataggggcagggggaggcggcctgatgatgtggcccaacagaggagagggccaatgcatcaggccaacctggcggcagcgcaaaagatg

SEQ ID NO: 141036 - DNA, 103 bp, Artificial Sequence
  Synthetic Polynucleotide
taatacgactcactataggggcgggcgagggcagggggaggcggcctgataacagaggagaatcaggatgcctccccctaacctggcggcagcgcaaaagatg

SEQ ID NO: 141037 - DNA, 103 bp, Artificial Sequence
  Synthetic Polynucleotide
taatacgactcactataggggtactccagggcgggcgagggcagggggagaacagaggagactccccatgccctcgcccaacctggcggcagcgcaaaagatg

SEQ ID NO: 141038 - DNA, 103 bp, Artificial Sequence
  Synthetic Polynucleotide
taatacgactcactatagggaccccagagtgtactccagggcgggcgaggaacagaggagacctcgcatgccctggagtaacctggcggcagcgcaaaagatg

SEQ ID NO: 141039 - DNA, 103 bp, Artificial Sequence
  Synthetic Polynucleotide
taatacgactcactataggggccaggcgggaccccagagtgtactccaggaacagaggagacctggaatgcactctgggaacctggcggcagcgcaaaagatg

SEQ ID NO: 141040 - DNA, 103 bp, Artificial Sequence
  Synthetic Polynucleotide
taatacgactcactatagggcatcttgggcaggtcgcacaggtagcaccaaacagaggagatggtgcatgctgtgcgacaacctggcggcagcgcaaaagatg

SEQ ID NO: 141041 - DNA, 103 bp, Artificial Sequence
  Synthetic Polynucleotide
taatacgactcactatagggcagcccattggccaggcgggaccccagagtaacagaggagaactctgatgtcccgcctgaacctggcggcagcgcaaaagatg

SEQ ID NO: 141042 - DNA, 103 bp, Artificial Sequence
  Synthetic Polynucleotide
taatacgactcactatagggcctcacggcccagcccattggccaggcgggaacagaggagacccgccatgccaatgggcaacctggcggcagcgcaaaagatg

SEQ ID NO: 141043 - DNA, 103 bp, Artificial Sequence
  Synthetic Polynucleotide
taatacgactcactataggggccacggcctcctcacggcccagcccattgaacagaggagacaatggatggggccgtgaaacctggcggcagcgcaaaagatg

SEQ ID NO: 141044 - DNA, 103 bp, Artificial Sequence
  Synthetic Polynucleotide
taatacgactcactatagggcgccccctcagccacggcctcctcacggccaacagaggagaggccgtatggaggccgtgaacctggcggcagcgcaaaagatg

SEQ ID NO: 141045 - DNA, 103 bp, Artificial Sequence
  Synthetic Polynucleotide
taatacgactcactatagggaggcccttcgcgccccctcagccacggcctaacagaggagaaggccgatgctgagggggaacctggcggcagcgcaaaagatg

SEQ ID NO: 141046 - DNA, 103 bp, Artificial Sequence
  Synthetic Polynucleotide
taatacgactcactataggggagccaagcaaggcccttcgcgccccctcaaacagaggagatgagggatggcgaagggcaacctggcggcagcgcaaaagatg

SEQ ID NO: 141047 - DNA, 103 bp, Artificial Sequence
  Synthetic Polynucleotide
taatacgactcactataggggccaggcatggagccaagcaaggcccttcgaacagaggagacgaaggatgttgcttggcaacctggcggcagcgcaaaagatg

SEQ ID NO: 141048 - DNA, 103 bp, Artificial Sequence
  Synthetic Polynucleotide
taatacgactcactatagggggggcatcaagccaggcatggagccaagcaaacagaggagatgcttgatgccatgcctgaacctggcggcagcgcaaaagatg

SEQ ID NO: 141049 - DNA, 103 bp, Artificial Sequence
  Synthetic Polynucleotide
taatacgactcactatagggagcagcccagggggcatcaagccaggcatgaacagaggagacatgccatgcttgatgccaacctggcggcagcgcaaaagatg

SEQ ID NO: 141050 - DNA, 103 bp, Artificial Sequence
  Synthetic Polynucleotide
taatacgactcactatagggtgcagctgccagcagcccagggggcatcaaaacagaggagattgatgatgcctgggctgaacctggcggcagcgcaaaagatg

SEQ ID NO: 141051 - DNA, 103 bp, Artificial Sequence
  Synthetic Polynucleotide
taatacgactcactatagggtggcccacggcatcttgggcaggtcgcacaaacagaggagatgtgcgatgtgcccaagaaacctggcggcagcgcaaaagatg

SEQ ID NO: 141052 - DNA, 103 bp, Artificial Sequence
  Synthetic Polynucleotide
taatacgactcactatagggggccagacactgcagctgccagcagcccagaacagaggagactgggcatgtggcagctgaacctggcggcagcgcaaaagatg

SEQ ID NO: 141053 - DNA, 103 bp, Artificial Sequence
  Synthetic Polynucleotide
taatacgactcactatagggcggcttcccaggccagacactgcagctgccaacagaggagaggcagcatgagtgtctggaacctggcggcagcgcaaaagatg

SEQ ID NO: 141054 - DNA, 103 bp, Artificial Sequence
  Synthetic Polynucleotide
taatacgactcactatagggcgtcaggcctcggcttcccaggccagacacaacagaggagagtgtctatgctgggaagcaacctggcggcagcgcaaaagatg

SEQ ID NO: 141055 - DNA, 103 bp, Artificial Sequence
  Synthetic Polynucleotide
taatacgactcactatagggcgggtgccagcgtcaggcctcggcttcccaaacagaggagatgggaaatggaggcctgaaacctggcggcagcgcaaaagatg

SEQ ID NO: 141056 - DNA, 103 bp, Artificial Sequence
  Synthetic Polynucleotide
taatacgactcactatagggggactcaagccgggtgccagcgtcaggcctaacagaggagaaggcctatggctggcaccaacctggcggcagcgcaaaagatg

SEQ ID NO: 141057 - DNA, 103 bp, Artificial Sequence
  Synthetic Polynucleotide
taatacgactcactataggggggacgggcaggactcaagccgggtgccagaacagaggagactggcaatgggcttgagtaacctggcggcagcgcaaaagatg

SEQ ID NO: 141058 - DNA, 103 bp, Artificial Sequence
  Synthetic Polynucleotide
taatacgactcactatagggagccgaagaggggacgggcaggactcaagcaacagaggagagcttgaatgctgcccgtcaacctggcggcagcgcaaaagatg

SEQ ID NO: 141059 - DNA, 103 bp, Artificial Sequence
  Synthetic Polynucleotide
taatacgactcactatagggtcgaaatcggagccgaagaggggacgggcaaacagaggagatgcccgatgcctcttcggaacctggcggcagcgcaaaagatg

SEQ ID NO: 141060 - DNA, 103 bp, Artificial Sequence
  Synthetic Polynucleotide
taatacgactcactatagggcttctctttctcgaaatcggagccgaagagaacagaggagactcttcatgtccgatttcaacctggcggcagcgcaaaagatg

SEQ ID NO: 141061 - DNA, 103 bp, Artificial Sequence
  Synthetic Polynucleotide
taatacgactcactatagggtcctctgctgcttctctttctcgaaatcggaacagaggagaccgattatgagaaagagaaacctggcggcagcgcaaaagatg

SEQ ID NO: 141062 - DNA, 103 bp, Artificial Sequence
  Synthetic Polynucleotide
taatacgactcactatagggtcccacaccatggcccacggcatcttgggcaacagaggagagcccaaatggccgtgggcaacctggcggcagcgcaaaagatg

SEQ ID NO: 141063 - DNA, 103 bp, Artificial Sequence
  Synthetic Polynucleotide
taatacgactcactatagggcagtccgcattcctctgctgcttctctttcaacagaggagagaaagaatggcagcagagaacctggcggcagcgcaaaagatg

SEQ ID NO: 141064 - DNA, 103 bp, Artificial Sequence
  Synthetic Polynucleotide
taatacgactcactatagggttctgccagacagtccgcattcctctgctgaacagaggagacagcagatgaatgcggacaacctggcggcagcgcaaaagatg

SEQ ID NO: 141065 - DNA, 103 bp, Artificial Sequence
  Synthetic Polynucleotide
taatacgactcactatagggcctcgttcagttctgccagacagtccgcataacagaggagaatgcggatggtctggcagaacctggcggcagcgcaaaagatg

SEQ ID NO: 141066 - DNA, 103 bp, Artificial Sequence
  Synthetic Polynucleotide
taatacgactcactatagggcctcgcatggcctcgttcagttctgccagaaacagaggagatctggcatgactgaacgaaacctggcggcagcgcaaaagatg

SEQ ID NO: 141067 - DNA, 103 bp, Artificial Sequence
  Synthetic Polynucleotide
taatacgactcactatagggctctgcccggcctcgcatggcctcgttcagaacagaggagactgaacatggccatgcgaaacctggcggcagcgcaaaagatg

SEQ ID NO: 141068 - DNA, 103 bp, Artificial Sequence
  Synthetic Polynucleotide
taatacgactcactatagggcgtgccattcctctgcccggcctcgcatggaacagaggagaccatgcatggccgggcagaacctggcggcagcgcaaaagatg

SEQ ID NO: 141069 - DNA, 103 bp, Artificial Sequence
  Synthetic Polynucleotide
taatacgactcactatagggttggggcgcccgtgccattcctctgcccggaacagaggagaccgggcatgggaatggcaaacctggcggcagcgcaaaagatg

SEQ ID NO: 141070 - DNA, 103 bp, Artificial Sequence
  Synthetic Polynucleotide
taatacgactcactatagggccgcactgctttggggcgcccgtgccattcaacagaggagagaatggatggggcgccccaacctggcggcagcgcaaaagatg

SEQ ID NO: 141071 - DNA, 103 bp, Artificial Sequence
  Synthetic Polynucleotide
taatacgactcactataggggtagctgttcccgcactgctttggggcgccaacagaggagaggcgccatgaagcagtgcaacctggcggcagcgcaaaagatg

SEQ ID NO: 141072 - DNA, 103 bp, Artificial Sequence
  Synthetic Polynucleotide
taatacgactcactataggggacagcgccagtagctgttcccgcactgctaacagaggagaagcagtatgggaacagctaacctggcggcagcgcaaaagatg

SEQ ID NO: 141073 - DNA, 103 bp, Artificial Sequence
  Synthetic Polynucleotide
taatacgactcactatagggctcgctgaagtcccacaccatggcccacggaacagaggagaccgtggatgatggtgtggaacctggcggcagcgcaaaagatg

SEQ ID NO: 141074 - DNA, 103 bp, Artificial Sequence
  Synthetic Polynucleotide
taatacgactcactatagggggcgcaggcggacagcgccagtagctgttcaacagaggagagaacagatgctggcgctgaacctggcggcagcgcaaaagatg

SEQ ID NO: 141075 - DNA, 103 bp, Artificial Sequence
  Synthetic Polynucleotide
taatacgactcactatagggcattgaacggggcgcaggcggacagcgccaaacagaggagatggcgcatgccgcctgcgaacctggcggcagcgcaaaagatg

SEQ ID NO: 141076 - DNA, 103 bp, Artificial Sequence
  Synthetic Polynucleotide
taatacgactcactatagggttgaagcgcacattgaacggggcgcaggcgaacagaggagacgcctgatgcccgttcaaaacctggcggcagcgcaaaagatg

SEQ ID NO: 141077 - DNA, 103 bp, Artificial Sequence
  Synthetic Polynucleotide
taatacgactcactataggggtgatccttcttgaagcgcacattgaacggaacagaggagaccgttcatggtgcgcttcaacctggcggcagcgcaaaagatg

SEQ ID NO: 141078 - DNA, 103 bp, Artificial Sequence
  Synthetic Polynucleotide
taatacgactcactatagggccaccagcccgtgatccttcttgaagcgcaaacagaggagatgcgctatgagaaggatcaacctggcggcagcgcaaaagatg

SEQ ID NO: 141079 - DNA, 103 bp, Artificial Sequence
  Synthetic Polynucleotide
taatacgactcactatagggaacactcgccccaccagcccgtgatccttcaacagaggagagaaggaatgcgggctggtaacctggcggcagcgcaaaagatg

SEQ ID NO: 141080 - DNA, 103 bp, Artificial Sequence
  Synthetic Polynucleotide
taatacgactcactatagggatcgaaggcgaacactcgccccaccagcccaacagaggagagggctgatggggcgagtgaacctggcggcagcgcaaaagatg

SEQ ID NO: 141081 - DNA, 103 bp, Artificial Sequence
  Synthetic Polynucleotide
taatacgactcactataggggggcagtagcatcgaaggcgaacactcgccaacagaggagaggcgagatgtcgccttcgaacctggcggcagcgcaaaagatg

SEQ ID NO: 141082 - DNA, 103 bp, Artificial Sequence
  Synthetic Polynucleotide
taatacgactcactatagggcctggaggacgggcagtagcatcgaaggcgaacagaggagacgccttatgtgctactgcaacctggcggcagcgcaaaagatg

SEQ ID NO: 141083 - DNA, 103 bp, Artificial Sequence
  Synthetic Polynucleotide
taatacgactcactataggggaactcgtatcctggaggacgggcagtagcaacagaggagagctactatgcgtcctccaaacctggcggcagcgcaaaagatg

SEQ ID NO: 141084 - DNA, 103 bp, Artificial Sequence
  Synthetic Polynucleotide
taatacgactcactataggggacacacggcctcgctgaagtcccacaccaaacagaggagatggtgtatgacttcagcgaacctggcggcagcgcaaaagatg

SEQ ID NO: 141085 - DNA, 103 bp, Artificial Sequence
  Synthetic Polynucleotide
taatacgactcactataggggcttcagctcgaactcgtatcctggaggacaacagaggagagtcctcatggatacgagtaacctggcggcagcgcaaaagatg

SEQ ID NO: 141086 - DNA, 103 bp, Artificial Sequence
  Synthetic Polynucleotide
taatacgactcactatagggtcggtgaagagcttcagctcgaactcgtataacagaggagaatacgaatgcgagctgaaaacctggcggcagcgcaaaagatg

SEQ ID NO: 141087 - DNA, 103 bp, Artificial Sequence
  Synthetic Polynucleotide
taatacgactcactatagggacaggggtattcggtgaagagcttcagctcaacagaggagagagctgatgctcttcaccaacctggcggcagcgcaaaagatg

SEQ ID NO: 141088 - DNA, 103 bp, Artificial Sequence
  Synthetic Polynucleotide
taatacgactcactatagggtgccggaaccacaggggtattcggtgaagaaacagaggagatcttcaatgaatacccctaacctggcggcagcgcaaaagatg

SEQ ID NO: 141089 - DNA, 103 bp, Artificial Sequence
  Synthetic Polynucleotide
taatacgactcactataggggcgtacacattgccggaaccacaggggtataacagaggagaatacccatgtggttccggaacctggcggcagcgcaaaagatg

SEQ ID NO: 141090 - DNA, 103 bp, Artificial Sequence
  Synthetic Polynucleotide
taatacgactcactatagggcaggacgccggcgtacacattgccggaaccaacagaggagaggttccatgaatgtgtacaacctggcggcagcgcaaaagatg

SEQ ID NO: 141091 - DNA, 103 bp, Artificial Sequence
  Synthetic Polynucleotide
taatacgactcactataggggagccactgccaggacgccggcgtacacataacagaggagaatgtgtatgccggcgtccaacctggcggcagcgcaaaagatg

SEQ ID NO: 141092 - DNA, 103 bp, Artificial Sequence
  Synthetic Polynucleotide
taatacgactcactatagggaacatctggcgagccactgccaggacgccgaacagaggagacggcgtatgggcagtggcaacctggcggcagcgcaaaagatg

SEQ ID NO: 141093 - DNA, 103 bp, Artificial Sequence
  Synthetic Polynucleotide
taatacgactcactatagggagcatcgtggaacatctggcgagccactgcaacagaggagagcagtgatgcgccagatgaacctggcggcagcgcaaaagatg

SEQ ID NO: 141094 - DNA, 103 bp, Artificial Sequence
  Synthetic Polynucleotide
taatacgactcactataggggctcccgcagagcatcgtggaacatctggcaacagaggagagccagaatgtccacgatgaacctggcggcagcgcaaaagatg

SEQ ID NO: 141095 - DNA, 103 bp, Artificial Sequence
  Synthetic Polynucleotide
taatacgactcactatagggacgcagccgcgacacacggcctcgctgaagaacagaggagacttcagatgggccgtgtgaacctggcggcagcgcaaaagatg

SEQ ID NO: 141096 - DNA, 103 bp, Artificial Sequence
  Synthetic Polynucleotide
taatacgactcactataggggccttgcccggctcccgcagagcatcgtggaacagaggagaccacgaatgtctgcgggaaacctggcggcagcgcaaaagatg

SEQ ID NO: 141097 - DNA, 103 bp, Artificial Sequence
  Synthetic Polynucleotide
taatacgactcactatagggagaagccagtgccttgcccggctcccgcagaacagaggagactgcggatgccgggcaagaacctggcggcagcgcaaaagatg

SEQ ID NO: 141098 - DNA, 103 bp, Artificial Sequence
  Synthetic Polynucleotide
taatacgactcactatagggtgaagcccgaagaagccagtgccttgcccgaacagaggagacgggcaatgcactggcttaacctggcggcagcgcaaaagatg

SEQ ID NO: 141099 - DNA, 103 bp, Artificial Sequence
  Synthetic Polynucleotide
taatacgactcactatagggtcgaggtacttgaagcccgaagaagccagtaacagaggagaactggcatgttcgggcttaacctggcggcagcgcaaaagatg

SEQ ID NO: 141100 - DNA, 103 bp, Artificial Sequence
  Synthetic Polynucleotide
taatacgactcactataggggcgttcatattcgaggtacttgaagcccgaaacagaggagatcgggcatgaagtacctcaacctggcggcagcgcaaaagatg

SEQ ID NO: 141101 - DNA, 103 bp, Artificial Sequence
  Synthetic Polynucleotide
taatacgactcactatagggatccatgccggcgttcatattcgaggtactaacagaggagaagtaccatgaatatgaacaacctggcggcagcgcaaaagatg

SEQ ID NO: 141102 - DNA, 103 bp, Artificial Sequence
  Synthetic Polynucleotide
taatacgactcactatagggcattctcctgatccatgccggcgttcatataacagaggagaatatgaatgccggcatggaacctggcggcagcgcaaaagatg

SEQ ID NO: 141103 - DNA, 103 bp, Artificial Sequence
  Synthetic Polynucleotide
taatacgactcactatagggcagctgccgccattctcctgatccatgccgaacagaggagacggcatatgtcaggagaaaacctggcggcagcgcaaaagatg

SEQ ID NO: 141104 - DNA, 103 bp, Artificial Sequence
  Synthetic Polynucleotide
taatacgactcactataggggcagctcgcccagctgccgccattctcctgaacagaggagacaggagatgggcggcagcaacctggcggcagcgcaaaagatg

SEQ ID NO: 141105 - DNA, 103 bp, Artificial Sequence
  Synthetic Polynucleotide
taatacgactcactatagggccgtcggtaagcagctcgcccagctgccgcaacagaggagagcggcaatggggcgagctaacctggcggcagcgcaaaagatg

SEQ ID NO: 141106 - DNA, 103 bp, Artificial Sequence
  Synthetic Polynucleotide
taatacgactcactatagggcgcggccgccaccgccaccgccgcggccataacagaggagaatggccatggcggtggcgaacctggcggcagcgcaaaagatg

SEQ ID NO: 141107 - DNA, 103 bp, Artificial Sequence
  Synthetic Polynucleotide
taatacgactcactataggggcagccgcggcagacgggttcggtgaagtcaacagaggagagacttcatggaacccgtcaacctggcggcagcgcaaaagatg

SEQ ID NO: 141108 - DNA, 103 bp, Artificial Sequence
  Synthetic Polynucleotide
taatacgactcactatagggctcgaaacccaacaacctgcctgcagtcagaacagaggagactgactatgggcaggttgaacctggcggcagcgcaaaagatg

SEQ ID NO: 141109 - DNA, 103 bp, Artificial Sequence
  Synthetic Polynucleotide
taatacgactcactatagggccccgttggcctcgaaacccaacaacctgcaacagaggagagcaggtatgtgggtttcgaacctggcggcagcgcaaaagatg

SEQ ID NO: 141110 - DNA, 103 bp, Artificial Sequence
  Synthetic Polynucleotide
taatacgactcactataggggacccgttggccccgttggcctcgaaacccaacagaggagagggtttatgggccaacggaacctggcggcagcgcaaaagatg

SEQ ID NO: 141111 - DNA, 103 bp, Artificial Sequence
  Synthetic Polynucleotide
taatacgactcactatagggaactgctttagacccgttggccccgttggcaacagaggagagccaacatggccaacgggaacctggcggcagcgcaaaagatg

SEQ ID NO: 141112 - DNA, 103 bp, Artificial Sequence
  Synthetic Polynucleotide
taatacgactcactatagggctgttcttgcaactgctttagacccgttggaacagaggagaccaacgatgctaaagcagaacctggcggcagcgcaaaagatg

SEQ ID NO: 141113 - DNA, 103 bp, Artificial Sequence
  Synthetic Polynucleotide
taatacgactcactatagggcttttccttgctgttcttgcaactgctttaaacagaggagataaagcatgtgcaagaacaacctggcggcagcgcaaaagatg

SEQ ID NO: 141114 - DNA, 103 bp, Artificial Sequence
  Synthetic Polynucleotide
taatacgactcactatagggagagggcttccttttccttgctgttcttgcaacagaggagagcaagaatggcaaggaaaaacctggcggcagcgcaaaagatg

SEQ ID NO: 141115 - DNA, 103 bp, Artificial Sequence
  Synthetic Polynucleotide
taatacgactcactatagggctggttctggagagggcttccttttccttgaacagaggagacaaggaatgggaagccctaacctggcggcagcgcaaaagatg

SEQ ID NO: 141116 - DNA, 103 bp, Artificial Sequence
  Synthetic Polynucleotide
taatacgactcactatagggacttcaccttctggttctggagagggcttcaacagaggagagaagccatgtccagaaccaacctggcggcagcgcaaaagatg

SEQ ID NO: 141117 - DNA, 103 bp, Artificial Sequence
  Synthetic Polynucleotide
taatacgactcactatagggagggggcccgacttcaccttctggttctggaacagaggagaccagaaatggaaggtgaaaacctggcggcagcgcaaaagatg

SEQ ID NO: 141118 - DNA, 103 bp, Artificial Sequence
  Synthetic Polynucleotide
taatacgactcactatagggcgtagttgacgcagccgcggcagacgggttaacagaggagaaacccgatggccgcggctaacctggcggcagcgcaaaagatg

SEQ ID NO: 141119 - DNA, 103 bp, Artificial Sequence
  Synthetic Polynucleotide
taatacgactcactatagggcgttgatcttagggggcccgacttcaccttaacagaggagaaaggtgatgtcgggccccaacctggcggcagcgcaaaagatg

SEQ ID NO: 141120 - DNA, 103 bp, Artificial Sequence
  Synthetic Polynucleotide
taatacgactcactatagggtgggcctctccgttgatcttagggggcccgaacagaggagacgggccatgtaagatcaaaacctggcggcagcgcaaaagatg

SEQ ID NO: 141121 - DNA, 103 bp, Artificial Sequence
  Synthetic Polynucleotide
taatacgactcactatagggcagccacggctgggcctctccgttgatcttaacagaggagaaagatcatgggagaggccaacctggcggcagcgcaaaagatg

SEQ ID NO: 141122 - DNA, 103 bp, Artificial Sequence
  Synthetic Polynucleotide
taatacgactcactatagggtggatgtggacagccacggctgggcctctcaacagaggagagagaggatgagccgtggcaacctggcggcagcgcaaaagatg

SEQ ID NO: 141123 - DNA, 103 bp, Artificial Sequence
  Synthetic Polynucleotide
taatacgactcactatagggagcccctctgtggatgtggacagccacggcaacagaggagagccgtgatggtccacatcaacctggcggcagcgcaaaagatg

SEQ ID NO: 141124 - DNA, 103 bp, Artificial Sequence
  Synthetic Polynucleotide
taatacgactcactatagggggggatcttgagcccctctgtggatgtggaaacagaggagatccacaatgacagaggggaacctggcggcagcgcaaaagatg

SEQ ID NO: 141125 - DNA, 103 bp, Artificial Sequence
  Synthetic Polynucleotide
taatacgactcactatagggtaggagtcatggggatcttgagcccctctgaacagaggagacagaggatgtcaagatccaacctggcggcagcgcaaaagatg

SEQ ID NO: 141126 - DNA, 103 bp, Artificial Sequence
  Synthetic Polynucleotide
taatacgactcactatagggaaagaggatgtaggagtcatggggatcttgaacagaggagacaagatatgcatgactccaacctggcggcagcgcaaaagatg

SEQ ID NO: 141127 - DNA, 103 bp, Artificial Sequence
  Synthetic Polynucleotide
taatacgactcactatagggcggagacacaaaagaggatgtaggagtcataacagaggagaatgactatgacatcctctaacctggcggcagcgcaaaagatg

SEQ ID NO: 141128 - DNA, 103 bp, Artificial Sequence
  Synthetic Polynucleotide
taatacgactcactatagggtgggtggtggcggagacacaaaagaggatgaacagaggagacatcctatgttgtgtctcaacctggcggcagcgcaaaagatg

SEQ ID NO: 141129 - DNA, 103 bp, Artificial Sequence
  Synthetic Polynucleotide
taatacgactcactatagggtcggcgccctcgtagttgacgcagccgcggaacagaggagaccgcggatgcgtcaactaaacctggcggcagcgcaaaagatg

SEQ ID NO: 141130 - DNA, 103 bp, Artificial Sequence
  Synthetic Polynucleotide
taatacgactcactatagggggtgaggcagtgggtggtggcggagacacaaacagaggagatgtgtcatggccaccaccaacctggcggcagcgcaaaagatg

SEQ ID NO: 141131 - DNA, 103 bp, Artificial Sequence
  Synthetic Polynucleotide
taatacgactcactataggggttggaatgaggtgaggcagtgggtggtggaacagaggagaccaccaatgactgcctcaaacctggcggcagcgcaaaagatg

SEQ ID NO: 141132 - DNA, 103 bp, Artificial Sequence
  Synthetic Polynucleotide
taatacgactcactataggggtgtggtccggttggaatgaggtgaggcagaacagaggagactgcctatgctcattccaaacctggcggcagcgcaaaagatg

SEQ ID NO: 141133 - DNA, 103 bp, Artificial Sequence
  Synthetic Polynucleotide
taatacgactcactataggggcttcaggcggtgtggtccggttggaatgaaacagaggagatcattcatgccggaccacaacctggcggcagcgcaaaagatg

SEQ ID NO: 141134 - DNA, 103 bp, Artificial Sequence
  Synthetic Polynucleotide
taatacgactcactatagggattctgggccgcttcaggcggtgtggtccgaacagaggagacggaccatgccgcctgaaaacctggcggcagcgcaaaagatg

SEQ ID NO: 141135 - DNA, 103 bp, Artificial Sequence
  Synthetic Polynucleotide
taatacgactcactataggggggactggccattctgggccgcttcaggcgaacagaggagacgcctgatgcggcccagaaacctggcggcagcgcaaaagatg

SEQ ID NO: 141136 - DNA, 103 bp, Artificial Sequence
  Synthetic Polynucleotide
taatacgactcactataggggctgccatgggggactggccattctgggccaacagaggagaggcccaatgtggccagtcaacctggcggcagcgcaaaagatg

SEQ ID NO: 141137 - DNA, 103 bp, Artificial Sequence
  Synthetic Polynucleotide
taatacgactcactatagggtaagatcagggctgccatgggggactggccaacagaggagaggccagatgcccatggcaaacctggcggcagcgcaaaagatg

SEQ ID NO: 141138 - DNA, 103 bp, Artificial Sequence
  Synthetic Polynucleotide
taatacgactcactatagggtgtctgctactaagatcagggctgccatggaacagaggagaccatggatgccctgatctaacctggcggcagcgcaaaagatg

SEQ ID NO: 141139 - DNA, 103 bp, Artificial Sequence
  Synthetic Polynucleotide
taatacgactcactatagggccccctgcattgtctgctactaagatcaggaacagaggagacctgatatgagtagcagaaacctggcggcagcgcaaaagatg

SEQ ID NO: 141140 - DNA, 103 bp, Artificial Sequence
  Synthetic Polynucleotide
taatacgactcactatagggctcgacgcggtcggcgccctcgtagttgacaacagaggagagtcaacatggagggcgccaacctggcggcagcgcaaaagatg

SEQ ID NO: 141141 - DNA, 103 bp, Artificial Sequence
  Synthetic Polynucleotide
taatacgactcactatagggggcatgactgccccctgcattgtctgctacaacagaggagagtagcaatgaatgcagggaacctggcggcagcgcaaaagatg

SEQ ID NO: 141142 - DNA, 103 bp, Artificial Sequence
  Synthetic Polynucleotide
taatacgactcactatagggcatcttttgaggcatgactgccccctgcataacagaggagaatgcagatggcagtcatgaacctggcggcagcgcaaaagatg

SEQ ID NO: 141143 - DNA, 103 bp, Artificial Sequence
  Synthetic Polynucleotide
taatacgactcactatagggacctggttggcatcttttgaggcatgactgaacagaggagacagtcaatgctcaaaagaaacctggcggcagcgcaaaagatg

SEQ ID NO: 141144 - DNA, 103 bp, Artificial Sequence
  Synthetic Polynucleotide
taatacgactcactatagggagtggagtgaacctggttggcatcttttgaaacagaggagatcaaaaatggccaaccagaacctggcggcagcgcaaaagatg

SEQ ID NO: 141145 - DNA, 103 bp, Artificial Sequence
  Synthetic Polynucleotide
taatacgactcactatagggtcctcctggtagtggagtgaacctggttggaacagaggagaccaaccatgttcactccaaacctggcggcagcgcaaaagatg

SEQ ID NO: 141146 - DNA, 103 bp, Artificial Sequence
  Synthetic Polynucleotide
taatacgactcactatagggctgttgctattcctcctggtagtggagtgaaacagaggagatcactcatgtaccaggagaacctggcggcagcgcaaaagatg

SEQ ID NO: 141147 - DNA, 103 bp, Artificial Sequence
  Synthetic Polynucleotide
taatacgactcactatagggagagggcggactgttgctattcctcctggtaacagaggagaaccaggatgaatagcaacaacctggcggcagcgcaaaagatg

SEQ ID NO: 141148 - DNA, 103 bp, Artificial Sequence
  Synthetic Polynucleotide
taatacgactcactatagggtagaggacggagagggcggactgttgctataacagaggagaatagcaatggtccgccctaacctggcggcagcgcaaaagatg

SEQ ID NO: 141149 - DNA, 103 bp, Artificial Sequence
  Synthetic Polynucleotide
taatacgactcactatagggctttggttcatagaggacggagagggcggaaacagaggagatccgccatgtccgtcctcaacctggcggcagcgcaaaagatg

SEQ ID NO: 141150 - DNA, 103 bp, Artificial Sequence
  Synthetic Polynucleotide
taatacgactcactataggggcccagccttctttggttcatagaggacggaacagaggagaccgtccatgatgaaccaaaacctggcggcagcgcaaaagatg

SEQ ID NO: 141151 - DNA, 103 bp, Artificial Sequence
  Synthetic Polynucleotide
taatacgactcactatagggcgatgacgaactcgacgcggtcggcgccctaacagaggagaagggcgatgaccgcgtcgaacctggcggcagcgcaaaagatg

SEQ ID NO: 141152 - DNA, 103 bp, Artificial Sequence
  Synthetic Polynucleotide
taatacgactcactatagggcctctctggggcccagccttctttggttcaaacagaggagatgaaccatggaaggctggaacctggcggcagcgcaaaagatg

SEQ ID NO: 141153 - DNA, 103 bp, Artificial Sequence
  Synthetic Polynucleotide
taatacgactcactatagggtggccccccacctctctggggcccagccttaacagaggagaaaggctatgccccagagaaacctggcggcagcgcaaaagatg

SEQ ID NO: 141154 - DNA, 103 bp, Artificial Sequence
  Synthetic Polynucleotide
taatacgactcactataggggcctgctccctggccccccacctctctgggaacagaggagacccagaatggtggggggcaacctggcggcagcgcaaaagatg

SEQ ID NO: 141155 - DNA, 103 bp, Artificial Sequence
  Synthetic Polynucleotide
taatacgactcactatagggctcctgtgttgcctgctccctggccccccaaacagaggagatgggggatgagggagcagaacctggcggcagcgcaaaagatg

SEQ ID NO: 141156 - DNA, 103 bp, Artificial Sequence
  Synthetic Polynucleotide
taatacgactcactatagggggctccagtcctcctgtgttgcctgctcccaacagaggagagggagcatgcaacacaggaacctggcggcagcgcaaaagatg

SEQ ID NO: 141157 - DNA, 103 bp, Artificial Sequence
  Synthetic Polynucleotide
taatacgactcactatagggagggtgcactggctccagtcctcctgtgttaacagaggagaaacacaatgggactggagaacctggcggcagcgcaaaagatg

SEQ ID NO: 141158 - DNA, 103 bp, Artificial Sequence
  Synthetic Polynucleotide
taatacgactcactatagggggaggctggcagggtgcactggctccagtcaacagaggagagactggatgcagtgcaccaacctggcggcagcgcaaaagatg

SEQ ID NO: 141159 - DNA, 103 bp, Artificial Sequence
  Synthetic Polynucleotide
taatacgactcactataggggaggagtccgggaggctggcagggtgcactaacagaggagaagtgcaatgtgccagcctaacctggcggcagcgcaaaagatg

SEQ ID NO: 141160 - DNA, 103 bp, Artificial Sequence
  Synthetic Polynucleotide
taatacgactcactatagggggttgccagagaggagtccgggaggctggcaacagaggagagccagcatgccggactccaacctggcggcagcgcaaaagatg

SEQ ID NO: 141161 - DNA, 103 bp, Artificial Sequence
  Synthetic Polynucleotide
taatacgactcactataggggcggggcactggttgccagagaggagtccgaacagaggagacggactatgctctggcaaaacctggcggcagcgcaaaagatg

SEQ ID NO: 141162 - DNA, 103 bp, Artificial Sequence
  Synthetic Polynucleotide
taatacgactcactatagggcgcgccgtctcgatgacgaactcgacgcggaacagaggagaccgcgtatggttcgtcataacctggcggcagcgcaaaagatg

SEQ ID NO: 141163 - DNA, 103 bp, Artificial Sequence
  Synthetic Polynucleotide
taatacgactcactataggggtgcagcacagcggggcactggttgccagaaacagaggagatctggcatgcagtgccccaacctggcggcagcgcaaaagatg

SEQ ID NO: 141164 - DNA, 103 bp, Artificial Sequence
  Synthetic Polynucleotide
taatacgactcactataggggtggcagagggtgcagcacagcggggcactaacagaggagaagtgccatgctgtgctgcaacctggcggcagcgcaaaagatg

SEQ ID NO: 141165 - DNA, 103 bp, Artificial Sequence
  Synthetic Polynucleotide
taatacgactcactatagggccagccgctcgtggcagagggtgcagcacaaacagaggagatgtgctatgccctctgccaacctggcggcagcgcaaaagatg

SEQ ID NO: 141166 - DNA, 103 bp, Artificial Sequence
  Synthetic Polynucleotide
taatacgactcactatagggtgggtgtcctccagccgctcgtggcagaggaacagaggagacctctgatgcgagcggctaacctggcggcagcgcaaaagatg

SEQ ID NO: 141167 - DNA, 103 bp, Artificial Sequence
  Synthetic Polynucleotide
taatacgactcactatagggctgcacaaaatgggtgtcctccagccgctcaacagaggagagagcggatggaggacaccaacctggcggcagcgcaaaagatg

SEQ ID NO: 141168 - DNA, 103 bp, Artificial Sequence
  Synthetic Polynucleotide
taatacgactcactatagggcggacgggcactgcacaaaatgggtgtcctaacagaggagaaggacaatgattttgtgcaacctggcggcagcgcaaaagatg

SEQ ID NO: 141169 - DNA, 103 bp, Artificial Sequence
  Synthetic Polynucleotide
taatacgactcactatagggtgcgaagggacggacgggcactgcacaaaaaacagaggagattttgtatggtgcccgtcaacctggcggcagcgcaaaagatg

SEQ ID NO: 141170 - DNA, 103 bp, Artificial Sequence
  Synthetic Polynucleotide
taatacgactcactataggggcagaacttgtgcgaagggacggacgggcaaacagaggagatgcccgatggtcccttcgaacctggcggcagcgcaaaagatg

SEQ ID NO: 141171 - DNA, 103 bp, Artificial Sequence
  Synthetic Polynucleotide
taatacgactcactatagggagcaagggaagcagaacttgtgcgaagggaaacagaggagatcccttatgacaagttctaacctggcggcagcgcaaaagatg

SEQ ID NO: 141172 - DNA, 103 bp, Artificial Sequence
  Synthetic Polynucleotide
taatacgactcactatagggctttgtctggagcaagggaagcagaacttgaacagaggagacaagttatgcttcccttgaacctggcggcagcgcaaaagatg

SEQ ID NO: 141173 - DNA, 103 bp, Artificial Sequence
  Synthetic Polynucleotide
taatacgactcactatagggcttgagctgccgcgccgtctcgatgacgaaaacagaggagattcgtcatggagacggcgaacctggcggcagcgcaaaagatg

SEQ ID NO: 141174 - DNA, 103 bp, Artificial Sequence
  Synthetic Polynucleotide
taatacgactcactatagggctgtttgatgctttgtctggagcaagggaaaacagaggagattccctatgtccagacaaaacctggcggcagcgcaaaagatg

SEQ ID NO: 141175 - DNA, 103 bp, Artificial Sequence
  Synthetic Polynucleotide
taatacgactcactatagggtagctccctgctgtttgatgctttgtctggaacagaggagaccagacatggcatcaaacaacctggcggcagcgcaaaagatg

SEQ ID NO: 141176 - DNA, 103 bp, Artificial Sequence
  Synthetic Polynucleotide
taatacgactcactatagggacctctccactagctccctgctgtttgatgaacagaggagacatcaaatggcagggagcaacctggcggcagcgcaaaagatg

SEQ ID NO: 141177 - DNA, 103 bp, Artificial Sequence
  Synthetic Polynucleotide
taatacgactcactataggggggacaatagacctctccactagctccctgaacagaggagacagggaatgagtggagagaacctggcggcagcgcaaaagatg

SEQ ID NO: 141178 - DNA, 103 bp, Artificial Sequence
  Synthetic Polynucleotide
taatacgactcactatagggtttccccactgggacaatagacctctccacaacagaggagagtggagatgtctattgtcaacctggcggcagcgcaaaagatg

SEQ ID NO: 141179 - DNA, 103 bp, Artificial Sequence
  Synthetic Polynucleotide
taatacgactcactatagggagagggcatttttccccactgggacaatagaacagaggagactattgatgcagtggggaaacctggcggcagcgcaaaagatg

SEQ ID NO: 141180 - DNA, 103 bp, Artificial Sequence
  Synthetic Polynucleotide
taatacgactcactatagggggagcccacaagagggcatttttccccactaacagaggagaagtgggatgaaatgccctaacctggcggcagcgcaaaagatg

SEQ ID NO: 141181 - DNA, 103 bp, Artificial Sequence
  Synthetic Polynucleotide
taatacgactcactatagggaggggacattggagcccacaagagggcattaacagaggagaaatgccatgttgtgggctaacctggcggcagcgcaaaagatg

SEQ ID NO: 141182 - DNA, 103 bp, Artificial Sequence
  Synthetic Polynucleotide
taatacgactcactatagggataaaggcccaggggacattggagcccacaaacagaggagatgtgggatgcaatgtcccaacctggcggcagcgcaaaagatg

SEQ ID NO: 141183 - DNA, 103 bp, Artificial Sequence
  Synthetic Polynucleotide
taatacgactcactatagggttccccttgcataaaggcccaggggacattaacagaggagaaatgtcatgtgggcctttaacctggcggcagcgcaaaagatg

SEQ ID NO: 141184 - DNA, 103 bp, Artificial Sequence
  Synthetic Polynucleotide
taatacgactcactatagggcgtgcgcccgcttgagctgccgcgccgtctaacagaggagaagacggatgggcagctcaaacctggcggcagcgcaaaagatg

SEQ ID NO: 141185 - DNA, 103 bp, Artificial Sequence
  Synthetic Polynucleotide
taatacgactcactatagggtggttgcaatttccccttgcataaaggcccaacagaggagagggcctatgtgcaaggggaacctggcggcagcgcaaaagatg

SEQ ID NO: 141186 - DNA, 103 bp, Artificial Sequence
  Synthetic Polynucleotide
taatacgactcactatagggccagcaaggatggttgcaatttccccttgcaacagaggagagcaaggatgaattgcaacaacctggcggcagcgcaaaagatg

SEQ ID NO: 141187 - DNA, 103 bp, Artificial Sequence
  Synthetic Polynucleotide
taatacgactcactatagggtttcacatctccagcaaggatggttgcaataacagaggagaattgcaatgatccttgctaacctggcggcagcgcaaaagatg

SEQ ID NO: 141188 - DNA, 103 bp, Artificial Sequence
  Synthetic Polynucleotide
taatacgactcactatagggcttttttcactttcacatctccagcaaggaaacagaggagatccttgatggagatgtgaaacctggcggcagcgcaaaagatg

SEQ ID NO: 141189 - DNA, 103 bp, Artificial Sequence
  Synthetic Polynucleotide
taatacgactcactataggggagtctctctcttttttcactttcacatctaacagaggagaagatgtatgagtgaaaaaaacctggcggcagcgcaaaagatg

SEQ ID NO: 141190 - DNA, 103 bp, Artificial Sequence
  Synthetic Polynucleotide
taatacgactcactataggggggaagcagccgtgcgcccgcttgagctgcaacagaggagagcagctatggcgggcgcaaacctggcggcagcgcaaaagatg

SEQ ID NO: 141191 - DNA, 103 bp, Artificial Sequence
  Synthetic Polynucleotide
taatacgactcactataggggcgaccctccgggaagcagccgtgcgcccgaacagaggagacgggcgatgggctgcttcaacctggcggcagcgcaaaagatg

SEQ ID NO: 141192 - DNA, 103 bp, Artificial Sequence
  Synthetic Polynucleotide
taatacgactcactataggggccgccgggacgcggccgccaccgccaccgaacagaggagacggtggatgtggcggccgaacctggcggcagcgcaaaagatg

SEQ ID NO: 141193 - DNA, 103 bp, Artificial Sequence
  Synthetic Polynucleotide
taatacgactcactatagggcgggtggggagcgaccctccgggaagcagcaacagaggagagctgctatgcggagggtcaacctggcggcagcgcaaaagatg

SEQ ID NO: 141194 - DNA, 103 bp, Artificial Sequence
  Synthetic Polynucleotide
taatacgactcactataggggccgcggcgccgggtggggagcgaccctccaacagaggagaggagggatgctccccaccaacctggcggcagcgcaaaagatg

SEQ ID NO: 141195 - DNA, 103 bp, Artificial Sequence
  Synthetic Polynucleotide
taatacgactcactatagggggcggccgaggccgcggcgccgggtggggaaacagaggagatccccaatgggcgccgcgaacctggcggcagcgcaaaagatg

SEQ ID NO: 141196 - DNA, 103 bp, Artificial Sequence
  Synthetic Polynucleotide
taatacgactcactataggggcggcttggcggcggccgaggccgcggcgcaacagaggagagcgccgatgcctcggccgaacctggcggcagcgcaaaagatg

SEQ ID NO: 141197 - DNA, 103 bp, Artificial Sequence
  Synthetic Polynucleotide
taatacgactcactataggggagagcggcggcggcttggcggcggccgagaacagaggagactcggcatgcgccaagccaacctggcggcagcgcaaaagatg

SEQ ID NO: 141198 - DNA, 103 bp, Artificial Sequence
  Synthetic Polynucleotide
taatacgactcactataggggtccttggcggagagcggcggcggcttggcaacagaggagagccaagatgccgccgctcaacctggcggcagcgcaaaagatg

SEQ ID NO: 141199 - DNA, 103 bp, Artificial Sequence
  Synthetic Polynucleotide
taatacgactcactataggggcaaaaggatgtccttggcggagagcggcgaacagaggagacgccgcatgccgccaaggaacctggcggcagcgcaaaagatg

SEQ ID NO: 141200 - DNA, 103 bp, Artificial Sequence
  Synthetic Polynucleotide
taatacgactcactatagggtgctgctgctgcaaaaggatgtccttggcgaacagaggagacgccaaatgcatccttttaacctggcggcagcgcaaaagatg

SEQ ID NO: 141201 - DNA, 103 bp, Artificial Sequence
  Synthetic Polynucleotide
taatacgactcactataggggccaagctgctgctgctgctgcaaaaggataacagaggagaatccttatgcagcagcagaacctggcggcagcgcaaaagatg

SEQ ID NO: 141202 - DNA, 103 bp, Artificial Sequence
  Synthetic Polynucleotide
taatacgactcactatagggggccgccgtggccaagctgctgctgctgctaacagaggagaagcagcatgagcagcttgaacctggcggcagcgcaaaagatg

SEQ ID NO: 141203 - DNA, 103 bp, Artificial Sequence
  Synthetic Polynucleotide
taatacgactcactatagggtagcacgactgccgccgggacgcggccgccaacagaggagaggcggcatggtcccggcgaacctggcggcagcgcaaaagatg

SEQ ID NO: 141204 - DNA, 103 bp, Artificial Sequence
  Synthetic Polynucleotide
taatacgactcactataggggccgcctcggggccgccgtggccaagctgcaacagaggagagcagctatgccacggcggaacctggcggcagcgcaaaagatg

SEQ ID NO: 141205 - DNA, 103 bp, Artificial Sequence
  Synthetic Polynucleotide
taatacgactcactatagggcgcgcgcggggccgcctcggggccgccgtgaacagaggagacacggcatgcccgaggcgaacctggcggcagcgcaaaagatg

SEQ ID NO: 141206 - DNA, 103 bp, Artificial Sequence
  Synthetic Polynucleotide
taatacgactcactatagggaggcctgcggcgcgcgcggggccgcctcggaacagaggagaccgaggatgccccgcgcgaacctggcggcagcgcaaaagatg

SEQ ID NO: 141207 - DNA, 103 bp, Artificial Sequence
  Synthetic Polynucleotide
taatacgactcactatagggtagcgctccaaggcctgcggcgcgcgcgggaacagaggagacccgcgatggccgcaggcaacctggcggcagcgcaaaagatg

SEQ ID NO: 141208 - DNA, 103 bp, Artificial Sequence
  Synthetic Polynucleotide
taatacgactcactatagggcgccaacgggtagcgctccaaggcctgcggaacagaggagaccgcagatgttggagcgcaacctggcggcagcgcaaaagatg

SEQ ID NO: 141209 - DNA, 103 bp, Artificial Sequence
  Synthetic Polynucleotide
taatacgactcactatagggcggccgcggccgccaacgggtagcgctccaaacagaggagatggagcatgacccgttggaacctggcggcagcgcaaaagatg

SEQ ID NO: 141210 - DNA, 103 bp, Artificial Sequence
  Synthetic Polynucleotide
taatacgactcactataggggggggcctctcggccgcggccgccaacgggaacagaggagacccgttatgggccgcggcaacctggcggcagcgcaaaagatg

SEQ ID NO: 141211 - DNA, 103 bp, Artificial Sequence
  Synthetic Polynucleotide
taatacgactcactataggggccgaggcgcgggggcctctcggccgcggcaacagaggagagccgcgatggagaggcccaacctggcggcagcgcaaaagatg

SEQ ID NO: 141212 - DNA, 103 bp, Artificial Sequence
  Synthetic Polynucleotide
taatacgactcactatagggcgaagtcagagccgaggcgcgggggcctctaacagaggagaagaggcatgcgcgcctcgaacctggcggcagcgcaaaagatg

SEQ ID NO: 141213 - DNA, 103 bp, Artificial Sequence
  Synthetic Polynucleotide
taatacgactcactatagggcggctgctgccgaagtcagagccgaggcgcaacagaggagagcgcctatgctctgacttaacctggcggcagcgcaaaagatg

SEQ ID NO: 141214 - DNA, 103 bp, Artificial Sequence
  Synthetic Polynucleotide
taatacgactcactataggggtcacacaggtagcacgactgccgccgggaaacagaggagatcccggatgcagtcgtgcaacctggcggcagcgcaaaagatg

SEQ ID NO: 141215 - DNA, 103 bp, Artificial Sequence
  Synthetic Polynucleotide
taatacgactcactatagggcgctgccgggcggctgctgccgaagtcagaaacagaggagatctgacatgggcagcagcaacctggcggcagcgcaaaagatg

SEQ ID NO: 141216 - DNA, 103 bp, Artificial Sequence
  Synthetic Polynucleotide
taatacgactcactataggggggccaggctcgctgccgggcggctgctgcaacagaggagagcagcaatggcccggcagaacctggcggcagcgcaaaagatg

SEQ ID NO: 141217 - DNA, 103 bp, Artificial Sequence
  Synthetic Polynucleotide
taatacgactcactataggggtcggcggctgggccaggctcgctgccgggaacagaggagacccggcatggagcctggcaacctggcggcagcgcaaaagatg

SEQ ID NO: 141218 - DNA, 103 bp, Artificial Sequence
  Synthetic Polynucleotide
taatacgactcactatagggcggctgcggcgtcggcggctgggccaggctaacagaggagaagcctgatgcagccgccgaacctggcggcagcgcaaaagatg

SEQ ID NO: 141219 - DNA, 103 bp, Artificial Sequence
  Synthetic Polynucleotide
taatacgactcactatagggtcacgggcggcggctgcggcgtcggcggctaacagaggagaagccgcatgcgccgcagcaacctggcggcagcgcaaaagatg

SEQ ID NO: 141220 - DNA, 103 bp, Artificial Sequence
  Synthetic Polynucleotide
taatacgactcactatagggaggatgccgttcacgggcggcggctgcggcaacagaggagagccgcaatggccgcccgtaacctggcggcagcgcaaaagatg

SEQ ID NO: 141221 - DNA, 103 bp, Artificial Sequence
  Synthetic Polynucleotide
taatacgactcactataggggttgggcaccaggatgccgttcacgggcggaacagaggagaccgcccatgaacggcatcaacctggcggcagcgcaaaagatg

SEQ ID NO: 141222 - DNA, 103 bp, Artificial Sequence
  Synthetic Polynucleotide
taatacgactcactatagggtggagaagccgttgggcaccaggatgccgtaacagaggagaacggcaatgtggtgcccaaacctggcggcagcgcaaaagatg

SEQ ID NO: 141223 - DNA, 103 bp, Artificial Sequence
  Synthetic Polynucleotide
taatacgactcactatagggtcctctagcttggagaagccgttgggcaccaacagaggagaggtgccatgcggcttctcaacctggcggcagcgcaaaagatg

SEQ ID NO: 141224 - DNA, 103 bp, Artificial Sequence
  Synthetic Polynucleotide
taatacgactcactatagggctcgggcggctcctctagcttggagaagccaacagaggagaggcttcatgaagctagagaacctggcggcagcgcaaaagatg

SEQ ID NO: 141225 - DNA, 103 bp, Artificial Sequence
  Synthetic Polynucleotide
taatacgactcactatagggtgcggggcaggtcacacaggtagcacgactaacagaggagaagtcgtatgacctgtgtgaacctggcggcagcgcaaaagatg

SEQ ID NO: 141226 - DNA, 103 bp, Artificial Sequence
  Synthetic Polynucleotide
taatacgactcactatagggggcgattcagctcgggcggctcctctagctaacagaggagaagctagatgagccgcccgaacctggcggcagcgcaaaagatg

SEQ ID NO: 141227 - DNA, 103 bp, Artificial Sequence
  Synthetic Polynucleotide
taatacgactcactatagggttcgggctctggcgattcagctcgggcggcaacagaggagagccgccatggctgaatcgaacctggcggcagcgcaaaagatg

SEQ ID NO: 141228 - DNA, 103 bp, Artificial Sequence
  Synthetic Polynucleotide
taatacgactcactataggggcgccgcgggttcgggctctggcgattcagaacagaggagactgaatatgcagagcccgaacctggcggcagcgcaaaagatg

SEQ ID NO: 141229 - DNA, 103 bp, Artificial Sequence
  Synthetic Polynucleotide
taatacgactcactatagggccgcgtggccgcgccgcgggttcgggctctaacagaggagaagagccatgacccgcggcaacctggcggcagcgcaaaagatg

SEQ ID NO: 141230 - DNA, 103 bp, Artificial Sequence
  Synthetic Polynucleotide
taatacgactcactataggggtgggcggcaccgcgtggccgcgccgcgggaacagaggagacccgcgatgcggccacgcaacctggcggcagcgcaaaagatg

SEQ ID NO: 141231 - DNA, 103 bp, Artificial Sequence
  Synthetic Polynucleotide
taatacgactcactatagggcggcaccagggtgggcggcaccgcgtggccaacagaggagaggccacatggtgccgcccaacctggcggcagcgcaaaagatg

SEQ ID NO: 141232 - DNA, 103 bp, Artificial Sequence
  Synthetic Polynucleotide
taatacgactcactatagggcgttcatgagcggcaccagggtgggcggcaaacagaggagatgccgcatgccctggtgcaacctggcggcagcgcaaaagatg

SEQ ID NO: 141233 - DNA, 103 bp, Artificial Sequence
  Synthetic Polynucleotide
taatacgactcactataggggtggccgagccgttcatgagcggcaccaggaacagaggagacctggtatggctcatgaaaacctggcggcagcgcaaaagatg

SEQ ID NO: 141234 - DNA, 103 bp, Artificial Sequence
  Synthetic Polynucleotide
taatacgactcactataggggggcagcggcgtggccgagccgttcatgagaacagaggagactcatgatgggctcggccaacctggcggcagcgcaaaagatg

SEQ ID NO: 141235 - DNA, 103 bp, Artificial Sequence
  Synthetic Polynucleotide
taatacgactcactatagggcgagcgcggtgggcagcggcgtggccgagcaacagaggagagctcggatgcgccgctgcaacctggcggcagcgcaaaagatg

SEQ ID NO: 141236 - DNA, 103 bp, Artificial Sequence
  Synthetic Polynucleotide
taatacgactcactataggggcccagggcatgcggggcaggtcacacaggaacagaggagacctgtgatgcctgccccgaacctggcggcagcgcaaaagatg

SEQ ID NO: 141237 - DNA, 103 bp, Artificial Sequence
  Synthetic Polynucleotide
taatacgactcactatagggccgccgaggccgagcgcggtgggcagcggcaacagaggagagccgctatgcaccgcgctaacctggcggcagcgcaaaagatg

SEQ ID NO: 141238 - DNA, 103 bp, Artificial Sequence
  Synthetic Polynucleotide
taatacgactcactatagggggcagcgcggccgccgaggccgagcgcggtaacagaggagaaccgcgatgggcctcggcaacctggcggcagcgcaaaagatg

SEQ ID NO: 141239 - DNA, 103 bp, Artificial Sequence
  Synthetic Polynucleotide
taatacgactcactatagggctaaggaggcggcagcgcggccgccgaggcaacagaggagagcctcgatggccgcgctgaacctggcggcagcgcaaaagatg

SEQ ID NO: 141240 - DNA, 103 bp, Artificial Sequence
  Synthetic Polynucleotide
taatacgactcactataggggacaccgcggctaaggaggcggcagcgcggaacagaggagaccgcgcatgcgcctccttaacctggcggcagcgcaaaagatg

SEQ ID NO: 141241 - DNA, 103 bp, Artificial Sequence
  Synthetic Polynucleotide
taatacgactcactatagggcgcggttccggacaccgcggctaaggaggcaacagaggagagcctccatggccgcggtgaacctggcggcagcgcaaaagatg

SEQ ID NO: 141242 - DNA, 103 bp, Artificial Sequence
  Synthetic Polynucleotide
taatacgactcactatagggggctggcggccgcggttccggacaccgcggaacagaggagaccgcggatgccggaaccgaacctggcggcagcgcaaaagatg

SEQ ID NO: 141243 - DNA, 103 bp, Artificial Sequence
  Synthetic Polynucleotide
taatacgactcactataggggcggagcccaggctggcggccgcggttccgaacagaggagacggaacatgggccgccagaacctggcggcagcgcaaaagatg

SEQ ID NO: 141244 - DNA, 103 bp, Artificial Sequence
  Synthetic Polynucleotide
taatacgactcactatagggggtgggctgcgcggagcccaggctggcggcaacagaggagagccgccatgctgggctccaacctggcggcagcgcaaaagatg

SEQ ID NO: 141245 - DNA, 103 bp, Artificial Sequence
  Synthetic Polynucleotide
taatacgactcactatagggcgcccagatcggtgggctgcgcggagcccaaacagaggagatgggctatgcgcagcccaaacctggcggcagcgcaaaagatg

SEQ ID NO: 141246 - DNA, 103 bp, Artificial Sequence
  Synthetic Polynucleotide
taatacgactcactatagggcgcttgtgggcgcccagatcggtgggctgcaacagaggagagcagccatgcgatctgggaacctggcggcagcgcaaaagatg

SEQ ID NO: 141247 - DNA, 103 bp, Artificial Sequence
  Synthetic Polynucleotide
taatacgactcactatagggccagatcatggcccagggcatgcggggcagaacagaggagactgcccatgatgccctggaacctggcggcagcgcaaaagatg

SEQ ID NO: 141248 - DNA, 103 bp, Artificial Sequence
  Synthetic Polynucleotide
taatacgactcactatagggggatgccggccgcttgtgggcgcccagatcaacagaggagagatctgatggcccacaagaacctggcggcagcgcaaaagatg

SEQ ID NO: 141249 - DNA, 103 bp, Artificial Sequence
  Synthetic Polynucleotide
taatacgactcactatagggtgctcgacacggatgccggccgcttgtgggaacagaggagacccacaatgggccggcataacctggcggcagcgcaaaagatg

SEQ ID NO: 141250 - DNA, 103 bp, Artificial Sequence
  Synthetic Polynucleotide
taatacgactcactatagggacggcagcgctgctcgacacggatgccggcaacagaggagagccggcatgcgtgtcgagaacctggcggcagcgcaaaagatg

SEQ ID NO: 141251 - DNA, 103 bp, Artificial Sequence
  Synthetic Polynucleotide
taatacgactcactatagggctcgtgctccacggcagcgctgctcgacacaacagaggagagtgtcgatgagcgctgccaacctggcggcagcgcaaaagatg

SEQ ID NO: 141252 - DNA, 103 bp, Artificial Sequence
  Synthetic Polynucleotide
taatacgactcactatagggcctcacgctgctcgtgctccacggcagcgcaacagaggagagcgctgatgtggagcacgaacctggcggcagcgcaaaagatg

SEQ ID NO: 141253 - DNA, 103 bp, Artificial Sequence
  Synthetic Polynucleotide
taatacgactcactatagggttggctgccgcctcacgctgctcgtgctccaacagaggagaggagcaatggcagcgtgaaacctggcggcagcgcaaaagatg

SEQ ID NO: 141254 - DNA, 103 bp, Artificial Sequence
  Synthetic Polynucleotide
taatacgactcactatagggttgtttctccttggctgccgcctcacgctgaacagaggagacagcgtatggcggcagccaacctggcggcagcgcaaaagatg

SEQ ID NO: 141255 - DNA, 103 bp, Artificial Sequence
  Synthetic Polynucleotide
taatacgactcactataggggcggcggcggttgtttctccttggctgccgaacagaggagacggcagatgaggagaaacaacctggcggcagcgcaaaagatg

SEQ ID NO: 141256 - DNA, 103 bp, Artificial Sequence
  Synthetic Polynucleotide
taatacgactcactatagggcggtgcgcaggcggcggcggttgtttctccaacagaggagaggagaaatgaccgccgccaacctggcggcagcgcaaaagatg

SEQ ID NO: 141257 - DNA, 103 bp, Artificial Sequence
  Synthetic Polynucleotide
taatacgactcactatagggggccgggccccggtgcgcaggcggcggcggaacagaggagaccgccgatgcctgcgcacaacctggcggcagcgcaaaagatg

SEQ ID NO: 141258 - DNA, 103 bp, Artificial Sequence
  Synthetic Polynucleotide
taatacgactcactatagggcggtgaagtcccagatcatggcccagggcaaacagaggagatgccctatgccatgatctaacctggcggcagcgcaaaagatg

SEQ ID NO: 141259 - DNA, 103 bp, Artificial Sequence
  Synthetic Polynucleotide
taatacgactcactatagggacaggctgtcggccgggccccggtgcgcagaacagaggagactgcgcatgggggcccggaacctggcggcagcgcaaaagatg

SEQ ID NO: 141260 - DNA, 103 bp, Artificial Sequence
  Synthetic Polynucleotide
taatacgactcactataggggccgcggtggacaggctgtcggccgggcccaacagaggagagggcccatgcgacagcctaacctggcggcagcgcaaaagatg

SEQ ID NO: 141261 - DNA, 103 bp, Artificial Sequence
  Synthetic Polynucleotide
taatacgactcactatagggggcggccccggccgcggtggacaggctgtcaacagaggagagacagcatgtccaccgcgaacctggcggcagcgcaaaagatg

SEQ ID NO: 141262 - DNA, 103 bp, Artificial Sequence
  Synthetic Polynucleotide
taatacgactcactatagggcgctcagctcggcggccccggccgcggtggaacagaggagaccaccgatgccggggccgaacctggcggcagcgcaaaagatg

SEQ ID NO: 141263 - DNA, 103 bp, Artificial Sequence
  Synthetic Polynucleotide
taatacgactcactataggggcaccttccgcgctcagctcggcggccccgaacagaggagacggggcatgcgagctgagaacctggcggcagcgcaaaagatg

SEQ ID NO: 141264 - DNA, 103 bp, Artificial Sequence
  Synthetic Polynucleotide
taatacgactcactataggggctcttgcccgcaccttccgcgctcagctcaacagaggagagagctgatggcggaaggtaacctggcggcagcgcaaaagatg

SEQ ID NO: 141265 - DNA, 103 bp, Artificial Sequence
  Synthetic Polynucleotide
taatacgactcactatagggcagacccgcggctcttgcccgcaccttccgaacagaggagacggaagatgcgggcaagaaacctggcggcagcgcaaaagatg

SEQ ID NO: 141266 - DNA, 103 bp, Artificial Sequence
  Synthetic Polynucleotide
taatacgactcactatagggtcctgctctccagacccgcggctcttgcccaacagaggagagggcaaatgccgcgggtcaacctggcggcagcgcaaaagatg

SEQ ID NO: 141267 - DNA, 103 bp, Artificial Sequence
  Synthetic Polynucleotide
taatacgactcactataggggttgacccagtcctgctctccagacccgcgaacagaggagacgcgggatgggagagcagaacctggcggcagcgcaaaagatg

SEQ ID NO: 141268 - DNA, 103 bp, Artificial Sequence
  Synthetic Polynucleotide
taatacgactcactatagggtcttgggcctgttgacccagtcctgctctcaacagaggagagagagcatgactgggtcaaacctggcggcagcgcaaaagatg

SEQ ID NO: 141269 - DNA, 103 bp, Artificial Sequence
  Synthetic Polynucleotide
taatacgactcactatagggcagacgggttcggtgaagtcccagatcatgaacagaggagacatgatatgggacttcacaacctggcggcagcgcaaaagatg

SEQ ID NO: 141270 - DNA, 103 bp, Artificial Sequence
  Synthetic Polynucleotide
taatacgactcactatagggtcgcgcacggtcttgggcctgttgacccagaacagaggagactgggtatgcaggcccaaaacctggcggcagcgcaaaagatg

SEQ ID NO: 141271 - DNA, 103 bp, Artificial Sequence
  Synthetic Polynucleotide
taatacgactcactatagggcagcagcgtgtcgcgcacggtcttgggcctaacagaggagaaggcccatgaccgtgcgcaacctggcggcagcgcaaaagatg

SEQ ID NO: 141272 - DNA, 103 bp, Artificial Sequence
  Synthetic Polynucleotide
taatacgactcactatagggggtgcagcgccagcagcgtgtcgcgcacggaacagaggagaccgtgcatgacacgctgcaacctggcggcagcgcaaaagatg

SEQ ID NO: 141273 - DNA, 103 bp, Artificial Sequence
  Synthetic Polynucleotide
taatacgactcactatagggtggccgtgctggtgcagcgccagcagcgtgaacagaggagacacgctatgggcgctgcaaacctggcggcagcgcaaaagatg

SEQ ID NO: 141274 - DNA, 103 bp, Artificial Sequence
  Synthetic Polynucleotide
taatacgactcactataggggggccccgagtggccgtgctggtgcagcgcaacagaggagagcgctgatgcagcacggcaacctggcggcagcgcaaaagatg

SEQ ID NO: 141275 - DNA, 103 bp, Artificial Sequence
  Synthetic Polynucleotide
taatacgactcactatagggtgctctcgaagggccccgagtggccgtgctaacagaggagaagcacgatgactcggggcaacctggcggcagcgcaaaagatg

SEQ ID NO: 141276 - DNA, 103 bp, Artificial Sequence
  Synthetic Polynucleotide
taatacgactcactatagggttcttaaacttgctctcgaagggccccgagaacagaggagactcgggatgcttcgagagaacctggcggcagcgcaaaagatg

SEQ ID NO: 141277 - DNA, 103 bp, Artificial Sequence
  Synthetic Polynucleotide
taatacgactcactatagggggccggctccttcttaaacttgctctcgaaaacagaggagattcgagatgaagtttaagaacctggcggcagcgcaaaagatg

SEQ ID NO: 141278 - DNA, 103 bp, Artificial Sequence
  Synthetic Polynucleotide
taatacgactcactatagggctgcagtcagggccggctccttcttaaactaacagaggagaagtttaatgaggagccggaacctggcggcagcgcaaaagatg

SEQ ID NO: 141279 - DNA, 103 bp, Artificial Sequence
  Synthetic Polynucleotide
taatacgactcactatagggaacaacctgcctgcagtcagggccggctccaacagaggagaggagccatgcctgactgcaacctggcggcagcgcaaaagatg

SEQ ID NO: 141280 - DNA, 103 bp, Artificial Sequence
  Synthetic Polynucleotide
taatacgactcactatagggccgggacgaggacacctgcgccgccgacataacagaggagaatgtcgatggcgcaggtgaacctggcggcagcgcaaaagatg

SEQ ID NO: 141281 - DNA, 103 bp, Artificial Sequence
  Synthetic Polynucleotide
taatacgactcactataggggttgacgcaaccgcggcatacgggttccgaaacagaggagatcggaaatggtatgccgcaacctggcggcagcgcaaaagatg

SEQ ID NO: 141282 - DNA, 103 bp, Artificial Sequence
  Synthetic Polynucleotide
taatacgactcactatagggctggtctgtgctcgacaccgagccgggcctaacagaggagaaggcccatgtcggtgtcgaacctggcggcagcgcaaaagatg

SEQ ID NO: 141283 - DNA, 103 bp, Artificial Sequence
  Synthetic Polynucleotide
taatacgactcactatagggactcgcgctcctggtctgtgctcgacaccgaacagaggagacggtgtatggcacagaccaacctggcggcagcgcaaaagatg

SEQ ID NO: 141284 - DNA, 103 bp, Artificial Sequence
  Synthetic Polynucleotide
taatacgactcactatagggttctccttcaactcgcgctcctggtctgtgaacagaggagacacagaatgggagcgcgaaacctggcggcagcgcaaaagatg

SEQ ID NO: 141285 - DNA, 103 bp, Artificial Sequence
  Synthetic Polynucleotide
taatacgactcactataggggttgcgctgcttctccttcaactcgcgctcaacagaggagagagcgcatgttgaaggagaacctggcggcagcgcaaaagatg

SEQ ID NO: 141286 - DNA, 103 bp, Artificial Sequence
  Synthetic Polynucleotide
taatacgactcactataggggggcctcggcgttgcgctgcttctccttcaaacagaggagatgaaggatgagcagcgcaaacctggcggcagcgcaaaagatg

SEQ ID NO: 141287 - DNA, 103 bp, Artificial Sequence
  Synthetic Polynucleotide
taatacgactcactatagggagctcggccagggcctcggcgttgcgctgcaacagaggagagcagcgatgcgccgaggcaacctggcggcagcgcaaaagatg

SEQ ID NO: 141288 - DNA, 103 bp, Artificial Sequence
  Synthetic Polynucleotide
taatacgactcactataggggctctcgctcagctcggccagggcctcggcaacagaggagagccgagatgctggccgagaacctggcggcagcgcaaaagatg

SEQ ID NO: 141289 - DNA, 103 bp, Artificial Sequence
  Synthetic Polynucleotide
taatacgactcactatagggggttgcgcaggctctcgctcagctcggccaaacagaggagatggccgatgtgagcgagaaacctggcggcagcgcaaaagatg

SEQ ID NO: 141290 - DNA, 103 bp, Artificial Sequence
  Synthetic Polynucleotide
taatacgactcactatagggtcctcggcgcggttgcgcaggctctcgctcaacagaggagagagcgaatgcctgcgcaaaacctggcggcagcgcaaaagatg

SEQ ID NO: 141291 - DNA, 103 bp, Artificial Sequence
  Synthetic Polynucleotide
taatacgactcactataggggctggcccactcctcggcgcggttgcgcagaacagaggagactgcgcatgcgcgccgagaacctggcggcagcgcaaaagatg

SEQ ID NO: 141292 - DNA, 103 bp, Artificial Sequence
  Synthetic Polynucleotide
taatacgactcactatagggcgccctcgtagttgacgcaaccgcggcataaacagaggagatatgccatggttgcgtcaaacctggcggcagcgcaaaagatg

SEQ ID NO: 141293 - DNA, 103 bp, Artificial Sequence
  Synthetic Polynucleotide
taatacgactcactatagggtcttgggcttgctggcccactcctcggcgcaacagaggagagcgccgatgagtgggccaaacctggcggcagcgcaaaagatg

SEQ ID NO: 141294 - DNA, 103 bp, Artificial Sequence
  Synthetic Polynucleotide
taatacgactcactatagggtcgcggaccatcttgggcttgctggcccacaacagaggagagtgggcatgcaagcccaaaacctggcggcagcgcaaaagatg

SEQ ID NO: 141295 - DNA, 103 bp, Artificial Sequence
  Synthetic Polynucleotide
taatacgactcactataggggagcagcgtgtcgcggaccatcttgggcttaacagaggagaaagcccatgatggtccgcaacctggcggcagcgcaaaagatg

SEQ ID NO: 141296 - DNA, 103 bp, Artificial Sequence
  Synthetic Polynucleotide
taatacgactcactatagggctgccagcgtgagcagcgtgtcgcggaccaaacagaggagatggtccatgacacgctgcaacctggcggcagcgcaaaagatg

SEQ ID NO: 141297 - DNA, 103 bp, Artificial Sequence
  Synthetic Polynucleotide
taatacgactcactatagggggcgtgcagcctgccagcgtgagcagcgtgaacagaggagacacgctatgcacgctggcaacctggcggcagcgcaaaagatg

SEQ ID NO: 141298 - DNA, 103 bp, Artificial Sequence
  Synthetic Polynucleotide
taatacgactcactatagggaacctcgtagggcgtgcagcctgccagcgtaacagaggagaacgctgatgggctgcacgaacctggcggcagcgcaaaagatg

SEQ ID NO: 141299 - DNA, 103 bp, Artificial Sequence
  Synthetic Polynucleotide
taatacgactcactatagggtcttgaagcgaacctcgtagggcgtgcagcaacagaggagagctgcaatgcctacgaggaacctggcggcagcgcaaaagatg

SEQ ID NO: 141300 - DNA, 103 bp, Artificial Sequence
  Synthetic Polynucleotide
taatacgactcactataggggagtggtccttcttgaagcgaacctcgtagaacagaggagactacgaatgtcgcttcaaaacctggcggcagcgcaaaagatg

SEQ ID NO: 141301 - DNA, 103 bp, Artificial Sequence
  Synthetic Polynucleotide
taatacgactcactataggggcccagcagcgagtggtccttcttgaagcgaacagaggagacgcttcatgaaggaccacaacctggcggcagcgcaaaagatg

SEQ ID NO: 141302 - DNA, 103 bp, Artificial Sequence
  Synthetic Polynucleotide
taatacgactcactatagggcgaaaacgcggcccagcagcgagtggtcctaacagaggagaaggaccatgcgctgctggaacctggcggcagcgcaaaagatg

SEQ ID NO: 141303 - DNA, 103 bp, Artificial Sequence
  Synthetic Polynucleotide
taatacgactcactatagggatgcgatcagcgccctcgtagttgacgcaaaacagaggagattgcgtatgctacgagggaacctggcggcagcgcaaaagatg

SEQ ID NO: 141304 - DNA, 103 bp, Artificial Sequence
  Synthetic Polynucleotide
taatacgactcactataggggcgtcgaaggcgaaaacgcggcccagcagcaacagaggagagctgctatgccgcgttttaacctggcggcagcgcaaaagatg

SEQ ID NO: 141305 - DNA, 103 bp, Artificial Sequence
  Synthetic Polynucleotide
taatacgactcactatagggcttggagacggcgtcgaaggcgaaaacgcgaacagaggagacgcgttatggccttcgacaacctggcggcagcgcaaaagatg

SEQ ID NO: 141306 - DNA, 103 bp, Artificial Sequence
  Synthetic Polynucleotide
taatacgactcactatagggccatgccgggcttggagacggcgtcgaaggaacagaggagaccttcgatgccgtctccaaacctggcggcagcgcaaaagatg

SEQ ID NO: 141307 - DNA, 103 bp, Artificial Sequence
  Synthetic Polynucleotide
taatacgactcactatagggaattcgtagtccatgccgggcttggagacgaacagaggagacgtctcatggcccggcataacctggcggcagcgcaaaagatg

SEQ ID NO: 141308 - DNA, 103 bp, Artificial Sequence
  Synthetic Polynucleotide
taatacgactcactataggggaacagcttcaattcgtagtccatgccgggaacagaggagacccggcatggactacgaaaacctggcggcagcgcaaaagatg

SEQ ID NO: 141309 - DNA, 103 bp, Artificial Sequence
  Synthetic Polynucleotide
taatacgactcactatagggggtactcaatgaacagcttcaattcgtagtaacagaggagaactacgatgtgaagctgtaacctggcggcagcgcaaaagatg

SEQ ID NO: 141310 - DNA, 103 bp, Artificial Sequence
  Synthetic Polynucleotide
taatacgactcactataggggagcccgtggggtactcaatgaacagcttcaacagaggagagaagctatgcattgagtaaacctggcggcagcgcaaaagatg

SEQ ID NO: 141311 - DNA, 103 bp, Artificial Sequence
  Synthetic Polynucleotide
taatacgactcactatagggcacgttgcccgagcccgtggggtactcaataacagaggagaattgagatgcccacgggcaacctggcggcagcgcaaaagatg

SEQ ID NO: 141312 - DNA, 103 bp, Artificial Sequence
  Synthetic Polynucleotide
taatacgactcactatagggcactggagtacacgttgcccgagcccgtggaacagaggagaccacggatgcgggcaacgaacctggcggcagcgcaaaagatg

SEQ ID NO: 141313 - DNA, 103 bp, Artificial Sequence
  Synthetic Polynucleotide
taatacgactcactatagggacaccagatgcactggagtacacgttgcccaacagaggagagggcaaatggtactccagaacctggcggcagcgcaaaagatg

SEQ ID NO: 141314 - DNA, 103 bp, Artificial Sequence
  Synthetic Polynucleotide
taatacgactcactatagggcacgaattcgatgcgatcagcgccctcgtaaacagaggagatacgagatggctgatcgcaacctggcggcagcgcaaaagatg

SEQ ID NO: 141315 - DNA, 103 bp, Artificial Sequence
  Synthetic Polynucleotide
taatacgactcactatagggctgcttggccacaccagatgcactggagtaaacagaggagatactccatggcatctggtaacctggcggcagcgcaaaagatg

SEQ ID NO: 141316 - DNA, 103 bp, Artificial Sequence
  Synthetic Polynucleotide
taatacgactcactatagggcctgatacatctgcttggccacaccagatgaacagaggagacatctgatgtggccaagcaacctggcggcagcgcaaaagatg

SEQ ID NO: 141317 - DNA, 103 bp, Artificial Sequence
  Synthetic Polynucleotide
taatacgactcactatagggttcatgcagtcctgatacatctgcttggccaacagaggagaggccaaatggatgtatcaaacctggcggcagcgcaaaagatg

SEQ ID NO: 141318 - DNA, 103 bp, Artificial Sequence
  Synthetic Polynucleotide
taatacgactcactataggggccgaagtccttcatgcagtcctgatacataacagaggagaatgtatatggactgcatgaacctggcggcagcgcaaaagatg

SEQ ID NO: 141319 - DNA, 103 bp, Artificial Sequence
  Synthetic Polynucleotide
taatacgactcactatagggataggccccggccgaagtccttcatgcagtaacagaggagaactgcaatgaggacttcgaacctggcggcagcgcaaaagatg

SEQ ID NO: 141320 - DNA, 103 bp, Artificial Sequence
  Synthetic Polynucleotide
taatacgactcactatagggaaacccgaggataggccccggccgaagtccaacagaggagaggacttatgccggggcctaacctggcggcagcgcaaaagatg

SEQ ID NO: 141321 - DNA, 103 bp, Artificial Sequence
  Synthetic Polynucleotide
taatacgactcactatagggcaggtacttgaaacccgaggataggccccgaacagaggagacggggcatgtcctcgggtaacctggcggcagcgcaaaagatg

SEQ ID NO: 141322 - DNA, 103 bp, Artificial Sequence
  Synthetic Polynucleotide
taatacgactcactatagggtttcgtactccaggtacttgaaacccgaggaacagaggagacctcggatgtcaagtaccaacctggcggcagcgcaaaagatg

SEQ ID NO: 141323 - DNA, 103 bp, Artificial Sequence
  Synthetic Polynucleotide
taatacgactcactatagggccgtgcttcttttcgtactccaggtacttgaacagaggagacaagtaatgggagtacgaaacctggcggcagcgcaaaagatg

SEQ ID NO: 141324 - DNA, 103 bp, Artificial Sequence
  Synthetic Polynucleotide
taatacgactcactataggggtccccggagccgtgcttcttttcgtactcaacagaggagagagtacatgaagaagcacaacctggcggcagcgcaaaagatg

SEQ ID NO: 141325 - DNA, 103 bp, Artificial Sequence
  Synthetic Polynucleotide
taatacgactcactatagggctgtctcgatcacgaattcgatgcgatcagaacagaggagactgatcatgtcgaattcgaacctggcggcagcgcaaaagatg

SEQ ID NO: 141326 - DNA, 103 bp, Artificial Sequence
  Synthetic Polynucleotide
taatacgactcactataggggcaggcgccagtccccggagccgtgcttctaacagaggagaagaagcatggctccggggaacctggcggcagcgcaaaagatg

SEQ ID NO: 141327 - DNA, 103 bp, Artificial Sequence
  Synthetic Polynucleotide
taatacgactcactatagggaggtctccaagcaggcgccagtccccggagaacagaggagactccggatgctggcgcctaacctggcggcagcgcaaaagatg

SEQ ID NO: 141328 - DNA, 103 bp, Artificial Sequence
  Synthetic Polynucleotide
taatacgactcactatagggttcggggagcaggtctccaagcaggcgccaaacagaggagatggcgcatgcttggagacaacctggcggcagcgcaaaagatg

SEQ ID NO: 141329 - DNA, 103 bp, Artificial Sequence
  Synthetic Polynucleotide
taatacgactcactatagggagcgcacggcttcggggagcaggtctccaaaacagaggagattggagatgtgctccccgaacctggcggcagcgcaaaagatg

SEQ ID NO: 141330 - DNA, 103 bp, Artificial Sequence
  Synthetic Polynucleotide
taatacgactcactatagggtccttgaagaagcgcacggcttcggggagcaacagaggagagctcccatgagccgtgcgaacctggcggcagcgcaaaagatg

SEQ ID NO: 141331 - DNA, 103 bp, Artificial Sequence
  Synthetic Polynucleotide
taatacgactcactataggggggcacgccctccttgaagaagcgcacggcaacagaggagagccgtgatgttcttcaagaacctggcggcagcgcaaaagatg

SEQ ID NO: 141332 - DNA, 103 bp, Artificial Sequence
  Synthetic Polynucleotide
taatacgactcactatagggtgtcggcgccgggcacgccctccttgaagaaacagaggagatcttcaatgagggcgtgcaacctggcggcagcgcaaaagatg

SEQ ID NO: 141333 - DNA, 103 bp, Artificial Sequence
  Synthetic Polynucleotide
taatacgactcactatagggtggggcagcatgtcggcgccgggcacgcccaacagaggagagggcgtatgcggcgccgaaacctggcggcagcgcaaaagatg

SEQ ID NO: 141334 - DNA, 103 bp, Artificial Sequence
  Synthetic Polynucleotide
taatacgactcactatagggcaggtagggctggggcagcatgtcggcgccaacagaggagaggcgccatgatgctgcccaacctggcggcagcgcaaaagatg

SEQ ID NO: 141335 - DNA, 103 bp, Artificial Sequence
  Synthetic Polynucleotide
taatacgactcactatagggagctggcgtccaggtagggctggggcagcaaacagaggagatgctgcatgagccctaccaacctggcggcagcgcaaaagatg

SEQ ID NO: 141336 - DNA, 103 bp, Artificial Sequence
  Synthetic Polynucleotide
taatacgactcactatagggagctggcgcgctgtctcgatcacgaattcgaacagaggagacgaattatggatcgagacaacctggcggcagcgcaaaagatg

SEQ ID NO: 141337 - DNA, 103 bp, Artificial Sequence
  Synthetic Polynucleotide
taatacgactcactatagggagcatgggacagctggcgtccaggtagggcaacagaggagagccctaatgggacgccagaacctggcggcagcgcaaaagatg

SEQ ID NO: 141338 - DNA, 103 bp, Artificial Sequence
  Synthetic Polynucleotide
taatacgactcactatagggagcagtgggcagcatgggacagctggcgtcaacagaggagagacgccatgtgtcccatgaacctggcggcagcgcaaaagatg

SEQ ID NO: 141339 - DNA, 103 bp, Artificial Sequence
  Synthetic Polynucleotide
taatacgactcactataggggactcaccagagcagtgggcagcatgggacaacagaggagagtcccaatgtgcccactgaacctggcggcagcgcaaaagatg

SEQ ID NO: 141340 - DNA, 103 bp, Artificial Sequence
  Synthetic Polynucleotide
taatacgactcactataggggcgcggctcagactcaccagagcagtgggcaacagaggagagcccacatgtctggtgagaacctggcggcagcgcaaaagatg

SEQ ID NO: 141341 - DNA, 103 bp, Artificial Sequence
  Synthetic Polynucleotide
taatacgactcactatagggtgcgctgggggcgcggctcagactcaccagaacagaggagactggtgatgctgagccgcaacctggcggcagcgcaaaagatg

SEQ ID NO: 141342 - DNA, 103 bp, Artificial Sequence
  Synthetic Polynucleotide
taatacgactcactatagggtccccgggggtgcgctgggggcgcggctcaaacagaggagatgagccatgcccccagcgaacctggcggcagcgcaaaagatg

SEQ ID NO: 141343 - DNA, 103 bp, Artificial Sequence
  Synthetic Polynucleotide
taatacgactcactatagggaaggccccggtccccgggggtgcgctggggaacagaggagaccccagatgacccccgggaacctggcggcagcgcaaaagatg

SEQ ID NO: 141344 - DNA, 103 bp, Artificial Sequence
  Synthetic Polynucleotide
taatacgactcactatagggggcgggcggcaaggccccggtccccgggggaacagaggagacccccgatgaccggggccaacctggcggcagcgcaaaagatg

SEQ ID NO: 141345 - DNA, 103 bp, Artificial Sequence
  Synthetic Polynucleotide
taatacgactcactatagggccgacggcgcggcgggcggcaaggccccggaacagaggagaccggggatgtgccgcccgaacctggcggcagcgcaaaagatg

SEQ ID NO: 141346 - DNA, 103 bp, Artificial Sequence
  Synthetic Polynucleotide
taatacgactcactataggggcgccccggcccgacggcgcggcgggcggcaacagaggagagccgccatgcgcgccgtcaacctggcggcagcgcaaaagatg

SEQ ID NO: 141347 - DNA, 103 bp, Artificial Sequence
  Synthetic Polynucleotide
taatacgactcactatagggcgcccgcttcagctggcgcgctgtctcgataacagaggagaatcgagatggcgcgccagaacctggcggcagcgcaaaagatg

SEQ ID NO: 141348 - DNA, 103 bp, Artificial Sequence
  Synthetic Polynucleotide
taatacgactcactataggggctggcggctgcgccccggcccgacggcgcaacagaggagagcgccgatgggccggggcaacctggcggcagcgcaaaagatg

SEQ ID NO: 141349 - DNA, 103 bp, Artificial Sequence
  Synthetic Polynucleotide
taatacgactcactatagggtcttgcgcaggctggcggctgcgccccggcaacagaggagagccgggatgcagccgccaaacctggcggcagcgcaaaagatg

SEQ ID NO: 141350 - DNA, 103 bp, Artificial Sequence
  Synthetic Polynucleotide
taatacgactcactataggggaggcctttctcttgcgcaggctggcggctaacagaggagaagccgcatgcctgcgcaaaacctggcggcagcgcaaaagatg

SEQ ID NO: 141351 - DNA, 103 bp, Artificial Sequence
  Synthetic Polynucleotide
taatacgactcactataggggggctccggagaggcctttctcttgcgcagaacagaggagactgcgcatgagaaaggccaacctggcggcagcgcaaaagatg

SEQ ID NO: 141352 - DNA, 103 bp, Artificial Sequence
  Synthetic Polynucleotide
taatacgactcactatagggctgagtccgggggctccggagaggcctttcaacagaggagagaaaggatgctccggagcaacctggcggcagcgcaaaagatg

SEQ ID NO: 141353 - DNA, 103 bp, Artificial Sequence
  Synthetic Polynucleotide
taatacgactcactataggggcgccctcggctgagtccgggggctccggaaacagaggagatccggaatgcccggactcaacctggcggcagcgcaaaagatg

SEQ ID NO: 141354 - DNA, 103 bp, Artificial Sequence
  Synthetic Polynucleotide
taatacgactcactatagggcagcttcagcgcgccctcggctgagtccggaacagaggagaccggacatggccgagggcaacctggcggcagcgcaaaagatg

SEQ ID NO: 141355 - DNA, 103 bp, Artificial Sequence
  Synthetic Polynucleotide
taatacgactcactataggggttcctcgcccagcttcagcgcgccctcggaacagaggagaccgaggatgcgctgaagcaacctggcggcagcgcaaaagatg

SEQ ID NO: 141356 - DNA, 103 bp, Artificial Sequence
  Synthetic Polynucleotide
taatacgactcactatagggtgcctctgctgttcctcgcccagcttcagcaacagaggagagctgaaatggggcgaggaaacctggcggcagcgcaaaagatg

SEQ ID NO: 141357 - DNA, 103 bp, Artificial Sequence
  Synthetic Polynucleotide
taatacgactcactatagggcatccactgctgcctctgctgttcctcgccaacagaggagaggcgagatgcagcagaggaacctggcggcagcgcaaaagatg

SEQ ID NO: 141358 - DNA, 103 bp, Artificial Sequence
  Synthetic Polynucleotide
taatacgactcactatagggagcagccgtgcgcccgcttcagctggcgcgaacagaggagacgcgccatgtgaagcgggaacctggcggcagcgcaaaagatg

SEQ ID NO: 141359 - DNA, 103 bp, Artificial Sequence
  Synthetic Polynucleotide
taatacgactcactatagggtctggttcgccatccactgctgcctctgctaacagaggagaagcagaatgagcagtggaaacctggcggcagcgcaaaagatg

SEQ ID NO: 141360 - DNA, 103 bp, Artificial Sequence
  Synthetic Polynucleotide
taatacgactcactatagggagcgcctcgctctggttcgccatccactgcaacagaggagagcagtgatgggcgaaccaaacctggcggcagcgcaaaagatg

SEQ ID NO: 141361 - DNA, 103 bp, Artificial Sequence
  Synthetic Polynucleotide
taatacgactcactatagggggtgagcttcagcgcctcgctctggttcgcaacagaggagagcgaacatgagcgaggcgaacctggcggcagcgcaaaagatg

SEQ ID NO: 141362 - DNA, 103 bp, Artificial Sequence
  Synthetic Polynucleotide
taatacgactcactatagggcggcggacatggtgagcttcagcgcctcgcaacagaggagagcgaggatgtgaagctcaaacctggcggcagcgcaaaagatg

SEQ ID NO: 141363 - DNA, 103 bp, Artificial Sequence
  Synthetic Polynucleotide
taatacgactcactataggggcgaagcccccggcggacatggtgagcttcaacagaggagagaagctatgcatgtccgcaacctggcggcagcgcaaaagatg

SEQ ID NO: 141364 - DNA, 103 bp, Artificial Sequence
  Synthetic Polynucleotide
taatacgactcactatagggccccggcgccgcgaagcccccggcggacataacagaggagaatgtccatggggggcttcaacctggcggcagcgcaaaagatg

SEQ ID NO: 141365 - DNA, 103 bp, Artificial Sequence
  Synthetic Polynucleotide
taatacgactcactatagggccgccgcgtgccccggcgccgcgaagccccaacagaggagaggggctatgcggcgccggaacctggcggcagcgcaaaagatg

SEQ ID NO: 141366 - DNA, 103 bp, Artificial Sequence
  Synthetic Polynucleotide
taatacgactcactatagggggcggaccccccgccgcgtgccccggcgccaacagaggagaggcgccatggcacgcggcaacctggcggcagcgcaaaagatg

SEQ ID NO: 141367 - DNA, 103 bp, Artificial Sequence
  Synthetic Polynucleotide
taatacgactcactataggggggcggcggaggcggaccccccgccgcgtgaacagaggagacacgcgatggggggtccgaacctggcggcagcgcaaaagatg

SEQ ID NO: 141368 - DNA, 103 bp, Artificial Sequence
  Synthetic Polynucleotide
taatacgactcactatagggccagaggtgggggcggcggaggcggaccccaacagaggagaggggtcatgctccgccgcaacctggcggcagcgcaaaagatg

SEQ ID NO: 141369 - DNA, 103 bp, Artificial Sequence
  Synthetic Polynucleotide
taatacgactcactatagggccgtcctggaagcagccgtgcgcccgcttcaacagaggagagaagcgatggcacggctgaacctggcggcagcgcaaaagatg

SEQ ID NO: 141370 - DNA, 103 bp, Artificial Sequence
  Synthetic Polynucleotide
taatacgactcactataggggaatggggtcccagaggtgggggcggcggaaacagaggagatccgccatgcccacctctaacctggcggcagcgcaaaagatg

SEQ ID NO: 141371 - DNA, 103 bp, Artificial Sequence
  Synthetic Polynucleotide
taatacgactcactatagggggtccggttggaatggggtcccagaggtggaacagaggagaccacctatgggaccccataacctggcggcagcgcaaaagatg

SEQ ID NO: 141372 - DNA, 103 bp, Artificial Sequence
  Synthetic Polynucleotide
taatacgactcactatagggcaggtggggtggtccggttggaatggggtcaacagaggagagaccccatgccaaccggaaacctggcggcagcgcaaaagatg

SEQ ID NO: 141373 - DNA, 103 bp, Artificial Sequence
  Synthetic Polynucleotide
taatacgactcactatagggggggctgactcaggtggggtggtccggttgaacagaggagacaaccgatgcaccccaccaacctggcggcagcgcaaaagatg

SEQ ID NO: 141374 - DNA, 103 bp, Artificial Sequence
  Synthetic Polynucleotide
taatacgactcactatagggaccgttctggggggctgactcaggtggggtaacagaggagaaccccaatggagtcagccaacctggcggcagcgcaaaagatg

SEQ ID NO: 141375 - DNA, 103 bp, Artificial Sequence
  Synthetic Polynucleotide
taatacgactcactatagggtaggggacggaccgttctggggggctgactaacagaggagaagtcagatgcccagaacgaacctggcggcagcgcaaaagatg

SEQ ID NO: 141376 - DNA, 103 bp, Artificial Sequence
  Synthetic Polynucleotide
taatacgactcactatagggagagcggccataggggacggaccgttctggaacagaggagaccagaaatgtccgtccccaacctggcggcagcgcaaaagatg

SEQ ID NO: 141377 - DNA, 103 bp, Artificial Sequence
  Synthetic Polynucleotide
taatacgactcactatagggcaccgacatgagagcggccataggggacggaacagaggagaccgtccatgatggccgctaacctggcggcagcgcaaaagatg

SEQ ID NO: 141378 - DNA, 103 bp, Artificial Sequence
  Synthetic Polynucleotide
taatacgactcactataggggagtatctgccaccgacatgagagcggccaaacagaggagatggccgatgtcatgtcggaacctggcggcagcgcaaaagatg

SEQ ID NO: 141379 - DNA, 103 bp, Artificial Sequence
  Synthetic Polynucleotide
taatacgactcactataggggctgtgcccagagtatctgccaccgacatgaacagaggagacatgtcatgggcagatacaacctggcggcagcgcaaaagatg

SEQ ID NO: 141380 - DNA, 103 bp, Artificial Sequence
  Synthetic Polynucleotide
taatacgactcactataggggggggagcggccgtcctggaagcagccgtgaacagaggagacacggcatgttccaggacaacctggcggcagcgcaaaagatg

SEQ ID NO: 141381 - DNA, 103 bp, Artificial Sequence
  Synthetic Polynucleotide
taatacgactcactataggggggcgagtgcgctgtgcccagagtatctgcaacagaggagagcagatatgctgggcacaaacctggcggcagcgcaaaagatg

SEQ ID NO: 141382 - DNA, 103 bp, Artificial Sequence
  Synthetic Polynucleotide
taatacgactcactatagggtgccatccttgggcgagtgcgctgtgcccaaacagaggagatgggcaatgcgcactcgcaacctggcggcagcgcaaaagatg

SEQ ID NO: 141383 - DNA, 103 bp, Artificial Sequence
  Synthetic Polynucleotide
taatacgactcactatagggtgcacggaactgccatccttgggcgagtgcaacagaggagagcactcatgcaaggatggaacctggcggcagcgcaaaagatg

SEQ ID NO: 141384 - DNA, 103 bp, Artificial Sequence
  Synthetic Polynucleotide
taatacgactcactatagggagtggtagagtgcacggaactgccatccttaacagaggagaaaggatatgagttccgtgaacctggcggcagcgcaaaagatg

SEQ ID NO: 141385 - DNA, 103 bp, Artificial Sequence
  Synthetic Polynucleotide
taatacgactcactataggggcgccgacgcagtggtagagtgcacggaacaacagaggagagttccgatgactctaccaaacctggcggcagcgcaaaagatg

SEQ ID NO: 141386 - DNA, 103 bp, Artificial Sequence
  Synthetic Polynucleotide
taatacgactcactatagggctgtttcgccgcgccgacgcagtggtagagaacagaggagactctacatgtgcgtcggcaacctggcggcagcgcaaaagatg

SEQ ID NO: 141387 - DNA, 103 bp, Artificial Sequence
  Synthetic Polynucleotide
taatacgactcactatagggtgggctgctgctgtttcgccgcgccgacgcaacagaggagagcgtcgatgcggcgaaacaacctggcggcagcgcaaaagatg

SEQ ID NO: 141388 - DNA, 103 bp, Artificial Sequence
  Synthetic Polynucleotide
taatacgactcactatagggccggcgagactgggctgctgctgtttcgccaacagaggagaggcgaaatggcagcagccaacctggcggcagcgcaaaagatg

SEQ ID NO: 141389 - DNA, 103 bp, Artificial Sequence
  Synthetic Polynucleotide
taatacgactcactatagggggcacggaggccggcgagactgggctgctgaacagaggagacagcagatgagtctcgccaacctggcggcagcgcaaaagatg

SEQ ID NO: 141390 - DNA, 103 bp, Artificial Sequence
  Synthetic Polynucleotide
taatacgactcactataggggcgctgccccggcacggaggccggcgagacaacagaggagagtctcgatggcctccgtgaacctggcggcagcgcaaaagatg

SEQ ID NO: 141391 - DNA, 103 bp, Artificial Sequence
  Synthetic Polynucleotide
taatacgactcactatagggaagattgtctccgggacgaggacacctgcgaacagaggagacgcaggatgcctcgtcccaacctggcggcagcgcaaaagatg

SEQ ID NO: 141392 - DNA, 103 bp, Artificial Sequence
  Synthetic Polynucleotide
taatacgactcactataggggcggcggcccgggggagcggccgtcctggaaacagaggagatccaggatggccgctcccaacctggcggcagcgcaaaagatg

SEQ ID NO: 141393 - DNA, 103 bp, Artificial Sequence
  Synthetic Polynucleotide
taatacgactcactatagggatgccaagcggcgctgccccggcacggaggaacagaggagacctccgatgcggggcagcaacctggcggcagcgcaaaagatg

SEQ ID NO: 141394 - DNA, 103 bp, Artificial Sequence
  Synthetic Polynucleotide
taatacgactcactatagggccgttacgtgatgccaagcggcgctgccccaacagaggagaggggcaatgccgcttggcaacctggcggcagcgcaaaagatg

SEQ ID NO: 141395 - DNA, 103 bp, Artificial Sequence
  Synthetic Polynucleotide
taatacgactcactatagggattcaggtccccgttacgtgatgccaagcgaacagaggagacgcttgatgtcacgtaacaacctggcggcagcgcaaaagatg

SEQ ID NO: 141396 - DNA, 103 bp, Artificial Sequence
  Synthetic Polynucleotide
taatacgactcactatagggccacctgtaaattcaggtccccgttacgtgaacagaggagacacgtaatggggacctgaaacctggcggcagcgcaaaagatg

SEQ ID NO: 141397 - DNA, 103 bp, Artificial Sequence
  Synthetic Polynucleotide
taatacgactcactatagggggcgggggcgccacctgtaaattcaggtccaacagaggagaggacctatgtttacaggtaacctggcggcagcgcaaaagatg

SEQ ID NO: 141398 - DNA, 103 bp, Artificial Sequence
  Synthetic Polynucleotide
taatacgactcactatagggggcgctaggcggcgggggcgccacctgtaaaacagaggagattacagatggcgcccccgaacctggcggcagcgcaaaagatg

SEQ ID NO: 141399 - DNA, 103 bp, Artificial Sequence
  Synthetic Polynucleotide
taatacgactcactatagggtgcccgggtgggcgctaggcggcgggggcgaacagaggagacgccccatgcgcctagcgaacctggcggcagcgcaaaagatg

SEQ ID NO: 141400 - DNA, 103 bp, Artificial Sequence
  Synthetic Polynucleotide
taatacgactcactatagggacttggtccatgcccgggtgggcgctaggcaacagaggagagcctagatgccacccgggaacctggcggcagcgcaaaagatg

SEQ ID NO: 141401 - DNA, 103 bp, Artificial Sequence
  Synthetic Polynucleotide
taatacgactcactatagggttgggggtgcacttggtccatgcccgggtgaacagaggagacacccgatgatggaccaaaacctggcggcagcgcaaaagatg

SEQ ID NO: 141402 - DNA, 103 bp, Artificial Sequence
  Synthetic Polynucleotide
taatacgactcactatagggccggaatgttttgggggtgcacttggtccaaacagaggagatggaccatgtgcacccccaacctggcggcagcgcaaaagatg

SEQ ID NO: 141403 - DNA, 103 bp, Artificial Sequence
  Synthetic Polynucleotide
taatacgactcactatagggccgacgggcggcggcggcccgggggagcggaacagaggagaccgctcatgcgggccgccaacctggcggcagcgcaaaagatg

SEQ ID NO: 141404 - DNA, 103 bp, Artificial Sequence
  Synthetic Polynucleotide
taatacgactcactatagggatgggggaatccggaatgttttgggggtgcaacagaggagagcacccatgaaacattccaacctggcggcagcgcaaaagatg

SEQ ID NO: 141405 - DNA, 103 bp, Artificial Sequence
  Synthetic Polynucleotide
taatacgactcactataggggctgttggccatgggggaatccggaatgttaacagaggagaaacattatggattcccccaacctggcggcagcgcaaaagatg

SEQ ID NO: 141406 - DNA, 103 bp, Artificial Sequence
  Synthetic Polynucleotide
taatacgactcactatagggagaggggtccgctgttggccatgggggaataacagaggagaattcccatgtggccaacaaacctggcggcagcgcaaaagatg

SEQ ID NO: 141407 - DNA, 103 bp, Artificial Sequence
  Synthetic Polynucleotide
taatacgactcactatagggatggtgcagcagaggggtccgctgttggccaacagaggagaggccaaatgcggacccctaacctggcggcagcgcaaaagatg

SEQ ID NO: 141408 - DNA, 103 bp, Artificial Sequence
  Synthetic Polynucleotide
taatacgactcactatagggttcgtggcaaatggtgcagcagaggggtccaacagaggagaggacccatgtgctgcaccaacctggcggcagcgcaaaagatg

SEQ ID NO: 141409 - DNA, 103 bp, Artificial Sequence
  Synthetic Polynucleotide
taatacgactcactatagggcctccaaacgttcgtggcaaatggtgcagcaacagaggagagctgcaatgtttgccacgaacctggcggcagcgcaaaagatg

SEQ ID NO: 141410 - DNA, 103 bp, Artificial Sequence
  Synthetic Polynucleotide
taatacgactcactatagggaaatgcgtatcctccaaacgttcgtggcaaaacagaggagattgccaatgacgtttggaaacctggcggcagcgcaaaagatg

SEQ ID NO: 141411 - DNA, 103 bp, Artificial Sequence
  Synthetic Polynucleotide
taatacgactcactataggggcactgaacgaaatgcgtatcctccaaacgaacagaggagacgtttgatggatacgcataacctggcggcagcgcaaaagatg

SEQ ID NO: 141412 - DNA, 103 bp, Artificial Sequence
  Synthetic Polynucleotide
taatacgactcactatagggggacggaagggcactgaacgaaatgcgtataacagaggagaatacgcatgtcgttcagtaacctggcggcagcgcaaaagatg

SEQ ID NO: 141413 - DNA, 103 bp, Artificial Sequence
  Synthetic Polynucleotide
taatacgactcactatagggttgtggctggggacggaagggcactgaacgaacagaggagacgttcaatgcccttccgtaacctggcggcagcgcaaaagatg

SEQ ID NO: 141414 - DNA, 103 bp, Artificial Sequence
  Synthetic Polynucleotide
taatacgactcactatagggtgtcttgaccccgacgggcggcggcggcccaacagaggagagggccgatgccgcccgtcaacctggcggcagcgcaaaagatg

SEQ ID NO: 141415 - DNA, 103 bp, Artificial Sequence
  Synthetic Polynucleotide
taatacgactcactataggggaagcaaaatttgtggctggggacggaaggaacagaggagaccttccatgcccagccacaacctggcggcagcgcaaaagatg

SEQ ID NO: 141416 - DNA, 103 bp, Artificial Sequence
  Synthetic Polynucleotide
taatacgactcactatagggtagagcaagggaagcaaaatttgtggctggaacagaggagaccagccatgaattttgctaacctggcggcagcgcaaaagatg

SEQ ID NO: 141417 - DNA, 103 bp, Artificial Sequence
  Synthetic Polynucleotide
taatacgactcactatagggatactctctctagagcaagggaagcaaaataacagaggagaattttgatgcccttgctcaacctggcggcagcgcaaaagatg

SEQ ID NO: 141418 - DNA, 103 bp, Artificial Sequence
  Synthetic Polynucleotide
taatacgactcactatagggctgggccttgatactctctctagagcaaggaacagaggagaccttgcatgagagagagtaacctggcggcagcgcaaaagatg

SEQ ID NO: 141419 - DNA, 103 bp, Artificial Sequence
  Synthetic Polynucleotide
taatacgactcactatagggcggtggccccctgggccttgatactctctcaacagaggagagagagaatgtcaaggcccaacctggcggcagcgcaaaagatg

SEQ ID NO: 141420 - DNA, 103 bp, Artificial Sequence
  Synthetic Polynucleotide
taatacgactcactatagggtacacctcgccggtggccccctgggccttgaacagaggagacaaggcatggggggccacaacctggcggcagcgcaaaagatg

SEQ ID NO: 141421 - DNA, 103 bp, Artificial Sequence
  Synthetic Polynucleotide
taatacgactcactataggggctggggcaatacacctcgccggtggccccaacagaggagaggggccatgggcgaggtgaacctggcggcagcgcaaaagatg

SEQ ID NO: 141422 - DNA, 103 bp, Artificial Sequence
  Synthetic Polynucleotide
taatacgactcactatagggatttctctccgctggggcaatacacctcgcaacagaggagagcgaggatgattgccccaaacctggcggcagcgcaaaagatg

SEQ ID NO: 141423 - DNA, 103 bp, Artificial Sequence
  Synthetic Polynucleotide
taatacgactcactatagggactagggggcatttctctccgctggggcaaaacagaggagattgcccatgcggagagaaaacctggcggcagcgcaaaagatg

SEQ ID NO: 141424 - DNA, 103 bp, Artificial Sequence
  Synthetic Polynucleotide
taatacgactcactatagggattcgacccgactagggggcatttctctccaacagaggagaggagagatgtgccccctaaacctggcggcagcgcaaaagatg

SEQ ID NO: 141425 - DNA, 103 bp, Artificial Sequence
  Synthetic Polynucleotide
taatacgactcactatagggacagggccactgtcttgaccccgacgggcgaacagaggagacgcccgatggggtcaagaaacctggcggcagcgcaaaagatg

SEQ ID NO: 141426 - DNA, 103 bp, Artificial Sequence
  Synthetic Polynucleotide
taatacgactcactatagggcccaaggtacattcgacccgactagggggcaacagaggagagcccccatgtcgggtcgaaacctggcggcagcgcaaaagatg

SEQ ID NO: 141427 - DNA, 103 bp, Artificial Sequence
  Synthetic Polynucleotide
taatacgactcactatagggtgcatgaaggcccaaggtacattcgacccgaacagaggagacgggtcatgtgtaccttgaacctggcggcagcgcaaaagatg

SEQ ID NO: 141428 - DNA, 103 bp, Artificial Sequence
  Synthetic Polynucleotide
taatacgactcactataggggatttcgccctgcatgaaggcccaaggtacaacagaggagagtacctatggccttcatgaacctggcggcagcgcaaaagatg

SEQ ID NO: 141429 - DNA, 103 bp, Artificial Sequence
  Synthetic Polynucleotide
taatacgactcactatagggagatagtcgcgatttcgccctgcatgaaggaacagaggagaccttcaatgagggcgaaaaacctggcggcagcgcaaaagatg

SEQ ID NO: 141430 - DNA, 103 bp, Artificial Sequence
  Synthetic Polynucleotide
taatacgactcactatagggtccccagctaagatagtcgcgatttcgcccaacagaggagagggcgaatgcgcgactataacctggcggcagcgcaaaagatg

SEQ ID NO: 141431 - DNA, 103 bp, Artificial Sequence
  Synthetic Polynucleotide
taatacgactcactatagggcactttaacatccccagctaagatagtcgcaacagaggagagcgactatgttagctgggaacctggcggcagcgcaaaagatg

SEQ ID NO: 141432 - DNA, 103 bp, Artificial Sequence
  Synthetic Polynucleotide
taatacgactcactatagggtctcctttttcactttaacatccccagctaaacagaggagatagctgatgatgttaaagaacctggcggcagcgcaaaagatg

SEQ ID NO: 141433 - DNA, 103 bp, Artificial Sequence
  Synthetic Polynucleotide
taatacgactcactatagggcaagggtctctctcctttttcactttaacaaacagaggagatgttaaatggaaaaaggaaacctggcggcagcgcaaaagatg

SEQ ID NO: 141434 - DNA, 103 bp, Artificial Sequence
  Synthetic Polynucleotide
taatacgactcactatagggtccttagccgacagggccactgtcttgaccaacagaggagaggtcaaatgagtggccctaacctggcggcagcgcaaaagatg

SEQ ID NO: 141435 - DNA, 103 bp, Artificial Sequence
  Synthetic Polynucleotide
taatacgactcactatagggcgccgccgcttccttagccgacagggccacaacagaggagagtggccatgtcggctaagaacctggcggcagcgcaaaagatg

SEQ ID NO: 141436 - DNA, 103 bp, Artificial Sequence
  Synthetic Polynucleotide
taatacgactcactatagggctgccgccgccgccgccgcttccttagccgaacagaggagacggctaatgaagcggcggaacctggcggcagcgcaaaagatg

SEQ ID NO: 141437 - DNA, 103 bp, Artificial Sequence
  Synthetic Polynucleotide
taatacgactcactataggggccgccgctgctgccgccgccgccgccgctaacagaggagaagcggcatgggcggcggcaacctggcggcagcgcaaaagatg

SEQ ID NO: 141438 - DNA, 103 bp, Artificial Sequence
  Synthetic Polynucleotide
taatacgactcactatagggggcggcggcggccgccgctgctgccgccgcaacagaggagagcggcgatggcagcggcgaacctggcggcagcgcaaaagatg

SEQ ID NO: 141439 - DNA, 103 bp, Artificial Sequence
  Synthetic Polynucleotide
taatacgactcactataggggttgcgcggcggcggcggcggccgccgctgaacagaggagacagcggatgccgccgccgaacctggcggcagcgcaaaagatg

SEQ ID NO: 141440 - DNA, 103 bp, Artificial Sequence
  Synthetic Polynucleotide
taatacgactcactatagggcacaggtagcaagattgtctccgggacgagaacagaggagactcgtcatggagacaatcaacctggcggcagcgcaaaagatg

SEQ ID NO: 141441 - DNA, 103 bp, Artificial Sequence
  Synthetic Polynucleotide
taatacgactcactatagggtgctgttgctgttgcgcggcggcggcggcgaacagaggagacgccgcatgcgccgcgcaaacctggcggcagcgcaaaagatg

SEQ ID NO: 141442 - DNA, 103 bp, Artificial Sequence
  Synthetic Polynucleotide
taatacgactcactatagggctgctgctgttgctgttgctgttgcgcggcaacagaggagagccgcgatgcagcaacagaacctggcggcagcgcaaaagatg

SEQ ID NO: 141443 - DNA, 103 bp, Artificial Sequence
  Synthetic Polynucleotide
taatacgactcactataggggctgctgctgctgctgctgttgctgttgctaacagaggagaagcaacatgaacagcagcaacctggcggcagcgcaaaagatg

SEQ ID NO: 141444 - DNA, 103 bp, Artificial Sequence
  Synthetic Polynucleotide
taatacgactcactatagggtgctgctgttgctgctgctgctgctgctgtaacagaggagaacagcaatggcagcagcaaacctggcggcagcgcaaaagatg

SEQ ID NO: 141445 - DNA, 103 bp, Artificial Sequence
  Synthetic Polynucleotide
taatacgactcactatagggctgctgctgctgctgctgttgctgctgctgaacagaggagacagcagatgcaacagcagaacctggcggcagcgcaaaagatg

SEQ ID NO: 141446 - DNA, 103 bp, Artificial Sequence
  Synthetic Polynucleotide
taatacgactcactataggggctgctgctgctgctgctgctgctgctgttaacagaggagaaacagcatgagcagcagcaacctggcggcagcgcaaaagatg

SEQ ID NO: 141447 - DNA, 103 bp, Artificial Sequence
  Synthetic Polynucleotide
taatacgactcactatagggtgttgttgctgctgctgctgctgctgctgcaacagaggagagcagcaatggcagcagcaaacctggcggcagcgcaaaagatg

SEQ ID NO: 141448 - DNA, 103 bp, Artificial Sequence
  Synthetic Polynucleotide
taatacgactcactataggggtggttgagctgttgttgctgctgctgctgaacagaggagacagcagatgcagcaacaaaacctggcggcagcgcaaaagatg

SEQ ID NO: 141449 - DNA, 103 bp, Artificial Sequence
  Synthetic Polynucleotide
taatacgactcactatagggaaccatcaacgtggttgagctgttgttgctaacagaggagaagcaacatgagctcaaccaacctggcggcagcgcaaaagatg

SEQ ID NO: 141450 - DNA, 103 bp, Artificial Sequence
  Synthetic Polynucleotide
taatacgactcactatagggggcttgctggaaccatcaacgtggttgagcaacagaggagagctcaaatgcgttgatggaacctggcggcagcgcaaaagatg

SEQ ID NO: 141451 - DNA, 103 bp, Artificial Sequence
  Synthetic Polynucleotide
taatacgactcactataggggggcaggtcgcacaggtagcaagattgtctaacagaggagaagacaaatgtgctacctgaacctggcggcagcgcaaaagatg

SEQ ID NO: 141452 - DNA, 103 bp, Artificial Sequence
  Synthetic Polynucleotide
taatacgactcactatagggcagcaccgcaggcttgctggaaccatcaacaacagaggagagttgatatgtccagcaagaacctggcggcagcgcaaaagatg

SEQ ID NO: 141453 - DNA, 103 bp, Artificial Sequence
  Synthetic Polynucleotide
taatacgactcactatagggacggggccgccagcaccgcaggcttgctggaacagaggagaccagcaatgctgcggtgcaacctggcggcagcgcaaaagatg

SEQ ID NO: 141454 - DNA, 103 bp, Artificial Sequence
  Synthetic Polynucleotide
taatacgactcactatagggtccaggccagacggggccgccagcaccgcaaacagaggagatgcggtatgggcggccccaacctggcggcagcgcaaaagatg

SEQ ID NO: 141455 - DNA, 103 bp, Artificial Sequence
  Synthetic Polynucleotide
taatacgactcactataggggccgtagcgctccaggccagacggggccgcaacagaggagagcggccatgtctggcctgaacctggcggcagcgcaaaagatg

SEQ ID NO: 141456 - DNA, 103 bp, Artificial Sequence
  Synthetic Polynucleotide
taatacgactcactatagggcagcgcttaggccgtagcgctccaggccagaacagaggagactggccatgagcgctacgaacctggcggcagcgcaaaagatg

SEQ ID NO: 141457 - DNA, 103 bp, Artificial Sequence
  Synthetic Polynucleotide
taatacgactcactataggggcggcggcggcagcgcttaggccgtagcgcaacagaggagagcgctaatgcctaagcgcaacctggcggcagcgcaaaagatg

SEQ ID NO: 141458 - DNA, 103 bp, Artificial Sequence
  Synthetic Polynucleotide
taatacgactcactatagggggcggcggcggcggcggcggcagcgcttagaacagaggagactaagcatggccgccgccaacctggcggcagcgcaaaagatg

SEQ ID NO: 141459 - DNA, 103 bp, Artificial Sequence
  Synthetic Polynucleotide
taatacgactcactatagggcagcggcggcggcggcggcggcggcggcggaacagaggagaccgccgatgccgccgccgaacctggcggcagcgcaaaagatg

SEQ ID NO: 141460 - DNA, 103 bp, Artificial Sequence
  Synthetic Polynucleotide
taatacgactcactatagggtgttccaccgcagcggcggcggcggcggcgaacagaggagacgccgcatgcgccgccgcaacctggcggcagcgcaaaagatg

SEQ ID NO: 141461 - DNA, 103 bp, Artificial Sequence
  Synthetic Polynucleotide
taatacgactcactataggggcggctgcgctgttccaccgcagcggcggcaacagaggagagccgccatggcggtggaaaacctggcggcagcgcaaaagatg

SEQ ID NO: 141462 - DNA, 103 bp, Artificial Sequence
  Synthetic Polynucleotide
taatacgactcactatagggagggcatgcggggcaggtcgcacaggtagcaacagaggagagctaccatggcgacctgcaacctggcggcagcgcaaaagatg

SEQ ID NO: 141463 - DNA, 103 bp, Artificial Sequence
  Synthetic Polynucleotide
taatacgactcactatagggggtactcgaagcggctgcgctgttccaccgaacagaggagacggtggatgagcgcagccaacctggcggcagcgcaaaagatg

SEQ ID NO: 141464 - DNA, 103 bp, Artificial Sequence
  Synthetic Polynucleotide
taatacgactcactatagggggcggtggcgggtactcgaagcggctgcgcaacagaggagagcgcagatgcttcgagtaaacctggcggcagcgcaaaagatg

SEQ ID NO: 141465 - DNA, 103 bp, Artificial Sequence
  Synthetic Polynucleotide
taatacgactcactatagggcaggctcaccggcggtggcgggtactcgaaaacagaggagattcgagatgccgccaccgaacctggcggcagcgcaaaagatg

SEQ ID NO: 141466 - DNA, 103 bp, Artificial Sequence
  Synthetic Polynucleotide
taatacgactcactatagggtgctgcttcccaggctcaccggcggtggcgaacagaggagacgccacatgcggtgagccaacctggcggcagcgcaaaagatg

SEQ ID NO: 141467 - DNA, 103 bp, Artificial Sequence
  Synthetic Polynucleotide
taatacgactcactataggggcggtgtggctgctgcttcccaggctcaccaacagaggagaggtgagatggggaagcagaacctggcggcagcgcaaaagatg

SEQ ID NO: 141468 - DNA, 103 bp, Artificial Sequence
  Synthetic Polynucleotide
taatacgactcactataggggggcagtcgcgcggtgtggctgctgcttccaacagaggagaggaagcatgagccacaccaacctggcggcagcgcaaaagatg

SEQ ID NO: 141469 - DNA, 103 bp, Artificial Sequence
  Synthetic Polynucleotide
taatacgactcactatagggccaggccgttgggcagtcgcgcggtgtggcaacagaggagagccacaatgcgcgactgcaacctggcggcagcgcaaaagatg

SEQ ID NO: 141470 - DNA, 103 bp, Artificial Sequence
  Synthetic Polynucleotide
taatacgactcactatagggtttgggccccccaggccgttgggcagtcgcaacagaggagagcgactatgcaacggcctaacctggcggcagcgcaaaagatg

SEQ ID NO: 141471 - DNA, 103 bp, Artificial Sequence
  Synthetic Polynucleotide
taatacgactcactatagggggggaagccgtttgggccccccaggccgttaacagaggagaaacggcatggggggcccaaacctggcggcagcgcaaaagatg

SEQ ID NO: 141472 - DNA, 103 bp, Artificial Sequence
  Synthetic Polynucleotide
taatacgactcactataggggtgttggtttggggaagccgtttgggccccaacagaggagaggggccatgacggcttccaacctggcggcagcgcaaaagatg

SEQ ID NO: 141473 - DNA, 103 bp, Artificial Sequence
  Synthetic Polynucleotide
taatacgactcactatagggatcatggcccagggcatgcggggcaggtcgaacagaggagacgacctatgccgcatgccaacctggcggcagcgcaaaagatg

SEQ ID NO: 141474 - DNA, 103 bp, Artificial Sequence
  Synthetic Polynucleotide
taatacgactcactatagggccctcctctggtgttggtttggggaagccgaacagaggagacggcttatgcaaaccaacaacctggcggcagcgcaaaagatg

SEQ ID NO: 141475 - DNA, 103 bp, Artificial Sequence
  Synthetic Polynucleotide
taatacgactcactatagggctctgggggtccctcctctggtgttggtttaacagaggagaaaaccaatgccagaggagaacctggcggcagcgcaaaagatg

SEQ ID NO: 141476 - DNA, 103 bp, Artificial Sequence
  Synthetic Polynucleotide
taatacgactcactataggggacggttcagctctgggggtccctcctctgaacagaggagacagaggatggacccccagaacctggcggcagcgcaaaagatg

SEQ ID NO: 141477 - DNA, 103 bp, Artificial Sequence
  Synthetic Polynucleotide
taatacgactcactatagggttggggctctgacggttcagctctgggggtaacagaggagaacccccatggctgaaccgaacctggcggcagcgcaaaagatg

SEQ ID NO: 141478 - DNA, 103 bp, Artificial Sequence
  Synthetic Polynucleotide
taatacgactcactatagggtgaagaagaattggggctctgacggttcagaacagaggagactgaacatgcagagccccaacctggcggcagcgcaaaagatg

SEQ ID NO: 141479 - DNA, 103 bp, Artificial Sequence
  Synthetic Polynucleotide
taatacgactcactatagggacgccgccgctgaagaagaattggggctctaacagaggagaagagccatgattcttcttaacctggcggcagcgcaaaagatg

SEQ ID NO: 141480 - DNA, 103 bp, Artificial Sequence
  Synthetic Polynucleotide
taatacgactcactataggggacgccaccgacgccgccgctgaagaagaaaacagaggagattcttcatgagcggcggcaacctggcggcagcgcaaaagatg

SEQ ID NO: 141481 - DNA, 103 bp, Artificial Sequence
  Synthetic Polynucleotide
taatacgactcactatagggtccacgccgagacgccaccgacgccgccgcaacagaggagagcggcgatgtcggtggcgaacctggcggcagcgcaaaagatg

SEQ ID NO: 141482 - DNA, 103 bp, Artificial Sequence
  Synthetic Polynucleotide
taatacgactcactatagggcaccgtgcgttccacgccgagacgccaccgaacagaggagacggtggatgctcggcgtgaacctggcggcagcgcaaaagatg

SEQ ID NO: 141483 - DNA, 103 bp, Artificial Sequence
  Synthetic Polynucleotide
taatacgactcactataggggtaaccagcccaccgtgcgttccacgccgaaacagaggagatcggcgatgaacgcacggaacctggcggcagcgcaaaagatg

SEQ ID NO: 141484 - DNA, 103 bp, Artificial Sequence
  Synthetic Polynucleotide
taatacgactcactataggggaagtcccagatcatggcccagggcatgcgaacagaggagacgcatgatgtgggccatgaacctggcggcagcgcaaaagatg

SEQ ID NO: 141485 - DNA, 103 bp, Artificial Sequence
  Synthetic Polynucleotide
taatacgactcactataggggggcagccccgtaaccagcccaccgtgcgtaacagaggagaacgcacatggggctggttaacctggcggcagcgcaaaagatg

SEQ ID NO: 141486 - DNA, 103 bp, Artificial Sequence
  Synthetic Polynucleotide
taatacgactcactatagggcccccgggttgggcagccccgtaaccagccaacagaggagaggctggatgcggggctgcaacctggcggcagcgcaaaagatg

SEQ ID NO: 141487 - DNA, 103 bp, Artificial Sequence
  Synthetic Polynucleotide
taatacgactcactatagggcctccgccaccccccgggttgggcagccccaacagaggagaggggctatgcaacccgggaacctggcggcagcgcaaaagatg

SEQ ID NO: 141488 - DNA, 103 bp, Artificial Sequence
  Synthetic Polynucleotide
taatacgactcactataggggagctgggggcctccgccaccccccgggttaacagaggagaaacccgatgggtggcggaaacctggcggcagcgcaaaagatg

SEQ ID NO: 141489 - DNA, 103 bp, Artificial Sequence
  Synthetic Polynucleotide
taatacgactcactatagggggggcacggtgagctgggggcctccgccacaacagaggagagtggcgatggcccccagcaacctggcggcagcgcaaaagatg

SEQ ID NO: 141490 - DNA, 103 bp, Artificial Sequence
  Synthetic Polynucleotide
taatacgactcactatagggagcaggttggggggcacggtgagctgggggaacagaggagacccccaatgcaccgtgccaacctggcggcagcgcaaaagatg

SEQ ID NO: 141491 - DNA, 103 bp, Artificial Sequence
  Synthetic Polynucleotide
taatacgactcactatagggcgtctgcggtagcaggttggggggcacggtaacagaggagaaccgtgatgcccaacctgaacctggcggcagcgcaaaagatg

SEQ ID NO: 141492 - DNA, 103 bp, Artificial Sequence
  Synthetic Polynucleotide
taatacgactcactatagggcgttaagcagcgtctgcggtagcaggttggaacagaggagaccaaccatgtaccgcagaaacctggcggcagcgcaaaagatg

SEQ ID NO: 141493 - DNA, 103 bp, Artificial Sequence
  Synthetic Polynucleotide
taatacgactcactatagggctggccgggccgttaagcagcgtctgcggtaacagaggagaaccgcaatggctgcttaaaacctggcggcagcgcaaaagatg

SEQ ID NO: 141494 - DNA, 103 bp, Artificial Sequence
  Synthetic Polynucleotide
taatacgactcactatagggtaccgcagcgctggccgggccgttaagcagaacagaggagactgcttatgggcccggccaacctggcggcagcgcaaaagatg

SEQ ID NO: 141495 - DNA, 103 bp, Artificial Sequence
  Synthetic Polynucleotide
taatacgactcactatagggcgggttccgagaagtcccagatcatggcccaacagaggagagggccaatgtctgggactaacctggcggcagcgcaaaagatg

SEQ ID NO: 141496 - DNA, 103 bp, Artificial Sequence
  Synthetic Polynucleotide
taatacgactcactataggggtggggggagtaccgcagcgctggccgggcaacagaggagagcccggatggcgctgcggaacctggcggcagcgcaaaagatg

SEQ ID NO: 141497 - DNA, 103 bp, Artificial Sequence
  Synthetic Polynucleotide
taatacgactcactatagggtggggagggggtggggggagtaccgcagcgaacagaggagacgctgcatgactccccccaacctggcggcagcgcaaaagatg

SEQ ID NO: 141498 - DNA, 103 bp, Artificial Sequence
  Synthetic Polynucleotide
taatacgactcactataggggcccagggcgtggggagggggtggggggagaacagaggagactccccatgccccctcccaacctggcggcagcgcaaaagatg

SEQ ID NO: 141499 - DNA, 103 bp, Artificial Sequence
  Synthetic Polynucleotide
taatacgactcactataggggcccacggctgcccagggcgtggggaggggaacagaggagacccctcatgacgccctggaacctggcggcagcgcaaaagatg

SEQ ID NO: 141500 - DNA, 103 bp, Artificial Sequence
  Synthetic Polynucleotide
taatacgactcactatagggggcgtcgggggcccacggctgcccagggcgaacagaggagacgccctatgcagccgtggaacctggcggcagcgcaaaagatg

SEQ ID NO: 141501 - DNA, 103 bp, Artificial Sequence
  Synthetic Polynucleotide
taatacgactcactatagggtgggggagcaggcgtcgggggcccacggctaacagaggagaagccgtatgcccccgacgaacctggcggcagcgcaaaagatg

SEQ ID NO: 141502 - DNA, 103 bp, Artificial Sequence
  Synthetic Polynucleotide
taatacgactcactatagggcaggagcccctgggggagcaggcgtcggggaacagaggagaccccgaatgctgctccccaacctggcggcagcgcaaaagatg

SEQ ID NO: 141503 - DNA, 103 bp, Artificial Sequence
  Synthetic Polynucleotide
taatacgactcactataggggcggggcccccaggagcccctgggggagcaaacagaggagatgctccatgaggggctccaacctggcggcagcgcaaaagatg

SEQ ID NO: 141504 - DNA, 103 bp, Artificial Sequence
  Synthetic Polynucleotide
taatacgactcactatagggcccgagacaagcggggcccccaggagccccaacagaggagaggggctatggggggccccaacctggcggcagcgcaaaagatg

SEQ ID NO: 141505 - DNA, 103 bp, Artificial Sequence
  Synthetic Polynucleotide
taatacgactcactatagggccggggtacccccgagacaagcggggccccaacagaggagaggggccatgcttgtctcgaacctggcggcagcgcaaaagatg

SEQ ID NO: 141506 - DNA, 103 bp, Artificial Sequence
  Synthetic Polynucleotide
taatacgactcactatagggccgcggcatacgggttccgagaagtcccagaacagaggagactgggaatgctcggaaccaacctggcggcagcgcaaaagatg

SEQ ID NO: 141507 - DNA, 103 bp, Artificial Sequence
  Synthetic Polynucleotide
taatacgactcactataggggccgatacacccggggtacccccgagacaaaacagaggagattgtctatggggtaccccaacctggcggcagcgcaaaagatg

SEQ ID NO: 141508 - DNA, 103 bp, Artificial Sequence
  Synthetic Polynucleotide
taatacgactcactatagggggacgacgtggccgatacacccggggtaccaacagaggagaggtaccatgggtgtatcgaacctggcggcagcgcaaaagatg

SEQ ID NO: 141509 - DNA, 103 bp, Artificial Sequence
  Synthetic Polynucleotide
taatacgactcactatagggacgacgcggaggacgacgtggccgatacacaacagaggagagtgtatatgccacgtcgtaacctggcggcagcgcaaaagatg

SEQ ID NO: 141510 - DNA, 103 bp, Artificial Sequence
  Synthetic Polynucleotide
taatacgactcactataggggaggtcgaagacgacgcggaggacgacgtgaacagaggagacacgtcatgctccgcgtcaacctggcggcagcgcaaaagatg

SEQ ID NO: 141511 - DNA, 103 bp, Artificial Sequence
  Synthetic Polynucleotide
taatacgactcactatagggcaccgacgaagaggtcgaagacgacgcggaaacagaggagatccgcgatgtcttcgaccaacctggcggcagcgcaaaagatg

SEQ ID NO: 141512 - DNA, 103 bp, Artificial Sequence
  Synthetic Polynucleotide
taatacgactcactatagggccacctctgccaccgacgaagaggtcgaagaacagaggagacttcgaatgcttcgtcggaacctggcggcagcgcaaaagatg

SEQ ID NO: 141513 - DNA, 103 bp, Artificial Sequence
  Synthetic Polynucleotide
taatacgactcactataggggcacccacgcccacctctgccaccgacgaaaacagaggagattcgtcatgggcagaggtaacctggcggcagcgcaaaagatg

SEQ ID NO: 141514 - DNA, 103 bp, Artificial Sequence
  Synthetic Polynucleotide
taatacgactcactatagggcttaccaccagcacccacgcccacctctgcaacagaggagagcagagatgggcgtgggtaacctggcggcagcgcaaaagatg

SEQ ID NO: 141515 - DNA, 103 bp, Artificial Sequence
  Synthetic Polynucleotide
taatacgactcactatagggagccgggcctcttaccaccagcacccacgcaacagaggagagcgtggatgctggtggtaaacctggcggcagcgcaaaagatg

SEQ ID NO: 141516 - DNA, 103 bp, Artificial Sequence
  Synthetic Polynucleotide
taatacgactcactatagggctcgacaccgagccgggcctcttaccaccaaacagaggagatggtggatggaggcccggaacctggcggcagcgcaaaagatg

SEQ ID NO: 141517 - DNA, 103 bp, Artificial Sequence
  Synthetic Polynucleotide
taatacgactcactataggggggcaggatccgtggctttggggttcccataacagaggagaatgggaatgccaaagccaaacctggcggcagcgcaaaagatg

SEQ ID NO: 141518 - DNA, 103 bp, Artificial Sequence
  Synthetic Polynucleotide
taatacgactcactataggggtgcttccaagggatgcggaagcgcgtgcgaacagaggagacgcacgatgttccgcatcaacctggcggcagcgcaaaagatg

SEQ ID NO: 141519 - DNA, 103 bp, Artificial Sequence
  Synthetic Polynucleotide
taatacgactcactatagggtggtgagcgtccgcttccttccgtgaaggtaacagaggagaaccttcatggaaggaagcaacctggcggcagcgcaaaagatg

SEQ ID NO: 141520 - DNA, 103 bp, Artificial Sequence
  Synthetic Polynucleotide
taatacgactcactataggggggcatagcgtggtgagcgtccgcttccttaacagaggagaaaggaaatggacgctcacaacctggcggcagcgcaaaagatg

SEQ ID NO: 141521 - DNA, 103 bp, Artificial Sequence
  Synthetic Polynucleotide
taatacgactcactatagggcagaaccagagggcatagcgtggtgagcgtaacagaggagaacgctcatgacgctatgcaacctggcggcagcgcaaaagatg

SEQ ID NO: 141522 - DNA, 103 bp, Artificial Sequence
  Synthetic Polynucleotide
taatacgactcactatagggctcccccacacagaaccagagggcatagcgaacagaggagacgctatatgctctggttcaacctggcggcagcgcaaaagatg

SEQ ID NO: 141523 - DNA, 103 bp, Artificial Sequence
  Synthetic Polynucleotide
taatacgactcactatagggggggccatgactcccccacacagaaccagaaacagaggagatctggtatggtgtgggggaacctggcggcagcgcaaaagatg

SEQ ID NO: 141524 - DNA, 103 bp, Artificial Sequence
  Synthetic Polynucleotide
taatacgactcactatagggggctggtcctggggccatgactcccccacaaacagaggagatgtgggatggtcatggccaacctggcggcagcgcaaaagatg

SEQ ID NO: 141525 - DNA, 103 bp, Artificial Sequence
  Synthetic Polynucleotide
taatacgactcactatagggcttggtccacggctggtcctggggccatgaaacagaggagatcatggatgcaggaccagaacctggcggcagcgcaaaagatg

SEQ ID NO: 141526 - DNA, 103 bp, Artificial Sequence
  Synthetic Polynucleotide
taatacgactcactatagggtcacgagcctcttggtccacggctggtcctaacagaggagaaggaccatgcgtggaccaaacctggcggcagcgcaaaagatg

SEQ ID NO: 141527 - DNA, 103 bp, Artificial Sequence
  Synthetic Polynucleotide
taatacgactcactatagggaccttgaccatcacgagcctcttggtccacaacagaggagagtggacatggaggctcgtaacctggcggcagcgcaaaagatg

SEQ ID NO: 141528 - DNA, 103 bp, Artificial Sequence
  Synthetic Polynucleotide
taatacgactcactatagggcgtgggcacaaccttgaccatcacgagcctaacagaggagaaggctcatgatggtcaagaacctggcggcagcgcaaaagatg

SEQ ID NO: 141529 - DNA, 103 bp, Artificial Sequence
  Synthetic Polynucleotide
taatacgactcactataggggccgtaggccgtgcttccaagggatgcggaaacagaggagatccgcaatgcttggaagcaacctggcggcagcgcaaaagatg

SEQ ID NO: 141530 - DNA, 103 bp, Artificial Sequence
  Synthetic Polynucleotide
taatacgactcactatagggccctgaggcacgtgggcacaaccttgaccaaacagaggagatggtcaatgttgtgcccaaacctggcggcagcgcaaaagatg

SEQ ID NO: 141531 - DNA, 103 bp, Artificial Sequence
  Synthetic Polynucleotide
taatacgactcactatagggtctaccaaggccctgaggcacgtgggcacaaacagaggagatgtgccatggtgcctcagaacctggcggcagcgcaaaagatg

SEQ ID NO: 141532 - DNA, 103 bp, Artificial Sequence
  Synthetic Polynucleotide
taatacgactcactatagggccgggccatttctaccaaggccctgaggcaaacagaggagatgcctcatggccttggtaaacctggcggcagcgcaaaagatg

SEQ ID NO: 141533 - DNA, 103 bp, Artificial Sequence
  Synthetic Polynucleotide
taatacgactcactatagggcaccccctacccgggccatttctaccaaggaacagaggagaccttggatgaaatggcccaacctggcggcagcgcaaaagatg

SEQ ID NO: 141534 - DNA, 103 bp, Artificial Sequence
  Synthetic Polynucleotide
taatacgactcactatagggagggaggaggcaccccctacccgggccattaacagaggagaaatggcatgggtagggggaacctggcggcagcgcaaaagatg

SEQ ID NO: 141535 - DNA, 103 bp, Artificial Sequence
  Synthetic Polynucleotide
taatacgactcactatagggagtattctccagggaggaggcaccccctacaacagaggagagtagggatggcctcctccaacctggcggcagcgcaaaagatg

SEQ ID NO: 141536 - DNA, 103 bp, Artificial Sequence
  Synthetic Polynucleotide
taatacgactcactataggggcaggtccacagtattctccagggaggaggaacagaggagacctcctatgtggagaataaacctggcggcagcgcaaaagatg

SEQ ID NO: 141537 - DNA, 103 bp, Artificial Sequence
  Synthetic Polynucleotide
taatacgactcactatagggttggaaatgtgcaggtccacagtattctccaacagaggagaggagaaatgtgtggacctaacctggcggcagcgcaaaagatg

SEQ ID NO: 141538 - DNA, 103 bp, Artificial Sequence
  Synthetic Polynucleotide
taatacgactcactatagggtgggtggctgttggaaatgtgcaggtccacaacagaggagagtggacatgcacatttccaacctggcggcagcgcaaaagatg

SEQ ID NO: 141539 - DNA, 103 bp, Artificial Sequence
  Synthetic Polynucleotide
taatacgactcactatagggtgagggagagtgggtggctgttggaaatgtaacagaggagaacatttatgacagccaccaacctggcggcagcgcaaaagatg

SEQ ID NO: 141540 - DNA, 103 bp, Artificial Sequence
  Synthetic Polynucleotide
taatacgactcactatagggtgtgcatcctgccgtaggccgtgcttccaaaacagaggagattggaaatgcggcctacgaacctggcggcagcgcaaaagatg

SEQ ID NO: 141541 - DNA, 103 bp, Artificial Sequence
  Synthetic Polynucleotide
taatacgactcactatagggtggtcggaggtgagggagagtgggtggctgaacagaggagacagccaatgactctccctaacctggcggcagcgcaaaagatg

SEQ ID NO: 141542 - DNA, 103 bp, Artificial Sequence
  Synthetic Polynucleotide
taatacgactcactatagggggccttgtactggtcggaggtgagggagagaacagaggagactctccatgacctccgacaacctggcggcagcgcaaaagatg

SEQ ID NO: 141543 - DNA, 103 bp, Artificial Sequence
  Synthetic Polynucleotide
taatacgactcactatagggcctgcaggtaggccttgtactggtcggaggaacagaggagacctccgatgagtacaaggaacctggcggcagcgcaaaagatg

SEQ ID NO: 141544 - DNA, 103 bp, Artificial Sequence
  Synthetic Polynucleotide
taatacgactcactatagggtccaccaagtcctgcaggtaggccttgtacaacagaggagagtacaaatgctacctgcaaacctggcggcagcgcaaaagatg

SEQ ID NO: 141545 - DNA, 103 bp, Artificial Sequence
  Synthetic Polynucleotide
taatacgactcactatagggatccatgccctccaccaagtcctgcaggtaaacagaggagatacctgatggacttggtgaacctggcggcagcgcaaaagatg

SEQ ID NO: 141546 - DNA, 103 bp, Artificial Sequence
  Synthetic Polynucleotide
taatacgactcactatagggggccctggaaatccatgccctccaccaagtaacagaggagaacttggatgagggcatggaacctggcggcagcgcaaaagatg

SEQ ID NO: 141547 - DNA, 103 bp, Artificial Sequence
  Synthetic Polynucleotide
taatacgactcactatagggctctccccagggccctggaaatccatgcccaacagaggagagggcatatgtttccagggaacctggcggcagcgcaaaagatg

SEQ ID NO: 141548 - DNA, 103 bp, Artificial Sequence
  Synthetic Polynucleotide
taatacgactcactatagggatcctcctgctgtgcatcctgccgtaggccaacagaggagaggcctaatgcaggatgcaaacctggcggcagcgcaaaagatg

SEQ ID NO: 141549 - DNA, 103 bp, Artificial Sequence
  Synthetic Polynucleotide
taatacgactcactatagggagattccgaaatcctcctgctgtgcatcctaacagaggagaaggatgatgagcaggaggaacctggcggcagcgcaaaagatg

SEQ ID NO: 141550 - DNA, 103 bp, Artificial Sequence
  Synthetic Polynucleotide
taatacgactcactatagggcaggcctggaagattccgaaatcctcctgcaacagaggagagcaggaatgtttcggaataacctggcggcagcgcaaaagatg

SEQ ID NO: 141551 - DNA, 103 bp, Artificial Sequence
  Synthetic Polynucleotide
taatacgactcactatagggggcctcggcccaggcctggaagattccgaaaacagaggagattcggaatgttccaggccaacctggcggcagcgcaaaagatg

SEQ ID NO: 141552 - DNA, 103 bp, Artificial Sequence
  Synthetic Polynucleotide
taatacgactcactatagggatgcaccagtggcctcggcccaggcctggaaacagaggagatccaggatggggccgaggaacctggcggcagcgcaaaagatg

SEQ ID NO: 141553 - DNA, 103 bp, Artificial Sequence
  Synthetic Polynucleotide
taatacgactcactatagggccgggaacatatgcaccagtggcctcggccaacagaggagaggccgaatgcactggtgcaacctggcggcagcgcaaaagatg

SEQ ID NO: 141554 - DNA, 103 bp, Artificial Sequence
  Synthetic Polynucleotide
taatacgactcactatagggcttatccctcccgggaacatatgcaccagtaacagaggagaactggtatgtatgttcccaacctggcggcagcgcaaaagatg

SEQ ID NO: 141555 - DNA, 103 bp, Artificial Sequence
  Synthetic Polynucleotide
taatacgactcactatagggacaccagccagggcaggatccgtggctttgaacagaggagacaaagcatgggatcctgcaacctggcggcagcgcaaaagatg

SEQ ID NO: 141556 - DNA, 103 bp, Artificial Sequence
  Synthetic Polynucleotide
taatacgactcactataggggcaggtctggcttatccctcccgggaacataacagaggagaatgttcatgggagggataaacctggcggcagcgcaaaagatg

SEQ ID NO: 141557 - DNA, 103 bp, Artificial Sequence
  Synthetic Polynucleotide
taatacgactcactatagggttccaggttggcaggtctggcttatccctcaacagaggagagagggaatggccagacctaacctggcggcagcgcaaaagatg

SEQ ID NO: 141558 - DNA, 103 bp, Artificial Sequence
  Synthetic Polynucleotide
taatacgactcactataggggaaattcctcttccaggttggcaggtctggaacagaggagaccagacatgccaacctggaacctggcggcagcgcaaaagatg

SEQ ID NO: 141559 - DNA, 103 bp, Artificial Sequence
  Synthetic Polynucleotide
taatacgactcactataggggggcagagcggaaattcctcttccaggttgaacagaggagacaacctatgagaggaattaacctggcggcagcgcaaaagatg

SEQ ID NO: 141560 - DNA, 103 bp, Artificial Sequence
  Synthetic Polynucleotide
taatacgactcactatagggttgcggttgagggcagagcggaaattcctcaacagaggagagaggaaatgccgctctgcaacctggcggcagcgcaaaagatg

SEQ ID NO: 141561 - DNA, 103 bp, Artificial Sequence
  Synthetic Polynucleotide
taatacgactcactatagggcaacccttctttgcggttgagggcagagcgaacagaggagacgctctatgctcaaccgcaacctggcggcagcgcaaaagatg

SEQ ID NO: 141562 - DNA, 103 bp, Artificial Sequence
  Synthetic Polynucleotide
taatacgactcactatagggctgctaaacgcaacccttctttgcggttgaaacagaggagatcaaccatgaagaagggtaacctggcggcagcgcaaaagatg

SEQ ID NO: 141563 - DNA, 103 bp, Artificial Sequence
  Synthetic Polynucleotide
taatacgactcactatagggctccggtcctctgctaaacgcaacccttctaacagaggagaagaaggatggcgtttagcaacctggcggcagcgcaaaagatg

SEQ ID NO: 141564 - DNA, 103 bp, Artificial Sequence
  Synthetic Polynucleotide
taatacgactcactatagggagggtccttgctccggtcctctgctaaacgaacagaggagacgtttaatggaggaccggaacctggcggcagcgcaaaagatg

SEQ ID NO: 141565 - DNA, 103 bp, Artificial Sequence
  Synthetic Polynucleotide
taatacgactcactataggggtgggtcgtgagggtccttgctccggtcctaacagaggagaaggaccatggcaaggaccaacctggcggcagcgcaaaagatg

SEQ ID NO: 141566 - DNA, 103 bp, Artificial Sequence
  Synthetic Polynucleotide
taatacgactcactatagggtccagctgcgacaccagccagggcaggatcaacagaggagagatcctatgctggctggtaacctggcggcagcgcaaaagatg

SEQ ID NO: 141567 - DNA, 103 bp, Artificial Sequence
  Synthetic Polynucleotide
taatacgactcactatagggtagattttatgtgggtcgtgagggtccttgaacagaggagacaaggaatgtcacgacccaacctggcggcagcgcaaaagatg

SEQ ID NO: 141568 - DNA, 103 bp, Artificial Sequence
  Synthetic Polynucleotide
taatacgactcactatagggcacaaactcgtagattttatgtgggtcgtgaacagaggagacacgacatgcataaaatcaacctggcggcagcgcaaaagatg

SEQ ID NO: 141569 - DNA, 103 bp, Artificial Sequence
  Synthetic Polynucleotide
taatacgactcactatagggctcctgagttcacaaactcgtagattttataacagaggagaataaaaatgacgagtttgaacctggcggcagcgcaaaagatg

SEQ ID NO: 141570 - DNA, 103 bp, Artificial Sequence
  Synthetic Polynucleotide
taatacgactcactatagggaagtccccaactcctgagttcacaaactcgaacagaggagacgagttatggaactcaggaacctggcggcagcgcaaaagatg

SEQ ID NO: 141571 - DNA, 103 bp, Artificial Sequence
  Synthetic Polynucleotide
taatacgactcactatagggtggctgggaaaagtccccaactcctgagttaacagaggagaaactcaatggttggggacaacctggcggcagcgcaaaagatg

SEQ ID NO: 141572 - DNA, 103 bp, Artificial Sequence
  Synthetic Polynucleotide
taatacgactcactataggggagaggtgtctggctgggaaaagtccccaaaacagaggagattggggatgtttcccagcaacctggcggcagcgcaaaagatg

SEQ ID NO: 141573 - DNA, 103 bp, Artificial Sequence
  Synthetic Polynucleotide
taatacgactcactatagggttggtgtccggagaggtgtctggctgggaaaacagaggagattcccaatgagacacctcaacctggcggcagcgcaaaagatg

SEQ ID NO: 141574 - DNA, 103 bp, Artificial Sequence
  Synthetic Polynucleotide
taatacgactcactataggggcctccaccattggtgtccggagaggtgtcaacagaggagagacaccatgccggacaccaacctggcggcagcgcaaaagatg

SEQ ID NO: 141575 - DNA, 103 bp, Artificial Sequence
  Synthetic Polynucleotide
taatacgactcactatagggcagaagtactgcctccaccattggtgtccgaacagaggagacggacaatgatggtggagaacctggcggcagcgcaaaagatg

SEQ ID NO: 141576 - DNA, 103 bp, Artificial Sequence
  Synthetic Polynucleotide
taatacgactcactatagggtcctgggtatcagaagtactgcctccaccaaacagaggagatggtggatgcagtacttcaacctggcggcagcgcaaaagatg

SEQ ID NO: 141577 - DNA, 103 bp, Artificial Sequence
  Synthetic Polynucleotide
taatacgactcactatagggttgccccaggtccagctgcgacaccagccaaacagaggagatggctgatgtcgcagctgaacctggcggcagcgcaaaagatg

SEQ ID NO: 141578 - DNA, 103 bp, Artificial Sequence
  Synthetic Polynucleotide
taatacgactcactatagggcagaatgtcttcctgggtatcagaagtactaacagaggagaagtactatggatacccagaacctggcggcagcgcaaaagatg

SEQ ID NO: 141579 - DNA, 103 bp, Artificial Sequence
  Synthetic Polynucleotide
taatacgactcactataggggtaactcatccagaatgtcttcctgggtataacagaggagaatacccatgaagacattcaacctggcggcagcgcaaaagatg

SEQ ID NO: 141580 - DNA, 103 bp, Artificial Sequence
  Synthetic Polynucleotide
taatacgactcactatagggatgttacccagtaactcatccagaatgtctaacagaggagaagacatatgggatgagttaacctggcggcagcgcaaaagatg

SEQ ID NO: 141581 - DNA, 103 bp, Artificial Sequence
  Synthetic Polynucleotide
taatacgactcactatagggggccaacaccatgttacccagtaactcatcaacagaggagagatgagatgctgggtaacaacctggcggcagcgcaaaagatg

SEQ ID NO: 141582 - DNA, 103 bp, Artificial Sequence
  Synthetic Polynucleotide
taatacgactcactatagggctgggagtggggccaacaccatgttacccaaacagaggagatgggtaatgtggtgttggaacctggcggcagcgcaaaagatg

SEQ ID NO: 141583 - DNA, 103 bp, Artificial Sequence
  Synthetic Polynucleotide
taatacgactcactatagggggtcccggatctgggagtggggccaacaccaacagaggagaggtgttatgcccactcccaacctggcggcagcgcaaaagatg

SEQ ID NO: 141584 - DNA, 103 bp, Artificial Sequence
  Synthetic Polynucleotide
taatacgactcactatagggcaggcttgggggtcccggatctgggagtggaacagaggagaccactcatggatccgggaaacctggcggcagcgcaaaagatg

SEQ ID NO: 141585 - DNA, 103 bp, Artificial Sequence
  Synthetic Polynucleotide
taatacgactcactataggggggctacagccaggcttgggggtcccggataacagaggagaatccggatgccccaagccaacctggcggcagcgcaaaagatg

SEQ ID NO: 141586 - DNA, 103 bp, Artificial Sequence
  Synthetic Polynucleotide
taatacgactcactatagggcagggctcaggggctacagccaggcttgggaacagaggagacccaagatgggctgtagcaacctggcggcagcgcaaaagatg

SEQ ID NO: 141587 - DNA, 103 bp, Artificial Sequence
  Synthetic Polynucleotide
taatacgactcactataggggggctgagggcagggctcaggggctacagcaacagaggagagctgtaatgcctgagcccaacctggcggcagcgcaaaagatg

SEQ ID NO: 141588 - DNA, 103 bp, Artificial Sequence
  Synthetic Polynucleotide
taatacgactcactatagggcgccctccagttgccccaggtccagctgcgaacagaggagacgcagcatgacctggggcaacctggcggcagcgcaaaagatg

SEQ ID NO: 141589 - DNA, 103 bp, Artificial Sequence
  Synthetic Polynucleotide
taatacgactcactatagggggctccgcaggggctgagggcagggctcagaacagaggagactgagcatggccctcagcaacctggcggcagcgcaaaagatg

SEQ ID NO: 141590 - DNA, 103 bp, Artificial Sequence
  Synthetic Polynucleotide
taatacgactcactatagggtccaagctggggctccgcaggggctgagggaacagaggagaccctcaatgcctgcggagaacctggcggcagcgcaaaagatg

SEQ ID NO: 141591 - DNA, 103 bp, Artificial Sequence
  Synthetic Polynucleotide
taatacgactcactatagggagtgggattgtccaagctggggctccgcagaacagaggagactgcggatgcccagcttgaacctggcggcagcgcaaaagatg

SEQ ID NO: 141592 - DNA, 103 bp, Artificial Sequence
  Synthetic Polynucleotide
taatacgactcactatagggttgggaagggagtgggattgtccaagctggaacagaggagaccagctatgacaatcccaaacctggcggcagcgcaaaagatg

SEQ ID NO: 141593 - DNA, 103 bp, Artificial Sequence
  Synthetic Polynucleotide
taatacgactcactatagggggccccaggtttgggaagggagtgggattgaacagaggagacaatccatgtcccttcccaacctggcggcagcgcaaaagatg

SEQ ID NO: 141594 - DNA, 103 bp, Artificial Sequence
  Synthetic Polynucleotide
taatacgactcactataggggttctcagagggccccaggtttgggaagggaacagaggagacccttcatgaacctggggaacctggcggcagcgcaaaagatg

SEQ ID NO: 141595 - DNA, 103 bp, Artificial Sequence
  Synthetic Polynucleotide
taatacgactcactataggggcttcagtgggttctcagagggccccaggtaacagaggagaacctggatgcctctgagaaacctggcggcagcgcaaaagatg

SEQ ID NO: 141596 - DNA, 103 bp, Artificial Sequence
  Synthetic Polynucleotide
taatacgactcactatagggaccaacagccgcttcagtgggttctcagagaacagaggagactctgaatgcccactgaaaacctggcggcagcgcaaaagatg

SEQ ID NO: 141597 - DNA, 103 bp, Artificial Sequence
  Synthetic Polynucleotide
taatacgactcactatagggttcccccggcaccaacagccgcttcagtggaacagaggagaccactgatgcggctgttgaacctggcggcagcgcaaaagatg

SEQ ID NO: 141598 - DNA, 103 bp, Artificial Sequence
  Synthetic Polynucleotide
taatacgactcactatagggactcccactcttcccccggcaccaacagccaacagaggagaggctgtatgtgccgggggaacctggcggcagcgcaaaagatg

SEQ ID NO: 141599 - DNA, 103 bp, Artificial Sequence
  Synthetic Polynucleotide
taatacgactcactatagggacccaggccacgccctccagttgccccaggaacagaggagacctgggatgactggagggaacctggcggcagcgcaaaagatg

SEQ ID NO: 141600 - DNA, 103 bp, Artificial Sequence
  Synthetic Polynucleotide
taatacgactcactataggggtcacctcgaactcccactcttcccccggcaacagaggagagccgggatgagagtgggaaacctggcggcagcgcaaaagatg

SEQ ID NO: 141601 - DNA, 103 bp, Artificial Sequence
  Synthetic Polynucleotide
taatacgactcactataggggtagaaggctgtcacctcgaactcccactcaacagaggagagagtggatgttcgaggtgaacctggcggcagcgcaaaagatg

SEQ ID NO: 141602 - DNA, 103 bp, Artificial Sequence
  Synthetic Polynucleotide
taatacgactcactatagggggcggccccggtagaaggctgtcacctcgaaacagaggagatcgaggatgcagccttctaacctggcggcagcgcaaaagatg

SEQ ID NO: 141603 - DNA, 103 bp, Artificial Sequence
  Synthetic Polynucleotide
taatacgactcactatagggtggaagacttggcggccccggtagaaggctaacagaggagaagccttatgccggggccgaacctggcggcagcgcaaaagatg

SEQ ID NO: 141604 - DNA, 103 bp, Artificial Sequence
  Synthetic Polynucleotide
taatacgactcactataggggatggtctgctggaagacttggcggccccgaacagaggagacggggcatgcaagtcttcaacctggcggcagcgcaaaagatg

SEQ ID NO: 141605 - DNA, 103 bp, Artificial Sequence
  Synthetic Polynucleotide
taatacgactcactatagggccgggcaggagatggtctgctggaagacttaacagaggagaaagtctatgagcagaccaaacctggcggcagcgcaaaagatg

SEQ ID NO: 141606 - DNA, 103 bp, Artificial Sequence
  Synthetic Polynucleotide
taatacgactcactatagggcgcaggccctccgggcaggagatggtctgcaacagaggagagcagacatgctcctgcccaacctggcggcagcgcaaaagatg

SEQ ID NO: 141607 - DNA, 103 bp, Artificial Sequence
  Synthetic Polynucleotide
taatacgactcactatagggccccaccagccgcaggccctccgggcaggaaacagaggagatcctgcatggagggcctgaacctggcggcagcgcaaaagatg

SEQ ID NO: 141608 - DNA, 103 bp, Artificial Sequence
  Synthetic Polynucleotide
taatacgactcactatagggccacttcggaccccaccagccgcaggccctaacagaggagaagggccatgggctggtggaacctggcggcagcgcaaaagatg

SEQ ID NO: 141609 - DNA, 103 bp, Artificial Sequence
  Synthetic Polynucleotide
taatacgactcactataggggtcctgtctcccacttcggaccccaccagcaacagaggagagctggtatggtccgaagtaacctggcggcagcgcaaaagatg

SEQ ID NO: 141610 - DNA, 103 bp, Artificial Sequence
  Synthetic Polynucleotide
taatacgactcactataggggctcttgttcacccaggccacgccctccagaacagaggagactggagatggtggcctggaacctggcggcagcgcaaaagatg

SEQ ID NO: 141611 - DNA, 103 bp, Artificial Sequence
  Synthetic Polynucleotide
taatacgactcactatagggtccaggcagcgtcctgtctcccacttcggaaacagaggagatccgaaatgggagacaggaacctggcggcagcgcaaaagatg

SEQ ID NO: 141612 - DNA, 103 bp, Artificial Sequence
  Synthetic Polynucleotide
taatacgactcactatagggtgactggccatccaggcagcgtcctgtctcaacagaggagagagacaatgcgctgcctgaacctggcggcagcgcaaaagatg

SEQ ID NO: 141613 - DNA, 103 bp, Artificial Sequence
  Synthetic Polynucleotide
taatacgactcactatagggtctggcagtgtgactggccatccaggcagcaacagaggagagctgccatgatggccagtaacctggcggcagcgcaaaagatg

SEQ ID NO: 141614 - DNA, 103 bp, Artificial Sequence
  Synthetic Polynucleotide
taatacgactcactatagggcatgccagggtctggcagtgtgactggccaaacagaggagatggccaatgacactgccaaacctggcggcagcgcaaaagatg

SEQ ID NO: 141615 - DNA, 103 bp, Artificial Sequence
  Synthetic Polynucleotide
taatacgactcactatagggctgtcagggacatgccagggtctggcagtgaacagaggagacactgcatgaccctggcaaacctggcggcagcgcaaaagatg

SEQ ID NO: 141616 - DNA, 103 bp, Artificial Sequence
  Synthetic Polynucleotide
taatacgactcactatagggactcccctgtctgtcagggacatgccagggaacagaggagaccctggatggtccctgacaacctggcggcagcgcaaaagatg

SEQ ID NO: 141617 - DNA, 103 bp, Artificial Sequence
  Synthetic Polynucleotide
taatacgactcactataggggtagctcatcactcccctgtctgtcagggaaacagaggagatccctgatggacaggggaaacctggcggcagcgcaaaagatg

SEQ ID NO: 141618 - DNA, 103 bp, Artificial Sequence
  Synthetic Polynucleotide
taatacgactcactatagggcatgcctcacgtagctcatcactcccctgtaacagaggagaacagggatgtgatgagctaacctggcggcagcgcaaaagatg

SEQ ID NO: 141619 - DNA, 103 bp, Artificial Sequence
  Synthetic Polynucleotide
taatacgactcactatagggcagctcagcacatgcctcacgtagctcatcaacagaggagagatgagatgcgtgaggcaaacctggcggcagcgcaaaagatg

SEQ ID NO: 141620 - DNA, 103 bp, Artificial Sequence
  Synthetic Polynucleotide
taatacgactcactatagggcccacccaggcagctcagcacatgcctcacaacagaggagagtgaggatggtgctgagcaacctggcggcagcgcaaaagatg

SEQ ID NO: 141621 - DNA, 103 bp, Artificial Sequence
  Synthetic Polynucleotide
taatacgactcactatagggagcgcgtgcggctcttgttcacccaggccaaacagaggagatggcctatgtgaacaagaaacctggcggcagcgcaaaagatg

SEQ ID NO: 141622 - DNA, 103 bp, Artificial Sequence
  Synthetic Polynucleotide
taatacgactcactataggggagccagtcccccacccaggcagctcagcaaacagaggagatgctgaatggcctgggtgaacctggcggcagcgcaaaagatg

SEQ ID NO: 141623 - DNA, 103 bp, Artificial Sequence
  Synthetic Polynucleotide
taatacgactcactataggggcccgccagagagccagtcccccacccaggaacagaggagacctgggatggggactggcaacctggcggcagcgcaaaagatg

SEQ ID NO: 141624 - DNA, 103 bp, Artificial Sequence
  Synthetic Polynucleotide
taatacgactcactatagggccactgcccggcccgccagagagccagtccaacagaggagaggactgatgctctggcggaacctggcggcagcgcaaaagatg

SEQ ID NO: 141625 - DNA, 103 bp, Artificial Sequence
  Synthetic Polynucleotide
taatacgactcactataggggggcccagagccactgcccggcccgccagaaacagaggagatctggcatgccgggcagtaacctggcggcagcgcaaaagatg

SEQ ID NO: 141626 - DNA, 103 bp, Artificial Sequence
  Synthetic Polynucleotide
taatacgactcactatagggcccagccgctgggcccagagccactgcccgaacagaggagacgggcaatggctctgggcaacctggcggcagcgcaaaagatg

SEQ ID NO: 141627 - DNA, 103 bp, Artificial Sequence
  Synthetic Polynucleotide
taatacgactcactataggggtggcagtgccccagccgctgggcccagagaacagaggagactctggatgcagcggctgaacctggcggcagcgcaaaagatg

SEQ ID NO: 141628 - DNA, 103 bp, Artificial Sequence
  Synthetic Polynucleotide
taatacgactcactatagggcccagtatgtgtggcagtgccccagccgctaacagaggagaagcggcatgggcactgccaacctggcggcagcgcaaaagatg

SEQ ID NO: 141629 - DNA, 103 bp, Artificial Sequence
  Synthetic Polynucleotide
taatacgactcactatagggtcgctcactgcccagtatgtgtggcagtgcaacagaggagagcactgatgcacatactgaacctggcggcagcgcaaaagatg

SEQ ID NO: 141630 - DNA, 103 bp, Artificial Sequence
  Synthetic Polynucleotide
taatacgactcactataggggagcagctcctcgctcactgcccagtatgtaacagaggagaacatacatggcagtgagcaacctggcggcagcgcaaaagatg

SEQ ID NO: 141631 - DNA, 103 bp, Artificial Sequence
  Synthetic Polynucleotide
taatacgactcactatagggcgctgttggggagcagctcctcgctcactgaacagaggagacagtgaatgaggagctgcaacctggcggcagcgcaaaagatg

SEQ ID NO: 141632 - DNA, 103 bp, Artificial Sequence
  Synthetic Polynucleotide
taatacgactcactataggggggatgcggaagcgcgtgcggctcttgttcaacagaggagagaacaaatgccgcacgcgaacctggcggcagcgcaaaagatg

SEQ ID NO: 141633 - DNA, 103 bp, Artificial Sequence
  Synthetic Polynucleotide
taatacgactcactatagggggcccatgcccgctgttggggagcagctccaacagaggagaggagctatgccccaacagaacctggcggcagcgcaaaagatg

SEQ ID NO: 141634 - DNA, 103 bp, Artificial Sequence
  Synthetic Polynucleotide
taatacgactcactatagggctcgccatcaggcccatgcccgctgttgggaacagaggagacccaacatggggcatgggaacctggcggcagcgcaaaagatg

SEQ ID NO: 141635 - DNA, 103 bp, Artificial Sequence
  Synthetic Polynucleotide
taatacgactcactatagggccttggggacctcgccatcaggcccatgccaacagaggagaggcatgatgctgatggcgaacctggcggcagcgcaaaagatg

SEQ ID NO: 141636 - DNA, 103 bp, Artificial Sequence
  Synthetic Polynucleotide
taatacgactcactatagggccttccttgtccttggggacctcgccatcaaacagaggagatgatggatgggtccccaaaacctggcggcagcgcaaaagatg

SEQ ID NO: 141637 - DNA, 103 bp, Artificial Sequence
  Synthetic Polynucleotide
taatacgactcactatagggaaacacgcctccttccttgtccttggggacaacagaggagagtccccatggacaaggaaaacctggcggcagcgcaaaagatg

SEQ ID NO: 141638 - DNA, 103 bp, Artificial Sequence
  Synthetic Polynucleotide
taatacgactcactataggggccccaggtcaaacacgcctccttccttgtaacagaggagaacaaggatggaggcgtgtaacctggcggcagcgcaaaagatg

SEQ ID NO: 141639 - DNA, 103 bp, Artificial Sequence
  Synthetic Polynucleotide
taatacgactcactatagggacaatgaagggccccaggtcaaacacgcctaacagaggagaaggcgtatgtgacctgggaacctggcggcagcgcaaaagatg

SEQ ID NO: 141640 - DNA, 103 bp, Artificial Sequence
  Synthetic Polynucleotide
taatacgactcactatagggaatcagatctacaatgaagggccccaggtcaacagaggagagacctgatgcccttcattaacctggcggcagcgcaaaagatg

SEQ ID NO: 141641 - DNA, 103 bp, Artificial Sequence
  Synthetic Polynucleotide
taatacgactcactatagggccgtgaaggtaatcagatctacaatgaaggaacagaggagaccttcaatgtagatctgaaacctggcggcagcgcaaaagatg

SEQ ID NO: 141642 - DNA, 103 bp, Artificial Sequence
  Synthetic Polynucleotide
taatacgactcactatagggccgcttccttccgtgaaggtaatcagatctaacagaggagaagatctatgtaccttcacaacctggcggcagcgcaaaagatg

SEQ ID NO: 141643 - DNA, 103 bp, Artificial Sequence
  Synthetic Polynucleotide
taatacgactcactatagggtccgcctcggccgccgccctccaggttcataacagaggagaatgaacatggagggcggcaacctggcggcagcgcaaaagatg

SEQ ID NO: 141644 - DNA, 103 bp, Artificial Sequence
  Synthetic Polynucleotide
taatacgactcactatagggcagcccggggtacttgccgctgtcgatctgaacagaggagacagatcatgagcggcaagaacctggcggcagcgcaaaagatg

SEQ ID NO: 141645 - DNA, 103 bp, Artificial Sequence
  Synthetic Polynucleotide
taatacgactcactatagggcaggggcccgtcccagtagatcctgctctgaacagaggagacagagcatgatctactggaacctggcggcagcgcaaaagatg

SEQ ID NO: 141646 - DNA, 103 bp, Artificial Sequence
  Synthetic Polynucleotide
taatacgactcactatagggtgcacagcgccaggggcccgtcccagtagaaacagaggagatctactatgacgggccccaacctggcggcagcgcaaaagatg

SEQ ID NO: 141647 - DNA, 103 bp, Artificial Sequence
  Synthetic Polynucleotide
taatacgactcactatagggggccggtcgttgcacagcgccaggggcccgaacagaggagacgggccatgggcgctgtgaacctggcggcagcgcaaaagatg

SEQ ID NO: 141648 - DNA, 103 bp, Artificial Sequence
  Synthetic Polynucleotide
taatacgactcactatagggcagtttgttgggccggtcgttgcacagcgcaacagaggagagcgctgatgaacgaccggaacctggcggcagcgcaaaagatg

SEQ ID NO: 141649 - DNA, 103 bp, Artificial Sequence
  Synthetic Polynucleotide
taatacgactcactatagggggtctctctccagtttgttgggccggtcgtaacagaggagaacgaccatgccaacaaacaacctggcggcagcgcaaaagatg

SEQ ID NO: 141650 - DNA, 103 bp, Artificial Sequence
  Synthetic Polynucleotide
taatacgactcactatagggttgcaggtctggtctctctccagtttgttgaacagaggagacaacaaatgggagagagaaacctggcggcagcgcaaaagatg

SEQ ID NO: 141651 - DNA, 103 bp, Artificial Sequence
  Synthetic Polynucleotide
taatacgactcactataggggtcaaagagcttgcaggtctggtctctctcaacagaggagagagagaatgcagacctgcaacctggcggcagcgcaaaagatg

SEQ ID NO: 141652 - DNA, 103 bp, Artificial Sequence
  Synthetic Polynucleotide
taatacgactcactatagggactgctgtgtgtcaaagagcttgcaggtctaacagaggagaagacctatgagctctttgaacctggcggcagcgcaaaagatg

SEQ ID NO: 141653 - DNA, 103 bp, Artificial Sequence
  Synthetic Polynucleotide
taatacgactcactatagggtctgacaagaactgctgtgtgtcaaagagcaacagaggagagctcttatgcacacagcaaacctggcggcagcgcaaaagatg

SEQ ID NO: 141654 - DNA, 103 bp, Artificial Sequence
  Synthetic Polynucleotide
taatacgactcactatagggcgcttgcagctctgacaagaactgctgtgtaacagaggagaacacagatgttcttgtcaaacctggcggcagcgcaaaagatg

SEQ ID NO: 141655 - DNA, 103 bp, Artificial Sequence
  Synthetic Polynucleotide
taatacgactcactatagggtctcccacaccagcccggggtacttgccgcaacagaggagagcggcaatgaccccgggcaacctggcggcagcgcaaaagatg

SEQ ID NO: 141656 - DNA, 103 bp, Artificial Sequence
  Synthetic Polynucleotide
taatacgactcactatagggggtgagcaaacgcttgcagctctgacaagaaacagaggagatcttgtatgagctgcaagaacctggcggcagcgcaaaagatg

SEQ ID NO: 141657 - DNA, 103 bp, Artificial Sequence
  Synthetic Polynucleotide
taatacgactcactataggggagcggccgtggtgagcaaacgcttgcagcaacagaggagagctgcaatggtttgctcaaacctggcggcagcgcaaaagatg

SEQ ID NO: 141658 - DNA, 103 bp, Artificial Sequence
  Synthetic Polynucleotide
taatacgactcactatagggtcttggcagggagcggccgtggtgagcaaaaacagaggagatttgctatgcacggccgcaacctggcggcagcgcaaaagatg

SEQ ID NO: 141659 - DNA, 103 bp, Artificial Sequence
  Synthetic Polynucleotide
taatacgactcactatagggtcacctggaatcttggcagggagcggccgtaacagaggagaacggccatgccctgccaaaacctggcggcagcgcaaaagatg

SEQ ID NO: 141660 - DNA, 103 bp, Artificial Sequence
  Synthetic Polynucleotide
taatacgactcactatagggaagcatagagtcacctggaatcttggcaggaacagaggagacctgccatgattccaggtaacctggcggcagcgcaaaagatg

SEQ ID NO: 141661 - DNA, 103 bp, Artificial Sequence
  Synthetic Polynucleotide
taatacgactcactatagggctcctctccaaagcatagagtcacctggaaaacagaggagattccagatgactctatgcaacctggcggcagcgcaaaagatg

SEQ ID NO: 141662 - DNA, 103 bp, Artificial Sequence
  Synthetic Polynucleotide
taatacgactcactatagggggtctggaaactcctctccaaagcatagagaacagaggagactctatatgttggagaggaacctggcggcagcgcaaaagatg

SEQ ID NO: 141663 - DNA, 103 bp, Artificial Sequence
  Synthetic Polynucleotide
taatacgactcactatagggtgcctctgagggtctggaaactcctctccaaacagaggagatggagaatggtttccagaaacctggcggcagcgcaaaagatg

SEQ ID NO: 141664 - DNA, 103 bp, Artificial Sequence
  Synthetic Polynucleotide
taatacgactcactataggggagctttctttgcctctgagggtctggaaaaacagaggagatttccaatgcctcagaggaacctggcggcagcgcaaaagatg

SEQ ID NO: 141665 - DNA, 103 bp, Artificial Sequence
  Synthetic Polynucleotide
taatacgactcactataggggagctgtgatgagctttctttgcctctgagaacagaggagactcagaatgaaagaaagcaacctggcggcagcgcaaaagatg

SEQ ID NO: 141666 - DNA, 103 bp, Artificial Sequence
  Synthetic Polynucleotide
taatacgactcactatagggttctcctcgttctcccacaccagcccggggaacagaggagaccccggatgggtgtgggaaacctggcggcagcgcaaaagatg

SEQ ID NO: 141667 - DNA, 103 bp, Artificial Sequence
  Synthetic Polynucleotide
taatacgactcactatagggggttctacgtgagctgtgatgagctttcttaacagaggagaaagaaaatgcatcacagcaacctggcggcagcgcaaaagatg

SEQ ID NO: 141668 - DNA, 103 bp, Artificial Sequence
  Synthetic Polynucleotide
taatacgactcactatagggggctagcagaggttctacgtgagctgtgataacagaggagaatcacaatgcacgtagaaaacctggcggcagcgcaaaagatg

SEQ ID NO: 141669 - DNA, 103 bp, Artificial Sequence
  Synthetic Polynucleotide
taatacgactcactatagggatagttgtctggctagcagaggttctacgtaacagaggagaacgtagatgctctgctagaacctggcggcagcgcaaaagatg

SEQ ID NO: 141670 - DNA, 103 bp, Artificial Sequence
  Synthetic Polynucleotide
taatacgactcactataggggcaaaataatatagttgtctggctagcagaaacagaggagatctgctatgcagacaactaacctggcggcagcgcaaaagatg

SEQ ID NO: 141671 - DNA, 103 bp, Artificial Sequence
  Synthetic Polynucleotide
taatacgactcactataggggttttgttgagcaaaataatatagttgtctaacagaggagaagacaaatgtattattttaacctggcggcagcgcaaaagatg

SEQ ID NO: 141672 - DNA, 103 bp, Artificial Sequence
  Synthetic Polynucleotide
taatacgactcactatagggaatgtccactgttttgttgagcaaaataataacagaggagaattattatgctcaacaaaaacctggcggcagcgcaaaagatg

SEQ ID NO: 141673 - DNA, 103 bp, Artificial Sequence
  Synthetic Polynucleotide
taatacgactcactatagggcccctcaggaaatgtccactgttttgttgaaacagaggagatcaacaatgcagtggacaaacctggcggcagcgcaaaagatg

SEQ ID NO: 141674 - DNA, 103 bp, Artificial Sequence
  Synthetic Polynucleotide
taatacgactcactatagggtaaatcgtagcccctcaggaaatgtccactaacagaggagaagtggaatgttcctgaggaacctggcggcagcgcaaaagatg

SEQ ID NO: 141675 - DNA, 103 bp, Artificial Sequence
  Synthetic Polynucleotide
taatacgactcactatagggtgtgttctggtaaatcgtagcccctcaggaaacagaggagatcctgaatggctacgattaacctggcggcagcgcaaaagatg

SEQ ID NO: 141676 - DNA, 103 bp, Artificial Sequence
  Synthetic Polynucleotide
taatacgactcactatagggggattgctgatgtgttctggtaaatcgtagaacagaggagactacgaatgaccagaacaaacctggcggcagcgcaaaagatg

SEQ ID NO: 141677 - DNA, 103 bp, Artificial Sequence
  Synthetic Polynucleotide
taatacgactcactataggggaagatgctcttctcctcgttctcccacacaacagaggagagtgtggatgaacgaggagaacctggcggcagcgcaaaagatg

SEQ ID NO: 141678 - DNA, 103 bp, Artificial Sequence
  Synthetic Polynucleotide
taatacgactcactataggggtaatcttctggattgctgatgtgttctggaacagaggagaccagaaatgatcagcaataacctggcggcagcgcaaaagatg

SEQ ID NO: 141679 - DNA, 103 bp, Artificial Sequence
  Synthetic Polynucleotide
taatacgactcactatagggtagatctgtggtaatcttctggattgctgaaacagaggagatcagcaatgcagaagattaacctggcggcagcgcaaaagatg

SEQ ID NO: 141680 - DNA, 103 bp, Artificial Sequence
  Synthetic Polynucleotide
taatacgactcactataggggaatggcggatagatctgtggtaatcttctaacagaggagaagaagaatgccacagatcaacctggcggcagcgcaaaagatg

SEQ ID NO: 141681 - DNA, 103 bp, Artificial Sequence
  Synthetic Polynucleotide
taatacgactcactatagggttgaatagaggaatggcggatagatctgtgaacagaggagacacagaatgatccgccataacctggcggcagcgcaaaagatg

SEQ ID NO: 141682 - DNA, 103 bp, Artificial Sequence
  Synthetic Polynucleotide
taatacgactcactatagggaggggatgcggaagatgctcttctcctcgtaacagaggagaacgaggatgagagcatctaacctggcggcagcgcaaaagatg

SEQ ID NO: 141683 - DNA, 103 bp, Artificial Sequence
  Synthetic Polynucleotide
taatacgactcactataggggcgtgcttccaggggatgcggaagatgctcaacagaggagagagcatatgccgcatcccaacctggcggcagcgcaaaagatg

SEQ ID NO: 141684 - DNA, 103 bp, Artificial Sequence
  Synthetic Polynucleotide
taatacgactcactatagggctgcttgcccgcgtgcttccaggggatgcgaacagaggagacgcatcatgtggaagcacaacctggcggcagcgcaaaagatg

SEQ ID NO: 141685 - DNA, 103 bp, Artificial Sequence
  Synthetic Polynucleotide
taatacgactcactatagggggttgtagtcctgcttgcccgcgtgcttccaacagaggagaggaagcatgcgggcaagcaacctggcggcagcgcaaaagatg

SEQ ID NO: 141686 - DNA, 103 bp, Artificial Sequence
  Synthetic Polynucleotide
taatacgactcactatagggtcctcctcgcggttgtagtcctgcttgcccaacagaggagagggcaaatgggactacaaaacctggcggcagcgcaaaagatg

SEQ ID NO: 141687 - DNA, 103 bp, Artificial Sequence
  Synthetic Polynucleotide
taatacgactcactataggggagcgcggcgtcctcctcgcggttgtagtcaacagaggagagactacatgcgcgaggagaacctggcggcagcgcaaaagatg

SEQ ID NO: 141688 - DNA, 103 bp, Artificial Sequence
  Synthetic Polynucleotide
taatacgactcactatagggtgccgaactctccgcctcggccgccgccctaacagaggagaagggcgatggccgaggcgaacctggcggcagcgcaaaagatg

SEQ ID NO: 141689 - DNA, 103 bp, Artificial Sequence
  Synthetic Polynucleotide
taatacgactcactatagggaagccttgaagagcgcggcgtcctcctcgcaacagaggagagcgaggatgacgccgcgcaacctggcggcagcgcaaaagatg

SEQ ID NO: 141690 - DNA, 103 bp, Artificial Sequence
  Synthetic Polynucleotide
taatacgactcactatagggaacagtgcccaagccttgaagagcgcggcgaacagaggagacgccgcatgcttcaaggcaacctggcggcagcgcaaaagatg

SEQ ID NO: 141691 - DNA, 103 bp, Artificial Sequence
  Synthetic Polynucleotide
taatacgactcactatagggctttcctttaaacagtgcccaagccttgaaaacagaggagattcaagatgtgggcactgaacctggcggcagcgcaaaagatg

SEQ ID NO: 141692 - DNA, 103 bp, Artificial Sequence
  Synthetic Polynucleotide
taatacgactcactatagggcttctcggaactttcctttaaacagtgcccaacagaggagagggcacatgttaaaggaaaacctggcggcagcgcaaaagatg

SEQ ID NO: 141693 - DNA, 103 bp, Artificial Sequence
  Synthetic Polynucleotide
taatacgactcactatagggttgtcgatgccttctcggaactttcctttaaacagaggagataaaggatggttccgagaaacctggcggcagcgcaaaagatg

SEQ ID NO: 141694 - DNA, 103 bp, Artificial Sequence
  Synthetic Polynucleotide
taatacgactcactatagggagggtccggcttgtcgatgccttctcggaaaacagaggagattccgaatgggcatcgacaacctggcggcagcgcaaaagatg

SEQ ID NO: 141695 - DNA, 103 bp, Artificial Sequence
  Synthetic Polynucleotide
taatacgactcactatagggtccaggtgggagggtccggcttgtcgatgcaacagaggagagcatcgatgagccggaccaacctggcggcagcgcaaaagatg

SEQ ID NO: 141696 - DNA, 103 bp, Artificial Sequence
  Synthetic Polynucleotide
taatacgactcactatagggaggcgcgtcttccaggtgggagggtccggcaacagaggagagccggaatgtcccacctgaacctggcggcagcgcaaaagatg

SEQ ID NO: 141697 - DNA, 103 bp, Artificial Sequence
  Synthetic Polynucleotide
taatacgactcactatagggagcgcaccgcaggcgcgtcttccaggtgggaacagaggagacccaccatgaagacgcgcaacctggcggcagcgcaaaagatg

SEQ ID NO: 141698 - DNA, 103 bp, Artificial Sequence
  Synthetic Polynucleotide
taatacgactcactatagggtcttgttcaaagcgcaccgcaggcgcgtctaacagaggagaagacgcatgtgcggtgcgaacctggcggcagcgcaaaagatg

SEQ ID NO: 141699 - DNA, 103 bp, Artificial Sequence
  Synthetic Polynucleotide
taatacgactcactatagggaccgcgctcatgccgaactctccgcctcggaacagaggagaccgaggatgagagttcggaacctggcggcagcgcaaaagatg

SEQ ID NO: 141700 - DNA, 103 bp, Artificial Sequence
  Synthetic Polynucleotide
taatacgactcactatagggaagtcattgctcttgttcaaagcgcaccgcaacagaggagagcggtgatgtttgaacaaaacctggcggcagcgcaaaagatg

SEQ ID NO: 141701 - DNA, 103 bp, Artificial Sequence
  Synthetic Polynucleotide
taatacgactcactatagggcagttcctcaaagtcattgctcttgttcaaaacagaggagattgaacatgagcaatgacaacctggcggcagcgcaaaagatg

SEQ ID NO: 141702 - DNA, 103 bp, Artificial Sequence
  Synthetic Polynucleotide
taatacgactcactatagggtccgctcaaccagttcctcaaagtcattgcaacagaggagagcaatgatgttgaggaacaacctggcggcagcgcaaaagatg

SEQ ID NO: 141703 - DNA, 103 bp, Artificial Sequence
  Synthetic Polynucleotide
taatacgactcactatagggtccagctggctccgctcaaccagttcctcaaacagaggagatgaggaatgggttgagcgaacctggcggcagcgcaaaagatg

SEQ ID NO: 141704 - DNA, 103 bp, Artificial Sequence
  Synthetic Polynucleotide
taatacgactcactataggggtctgagatgtccagctggctccgctcaacaacagaggagagttgagatgagccagctgaacctggcggcagcgcaaaagatg

SEQ ID NO: 141705 - DNA, 103 bp, Artificial Sequence
  Synthetic Polynucleotide
taatacgactcactatagggctttgtacgggtctgagatgtccagctggcaacagaggagagccagcatgacatctcagaacctggcggcagcgcaaaagatg

SEQ ID NO: 141706 - DNA, 103 bp, Artificial Sequence
  Synthetic Polynucleotide
taatacgactcactatagggatcctgtacactttgtacgggtctgagatgaacagaggagacatctcatgcccgtacaaaacctggcggcagcgcaaaagatg

SEQ ID NO: 141707 - DNA, 103 bp, Artificial Sequence
  Synthetic Polynucleotide
taatacgactcactatagggctcaggaacaatcctgtacactttgtacggaacagaggagaccgtacatggtgtacaggaacctggcggcagcgcaaaagatg

SEQ ID NO: 141708 - DNA, 103 bp, Artificial Sequence
  Synthetic Polynucleotide
taatacgactcactatagggttttggctccctcaggaacaatcctgtacaaacagaggagatgtacaatgttgttcctgaacctggcggcagcgcaaaagatg

SEQ ID NO: 141709 - DNA, 103 bp, Artificial Sequence
  Synthetic Polynucleotide
taatacgactcactatagggttggctccttttttggctccctcaggaacaaacagaggagatgttccatggggagccaaaacctggcggcagcgcaaaagatg

SEQ ID NO: 141710 - DNA, 103 bp, Artificial Sequence
  Synthetic Polynucleotide
taatacgactcactataggggccgcagctcaccgcgctcatgccgaactcaacagaggagagagttcatgatgagcgcgaacctggcggcagcgcaaaagatg

SEQ ID NO: 141711 - DNA, 103 bp, Artificial Sequence
  Synthetic Polynucleotide
taatacgactcactatagggggtgagctgcttggctccttttttggctccaacagaggagaggagccatgaaaggagccaacctggcggcagcgcaaaagatg

SEQ ID NO: 141712 - DNA, 103 bp, Artificial Sequence
  Synthetic Polynucleotide
taatacgactcactatagggggtcctccagggtgagctgcttggctccttaacagaggagaaaggagatgagcagctcaaacctggcggcagcgcaaaagatg

SEQ ID NO: 141713 - DNA, 103 bp, Artificial Sequence
  Synthetic Polynucleotide
taatacgactcactataggggacatctgcgggtcctccagggtgagctgcaacagaggagagcagctatgcctggaggaaacctggcggcagcgcaaaagatg

SEQ ID NO: 141714 - DNA, 103 bp, Artificial Sequence
  Synthetic Polynucleotide
taatacgactcactataggggtggctcatggacatctgcgggtcctccagaacagaggagactggagatgccgcagatgaacctggcggcagcgcaaaagatg

SEQ ID NO: 141715 - DNA, 103 bp, Artificial Sequence
  Synthetic Polynucleotide
taatacgactcactatagggtggtgtaggggtggctcatggacatctgcgaacagaggagacgcagaatgccatgagccaacctggcggcagcgcaaaagatg

SEQ ID NO: 141716 - DNA, 103 bp, Artificial Sequence
  Synthetic Polynucleotide
taatacgactcactatagggggcgttgtcatggtgtaggggtggctcatgaacagaggagacatgagatgcccctacacaacctggcggcagcgcaaaagatg

SEQ ID NO: 141717 - DNA, 103 bp, Artificial Sequence
  Synthetic Polynucleotide
taatacgactcactatagggcgaagggtaaggcgttgtcatggtgtagggaacagaggagaccctacatgatgacaacgaacctggcggcagcgcaaaagatg

SEQ ID NO: 141718 - DNA, 103 bp, Artificial Sequence
  Synthetic Polynucleotide
taatacgactcactataggggggctgggagcgaagggtaaggcgttgtcaaacagaggagatgacaaatgcttacccttaacctggcggcagcgcaaaagatg

SEQ ID NO: 141719 - DNA, 103 bp, Artificial Sequence
  Synthetic Polynucleotide
taatacgactcactatagggtgaacctgctgggctgggagcgaagggtaaaacagaggagattacccatggctcccagcaacctggcggcagcgcaaaagatg

SEQ ID NO: 141720 - DNA, 103 bp, Artificial Sequence
  Synthetic Polynucleotide
taatacgactcactatagggcatgtagttgtgaacctgctgggctgggagaacagaggagactcccaatgcagcaggttaacctggcggcagcgcaaaagatg

SEQ ID NO: 141721 - DNA, 103 bp, Artificial Sequence
  Synthetic Polynucleotide
taatacgactcactataggggcttcccgttgccgcagctcaccgcgctcaaacagaggagatgagcgatgtgagctgcgaacctggcggcagcgcaaaagatg

SEQ ID NO: 141722 - DNA, 103 bp, Artificial Sequence
  Synthetic Polynucleotide
taatacgactcactatagggggggtggcatcatgtagttgtgaacctgctaacagaggagaagcaggatgacaactacaaacctggcggcagcgcaaaagatg

SEQ ID NO: 141723 - DNA, 103 bp, Artificial Sequence
  Synthetic Polynucleotide
taatacgactcactatagggcttcggtcgaggggtggcatcatgtagttgaacagaggagacaactaatggatgccaccaacctggcggcagcgcaaaagatg

SEQ ID NO: 141724 - DNA, 103 bp, Artificial Sequence
  Synthetic Polynucleotide
taatacgactcactataggggtccctccagcttcggtcgaggggtggcataacagaggagaatgccaatgctcgaccgaaacctggcggcagcgcaaaagatg

SEQ ID NO: 141725 - DNA, 103 bp, Artificial Sequence
  Synthetic Polynucleotide
taatacgactcactatagggccgggacgtagtccctccagcttcggtcgaaacagaggagatcgaccatggctggagggaacctggcggcagcgcaaaagatg

SEQ ID NO: 141726 - DNA, 103 bp, Artificial Sequence
  Synthetic Polynucleotide
taatacgactcactatagggtgtggctgatccgggacgtagtccctccagaacagaggagactggagatgctacgtcccaacctggcggcagcgcaaaagatg

SEQ ID NO: 141727 - DNA, 103 bp, Artificial Sequence
  Synthetic Polynucleotide
taatacgactcactataggggatttccgggtgtggctgatccgggacgtaaacagaggagatacgtcatggatcagccaaacctggcggcagcgcaaaagatg

SEQ ID NO: 141728 - DNA, 103 bp, Artificial Sequence
  Synthetic Polynucleotide
taatacgactcactatagggattggtacgggatttccgggtgtggctgataacagaggagaatcagcatgacccggaaaaacctggcggcagcgcaaaagatg

SEQ ID NO: 141729 - DNA, 103 bp, Artificial Sequence
  Synthetic Polynucleotide
taatacgactcactataggggtcatgggacattggtacgggatttccgggaacagaggagacccggaatgcccgtaccaaacctggcggcagcgcaaaagatg

SEQ ID NO: 141730 - DNA, 103 bp, Artificial Sequence
  Synthetic Polynucleotide
taatacgactcactataggggggtccaaacgtcatgggacattggtacggaacagaggagaccgtacatgtgtcccatgaacctggcggcagcgcaaaagatg

SEQ ID NO: 141731 - DNA, 103 bp, Artificial Sequence
  Synthetic Polynucleotide
taatacgactcactatagggggtggccgcggggtccaaacgtcatgggacaacagaggagagtcccaatgcgtttggacaacctggcggcagcgcaaaagatg

SEQ ID NO: 141732 - DNA, 103 bp, Artificial Sequence
  Synthetic Polynucleotide
taatacgactcactatagggcactggcggagcttcccgttgccgcagctcaacagaggagagagctgatgcaacgggaaaacctggcggcagcgcaaaagatg

SEQ ID NO: 141733 - DNA, 103 bp, Artificial Sequence
  Synthetic Polynucleotide
taatacgactcactatagggccttgccagtggtggccgcggggtccaaacaacagaggagagtttggatgccgcggccaaacctggcggcagcgcaaaagatg

SEQ ID NO: 141734 - DNA, 103 bp, Artificial Sequence
  Synthetic Polynucleotide
taatacgactcactatagggacaagctgggccttgccagtggtggccgcgaacagaggagacgcggcatgcactggcaaaacctggcggcagcgcaaaagatg

SEQ ID NO: 141735 - DNA, 103 bp, Artificial Sequence
  Synthetic Polynucleotide
taatacgactcactatagggaaccattttcacaagctgggccttgccagtaacagaggagaactggcatggcccagcttaacctggcggcagcgcaaaagatg

SEQ ID NO: 141736 - DNA, 103 bp, Artificial Sequence
  Synthetic Polynucleotide
taatacgactcactataggggtcacctggcaaccattttcacaagctgggaacagaggagacccagcatgtgaaaatggaacctggcggcagcgcaaaagatg

SEQ ID NO: 141737 - DNA, 103 bp, Artificial Sequence
  Synthetic Polynucleotide
taatacgactcactatagggaaaggttcctgtcacctggcaaccattttcaacagaggagagaaaatatgtgccaggtgaacctggcggcagcgcaaaagatg

SEQ ID NO: 141738 - DNA, 103 bp, Artificial Sequence
  Synthetic Polynucleotide
taatacgactcactatagggcacaagcataaaaggttcctgtcacctggcaacagaggagagccaggatgcaggaacctaacctggcggcagcgcaaaagatg

SEQ ID NO: 141739 - DNA, 103 bp, Artificial Sequence
  Synthetic Polynucleotide
taatacgactcactatagggtcaggtggggcacaagcataaaaggttcctaacagaggagaaggaacatgttatgcttgaacctggcggcagcgcaaaagatg

SEQ ID NO: 141740 - DNA, 103 bp, Artificial Sequence
  Synthetic Polynucleotide
taatacgactcactatagggagcctgggactcaggtggggcacaagcataaacagaggagatatgctatggccccacctaacctggcggcagcgcaaaagatg

SEQ ID NO: 141741 - DNA, 103 bp, Artificial Sequence
  Synthetic Polynucleotide
taatacgactcactatagggggactccgggagcctgggactcaggtggggaacagaggagaccccacatgagtcccaggaacctggcggcagcgcaaaagatg

SEQ ID NO: 141742 - DNA, 103 bp, Artificial Sequence
  Synthetic Polynucleotide
taatacgactcactatagggggctctgtggggactccgggagcctgggacaacagaggagagtcccaatgtcccggagtaacctggcggcagcgcaaaagatg

SEQ ID NO: 141743 - DNA, 103 bp, Artificial Sequence
  Synthetic Polynucleotide
taatacgactcactataggggtcgatcagccactggcggagcttcccgttaacagaggagaaacgggatgctccgccagaacctggcggcagcgcaaaagatg

SEQ ID NO: 141744 - DNA, 103 bp, Artificial Sequence
  Synthetic Polynucleotide
taatacgactcactatagggccttatgcttggctctgtggggactccgggaacagaggagacccggaatgcccacagagaacctggcggcagcgcaaaagatg

SEQ ID NO: 141745 - DNA, 103 bp, Artificial Sequence
  Synthetic Polynucleotide
taatacgactcactatagggcttcggcagaccttatgcttggctctgtggaacagaggagaccacagatgcaagcataaaacctggcggcagcgcaaaagatg

SEQ ID NO: 141746 - DNA, 103 bp, Artificial Sequence
  Synthetic Polynucleotide
taatacgactcactatagggaacgccaaggcttcggcagaccttatgcttaacagaggagaaagcatatggtctgccgaaacctggcggcagcgcaaaagatg

SEQ ID NO: 141747 - DNA, 103 bp, Artificial Sequence
  Synthetic Polynucleotide
taatacgactcactataggggcagtctgagaacgccaaggcttcggcagaaacagaggagatctgccatggccttggcgaacctggcggcagcgcaaaagatg

SEQ ID NO: 141748 - DNA, 103 bp, Artificial Sequence
  Synthetic Polynucleotide
taatacgactcactatagggtgtgcagccggcagtctgagaacgccaaggaacagaggagaccttggatgtctcagactaacctggcggcagcgcaaaagatg

SEQ ID NO: 141749 - DNA, 103 bp, Artificial Sequence
  Synthetic Polynucleotide
taatacgactcactatagggtacaggcagatgtgcagccggcagtctgagaacagaggagactcagaatgccggctgcaaacctggcggcagcgcaaaagatg

SEQ ID NO: 141750 - DNA, 103 bp, Artificial Sequence
  Synthetic Polynucleotide
taatacgactcactatagggttcccggtagtacaggcagatgtgcagccgaacagaggagacggctgatgatctgcctgaacctggcggcagcgcaaaagatg

SEQ ID NO: 141751 - DNA, 103 bp, Artificial Sequence
  Synthetic Polynucleotide
taatacgactcactatagggtcacgaggatttcccggtagtacaggcagaaacagaggagatctgccatgactaccgggaacctggcggcagcgcaaaagatg

SEQ ID NO: 141752 - DNA, 103 bp, Artificial Sequence
  Synthetic Polynucleotide
taatacgactcactataggggtcagctccttcacgaggatttcccggtagaacagaggagactaccgatgaatcctcgtaacctggcggcagcgcaaaagatg

SEQ ID NO: 141753 - DNA, 103 bp, Artificial Sequence
  Synthetic Polynucleotide
taatacgactcactataggggctggacgtggtcagctccttcacgaggataacagaggagaatcctcatgaaggagctgaacctggcggcagcgcaaaagatg

SEQ ID NO: 141754 - DNA, 103 bp, Artificial Sequence
  Synthetic Polynucleotide
taatacgactcactatagggtgtcgatctggtcgatcagccactggcggaaacagaggagatccgccatgggctgatcgaacctggcggcagcgcaaaagatg

SEQ ID NO: 141755 - DNA, 103 bp, Artificial Sequence
  Synthetic Polynucleotide
taatacgactcactatagggagccctcggggctggacgtggtcagctcctaacagaggagaaggagcatgccacgtccaaacctggcggcagcgcaaaagatg

SEQ ID NO: 141756 - DNA, 103 bp, Artificial Sequence
  Synthetic Polynucleotide
taatacgactcactataggggagatccggcagccctcggggctggacgtgaacagaggagacacgtcatgccccgagggaacctggcggcagcgcaaaagatg

SEQ ID NO: 141757 - DNA, 103 bp, Artificial Sequence
  Synthetic Polynucleotide
taatacgactcactatagggatgtccatgggagatccggcagccctcgggaacagaggagacccgagatgtgccggatcaacctggcggcagcgcaaaagatg

SEQ ID NO: 141758 - DNA, 103 bp, Artificial Sequence
  Synthetic Polynucleotide
taatacgactcactatagggcgtcatacgtatgtccatgggagatccggcaacagaggagagccggaatgcccatggacaacctggcggcagcgcaaaagatg

SEQ ID NO: 141759 - DNA, 103 bp, Artificial Sequence
  Synthetic Polynucleotide
taatacgactcactatagggaggttgctggcgtcatacgtatgtccatggaacagaggagaccatggatgtacgtatgaaacctggcggcagcgcaaaagatg

SEQ ID NO: 141760 - DNA, 103 bp, Artificial Sequence
  Synthetic Polynucleotide
taatacgactcactataggggacctggtccaggttgctggcgtcatacgtaacagaggagaacgtatatggccagcaacaacctggcggcagcgcaaaagatg

SEQ ID NO: 141761 - DNA, 103 bp, Artificial Sequence
  Synthetic Polynucleotide
taatacgactcactatagggaggggaacaggacctggtccaggttgctggaacagaggagaccagcaatgtggaccaggaacctggcggcagcgcaaaagatg

SEQ ID NO: 141762 - DNA, 103 bp, Artificial Sequence
  Synthetic Polynucleotide
taatacgactcactatagggtcctctgggtaggggaacaggacctggtccaacagaggagaggaccaatgcctgttcccaacctggcggcagcgcaaaagatg

SEQ ID NO: 141763 - DNA, 103 bp, Artificial Sequence
  Synthetic Polynucleotide
taatacgactcactatagggctggccattgtcctctgggtaggggaacagaacagaggagactgttcatgtacccagagaacctggcggcagcgcaaaagatg

SEQ ID NO: 141764 - DNA, 103 bp, Artificial Sequence
  Synthetic Polynucleotide
taatacgactcactatagggtgtttttcctctggccattgtcctctgggtaacagaggagaacccagatgacaatggccaacctggcggcagcgcaaaagatg

SEQ ID NO: 141765 - DNA, 103 bp, Artificial Sequence
  Synthetic Polynucleotide
taatacgactcactatagggtacttgccgctgtcgatctggtcgatcagcaacagaggagagctgatatgccagatcgaaacctggcggcagcgcaaaagatg

SEQ ID NO: 141766 - DNA, 103 bp, Artificial Sequence
  Synthetic Polynucleotide
taatacgactcactatagggagcttctcaatgtttttcctctggccattgaacagaggagacaatggatggaggaaaaaaacctggcggcagcgcaaaagatg

SEQ ID NO: 141767 - DNA, 103 bp, Artificial Sequence
  Synthetic Polynucleotide
taatacgactcactataggggtggctcagcagcttctcaatgtttttcctaacagaggagaaggaaaatgattgagaagaacctggcggcagcgcaaaagatg

SEQ ID NO: 141768 - DNA, 103 bp, Artificial Sequence
  Synthetic Polynucleotide
taatacgactcactatagggccctctccaggtggctcagcagcttctcaaaacagaggagattgagaatgtgctgagccaacctggcggcagcgcaaaagatg

SEQ ID NO: 141769 - DNA, 103 bp, Artificial Sequence
  Synthetic Polynucleotide
taatacgactcactatagggaggaccacgcccctctccaggtggctcagcaacagaggagagctgagatgcctggagagaacctggcggcagcgcaaaagatg

SEQ ID NO: 141770 - DNA, 103 bp, Artificial Sequence
  Synthetic Polynucleotide
taatacgactcactatagggggccatccagaggaccacgcccctctccagaacagaggagactggagatgggcgtggtcaacctggcggcagcgcaaaagatg

SEQ ID NO: 141771 - DNA, 103 bp, Artificial Sequence
  Synthetic Polynucleotide
taatacgactcactataggggcccgtcgggggccatccagaggaccacgcaacagaggagagcgtggatgtctggatggaacctggcggcagcgcaaaagatg

SEQ ID NO: 141772 - DNA, 103 bp, Artificial Sequence
  Synthetic Polynucleotide
taatacgactcactatagggttcgcatagagcccgtcgggggccatccagaacagaggagactggatatgccccgacggaacctggcggcagcgcaaaagatg

SEQ ID NO: 141773 - DNA, 103 bp, Artificial Sequence
  Synthetic Polynucleotide
taatacgactcactataggggcacagtcttttcgcatagagcccgtcgggaacagaggagacccgacatgctctatgcgaacctggcggcagcgcaaaagatg

SEQ ID NO: 141774 - DNA, 103 bp, Artificial Sequence
  Synthetic Polynucleotide
taatacgactcactatagggtcctgctctggcacagtcttttcgcatagaaacagaggagatctatgatgaaagactgtaacctggcggcagcgcaaaagatg

SEQ ID NO: 141775 - DNA, 103 bp, Artificial Sequence
  Synthetic Polynucleotide
taatacgactcactatagggtcccagtagatcctgctctggcacagtcttaacagaggagaaagactatgccagagcagaacctggcggcagcgcaaaagatg

SEQ ID NO: 141776 - DNA, 103 bp, Artificial Sequence
  Synthetic Polynucleotide
taatacgactcactatagggggtgggagccactgggatggactggttcataacagaggagaatgaacatgtccatcccaaacctggcggcagcgcaaaagatg

SEQ ID NO: 141777 - DNA, 103 bp, Artificial Sequence
  Synthetic Polynucleotide
taatacgactcactatagggcttttccccgttgacccattgaagccctggaacagaggagaccagggatgcaatgggtcaacctggcggcagcgcaaaagatg

SEQ ID NO: 141778 - DNA, 103 bp, Artificial Sequence
  Synthetic Polynucleotide
taatacgactcactatagggacacaggcggatggcataaaggtcctggccaacagaggagaggccagatgctttatgccaacctggcggcagcgcaaaagatg

SEQ ID NO: 141779 - DNA, 103 bp, Artificial Sequence
  Synthetic Polynucleotide
taatacgactcactatagggccttgcactgacacaggcggatggcataaaaacagaggagatttatgatgtccgcctgtaacctggcggcagcgcaaaagatg

SEQ ID NO: 141780 - DNA, 103 bp, Artificial Sequence
  Synthetic Polynucleotide
taatacgactcactatagggctccagaacaccttgcactgacacaggcggaacagaggagaccgcctatgtcagtgcaaaacctggcggcagcgcaaaagatg

SEQ ID NO: 141781 - DNA, 103 bp, Artificial Sequence
  Synthetic Polynucleotide
taatacgactcactatagggacaaggcccgctccagaacaccttgcactgaacagaggagacagtgcatggtgttctggaacctggcggcagcgcaaaagatg

SEQ ID NO: 141782 - DNA, 103 bp, Artificial Sequence
  Synthetic Polynucleotide
taatacgactcactataggggggctgaggcacaaggcccgctccagaacaaacagaggagatgttctatggcgggccttaacctggcggcagcgcaaaagatg

SEQ ID NO: 141783 - DNA, 103 bp, Artificial Sequence
  Synthetic Polynucleotide
taatacgactcactatagggcatgagtcatgggctgaggcacaaggcccgaacagaggagacgggccatgtgcctcagcaacctggcggcagcgcaaaagatg

SEQ ID NO: 141784 - DNA, 103 bp, Artificial Sequence
  Synthetic Polynucleotide
taatacgactcactatagggggggttggggcatgagtcatgggctgaggcaacagaggagagcctcaatgcatgactcaaacctggcggcagcgcaaaagatg

SEQ ID NO: 141785 - DNA, 103 bp, Artificial Sequence
  Synthetic Polynucleotide
taatacgactcactatagggcccgctggatggggttggggcatgagtcataacagaggagaatgactatggccccaaccaacctggcggcagcgcaaaagatg

SEQ ID NO: 141786 - DNA, 103 bp, Artificial Sequence
  Synthetic Polynucleotide
taatacgactcactataggggtcttgacctcccgctggatggggttggggaacagaggagaccccaaatgcatccagcgaacctggcggcagcgcaaaagatg

SEQ ID NO: 141787 - DNA, 103 bp, Artificial Sequence
  Synthetic Polynucleotide
taatacgactcactataggggaaaagcttggtcttgacctcccgctggataacagaggagaatccagatggaggtcaagaacctggcggcagcgcaaaagatg

SEQ ID NO: 141788 - DNA, 103 bp, Artificial Sequence
  Synthetic Polynucleotide
taatacgactcactatagggagaataatttcttttccccgttgacccattaacagaggagaaatgggatgacggggaaaaacctggcggcagcgcaaaagatg

SEQ ID NO: 141789 - DNA, 103 bp, Artificial Sequence
  Synthetic Polynucleotide
taatacgactcactataggggctccaggctgaaaagcttggtcttgacctaacagaggagaaggtcaatgccaagctttaacctggcggcagcgcaaaagatg

SEQ ID NO: 141790 - DNA, 103 bp, Artificial Sequence
  Synthetic Polynucleotide
taatacgactcactatagggttgagaaaatgctccaggctgaaaagcttgaacagaggagacaagctatgcagcctggaaacctggcggcagcgcaaaagatg

SEQ ID NO: 141791 - DNA, 103 bp, Artificial Sequence
  Synthetic Polynucleotide
taatacgactcactataggggatgagctcattgagaaaatgctccaggctaacagaggagaagcctgatgcattttctcaacctggcggcagcgcaaaagatg

SEQ ID NO: 141792 - DNA, 103 bp, Artificial Sequence
  Synthetic Polynucleotide
taatacgactcactatagggtttggaacaggatgagctcattgagaaaataacagaggagaattttcatgatgagctcaaacctggcggcagcgcaaaagatg

SEQ ID NO: 141793 - DNA, 103 bp, Artificial Sequence
  Synthetic Polynucleotide
taatacgactcactataggggtctggcccttttggaacaggatgagctcaaacagaggagatgagctatgcctgttccaaacctggcggcagcgcaaaagatg

SEQ ID NO: 141794 - DNA, 103 bp, Artificial Sequence
  Synthetic Polynucleotide
taatacgactcactatagggtggggtgttggtctggcccttttggaacagaacagaggagactgttcatgaagggccagaacctggcggcagcgcaaaagatg

SEQ ID NO: 141795 - DNA, 103 bp, Artificial Sequence
  Synthetic Polynucleotide
taatacgactcactatagggcgaagggtggtggggtgttggtctggccctaacagaggagaagggccatgccaacacccaacctggcggcagcgcaaaagatg

SEQ ID NO: 141796 - DNA, 103 bp, Artificial Sequence
  Synthetic Polynucleotide
taatacgactcactatagggaagaagatctcgaagggtggtggggtgttgaacagaggagacaacacatgaccacccttaacctggcggcagcgcaaaagatg

SEQ ID NO: 141797 - DNA, 103 bp, Artificial Sequence
  Synthetic Polynucleotide
taatacgactcactatagggcccaaagcagaagaagatctcgaagggtggaacagaggagaccacccatggagatcttcaacctggcggcagcgcaaaagatg

SEQ ID NO: 141798 - DNA, 103 bp, Artificial Sequence
  Synthetic Polynucleotide
taatacgactcactataggggccattcttccccaaagcagaagaagatctaacagaggagaagatctatgtctgctttgaacctggcggcagcgcaaaagatg

SEQ ID NO: 141799 - DNA, 103 bp, Artificial Sequence
  Synthetic Polynucleotide
taatacgactcactatagggcaggggatgcagaataatttcttttccccgaacagaggagacggggaatggaaattattaacctggcggcagcgcaaaagatg

SEQ ID NO: 141800 - DNA, 103 bp, Artificial Sequence
  Synthetic Polynucleotide
taatacgactcactatagggttgcggtcaggccattcttccccaaagcagaacagaggagactgcttatgggaagaatgaacctggcggcagcgcaaaagatg

SEQ ID NO: 141801 - DNA, 103 bp, Artificial Sequence
  Synthetic Polynucleotide
taatacgactcactatagggctctcggggtttgcggtcaggccattcttcaacagaggagagaagaaatgcctgaccgcaacctggcggcagcgcaaaagatg

SEQ ID NO: 141802 - DNA, 103 bp, Artificial Sequence
  Synthetic Polynucleotide
taatacgactcactatagggtgagcttcttctctcggggtttgcggtcagaacagaggagactgaccatgaaccccgagaacctggcggcagcgcaaaagatg

SEQ ID NO: 141803 - DNA, 103 bp, Artificial Sequence
  Synthetic Polynucleotide
taatacgactcactatagggtgtacagtaatgagcttcttctctcggggtaacagaggagaaccccgatggaagaagctaacctggcggcagcgcaaaagatg

SEQ ID NO: 141804 - DNA, 103 bp, Artificial Sequence
  Synthetic Polynucleotide
taatacgactcactatagggaggcaccacctgtacagtaatgagcttcttaacagaggagaaagaagatgattactgtaaacctggcggcagcgcaaaagatg

SEQ ID NO: 141805 - DNA, 103 bp, Artificial Sequence
  Synthetic Polynucleotide
taatacgactcactataggggagctgctacaggcaccacctgtacagtaaaacagaggagattactgatgaggtggtgcaacctggcggcagcgcaaaagatg

SEQ ID NO: 141806 - DNA, 103 bp, Artificial Sequence
  Synthetic Polynucleotide
taatacgactcactatagggagcagcagtcgagctgctacaggcaccaccaacagaggagaggtggtatgtgtagcagcaacctggcggcagcgcaaaagatg

SEQ ID NO: 141807 - DNA, 103 bp, Artificial Sequence
  Synthetic Polynucleotide
taatacgactcactataggggaacatctccagcagcagtcgagctgctacaacagaggagagtagcaatgcgactgctgaacctggcggcagcgcaaaagatg

SEQ ID NO: 141808 - DNA, 103 bp, Artificial Sequence
  Synthetic Polynucleotide
taatacgactcactataggggctcccctgagaacatctccagcagcagtcaacagaggagagactgcatgtggagatgtaacctggcggcagcgcaaaagatg

SEQ ID NO: 141809 - DNA, 103 bp, Artificial Sequence
  Synthetic Polynucleotide
taatacgactcactataggggaccaagatagctcccctgagaacatctccaacagaggagaggagatatgctcaggggaaacctggcggcagcgcaaaagatg

SEQ ID NO: 141810 - DNA, 103 bp, Artificial Sequence
  Synthetic Polynucleotide
taatacgactcactatagggggcatgcctccaggggatgcagaataatttaacagaggagaaaattaatgtgcatccccaacctggcggcagcgcaaaagatg

SEQ ID NO: 141811 - DNA, 103 bp, Artificial Sequence
  Synthetic Polynucleotide
taatacgactcactatagggactatcagctgaccaagatagctcccctgaaacagaggagatcagggatgctatcttggaacctggcggcagcgcaaaagatg

SEQ ID NO: 141812 - DNA, 103 bp, Artificial Sequence
  Synthetic Polynucleotide
taatacgactcactataggggtagccggatactatcagctgaccaagataaacagaggagatatcttatgcagctgataaacctggcggcagcgcaaaagatg

SEQ ID NO: 141813 - DNA, 103 bp, Artificial Sequence
  Synthetic Polynucleotide
taatacgactcactatagggtttgagatctgtagccggatactatcagctaacagaggagaagctgaatgtatccggctaacctggcggcagcgcaaaagatg

SEQ ID NO: 141814 - DNA, 103 bp, Artificial Sequence
  Synthetic Polynucleotide
taatacgactcactataggggaggtctgggtttgagatctgtagccggataacagaggagaatccggatgcagatctcaaacctggcggcagcgcaaaagatg

SEQ ID NO: 141815 - DNA, 103 bp, Artificial Sequence
  Synthetic Polynucleotide
taatacgactcactatagggtgcggtctttgaggtctgggtttgagatctaacagaggagaagatctatgacccagaccaacctggcggcagcgcaaaagatg

SEQ ID NO: 141816 - DNA, 103 bp, Artificial Sequence
  Synthetic Polynucleotide
taatacgactcactatagggtgctccaccatgcggtctttgaggtctgggaacagaggagacccagaatgcaaagaccgaacctggcggcagcgcaaaagatg

SEQ ID NO: 141817 - DNA, 103 bp, Artificial Sequence
  Synthetic Polynucleotide
taatacgactcactatagggctccttgaattgctccaccatgcggtctttaacagaggagaaaagacatgatggtggagaacctggcggcagcgcaaaagatg

SEQ ID NO: 141818 - DNA, 103 bp, Artificial Sequence
  Synthetic Polynucleotide
taatacgactcactatagggtgtgatggagctccttgaattgctccaccaaacagaggagatggtggatgaattcaaggaacctggcggcagcgcaaaagatg

SEQ ID NO: 141819 - DNA, 103 bp, Artificial Sequence
  Synthetic Polynucleotide
taatacgactcactataggggactgccagatgtgatggagctccttgaataacagaggagaattcaaatggctccatcaaacctggcggcagcgcaaaagatg

SEQ ID NO: 141820 - DNA, 103 bp, Artificial Sequence
  Synthetic Polynucleotide
taatacgactcactatagggccgctgctgggactgccagatgtgatggagaacagaggagactccatatgatctggcagaacctggcggcagcgcaaaagatg

SEQ ID NO: 141821 - DNA, 103 bp, Artificial Sequence
  Synthetic Polynucleotide
taatacgactcactatagggcatgccttgtggcatgcctccaggggatgcaacagaggagagcatccatgggaggcatgaacctggcggcagcgcaaaagatg

SEQ ID NO: 141822 - DNA, 103 bp, Artificial Sequence
  Synthetic Polynucleotide
taatacgactcactatagggcaggctgcaaccgctgctgggactgccagaaacagaggagatctggcatgcccagcagcaacctggcggcagcgcaaaagatg

SEQ ID NO: 141823 - DNA, 103 bp, Artificial Sequence
  Synthetic Polynucleotide
taatacgactcactataggggcctgggccacaggctgcaaccgctgctggaacagaggagaccagcaatggttgcagccaacctggcggcagcgcaaaagatg

SEQ ID NO: 141824 - DNA, 103 bp, Artificial Sequence
  Synthetic Polynucleotide
taatacgactcactatagggtccaggaggggcctgggccacaggctgcaaaacagaggagattgcagatggtggcccagaacctggcggcagcgcaaaagatg

SEQ ID NO: 141825 - DNA, 103 bp, Artificial Sequence
  Synthetic Polynucleotide
taatacgactcactatagggcaaggcctgctccaggaggggcctgggccaaacagaggagatggcccatgcccctcctgaacctggcggcagcgcaaaagatg

SEQ ID NO: 141826 - DNA, 103 bp, Artificial Sequence
  Synthetic Polynucleotide
taatacgactcactatagggtggccaacaccaaggcctgctccaggagggaacagaggagaccctccatgagcaggcctaacctggcggcagcgcaaaagatg

SEQ ID NO: 141827 - DNA, 103 bp, Artificial Sequence
  Synthetic Polynucleotide
taatacgactcactatagggccagggcccctggccaacaccaaggcctgcaacagaggagagcaggcatgggtgttggcaacctggcggcagcgcaaaagatg

SEQ ID NO: 141828 - DNA, 103 bp, Artificial Sequence
  Synthetic Polynucleotide
taatacgactcactatagggggtgcataggccagggcccctggccaacacaacagaggagagtgttgatgaggggccctaacctggcggcagcgcaaaagatg

SEQ ID NO: 141829 - DNA, 103 bp, Artificial Sequence
  Synthetic Polynucleotide
taatacgactcactatagggatgccagctgggtgcataggccagggccccaacagaggagaggggccatggcctatgcaaacctggcggcagcgcaaaagatg

SEQ ID NO: 141830 - DNA, 103 bp, Artificial Sequence
  Synthetic Polynucleotide
taatacgactcactatagggtggctgggaccatgccttgtggcatgcctcaacagaggagagaggcaatgcacaaggcaaacctggcggcagcgcaaaagatg

SEQ ID NO: 141831 - DNA, 103 bp, Artificial Sequence
  Synthetic Polynucleotide
taatacgactcactatagggatctccgtcctggctgggaccatgccttgtaacagaggagaacaaggatgggtcccagcaacctggcggcagcgcaaaagatg

SEQ ID NO: 141832 - DNA, 103 bp, Artificial Sequence
  Synthetic Polynucleotide
taatacgactcactatagggagatggtgttatctccgtcctggctgggacaacagaggagagtcccaatgaggacggagaacctggcggcagcgcaaaagatg

SEQ ID NO: 141833 - DNA, 103 bp, Artificial Sequence
  Synthetic Polynucleotide
taatacgactcactatagggcaggccttgaagatggtgttatctccgtccaacagaggagaggacggatgtaacaccataacctggcggcagcgcaaaagatg

SEQ ID NO: 141834 - DNA, 103 bp, Artificial Sequence
  Synthetic Polynucleotide
taatacgactcactatagggctccttggcccaggccttgaagatggtgttaacagaggagaaacaccatgttcaaggccaacctggcggcagcgcaaaagatg

SEQ ID NO: 141835 - DNA, 103 bp, Artificial Sequence
  Synthetic Polynucleotide
taatacgactcactatagggggcggggtggggtgggagccactgggatggaacagaggagaccatccatgtggctcccaaacctggcggcagcgcaaaagatg

SEQ ID NO: 141836 - DNA, 103 bp, Artificial Sequence
  Synthetic Polynucleotide
taatacgactcactatagggatttccctgtctccttggcccaggccttgaaacagaggagatcaaggatggggccaaggaacctggcggcagcgcaaaagatg

SEQ ID NO: 141837 - DNA, 103 bp, Artificial Sequence
  Synthetic Polynucleotide
taatacgactcactatagggccttcggtgtatttccctgtctccttggccaacagaggagaggccaaatggacagggaaaacctggcggcagcgcaaaagatg

SEQ ID NO: 141838 - DNA, 103 bp, Artificial Sequence
  Synthetic Polynucleotide
taatacgactcactatagggttcatccacgccttcggtgtatttccctgtaacagaggagaacagggatgtacaccgaaaacctggcggcagcgcaaaagatg

SEQ ID NO: 141839 - DNA, 103 bp, Artificial Sequence
  Synthetic Polynucleotide
taatacgactcactatagggccggatcggcttcatccacgccttcggtgtaacagaggagaacaccgatggcgtggatgaacctggcggcagcgcaaaagatg

SEQ ID NO: 141840 - DNA, 103 bp, Artificial Sequence
  Synthetic Polynucleotide
taatacgactcactatagggttccacttggccggatcggcttcatccacgaacagaggagacgtggaatgagccgatccaacctggcggcagcgcaaaagatg

SEQ ID NO: 141841 - DNA, 103 bp, Artificial Sequence
  Synthetic Polynucleotide
taatacgactcactatagggcaggttggccttccacttggccggatcggcaacagaggagagccgatatggccaagtggaacctggcggcagcgcaaaagatg

SEQ ID NO: 141842 - DNA, 103 bp, Artificial Sequence
  Synthetic Polynucleotide
taatacgactcactataggggggcacagcgcaggttggccttccacttggaacagaggagaccaagtatgaggccaaccaacctggcggcagcgcaaaagatg

SEQ ID NO: 141843 - DNA, 103 bp, Artificial Sequence
  Synthetic Polynucleotide
taatacgactcactatagggctcttgttaagggcacagcgcaggttggccaacagaggagaggccaaatggcgctgtgcaacctggcggcagcgcaaaagatg

SEQ ID NO: 141844 - DNA, 103 bp, Artificial Sequence
  Synthetic Polynucleotide
taatacgactcactataggggaagtcccggctcttgttaagggcacagcgaacagaggagacgctgtatgcttaacaagaacctggcggcagcgcaaaagatg

SEQ ID NO: 141845 - DNA, 103 bp, Artificial Sequence
  Synthetic Polynucleotide
taatacgactcactatagggagatgaggcggaagtcccggctcttgttaaaacagaggagattaacaatggccgggactaacctggcggcagcgcaaaagatg

SEQ ID NO: 141846 - DNA, 103 bp, Artificial Sequence
  Synthetic Polynucleotide
taatacgactcactatagggagccgcacgcggcggggtggggtgggagccaacagaggagaggctccatgcccaccccgaacctggcggcagcgcaaaagatg

SEQ ID NO: 141847 - DNA, 103 bp, Artificial Sequence
  Synthetic Polynucleotide
taatacgactcactatagggggcccgtcgtagatgaggcggaagtcccggaacagaggagaccgggaatgccgcctcataacctggcggcagcgcaaaagatg

SEQ ID NO: 141848 - DNA, 103 bp, Artificial Sequence
  Synthetic Polynucleotide
taatacgactcactatagggcatgtcccggggcccgtcgtagatgaggcgaacagaggagacgcctcatgtacgacgggaacctggcggcagcgcaaaagatg

SEQ ID NO: 141849 - DNA, 103 bp, Artificial Sequence
  Synthetic Polynucleotide
taatacgactcactataggggctgaggtggcatgtcccggggcccgtcgtaacagaggagaacgacgatgcccgggacaaacctggcggcagcgcaaaagatg

SEQ ID NO: 141850 - DNA, 103 bp, Artificial Sequence
  Synthetic Polynucleotide
taatacgactcactatagggatcttgtagggctgaggtggcatgtcccggaacagaggagaccgggaatggccacctcaaacctggcggcagcgcaaaagatg

SEQ ID NO: 141851 - DNA, 103 bp, Artificial Sequence
  Synthetic Polynucleotide
taatacgactcactataggggacctcgtagatcttgtagggctgaggtggaacagaggagaccacctatgccctacaagaacctggcggcagcgcaaaagatg

SEQ ID NO: 141852 - DNA, 103 bp, Artificial Sequence
  Synthetic Polynucleotide
taatacgactcactatagggcattggagcagacctcgtagatcttgtaggaacagaggagacctacaatgtctacgaggaacctggcggcagcgcaaaagatg

SEQ ID NO: 141853 - DNA, 103 bp, Artificial Sequence
  Synthetic Polynucleotide
taatacgactcactatagggggagcagggccattggagcagacctcgtagaacagaggagactacgaatgctgctccaaaacctggcggcagcgcaaaagatg

SEQ ID NO: 141854 - DNA, 103 bp, Artificial Sequence
  Synthetic Polynucleotide
taatacgactcactatagggggagtctgtgggagcagggccattggagcaaacagaggagatgctccatgggccctgctaacctggcggcagcgcaaaagatg

SEQ ID NO: 141855 - DNA, 103 bp, Artificial Sequence
  Synthetic Polynucleotide
taatacgactcactatagggcagggggctgggagtctgtgggagcagggcaacagaggagagccctgatgccacagactaacctggcggcagcgcaaaagatg

SEQ ID NO: 141856 - DNA, 103 bp, Artificial Sequence
  Synthetic Polynucleotide
taatacgactcactataggggagtaatcctcagggggctgggagtctgtgaacagaggagacacagaatgccagcccccaacctggcggcagcgcaaaagatg

SEQ ID NO: 141857 - DNA, 103 bp, Artificial Sequence
  Synthetic Polynucleotide
taatacgactcactatagggccagggcttcagccgcacgcggcggggtggaacagaggagaccacccatgcgcgtgcggaacctggcggcagcgcaaaagatg

SEQ ID NO: 141858 - DNA, 103 bp, Artificial Sequence
  Synthetic Polynucleotide
taatacgactcactatagggtgcaccaaaagagtaatcctcagggggctgaacagaggagacagcccatggaggattacaacctggcggcagcgcaaaagatg

SEQ ID NO: 141859 - DNA, 103 bp, Artificial Sequence
  Synthetic Polynucleotide
taatacgactcactatagggcctcctctcctgcaccaaaagagtaatcctaacagaggagaaggattatgcttttggtgaacctggcggcagcgcaaaagatg

SEQ ID NO: 141860 - DNA, 103 bp, Artificial Sequence
  Synthetic Polynucleotide
taatacgactcactatagggtcttcttcctcctcctctcctgcaccaaaaaacagaggagattttggatgaggagaggaaacctggcggcagcgcaaaagatg

SEQ ID NO: 141861 - DNA, 103 bp, Artificial Sequence
  Synthetic Polynucleotide
taatacgactcactatagggcagctcttcctcttcttcctcctcctctccaacagaggagaggagagatggaggaagaaaacctggcggcagcgcaaaagatg

SEQ ID NO: 141862 - DNA, 103 bp, Artificial Sequence
  Synthetic Polynucleotide
taatacgactcactatagggacatcctctgcagctcttcctcttcttcctaacagaggagaaggaagatgaggaagagcaacctggcggcagcgcaaaagatg

SEQ ID NO: 141863 - DNA, 103 bp, Artificial Sequence
  Synthetic Polynucleotide
taatacgactcactatagggaggcttggcaacatcctctgcagctcttccaacagaggagaggaagaatggcagaggataacctggcggcagcgcaaaagatg

SEQ ID NO: 141864 - DNA, 103 bp, Artificial Sequence
  Synthetic Polynucleotide
taatacgactcactatagggtgtgaggctcaggcttggcaacatcctctgaacagaggagacagaggatgttgccaagcaacctggcggcagcgcaaaagatg

SEQ ID NO: 141865 - DNA, 103 bp, Artificial Sequence
  Synthetic Polynucleotide
taatacgactcactatagggtgacatcctctgtgaggctcaggcttggcaaacagaggagatgccaaatgtgagcctcaaacctggcggcagcgcaaaagatg

SEQ ID NO: 141866 - DNA, 103 bp, Artificial Sequence
  Synthetic Polynucleotide
taatacgactcactatagggggcggccacttgacatcctctgtgaggctcaacagaggagagagcctatgagaggatgtaacctggcggcagcgcaaaagatg

SEQ ID NO: 141867 - DNA, 103 bp, Artificial Sequence
  Synthetic Polynucleotide
taatacgactcactatagggctgcagagtgggcggccacttgacatcctcaacagaggagagaggatatgaagtggccgaacctggcggcagcgcaaaagatg

SEQ ID NO: 141868 - DNA, 103 bp, Artificial Sequence
  Synthetic Polynucleotide
taatacgactcactataggggggccaccagccagggcttcagccgcacgcaacagaggagagcgtgcatgtgaagccctaacctggcggcagcgcaaaagatg

SEQ ID NO: 141869 - DNA, 103 bp, Artificial Sequence
  Synthetic Polynucleotide
taatacgactcactataggggagtgggcggctgcagagtgggcggccactaacagaggagaagtggcatgccactctgcaacctggcggcagcgcaaaagatg

SEQ ID NO: 141870 - DNA, 103 bp, Artificial Sequence
  Synthetic Polynucleotide
taatacgactcactatagggggcggccgcagagtgggcggctgcagagtgaacagaggagacactctatggccgcccacaacctggcggcagcgcaaaagatg

SEQ ID NO: 141871 - DNA, 103 bp, Artificial Sequence
  Synthetic Polynucleotide
taatacgactcactatagggctgcagagtaggcggccgcagagtgggcggaacagaggagaccgcccatgctgcggccgaacctggcggcagcgcaaaagatg

SEQ ID NO: 141872 - DNA, 103 bp, Artificial Sequence
  Synthetic Polynucleotide
taatacgactcactataggggagtgggcggctgcagagtaggcggccgcaaacagaggagatgcggcatgctactctgcaacctggcggcagcgcaaaagatg

SEQ ID NO: 141873 - DNA, 103 bp, Artificial Sequence
  Synthetic Polynucleotide
taatacgactcactatagggggcggctgcagagtgggcggctgcagagtaaacagaggagatactctatggccgcccacaacctggcggcagcgcaaaagatg

SEQ ID NO: 141874 - DNA, 103 bp, Artificial Sequence
  Synthetic Polynucleotide
taatacgactcactatagggcagcaccacgggcggctgcagagtgggcggaacagaggagaccgcccatgctgcagccgaacctggcggcagcgcaaaagatg

SEQ ID NO: 141875 - DNA, 103 bp, Artificial Sequence
  Synthetic Polynucleotide
taatacgactcactatagggcagggggacccagcaccacgggcggctgcaaacagaggagatgcagcatgccgtggtgcaacctggcggcagcgcaaaagatg

SEQ ID NO: 141876 - DNA, 103 bp, Artificial Sequence
  Synthetic Polynucleotide
taatacgactcactataggggggtctggagcagggggacccagcaccacgaacagaggagacgtggtatggggtcccccaacctggcggcagcgcaaaagatg

SEQ ID NO: 141877 - DNA, 103 bp, Artificial Sequence
  Synthetic Polynucleotide
taatacgactcactatagggcagggggctggggtctggagcagggggaccaacagaggagaggtcccatggctccagacaacctggcggcagcgcaaaagatg

SEQ ID NO: 141878 - DNA, 103 bp, Artificial Sequence
  Synthetic Polynucleotide
taatacgactcactatagggggggaggagccagggggctggggtctggagaacagaggagactccagatgccagcccccaacctggcggcagcgcaaaagatg

SEQ ID NO: 141879 - DNA, 103 bp, Artificial Sequence
  Synthetic Polynucleotide
taatacgactcactatagggctgttcacctgggccaccagccagggcttcaacagaggagagaagccatggctggtggcaacctggcggcagcgcaaaagatg

SEQ ID NO: 141880 - DNA, 103 bp, Artificial Sequence
  Synthetic Polynucleotide
taatacgactcactataggggggttgccagggggaggagccagggggctgaacagaggagacagcccatgggctcctccaacctggcggcagcgcaaaagatg

SEQ ID NO: 141881 - DNA, 103 bp, Artificial Sequence
  Synthetic Polynucleotide
taatacgactcactataggggaagccagcagggttgccagggggaggagcaacagaggagagctcctatgcctggcaacaacctggcggcagcgcaaaagatg

SEQ ID NO: 141882 - DNA, 103 bp, Artificial Sequence
  Synthetic Polynucleotide
taatacgactcactataggggaagctccctgaagccagcagggttgccagaacagaggagactggcaatgctgctggctaacctggcggcagcgcaaaagatg

SEQ ID NO: 141883 - DNA, 103 bp, Artificial Sequence
  Synthetic Polynucleotide
taatacgactcactatagggacctcagagagaagctccctgaagccagcaaacagaggagatgctggatgcagggagctaacctggcggcagcgcaaaagatg

SEQ ID NO: 141884 - DNA, 103 bp, Artificial Sequence
  Synthetic Polynucleotide
taatacgactcactatagggaggctccaggacctcagagagaagctccctaacagaggagaagggagatgctctctgagaacctggcggcagcgcaaaagatg

SEQ ID NO: 141885 - DNA, 103 bp, Artificial Sequence
  Synthetic Polynucleotide
taatacgactcactataggggcaggggcccaggctccaggacctcagagaaacagaggagatctctgatgtcctggagcaacctggcggcagcgcaaaagatg

SEQ ID NO: 141886 - DNA, 103 bp, Artificial Sequence
  Synthetic Polynucleotide
taatacgactcactatagggaggctggcaggcaggggcccaggctccaggaacagaggagacctggaatgtgggcccctaacctggcggcagcgcaaaagatg

SEQ ID NO: 141887 - DNA, 103 bp, Artificial Sequence
  Synthetic Polynucleotide
taatacgactcactatagggtgcagggggcaggctggcaggcaggggcccaacagaggagagggcccatgcctgccagcaacctggcggcagcgcaaaagatg

SEQ ID NO: 141888 - DNA, 103 bp, Artificial Sequence
  Synthetic Polynucleotide
taatacgactcactataggggctgttcgcctgcagggggcaggctggcagaacagaggagactgccaatgtgccccctgaacctggcggcagcgcaaaagatg

SEQ ID NO: 141889 - DNA, 103 bp, Artificial Sequence
  Synthetic Polynucleotide
taatacgactcactatagggtctggcaggagctgttcgcctgcagggggcaacagaggagagcccccatgaggcgaacaaacctggcggcagcgcaaaagatg

SEQ ID NO: 141890 - DNA, 103 bp, Artificial Sequence
  Synthetic Polynucleotide
taatacgactcactataggggtactggcagctgttcacctgggccaccagaacagaggagactggtgatgcaggtgaacaacctggcggcagcgcaaaagatg

SEQ ID NO: 141891 - DNA, 103 bp, Artificial Sequence
  Synthetic Polynucleotide
taatacgactcactataggggatcagcaggtctggcaggagctgttcgccaacagaggagaggcgaaatgctcctgccaaacctggcggcagcgcaaaagatg

SEQ ID NO: 141892 - DNA, 103 bp, Artificial Sequence
  Synthetic Polynucleotide
taatacgactcactatagggtgtgggggctgatcagcaggtctggcaggaaacagaggagatcctgcatgacctgctgaaacctggcggcagcgcaaaagatg

SEQ ID NO: 141893 - DNA, 103 bp, Artificial Sequence
  Synthetic Polynucleotide
taatacgactcactatagggagaggcagcatgtgggggctgatcagcaggaacagaggagacctgctatgcagcccccaaacctggcggcagcgcaaaagatg

SEQ ID NO: 141894 - DNA, 103 bp, Artificial Sequence
  Synthetic Polynucleotide
taatacgactcactatagggcaggtcggtcagaggcagcatgtgggggctaacagaggagaagccccatgatgctgcctaacctggcggcagcgcaaaagatg

SEQ ID NO: 141895 - DNA, 103 bp, Artificial Sequence
  Synthetic Polynucleotide
taatacgactcactatagggacttgatctccaggtcggtcagaggcagcaaacagaggagatgctgcatgtgaccgaccaacctggcggcagcgcaaaagatg

SEQ ID NO: 141896 - DNA, 103 bp, Artificial Sequence
  Synthetic Polynucleotide
taatacgactcactatagggcggtactgaaacttgatctccaggtcggtcaacagaggagagaccgaatgggagatcaaaacctggcggcagcgcaaaagatg

SEQ ID NO: 141897 - DNA, 103 bp, Artificial Sequence
  Synthetic Polynucleotide
taatacgactcactatagggtggccgcccccggtactgaaacttgatctcaacagaggagagagatcatgtttcagtacaacctggcggcagcgcaaaagatg

SEQ ID NO: 141898 - DNA, 103 bp, Artificial Sequence
  Synthetic Polynucleotide
taatacgactcactataggggggcccggggtggccgcccccggtactgaaaacagaggagattcagtatggggggcggcaacctggcggcagcgcaaaagatg

SEQ ID NO: 141899 - DNA, 103 bp, Artificial Sequence
  Synthetic Polynucleotide
taatacgactcactatagggctgatggtgagggcccggggtggccgccccaacagaggagaggggcgatgaccccgggcaacctggcggcagcgcaaaagatg

SEQ ID NO: 141900 - DNA, 103 bp, Artificial Sequence
  Synthetic Polynucleotide
taatacgactcactatagggatgggggttgctgatggtgagggcccggggaacagaggagaccccggatgctcaccatcaacctggcggcagcgcaaaagatg

SEQ ID NO: 141901 - DNA, 103 bp, Artificial Sequence
  Synthetic Polynucleotide
taatacgactcactataggggaagccctgggtactggcagctgttcacctaacagaggagaaggtgaatggctgccagtaacctggcggcagcgcaaaagatg

SEQ ID NO: 141902 - DNA, 103 bp, Artificial Sequence
  Synthetic Polynucleotide
taatacgactcactataggggccggcagccatgggggttgctgatggtgaaacagaggagatcaccaatggcaacccccaacctggcggcagcgcaaaagatg

SEQ ID NO: 141903 - DNA, 103 bp, Artificial Sequence
  Synthetic Polynucleotide
taatacgactcactatagggctgtagaagagccggcagccatgggggttgaacagaggagacaacccatgtggctgccgaacctggcggcagcgcaaaagatg

SEQ ID NO: 141904 - DNA, 103 bp, Artificial Sequence
  Synthetic Polynucleotide
taatacgactcactatagggctccagctggctgtagaagagccggcagccaacagaggagaggctgcatgctcttctacaacctggcggcagcgcaaaagatg

SEQ ID NO: 141905 - DNA, 103 bp, Artificial Sequence
  Synthetic Polynucleotide
taatacgactcactatagggcctgggtggcctccagctggctgtagaagaaacagaggagatcttctatggccagctggaacctggcggcagcgcaaaagatg

SEQ ID NO: 141906 - DNA, 103 bp, Artificial Sequence
  Synthetic Polynucleotide
taatacgactcactatagggtccacctgctcctgggtggcctccagctggaacagaggagaccagctatgggccacccaaacctggcggcagcgcaaaagatg

SEQ ID NO: 141907 - DNA, 103 bp, Artificial Sequence
  Synthetic Polynucleotide
taatacgactcactataggggccgaagagttccacctgctcctgggtggcaacagaggagagccaccatggagcaggtgaacctggcggcagcgcaaaagatg

SEQ ID NO: 141908 - DNA, 103 bp, Artificial Sequence
  Synthetic Polynucleotide
taatacgactcactatagggggcttatggggccgaagagttccacctgctaacagaggagaagcaggatgaactcttcgaacctggcggcagcgcaaaagatg

SEQ ID NO: 141909 - DNA, 103 bp, Artificial Sequence
  Synthetic Polynucleotide
taatacgactcactatagggacttgctccaggcttatggggccgaagagtaacagaggagaactcttatgccccataagaacctggcggcagcgcaaaagatg

SEQ ID NO: 141910 - DNA, 103 bp, Artificial Sequence
  Synthetic Polynucleotide
taatacgactcactatagggggggaagcgcacttgctccaggcttatgggaacagaggagacccataatgctggagcaaaacctggcggcagcgcaaaagatg

SEQ ID NO: 141911 - DNA, 103 bp, Artificial Sequence
  Synthetic Polynucleotide
taatacgactcactatagggcctcagggctggggaagcgcacttgctccaaacagaggagatggagcatgtgcgcttccaacctggcggcagcgcaaaagatg

SEQ ID NO: 141912 - DNA, 103 bp, Artificial Sequence
  Synthetic Polynucleotide
taatacgactcactatagggttgacccattgaagccctgggtactggcagaacagaggagactgccaatgcccagggctaacctggcggcagcgcaaaagatg

SEQ ID NO: 141913 - DNA, 103 bp, Artificial Sequence
  Synthetic Polynucleotide
taatacgactcactatagggctggggatgtcctcagggctggggaagcgcaacagaggagagcgcttatgcagccctgaaacctggcggcagcgcaaaagatg

SEQ ID NO: 141914 - DNA, 103 bp, Artificial Sequence
  Synthetic Polynucleotide
taatacgactcactatagggctgcttgtcactggggatgtcctcagggctaacagaggagaagccctatggacatccccaacctggcggcagcgcaaaagatg

SEQ ID NO: 141915 - DNA, 103 bp, Artificial Sequence
  Synthetic Polynucleotide
taatacgactcactatagggtgtagaagcgctgcttgtcactggggatgtaacagaggagaacatccatggtgacaagcaacctggcggcagcgcaaaagatg

SEQ ID NO: 141916 - DNA, 103 bp, Artificial Sequence
  Synthetic Polynucleotide
taatacgactcactatagggagctggttcgtgtagaagcgctgcttgtcaaacagaggagatgacaaatggcgcttctaaacctggcggcagcgcaaaagatg

SEQ ID NO: 141917 - DNA, 103 bp, Artificial Sequence
  Synthetic Polynucleotide
taatacgactcactataggggacatccagcagctggttcgtgtagaagcgaacagaggagacgcttcatgacgaaccagaacctggcggcagcgcaaaagatg

SEQ ID NO: 141918 - DNA, 103 bp, Artificial Sequence
  Synthetic Polynucleotide
taatacgactcactatagggcgcggtccaggacatccagcagctggttcgaacagaggagacgaaccatgtgctggatgaacctggcggcagcgcaaaagatg

SEQ ID NO: 141919 - DNA, 103 bp, Artificial Sequence
  Synthetic Polynucleotide
taatacgactcactatagggaggatgagcccgcggtccaggacatccagcaacagaggagagctggaatgcctggaccgaacctggcggcagcgcaaaagatg

SEQ ID NO: 141920 - DNA, 103 bp, Artificial Sequence
  Synthetic Polynucleotide
taatacgactcactatagggctgtagctggaggatgagcccgcggtccagaacagaggagactggacatggggctcatcaacctggcggcagcgcaaaagatg

SEQ ID NO: 141921 - DNA, 103 bp, Artificial Sequence
  Synthetic Polynucleotide
taatacgactcactatagggggtcctggccctgtagctggaggatgagccaacagaggagaggctcaatgtccagctacaacctggcggcagcgcaaaagatg

SEQ ID NO: 141922 - DNA, 103 bp, Artificial Sequence
  Synthetic Polynucleotide
taatacgactcactatagggatggcataaaggtcctggccctgtagctggaacagaggagaccagctatggggccaggaaacctggcggcagcgcaaaagatg

SEQ ID NO: 141923 - DNA, 103 bp, Artificial Sequence
  Synthetic Polynucleotide
taatacgactcactatagggtagccggactctgcgggggtggagggccataacagaggagaatggccatgcacccccgcaacctggcggcagcgcaaaagatg

SEQ ID NO: 141924 - DNA, 103 bp, Artificial Sequence
  Synthetic Polynucleotide
taatacgactcactatagggccagggaatctggaagcgtttagagtccctaacagaggagaagggacatgaaacgcttcaacctggcggcagcgcaaaagatg

SEQ ID NO: 141925 - DNA, 103 bp, Artificial Sequence
  Synthetic Polynucleotide
taatacgactcactatagggttgtctctcaatcaggttgggagcaacaagaacagaggagacttgttatgcccaacctgaacctggcggcagcgcaaaagatg

SEQ ID NO: 141926 - DNA, 103 bp, Artificial Sequence
  Synthetic Polynucleotide
taatacgactcactatagggtgaccttcttttgtctctcaatcaggttggaacagaggagaccaaccatgttgagagacaacctggcggcagcgcaaaagatg

SEQ ID NO: 141927 - DNA, 103 bp, Artificial Sequence
  Synthetic Polynucleotide
taatacgactcactatagggcaaaatagcttgaccttcttttgtctctcaaacagaggagatgagagatgaaagaaggtaacctggcggcagcgcaaaagatg

SEQ ID NO: 141928 - DNA, 103 bp, Artificial Sequence
  Synthetic Polynucleotide
taatacgactcactatagggtgtttccagacaaaatagcttgaccttcttaacagaggagaaagaagatgaagctatttaacctggcggcagcgcaaaagatg

SEQ ID NO: 141929 - DNA, 103 bp, Artificial Sequence
  Synthetic Polynucleotide
taatacgactcactatagggcgctaaggaatgtttccagacaaaatagctaacagaggagaagctatatggtctggaaaaacctggcggcagcgcaaaagatg

SEQ ID NO: 141930 - DNA, 103 bp, Artificial Sequence
  Synthetic Polynucleotide
taatacgactcactataggggcaatgagatcgctaaggaatgtttccagaaacagaggagatctggaatgattccttagaacctggcggcagcgcaaaagatg

SEQ ID NO: 141931 - DNA, 103 bp, Artificial Sequence
  Synthetic Polynucleotide
taatacgactcactatagggtttctggtgggcaatgagatcgctaaggaaaacagaggagattccttatggatctcattaacctggcggcagcgcaaaagatg

SEQ ID NO: 141932 - DNA, 103 bp, Artificial Sequence
  Synthetic Polynucleotide
taatacgactcactatagggctatctgtcctttctggtgggcaatgagataacagaggagaatctcaatgcccaccagaaacctggcggcagcgcaaaagatg

SEQ ID NO: 141933 - DNA, 103 bp, Artificial Sequence
  Synthetic Polynucleotide
taatacgactcactatagggggctgcttctctatctgtcctttctggtggaacagaggagaccaccaatgaggacagataacctggcggcagcgcaaaagatg

SEQ ID NO: 141934 - DNA, 103 bp, Artificial Sequence
  Synthetic Polynucleotide
taatacgactcactatagggctcaaacggtggctgcttctctatctgtccaacagaggagaggacagatggagaagcagaacctggcggcagcgcaaaagatg

SEQ ID NO: 141935 - DNA, 103 bp, Artificial Sequence
  Synthetic Polynucleotide
taatacgactcactatagggtggcatgtttccagggaatctggaagcgttaacagaggagaaacgctatgagattccctaacctggcggcagcgcaaaagatg

SEQ ID NO: 141936 - DNA, 103 bp, Artificial Sequence
  Synthetic Polynucleotide
taatacgactcactatagggataagtagatctcaaacggtggctgcttctaacagaggagaagaagcatgcaccgtttgaacctggcggcagcgcaaaagatg

SEQ ID NO: 141937 - DNA, 103 bp, Artificial Sequence
  Synthetic Polynucleotide
taatacgactcactatagggtccccaaagcataagtagatctcaaacggtaacagaggagaaccgttatggatctacttaacctggcggcagcgcaaaagatg

SEQ ID NO: 141938 - DNA, 103 bp, Artificial Sequence
  Synthetic Polynucleotide
taatacgactcactatagggtggccattcttccccaaagcataagtagataacagaggagaatctacatgtgctttgggaacctggcggcagcgcaaaagatg

SEQ ID NO: 141939 - DNA, 103 bp, Artificial Sequence
  Synthetic Polynucleotide
taatacgactcactataggggtttcccatctggccattcttccccaaagcaacagaggagagctttgatgaagaatggcaacctggcggcagcgcaaaagatg

SEQ ID NO: 141940 - DNA, 103 bp, Artificial Sequence
  Synthetic Polynucleotide
taatacgactcactatagggctttccaatggtttcccatctggccattctaacagaggagaagaatgatgagatgggaaaacctggcggcagcgcaaaagatg

SEQ ID NO: 141941 - DNA, 103 bp, Artificial Sequence
  Synthetic Polynucleotide
taatacgactcactataggggatgagtttcctttccaatggtttcccatcaacagaggagagatgggatgccattggaaaacctggcggcagcgcaaaagatg

SEQ ID NO: 141942 - DNA, 103 bp, Artificial Sequence
  Synthetic Polynucleotide
taatacgactcactatagggcctgaaccaagatgagtttcctttccaatgaacagaggagacattggatgggaaactcaaacctggcggcagcgcaaaagatg

SEQ ID NO: 141943 - DNA, 103 bp, Artificial Sequence
  Synthetic Polynucleotide
taatacgactcactatagggactggaatgacctgaaccaagatgagtttcaacagaggagagaaactatgcttggttcaaacctggcggcagcgcaaaagatg

SEQ ID NO: 141944 - DNA, 103 bp, Artificial Sequence
  Synthetic Polynucleotide
taatacgactcactatagggccgagccactactggaatgacctgaaccaaaacagaggagattggttatggtcattccaaacctggcggcagcgcaaaagatg

SEQ ID NO: 141945 - DNA, 103 bp, Artificial Sequence
  Synthetic Polynucleotide
taatacgactcactatagggcgtagatcatccgagccactactggaatgaaacagaggagatcattcatgtagtggctcaacctggcggcagcgcaaaagatg

SEQ ID NO: 141946 - DNA, 103 bp, Artificial Sequence
  Synthetic Polynucleotide
taatacgactcactatagggctatgccgggtggcatgtttccagggaatcaacagaggagagattccatggaaacatgcaacctggcggcagcgcaaaagatg

SEQ ID NO: 141947 - DNA, 103 bp, Artificial Sequence
  Synthetic Polynucleotide
taatacgactcactataggggaaaacatctcgtagatcatccgagccactaacagaggagaagtggcatggatgatctaaacctggcggcagcgcaaaagatg

SEQ ID NO: 141948 - DNA, 103 bp, Artificial Sequence
  Synthetic Polynucleotide
taatacgactcactataggggaaatcaccagaaaacatctcgtagatcataacagaggagaatgatcatggagatgtttaacctggcggcagcgcaaaagatg

SEQ ID NO: 141949 - DNA, 103 bp, Artificial Sequence
  Synthetic Polynucleotide
taatacgactcactatagggaggatcgtgtgaaatcaccagaaaacatctaacagaggagaagatgtatgctggtgattaacctggcggcagcgcaaaagatg

SEQ ID NO: 141950 - DNA, 103 bp, Artificial Sequence
  Synthetic Polynucleotide
taatacgactcactatagggccactatcaaaggatcgtgtgaaatcaccaaacagaggagatggtgaatgcacacgatcaacctggcggcagcgcaaaagatg

SEQ ID NO: 141951 - DNA, 103 bp, Artificial Sequence
  Synthetic Polynucleotide
taatacgactcactataggggcggacactgccactatcaaaggatcgtgtaacagaggagaacacgaatgtttgatagtaacctggcggcagcgcaaaagatg

SEQ ID NO: 141952 - DNA, 103 bp, Artificial Sequence
  Synthetic Polynucleotide
taatacgactcactatagggagatctgcaggcggacactgccactatcaaaacagaggagattgataatggcagtgtccaacctggcggcagcgcaaaagatg

SEQ ID NO: 141953 - DNA, 103 bp, Artificial Sequence
  Synthetic Polynucleotide
taatacgactcactatagggtctggggttgagatctgcaggcggacactgaacagaggagacagtgtatgcctgcagataacctggcggcagcgcaaaagatg

SEQ ID NO: 141954 - DNA, 103 bp, Artificial Sequence
  Synthetic Polynucleotide
taatacgactcactatagggatccttgatgtctggggttgagatctgcagaacagaggagactgcagatgtcaaccccaaacctggcggcagcgcaaaagatg

SEQ ID NO: 141955 - DNA, 103 bp, Artificial Sequence
  Synthetic Polynucleotide
taatacgactcactatagggcaacgatgttatccttgatgtctggggttgaacagaggagacaacccatgacatcaaggaacctggcggcagcgcaaaagatg

SEQ ID NO: 141956 - DNA, 103 bp, Artificial Sequence
  Synthetic Polynucleotide
taatacgactcactatagggttcagctgagcaacgatgttatccttgatgaacagaggagacatcaaatgtaacatcgtaacctggcggcagcgcaaaagatg

SEQ ID NO: 141957 - DNA, 103 bp, Artificial Sequence
  Synthetic Polynucleotide
taatacgactcactatagggttgttgagggctatgccgggtggcatgtttaacagaggagaaaacatatgacccggcataacctggcggcagcgcaaaagatg

SEQ ID NO: 141958 - DNA, 103 bp, Artificial Sequence
  Synthetic Polynucleotide
taatacgactcactataggggtacagctgcttcagctgagcaacgatgttaacagaggagaaacatcatggctcagctgaacctggcggcagcgcaaaagatg

SEQ ID NO: 141959 - DNA, 103 bp, Artificial Sequence
  Synthetic Polynucleotide
taatacgactcactataggggaaggatgcggtacagctgcttcagctgagaacagaggagactcagcatgagcagctgtaacctggcggcagcgcaaaagatg

SEQ ID NO: 141960 - DNA, 103 bp, Artificial Sequence
  Synthetic Polynucleotide
taatacgactcactatagggtcctgggtttgaaggatgcggtacagctgcaacagaggagagcagctatgccgcatcctaacctggcggcagcgcaaaagatg

SEQ ID NO: 141961 - DNA, 103 bp, Artificial Sequence
  Synthetic Polynucleotide
taatacgactcactatagggctgccagctctcctgggtttgaaggatgcgaacagaggagacgcatcatgcaaacccagaacctggcggcagcgcaaaagatg

SEQ ID NO: 141962 - DNA, 103 bp, Artificial Sequence
  Synthetic Polynucleotide
taatacgactcactataggggctgcatgggctgccagctctcctgggtttaacagaggagaaaacccatgagagctggcaacctggcggcagcgcaaaagatg

SEQ ID NO: 141963 - DNA, 103 bp, Artificial Sequence
  Synthetic Polynucleotide
taatacgactcactatagggctgggggtgggctgcatgggctgccagctcaacagaggagagagctgatggcccatgcaaacctggcggcagcgcaaaagatg

SEQ ID NO: 141964 - DNA, 103 bp, Artificial Sequence
  Synthetic Polynucleotide
taatacgactcactatagggcagttgcatgctgggggtgggctgcatgggaacagaggagacccatgatgcccacccccaacctggcggcagcgcaaaagatg

SEQ ID NO: 141965 - DNA, 103 bp, Artificial Sequence
  Synthetic Polynucleotide
taatacgactcactataggggggcagggggcagttgcatgctgggggtggaacagaggagaccacccatggcatgcaacaacctggcggcagcgcaaaagatg

SEQ ID NO: 141966 - DNA, 103 bp, Artificial Sequence
  Synthetic Polynucleotide
taatacgactcactatagggtggggaggcagggcagggggcagttgcatgaacagaggagacatgcaatggccccctgcaacctggcggcagcgcaaaagatg

SEQ ID NO: 141967 - DNA, 103 bp, Artificial Sequence
  Synthetic Polynucleotide
taatacgactcactatagggtttcctcttcttgttgagggctatgccgggaacagaggagacccggcatggccctcaacaacctggcggcagcgcaaaagatg

SEQ ID NO: 141968 - DNA, 103 bp, Artificial Sequence
  Synthetic Polynucleotide
taatacgactcactatagggaaaatggtattttcctcttcttgttgagggaacagaggagaccctcaatgagaagaggaaacctggcggcagcgcaaaagatg

SEQ ID NO: 141969 - DNA, 103 bp, Artificial Sequence
  Synthetic Polynucleotide
taatacgactcactatagggccaggccttaaaaatggtattttcctcttcaacagaggagagaagagatgaataccattaacctggcggcagcgcaaaagatg

SEQ ID NO: 141970 - DNA, 103 bp, Artificial Sequence
  Synthetic Polynucleotide
taatacgactcactatagggtctctacagcccaggccttaaaaatggtataacagaggagaataccaatgttaaggcctaacctggcggcagcgcaaaagatg

SEQ ID NO: 141971 - DNA, 103 bp, Artificial Sequence
  Synthetic Polynucleotide
taatacgactcactatagggtacttccctgtctctacagcccaggccttaaacagaggagataaggcatgggctgtagaaacctggcggcagcgcaaaagatg

SEQ ID NO: 141972 - DNA, 103 bp, Artificial Sequence
  Synthetic Polynucleotide
taatacgactcactatagggcccttcctggtacttccctgtctctacagcaacagaggagagctgtaatgacagggaagaacctggcggcagcgcaaaagatg

SEQ ID NO: 141973 - DNA, 103 bp, Artificial Sequence
  Synthetic Polynucleotide
taatacgactcactataggggccagggctttagccggactctgcgggggtaacagaggagaacccccatggagtccggcaacctggcggcagcgcaaaagatg

SEQ ID NO: 141974 - DNA, 103 bp, Artificial Sequence
  Synthetic Polynucleotide
taatacgactcactatagggggtcatccaccccttcctggtacttccctgaacagaggagacagggaatgaccaggaagaacctggcggcagcgcaaaagatg

SEQ ID NO: 141975 - DNA, 103 bp, Artificial Sequence
  Synthetic Polynucleotide
taatacgactcactataggggctgggtcagggtcatccaccccttcctggaacagaggagaccaggaatgggtggatgaaacctggcggcagcgcaaaagatg

SEQ ID NO: 141976 - DNA, 103 bp, Artificial Sequence
  Synthetic Polynucleotide
taatacgactcactatagggcttccatttagctgggtcagggtcatccacaacagaggagagtggatatgcctgacccaaacctggcggcagcgcaaaagatg

SEQ ID NO: 141977 - DNA, 103 bp, Artificial Sequence
  Synthetic Polynucleotide
taatacgactcactataggggcagctgggccttccatttagctgggtcagaacagaggagactgaccatgctaaatggaaacctggcggcagcgcaaaagatg

SEQ ID NO: 141978 - DNA, 103 bp, Artificial Sequence
  Synthetic Polynucleotide
taatacgactcactatagggagagcacagcgcagctgggccttccatttaaacagaggagataaatgatgggcccagctaacctggcggcagcgcaaaagatg

SEQ ID NO: 141979 - DNA, 103 bp, Artificial Sequence
  Synthetic Polynucleotide
taatacgactcactataggggctcttattgagagcacagcgcagctgggcaacagaggagagcccagatgcgctgtgctaacctggcggcagcgcaaaagatg

SEQ ID NO: 141980 - DNA, 103 bp, Artificial Sequence
  Synthetic Polynucleotide
taatacgactcactatagggtgaattctctgctcttattgagagcacagcaacagaggagagctgtgatgtcaataagaaacctggcggcagcgcaaaagatg

SEQ ID NO: 141981 - DNA, 103 bp, Artificial Sequence
  Synthetic Polynucleotide
taatacgactcactatagggtacatcaggttgaattctctgctcttattgaacagaggagacaataaatgcagagaattaacctggcggcagcgcaaaagatg

SEQ ID NO: 141982 - DNA, 103 bp, Artificial Sequence
  Synthetic Polynucleotide
taatacgactcactatagggggtgccatcatacatcaggttgaattctctaacagaggagaagagaaatgaacctgatgaacctggcggcagcgcaaaagatg

SEQ ID NO: 141983 - DNA, 103 bp, Artificial Sequence
  Synthetic Polynucleotide
taatacgactcactataggggcacctccttggtgccatcatacatcaggtaacagaggagaacctgaatgatgatggcaaacctggcggcagcgcaaaagatg

SEQ ID NO: 141984 - DNA, 103 bp, Artificial Sequence
  Synthetic Polynucleotide
taatacgactcactatagggtgggccaccagccagggctttagccggactaacagaggagaagtccgatgaaagccctgaacctggcggcagcgcaaaagatg

SEQ ID NO: 141985 - DNA, 103 bp, Artificial Sequence
  Synthetic Polynucleotide
taatacgactcactataggggggttcatgggcacctccttggtgccatcaaacagaggagatgatggatgcaaggaggtaacctggcggcagcgcaaaagatg

SEQ ID NO: 141986 - DNA, 103 bp, Artificial Sequence
  Synthetic Polynucleotide
taatacgactcactatagggtatcttcactgggttcatgggcacctccttaacagaggagaaaggagatgcccatgaacaacctggcggcagcgcaaaagatg

SEQ ID NO: 141987 - DNA, 103 bp, Artificial Sequence
  Synthetic Polynucleotide
taatacgactcactatagggacacttgatatatcttcactgggttcatggaacagaggagaccatgaatgcagtgaagaaacctggcggcagcgcaaaagatg

SEQ ID NO: 141988 - DNA, 103 bp, Artificial Sequence
  Synthetic Polynucleotide
taatacgactcactataggggggatgtcacacacttgatatatcttcactaacagaggagaagtgaaatgatatcaagtaacctggcggcagcgcaaaagatg

SEQ ID NO: 141989 - DNA, 103 bp, Artificial Sequence
  Synthetic Polynucleotide
taatacgactcactatagggctggggctgagggatgtcacacacttgataaacagaggagatatcaaatgtgtgacatcaacctggcggcagcgcaaaagatg

SEQ ID NO: 141990 - DNA, 103 bp, Artificial Sequence
  Synthetic Polynucleotide
taatacgactcactatagggtgatcgagccctggggctgagggatgtcacaacagaggagagtgacaatgctcagccccaacctggcggcagcgcaaaagatg

SEQ ID NO: 141991 - DNA, 103 bp, Artificial Sequence
  Synthetic Polynucleotide
taatacgactcactatagggcctgggttaatgatcgagccctggggctgaaacagaggagatcagccatggggctcgataacctggcggcagcgcaaaagatg

SEQ ID NO: 141992 - DNA, 103 bp, Artificial Sequence
  Synthetic Polynucleotide
taatacgactcactatagggccctgtggatcctgggttaatgatcgagccaacagaggagaggctcgatgattaacccaaacctggcggcagcgcaaaagatg

SEQ ID NO: 141993 - DNA, 103 bp, Artificial Sequence
  Synthetic Polynucleotide
taatacgactcactatagggagggagcagaccctgtggatcctgggttaaaacagaggagattaaccatggatccacagaacctggcggcagcgcaaaagatg

SEQ ID NO: 141994 - DNA, 103 bp, Artificial Sequence
  Synthetic Polynucleotide
taatacgactcactatagggttctcatcccagggagcagaccctgtggataacagaggagaatccacatggtctgctccaacctggcggcagcgcaaaagatg

SEQ ID NO: 141995 - DNA, 103 bp, Artificial Sequence
  Synthetic Polynucleotide
taatacgactcactatagggactatccacctgggccaccagccagggcttaacagaggagaaagcccatgctggtggccaacctggcggcagcgcaaaagatg

SEQ ID NO: 141996 - DNA, 103 bp, Artificial Sequence
  Synthetic Polynucleotide
taatacgactcactatagggatcattatccttctcatcccagggagcagaaacagaggagatctgctatgtgggatgagaacctggcggcagcgcaaaagatg

SEQ ID NO: 141997 - DNA, 103 bp, Artificial Sequence
  Synthetic Polynucleotide
taatacgactcactatagggcttcatccacatcattatccttctcatcccaacagaggagagggatgatgaggataatgaacctggcggcagcgcaaaagatg

SEQ ID NO: 141998 - DNA, 103 bp, Artificial Sequence
  Synthetic Polynucleotide
taatacgactcactatagggtcctcatcttcttcatccacatcattatccaacagaggagaggataaatgtgtggatgaaacctggcggcagcgcaaaagatg

SEQ ID NO: 141999 - DNA, 103 bp, Artificial Sequence
  Synthetic Polynucleotide
taatacgactcactatagggcagctcatcttcctcatcttcttcatccacaacagaggagagtggatatggaagatgagaacctggcggcagcgcaaaagatg

SEQ ID NO: 142000 - DNA, 103 bp, Artificial Sequence
  Synthetic Polynucleotide
taatacgactcactataggggcgactgatccagctcatcttcctcatcttaacagaggagaaagatgatgaagatgagcaacctggcggcagcgcaaaagatg

SEQ ID NO: 142001 - DNA, 103 bp, Artificial Sequence
  Synthetic Polynucleotide
taatacgactcactatagggacatggtgctgcgactgatccagctcatctaacagaggagaagatgaatgggatcagtcaacctggcggcagcgcaaaagatg

SEQ ID NO: 142002 - DNA, 103 bp, Artificial Sequence
  Synthetic Polynucleotide
taatacgactcactatagggctggatgggaacatggtgctgcgactgatcaacagaggagagatcagatgcagcaccataacctggcggcagcgcaaaagatg

SEQ ID NO: 142003 - DNA, 103 bp, Artificial Sequence
  Synthetic Polynucleotide
taatacgactcactatagggggaaggtgtcctggatgggaacatggtgctaacagaggagaagcaccatgttcccatccaacctggcggcagcgcaaaagatg

SEQ ID NO: 142004 - DNA, 103 bp, Artificial Sequence
  Synthetic Polynucleotide
taatacgactcactatagggttcaggaaggggaaggtgtcctggatgggaaacagaggagatcccatatgggacaccttaacctggcggcagcgcaaaagatg

SEQ ID NO: 142005 - DNA, 103 bp, Artificial Sequence
  Synthetic Polynucleotide
taatacgactcactatagggaccattgatgttcaggaaggggaaggtgtcaacagaggagagacaccatgcccttcctgaacctggcggcagcgcaaaagatg

SEQ ID NO: 142006 - DNA, 103 bp, Artificial Sequence
  Synthetic Polynucleotide
taatacgactcactatagggggtagaggccactatccacctgggccaccaaacagaggagatggtggatgaggtggataaacctggcggcagcgcaaaagatg

SEQ ID NO: 142007 - DNA, 103 bp, Artificial Sequence
  Synthetic Polynucleotide
taatacgactcactatagggccatgggagaaccattgatgttcaggaaggaacagaggagaccttccatgacatcaatgaacctggcggcagcgcaaaagatg

SEQ ID NO: 142008 - DNA, 103 bp, Artificial Sequence
  Synthetic Polynucleotide
taatacgactcactatagggctggctggcgccatgggagaaccattgatgaacagaggagacatcaaatgttctcccataacctggcggcagcgcaaaagatg

SEQ ID NO: 142009 - DNA, 103 bp, Artificial Sequence
  Synthetic Polynucleotide
taatacgactcactatagggattgcccacactggctggcgccatgggagaaacagaggagatctcccatggcgccagccaacctggcggcagcgcaaaagatg

SEQ ID NO: 142010 - DNA, 103 bp, Artificial Sequence
  Synthetic Polynucleotide
taatacgactcactatagggccacactgcaattgcccacactggctggcgaacagaggagacgccagatggtgtgggcaaacctggcggcagcgcaaaagatg

SEQ ID NO: 142011 - DNA, 103 bp, Artificial Sequence
  Synthetic Polynucleotide
taatacgactcactatagggctgcagttgcccacactgcaattgcccacaaacagaggagatgtgggatgttgcagtgtaacctggcggcagcgcaaaagatg

SEQ ID NO: 142012 - DNA, 103 bp, Artificial Sequence
  Synthetic Polynucleotide
taatacgactcactatagggtgcctccgggctgcagttgcccacactgcaaacagaggagatgcagtatgggcaactgcaacctggcggcagcgcaaaagatg

SEQ ID NO: 142013 - DNA, 103 bp, Artificial Sequence
  Synthetic Polynucleotide
taatacgactcactatagggtgggccacactgcctccgggctgcagttgcaacagaggagagcaactatggcccggaggaacctggcggcagcgcaaaagatg

SEQ ID NO: 142014 - DNA, 103 bp, Artificial Sequence
  Synthetic Polynucleotide
taatacgactcactatagggggttcagttttgggccacactgcctccgggaacagaggagacccggaatgagtgtggccaacctggcggcagcgcaaaagatg

SEQ ID NO: 142015 - DNA, 103 bp, Artificial Sequence
  Synthetic Polynucleotide
taatacgactcactatagggcatctccaggggttcagttttgggccacacaacagaggagagtgtggatgaaaactgaaaacctggcggcagcgcaaaagatg

SEQ ID NO: 142016 - DNA, 103 bp, Artificial Sequence
  Synthetic Polynucleotide
taatacgactcactatagggggggtacttccatctccaggggttcagtttaacagaggagaaaactgatgccctggagaaacctggcggcagcgcaaaagatg

SEQ ID NO: 142017 - DNA, 103 bp, Artificial Sequence
  Synthetic Polynucleotide
taatacgactcactatagggatgagcccagggtagaggccactatccaccaacagaggagaggtggaatgtggcctctaaacctggcggcagcgcaaaagatg

SEQ ID NO: 142018 - DNA, 103 bp, Artificial Sequence
  Synthetic Polynucleotide
taatacgactcactatagggataggtgcctggggtacttccatctccaggaacagaggagacctggaatgggaagtaccaacctggcggcagcgcaaaagatg

SEQ ID NO: 142019 - DNA, 103 bp, Artificial Sequence
  Synthetic Polynucleotide
taatacgactcactataggggaagggctgtataggtgcctggggtacttcaacagaggagagaagtaatgcaggcacctaacctggcggcagcgcaaaagatg

SEQ ID NO: 142020 - DNA, 103 bp, Artificial Sequence
  Synthetic Polynucleotide
taatacgactcactataggggagagctatagaagggctgtataggtgcctaacagaggagaaggcacatgtacagccctaacctggcggcagcgcaaaagatg

SEQ ID NO: 142021 - DNA, 103 bp, Artificial Sequence
  Synthetic Polynucleotide
taatacgactcactatagggcacagttctggagagctatagaagggctgtaacagaggagaacagccatgctatagctcaacctggcggcagcgcaaaagatg

SEQ ID NO: 142022 - DNA, 103 bp, Artificial Sequence
  Synthetic Polynucleotide
taatacgactcactatagggagagctgatccacagttctggagagctataaacagaggagatatagcatgccagaactgaacctggcggcagcgcaaaagatg

SEQ ID NO: 142023 - DNA, 103 bp, Artificial Sequence
  Synthetic Polynucleotide
taatacgactcactatagggtcattgggagagagctgatccacagttctgaacagaggagacagaacatgggatcagctaacctggcggcagcgcaaaagatg

SEQ ID NO: 142024 - DNA, 103 bp, Artificial Sequence
  Synthetic Polynucleotide
taatacgactcactatagggtccaggtcagtcattgggagagagctgatcaacagaggagagatcagatgtctcccaataacctggcggcagcgcaaaagatg

SEQ ID NO: 142025 - DNA, 103 bp, Artificial Sequence
  Synthetic Polynucleotide
taatacgactcactatagggaaacttgatgtccaggtcagtcattgggagaacagaggagactcccaatgactgacctgaacctggcggcagcgcaaaagatg

SEQ ID NO: 142026 - DNA, 103 bp, Artificial Sequence
  Synthetic Polynucleotide
taatacgactcactatagggcacggtactgaaacttgatgtccaggtcagaacagaggagactgaccatgacatcaagtaacctggcggcagcgcaaaagatg

SEQ ID NO: 142027 - DNA, 103 bp, Artificial Sequence
  Synthetic Polynucleotide
taatacgactcactatagggtactccttcccacggtactgaaacttgatgaacagaggagacatcaaatgtcagtaccgaacctggcggcagcgcaaaagatg

SEQ ID NO: 142028 - DNA, 103 bp, Artificial Sequence
  Synthetic Polynucleotide
taatacgactcactataggggtgtagccagatgagcccagggtagaggccaacagaggagaggcctcatgcctgggctcaacctggcggcagcgcaaaagatg

SEQ ID NO: 142029 - DNA, 103 bp, Artificial Sequence
  Synthetic Polynucleotide
taatacgactcactatagggggtctgcccgtactccttcccacggtactgaacagaggagacagtacatggggaaggagaacctggcggcagcgcaaaagatg

SEQ ID NO: 142030 - DNA, 103 bp, Artificial Sequence
  Synthetic Polynucleotide
taatacgactcactatagggtcacggtcatggtctgcccgtactccttccaacagaggagaggaaggatgacgggcagaaacctggcggcagcgcaaaagatg

SEQ ID NO: 142031 - DNA, 103 bp, Artificial Sequence
  Synthetic Polynucleotide
taatacgactcactatagggtgagggttgctcacggtcatggtctgcccgaacagaggagacgggcaatgcatgaccgtaacctggcggcagcgcaaaagatg

SEQ ID NO: 142032 - DNA, 103 bp, Artificial Sequence
  Synthetic Polynucleotide
taatacgactcactatagggtcggcagccctgagggttgctcacggtcataacagaggagaatgaccatgagcaaccctaacctggcggcagcgcaaaagatg

SEQ ID NO: 142033 - DNA, 103 bp, Artificial Sequence
  Synthetic Polynucleotide
taatacgactcactatagggcatagaagagtcggcagccctgagggttgcaacagaggagagcaaccatgagggctgccaacctggcggcagcgcaaaagatg

SEQ ID NO: 142034 - DNA, 103 bp, Artificial Sequence
  Synthetic Polynucleotide
taatacgactcactatagggcccaggtccccatagaagagtcggcagcccaacagaggagagggctgatgactcttctaaacctggcggcagcgcaaaagatg

SEQ ID NO: 142035 - DNA, 103 bp, Artificial Sequence
  Synthetic Polynucleotide
taatacgactcactatagggaggcatgggacccaggtccccatagaagagaacagaggagactcttcatgggggacctgaacctggcggcagcgcaaaagatg

SEQ ID NO: 142036 - DNA, 103 bp, Artificial Sequence
  Synthetic Polynucleotide
taatacgactcactatagggcctcctggtcaggcatgggacccaggtcccaacagaggagagggaccatggtcccatgcaacctggcggcagcgcaaaagatg

SEQ ID NO: 142037 - DNA, 103 bp, Artificial Sequence
  Synthetic Polynucleotide
taatacgactcactatagggccaaagagctcctcctggtcaggcatgggaaacagaggagatcccatatgtgaccaggaaacctggcggcagcgcaaaagatg

SEQ ID NO: 142038 - DNA, 103 bp, Artificial Sequence
  Synthetic Polynucleotide
taatacgactcactataggggctgacgggaccaaagagctcctcctggtcaacagaggagagaccagatggagctctttaacctggcggcagcgcaaaagatg

SEQ ID NO: 142039 - DNA, 103 bp, Artificial Sequence
  Synthetic Polynucleotide
taatacgactcactatagggtagagtccctgtgtagccagatgagcccagaacagaggagactgggcatgtctggctacaacctggcggcagcgcaaaagatg

SEQ ID NO: 142040 - DNA, 103 bp, Artificial Sequence
  Synthetic Polynucleotide
taatacgactcactatagggcctgctccaggctgacgggaccaaagagctaacagaggagaagctctatggtcccgtcaaacctggcggcagcgcaaaagatg

SEQ ID NO: 142041 - DNA, 103 bp, Artificial Sequence
  Synthetic Polynucleotide
taatacgactcactataggggggaatttgacctgctccaggctgacgggaaacagaggagatcccgtatgcctggagcaaacctggcggcagcgcaaaagatg

SEQ ID NO: 142042 - DNA, 103 bp, Artificial Sequence
  Synthetic Polynucleotide
taatacgactcactatagggctcaggacctgggaatttgacctgctccagaacagaggagactggagatggtcaaattcaacctggcggcagcgcaaaagatg

SEQ ID NO: 142043 - DNA, 103 bp, Artificial Sequence
  Synthetic Polynucleotide
taatacgactcactatagggtggtaatatgctcaggacctgggaatttgaaacagaggagatcaaatatgcaggtcctgaacctggcggcagcgcaaaagatg

SEQ ID NO: 142044 - DNA, 103 bp, Artificial Sequence
  Synthetic Polynucleotide
taatacgactcactatagggtgcttctcattggtaatatgctcaggacctaacagaggagaaggtccatggcatattacaacctggcggcagcgcaaaagatg

SEQ ID NO: 142045 - DNA, 103 bp, Artificial Sequence
  Synthetic Polynucleotide
taatacgactcactataggggaacagcttctgcttctcattggtaatatgaacagaggagacatattatgaatgagaagaacctggcggcagcgcaaaagatg

SEQ ID NO: 142046 - DNA, 103 bp, Artificial Sequence
  Synthetic Polynucleotide
taatacgactcactataggggcttgctagtgaacagcttctgcttctcataacagaggagaatgagaatgagaagctgtaacctggcggcagcgcaaaagatg

SEQ ID NO: 142047 - DNA, 103 bp, Artificial Sequence
  Synthetic Polynucleotide
taatacgactcactatagggacgtccagcagcttgctagtgaacagcttcaacagaggagagaagctatgcactagcaaaacctggcggcagcgcaaaagatg

SEQ ID NO: 142048 - DNA, 103 bp, Artificial Sequence
  Synthetic Polynucleotide
taatacgactcactatagggtctgtccatgacgtccagcagcttgctagtaacagaggagaactagcatgctgctggacaacctggcggcagcgcaaaagatg

SEQ ID NO: 142049 - DNA, 103 bp, Artificial Sequence
  Synthetic Polynucleotide
taatacgactcactatagggggatcagtcctctgtccatgacgtccagcaaacagaggagatgctggatgtcatggacaaacctggcggcagcgcaaaagatg

SEQ ID NO: 142050 - DNA, 103 bp, Artificial Sequence
  Synthetic Polynucleotide
taatacgactcactatagggtggaagcgtttagagtccctgtgtagccagaacagaggagactggctatgcagggactcaacctggcggcagcgcaaaagatg

SEQ ID NO: 142051 - DNA, 103 bp, Artificial Sequence
  Synthetic Polynucleotide
taatacgactcactatagggctgacctccaggatcagtcctctgtccatgaacagaggagacatggaatgaggactgataacctggcggcagcgcaaaagatg

SEQ ID NO: 142052 - DNA, 103 bp, Artificial Sequence
  Synthetic Polynucleotide
taatacgactcactatagggggcatgaccgctgacctccaggatcagtccaacagaggagaggactgatgctggaggtcaacctggcggcagcgcaaaagatg

SEQ ID NO: 142053 - DNA, 103 bp, Artificial Sequence
  Synthetic Polynucleotide
taatacgactcactatagggtggcataaatggcatgaccgctgacctccaaacagaggagatggaggatggcggtcatgaacctggcggcagcgcaaaagatg

SEQ ID NO: 142054 - DNA, 103 bp, Artificial Sequence
  Synthetic Polynucleotide
taatacgactcactatagggcacagcctgatggcataaatggcatgaccgaacagaggagacggtcaatgcatttatgcaacctggcggcagcgcaaaagatg

SEQ ID NO: 142055 - DNA, 103 bp, Artificial Sequence
  Synthetic Polynucleotide
taatacgactcactatagggcttgcactggcacagcctgatggcataaataacagaggagaatttatatgatcaggctgaacctggcggcagcgcaaaagatg

SEQ ID NO: 142056 - DNA, 103 bp, Artificial Sequence
  Synthetic Polynucleotide
taatacgactcactatagggaccagtacaccttgcactggcacagcctgaaacagaggagatcaggcatggccagtgcaaacctggcggcagcgcaaaagatg

SEQ ID NO: 142057 - DNA, 103 bp, Artificial Sequence
  Synthetic Polynucleotide
taatacgactcactatagggcatggcccagaccagtacaccttgcactggaacagaggagaccagtgatgggtgtactgaacctggcggcagcgcaaaagatg

SEQ ID NO: 142058 - DNA, 103 bp, Artificial Sequence
  Synthetic Polynucleotide
taatacgactcactatagggtgatggggcacatggcccagaccagtacacaacagaggagagtgtacatgtctgggccaaacctggcggcagcgcaaaagatg

SEQ ID NO: 142059 - DNA, 103 bp, Artificial Sequence
  Synthetic Polynucleotide
taatacgactcactataggggagcaacaagtgatggggcacatggcccagaacagaggagactgggcatggtgccccataacctggcggcagcgcaaaagatg

SEQ ID NO: 142060 - DNA, 103 bp, Artificial Sequence
  Synthetic Polynucleotide
taatacgactcactatagggatcaggttgggagcaacaagtgatggggcaaacagaggagatgccccatgacttgttgcaacctggcggcagcgcaaaagatg

SEQ ID NO: 142061 - DNA, 103 bp, Artificial Sequence
  Synthetic Polynucleotide
taatacgactcactataggggccggctgcagggcgctcggggactggcataacagaggagaatgccaatgcccgagcgcaacctggcggcagcgcaaaagatg

SEQ ID NO: 142062 - DNA, 103 bp, Artificial Sequence
  Synthetic Polynucleotide
taatacgactcactatagggatagcagccgctgctgatctctccaaggagaacagaggagactccttatggagatcagcaacctggcggcagcgcaaaagatg

SEQ ID NO: 142063 - DNA, 103 bp, Artificial Sequence
  Synthetic Polynucleotide
taatacgactcactatagggctgggggtctgtggcccggacagctgggtcaacagaggagagacccaatggtccgggccaacctggcggcagcgcaaaagatg

SEQ ID NO: 142064 - DNA, 103 bp, Artificial Sequence
  Synthetic Polynucleotide
taatacgactcactatagggatgctacctgctgggggtctgtggcccggaaacagaggagatccgggatgcagacccccaacctggcggcagcgcaaaagatg

SEQ ID NO: 142065 - DNA, 103 bp, Artificial Sequence
  Synthetic Polynucleotide
taatacgactcactataggggggctggggaatgctacctgctgggggtctaacagaggagaagacccatggcaggtagcaacctggcggcagcgcaaaagatg

SEQ ID NO: 142066 - DNA, 103 bp, Artificial Sequence
  Synthetic Polynucleotide
taatacgactcactataggggagctcggcagggctggggaatgctacctgaacagaggagacaggtaatgttccccagcaacctggcggcagcgcaaaagatg

SEQ ID NO: 142067 - DNA, 103 bp, Artificial Sequence
  Synthetic Polynucleotide
taatacgactcactatagggtctggtccgggagctcggcagggctggggaaacagaggagatccccaatgctgccgagcaacctggcggcagcgcaaaagatg

SEQ ID NO: 142068 - DNA, 103 bp, Artificial Sequence
  Synthetic Polynucleotide
taatacgactcactatagggcgcagctgcttctggtccgggagctcggcaaacagaggagatgccgaatgcccggaccaaacctggcggcagcgcaaaagatg

SEQ ID NO: 142069 - DNA, 103 bp, Artificial Sequence
  Synthetic Polynucleotide
taatacgactcactatagggctccgtgtagcgcagctgcttctggtccggaacagaggagaccggacatgaagcagctgaacctggcggcagcgcaaaagatg

SEQ ID NO: 142070 - DNA, 103 bp, Artificial Sequence
  Synthetic Polynucleotide
taatacgactcactataggggcagcagttcctccgtgtagcgcagctgctaacagaggagaagcagcatggctacacggaacctggcggcagcgcaaaagatg

SEQ ID NO: 142071 - DNA, 103 bp, Artificial Sequence
  Synthetic Polynucleotide
taatacgactcactataggggccacgtgccgcagcagttcctccgtgtagaacagaggagactacacatgggaactgctaacctggcggcagcgcaaaagatg

SEQ ID NO: 142072 - DNA, 103 bp, Artificial Sequence
  Synthetic Polynucleotide
taatacgactcactatagggcaacccaggggccacgtgccgcagcagttcaacagaggagagaactgatgcggcacgtgaacctggcggcagcgcaaaagatg

SEQ ID NO: 142073 - DNA, 103 bp, Artificial Sequence
  Synthetic Polynucleotide
taatacgactcactataggggcagcccctcatagcagccgctgctgatctaacagaggagaagatcaatggcggctgctaacctggcggcagcgcaaaagatg

SEQ ID NO: 142074 - DNA, 103 bp, Artificial Sequence
  Synthetic Polynucleotide
taatacgactcactataggggctccaggtgcaacccaggggccacgtgccaacagaggagaggcacgatgcccctgggtaacctggcggcagcgcaaaagatg

SEQ ID NO: 142075 - DNA, 103 bp, Artificial Sequence
  Synthetic Polynucleotide
taatacgactcactatagggggcccccgaagctccaggtgcaacccagggaacagaggagaccctggatggcacctggaaacctggcggcagcgcaaaagatg

SEQ ID NO: 142076 - DNA, 103 bp, Artificial Sequence
  Synthetic Polynucleotide
taatacgactcactatagggccacagctgtggcccccgaagctccaggtgaacagaggagacacctgatgcttcgggggaacctggcggcagcgcaaaagatg

SEQ ID NO: 142077 - DNA, 103 bp, Artificial Sequence
  Synthetic Polynucleotide
taatacgactcactatagggtgcgccgggcccacagctgtggcccccgaaaacagaggagattcgggatgcacagctgtaacctggcggcagcgcaaaagatg

SEQ ID NO: 142078 - DNA, 103 bp, Artificial Sequence
  Synthetic Polynucleotide
taatacgactcactatagggcacttgcccatgcgccgggcccacagctgtaacagaggagaacagctatgggcccggcgaacctggcggcagcgcaaaagatg

SEQ ID NO: 142079 - DNA, 103 bp, Artificial Sequence
  Synthetic Polynucleotide
taatacgactcactataggggtacaccttgcacttgcccatgcgccgggcaacagaggagagcccggatgatgggcaagaacctggcggcagcgcaaaagatg

SEQ ID NO: 142080 - DNA, 103 bp, Artificial Sequence
  Synthetic Polynucleotide
taatacgactcactatagggccacctcccagtacaccttgcacttgcccaaacagaggagatgggcaatggcaaggtgtaacctggcggcagcgcaaaagatg

SEQ ID NO: 142081 - DNA, 103 bp, Artificial Sequence
  Synthetic Polynucleotide
taatacgactcactataggggggggtccgcccacctcccagtacaccttgaacagaggagacaaggtatgctgggaggtaacctggcggcagcgcaaaagatg

SEQ ID NO: 142082 - DNA, 103 bp, Artificial Sequence
  Synthetic Polynucleotide
taatacgactcactatagggggcggagcctgggggtccgcccacctcccaaacagaggagatgggagatgggcggacccaacctggcggcagcgcaaaagatg

SEQ ID NO: 142083 - DNA, 103 bp, Artificial Sequence
  Synthetic Polynucleotide
taatacgactcactatagggtggaggggctggcggagcctgggggtccgcaacagaggagagcggacatgcaggctccgaacctggcggcagcgcaaaagatg

SEQ ID NO: 142084 - DNA, 103 bp, Artificial Sequence
  Synthetic Polynucleotide
taatacgactcactatagggtccagccactgcagcccctcatagcagccgaacagaggagacggctgatgtgaggggctaacctggcggcagcgcaaaagatg

SEQ ID NO: 142085 - DNA, 103 bp, Artificial Sequence
  Synthetic Polynucleotide
taatacgactcactatagggcaggctggggtggaggggctggcggagcctaacagaggagaaggctcatgcagcccctcaacctggcggcagcgcaaaagatg

SEQ ID NO: 142086 - DNA, 103 bp, Artificial Sequence
  Synthetic Polynucleotide
taatacgactcactatagggaggcagcaggcaggctggggtggaggggctaacagaggagaagccccatgaccccagccaacctggcggcagcgcaaaagatg

SEQ ID NO: 142087 - DNA, 103 bp, Artificial Sequence
  Synthetic Polynucleotide
taatacgactcactatagggcacagttccgaggcagcaggcaggctggggaacagaggagaccccagatggcctgctgcaacctggcggcagcgcaaaagatg

SEQ ID NO: 142088 - DNA, 103 bp, Artificial Sequence
  Synthetic Polynucleotide
taatacgactcactatagggatgggggtgtcacagttccgaggcagcaggaacagaggagacctgctatgtcggaactgaacctggcggcagcgcaaaagatg

SEQ ID NO: 142089 - DNA, 103 bp, Artificial Sequence
  Synthetic Polynucleotide
taatacgactcactataggggaagtcgaagatgggggtgtcacagttccgaacagaggagacggaacatggacacccccaacctggcggcagcgcaaaagatg

SEQ ID NO: 142090 - DNA, 103 bp, Artificial Sequence
  Synthetic Polynucleotide
taatacgactcactatagggagaagactctgaagtcgaagatgggggtgtaacagaggagaacacccatgtcttcgactaacctggcggcagcgcaaaagatg

SEQ ID NO: 142091 - DNA, 103 bp, Artificial Sequence
  Synthetic Polynucleotide
taatacgactcactatagggagctcttggaagaagactctgaagtcgaagaacagaggagacttcgaatgcagagtcttaacctggcggcagcgcaaaagatg

SEQ ID NO: 142092 - DNA, 103 bp, Artificial Sequence
  Synthetic Polynucleotide
taatacgactcactataggggaattccaccagctcttggaagaagactctaacagaggagaagagtcatgttccaagagaacctggcggcagcgcaaaagatg

SEQ ID NO: 142093 - DNA, 103 bp, Artificial Sequence
  Synthetic Polynucleotide
taatacgactcactataggggccgtgcccggaattccaccagctcttggaaacagaggagatccaagatgtggtggaataacctggcggcagcgcaaaagatg

SEQ ID NO: 142094 - DNA, 103 bp, Artificial Sequence
  Synthetic Polynucleotide
taatacgactcactatagggccacggcgctgccgtgcccggaattccaccaacagaggagaggtggaatgccgggcacgaacctggcggcagcgcaaaagatg

SEQ ID NO: 142095 - DNA, 103 bp, Artificial Sequence
  Synthetic Polynucleotide
taatacgactcactataggggcgggcctcgtccagccactgcagcccctcaacagaggagagaggggatgcagtggctgaacctggcggcagcgcaaaagatg

SEQ ID NO: 142096 - DNA, 103 bp, Artificial Sequence
  Synthetic Polynucleotide
taatacgactcactataggggcgtggggagccacggcgctgccgtgcccgaacagaggagacgggcaatgcagcgccgtaacctggcggcagcgcaaaagatg

SEQ ID NO: 142097 - DNA, 103 bp, Artificial Sequence
  Synthetic Polynucleotide
taatacgactcactatagggagatggtatagcgtggggagccacggcgctaacagaggagaagcgccatggctccccacaacctggcggcagcgcaaaagatg

SEQ ID NO: 142098 - DNA, 103 bp, Artificial Sequence
  Synthetic Polynucleotide
taatacgactcactatagggaagcccaggtagatggtatagcgtggggagaacagaggagactccccatgctataccataacctggcggcagcgcaaaagatg

SEQ ID NO: 142099 - DNA, 103 bp, Artificial Sequence
  Synthetic Polynucleotide
taatacgactcactataggggtcctgcccgaagcccaggtagatggtataaacagaggagatataccatgtacctgggcaacctggcggcagcgcaaaagatg

SEQ ID NO: 142100 - DNA, 103 bp, Artificial Sequence
  Synthetic Polynucleotide
taatacgactcactatagggcagctgacaggtcctgcccgaagcccaggtaacagaggagaacctggatgtcgggcaggaacctggcggcagcgcaaaagatg

SEQ ID NO: 142101 - DNA, 103 bp, Artificial Sequence
  Synthetic Polynucleotide
taatacgactcactatagggttgggcctcccagctgacaggtcctgcccgaacagaggagacgggcaatgcctgtcagcaacctggcggcagcgcaaaagatg

SEQ ID NO: 142102 - DNA, 103 bp, Artificial Sequence
  Synthetic Polynucleotide
taatacgactcactataggggctcttctccttgggcctcccagctgacagaacagaggagactgtcaatggggaggcccaacctggcggcagcgcaaaagatg

SEQ ID NO: 142103 - DNA, 103 bp, Artificial Sequence
  Synthetic Polynucleotide
taatacgactcactatagggccaggaccaggctcttctccttgggcctccaacagaggagaggaggcatgaggagaagaaacctggcggcagcgcaaaagatg

SEQ ID NO: 142104 - DNA, 103 bp, Artificial Sequence
  Synthetic Polynucleotide
taatacgactcactatagggtccagcttcaccaggaccaggctcttctccaacagaggagaggagaaatgcctggtcctaacctggcggcagcgcaaaagatg

SEQ ID NO: 142105 - DNA, 103 bp, Artificial Sequence
  Synthetic Polynucleotide
taatacgactcactatagggcagccagggttccagcttcaccaggaccagaacagaggagactggtcatggtgaagctgaacctggcggcagcgcaaaagatg

SEQ ID NO: 142106 - DNA, 103 bp, Artificial Sequence
  Synthetic Polynucleotide
taatacgactcactatagggggaaacaggtgcgggcctcgtccagccactaacagaggagaagtggcatgacgaggcccaacctggcggcagcgcaaaagatg

SEQ ID NO: 142107 - DNA, 103 bp, Artificial Sequence
  Synthetic Polynucleotide
taatacgactcactataggggcactcggcacagccagggttccagcttcaaacagaggagatgaagcatgaaccctggcaacctggcggcagcgcaaaagatg

SEQ ID NO: 142108 - DNA, 103 bp, Artificial Sequence
  Synthetic Polynucleotide
taatacgactcactatagggccctctaggtgcactcggcacagccagggtaacagaggagaaccctgatggtgccgagtaacctggcggcagcgcaaaagatg

SEQ ID NO: 142109 - DNA, 103 bp, Artificial Sequence
  Synthetic Polynucleotide
taatacgactcactatagggacgctgcgtgccctctaggtgcactcggcaaacagaggagatgccgaatgcacctagagaacctggcggcagcgcaaaagatg

SEQ ID NO: 142110 - DNA, 103 bp, Artificial Sequence
  Synthetic Polynucleotide
taatacgactcactatagggacacaccctcacgctgcgtgccctctaggtaacagaggagaacctagatggcacgcagcaacctggcggcagcgcaaaagatg

SEQ ID NO: 142111 - DNA, 103 bp, Artificial Sequence
  Synthetic Polynucleotide
taatacgactcactatagggtccagggaagacacaccctcacgctgcgtgaacagaggagacacgcaatgtgagggtgtaacctggcggcagcgcaaaagatg

SEQ ID NO: 142112 - DNA, 103 bp, Artificial Sequence
  Synthetic Polynucleotide
taatacgactcactataggggctgctgctatccagggaagacacaccctcaacagaggagagagggtatgtcttccctgaacctggcggcagcgcaaaagatg

SEQ ID NO: 142113 - DNA, 103 bp, Artificial Sequence
  Synthetic Polynucleotide
taatacgactcactatagggagaggctgaggctgctgctatccagggaagaacagaggagacttcccatgatagcagcaaacctggcggcagcgcaaaagatg

SEQ ID NO: 142114 - DNA, 103 bp, Artificial Sequence
  Synthetic Polynucleotide
taatacgactcactatagggctggacaggcagaggctgaggctgctgctaaacagaggagatagcagatgcctcagcctaacctggcggcagcgcaaaagatg

SEQ ID NO: 142115 - DNA, 103 bp, Artificial Sequence
  Synthetic Polynucleotide
taatacgactcactataggggctgttggcgctggacaggcagaggctgagaacagaggagactcagcatgtgcctgtccaacctggcggcagcgcaaaagatg

SEQ ID NO: 142116 - DNA, 103 bp, Artificial Sequence
  Synthetic Polynucleotide
taatacgactcactatagggcgtcatagaggctgttggcgctggacaggcaacagaggagagcctgtatggcgccaacaaacctggcggcagcgcaaaagatg

SEQ ID NO: 142117 - DNA, 103 bp, Artificial Sequence
  Synthetic Polynucleotide
taatacgactcactatagggcagggcacgcggaaacaggtgcgggcctcgaacagaggagacgaggcatgcacctgtttaacctggcggcagcgcaaaagatg

SEQ ID NO: 142118 - DNA, 103 bp, Artificial Sequence
  Synthetic Polynucleotide
taatacgactcactatagggcactcgatgtcgtcatagaggctgttggcgaacagaggagacgccaaatgcctctatgaaacctggcggcagcgcaaaagatg

SEQ ID NO: 142119 - DNA, 103 bp, Artificial Sequence
  Synthetic Polynucleotide
taatacgactcactatagggcataaggaagcactcgatgtcgtcatagagaacagaggagactctatatggacatcgagaacctggcggcagcgcaaaagatg

SEQ ID NO: 142120 - DNA, 103 bp, Artificial Sequence
  Synthetic Polynucleotide
taatacgactcactataggggctccagctccataaggaagcactcgatgtaacagaggagaacatcgatggcttccttaaacctggcggcagcgcaaaagatg

SEQ ID NO: 142121 - DNA, 103 bp, Artificial Sequence
  Synthetic Polynucleotide
taatacgactcactatagggtaggcgggctgctccagctccataaggaagaacagaggagacttcctatgggagctggaaacctggcggcagcgcaaaagatg

SEQ ID NO: 142122 - DNA, 103 bp, Artificial Sequence
  Synthetic Polynucleotide
taatacgactcactataggggaagtgcttccagggcacgcggaaacaggtaacagaggagaacctgtatgcgcgtgcccaacctggcggcagcgcaaaagatg

SEQ ID NO: 142123 - DNA, 103 bp, Artificial Sequence
  Synthetic Polynucleotide
taatacgactcactatagggccttgcgcgcgaagtgcttccagggcacgcaacagaggagagcgtgcatgggaagcactaacctggcggcagcgcaaaagatg

SEQ ID NO: 142124 - DNA, 103 bp, Artificial Sequence
  Synthetic Polynucleotide
taatacgactcactatagggtcgctcaggtccttgcgcgcgaagtgcttcaacagaggagagaagcaatgcgcgcgcaaaacctggcggcagcgcaaaagatg

SEQ ID NO: 142125 - DNA, 103 bp, Artificial Sequence
  Synthetic Polynucleotide
taatacgactcactatagggcgcgtcggcctcgctcaggtccttgcgcgcaacagaggagagcgcgcatggacctgagcaacctggcggcagcgcaaaagatg

SEQ ID NO: 142126 - DNA, 103 bp, Artificial Sequence
  Synthetic Polynucleotide
taatacgactcactataggggagagtcagggccggctgcagggcgctcggaacagaggagaccgagcatgctgcagccgaacctggcggcagcgcaaaagatg

SEQ ID NO: 142127 - DNA, 103 bp, Artificial Sequence
  Synthetic Polynucleotide
taatacgactcactatagggtgaagatgcgcgcgtcggcctcgctcaggtaacagaggagaacctgaatgaggccgacgaacctggcggcagcgcaaaagatg

SEQ ID NO: 142128 - DNA, 103 bp, Artificial Sequence
  Synthetic Polynucleotide
taatacgactcactataggggcccaggccttgaagatgcgcgcgtcggccaacagaggagaggccgaatggcgcatcttaacctggcggcagcgcaaaagatg

SEQ ID NO: 142129 - DNA, 103 bp, Artificial Sequence
  Synthetic Polynucleotide
taatacgactcactataggggcgggccacagcccaggccttgaagatgcgaacagaggagacgcatcatgaaggcctggaacctggcggcagcgcaaaagatg

SEQ ID NO: 142130 - DNA, 103 bp, Artificial Sequence
  Synthetic Polynucleotide
taatacgactcactataggggccacctgccgcgggccacagcccaggcctaacagaggagaaggcctatgctgtggcccaacctggcggcagcgcaaaagatg

SEQ ID NO: 142131 - DNA, 103 bp, Artificial Sequence
  Synthetic Polynucleotide
taatacgactcactatagggctgctaggcggccacctgccgcgggccacaaacagaggagatgtggcatgcggcaggtgaacctggcggcagcgcaaaagatg

SEQ ID NO: 142132 - DNA, 103 bp, Artificial Sequence
  Synthetic Polynucleotide
taatacgactcactatagggacctcccctgctgctaggcggccacctgccaacagaggagaggcaggatgccgcctagcaacctggcggcagcgcaaaagatg

SEQ ID NO: 142133 - DNA, 103 bp, Artificial Sequence
  Synthetic Polynucleotide
taatacgactcactatagggggggcgggccacctcccctgctgctaggcgaacagaggagacgcctaatggcaggggagaacctggcggcagcgcaaaagatg

SEQ ID NO: 142134 - DNA, 103 bp, Artificial Sequence
  Synthetic Polynucleotide
taatacgactcactatagggtcagcctcggggggcgggccacctcccctgaacagaggagacaggggatgtggcccgccaacctggcggcagcgcaaaagatg

SEQ ID NO: 142135 - DNA, 103 bp, Artificial Sequence
  Synthetic Polynucleotide
taatacgactcactatagggctccgcagtctcagcctcggggggcgggccaacagaggagaggcccgatgcccgaggctaacctggcggcagcgcaaaagatg

SEQ ID NO: 142136 - DNA, 103 bp, Artificial Sequence
  Synthetic Polynucleotide
taatacgactcactatagggagccggcgcgctccgcagtctcagcctcggaacagaggagaccgaggatgagactgcggaacctggcggcagcgcaaaagatg

SEQ ID NO: 142137 - DNA, 103 bp, Artificial Sequence
  Synthetic Polynucleotide
taatacgactcactatagggcccggccgcggagagtcagggccggctgcaaacagaggagatgcagcatgccctgactcaacctggcggcagcgcaaaagatg

SEQ ID NO: 142138 - DNA, 103 bp, Artificial Sequence
  Synthetic Polynucleotide
taatacgactcactatagggttggttttccagccggcgcgctccgcagtcaacagaggagagactgcatggcgcgccggaacctggcggcagcgcaaaagatg

SEQ ID NO: 142139 - DNA, 103 bp, Artificial Sequence
  Synthetic Polynucleotide
taatacgactcactataggggcagcggaagttggttttccagccggcgcgaacagaggagacgcgccatgtggaaaaccaacctggcggcagcgcaaaagatg

SEQ ID NO: 142140 - DNA, 103 bp, Artificial Sequence
  Synthetic Polynucleotide
taatacgactcactatagggtgcgcagtgcgcagcggaagttggttttccaacagaggagaggaaaaatgacttccgctaacctggcggcagcgcaaaagatg

SEQ ID NO: 142141 - DNA, 103 bp, Artificial Sequence
  Synthetic Polynucleotide
taatacgactcactatagggcgacgcgtgctgcgcagtgcgcagcggaagaacagaggagacttccgatgcgcactgcgaacctggcggcagcgcaaaagatg

SEQ ID NO: 142142 - DNA, 103 bp, Artificial Sequence
  Synthetic Polynucleotide
taatacgactcactatagggcatcacgaagcgacgcgtgctgcgcagtgcaacagaggagagcactgatgagcacgcgtaacctggcggcagcgcaaaagatg

SEQ ID NO: 142143 - DNA, 103 bp, Artificial Sequence
  Synthetic Polynucleotide
taatacgactcactatagggtatcccgcagcatcacgaagcgacgcgtgcaacagaggagagcacgcatggcttcgtgaaacctggcggcagcgcaaaagatg

SEQ ID NO: 142144 - DNA, 103 bp, Artificial Sequence
  Synthetic Polynucleotide
taatacgactcactatagggtcccccgagttatcccgcagcatcacgaagaacagaggagacttcgtatggctgcgggaaacctggcggcagcgcaaaagatg

SEQ ID NO: 142145 - DNA, 103 bp, Artificial Sequence
  Synthetic Polynucleotide
taatacgactcactataggggtcggccgggtcccccgagttatcccgcagaacagaggagactgcggatgaactcggggaacctggcggcagcgcaaaagatg

SEQ ID NO: 142146 - DNA, 103 bp, Artificial Sequence
  Synthetic Polynucleotide
taatacgactcactatagggccttgtgcgggtcggccgggtcccccgagtaacagaggagaactcggatgacccggccgaacctggcggcagcgcaaaagatg

SEQ ID NO: 142147 - DNA, 103 bp, Artificial Sequence
  Synthetic Polynucleotide
taatacgactcactatagggagcgcgtacaccttgtgcgggtcggccgggaacagaggagacccggcatgcccgcacaaaacctggcggcagcgcaaaagatg

SEQ ID NO: 142148 - DNA, 103 bp, Artificial Sequence
  Synthetic Polynucleotide
taatacgactcactatagggcctgcgggtgcccggccgcggagagtcaggaacagaggagacctgacatgccgcggccgaacctggcggcagcgcaaaagatg

SEQ ID NO: 142149 - DNA, 103 bp, Artificial Sequence
  Synthetic Polynucleotide
taatacgactcactatagggctcccggctgagcgcgtacaccttgtgcggaacagaggagaccgcacatggtgtacgcgaacctggcggcagcgcaaaagatg

SEQ ID NO: 142150 - DNA, 103 bp, Artificial Sequence
  Synthetic Polynucleotide
taatacgactcactataggggccagcacagctcccggctgagcgcgtacaaacagaggagatgtacgatgtcagccgggaacctggcggcagcgcaaaagatg

SEQ ID NO: 142151 - DNA, 103 bp, Artificial Sequence
  Synthetic Polynucleotide
taatacgactcactataggggggccttctcgccagcacagctcccggctgaacagaggagacagccgatggctgtgctgaacctggcggcagcgcaaaagatg

SEQ ID NO: 142152 - DNA, 103 bp, Artificial Sequence
  Synthetic Polynucleotide
taatacgactcactataggggtccgtgcctgggccttctcgccagcacagaacagaggagactgtgcatgcgagaaggcaacctggcggcagcgcaaaagatg

SEQ ID NO: 142153 - DNA, 103 bp, Artificial Sequence
  Synthetic Polynucleotide
taatacgactcactatagggcctcagtctggtccgtgcctgggccttctcaacagaggagagagaagatgcaggcacggaacctggcggcagcgcaaaagatg

SEQ ID NO: 142154 - DNA, 103 bp, Artificial Sequence
  Synthetic Polynucleotide
taatacgactcactatagggggggcctctgcctcagtctggtccgtgcctaacagaggagaaggcacatgccagactgaaacctggcggcagcgcaaaagatg

SEQ ID NO: 142155 - DNA, 103 bp, Artificial Sequence
  Synthetic Polynucleotide
taatacgactcactataggggacagctgcgggggcctctgcctcagtctgaacagaggagacagactatggcagaggccaacctggcggcagcgcaaaagatg

SEQ ID NO: 142156 - DNA, 103 bp, Artificial Sequence
  Synthetic Polynucleotide
taatacgactcactataggggtggtggtgggacagctgcgggggcctctgaacagaggagacagaggatgccgcagctgaacctggcggcagcgcaaaagatg

SEQ ID NO: 142157 - DNA, 103 bp, Artificial Sequence
  Synthetic Polynucleotide
taatacgactcactatagggggcccaccctgtggtggtgggacagctgcgaacagaggagacgcagcatgcccaccaccaacctggcggcagcgcaaaagatg

SEQ ID NO: 142158 - DNA, 103 bp, Artificial Sequence
  Synthetic Polynucleotide
taatacgactcactatagggtggccctgggggcccaccctgtggtggtggaacagaggagaccaccaatgcagggtgggaacctggcggcagcgcaaaagatg

SEQ ID NO: 142159 - DNA, 103 bp, Artificial Sequence
  Synthetic Polynucleotide
taatacgactcactataggggtggggctgccctgcgggtgcccggccgcgaacagaggagacgcggcatggcacccgcaaacctggcggcagcgcaaaagatg

SEQ ID NO: 142160 - DNA, 103 bp, Artificial Sequence
  Synthetic Polynucleotide
taatacgactcactataggggtgccaggaatggccctgggggcccaccctaacagaggagaagggtgatgccccagggcaacctggcggcagcgcaaaagatg

SEQ ID NO: 142161 - DNA, 103 bp, Artificial Sequence
  Synthetic Polynucleotide
taatacgactcactataggggcatgtgtgtgtgccaggaatggccctgggaacagaggagacccaggatgattcctggcaacctggcggcagcgcaaaagatg

SEQ ID NO: 142162 - DNA, 103 bp, Artificial Sequence
  Synthetic Polynucleotide
taatacgactcactatagggttggagtccagcatgtgtgtgtgccaggaaaacagaggagattcctgatgcacacacataacctggcggcagcgcaaaagatg

SEQ ID NO: 142163 - DNA, 103 bp, Artificial Sequence
  Synthetic Polynucleotide
taatacgactcactatagggggcctggggcttggagtccagcatgtgtgtaacagaggagaacacacatgctggactccaacctggcggcagcgcaaaagatg

SEQ ID NO: 142164 - DNA, 103 bp, Artificial Sequence
  Synthetic Polynucleotide
taatacgactcactataggggcagggagggggcctggggcttggagtccaaacagaggagatggactatgagccccaggaacctggcggcagcgcaaaagatg

SEQ ID NO: 142165 - DNA, 103 bp, Artificial Sequence
  Synthetic Polynucleotide
taatacgactcactatagggaccagctggggcagggagggggcctggggcaacagaggagagccccaatgcccctccctaacctggcggcagcgcaaaagatg

SEQ ID NO: 142166 - DNA, 103 bp, Artificial Sequence
  Synthetic Polynucleotide
taatacgactcactatagggcccccttgtcaccagctggggcagggagggaacagaggagaccctccatgccccagctgaacctggcggcagcgcaaaagatg

SEQ ID NO: 142167 - DNA, 103 bp, Artificial Sequence
  Synthetic Polynucleotide
taatacgactcactatagggagcaggaggtcccccttgtcaccagctgggaacagaggagacccagcatgtgacaagggaacctggcggcagcgcaaaagatg

SEQ ID NO: 142168 - DNA, 103 bp, Artificial Sequence
  Synthetic Polynucleotide
taatacgactcactatagggcactgcctggagcaggaggtcccccttgtcaacagaggagagacaagatggacctcctgaacctggcggcagcgcaaaagatg

SEQ ID NO: 142169 - DNA, 103 bp, Artificial Sequence
  Synthetic Polynucleotide
taatacgactcactatagggagctctgttgcactgcctggagcaggaggtaacagaggagaacctccatgtccaggcagaacctggcggcagcgcaaaagatg

SEQ ID NO: 142170 - DNA, 103 bp, Artificial Sequence
  Synthetic Polynucleotide
taatacgactcactatagggaacagcacgcgtggggctgccctgcgggtgaacagaggagacacccgatgggcagccccaacctggcggcagcgcaaaagatg

SEQ ID NO: 142171 - DNA, 103 bp, Artificial Sequence
  Synthetic Polynucleotide
taatacgactcactatagggtctgccaggcagctctgttgcactgcctggaacagaggagaccaggcatggcaacagagaacctggcggcagcgcaaaagatg

SEQ ID NO: 142172 - DNA, 103 bp, Artificial Sequence
  Synthetic Polynucleotide
taatacgactcactatagggcagcagatggtctgccaggcagctctgttgaacagaggagacaacagatgtgcctggcaaacctggcggcagcgcaaaagatg

SEQ ID NO: 142173 - DNA, 103 bp, Artificial Sequence
  Synthetic Polynucleotide
taatacgactcactatagggatgacgctgtcagcagatggtctgccaggcaacagaggagagcctggatgaccatctgcaacctggcggcagcgcaaaagatg

SEQ ID NO: 142174 - DNA, 103 bp, Artificial Sequence
  Synthetic Polynucleotide
taatacgactcactatagggtctgccccccatgacgctgtcagcagatggaacagaggagaccatctatggacagcgtcaacctggcggcagcgcaaaagatg

SEQ ID NO: 142175 - DNA, 103 bp, Artificial Sequence
  Synthetic Polynucleotide
taatacgactcactatagggtgggactggatctgccccccatgacgctgtaacagaggagaacagcgatgtggggggcaaacctggcggcagcgcaaaagatg

SEQ ID NO: 142176 - DNA, 103 bp, Artificial Sequence
  Synthetic Polynucleotide
taatacgactcactataggggagccttggttgggactggatctgccccccaacagaggagaggggggatgatccagtccaacctggcggcagcgcaaaagatg

SEQ ID NO: 142177 - DNA, 103 bp, Artificial Sequence
  Synthetic Polynucleotide
taatacgactcactatagggccctctccaggagccttggttgggactggaaacagaggagatccagtatgaaccaaggcaacctggcggcagcgcaaaagatg

SEQ ID NO: 142178 - DNA, 103 bp, Artificial Sequence
  Synthetic Polynucleotide
taatacgactcactatagggcccttcttgtccctctccaggagccttggtaacagaggagaaccaagatgcctggagagaacctggcggcagcgcaaaagatg

SEQ ID NO: 142179 - DNA, 103 bp, Artificial Sequence
  Synthetic Polynucleotide
taatacgactcactatagggtcaggggaagcccttcttgtccctctccagaacagaggagactggagatggacaagaagaacctggcggcagcgcaaaagatg

SEQ ID NO: 142180 - DNA, 103 bp, Artificial Sequence
  Synthetic Polynucleotide
taatacgactcactatagggcaggccccagtcaggggaagcccttcttgtaacagaggagaacaagaatggcttcccctaacctggcggcagcgcaaaagatg

SEQ ID NO: 142181 - DNA, 103 bp, Artificial Sequence
  Synthetic Polynucleotide
taatacgactcactatagggccactctccgaacagcacgcgtggggctgcaacagaggagagcagccatgcgcgtgctgaacctggcggcagcgcaaaagatg

SEQ ID NO: 142182 - DNA, 103 bp, Artificial Sequence
  Synthetic Polynucleotide
taatacgactcactataggggcctccagcacaggccccagtcaggggaagaacagaggagacttcccatgactggggccaacctggcggcagcgcaaaagatg

SEQ ID NO: 142183 - DNA, 103 bp, Artificial Sequence
  Synthetic Polynucleotide
taatacgactcactatagggggagccctgggcctccagcacaggccccagaacagaggagactggggatggtgctggagaacctggcggcagcgcaaaagatg

SEQ ID NO: 142184 - DNA, 103 bp, Artificial Sequence
  Synthetic Polynucleotide
taatacgactcactatagggtccccagcagggagccctgggcctccagcaaacagaggagatgctggatgcccagggctaacctggcggcagcgcaaaagatg

SEQ ID NO: 142185 - DNA, 103 bp, Artificial Sequence
  Synthetic Polynucleotide
taatacgactcactatagggcccgtacagctccccagcagggagccctggaacagaggagaccagggatgcctgctgggaacctggcggcagcgcaaaagatg

SEQ ID NO: 142186 - DNA, 103 bp, Artificial Sequence
  Synthetic Polynucleotide
taatacgactcactatagggctactgcccacccgtacagctccccagcagaacagaggagactgctgatgagctgtacgaacctggcggcagcgcaaaagatg

SEQ ID NO: 142187 - DNA, 103 bp, Artificial Sequence
  Synthetic Polynucleotide
taatacgactcactatagggggggtcgtctctactgcccacccgtacagcaacagaggagagctgtaatggtgggcagtaacctggcggcagcgcaaaagatg

SEQ ID NO: 142188 - DNA, 103 bp, Artificial Sequence
  Synthetic Polynucleotide
taatacgactcactatagggcccggggctgggggtcgtctctactgcccaaacagaggagatgggcaatggagacgaccaacctggcggcagcgcaaaagatg

SEQ ID NO: 142189 - DNA, 103 bp, Artificial Sequence
  Synthetic Polynucleotide
taatacgactcactatagggcgggctggggcccggggctgggggtcgtctaacagaggagaagacgaatgccagccccgaacctggcggcagcgcaaaagatg

SEQ ID NO: 142190 - DNA, 103 bp, Artificial Sequence
  Synthetic Polynucleotide
taatacgactcactataggggttagtgccgcgggctggggcccggggctgaacagaggagacagcccatggccccagccaacctggcggcagcgcaaaagatg

SEQ ID NO: 142191 - DNA, 103 bp, Artificial Sequence
  Synthetic Polynucleotide
taatacgactcactatagggctcgcctgtcgttagtgccgcgggctggggaacagaggagaccccagatggcggcactaaacctggcggcagcgcaaaagatg

SEQ ID NO: 142192 - DNA, 103 bp, Artificial Sequence
  Synthetic Polynucleotide
taatacgactcactatagggctccaaggagccactctccgaacagcacgcaacagaggagagcgtgcatgtcggagagtaacctggcggcagcgcaaaagatg

SEQ ID NO: 142193 - DNA, 103 bp, Artificial Sequence
  Synthetic Polynucleotide
taatacgactcactataggggggccgcggcctcgcctgtcgttagtgccgaacagaggagacggcacatgcgacaggcgaacctggcggcagcgcaaaagatg

SEQ ID NO: 142194 - DNA, 103 bp, Artificial Sequence
  Synthetic Polynucleotide
taatacgactcactatagggggggactctggggccgcggcctcgcctgtcaacagaggagagacaggatgggccgcggcaacctggcggcagcgcaaaagatg

SEQ ID NO: 142195 - DNA, 103 bp, Artificial Sequence
  Synthetic Polynucleotide
taatacgactcactatagggtgcctggtgcggggactctggggccgcggcaacagaggagagccgcgatgccagagtccaacctggcggcagcgcaaaagatg

SEQ ID NO: 142196 - DNA, 103 bp, Artificial Sequence
  Synthetic Polynucleotide
taatacgactcactatagggggtacggctctgcctggtgcggggactctgaacagaggagacagagtatgcgcaccaggaacctggcggcagcgcaaaagatg

SEQ ID NO: 142197 - DNA, 103 bp, Artificial Sequence
  Synthetic Polynucleotide
taatacgactcactataggggagggtgacaggtacggctctgcctggtgcaacagaggagagcaccaatgagagccgtaaacctggcggcagcgcaaaagatg

SEQ ID NO: 142198 - DNA, 103 bp, Artificial Sequence
  Synthetic Polynucleotide
taatacgactcactatagggggcgcttggggagggtgacaggtacggctcaacagaggagagagccgatgctgtcacccaacctggcggcagcgcaaaagatg

SEQ ID NO: 142199 - DNA, 103 bp, Artificial Sequence
  Synthetic Polynucleotide
taatacgactcactatagggccgcggtgcaggcgcttggggagggtgacaaacagaggagatgtcacatgccccaagcgaacctggcggcagcgcaaaagatg

SEQ ID NO: 142200 - DNA, 103 bp, Artificial Sequence
  Synthetic Polynucleotide
taatacgactcactatagggggctcttgcaccgcggtgcaggcgcttgggaacagaggagacccaagatgctgcaccgcaacctggcggcagcgcaaaagatg

SEQ ID NO: 142201 - DNA, 103 bp, Artificial Sequence
  Synthetic Polynucleotide
taatacgactcactatagggccctgggctgggctcttgcaccgcggtgcaaacagaggagatgcaccatggtgcaagagaacctggcggcagcgcaaaagatg

SEQ ID NO: 142202 - DNA, 103 bp, Artificial Sequence
  Synthetic Polynucleotide
taatacgactcactatagggcgtccagcgcccctgggctgggctcttgcaaacagaggagatgcaagatgccagcccagaacctggcggcagcgcaaaagatg

SEQ ID NO: 142203 - DNA, 103 bp, Artificial Sequence
  Synthetic Polynucleotide
taatacgactcactatagggctgctgatctctccaaggagccactctccgaacagaggagacggagaatggctccttggaacctggcggcagcgcaaaagatg

SEQ ID NO: 142204 - DNA, 103 bp, Artificial Sequence
  Synthetic Polynucleotide
taatacgactcactatagggatgatggtcacgtccagcgcccctgggctgaacagaggagacagcccatgggcgctggaaacctggcggcagcgcaaaagatg

SEQ ID NO: 142205 - DNA, 103 bp, Artificial Sequence
  Synthetic Polynucleotide
taatacgactcactataggggcccttgtacatgatggtcacgtccagcgcaacagaggagagcgctgatggtgaccatcaacctggcggcagcgcaaaagatg

SEQ ID NO: 142206 - DNA, 103 bp, Artificial Sequence
  Synthetic Polynucleotide
taatacgactcactataggggcaccgtgcggcccttgtacatgatggtcaaacagaggagatgaccaatgtgtacaaggaacctggcggcagcgcaaaagatg

SEQ ID NO: 142207 - DNA, 103 bp, Artificial Sequence
  Synthetic Polynucleotide
taatacgactcactatagggaccttctgcagcaccgtgcggcccttgtacaacagaggagagtacaaatgccgcacggtaacctggcggcagcgcaaaagatg

SEQ ID NO: 142208 - DNA, 103 bp, Artificial Sequence
  Synthetic Polynucleotide
taatacgactcactataggggtgtcccaccaccttctgcagcaccgtgcgaacagaggagacgcacgatgctgcagaagaacctggcggcagcgcaaaagatg

SEQ ID NO: 142209 - DNA, 103 bp, Artificial Sequence
  Synthetic Polynucleotide
taatacgactcactatagggtgcagctcgggtgtcccaccaccttctgcaaacagaggagatgcagaatgtggtgggacaacctggcggcagcgcaaaagatg

SEQ ID NO: 142210 - DNA, 103 bp, Artificial Sequence
  Synthetic Polynucleotide
taatacgactcactatagggtataggaacgtgcagctcgggtgtcccaccaacagaggagaggtgggatgcccgagctgaacctggcggcagcgcaaaagatg

SEQ ID NO: 142211 - DNA, 103 bp, Artificial Sequence
  Synthetic Polynucleotide
taatacgactcactatagggtggggggccgtataggaacgtgcagctcggaacagaggagaccgagcatgacgttcctaaacctggcggcagcgcaaaagatg

SEQ ID NO: 142212 - DNA, 103 bp, Artificial Sequence
  Synthetic Polynucleotide
taatacgactcactatagggcagctgggtctggggggccgtataggaacgaacagaggagacgttccatgacggcccccaacctggcggcagcgcaaaagatg

SEQ ID NO: 142213 - DNA, 103 bp, Artificial Sequence
  Synthetic Polynucleotide
taatacgactcactataggggtggcccggacagctgggtctggggggccgaacagaggagacggcccatgagacccagcaacctggcggcagcgcaaaagatg

SEQ ID NO: 142214 - DNA, 103 bp, Artificial Sequence
  Synthetic Polynucleotide
taatacgactcactatagggaagccgccgaccaccattccggtcacacataacagaggagaatgtgtatgcggaatggtaacctggcggcagcgcaaaagatg

SEQ ID NO: 142215 - DNA, 103 bp, Artificial Sequence
  Synthetic Polynucleotide
taatacgactcactatagggccaagggatccggaacatgctcttctcctcaacagaggagagaggagatgagcatgttcaacctggcggcagcgcaaaagatg

SEQ ID NO: 142216 - DNA, 103 bp, Artificial Sequence
  Synthetic Polynucleotide
taatacgactcactatagggccggccctggctgttatagaactgctgcagaacagaggagactgcagatgttctataacaacctggcggcagcgcaaaagatg

SEQ ID NO: 142217 - DNA, 103 bp, Artificial Sequence
  Synthetic Polynucleotide
taatacgactcactatagggcgtcaggaagccggccctggctgttatagaaacagaggagatctataatggccagggccaacctggcggcagcgcaaaagatg

SEQ ID NO: 142218 - DNA, 103 bp, Artificial Sequence
  Synthetic Polynucleotide
taatacgactcactatagggaccaccctgccgtcaggaagccggccctggaacagaggagaccagggatggcttcctgaaacctggcggcagcgcaaaagatg

SEQ ID NO: 142219 - DNA, 103 bp, Artificial Sequence
  Synthetic Polynucleotide
taatacgactcactatagggaaagcacagcaccaccctgccgtcaggaagaacagaggagacttcctatgggcagggtgaacctggcggcagcgcaaaagatg

SEQ ID NO: 142220 - DNA, 103 bp, Artificial Sequence
  Synthetic Polynucleotide
taatacgactcactatagggactcttccccaaagcacagcaccaccctgcaacagaggagagcagggatgtgctgtgctaacctggcggcagcgcaaaagatg

SEQ ID NO: 142221 - DNA, 103 bp, Artificial Sequence
  Synthetic Polynucleotide
taatacgactcactatagggatatccggaaactcttccccaaagcacagcaacagaggagagctgtgatgtggggaagaaacctggcggcagcgcaaaagatg

SEQ ID NO: 142222 - DNA, 103 bp, Artificial Sequence
  Synthetic Polynucleotide
taatacgactcactatagggcaagggggccatatccggaaactcttccccaacagaggagaggggaaatgtttccggataacctggcggcagcgcaaaagatg

SEQ ID NO: 142223 - DNA, 103 bp, Artificial Sequence
  Synthetic Polynucleotide
taatacgactcactataggggtttggagcgcaagggggccatatccggaaaacagaggagattccggatgtggccccctaacctggcggcagcgcaaaagatg

SEQ ID NO: 142224 - DNA, 103 bp, Artificial Sequence
  Synthetic Polynucleotide
taatacgactcactatagggacgagaatgagtttggagcgcaagggggccaacagaggagaggccccatggcgctccaaaacctggcggcagcgcaaaagatg

SEQ ID NO: 142225 - DNA, 103 bp, Artificial Sequence
  Synthetic Polynucleotide
taatacgactcactatagggctcaatctgcacgagaatgagtttggagcgaacagaggagacgctccatgctcattctcaacctggcggcagcgcaaaagatg

SEQ ID NO: 142226 - DNA, 103 bp, Artificial Sequence
  Synthetic Polynucleotide
taatacgactcactatagggcagcgtgtttccaagggatccggaacatgcaacagaggagagcatgtatgggatcccttaacctggcggcagcgcaaaagatg

SEQ ID NO: 142227 - DNA, 103 bp, Artificial Sequence
  Synthetic Polynucleotide
taatacgactcactatagggcatacagctgctcaatctgcacgagaatgaaacagaggagatcattcatgtgcagattgaacctggcggcagcgcaaaagatg

SEQ ID NO: 142228 - DNA, 103 bp, Artificial Sequence
  Synthetic Polynucleotide
taatacgactcactatagggagttgccggacatacagctgctcaatctgcaacagaggagagcagatatggcagctgtaaacctggcggcagcgcaaaagatg

SEQ ID NO: 142229 - DNA, 103 bp, Artificial Sequence
  Synthetic Polynucleotide
taatacgactcactatagggctcttctgccagttgccggacatacagctgaacagaggagacagctgatggtccggcaaaacctggcggcagcgcaaaagatg

SEQ ID NO: 142230 - DNA, 103 bp, Artificial Sequence
  Synthetic Polynucleotide
taatacgactcactatagggtcttcccagcctcttctgccagttgccggaaacagaggagatccggcatgtggcagaagaacctggcggcagcgcaaaagatg

SEQ ID NO: 142231 - DNA, 103 bp, Artificial Sequence
  Synthetic Polynucleotide
taatacgactcactataggggctccacagctcttcccagcctcttctgccaacagaggagaggcagaatgggctgggaaaacctggcggcagcgcaaaagatg

SEQ ID NO: 142232 - DNA, 103 bp, Artificial Sequence
  Synthetic Polynucleotide
taatacgactcactatagggcacagagccggctccacagctcttcccagcaacagaggagagctgggatgagctgtggaaacctggcggcagcgcaaaagatg

SEQ ID NO: 142233 - DNA, 103 bp, Artificial Sequence
  Synthetic Polynucleotide
taatacgactcactataggggggcctgcatcacagagccggctccacagcaacagaggagagctgtgatgccggctctgaacctggcggcagcgcaaaagatg

SEQ ID NO: 142234 - DNA, 103 bp, Artificial Sequence
  Synthetic Polynucleotide
taatacgactcactatagggggctcctcgggggcctgcatcacagagccgaacagaggagacggctcatggatgcaggcaacctggcggcagcgcaaaagatg

SEQ ID NO: 142235 - DNA, 103 bp, Artificial Sequence
  Synthetic Polynucleotide
taatacgactcactataggggtctggcggcggctcctcgggggcctgcataacagaggagaatgcagatgcccgaggagaacctggcggcagcgcaaaagatg

SEQ ID NO: 142236 - DNA, 103 bp, Artificial Sequence
  Synthetic Polynucleotide
taatacgactcactatagggggaagacctggtctggcggcggctcctcggaacagaggagaccgaggatgcgccgccagaacctggcggcagcgcaaaagatg

SEQ ID NO: 142237 - DNA, 103 bp, Artificial Sequence
  Synthetic Polynucleotide
taatacgactcactatagggtcttgcttgccagcgtgtttccaagggatcaacagaggagagatcccatggaaacacgcaacctggcggcagcgcaaaagatg

SEQ ID NO: 142238 - DNA, 103 bp, Artificial Sequence
  Synthetic Polynucleotide
taatacgactcactatagggggaaacatccggaagacctggtctggcggcaacagaggagagccgccatgccaggtcttaacctggcggcagcgcaaaagatg

SEQ ID NO: 142239 - DNA, 103 bp, Artificial Sequence
  Synthetic Polynucleotide
taatacgactcactatagggacaaatatctggaaacatccggaagacctgaacagaggagacaggtcatgcggatgtttaacctggcggcagcgcaaaagatg

SEQ ID NO: 142240 - DNA, 103 bp, Artificial Sequence
  Synthetic Polynucleotide
taatacgactcactatagggggtgtgaggcacaaatatctggaaacatccaacagaggagaggatgtatgcagatatttaacctggcggcagcgcaaaagatg

SEQ ID NO: 142241 - DNA, 103 bp, Artificial Sequence
  Synthetic Polynucleotide
taatacgactcactatagggaatgatctctggtgtgaggcacaaatatctaacagaggagaagatatatgtgcctcacaaacctggcggcagcgcaaaagatg

SEQ ID NO: 142242 - DNA, 103 bp, Artificial Sequence
  Synthetic Polynucleotide
taatacgactcactatagggttctctgaaaaatgatctctggtgtgaggcaacagaggagagcctcaatgcagagatcaaacctggcggcagcgcaaaagatg

SEQ ID NO: 142243 - DNA, 103 bp, Artificial Sequence
  Synthetic Polynucleotide
taatacgactcactatagggtctgttggttttctctgaaaaatgatctctaacagaggagaagagatatgttttcagagaacctggcggcagcgcaaaagatg

SEQ ID NO: 142244 - DNA, 103 bp, Artificial Sequence
  Synthetic Polynucleotide
taatacgactcactatagggtagacggtgatctgttggttttctctgaaaaacagaggagatttcagatgaaaccaacaaacctggcggcagcgcaaaagatg

SEQ ID NO: 142245 - DNA, 103 bp, Artificial Sequence
  Synthetic Polynucleotide
taatacgactcactatagggctgattataatcttgcttgccagcgtgtttaacagaggagaaaacacatgggcaagcaaaacctggcggcagcgcaaaagatg

SEQ ID NO: 142246 - DNA, 103 bp, Artificial Sequence
  Synthetic Polynucleotide
taatacgactcactatagggcatccacttcctgattataatcttgcttgcaacagaggagagcaagcatgattataatcaacctggcggcagcgcaaaagatg

SEQ ID NO: 142247 - DNA, 103 bp, Artificial Sequence
  Synthetic Polynucleotide
taatacgactcactatagggaaaatggaggcatccacttcctgattataaaacagaggagattataaatgggaagtggaaacctggcggcagcgcaaaagatg

SEQ ID NO: 142248 - DNA, 103 bp, Artificial Sequence
  Synthetic Polynucleotide
taatacgactcactatagggccaggccttaaaaatggaggcatccacttcaacagaggagagaagtgatggcctccattaacctggcggcagcgcaaaagatg

SEQ ID NO: 142249 - DNA, 103 bp, Artificial Sequence
  Synthetic Polynucleotide
taatacgactcactatagggtaaaaactgcccaggccttaaaaatggaggaacagaggagacctccaatgttaaggcctaacctggcggcagcgcaaaagatg

SEQ ID NO: 142250 - DNA, 103 bp, Artificial Sequence
  Synthetic Polynucleotide
taatacgactcactatagggaacttccctttaaaaactgcccaggccttaaacagaggagataaggcatgggcagttttaacctggcggcagcgcaaaagatg

SEQ ID NO: 142251 - DNA, 103 bp, Artificial Sequence
  Synthetic Polynucleotide
taatacgactcactatagggcccttctttaaacttccctttaaaaactgcaacagaggagagcagttatgaaagggaagaacctggcggcagcgcaaaagatg

SEQ ID NO: 142252 - DNA, 103 bp, Artificial Sequence
  Synthetic Polynucleotide
taatacgactcactataggggccactgtcgaagccgccgaccaccattccaacagaggagaggaatgatggtcggcggcaacctggcggcagcgcaaaagatg

SEQ ID NO: 142253 - DNA, 103 bp, Artificial Sequence
  Synthetic Polynucleotide
taatacgactcactatagggcagctttgtccccttctttaaacttcccttaacagaggagaaagggaatgttaaagaagaacctggcggcagcgcaaaagatg

SEQ ID NO: 142254 - DNA, 103 bp, Artificial Sequence
  Synthetic Polynucleotide
taatacgactcactataggggtggctggttcagctttgtccccttctttaaacagaggagataaagaatgggacaaagcaacctggcggcagcgcaaaagatg

SEQ ID NO: 142255 - DNA, 103 bp, Artificial Sequence
  Synthetic Polynucleotide
taatacgactcactatagggcgtcttccaagtggctggttcagctttgtcaacagaggagagacaaaatggaaccagccaacctggcggcagcgcaaaagatg

SEQ ID NO: 142256 - DNA, 103 bp, Artificial Sequence
  Synthetic Polynucleotide
taatacgactcactatagggagcgtaacctcgtcttccaagtggctggttaacagaggagaaaccagatgcttggaagaaacctggcggcagcgcaaaagatg

SEQ ID NO: 142257 - DNA, 103 bp, Artificial Sequence
  Synthetic Polynucleotide
taatacgactcactatagggttcaaagcacagcgtaacctcgtcttccaaaacagaggagattggaaatggaggttacgaacctggcggcagcgcaaaagatg

SEQ ID NO: 142258 - DNA, 103 bp, Artificial Sequence
  Synthetic Polynucleotide
taatacgactcactatagggtgggctcttattcaaagcacagcgtaacctaacagaggagaaggttaatgtgtgctttgaacctggcggcagcgcaaaagatg

SEQ ID NO: 142259 - DNA, 103 bp, Artificial Sequence
  Synthetic Polynucleotide
taatacgactcactatagggcctcaaaatctgggctcttattcaaagcacaacagaggagagtgcttatgataagagccaacctggcggcagcgcaaaagatg

SEQ ID NO: 142260 - DNA, 103 bp, Artificial Sequence
  Synthetic Polynucleotide
taatacgactcactatagggtccgtcacttcctcaaaatctgggctcttaaacagaggagataagagatgagattttgaaacctggcggcagcgcaaaagatg

SEQ ID NO: 142261 - DNA, 103 bp, Artificial Sequence
  Synthetic Polynucleotide
taatacgactcactatagggttgggaccggtccgtcacttcctcaaaatcaacagaggagagattttatggaagtgacgaacctggcggcagcgcaaaagatg

SEQ ID NO: 142262 - DNA, 103 bp, Artificial Sequence
  Synthetic Polynucleotide
taatacgactcactatagggaaatgtccagttgggaccggtccgtcacttaacagaggagaaagtgaatgaccggtcccaacctggcggcagcgcaaaagatg

SEQ ID NO: 142263 - DNA, 103 bp, Artificial Sequence
  Synthetic Polynucleotide
taatacgactcactatagggtgctcgatcagccactgtcgaagccgccgaaacagaggagatcggcgatgtcgacagtgaacctggcggcagcgcaaaagatg

SEQ ID NO: 142264 - DNA, 103 bp, Artificial Sequence
  Synthetic Polynucleotide
taatacgactcactatagggtatggctcggaaatgtccagttgggaccggaacagaggagaccggtcatgactggacataacctggcggcagcgcaaaagatg

SEQ ID NO: 142265 - DNA, 103 bp, Artificial Sequence
  Synthetic Polynucleotide
taatacgactcactataggggtaaactttgtatggctcggaaatgtccagaacagaggagactggacatgtccgagccaaacctggcggcagcgcaaaagatg

SEQ ID NO: 142266 - DNA, 103 bp, Artificial Sequence
  Synthetic Polynucleotide
taatacgactcactataggggaacaattcggtaaactttgtatggctcggaacagaggagaccgagcatgacaaagtttaacctggcggcagcgcaaaagatg

SEQ ID NO: 142267 - DNA, 103 bp, Artificial Sequence
  Synthetic Polynucleotide
taatacgactcactatagggtcttcctcaggaacaattcggtaaactttgaacagaggagacaaagtatgccgaattgtaacctggcggcagcgcaaaagatg

SEQ ID NO: 142268 - DNA, 103 bp, Artificial Sequence
  Synthetic Polynucleotide
taatacgactcactataggggcatttttgctcttcctcaggaacaattcgaacagaggagacgaattatgcctgaggaaaacctggcggcagcgcaaaagatg

SEQ ID NO: 142269 - DNA, 103 bp, Artificial Sequence
  Synthetic Polynucleotide
taatacgactcactatagggcgcctagtttgcatttttgctcttcctcagaacagaggagactgaggatgagcaaaaataacctggcggcagcgcaaaagatg

SEQ ID NO: 142270 - DNA, 103 bp, Artificial Sequence
  Synthetic Polynucleotide
taatacgactcactataggggcagttgccacgcctagtttgcatttttgcaacagaggagagcaaaaatgcaaactaggaacctggcggcagcgcaaaagatg

SEQ ID NO: 142271 - DNA, 103 bp, Artificial Sequence
  Synthetic Polynucleotide
taatacgactcactatagggcacgcagccagcagttgccacgcctagtttaacagaggagaaaactaatggtggcaactaacctggcggcagcgcaaaagatg

SEQ ID NO: 142272 - DNA, 103 bp, Artificial Sequence
  Synthetic Polynucleotide
taatacgactcactatagggtaacttcattcacgcagccagcagttgccaaacagaggagatggcaaatgctggctgcgaacctggcggcagcgcaaaagatg

SEQ ID NO: 142273 - DNA, 103 bp, Artificial Sequence
  Synthetic Polynucleotide
taatacgactcactatagggtccatctctgtaacttcattcacgcagccaaacagaggagatggctgatggaatgaagtaacctggcggcagcgcaaaagatg

SEQ ID NO: 142274 - DNA, 103 bp, Artificial Sequence
  Synthetic Polynucleotide
taatacgactcactatagggactgtcaatctgctcgatcagccactgtcgaacagaggagacgacagatgctgatcgagaacctggcggcagcgcaaaagatg

SEQ ID NO: 142275 - DNA, 103 bp, Artificial Sequence
  Synthetic Polynucleotide
taatacgactcactataggggcgaccgcactccatctctgtaacttcattaacagaggagaaatgaaatgacagagatgaacctggcggcagcgcaaaagatg

SEQ ID NO: 142276 - DNA, 103 bp, Artificial Sequence
  Synthetic Polynucleotide
taatacgactcactatagggcgatttcagagcgaccgcactccatctctgaacagaggagacagagaatgagtgcggtcaacctggcggcagcgcaaaagatg

SEQ ID NO: 142277 - DNA, 103 bp, Artificial Sequence
  Synthetic Polynucleotide
taatacgactcactatagggatcagctcgtcgatttcagagcgaccgcacaacagaggagagtgcggatgctctgaaataacctggcggcagcgcaaaagatg

SEQ ID NO: 142278 - DNA, 103 bp, Artificial Sequence
  Synthetic Polynucleotide
taatacgactcactatagggaggctccttgatcagctcgtcgatttcagaaacagaggagatctgaaatggacgagctgaacctggcggcagcgcaaaagatg

SEQ ID NO: 142279 - DNA, 103 bp, Artificial Sequence
  Synthetic Polynucleotide
taatacgactcactatagggcgtccacagaaggctccttgatcagctcgtaacagaggagaacgagcatgtcaaggagcaacctggcggcagcgcaaaagatg

SEQ ID NO: 142280 - DNA, 103 bp, Artificial Sequence
  Synthetic Polynucleotide
taatacgactcactatagggcccatgtaatcgtccacagaaggctccttgaacagaggagacaaggaatgttctgtggaaacctggcggcagcgcaaaagatg

SEQ ID NO: 142281 - DNA, 103 bp, Artificial Sequence
  Synthetic Polynucleotide
taatacgactcactatagggtttgatcatccccatgtaatcgtccacagaaacagaggagatctgtgatggattacatgaacctggcggcagcgcaaaagatg

SEQ ID NO: 142282 - DNA, 103 bp, Artificial Sequence
  Synthetic Polynucleotide
taatacgactcactatagggaagggctccttttgatcatccccatgtaataacagaggagaattacaatgggatgatcaaacctggcggcagcgcaaaagatg

SEQ ID NO: 142283 - DNA, 103 bp, Artificial Sequence
  Synthetic Polynucleotide
taatacgactcactatagggtccggcggggaagggctccttttgatcatcaacagaggagagatgatatgaaggagcccaacctggcggcagcgcaaaagatg

SEQ ID NO: 142284 - DNA, 103 bp, Artificial Sequence
  Synthetic Polynucleotide
taatacgactcactatagggccgacaggcctccggcggggaagggctcctaacagaggagaaggagcatgtccccgccgaacctggcggcagcgcaaaagatg

SEQ ID NO: 142285 - DNA, 103 bp, Artificial Sequence
  Synthetic Polynucleotide
taatacgactcactataggggatacatgctactgtcaatctgctcgatcaaacagaggagatgatcgatgagattgacaaacctggcggcagcgcaaaagatg

SEQ ID NO: 142286 - DNA, 103 bp, Artificial Sequence
  Synthetic Polynucleotide
taatacgactcactatagggggagctgactccgacaggcctccggcggggaacagaggagaccccgcatgaggcctgtcaacctggcggcagcgcaaaagatg

SEQ ID NO: 142287 - DNA, 103 bp, Artificial Sequence
  Synthetic Polynucleotide
taatacgactcactatagggcagtctggaaggagctgactccgacaggccaacagaggagaggcctgatggagtcagctaacctggcggcagcgcaaaagatg

SEQ ID NO: 142288 - DNA, 103 bp, Artificial Sequence
  Synthetic Polynucleotide
taatacgactcactatagggctgcgcccaccagtctggaaggagctgactaacagaggagaagtcagatgcttccagacaacctggcggcagcgcaaaagatg

SEQ ID NO: 142289 - DNA, 103 bp, Artificial Sequence
  Synthetic Polynucleotide
taatacgactcactatagggtgctgggctgctgcgcccaccagtctggaaaacagaggagattccagatgggtgggcgcaacctggcggcagcgcaaaagatg

SEQ ID NO: 142290 - DNA, 103 bp, Artificial Sequence
  Synthetic Polynucleotide
taatacgactcactatagggggcacgcctgtgctgggctgctgcgcccacaacagaggagagtgggcatggcagcccagaacctggcggcagcgcaaaagatg

SEQ ID NO: 142291 - DNA, 103 bp, Artificial Sequence
  Synthetic Polynucleotide
taatacgactcactatagggcgtcaccagcggcacgcctgtgctgggctgaacagaggagacagcccatgacaggcgtgaacctggcggcagcgcaaaagatg

SEQ ID NO: 142292 - DNA, 103 bp, Artificial Sequence
  Synthetic Polynucleotide
taatacgactcactatagggtggtgtaccccgtcaccagcggcacgcctgaacagaggagacaggcgatgcgctggtgaaacctggcggcagcgcaaaagatg

SEQ ID NO: 142293 - DNA, 103 bp, Artificial Sequence
  Synthetic Polynucleotide
taatacgactcactataggggcgtcgtaggtggtgtaccccgtcaccagcaacagaggagagctggtatgggggtacacaacctggcggcagcgcaaaagatg

SEQ ID NO: 142294 - DNA, 103 bp, Artificial Sequence
  Synthetic Polynucleotide
taatacgactcactatagggtgaatggtgcgcgtcgtaggtggtgtacccaacagaggagagggtacatgacctacgacaacctggcggcagcgcaaaagatg

SEQ ID NO: 142295 - DNA, 103 bp, Artificial Sequence
  Synthetic Polynucleotide
taatacgactcactataggggggagaatgctgaatggtgcgcgtcgtaggaacagaggagacctacgatgcgcaccattaacctggcggcagcgcaaaagatg

SEQ ID NO: 142296 - DNA, 103 bp, Artificial Sequence
  Synthetic Polynucleotide
taatacgactcactatagggatcagtcctggatacatgctactgtcaatcaacagaggagagattgaatgtagcatgtaaacctggcggcagcgcaaaagatg

SEQ ID NO: 142297 - DNA, 103 bp, Artificial Sequence
  Synthetic Polynucleotide
taatacgactcactatagggatcaccatctgggagaatgctgaatggtgcaacagaggagagcaccaatgagcattctcaacctggcggcagcgcaaaagatg

SEQ ID NO: 142298 - DNA, 103 bp, Artificial Sequence
  Synthetic Polynucleotide
taatacgactcactataggggtagaagctgatcaccatctgggagaatgcaacagaggagagcattcatgcagatggtgaacctggcggcagcgcaaaagatg

SEQ ID NO: 142299 - DNA, 103 bp, Artificial Sequence
  Synthetic Polynucleotide
taatacgactcactatagggtgcccccatagtagaagctgatcaccatctaacagaggagaagatggatgtcagcttctaacctggcggcagcgcaaaagatg

SEQ ID NO: 142300 - DNA, 103 bp, Artificial Sequence
  Synthetic Polynucleotide
taatacgactcactatagggcccaccagcttgcccccatagtagaagctgaacagaggagacagcttatgctatgggggaacctggcggcagcgcaaaagatg

SEQ ID NO: 142301 - DNA, 103 bp, Artificial Sequence
  Synthetic Polynucleotide
taatacgactcactatagggggtggcctggcccaccagcttgcccccataaacagaggagatatgggatgaagctggtgaacctggcggcagcgcaaaagatg

SEQ ID NO: 142302 - DNA, 103 bp, Artificial Sequence
  Synthetic Polynucleotide
taatacgactcactatagggggcaggtggtggtggcctggcccaccagctaacagaggagaagctggatggccaggccaaacctggcggcagcgcaaaagatg

SEQ ID NO: 142303 - DNA, 103 bp, Artificial Sequence
  Synthetic Polynucleotide
taatacgactcactatagggcagccctcggggcaggtggtggtggcctggaacagaggagaccaggcatgcaccacctgaacctggcggcagcgcaaaagatg

SEQ ID NO: 142304 - DNA, 103 bp, Artificial Sequence
  Synthetic Polynucleotide
taatacgactcactatagggggacaggcggcagccctcggggcaggtggtaacagaggagaaccaccatgcccgagggcaacctggcggcagcgcaaaagatg

SEQ ID NO: 142305 - DNA, 103 bp, Artificial Sequence
  Synthetic Polynucleotide
taatacgactcactataggggctggctcagggacaggcggcagccctcggaacagaggagaccgaggatggccgcctgtaacctggcggcagcgcaaaagatg

SEQ ID NO: 142306 - DNA, 103 bp, Artificial Sequence
  Synthetic Polynucleotide
taatacgactcactatagggggcagcccaggctggctcagggacaggcggaacagaggagaccgcctatgcctgagccaaacctggcggcagcgcaaaagatg

SEQ ID NO: 142307 - DNA, 103 bp, Artificial Sequence
  Synthetic Polynucleotide
taatacgactcactatagggattctcccaaatcagtcctggatacatgctaacagaggagaagcatgatgccaggactgaacctggcggcagcgcaaaagatg

SEQ ID NO: 142308 - DNA, 103 bp, Artificial Sequence
  Synthetic Polynucleotide
taatacgactcactatagggcttggtgccgggcagcccaggctggctcagaacagaggagactgagcatgcctgggctgaacctggcggcagcgcaaaagatg

SEQ ID NO: 142309 - DNA, 103 bp, Artificial Sequence
  Synthetic Polynucleotide
taatacgactcactataggggcccatacagcttggtgccgggcagcccagaacagaggagactgggcatgccggcaccaaacctggcggcagcgcaaaagatg

SEQ ID NO: 142310 - DNA, 103 bp, Artificial Sequence
  Synthetic Polynucleotide
taatacgactcactatagggaggccctcgggcccatacagcttggtgccgaacagaggagacggcacatggctgtatggaacctggcggcagcgcaaaagatg

SEQ ID NO: 142311 - DNA, 103 bp, Artificial Sequence
  Synthetic Polynucleotide
taatacgactcactatagggcaccagctccaggccctcgggcccatacagaacagaggagactgtatatgcccgagggcaacctggcggcagcgcaaaagatg

SEQ ID NO: 142312 - DNA, 103 bp, Artificial Sequence
  Synthetic Polynucleotide
taatacgactcactataggggcgggaagcgcaccagctccaggccctcggaacagaggagaccgaggatgtggagctggaacctggcggcagcgcaaaagatg

SEQ ID NO: 142313 - DNA, 103 bp, Artificial Sequence
  Synthetic Polynucleotide
taatacgactcactataggggcgtcggccggcgggaagcgcaccagctccaacagaggagaggagctatggcgcttcccaacctggcggcagcgcaaaagatg

SEQ ID NO: 142314 - DNA, 103 bp, Artificial Sequence
  Synthetic Polynucleotide
taatacgactcactataggggctggggatggcgtcggccggcgggaagcgaacagaggagacgcttcatgccggccgacaacctggcggcagcgcaaaagatg

SEQ ID NO: 142315 - DNA, 103 bp, Artificial Sequence
  Synthetic Polynucleotide
taatacgactcactatagggtctgtcgctcgctggggatggcgtcggccgaacagaggagacggccgatgccatccccaaacctggcggcagcgcaaaagatg

SEQ ID NO: 142316 - DNA, 103 bp, Artificial Sequence
  Synthetic Polynucleotide
taatacgactcactataggggtcacctgcctctgtcgctcgctggggatgaacagaggagacatcccatgcgagcgacaaacctggcggcagcgcaaaagatg

SEQ ID NO: 142317 - DNA, 103 bp, Artificial Sequence
  Synthetic Polynucleotide
taatacgactcactatagggcagcttccgcgtcacctgcctctgtcgctcaacagaggagagagcgaatgaggcaggtgaacctggcggcagcgcaaaagatg

SEQ ID NO: 142318 - DNA, 103 bp, Artificial Sequence
  Synthetic Polynucleotide
taatacgactcactatagggtcttctcctcattctcccaaatcagtcctgaacagaggagacaggacatgtttgggagaaacctggcggcagcgcaaaagatg

SEQ ID NO: 142319 - DNA, 103 bp, Artificial Sequence
  Synthetic Polynucleotide
taatacgactcactatagggggtgcccgaacagcttccgcgtcacctgccaacagaggagaggcaggatgcgcggaagcaacctggcggcagcgcaaaagatg

SEQ ID NO: 142320 - DNA, 103 bp, Artificial Sequence
  Synthetic Polynucleotide
taatacgactcactatagggccgcgctccaggtgcccgaacagcttccgcaacagaggagagcggaaatggttcgggcaaacctggcggcagcgcaaaagatg

SEQ ID NO: 142321 - DNA, 103 bp, Artificial Sequence
  Synthetic Polynucleotide
taatacgactcactatagggcagcagcaccccgcgctccaggtgcccgaaaacagaggagattcgggatgctggagcgcaacctggcggcagcgcaaaagatg

SEQ ID NO: 142322 - DNA, 103 bp, Artificial Sequence
  Synthetic Polynucleotide
taatacgactcactatagggggctgctgtgcagcagcaccccgcgctccaaacagaggagatggagcatggggtgctgcaacctggcggcagcgcaaaagatg

SEQ ID NO: 142323 - DNA, 103 bp, Artificial Sequence
  Synthetic Polynucleotide
taatacgactcactatagggacgccctgccggctgctgtgcagcagcaccaacagaggagaggtgctatggcacagcagaacctggcggcagcgcaaaagatg

SEQ ID NO: 142324 - DNA, 103 bp, Artificial Sequence
  Synthetic Polynucleotide
taatacgactcactatagggcttgacgaacacgccctgccggctgctgtgaacagaggagacacagcatgcggcagggcaacctggcggcagcgcaaaagatg

SEQ ID NO: 142325 - DNA, 103 bp, Artificial Sequence
  Synthetic Polynucleotide
taatacgactcactatagggggcacagccgcttgacgaacacgccctgccaacagaggagaggcaggatgtgttcgtcaaacctggcggcagcgcaaaagatg

SEQ ID NO: 142326 - DNA, 103 bp, Artificial Sequence
  Synthetic Polynucleotide
taatacgactcactatagggacgcggccctggcacagccgcttgacgaacaacagaggagagttcgtatggcggctgtgaacctggcggcagcgcaaaagatg

SEQ ID NO: 142327 - DNA, 103 bp, Artificial Sequence
  Synthetic Polynucleotide
taatacgactcactataggggctgcagaacacgcggccctggcacagccgaacagaggagacggctgatgcagggccgcaacctggcggcagcgcaaaagatg

SEQ ID NO: 142328 - DNA, 103 bp, Artificial Sequence
  Synthetic Polynucleotide
taatacgactcactatagggcggcgttgccgctgcagaacacgcggccctaacagaggagaagggccatgtgttctgcaaacctggcggcagcgcaaaagatg

SEQ ID NO: 142329 - DNA, 103 bp, Artificial Sequence
  Synthetic Polynucleotide
taatacgactcactatagggcggaacatgctcttctcctcattctcccaaaacagaggagattgggaatgtgaggagaaaacctggcggcagcgcaaaagatg

SEQ ID NO: 142330 - DNA, 103 bp, Artificial Sequence
  Synthetic Polynucleotide
taatacgactcactatagggttgcacaccacggcgttgccgctgcagaacaacagaggagagttctgatgcggcaacgcaacctggcggcagcgcaaaagatg

SEQ ID NO: 142331 - DNA, 103 bp, Artificial Sequence
  Synthetic Polynucleotide
taatacgactcactataggggggcctgcctttgcacaccacggcgttgccaacagaggagaggcaacatggtggtgtgcaacctggcggcagcgcaaaagatg

SEQ ID NO: 142332 - DNA, 103 bp, Artificial Sequence
  Synthetic Polynucleotide
taatacgactcactatagggccagcttgttgggcctgcctttgcacaccaaacagaggagatggtgtatgaaggcaggcaacctggcggcagcgcaaaagatg

SEQ ID NO: 142333 - DNA, 103 bp, Artificial Sequence
  Synthetic Polynucleotide
taatacgactcactatagggtcatcacgctccagcttgttgggcctgcctaacagaggagaaggcagatgcaacaagctaacctggcggcagcgcaaaagatg

SEQ ID NO: 142334 - DNA, 103 bp, Artificial Sequence
  Synthetic Polynucleotide
taatacgactcactatagggctggaccacctcatcacgctccagcttgttaacagaggagaaacaagatggagcgtgataacctggcggcagcgcaaaagatg

SEQ ID NO: 142335 - DNA, 103 bp, Artificial Sequence
  Synthetic Polynucleotide
taatacgactcactatagggtgtcgaagacctggaccacctcatcacgctaacagaggagaagcgtgatgaggtggtccaacctggcggcagcgcaaaagatg

SEQ ID NO: 142336 - DNA, 103 bp, Artificial Sequence
  Synthetic Polynucleotide
taatacgactcactatagggaactggctggtgtcgaagacctggaccaccaacagaggagaggtggtatgggtcttcgaaacctggcggcagcgcaaaagatg

SEQ ID NO: 142337 - DNA, 103 bp, Artificial Sequence
  Synthetic Polynucleotide
taatacgactcactatagggctctcggaagaactggctggtgtcgaagacaacagaggagagtcttcatgaccagccagaacctggcggcagcgcaaaagatg

SEQ ID NO: 142338 - DNA, 103 bp, Artificial Sequence
  Synthetic Polynucleotide
taatacgactcactatagggactgctgcagctctcggaagaactggctggaacagaggagaccagccatgtcttccgagaacctggcggcagcgcaaaagatg

SEQ ID NO: 142339 - DNA, 103 bp, Artificial Sequence
  Synthetic Polynucleotide
taatacgactcactatagggctgttatagaactgctgcagctctcggaagaacagaggagacttccgatggctgcagcaaacctggcggcagcgcaaaagatg

SEQ ID NO: 142340 - DNA, 103 bp, Artificial Sequence
  Synthetic Polynucleotide
taatacgactcactatagggccagacagctggacctcctgtgtccccctcaacagaggagagaggggatgacaggaggtaacctggcggcagcgcaaaagatg

SEQ ID NO: 142341 - DNA, 103 bp, Artificial Sequence
  Synthetic Polynucleotide
taatacgactcactatagggcttgtagggctcagcaacatccatgcggccaacagaggagaggccgcatggatgttgctaacctggcggcagcgcaaaagatg

SEQ ID NO: 142342 - DNA, 103 bp, Artificial Sequence
  Synthetic Polynucleotide
taatacgactcactatagggactgatacaccttgtagggctcagcaacataacagaggagaatgttgatgagccctacaaacctggcggcagcgcaaaagatg

SEQ ID NO: 142343 - DNA, 103 bp, Artificial Sequence
  Synthetic Polynucleotide
taatacgactcactatagggggtggcagcaactgatacaccttgtagggcaacagaggagagccctaatgggtgtatcaaacctggcggcagcgcaaaagatg

SEQ ID NO: 142344 - DNA, 103 bp, Artificial Sequence
  Synthetic Polynucleotide
taatacgactcactataggggacgattcctggtggcagcaactgatacacaacagaggagagtgtatatgttgctgccaaacctggcggcagcgcaaaagatg

SEQ ID NO: 142345 - DNA, 103 bp, Artificial Sequence
  Synthetic Polynucleotide
taatacgactcactataggggctggccagagacgattcctggtggcagcaaacagaggagatgctgcatgcaggaatcgaacctggcggcagcgcaaaagatg

SEQ ID NO: 142346 - DNA, 103 bp, Artificial Sequence
  Synthetic Polynucleotide
taatacgactcactatagggtgagtccctggctggccagagacgattcctaacagaggagaaggaatatgctctggccaaacctggcggcagcgcaaaagatg

SEQ ID NO: 142347 - DNA, 103 bp, Artificial Sequence
  Synthetic Polynucleotide
taatacgactcactatagggtggtactttctgagtccctggctggccagaaacagaggagatctggcatgccagggactaacctggcggcagcgcaaaagatg

SEQ ID NO: 142348 - DNA, 103 bp, Artificial Sequence
  Synthetic Polynucleotide
taatacgactcactataggggtcgctttgatggtactttctgagtccctgaacagaggagacagggaatgagaaagtacaacctggcggcagcgcaaaagatg

SEQ ID NO: 142349 - DNA, 103 bp, Artificial Sequence
  Synthetic Polynucleotide
taatacgactcactataggggaactgtgctgtcgctttgatggtactttcaacagaggagagaaagtatgatcaaagcgaacctggcggcagcgcaaaagatg

SEQ ID NO: 142350 - DNA, 103 bp, Artificial Sequence
  Synthetic Polynucleotide
taatacgactcactatagggagaggacacagaactgtgctgtcgctttgaaacagaggagatcaaagatgcagcacagtaacctggcggcagcgcaaaagatg

SEQ ID NO: 142351 - DNA, 103 bp, Artificial Sequence
  Synthetic Polynucleotide
taatacgactcactatagggggcgagtcttccagacagctggacctcctgaacagaggagacaggagatgcagctgtctaacctggcggcagcgcaaaagatg

SEQ ID NO: 142352 - DNA, 103 bp, Artificial Sequence
  Synthetic Polynucleotide
taatacgactcactatagggccttcctctcagaggacacagaactgtgctaacagaggagaagcacaatgctgtgtcctaacctggcggcagcgcaaaagatg

SEQ ID NO: 142353 - DNA, 103 bp, Artificial Sequence
  Synthetic Polynucleotide
taatacgactcactatagggtcctcttcctccttcctctcagaggacacaaacagaggagatgtgtcatgtgagaggaaaacctggcggcagcgcaaaagatg

SEQ ID NO: 142354 - DNA, 103 bp, Artificial Sequence
  Synthetic Polynucleotide
taatacgactcactatagggctgcatggcatcctcttcctccttcctctcaacagaggagagagaggatggaggaagagaacctggcggcagcgcaaaagatg

SEQ ID NO: 142355 - DNA, 103 bp, Artificial Sequence
  Synthetic Polynucleotide
taatacgactcactataggggtgtgcagttctgcatggcatcctcttcctaacagaggagaaggaagatgatgccatgcaacctggcggcagcgcaaaagatg

SEQ ID NO: 142356 - DNA, 103 bp, Artificial Sequence
  Synthetic Polynucleotide
taatacgactcactataggggagggactgagtgtgcagttctgcatggcaaacagaggagatgccatatggaactgcacaacctggcggcagcgcaaaagatg

SEQ ID NO: 142357 - DNA, 103 bp, Artificial Sequence
  Synthetic Polynucleotide
taatacgactcactatagggctggagcacagagggactgagtgtgcagttaacagaggagaaactgcatgctcagtcccaacctggcggcagcgcaaaagatg

SEQ ID NO: 142358 - DNA, 103 bp, Artificial Sequence
  Synthetic Polynucleotide
taatacgactcactatagggtgagggagtcctggagcacagagggactgaaacagaggagatcagtcatgctgtgctccaacctggcggcagcgcaaaagatg

SEQ ID NO: 142359 - DNA, 103 bp, Artificial Sequence
  Synthetic Polynucleotide
taatacgactcactatagggtcctcattattgagggagtcctggagcacaaacagaggagatgtgctatgggactccctaacctggcggcagcgcaaaagatg

SEQ ID NO: 142360 - DNA, 103 bp, Artificial Sequence
  Synthetic Polynucleotide
taatacgactcactatagggggccccctcctcctcattattgagggagtcaacagaggagagactccatgaataatgagaacctggcggcagcgcaaaagatg

SEQ ID NO: 142361 - DNA, 103 bp, Artificial Sequence
  Synthetic Polynucleotide
taatacgactcactatagggctcccccactggccccctcctcctcattataacagaggagaataatgatgaggagggggaacctggcggcagcgcaaaagatg

SEQ ID NO: 142362 - DNA, 103 bp, Artificial Sequence
  Synthetic Polynucleotide
taatacgactcactataggggcacagcgcaggcgagtcttccagacagctaacagaggagaagctgtatggaagactcgaacctggcggcagcgcaaaagatg

SEQ ID NO: 142363 - DNA, 103 bp, Artificial Sequence
  Synthetic Polynucleotide
taatacgactcactataggggaatggactgctcccccactggccccctccaacagaggagaggagggatgcagtgggggaacctggcggcagcgcaaaagatg

SEQ ID NO: 142364 - DNA, 103 bp, Artificial Sequence
  Synthetic Polynucleotide
taatacgactcactatagggcccaatgtctgaatggactgctcccccactaacagaggagaagtgggatggcagtccataacctggcggcagcgcaaaagatg

SEQ ID NO: 142365 - DNA, 103 bp, Artificial Sequence
  Synthetic Polynucleotide
taatacgactcactatagggtgctgctgctcccaatgtctgaatggactgaacagaggagacagtccatgcagacattgaacctggcggcagcgcaaaagatg

SEQ ID NO: 142366 - DNA, 103 bp, Artificial Sequence
  Synthetic Polynucleotide
taatacgactcactatagggctgctgctgctgctgctgctcccaatgtctaacagaggagaagacatatggagcagcagaacctggcggcagcgcaaaagatg

SEQ ID NO: 142367 - DNA, 103 bp, Artificial Sequence
  Synthetic Polynucleotide
taatacgactcactatagggtggctcagggctgctgctgctgctgctgctaacagaggagaagcagcatgagcagcagcaacctggcggcagcgcaaaagatg

SEQ ID NO: 142368 - DNA, 103 bp, Artificial Sequence
  Synthetic Polynucleotide
taatacgactcactatagggtaacttcctgtggctcagggctgctgctgcaacagaggagagcagcaatggccctgagcaacctggcggcagcgcaaaagatg

SEQ ID NO: 142369 - DNA, 103 bp, Artificial Sequence
  Synthetic Polynucleotide
taatacgactcactataggggttgtgtctgtaacttcctgtggctcagggaacagaggagaccctgaatgacaggaagtaacctggcggcagcgcaaaagatg

SEQ ID NO: 142370 - DNA, 103 bp, Artificial Sequence
  Synthetic Polynucleotide
taatacgactcactataggggggggcctcagttgtgtctgtaacttcctgaacagaggagacaggaaatgacagacacaaacctggcggcagcgcaaaagatg

SEQ ID NO: 142371 - DNA, 103 bp, Artificial Sequence
  Synthetic Polynucleotide
taatacgactcactatagggccccttgaaagggggcctcagttgtgtctgaacagaggagacagacaatgctgaggcccaacctggcggcagcgcaaaagatg

SEQ ID NO: 142372 - DNA, 103 bp, Artificial Sequence
  Synthetic Polynucleotide
taatacgactcactataggggacctctgatccccttgaaagggggcctcaaacagaggagatgaggcatgctttcaaggaacctggcggcagcgcaaaagatg

SEQ ID NO: 142373 - DNA, 103 bp, Artificial Sequence
  Synthetic Polynucleotide
taatacgactcactatagggcttgttgagtgcacagcgcaggcgagtcttaacagaggagaaagactatgctgcgctgtaacctggcggcagcgcaaaagatg

SEQ ID NO: 142374 - DNA, 103 bp, Artificial Sequence
  Synthetic Polynucleotide
taatacgactcactatagggaaactccagggacctctgatccccttgaaaaacagaggagatttcaaatggatcagaggaacctggcggcagcgcaaaagatg

SEQ ID NO: 142375 - DNA, 103 bp, Artificial Sequence
  Synthetic Polynucleotide
taatacgactcactataggggaggaagcagaaactccagggacctctgataacagaggagaatcagaatgccctggagtaacctggcggcagcgcaaaagatg

SEQ ID NO: 142376 - DNA, 103 bp, Artificial Sequence
  Synthetic Polynucleotide
taatacgactcactatagggtctggctctggaggaagcagaaactccaggaacagaggagacctggaatgtctgcttccaacctggcggcagcgcaaaagatg

SEQ ID NO: 142377 - DNA, 103 bp, Artificial Sequence
  Synthetic Polynucleotide
taatacgactcactatagggcctgaccaagtctggctctggaggaagcagaacagaggagactgcttatgccagagccaaacctggcggcagcgcaaaagatg

SEQ ID NO: 142378 - DNA, 103 bp, Artificial Sequence
  Synthetic Polynucleotide
taatacgactcactatagggcctgaaagtacctgaccaagtctggctctgaacagaggagacagagcatgacttggtcaaacctggcggcagcgcaaaagatg

SEQ ID NO: 142379 - DNA, 103 bp, Artificial Sequence
  Synthetic Polynucleotide
taatacgactcactataggggggcccaggccctgaaagtacctgaccaagaacagaggagacttggtatggtactttcaaacctggcggcagcgcaaaagatg

SEQ ID NO: 142380 - DNA, 103 bp, Artificial Sequence
  Synthetic Polynucleotide
taatacgactcactatagggcttcggtggggggcccaggccctgaaagtaaacagaggagatactttatgggcctgggcaacctggcggcagcgcaaaagatg

SEQ ID NO: 142381 - DNA, 103 bp, Artificial Sequence
  Synthetic Polynucleotide
taatacgactcactatagggttacctggaacttcggtggggggcccaggcaacagaggagagcctggatgccccaccgaaacctggcggcagcgcaaaagatg

SEQ ID NO: 142382 - DNA, 103 bp, Artificial Sequence
  Synthetic Polynucleotide
taatacgactcactatagggaaattcagtgttacctggaacttcggtgggaacagaggagacccaccatggttccaggtaacctggcggcagcgcaaaagatg

SEQ ID NO: 142383 - DNA, 103 bp, Artificial Sequence
  Synthetic Polynucleotide
taatacgactcactatagggctcttcccagaaattcagtgttacctggaaaacagaggagattccagatgacactgaataacctggcggcagcgcaaaagatg

SEQ ID NO: 142384 - DNA, 103 bp, Artificial Sequence
  Synthetic Polynucleotide
taatacgactcactatagggattcagaactcttgttgagtgcacagcgcaaacagaggagatgcgctatgcactcaacaaacctggcggcagcgcaaaagatg

SEQ ID NO: 142385 - DNA, 103 bp, Artificial Sequence
  Synthetic Polynucleotide
taatacgactcactatagggagccatggctctcttcccagaaattcagtgaacagaggagacactgaatgtctgggaagaacctggcggcagcgcaaaagatg

SEQ ID NO: 142386 - DNA, 103 bp, Artificial Sequence
  Synthetic Polynucleotide
taatacgactcactataggggtatggctggagccatggctctcttcccagaacagaggagactgggaatggagccatggaacctggcggcagcgcaaaagatg

SEQ ID NO: 142387 - DNA, 103 bp, Artificial Sequence
  Synthetic Polynucleotide
taatacgactcactatagggattctgtggagtatggctggagccatggctaacagaggagaagccatatgtccagccataacctggcggcagcgcaaaagatg

SEQ ID NO: 142388 - DNA, 103 bp, Artificial Sequence
  Synthetic Polynucleotide
taatacgactcactatagggctgtgataagattctgtggagtatggctggaacagaggagaccagccatgctccacagaaacctggcggcagcgcaaaagatg

SEQ ID NO: 142389 - DNA, 103 bp, Artificial Sequence
  Synthetic Polynucleotide
taatacgactcactatagggtccatcttcactgtgataagattctgtggaaacagaggagatccacaatgtcttatcacaacctggcggcagcgcaaaagatg

SEQ ID NO: 142390 - DNA, 103 bp, Artificial Sequence
  Synthetic Polynucleotide
taatacgactcactatagggaaaggcctgctccatcttcactgtgataagaacagaggagacttatcatggtgaagatgaacctggcggcagcgcaaaagatg

SEQ ID NO: 142391 - DNA, 103 bp, Artificial Sequence
  Synthetic Polynucleotide
taatacgactcactatagggagtatcgggcaaaggcctgctccatcttcaaacagaggagatgaagaatgagcaggcctaacctggcggcagcgcaaaagatg

SEQ ID NO: 142392 - DNA, 103 bp, Artificial Sequence
  Synthetic Polynucleotide
taatacgactcactatagggtgctccagcaagtatcgggcaaaggcctgcaacagaggagagcaggcatgtgcccgataaacctggcggcagcgcaaaagatg

SEQ ID NO: 142393 - DNA, 103 bp, Artificial Sequence
  Synthetic Polynucleotide
taatacgactcactatagggctctggagtctgctccagcaagtatcgggcaacagaggagagcccgaatgttgctggagaacctggcggcagcgcaaaagatg

SEQ ID NO: 142394 - DNA, 103 bp, Artificial Sequence
  Synthetic Polynucleotide
taatacgactcactatagggctgcctgctgctctggagtctgctccagcaaacagaggagatgctggatgagactccagaacctggcggcagcgcaaaagatg

SEQ ID NO: 142395 - DNA, 103 bp, Artificial Sequence
  Synthetic Polynucleotide
taatacgactcactatagggacctccttaaattcagaactcttgttgagtaacagaggagaactcaaatggagttctgaaacctggcggcagcgcaaaagatg

SEQ ID NO: 142396 - DNA, 103 bp, Artificial Sequence
  Synthetic Polynucleotide
taatacgactcactataggggacagaatggctgcctgctgctctggagtcaacagaggagagactccatggcagcaggcaacctggcggcagcgcaaaagatg

SEQ ID NO: 142397 - DNA, 103 bp, Artificial Sequence
  Synthetic Polynucleotide
taatacgactcactatagggctacaccagggacagaatggctgcctgctgaacagaggagacagcagatggccattctgaacctggcggcagcgcaaaagatg

SEQ ID NO: 142398 - DNA, 103 bp, Artificial Sequence
  Synthetic Polynucleotide
taatacgactcactatagggcctctcaggaacctccttaaattcagaactaacagaggagaagttctatgtttaaggagaacctggcggcagcgcaaaagatg

SEQ ID NO: 142399 - DNA, 103 bp, Artificial Sequence
  Synthetic Polynucleotide
taatacgactcactatagggccatgcggcccctctcaggaacctccttaaaacagaggagattaaggatgttcctgagaaacctggcggcagcgcaaaagatg

SEQ ID NO: 142400 - DNA, 103 bp, Artificial Sequence
  Synthetic Polynucleotide
taatacgactcactatagggtcagcaacatccatgcggcccctctcaggaaacagaggagatcctgaatggggccgcataacctggcggcagcgcaaaagatg

SEQ ID NO: 142401 - DNA, 103 bp, Artificial Sequence
  Synthetic Polynucleotide
taatacgactcactatagggtttttttggtggatctcccatgtctcccataacagaggagaatgggaatgatgggagataacctggcggcagcgcaaaagatg

SEQ ID NO: 142402 - DNA, 103 bp, Artificial Sequence
  Synthetic Polynucleotide
taatacgactcactatagggcgcatgccattccaaatccggagaaaccctaacagaggagaagggttatgccggatttgaacctggcggcagcgcaaaagatg

SEQ ID NO: 142403 - DNA, 103 bp, Artificial Sequence
  Synthetic Polynucleotide
taatacgactcactataggggttaggtgtatctggaagttgagaggacataacagaggagaatgtccatgcaacttccaaacctggcggcagcgcaaaagatg

SEQ ID NO: 142404 - DNA, 103 bp, Artificial Sequence
  Synthetic Polynucleotide
taatacgactcactatagggctaccatgctgttaggtgtatctggaagttaacagaggagaaacttcatgatacacctaaacctggcggcagcgcaaaagatg

SEQ ID NO: 142405 - DNA, 103 bp, Artificial Sequence
  Synthetic Polynucleotide
taatacgactcactatagggataggactggctaccatgctgttaggtgtaaacagaggagatacaccatgcagcatggtaacctggcggcagcgcaaaagatg

SEQ ID NO: 142406 - DNA, 103 bp, Artificial Sequence
  Synthetic Polynucleotide
taatacgactcactatagggtcatgcctcaataggactggctaccatgctaacagaggagaagcatgatggccagtcctaacctggcggcagcgcaaaagatg

SEQ ID NO: 142407 - DNA, 103 bp, Artificial Sequence
  Synthetic Polynucleotide
taatacgactcactatagggtcaaacatgccgcatgccattccaaatccgaacagaggagacggattatgaatggcatgaacctggcggcagcgcaaaagatg

SEQ ID NO: 142408 - DNA, 103 bp, Artificial Sequence
  Synthetic Polynucleotide
taatacgactcactatagggtccgcacatttcaaacatgccgcatgccataacagaggagaatggcaatgggcatgtttaacctggcggcagcgcaaaagatg

SEQ ID NO: 142409 - DNA, 103 bp, Artificial Sequence
  Synthetic Polynucleotide
taatacgactcactatagggctgattacactccgcacatttcaaacatgcaacagaggagagcatgtatgaaatgtgcgaacctggcggcagcgcaaaagatg

SEQ ID NO: 142410 - DNA, 103 bp, Artificial Sequence
  Synthetic Polynucleotide
taatacgactcactatagggcgtccaaatactgattacactccgcacattaacagaggagaaatgtgatgagtgtaatcaacctggcggcagcgcaaaagatg

SEQ ID NO: 142411 - DNA, 103 bp, Artificial Sequence
  Synthetic Polynucleotide
taatacgactcactataggggtacagctctcgtccaaatactgattacacaacagaggagagtgtaaatggtatttggaaacctggcggcagcgcaaaagatg

SEQ ID NO: 142412 - DNA, 103 bp, Artificial Sequence
  Synthetic Polynucleotide
taatacgactcactatagggaacaaagcatgtacagctctcgtccaaataaacagaggagatatttgatggagagctgtaacctggcggcagcgcaaaagatg

SEQ ID NO: 142413 - DNA, 103 bp, Artificial Sequence
  Synthetic Polynucleotide
taatacgactcactatagggtcccatccctaacaaagcatgtacagctctaacagaggagaagagctatgcatgctttgaacctggcggcagcgcaaaagatg

SEQ ID NO: 142414 - DNA, 103 bp, Artificial Sequence
  Synthetic Polynucleotide
taatacgactcactatagggcagtaggttttcccatccctaacaaagcataacagaggagaatgcttatgtagggatggaacctggcggcagcgcaaaagatg

SEQ ID NO: 142415 - DNA, 103 bp, Artificial Sequence
  Synthetic Polynucleotide
taatacgactcactatagggatctcttttacagtaggttttcccatccctaacagaggagaagggatatgaaaacctacaacctggcggcagcgcaaaagatg

SEQ ID NO: 142416 - DNA, 103 bp, Artificial Sequence
  Synthetic Polynucleotide
taatacgactcactatagggtcagacgttttttttttggtggatctcccaaacagaggagatgggagatgcaccaaaaaaacctggcggcagcgcaaaagatg

SEQ ID NO: 142417 - DNA, 103 bp, Artificial Sequence
  Synthetic Polynucleotide
taatacgactcactatagggacctgatataatctcttttacagtaggtttaacagaggagaaaacctatggtaaaagagaacctggcggcagcgcaaaagatg

SEQ ID NO: 142418 - DNA, 103 bp, Artificial Sequence
  Synthetic Polynucleotide
taatacgactcactatagggatcccgtacaacctgatataatctcttttaaacagaggagataaaagatgttatatcagaacctggcggcagcgcaaaagatg

SEQ ID NO: 142419 - DNA, 103 bp, Artificial Sequence
  Synthetic Polynucleotide
taatacgactcactatagggggcgcatttgatcccgtacaacctgatataaacagaggagatatatcatgttgtacgggaacctggcggcagcgcaaaagatg

SEQ ID NO: 142420 - DNA, 103 bp, Artificial Sequence
  Synthetic Polynucleotide
taatacgactcactatagggtgctgcacttggcgcatttgatcccgtacaaacagaggagatgtacgatgtcaaatgcgaacctggcggcagcgcaaaagatg

SEQ ID NO: 142421 - DNA, 103 bp, Artificial Sequence
  Synthetic Polynucleotide
taatacgactcactatagggctgaagccgatgctgcacttggcgcatttgaacagaggagacaaatgatgcaagtgcagaacctggcggcagcgcaaaagatg

SEQ ID NO: 142422 - DNA, 103 bp, Artificial Sequence
  Synthetic Polynucleotide
taatacgactcactataggggtcgttcttgctgaagccgatgctgcacttaacagaggagaaagtgcatgatcggcttcaacctggcggcagcgcaaaagatg

SEQ ID NO: 142423 - DNA, 103 bp, Artificial Sequence
  Synthetic Polynucleotide
taatacgactcactataggggcatcacgaagtcgttcttgctgaagccgaaacagaggagatcggctatggcaagaacgaacctggcggcagcgcaaaagatg

SEQ ID NO: 142424 - DNA, 103 bp, Artificial Sequence
  Synthetic Polynucleotide
taatacgactcactataggggagcgggcacgcatcacgaagtcgttcttgaacagaggagacaagaaatgcttcgtgataacctggcggcagcgcaaaagatg

SEQ ID NO: 142425 - DNA, 103 bp, Artificial Sequence
  Synthetic Polynucleotide
taatacgactcactatagggatacaccttggagcgggcacgcatcacgaaaacagaggagattcgtgatgcgtgcccgcaacctggcggcagcgcaaaagatg

SEQ ID NO: 142426 - DNA, 103 bp, Artificial Sequence
  Synthetic Polynucleotide
taatacgactcactatagggactcgatgtgatacaccttggagcgggcacaacagaggagagtgcccatgccaaggtgtaacctggcggcagcgcaaaagatg

SEQ ID NO: 142427 - DNA, 103 bp, Artificial Sequence
  Synthetic Polynucleotide
taatacgactcactatagggcatagggaaatcagacgttttttttttggtaacagaggagaaccaaaatgaaaacgtctaacctggcggcagcgcaaaagatg

SEQ ID NO: 142428 - DNA, 103 bp, Artificial Sequence
  Synthetic Polynucleotide
taatacgactcactatagggcagcggaaacactcgatgtgatacaccttgaacagaggagacaaggtatgtcacatcgaaacctggcggcagcgcaaaagatg

SEQ ID NO: 142429 - DNA, 103 bp, Artificial Sequence
  Synthetic Polynucleotide
taatacgactcactataggggcaggccacacagcggaaacactcgatgtgaacagaggagacacatcatgtgtttccgcaacctggcggcagcgcaaaagatg

SEQ ID NO: 142430 - DNA, 103 bp, Artificial Sequence
  Synthetic Polynucleotide
taatacgactcactataggggctggcggctgcaggccacacagcggaaacaacagaggagagtttccatggtgtggcctaacctggcggcagcgcaaaagatg

SEQ ID NO: 142431 - DNA, 103 bp, Artificial Sequence
  Synthetic Polynucleotide
taatacgactcactatagggccagggatgagctggcggctgcaggccacaaacagaggagatgtggcatgcagccgccaaacctggcggcagcgcaaaagatg

SEQ ID NO: 142432 - DNA, 103 bp, Artificial Sequence
  Synthetic Polynucleotide
taatacgactcactatagggaaattcgtccccagggatgagctggcggctaacagaggagaagccgcatgctcatccctaacctggcggcagcgcaaaagatg

SEQ ID NO: 142433 - DNA, 103 bp, Artificial Sequence
  Synthetic Polynucleotide
taatacgactcactatagggcccgaagcgcaaattcgtccccagggatgaaacagaggagatcatccatggggacgaataacctggcggcagcgcaaaagatg

SEQ ID NO: 142434 - DNA, 103 bp, Artificial Sequence
  Synthetic Polynucleotide
taatacgactcactatagggagaccgtcctcccgaagcgcaaattcgtccaacagaggagaggacgaatgtgcgcttcgaacctggcggcagcgcaaaagatg

SEQ ID NO: 142435 - DNA, 103 bp, Artificial Sequence
  Synthetic Polynucleotide
taatacgactcactatagggtcggcagaagagaccgtcctcccgaagcgcaacagaggagagcgcttatggaggacggtaacctggcggcagcgcaaaagatg

SEQ ID NO: 142436 - DNA, 103 bp, Artificial Sequence
  Synthetic Polynucleotide
taatacgactcactatagggcgtggtctgctcggcagaagagaccgtcctaacagaggagaaggacgatgtcttctgccaacctggcggcagcgcaaaagatg

SEQ ID NO: 142437 - DNA, 103 bp, Artificial Sequence
  Synthetic Polynucleotide
taatacgactcactatagggtccaccacatcgtggtctgctcggcagaagaacagaggagacttctgatgagcagaccaaacctggcggcagcgcaaaagatg

SEQ ID NO: 142438 - DNA, 103 bp, Artificial Sequence
  Synthetic Polynucleotide
taatacgactcactataggggcaaccaacacatagggaaatcagacgtttaacagaggagaaaacgtatgatttccctaaacctggcggcagcgcaaaagatg

SEQ ID NO: 142439 - DNA, 103 bp, Artificial Sequence
  Synthetic Polynucleotide
taatacgactcactatagggactggccctctccaccacatcgtggtctgcaacagaggagagcagacatggatgtggtgaacctggcggcagcgcaaaagatg

SEQ ID NO: 142440 - DNA, 103 bp, Artificial Sequence
  Synthetic Polynucleotide
taatacgactcactatagggcagcgcctagactggccctctccaccacataacagaggagaatgtggatgagagggccaaacctggcggcagcgcaaaagatg

SEQ ID NO: 142441 - DNA, 103 bp, Artificial Sequence
  Synthetic Polynucleotide
taatacgactcactatagggagcgggtcgccagcgcctagactggccctcaacagaggagagagggcatgtctaggcgcaacctggcggcagcgcaaaagatg

SEQ ID NO: 142442 - DNA, 103 bp, Artificial Sequence
  Synthetic Polynucleotide
taatacgactcactatagggcaggggactgagcgggtcgccagcgcctagaacagaggagactaggcatgggcgacccgaacctggcggcagcgcaaaagatg

SEQ ID NO: 142443 - DNA, 103 bp, Artificial Sequence
  Synthetic Polynucleotide
taatacgactcactataggggcgctggatgcaggggactgagcgggtcgcaacagaggagagcgaccatgtcagtccccaacctggcggcagcgcaaaagatg

SEQ ID NO: 142444 - DNA, 103 bp, Artificial Sequence
  Synthetic Polynucleotide
taatacgactcactatagggtgcagtggccgcgctggatgcaggggactgaacagaggagacagtccatggcatccagcaacctggcggcagcgcaaaagatg

SEQ ID NO: 142445 - DNA, 103 bp, Artificial Sequence
  Synthetic Polynucleotide
taatacgactcactatagggcgctgccatttgcagtggccgcgctggatgaacagaggagacatccaatgcggccactgaacctggcggcagcgcaaaagatg

SEQ ID NO: 142446 - DNA, 103 bp, Artificial Sequence
  Synthetic Polynucleotide
taatacgactcactatagggagatgggctccgctgccatttgcagtggccaacagaggagaggccacatgaaatggcagaacctggcggcagcgcaaaagatg

SEQ ID NO: 142447 - DNA, 103 bp, Artificial Sequence
  Synthetic Polynucleotide
taatacgactcactatagggtgcctggcggagatgggctccgctgccattaacagaggagaaatggcatgggagcccataacctggcggcagcgcaaaagatg

SEQ ID NO: 142448 - DNA, 103 bp, Artificial Sequence
  Synthetic Polynucleotide
taatacgactcactatagggcagggctggctgcctggcggagatgggctcaacagaggagagagcccatgtccgccaggaacctggcggcagcgcaaaagatg

SEQ ID NO: 142449 - DNA, 103 bp, Artificial Sequence
  Synthetic Polynucleotide
taatacgactcactatagggtctgattgccgcaaccaacacatagggaaaaacagaggagatttcccatggtgttggttaacctggcggcagcgcaaaagatg

SEQ ID NO: 142450 - DNA, 103 bp, Artificial Sequence
  Synthetic Polynucleotide
taatacgactcactatagggcgtggggccgcagggctggctgcctggcggaacagaggagaccgccaatgagccagcccaacctggcggcagcgcaaaagatg

SEQ ID NO: 142451 - DNA, 103 bp, Artificial Sequence
  Synthetic Polynucleotide
taatacgactcactatagggtgcttgtggacgtggggccgcagggctggcaacagaggagagccagcatggcggccccaaacctggcggcagcgcaaaagatg

SEQ ID NO: 142452 - DNA, 103 bp, Artificial Sequence
  Synthetic Polynucleotide
taatacgactcactatagggcttctccggctgcttgtggacgtggggccgaacagaggagacggcccatggtccacaagaacctggcggcagcgcaaaagatg

SEQ ID NO: 142453 - DNA, 103 bp, Artificial Sequence
  Synthetic Polynucleotide
taatacgactcactatagggcgcgggtggtcttctccggctgcttgtggaaacagaggagatccacaatgagccggagaaacctggcggcagcgcaaaagatg

SEQ ID NO: 142454 - DNA, 103 bp, Artificial Sequence
  Synthetic Polynucleotide
taatacgactcactatagggacagtccgcacgcgggtggtcttctccggcaacagaggagagccggaatggaccacccgaacctggcggcagcgcaaaagatg

SEQ ID NO: 142455 - DNA, 103 bp, Artificial Sequence
  Synthetic Polynucleotide
taatacgactcactatagggctcgttcagcacagtccgcacgcgggtggtaacagaggagaaccaccatggtgcggactaacctggcggcagcgcaaaagatg

SEQ ID NO: 142456 - DNA, 103 bp, Artificial Sequence
  Synthetic Polynucleotide
taatacgactcactataggggcagctgcttctcgttcagcacagtccgcaaacagaggagatgcggaatgtgctgaacgaacctggcggcagcgcaaaagatg

SEQ ID NO: 142457 - DNA, 103 bp, Artificial Sequence
  Synthetic Polynucleotide
taatacgactcactatagggcgcaaggtgtgcagctgcttctcgttcagcaacagaggagagctgaaatggaagcagctaacctggcggcagcgcaaaagatg

SEQ ID NO: 142458 - DNA, 103 bp, Artificial Sequence
  Synthetic Polynucleotide
taatacgactcactataggggtagcaggtccgcaaggtgtgcagctgcttaacagaggagaaagcagatgcacaccttgaacctggcggcagcgcaaaagatg

SEQ ID NO: 142459 - DNA, 103 bp, Artificial Sequence
  Synthetic Polynucleotide
taatacgactcactatagggggtttgcggcgtagcaggtccgcaaggtgtaacagaggagaacacctatgggacctgctaacctggcggcagcgcaaaagatg

SEQ ID NO: 142460 - DNA, 103 bp, Artificial Sequence
  Synthetic Polynucleotide
taatacgactcactatagggtgatcgtgaatctgattgccgcaaccaacaaacagaggagatgttggatgcggcaatcaaacctggcggcagcgcaaaagatg

SEQ ID NO: 142461 - DNA, 103 bp, Artificial Sequence
  Synthetic Polynucleotide
taatacgactcactatagggtctggccgcgggtttgcggcgtagcaggtcaacagaggagagacctgatgcgccgcaaaaacctggcggcagcgcaaaagatg

SEQ ID NO: 142462 - DNA, 103 bp, Artificial Sequence
  Synthetic Polynucleotide
taatacgactcactatagggcatgagcgcatctggccgcgggtttgcggcaacagaggagagccgcaatgccgcggccaaacctggcggcagcgcaaaagatg

SEQ ID NO: 142463 - DNA, 103 bp, Artificial Sequence
  Synthetic Polynucleotide
taatacgactcactataggggttgctccttcatgagcgcatctggccgcgaacagaggagacgcggcatgatgcgctcaaacctggcggcagcgcaaaagatg

SEQ ID NO: 142464 - DNA, 103 bp, Artificial Sequence
  Synthetic Polynucleotide
taatacgactcactatagggatctctaccagttgctccttcatgagcgcaaacagaggagatgcgctatggaaggagcaaacctggcggcagcgcaaaagatg

SEQ ID NO: 142465 - DNA, 103 bp, Artificial Sequence
  Synthetic Polynucleotide
taatacgactcactataggggaggcccgtcatctctaccagttgctccttaacagaggagaaaggagatgctggtagagaacctggcggcagcgcaaaagatg

SEQ ID NO: 142466 - DNA, 103 bp, Artificial Sequence
  Synthetic Polynucleotide
taatacgactcactatagggcacggggactgaggcccgtcatctctaccaaacagaggagatggtagatgtgacgggccaacctggcggcagcgcaaaagatg

SEQ ID NO: 142467 - DNA, 103 bp, Artificial Sequence
  Synthetic Polynucleotide
taatacgactcactatagggacccggatcacacggggactgaggcccgtcaacagaggagagacgggatgcagtccccgaacctggcggcagcgcaaaagatg

SEQ ID NO: 142468 - DNA, 103 bp, Artificial Sequence
  Synthetic Polynucleotide
taatacgactcactatagggttgaaaccagacccggatcacacggggactaacagaggagaagtcccatggtgatccggaacctggcggcagcgcaaaagatg

SEQ ID NO: 142469 - DNA, 103 bp, Artificial Sequence
  Synthetic Polynucleotide
taatacgactcactatagggaccgcttgttttgaaaccagacccggatcaaacagaggagatgatccatgtctggtttcaacctggcggcagcgcaaaagatg

SEQ ID NO: 142470 - DNA, 103 bp, Artificial Sequence
  Synthetic Polynucleotide
taatacgactcactatagggttgtccttgcaccgcttgttttgaaaccagaacagaggagactggttatgaaacaagcgaacctggcggcagcgcaaaagatg

SEQ ID NO: 142471 - DNA, 103 bp, Artificial Sequence
  Synthetic Polynucleotide
taatacgactcactatagggcagaatatactgatcgtgaatctgattgccaacagaggagaggcaatatgattcacgataacctggcggcagcgcaaaagatg

SEQ ID NO: 142472 - DNA, 103 bp, Artificial Sequence
  Synthetic Polynucleotide
taatacgactcactataggggcttcgcttcttgtccttgcaccgcttgttaacagaggagaaacaagatgtgcaaggacaacctggcggcagcgcaaaagatg

SEQ ID NO: 142473 - DNA, 103 bp, Artificial Sequence
  Synthetic Polynucleotide
taatacgactcactatagggtcatcatgatgcttcgcttcttgtccttgcaacagaggagagcaaggatgagaagcgaaaacctggcggcagcgcaaaagatg

SEQ ID NO: 142474 - DNA, 103 bp, Artificial Sequence
  Synthetic Polynucleotide
taatacgactcactatagggtggagttgcttcatcatgatgcttcgcttcaacagaggagagaagcgatgcatcatgataacctggcggcagcgcaaaagatg

SEQ ID NO: 142475 - DNA, 103 bp, Artificial Sequence
  Synthetic Polynucleotide
taatacgactcactatagggctgctgctgctggagttgcttcatcatgataacagaggagaatcatgatgaagcaactcaacctggcggcagcgcaaaagatg

SEQ ID NO: 142476 - DNA, 103 bp, Artificial Sequence
  Synthetic Polynucleotide
taatacgactcactatagggtgtcattgggctgctgctgctggagttgctaacagaggagaagcaacatgagcagcagcaacctggcggcagcgcaaaagatg

SEQ ID NO: 142477 - DNA, 103 bp, Artificial Sequence
  Synthetic Polynucleotide
taatacgactcactatagggatattagttttgtcattgggctgctgctgcaacagaggagagcagcaatggcccaatgaaacctggcggcagcgcaaaagatg

SEQ ID NO: 142478 - DNA, 103 bp, Artificial Sequence
  Synthetic Polynucleotide
taatacgactcactatagggcatcccctggatattagttttgtcattgggaacagaggagacccaatatgaaaactaataacctggcggcagcgcaaaagatg

SEQ ID NO: 142479 - DNA, 103 bp, Artificial Sequence
  Synthetic Polynucleotide
taatacgactcactataggggagttcctgtcatcccctggatattagtttaacagaggagaaaactaatgtccaggggaaacctggcggcagcgcaaaagatg

SEQ ID NO: 142480 - DNA, 103 bp, Artificial Sequence
  Synthetic Polynucleotide
taatacgactcactataggggccaccatgggagttcctgtcatcccctggaacagaggagaccagggatggacaggaacaacctggcggcagcgcaaaagatg

SEQ ID NO: 142481 - DNA, 103 bp, Artificial Sequence
  Synthetic Polynucleotide
taatacgactcactatagggtggactggcagccaccatgggagttcctgtaacagaggagaacaggaatgcccatggtgaacctggcggcagcgcaaaagatg

SEQ ID NO: 142482 - DNA, 103 bp, Artificial Sequence
  Synthetic Polynucleotide
taatacgactcactataggggagaaaccctcagaatatactgatcgtgaaaacagaggagattcacgatgagtatattcaacctggcggcagcgcaaaagatg

SEQ ID NO: 142483 - DNA, 103 bp, Artificial Sequence
  Synthetic Polynucleotide
taatacgactcactatagggcgtgtctctctggactggcagccaccatggaacagaggagaccatggatgctgccagtcaacctggcggcagcgcaaaagatg

SEQ ID NO: 142484 - DNA, 103 bp, Artificial Sequence
  Synthetic Polynucleotide
taatacgactcactatagggaagccaccgtcgtgtctctctggactggcaaacagaggagatgccagatgagagagacaaacctggcggcagcgcaaaagatg

SEQ ID NO: 142485 - DNA, 103 bp, Artificial Sequence
  Synthetic Polynucleotide
taatacgactcactataggggttagcctgtaagccaccgtcgtgtctctcaacagaggagagagagaatggacggtggcaacctggcggcagcgcaaaagatg

SEQ ID NO: 142486 - DNA, 103 bp, Artificial Sequence
  Synthetic Polynucleotide
taatacgactcactatagggcttccactgggttagcctgtaagccaccgtaacagaggagaacggtgatgtacaggctaaacctggcggcagcgcaaaagatg

SEQ ID NO: 142487 - DNA, 103 bp, Artificial Sequence
  Synthetic Polynucleotide
taatacgactcactatagggtaactttgtacttccactgggttagcctgtaacagaggagaacaggcatgcccagtggaaacctggcggcagcgcaaaagatg

SEQ ID NO: 142488 - DNA, 103 bp, Artificial Sequence
  Synthetic Polynucleotide
taatacgactcactatagggaggtggctggtaactttgtacttccactggaacagaggagaccagtgatggtacaaagtaacctggcggcagcgcaaaagatg

SEQ ID NO: 142489 - DNA, 103 bp, Artificial Sequence
  Synthetic Polynucleotide
taatacgactcactataggggtactttccaaggtggctggtaactttgtaaacagaggagatacaaaatgaccagccacaacctggcggcagcgcaaaagatg

SEQ ID NO: 142490 - DNA, 103 bp, Artificial Sequence
  Synthetic Polynucleotide
taatacgactcactatagggaagtcgctcagtactttccaaggtggctggaacagaggagaccagccatgttggaaagtaacctggcggcagcgcaaaagatg

SEQ ID NO: 142491 - DNA, 103 bp, Artificial Sequence
  Synthetic Polynucleotide
taatacgactcactatagggctgcaaggcgaagtcgctcagtactttccaaacagaggagatggaaaatgctgagcgacaacctggcggcagcgcaaaagatg

SEQ ID NO: 142492 - DNA, 103 bp, Artificial Sequence
  Synthetic Polynucleotide
taatacgactcactatagggctatgtcactctgcaaggcgaagtcgctcaaacagaggagatgagcgatgtcgccttgcaacctggcggcagcgcaaaagatg

SEQ ID NO: 142493 - DNA, 103 bp, Artificial Sequence
  Synthetic Polynucleotide
taatacgactcactatagggtccaaatccggagaaaccctcagaatatacaacagaggagagtatatatggagggtttcaacctggcggcagcgcaaaagatg

SEQ ID NO: 142494 - DNA, 103 bp, Artificial Sequence
  Synthetic Polynucleotide
taatacgactcactataggggcaggctgatctatgtcactctgcaaggcgaacagaggagacgccttatggagtgacataacctggcggcagcgcaaaagatg

SEQ ID NO: 142495 - DNA, 103 bp, Artificial Sequence
  Synthetic Polynucleotide
taatacgactcactatagggttgctgaaaagcaggctgatctatgtcactaacagaggagaagtgacatggatcagcctaacctggcggcagcgcaaaagatg

SEQ ID NO: 142496 - DNA, 103 bp, Artificial Sequence
  Synthetic Polynucleotide
taatacgactcactatagggaattgaccagttgctgaaaagcaggctgataacagaggagaatcagcatgcttttcagcaacctggcggcagcgcaaaagatg

SEQ ID NO: 142497 - DNA, 103 bp, Artificial Sequence
  Synthetic Polynucleotide
taatacgactcactatagggccttctgaaaaattgaccagttgctgaaaaaacagaggagattttcaatgactggtcaaaacctggcggcagcgcaaaagatg

SEQ ID NO: 142498 - DNA, 103 bp, Artificial Sequence
  Synthetic Polynucleotide
taatacgactcactataggggcccggtcctccttctgaaaaattgaccagaacagaggagactggtcatgttttcagaaaacctggcggcagcgcaaaagatg

SEQ ID NO: 142499 - DNA, 103 bp, Artificial Sequence
  Synthetic Polynucleotide
taatacgactcactatagggtggaattagagcccggtcctccttctgaaaaacagaggagatttcagatggaggaccggaacctggcggcagcgcaaaagatg

SEQ ID NO: 142500 - DNA, 103 bp, Artificial Sequence
  Synthetic Polynucleotide
taatacgactcactatagggtcactgccagtggaattagagcccggtcctaacagaggagaaggaccatgctctaattcaacctggcggcagcgcaaaagatg

SEQ ID NO: 142501 - DNA, 103 bp, Artificial Sequence
  Synthetic Polynucleotide
taatacgactcactatagggtgatgctacttcactgccagtggaattagaaacagaggagatctaatatgactggcagtaacctggcggcagcgcaaaagatg

SEQ ID NO: 142502 - DNA, 103 bp, Artificial Sequence
  Synthetic Polynucleotide
taatacgactcactataggggagaggacattgatgctacttcactgccagaacagaggagactggcaatgaagtagcataacctggcggcagcgcaaaagatg

SEQ ID NO: 142503 - DNA, 103 bp, Artificial Sequence
  Synthetic Polynucleotide
taatacgactcactatagggtctggaagttgagaggacattgatgctactaacagaggagaagtagcatgaatgtcctcaacctggcggcagcgcaaaagatg

SEQ ID NO: 142504 - DNA, 103 bp, Artificial Sequence
  Synthetic Polynucleotide
taatacgactcactataggggatattcctcttgggtctttccttgctcataacagaggagaatgagcatggaaagacccaacctggcggcagcgcaaaagatg

SEQ ID NO: 142505 - DNA, 103 bp, Artificial Sequence
  Synthetic Polynucleotide
taatacgactcactataggggaactccttcagagacaaataaaggactttaacagaggagaaaagtcatgtatttgtctaacctggcggcagcgcaaaagatg

SEQ ID NO: 142506 - DNA, 103 bp, Artificial Sequence
  Synthetic Polynucleotide
taatacgactcactatagggggcagtgtacttcacagttttggatggtgaaacagaggagatcaccaatgaaaactgtgaacctggcggcagcgcaaaagatg

SEQ ID NO: 142507 - DNA, 103 bp, Artificial Sequence
  Synthetic Polynucleotide
taatacgactcactatagggtcgtcaccgtggcagtgtacttcacagtttaacagaggagaaaactgatgagtacactgaacctggcggcagcgcaaaagatg

SEQ ID NO: 142508 - DNA, 103 bp, Artificial Sequence
  Synthetic Polynucleotide
taatacgactcactatagggacagcccccttcgtcaccgtggcagtgtacaacagaggagagtacacatgcacggtgacaacctggcggcagcgcaaaagatg

SEQ ID NO: 142509 - DNA, 103 bp, Artificial Sequence
  Synthetic Polynucleotide
taatacgactcactatagggggtgtatgtgacagcccccttcgtcaccgtaacagaggagaacggtgatgaagggggctaacctggcggcagcgcaaaagatg

SEQ ID NO: 142510 - DNA, 103 bp, Artificial Sequence
  Synthetic Polynucleotide
taatacgactcactatagggtcttggctttggtgtatgtgacagccccctaacagaggagaagggggatgtcacatacaaacctggcggcagcgcaaaagatg

SEQ ID NO: 142511 - DNA, 103 bp, Artificial Sequence
  Synthetic Polynucleotide
taatacgactcactatagggaccagttctctcttggctttggtgtatgtgaacagaggagacacataatgcaaagccaaaacctggcggcagcgcaaaagatg

SEQ ID NO: 142512 - DNA, 103 bp, Artificial Sequence
  Synthetic Polynucleotide
taatacgactcactatagggggtgtccttgaccagttctctcttggctttaacagaggagaaaagccatgagagaactgaacctggcggcagcgcaaaagatg

SEQ ID NO: 142513 - DNA, 103 bp, Artificial Sequence
  Synthetic Polynucleotide
taatacgactcactataggggattgggtttggtgtccttgaccagttctcaacagaggagagagaacatgtcaaggacaaacctggcggcagcgcaaaagatg

SEQ ID NO: 142514 - DNA, 103 bp, Artificial Sequence
  Synthetic Polynucleotide
taatacgactcactatagggggcttgtggtgattgggtttggtgtccttgaacagaggagacaaggaatgcaaacccaaaacctggcggcagcgcaaaagatg

SEQ ID NO: 142515 - DNA, 103 bp, Artificial Sequence
  Synthetic Polynucleotide
taatacgactcactatagggagcggaactgggcttgtggtgattgggtttaacagaggagaaaacccatgcaccacaagaacctggcggcagcgcaaaagatg

SEQ ID NO: 142516 - DNA, 103 bp, Artificial Sequence
  Synthetic Polynucleotide
taatacgactcactataggggggaattcttgaactccttcagagacaaataacagaggagaatttgtatgtgaaggagtaacctggcggcagcgcaaaagatg

SEQ ID NO: 142517 - DNA, 103 bp, Artificial Sequence
  Synthetic Polynucleotide
taatacgactcactatagggtgtggttgacagcggaactgggcttgtggtaacagaggagaaccacaatgccagttccgaacctggcggcagcgcaaaagatg

SEQ ID NO: 142518 - DNA, 103 bp, Artificial Sequence
  Synthetic Polynucleotide
taatacgactcactatagggcctgagattgtgtggttgacagcggaactgaacagaggagacagttcatgtgtcaaccaaacctggcggcagcgcaaaagatg

SEQ ID NO: 142519 - DNA, 103 bp, Artificial Sequence
  Synthetic Polynucleotide
taatacgactcactatagggttcagttttccctgagattgtgtggttgacaacagaggagagtcaacatgacaatctcaaacctggcggcagcgcaaaagatg

SEQ ID NO: 142520 - DNA, 103 bp, Artificial Sequence
  Synthetic Polynucleotide
taatacgactcactatagggcattgctactttcagttttccctgagattgaacagaggagacaatctatgggaaaactgaacctggcggcagcgcaaaagatg

SEQ ID NO: 142521 - DNA, 103 bp, Artificial Sequence
  Synthetic Polynucleotide
taatacgactcactatagggcgggtttttgcattgctactttcagttttcaacagaggagagaaaacatgaagtagcaaaacctggcggcagcgcaaaagatg

SEQ ID NO: 142522 - DNA, 103 bp, Artificial Sequence
  Synthetic Polynucleotide
taatacgactcactatagggcacctgtttgcgggtttttgcattgctactaacagaggagaagtagcatggcaaaaaccaacctggcggcagcgcaaaagatg

SEQ ID NO: 142523 - DNA, 103 bp, Artificial Sequence
  Synthetic Polynucleotide
taatacgactcactatagggcgagggatagcacctgtttgcgggtttttgaacagaggagacaaaaaatggcaaacaggaacctggcggcagcgcaaaagatg

SEQ ID NO: 142524 - DNA, 103 bp, Artificial Sequence
  Synthetic Polynucleotide
taatacgactcactataggggacgcccccccgagggatagcacctgtttgaacagaggagacaaacaatggctatccctaacctggcggcagcgcaaaagatg

SEQ ID NO: 142525 - DNA, 103 bp, Artificial Sequence
  Synthetic Polynucleotide
taatacgactcactatagggagtggacttggacgcccccccgagggatagaacagaggagactatccatggggggggcgaacctggcggcagcgcaaaagatg

SEQ ID NO: 142526 - DNA, 103 bp, Artificial Sequence
  Synthetic Polynucleotide
taatacgactcactatagggcggcgggcccagtggacttggacgccccccaacagaggagaggggggatgccaagtccaaacctggcggcagcgcaaaagatg

SEQ ID NO: 142527 - DNA, 103 bp, Artificial Sequence
  Synthetic Polynucleotide
taatacgactcactatagggtgcctcttctgggaattcttgaactccttcaacagaggagagaaggaatgcaagaattcaacctggcggcagcgcaaaagatg

SEQ ID NO: 142528 - DNA, 103 bp, Artificial Sequence
  Synthetic Polynucleotide
taatacgactcactatagggaggccattgacggcgggcccagtggacttgaacagaggagacaagtcatgtgggcccgcaacctggcggcagcgcaaaagatg

SEQ ID NO: 142529 - DNA, 103 bp, Artificial Sequence
  Synthetic Polynucleotide
taatacgactcactatagggactgaccttgaggccattgacggcgggcccaacagaggagagggcccatggtcaatggcaacctggcggcagcgcaaaagatg

SEQ ID NO: 142530 - DNA, 103 bp, Artificial Sequence
  Synthetic Polynucleotide
taatacgactcactatagggtcaacctgccactgaccttgaggccattgaaacagaggagatcaatgatgtcaaggtcaaacctggcggcagcgcaaaagatg

SEQ ID NO: 142531 - DNA, 103 bp, Artificial Sequence
  Synthetic Polynucleotide
taatacgactcactataggggactttgggttcaacctgccactgaccttgaacagaggagacaaggtatgtggcaggttaacctggcggcagcgcaaaagatg

SEQ ID NO: 142532 - DNA, 103 bp, Artificial Sequence
  Synthetic Polynucleotide
taatacgactcactatagggcttagtgcatgactttgggttcaacctgccaacagaggagaggcaggatgaacccaaagaacctggcggcagcgcaaaagatg

SEQ ID NO: 142533 - DNA, 103 bp, Artificial Sequence
  Synthetic Polynucleotide
taatacgactcactatagggcccccacctccttagtgcatgactttgggtaacagaggagaacccaaatgcatgcactaaacctggcggcagcgcaaaagatg

SEQ ID NO: 142534 - DNA, 103 bp, Artificial Sequence
  Synthetic Polynucleotide
taatacgactcactatagggagctgccgcccccccacctccttagtgcataacagaggagaatgcacatgggaggtgggaacctggcggcagcgcaaaagatg

SEQ ID NO: 142535 - DNA, 103 bp, Artificial Sequence
  Synthetic Polynucleotide
taatacgactcactataggggccctcccgcagctgccgcccccccacctcaacagaggagagaggtgatggggcggcagaacctggcggcagcgcaaaagatg

SEQ ID NO: 142536 - DNA, 103 bp, Artificial Sequence
  Synthetic Polynucleotide
taatacgactcactataggggcagctgcaggccctcccgcagctgccgccaacagaggagaggcggcatgtgcgggaggaacctggcggcagcgcaaaagatg

SEQ ID NO: 142537 - DNA, 103 bp, Artificial Sequence
  Synthetic Polynucleotide
taatacgactcactatagggagcccctcccgcagctgcaggccctcccgcaacagaggagagcgggaatgcctgcagctaacctggcggcagcgcaaaagatg

SEQ ID NO: 142538 - DNA, 103 bp, Artificial Sequence
  Synthetic Polynucleotide
taatacgactcactatagggttccgcatgctgcctcttctgggaattcttaacagaggagaaagaatatgcagaagaggaacctggcggcagcgcaaaagatg

SEQ ID NO: 142539 - DNA, 103 bp, Artificial Sequence
  Synthetic Polynucleotide
taatacgactcactatagggggagttccgcagcccctcccgcagctgcagaacagaggagactgcagatgcgggaggggaacctggcggcagcgcaaaagatg

SEQ ID NO: 142540 - DNA, 103 bp, Artificial Sequence
  Synthetic Polynucleotide
taatacgactcactataggggtctcctcttggagttccgcagcccctcccaacagaggagagggaggatgtgcggaactaacctggcggcagcgcaaaagatg

SEQ ID NO: 142541 - DNA, 103 bp, Artificial Sequence
  Synthetic Polynucleotide
taatacgactcactataggggcctcttccagtctcctcttggagttccgcaacagaggagagcggaaatgcaagaggagaacctggcggcagcgcaaaagatg

SEQ ID NO: 142542 - DNA, 103 bp, Artificial Sequence
  Synthetic Polynucleotide
taatacgactcactatagggcgcctggtgtgcctcttccagtctcctcttaacagaggagaaagaggatgctggaagagaacctggcggcagcgcaaaagatg

SEQ ID NO: 142543 - DNA, 103 bp, Artificial Sequence
  Synthetic Polynucleotide
taatacgactcactataggggcggcttctccgcctggtgtgcctcttccaaacagaggagatggaagatgcacaccaggaacctggcggcagcgcaaaagatg

SEQ ID NO: 142544 - DNA, 103 bp, Artificial Sequence
  Synthetic Polynucleotide
taatacgactcactataggggggggcgactgcggcttctccgcctggtgtaacagaggagaacaccaatgggagaagccaacctggcggcagcgcaaaagatg

SEQ ID NO: 142545 - DNA, 103 bp, Artificial Sequence
  Synthetic Polynucleotide
taatacgactcactatagggcatcttcttggggggcgactgcggcttctcaacagaggagagagaagatgcagtcgcccaacctggcggcagcgcaaaagatg

SEQ ID NO: 142546 - DNA, 103 bp, Artificial Sequence
  Synthetic Polynucleotide
taatacgactcactatagggccgcccctttcatcttcttggggggcgactaacagaggagaagtcgcatgccaagaagaaacctggcggcagcgcaaaagatg

SEQ ID NO: 142547 - DNA, 103 bp, Artificial Sequence
  Synthetic Polynucleotide
taatacgactcactataggggcggggccagccgcccctttcatcttcttgaacagaggagacaagaaatggaaaggggcaacctggcggcagcgcaaaagatg

SEQ ID NO: 142548 - DNA, 103 bp, Artificial Sequence
  Synthetic Polynucleotide
taatacgactcactatagggagggccttcggcggggccagccgcccctttaacagaggagaaaagggatggctggccccaacctggcggcagcgcaaaagatg

SEQ ID NO: 142549 - DNA, 103 bp, Artificial Sequence
  Synthetic Polynucleotide
taatacgactcactatagggcagcaatgccttccgcatgctgcctcttctaacagaggagaagaagaatgagcatgcggaacctggcggcagcgcaaaagatg

SEQ ID NO: 142550 - DNA, 103 bp, Artificial Sequence
  Synthetic Polynucleotide
taatacgactcactatagggccttcttgccagggccttcggcggggccagaacagaggagactggccatgccgaaggccaacctggcggcagcgcaaaagatg

SEQ ID NO: 142551 - DNA, 103 bp, Artificial Sequence
  Synthetic Polynucleotide
taatacgactcactatagggtcggccggggccttcttgccagggccttcgaacagaggagacgaaggatgtggcaagaaaacctggcggcagcgcaaaagatg

SEQ ID NO: 142552 - DNA, 103 bp, Artificial Sequence
  Synthetic Polynucleotide
taatacgactcactatagggcagacctctctcggccggggccttcttgccaacagaggagaggcaagatggccccggccaacctggcggcagcgcaaaagatg

SEQ ID NO: 142553 - DNA, 103 bp, Artificial Sequence
  Synthetic Polynucleotide
taatacgactcactataggggtccgttcagcagacctctctcggccggggaacagaggagaccccggatgagagaggtcaacctggcggcagcgcaaaagatg

SEQ ID NO: 142554 - DNA, 103 bp, Artificial Sequence
  Synthetic Polynucleotide
taatacgactcactatagggttcttcacgtgtccgttcagcagacctctcaacagaggagagagaggatggctgaacggaacctggcggcagcgcaaaagatg

SEQ ID NO: 142555 - DNA, 103 bp, Artificial Sequence
  Synthetic Polynucleotide
taatacgactcactatagggcggcacttccttcttcacgtgtccgttcagaacagaggagactgaacatgcacgtgaagaacctggcggcagcgcaaaagatg

SEQ ID NO: 142556 - DNA, 103 bp, Artificial Sequence
  Synthetic Polynucleotide
taatacgactcactataggggactgcgctccggcacttccttcttcacgtaacagaggagaacgtgaatgaggaagtgcaacctggcggcagcgcaaaagatg

SEQ ID NO: 142557 - DNA, 103 bp, Artificial Sequence
  Synthetic Polynucleotide
taatacgactcactatagggttcctctccagactgcgctccggcacttccaacagaggagaggaagtatgggagcgcagaacctggcggcagcgcaaaagatg

SEQ ID NO: 142558 - DNA, 103 bp, Artificial Sequence
  Synthetic Polynucleotide
taatacgactcactatagggcttcggccgattcctctccagactgcgctcaacagaggagagagcgcatgctggagaggaacctggcggcagcgcaaaagatg

SEQ ID NO: 142559 - DNA, 103 bp, Artificial Sequence
  Synthetic Polynucleotide
taatacgactcactatagggccgtggcccgcttcggccgattcctctccaaacagaggagatggagaatgatcggccgaaacctggcggcagcgcaaaagatg

SEQ ID NO: 142560 - DNA, 103 bp, Artificial Sequence
  Synthetic Polynucleotide
taatacgactcactatagggttcaggctcccagcaatgccttccgcatgcaacagaggagagcatgcatgaggcattgcaacctggcggcagcgcaaaagatg

SEQ ID NO: 142561 - DNA, 103 bp, Artificial Sequence
  Synthetic Polynucleotide
taatacgactcactatagggctcttcccggccgtggcccgcttcggccgaaacagaggagatcggccatggcgggccacaacctggcggcagcgcaaaagatg

SEQ ID NO: 142562 - DNA, 103 bp, Artificial Sequence
  Synthetic Polynucleotide
taatacgactcactataggggcctggcgtgctcttcccggccgtggcccgaacagaggagacgggccatggccgggaagaacctggcggcagcgcaaaagatg

SEQ ID NO: 142563 - DNA, 103 bp, Artificial Sequence
  Synthetic Polynucleotide
taatacgactcactataggggtgcttgtctgcctggcgtgctcttcccggaacagaggagaccgggaatggcacgccagaacctggcggcagcgcaaaagatg

SEQ ID NO: 142564 - DNA, 103 bp, Artificial Sequence
  Synthetic Polynucleotide
taatacgactcactataggggccttgccatgtgcttgtctgcctggcgtgaacagaggagacacgccatgcagacaagcaacctggcggcagcgcaaaagatg

SEQ ID NO: 142565 - DNA, 103 bp, Artificial Sequence
  Synthetic Polynucleotide
taatacgactcactatagggggcgctgtccgccttgccatgtgcttgtctaacagaggagaagacaaatgcatggcaagaacctggcggcagcgcaaaagatg

SEQ ID NO: 142566 - DNA, 103 bp, Artificial Sequence
  Synthetic Polynucleotide
taatacgactcactatagggtttcacaggaggcgctgtccgccttgccataacagaggagaatggcaatgcggacagcgaacctggcggcagcgcaaaagatg

SEQ ID NO: 142567 - DNA, 103 bp, Artificial Sequence
  Synthetic Polynucleotide
taatacgactcactataggggtagaacgattttcacaggaggcgctgtccaacagaggagaggacagatgctcctgtgaaacctggcggcagcgcaaaagatg

SEQ ID NO: 142568 - DNA, 103 bp, Artificial Sequence
  Synthetic Polynucleotide
taatacgactcactatagggcggttgcgaggtagaacgattttcacaggaaacagaggagatcctgtatgaatcgttctaacctggcggcagcgcaaaagatg

SEQ ID NO: 142569 - DNA, 103 bp, Artificial Sequence
  Synthetic Polynucleotide
taatacgactcactataggggcacggactccggttgcgaggtagaacgataacagaggagaatcgttatgcctcgcaacaacctggcggcagcgcaaaagatg

SEQ ID NO: 142570 - DNA, 103 bp, Artificial Sequence
  Synthetic Polynucleotide
taatacgactcactatagggtgcggcttgtgcacggactccggttgcgagaacagaggagactcgcaatgggagtccgtaacctggcggcagcgcaaaagatg

SEQ ID NO: 142571 - DNA, 103 bp, Artificial Sequence
  Synthetic Polynucleotide
taatacgactcactatagggattcacagttttcaggctcccagcaatgccaacagaggagaggcattatggggagcctgaacctggcggcagcgcaaaagatg

SEQ ID NO: 142572 - DNA, 103 bp, Artificial Sequence
  Synthetic Polynucleotide
taatacgactcactataggggcccgagtcctgcggcttgtgcacggactcaacagaggagagagtccatgcacaagccgaacctggcggcagcgcaaaagatg

SEQ ID NO: 142573 - DNA, 103 bp, Artificial Sequence
  Synthetic Polynucleotide
taatacgactcactatagggtctcggccttgcccgagtcctgcggcttgtaacagaggagaacaagcatgaggactcggaacctggcggcagcgcaaaagatg

SEQ ID NO: 142574 - DNA, 103 bp, Artificial Sequence
  Synthetic Polynucleotide
taatacgactcactatagggccgccgcccttctcggccttgcccgagtccaacagaggagaggactcatgcaaggccgaaacctggcggcagcgcaaaagatg

SEQ ID NO: 142575 - DNA, 103 bp, Artificial Sequence
  Synthetic Polynucleotide
taatacgactcactatagggcccggccttgccgccgcccttctcggccttaacagaggagaaaggccatgaagggcggcaacctggcggcagcgcaaaagatg

SEQ ID NO: 142576 - DNA, 103 bp, Artificial Sequence
  Synthetic Polynucleotide
taatacgactcactatagggtggccgcccacccggccttgccgccgccctaacagaggagaagggcgatggcaaggccgaacctggcggcagcgcaaaagatg

SEQ ID NO: 142577 - DNA, 103 bp, Artificial Sequence
  Synthetic Polynucleotide
taatacgactcactatagggatctcgtccatggccgcccacccggccttgaacagaggagacaaggcatggtgggcggcaacctggcggcagcgcaaaagatg

SEQ ID NO: 142578 - DNA, 103 bp, Artificial Sequence
  Synthetic Polynucleotide
taatacgactcactataggggaggacggggatctcgtccatggccgcccaaacagaggagatgggcgatgatggacgagaacctggcggcagcgcaaaagatg

SEQ ID NO: 142579 - DNA, 103 bp, Artificial Sequence
  Synthetic Polynucleotide
taatacgactcactatagggcggagggcctgaggacggggatctcgtccaaacagaggagatggacgatgtccccgtccaacctggcggcagcgcaaaagatg

SEQ ID NO: 142580 - DNA, 103 bp, Artificial Sequence
  Synthetic Polynucleotide
taatacgactcactatagggaactccttggcggagggcctgaggacggggaacagaggagaccccgtatgcaggccctcaacctggcggcagcgcaaaagatg

SEQ ID NO: 142581 - DNA, 103 bp, Artificial Sequence
  Synthetic Polynucleotide
taatacgactcactatagggcggatcgtggaactccttggcggagggcctaacagaggagaaggcccatggccaaggagaacctggcggcagcgcaaaagatg

SEQ ID NO: 142582 - DNA, 103 bp, Artificial Sequence
  Synthetic Polynucleotide
taatacgactcactatagggcaaggagcccattcacagttttcaggctccaacagaggagaggagccatgaaactgtgaaacctggcggcagcgcaaaagatg

SEQ ID NO: 142583 - DNA, 103 bp, Artificial Sequence
  Synthetic Polynucleotide
taatacgactcactatagggtgtagatgagcggatcgtggaactccttggaacagaggagaccaaggatgtccacgatcaacctggcggcagcgcaaaagatg

SEQ ID NO: 142584 - DNA, 103 bp, Artificial Sequence
  Synthetic Polynucleotide
taatacgactcactatagggaccgactcgatgtagatgagcggatcgtggaacagaggagaccacgaatggctcatctaaacctggcggcagcgcaaaagatg

SEQ ID NO: 142585 - DNA, 103 bp, Artificial Sequence
  Synthetic Polynucleotide
taatacgactcactatagggctgagcgcggaccgactcgatgtagatgagaacagaggagactcatcatgatcgagtcgaacctggcggcagcgcaaaagatg

SEQ ID NO: 142586 - DNA, 103 bp, Artificial Sequence
  Synthetic Polynucleotide
taatacgactcactatagggacttctccacctgagcgcggaccgactcgaaacagaggagatcgagtatgtccgcgctcaacctggcggcagcgcaaaagatg

SEQ ID NO: 142587 - DNA, 103 bp, Artificial Sequence
  Synthetic Polynucleotide
taatacgactcactatagggcacatcccgaacttctccacctgagcgcggaacagaggagaccgcgcatgggtggagaaaacctggcggcagcgcaaaagatg

SEQ ID NO: 142588 - DNA, 103 bp, Artificial Sequence
  Synthetic Polynucleotide
taatacgactcactataggggatcaccctgcacatcccgaacttctccacaacagaggagagtggagatgttcgggatgaacctggcggcagcgcaaaagatg

SEQ ID NO: 142589 - DNA, 103 bp, Artificial Sequence
  Synthetic Polynucleotide
taatacgactcactatagggccggaggggggatcaccctgcacatcccgaaacagaggagatcgggaatggcagggtgaaacctggcggcagcgcaaaagatg

SEQ ID NO: 142590 - DNA, 103 bp, Artificial Sequence
  Synthetic Polynucleotide
taatacgactcactatagggggccgccagtccggaggggggatcaccctgaacagaggagacagggtatgcccccctccaacctggcggcagcgcaaaagatg

SEQ ID NO: 142591 - DNA, 103 bp, Artificial Sequence
  Synthetic Polynucleotide
taatacgactcactatagggcttgcactcgggccgccagtccggagggggaacagaggagaccccctatggactggcggaacctggcggcagcgcaaaagatg

SEQ ID NO: 142592 - DNA, 103 bp, Artificial Sequence
  Synthetic Polynucleotide
taatacgactcactatagggcatcgttgagcttgcactcgggccgccagtaacagaggagaactggcatgccgagtgcaaacctggcggcagcgcaaaagatg

SEQ ID NO: 142593 - DNA, 103 bp, Artificial Sequence
  Synthetic Polynucleotide
taatacgactcactatagggtggtcattaccaaggagcccattcacagttaacagaggagaaactgtatgtgggctcctaacctggcggcagcgcaaaagatg

SEQ ID NO: 142594 - DNA, 103 bp, Artificial Sequence
  Synthetic Polynucleotide
taatacgactcactatagggaaccgcatctcatcgttgagcttgcactcgaacagaggagacgagtgatggctcaacgaaacctggcggcagcgcaaaagatg

SEQ ID NO: 142595 - DNA, 103 bp, Artificial Sequence
  Synthetic Polynucleotide
taatacgactcactatagggctgcgtgacaaaccgcatctcatcgttgagaacagaggagactcaacatggagatgcggaacctggcggcagcgcaaaagatg

SEQ ID NO: 142596 - DNA, 103 bp, Artificial Sequence
  Synthetic Polynucleotide
taatacgactcactatagggtgtgctgaatctgcgtgacaaaccgcatctaacagaggagaagatgcatgttgtcacgcaacctggcggcagcgcaaaagatg

SEQ ID NO: 142597 - DNA, 103 bp, Artificial Sequence
  Synthetic Polynucleotide
taatacgactcactatagggagcttgtggatgtgctgaatctgcgtgacaaacagaggagatgtcacatggattcagcaaacctggcggcagcgcaaaagatg

SEQ ID NO: 142598 - DNA, 103 bp, Artificial Sequence
  Synthetic Polynucleotide
taatacgactcactataggggcgccggcccagcttgtggatgtgctgaataacagaggagaattcagatgatccacaagaacctggcggcagcgcaaaagatg

SEQ ID NO: 142599 - DNA, 103 bp, Artificial Sequence
  Synthetic Polynucleotide
taatacgactcactatagggtggggccccagcgccggcccagcttgtggaaacagaggagatccacaatgtgggccggcaacctggcggcagcgcaaaagatg

SEQ ID NO: 142600 - DNA, 103 bp, Artificial Sequence
  Synthetic Polynucleotide
taatacgactcactatagggcgctgcacgttggggccccagcgccggcccaacagaggagagggccgatgctggggcccaacctggcggcagcgcaaaagatg

SEQ ID NO: 142601 - DNA, 103 bp, Artificial Sequence
  Synthetic Polynucleotide
taatacgactcactataggggcaggccagccgctgcacgttggggccccaaacagaggagatggggcatgaacgtgcagaacctggcggcagcgcaaaagatg

SEQ ID NO: 142602 - DNA, 103 bp, Artificial Sequence
  Synthetic Polynucleotide
taatacgactcactataggggcttcttgatgcaggccagccgctgcacgtaacagaggagaacgtgcatgggctggcctaacctggcggcagcgcaaaagatg

SEQ ID NO: 142603 - DNA, 103 bp, Artificial Sequence
  Synthetic Polynucleotide
taatacgactcactataggggatttgaggtgcttcttgatgcaggccagcaacagaggagagctggcatgcatcaagaaaacctggcggcagcgcaaaagatg

SEQ ID NO: 142604 - DNA, 103 bp, Artificial Sequence
  Synthetic Polynucleotide
taatacgactcactatagggtcccttagactggtcattaccaaggagcccaacagaggagagggctcatgggtaatgacaacctggcggcagcgcaaaagatg

SEQ ID NO: 142605 - DNA, 103 bp, Artificial Sequence
  Synthetic Polynucleotide
taatacgactcactataggggatgccctgagatttgaggtgcttcttgataacagaggagaatcaagatgcacctcaaaaacctggcggcagcgcaaaagatg

SEQ ID NO: 142606 - DNA, 103 bp, Artificial Sequence
  Synthetic Polynucleotide
taatacgactcactatagggcgtccatggtgatgccctgagatttgaggtaacagaggagaacctcaatgctcagggcaaacctggcggcagcgcaaaagatg

SEQ ID NO: 142607 - DNA, 103 bp, Artificial Sequence
  Synthetic Polynucleotide
taatacgactcactatagggagcgggagctcgtccatggtgatgccctgaaacagaggagatcagggatgcaccatggaaacctggcggcagcgcaaaagatg

SEQ ID NO: 142608 - DNA, 103 bp, Artificial Sequence
  Synthetic Polynucleotide
taatacgactcactataggggccccctatgagcgggagctcgtccatggtaacagaggagaaccatgatggagctcccgaacctggcggcagcgcaaaagatg

SEQ ID NO: 142609 - DNA, 103 bp, Artificial Sequence
  Synthetic Polynucleotide
taatacgactcactatagggcgagctcacagccccctatgagcgggagctaacagaggagaagctccatgtcataggggaacctggcggcagcgcaaaagatg

SEQ ID NO: 142610 - DNA, 103 bp, Artificial Sequence
  Synthetic Polynucleotide
taatacgactcactatagggcaggccaggtcgagctcacagccccctatgaacagaggagacataggatgctgtgagctaacctggcggcagcgcaaaagatg

SEQ ID NO: 142611 - DNA, 103 bp, Artificial Sequence
  Synthetic Polynucleotide
taatacgactcactatagggccggaaaaagcaggccaggtcgagctcacaaacagaggagatgtgagatggacctggccaacctggcggcagcgcaaaagatg

SEQ ID NO: 142612 - DNA, 103 bp, Artificial Sequence
  Synthetic Polynucleotide
taatacgactcactatagggcattaatcagccggaaaaagcaggccaggtaacagaggagaacctggatggctttttccaacctggcggcagcgcaaaagatg

SEQ ID NO: 142613 - DNA, 103 bp, Artificial Sequence
  Synthetic Polynucleotide
taatacgactcactatagggccgcccatctcattaatcagccggaaaaagaacagaggagactttttatggctgattaaaacctggcggcagcgcaaaagatg

SEQ ID NO: 142614 - DNA, 103 bp, Artificial Sequence
  Synthetic Polynucleotide
taatacgactcactatagggttgctgcatgccgcccatctcattaatcagaacagaggagactgattatggagatgggcaacctggcggcagcgcaaaagatg

SEQ ID NO: 142615 - DNA, 103 bp, Artificial Sequence
  Synthetic Polynucleotide
taatacgactcactatagggtcttctgaatgatattcctcttgggtctttaacagaggagaaaagacatgagaggaataaacctggcggcagcgcaaaagatg

SEQ ID NO: 142616 - DNA, 103 bp, Artificial Sequence
  Synthetic Polynucleotide
taatacgactcactatagggctggtcctaatcccttagactggtcattacaacagaggagagtaatgatgagtctaaggaacctggcggcagcgcaaaagatg

SEQ ID NO: 142617 - DNA, 103 bp, Artificial Sequence
  Synthetic Polynucleotide
taatacgactcactatagggggtcagtcacttgctgcatgccgcccatctaacagaggagaagatggatggcatgcagcaacctggcggcagcgcaaaagatg

SEQ ID NO: 142618 - DNA, 103 bp, Artificial Sequence
  Synthetic Polynucleotide
taatacgactcactatagggcattttttgaggtcagtcacttgctgcatgaacagaggagacatgcaatgagtgactgaaacctggcggcagcgcaaaagatg

SEQ ID NO: 142619 - DNA, 103 bp, Artificial Sequence
  Synthetic Polynucleotide
taatacgactcactatagggtagtttgttccattttttgaggtcagtcacaacagaggagagtgactatgctcaaaaaaaacctggcggcagcgcaaaagatg

SEQ ID NO: 142620 - DNA, 103 bp, Artificial Sequence
  Synthetic Polynucleotide
taatacgactcactataggggcatgtctgctagtttgttccattttttgaaacagaggagatcaaaaatgggaacaaacaacctggcggcagcgcaaaagatg

SEQ ID NO: 142621 - DNA, 103 bp, Artificial Sequence
  Synthetic Polynucleotide
taatacgactcactataggggggatgcgcagcatgtctgctagtttgttcaacagaggagagaacaaatgagcagacataacctggcggcagcgcaaaagatg

SEQ ID NO: 142622 - DNA, 103 bp, Artificial Sequence
  Synthetic Polynucleotide
taatacgactcactatagggggcagttctggggatgcgcagcatgtctgcaacagaggagagcagacatgctgcgcatcaacctggcggcagcgcaaaagatg

SEQ ID NO: 142623 - DNA, 103 bp, Artificial Sequence
  Synthetic Polynucleotide
taatacgactcactataggggccggtcctgggcagttctggggatgcgcaaacagaggagatgcgcaatgccagaactgaacctggcggcagcgcaaaagatg

SEQ ID NO: 142624 - DNA, 103 bp, Artificial Sequence
  Synthetic Polynucleotide
taatacgactcactatagggagcttggccagccggtcctgggcagttctgaacagaggagacagaacatgccaggaccgaacctggcggcagcgcaaaagatg

SEQ ID NO: 142625 - DNA, 103 bp, Artificial Sequence
  Synthetic Polynucleotide
taatacgactcactatagggggcctcctgcagcttggccagccggtcctgaacagaggagacaggacatgctggccaagaacctggcggcagcgcaaaagatg

SEQ ID NO: 142626 - DNA, 103 bp, Artificial Sequence
  Synthetic Polynucleotide
taatacgactcactatagggactggcagtaggcctcctgcagcttggccaaacagaggagatggccaatgtgcaggaggaacctggcggcagcgcaaaagatg

SEQ ID NO: 142627 - DNA, 103 bp, Artificial Sequence
  Synthetic Polynucleotide
taatacgactcactatagggtgttctgatgctggtcctaatcccttagacaacagaggagagtctaaatgattaggaccaacctggcggcagcgcaaaagatg

SEQ ID NO: 142628 - DNA, 103 bp, Artificial Sequence
  Synthetic Polynucleotide
taatacgactcactataggggagagtaggtactggcagtaggcctcctgcaacagaggagagcaggaatgctactgccaaacctggcggcagcgcaaaagatg

SEQ ID NO: 142629 - DNA, 103 bp, Artificial Sequence
  Synthetic Polynucleotide
taatacgactcactatagggggagtcgtaggagagtaggtactggcagtaaacagaggagatactgcatgtacctactcaacctggcggcagcgcaaaagatg

SEQ ID NO: 142630 - DNA, 103 bp, Artificial Sequence
  Synthetic Polynucleotide
taatacgactcactatagggctggggacagggagtcgtaggagagtaggtaacagaggagaacctacatgcctacgactaacctggcggcagcgcaaaagatg

SEQ ID NO: 142631 - DNA, 103 bp, Artificial Sequence
  Synthetic Polynucleotide
taatacgactcactatagggcggtgctcctctggggacagggagtcgtagaacagaggagactacgaatgcctgtccccaacctggcggcagcgcaaaagatg

SEQ ID NO: 142632 - DNA, 103 bp, Artificial Sequence
  Synthetic Polynucleotide
taatacgactcactatagggctccagccgccggtgctcctctggggacagaacagaggagactgtccatggaggagcacaacctggcggcagcgcaaaagatg

SEQ ID NO: 142633 - DNA, 103 bp, Artificial Sequence
  Synthetic Polynucleotide
taatacgactcactataggggcacctccttctccagccgccggtgctcctaacagaggagaaggagcatgggcggctggaacctggcggcagcgcaaaagatg

SEQ ID NO: 142634 - DNA, 103 bp, Artificial Sequence
  Synthetic Polynucleotide
taatacgactcactatagggttctccatcagcacctccttctccagccgcaacagaggagagcggctatggaaggaggtaacctggcggcagcgcaaaagatg

SEQ ID NO: 142635 - DNA, 103 bp, Artificial Sequence
  Synthetic Polynucleotide
taatacgactcactatagggcaggatctccttctccatcagcacctccttaacagaggagaaaggagatgctgatggagaacctggcggcagcgcaaaagatg

SEQ ID NO: 142636 - DNA, 103 bp, Artificial Sequence
  Synthetic Polynucleotide
taatacgactcactatagggtgcgcttctccaggatctccttctccatcaaacagaggagatgatggatgaggagatccaacctggcggcagcgcaaaagatg

SEQ ID NO: 142637 - DNA, 103 bp, Artificial Sequence
  Synthetic Polynucleotide
taatacgactcactatagggagcggccccttgcgcttctccaggatctccaacagaggagaggagatatgggagaagcgaacctggcggcagcgcaaaagatg

SEQ ID NO: 142638 - DNA, 103 bp, Artificial Sequence
  Synthetic Polynucleotide
taatacgactcactatagggattctctgactgttctgatgctggtcctaaaacagaggagattaggaatggcatcagaaaacctggcggcagcgcaaaagatg

SEQ ID NO: 142639 - DNA, 103 bp, Artificial Sequence
  Synthetic Polynucleotide
taatacgactcactataggggtggccttccagcggccccttgcgcttctcaacagaggagagagaagatgaaggggccgaacctggcggcagcgcaaaagatg

SEQ ID NO: 142640 - DNA, 103 bp, Artificial Sequence
  Synthetic Polynucleotide
taatacgactcactatagggcgttctctgtgtggccttccagcggcccctaacagaggagaaggggcatgtggaaggccaacctggcggcagcgcaaaagatg

SEQ ID NO: 142641 - DNA, 103 bp, Artificial Sequence
  Synthetic Polynucleotide
taatacgactcactatagggttgtggtggtcgttctctgtgtggccttccaacagaggagaggaaggatgcacagagaaaacctggcggcagcgcaaaagatg

SEQ ID NO: 142642 - DNA, 103 bp, Artificial Sequence
  Synthetic Polynucleotide
taatacgactcactatagggagggtggaacttgtggtggtcgttctctgtaacagaggagaacagagatggaccaccacaacctggcggcagcgcaaaagatg

SEQ ID NO: 142643 - DNA, 103 bp, Artificial Sequence
  Synthetic Polynucleotide
taatacgactcactatagggagcggggcagagggtggaacttgtggtggtaacagaggagaaccaccatgagttccaccaacctggcggcagcgcaaaagatg

SEQ ID NO: 142644 - DNA, 103 bp, Artificial Sequence
  Synthetic Polynucleotide
taatacgactcactatagggttgggctcgaagcggggcagagggtggaacaacagaggagagttccaatgtctgccccgaacctggcggcagcgcaaaagatg

SEQ ID NO: 142645 - DNA, 103 bp, Artificial Sequence
  Synthetic Polynucleotide
taatacgactcactataggggagcccattcttgggctcgaagcggggcagaacagaggagactgcccatgttcgagcccaacctggcggcagcgcaaaagatg

SEQ ID NO: 142646 - DNA, 103 bp, Artificial Sequence
  Synthetic Polynucleotide
taatacgactcactatagggcgccgtggatgagcccattcttgggctcgaaacagaggagatcgagcatgagaatgggcaacctggcggcagcgcaaaagatg

SEQ ID NO: 142647 - DNA, 103 bp, Artificial Sequence
  Synthetic Polynucleotide
taatacgactcactatagggctgggggccacgccgtggatgagcccattcaacagaggagagaatggatgcatccacggaacctggcggcagcgcaaaagatg

SEQ ID NO: 142648 - DNA, 103 bp, Artificial Sequence
  Synthetic Polynucleotide
taatacgactcactataggggaagccgttcctgggggccacgccgtggataacagaggagaatccacatggtggcccccaacctggcggcagcgcaaaagatg

SEQ ID NO: 142649 - DNA, 103 bp, Artificial Sequence
  Synthetic Polynucleotide
taatacgactcactatagggcgtccttttcattctctgactgttctgatgaacagaggagacatcagatgagtcagagaaacctggcggcagcgcaaaagatg

SEQ ID NO: 142650 - DNA, 103 bp, Artificial Sequence
  Synthetic Polynucleotide
taatacgactcactataggggcttgctgcggaagccgttcctgggggccaaacagaggagatggcccatgggaacggctaacctggcggcagcgcaaaagatg

SEQ ID NO: 142651 - DNA, 103 bp, Artificial Sequence
  Synthetic Polynucleotide
taatacgactcactatagggacctccttgagcttgctgcggaagccgttcaacagaggagagaacggatgccgcagcaaaacctggcggcagcgcaaaagatg

SEQ ID NO: 142652 - DNA, 103 bp, Artificial Sequence
  Synthetic Polynucleotide
taatacgactcactatagggggcctggcccacctccttgagcttgctgcgaacagaggagacgcagcatgctcaaggagaacctggcggcagcgcaaaagatg

SEQ ID NO: 142653 - DNA, 103 bp, Artificial Sequence
  Synthetic Polynucleotide
taatacgactcactatagggtcttcaactgggcctggcccacctccttgaaacagaggagatcaaggatgtgggccaggaacctggcggcagcgcaaaagatg

SEQ ID NO: 142654 - DNA, 103 bp, Artificial Sequence
  Synthetic Polynucleotide
taatacgactcactatagggcgccggccagtcttcaactgggcctggcccaacagaggagagggccaatgccagttgaaaacctggcggcagcgcaaaagatg

SEQ ID NO: 142655 - DNA, 103 bp, Artificial Sequence
  Synthetic Polynucleotide
taatacgactcactataggggaagagtcgccgccggccagtcttcaactgaacagaggagacagttgatgactggccggaacctggcggcagcgcaaaagatg

SEQ ID NO: 142656 - DNA, 103 bp, Artificial Sequence
  Synthetic Polynucleotide
taatacgactcactatagggtttcctgagcgaagagtcgccgccggccagaacagaggagactggccatgggcgactctaacctggcggcagcgcaaaagatg

SEQ ID NO: 142657 - DNA, 103 bp, Artificial Sequence
  Synthetic Polynucleotide
taatacgactcactatagggaccacttctttttcctgagcgaagagtcgcaacagaggagagcgactatgcgctcaggaaacctggcggcagcgcaaaagatg

SEQ ID NO: 142658 - DNA, 103 bp, Artificial Sequence
  Synthetic Polynucleotide
taatacgactcactatagggctcttccttgaccacttctttttcctgagcaacagaggagagctcagatgaaagaagtgaacctggcggcagcgcaaaagatg

SEQ ID NO: 142659 - DNA, 103 bp, Artificial Sequence
  Synthetic Polynucleotide
taatacgactcactatagggtgtcctcctcctcttccttgaccacttcttaacagaggagaaagaagatgtcaaggaagaacctggcggcagcgcaaaagatg

SEQ ID NO: 142660 - DNA, 103 bp, Artificial Sequence
  Synthetic Polynucleotide
taatacgactcactatagggtgggatgcatcgtccttttcattctctgacaacagaggagagtcagaatgtgaaaaggaaacctggcggcagcgcaaaagatg

SEQ ID NO: 142661 - DNA, 103 bp, Artificial Sequence
  Synthetic Polynucleotide
taatacgactcactatagggaggacgcctttgtcctcctcctcttccttgaacagaggagacaaggaatgggaggaggaaacctggcggcagcgcaaaagatg

SEQ ID NO: 142662 - DNA, 103 bp, Artificial Sequence
  Synthetic Polynucleotide
taatacgactcactataggggaagtcattgaggacgcctttgtcctcctcaacagaggagagaggagatgaaaggcgtcaacctggcggcagcgcaaaagatg

SEQ ID NO: 142663 - DNA, 103 bp, Artificial Sequence
  Synthetic Polynucleotide
taatacgactcactatagggtgcacttgtggaagtcattgaggacgccttaacagaggagaaaggcgatgtcaatgactaacctggcggcagcgcaaaagatg

SEQ ID NO: 142664 - DNA, 103 bp, Artificial Sequence
  Synthetic Polynucleotide
taatacgactcactatagggcccttatagatgcacttgtggaagtcattgaacagaggagacaatgaatgccacaagtgaacctggcggcagcgcaaaagatg

SEQ ID NO: 142665 - DNA, 103 bp, Artificial Sequence
  Synthetic Polynucleotide
taatacgactcactatagggaacagaccttcccttatagatgcacttgtgaacagaggagacacaagatgatctataagaacctggcggcagcgcaaaagatg

SEQ ID NO: 142666 - DNA, 103 bp, Artificial Sequence
  Synthetic Polynucleotide
taatacgactcactatagggttgttagagaaacagaccttcccttatagaaacagaggagatctataatggaaggtctgaacctggcggcagcgcaaaagatg

SEQ ID NO: 142667 - DNA, 103 bp, Artificial Sequence
  Synthetic Polynucleotide
taatacgactcactatagggcgataaaaagttgttagagaaacagaccttaacagaggagaaaggtcatgttctctaacaacctggcggcagcgcaaaagatg

SEQ ID NO: 142668 - DNA, 103 bp, Artificial Sequence
  Synthetic Polynucleotide
taatacgactcactatagggcctcgctgttcgataaaaagttgttagagaaacagaggagatctctaatgactttttataacctggcggcagcgcaaaagatg

SEQ ID NO: 142669 - DNA, 103 bp, Artificial Sequence
  Synthetic Polynucleotide
taatacgactcactatagggtcatgatattcctcgctgttcgataaaaagaacagaggagactttttatggaacagcgaaacctggcggcagcgcaaaagatg

SEQ ID NO: 142670 - DNA, 103 bp, Artificial Sequence
  Synthetic Polynucleotide
taatacgactcactatagggaaacacatgctcatgatattcctcgctgttaacagaggagaaacagcatggaatatcataacctggcggcagcgcaaaagatg

SEQ ID NO: 142671 - DNA, 103 bp, Artificial Sequence
  Synthetic Polynucleotide
taatacgactcactatagggggaggacacttgggatgcatcgtccttttcaacagaggagagaaaagatggatgcatccaacctggcggcagcgcaaaagatg

SEQ ID NO: 142672 - DNA, 103 bp, Artificial Sequence
  Synthetic Polynucleotide
taatacgactcactatagggctccttgctgaaacacatgctcatgatattaacagaggagaaatatcatgagcatgtgtaacctggcggcagcgcaaaagatg

SEQ ID NO: 142673 - DNA, 103 bp, Artificial Sequence
  Synthetic Polynucleotide
taatacgactcactatagggctggggcaggctccttgctgaaacacatgcaacagaggagagcatgtatgtcagcaaggaacctggcggcagcgcaaaagatg

SEQ ID NO: 142674 - DNA, 103 bp, Artificial Sequence
  Synthetic Polynucleotide
taatacgactcactatagggtcgatttcggctggggcaggctccttgctgaacagaggagacagcaaatggcctgccccaacctggcggcagcgcaaaagatg

SEQ ID NO: 142675 - DNA, 103 bp, Artificial Sequence
  Synthetic Polynucleotide
taatacgactcactataggggtactcttgctcgatttcggctggggcaggaacagaggagacctgccatggccgaaatcaacctggcggcagcgcaaaagatg

SEQ ID NO: 142676 - DNA, 103 bp, Artificial Sequence
  Synthetic Polynucleotide
taatacgactcactatagggctagcctccagtactcttgctcgatttcggaacagaggagaccgaaaatgagcaagagtaacctggcggcagcgcaaaagatg

SEQ ID NO: 142677 - DNA, 103 bp, Artificial Sequence
  Synthetic Polynucleotide
taatacgactcactatagggttctcttccactagcctccagtactcttgcaacagaggagagcaagaatgctggaggctaacctggcggcagcgcaaaagatg

SEQ ID NO: 142678 - DNA, 103 bp, Artificial Sequence
  Synthetic Polynucleotide
taatacgactcactataggggtggcagtccttctcttccactagcctccaaacagaggagatggaggatggtggaagagaacctggcggcagcgcaaaagatg

SEQ ID NO: 142679 - DNA, 103 bp, Artificial Sequence
  Synthetic Polynucleotide
taatacgactcactataggggcactgccacgtggcagtccttctcttccaaacagaggagatggaagatgaggactgccaacctggcggcagcgcaaaagatg

SEQ ID NO: 142680 - DNA, 103 bp, Artificial Sequence
  Synthetic Polynucleotide
taatacgactcactatagggttgccgcagtgcactgccacgtggcagtccaacagaggagaggactgatgcgtggcagtaacctggcggcagcgcaaaagatg

SEQ ID NO: 142681 - DNA, 103 bp, Artificial Sequence
  Synthetic Polynucleotide
taatacgactcactatagggggtgtccaccttgccgcagtgcactgccacaacagaggagagtggcaatgcactgcggcaacctggcggcagcgcaaaagatg

SEQ ID NO: 142682 - DNA, 103 bp, Artificial Sequence
  Synthetic Polynucleotide
taatacgactcactatagggcgttgctagtggaggacacttgggatgcataacagaggagaatgcatatgaagtgtcctaacctggcggcagcgcaaaagatg

SEQ ID NO: 142683 - DNA, 103 bp, Artificial Sequence
  Synthetic Polynucleotide
taatacgactcactatagggcgtgagtgttggtgtccaccttgccgcagtaacagaggagaactgcgatgaggtggacaaacctggcggcagcgcaaaagatg

SEQ ID NO: 142684 - DNA, 103 bp, Artificial Sequence
  Synthetic Polynucleotide
taatacgactcactatagggaatccactgccgtgagtgttggtgtccaccaacagaggagaggtggaatgcaacactcaaacctggcggcagcgcaaaagatg

SEQ ID NO: 142685 - DNA, 103 bp, Artificial Sequence
  Synthetic Polynucleotide
taatacgactcactatagggtcctactgggaatccactgccgtgagtgttaacagaggagaaacactatgggcagtggaaacctggcggcagcgcaaaagatg

SEQ ID NO: 142686 - DNA, 103 bp, Artificial Sequence
  Synthetic Polynucleotide
taatacgactcactataggggttctgattttcctactgggaatccactgcaacagaggagagcagtgatgtcccagtagaacctggcggcagcgcaaaagatg

SEQ ID NO: 142687 - DNA, 103 bp, Artificial Sequence
  Synthetic Polynucleotide
taatacgactcactatagggctcgaaaagggttctgattttcctactgggaacagaggagacccagtatgaaaatcagaaacctggcggcagcgcaaaagatg

SEQ ID NO: 142688 - DNA, 103 bp, Artificial Sequence
  Synthetic Polynucleotide
taatacgactcactatagggccatccatgcctcgaaaagggttctgatttaacagaggagaaaatcaatgcccttttcgaacctggcggcagcgcaaaagatg

SEQ ID NO: 142689 - DNA, 103 bp, Artificial Sequence
  Synthetic Polynucleotide
taatacgactcactatagggcggtgaggttccatccatgcctcgaaaaggaacagaggagaccttttatgggcatggataacctggcggcagcgcaaaagatg

SEQ ID NO: 142690 - DNA, 103 bp, Artificial Sequence
  Synthetic Polynucleotide
taatacgactcactatagggttggggaggacggtgaggttccatccatgcaacagaggagagcatggatggaacctcacaacctggcggcagcgcaaaagatg

SEQ ID NO: 142691 - DNA, 103 bp, Artificial Sequence
  Synthetic Polynucleotide
taatacgactcactatagggccctgtgttattggggaggacggtgaggttaacagaggagaaacctcatggtcctccccaacctggcggcagcgcaaaagatg

SEQ ID NO: 142692 - DNA, 103 bp, Artificial Sequence
  Synthetic Polynucleotide
taatacgactcactataggggcaggatggaccctgtgttattggggaggaaacagaggagatcctccatgataacacagaacctggcggcagcgcaaaagatg

SEQ ID NO: 142693 - DNA, 103 bp, Artificial Sequence
  Synthetic Polynucleotide
taatacgactcactataggggaactaacatcgttgctagtggaggacactaacagaggagaagtgtcatgcactagcaaaacctggcggcagcgcaaaagatg

SEQ ID NO: 142694 - DNA, 103 bp, Artificial Sequence
  Synthetic Polynucleotide
taatacgactcactatagggccgaggtgacgcaggatggaccctgtgttaaacagaggagataacacatggtccatcctaacctggcggcagcgcaaaagatg

SEQ ID NO: 142695 - DNA, 103 bp, Artificial Sequence
  Synthetic Polynucleotide
taatacgactcactatagggaggcacagcaccgaggtgacgcaggatggaaacagaggagatccatcatgcgtcacctcaacctggcggcagcgcaaaagatg

SEQ ID NO: 142696 - DNA, 103 bp, Artificial Sequence
  Synthetic Polynucleotide
taatacgactcactatagggtagtcactccaggcacagcaccgaggtgacaacagaggagagtcaccatggtgctgtgcaacctggcggcagcgcaaaagatg

SEQ ID NO: 142697 - DNA, 103 bp, Artificial Sequence
  Synthetic Polynucleotide
taatacgactcactatagggagccagggaatagtcactccaggcacagcaaacagaggagatgctgtatgtggagtgacaacctggcggcagcgcaaaagatg

SEQ ID NO: 142698 - DNA, 103 bp, Artificial Sequence
  Synthetic Polynucleotide
taatacgactcactataggggccaatatttagccagggaatagtcactccaacagaggagaggagtgatgattccctggaacctggcggcagcgcaaaagatg

SEQ ID NO: 142699 - DNA, 103 bp, Artificial Sequence
  Synthetic Polynucleotide
taatacgactcactatagggaaaagaccatgccaatatttagccagggaaaacagaggagattccctatgtaaatattgaacctggcggcagcgcaaaagatg

SEQ ID NO: 142700 - DNA, 103 bp, Artificial Sequence
  Synthetic Polynucleotide
taatacgactcactatagggcatgaggtagaaaagaccatgccaatatttaacagaggagaaaatatatgcatggtcttaacctggcggcagcgcaaaagatg

SEQ ID NO: 142701 - DNA, 103 bp, Artificial Sequence
  Synthetic Polynucleotide
taatacgactcactatagggtcgagaccagcatgaggtagaaaagaccataacagaggagaatggtcatgtctacctcaaacctggcggcagcgcaaaagatg

SEQ ID NO: 142702 - DNA, 103 bp, Artificial Sequence
  Synthetic Polynucleotide
taatacgactcactataggggattttggtctcgagaccagcatgaggtagaacagaggagactacctatggctggtctcaacctggcggcagcgcaaaagatg

SEQ ID NO: 142703 - DNA, 103 bp, Artificial Sequence
  Synthetic Polynucleotide
taatacgactcactatagggtatggaaggtgattttggtctcgagaccagaacagaggagactggtcatgagaccaaaaaacctggcggcagcgcaaaagatg

SEQ ID NO: 142704 - DNA, 103 bp, Artificial Sequence
  Synthetic Polynucleotide
taatacgactcactatagggaaaatctgaagaactaacatcgttgctagtaacagaggagaactagcatggatgttagtaacctggcggcagcgcaaaagatg

SEQ ID NO: 142705 - DNA, 103 bp, Artificial Sequence
  Synthetic Polynucleotide
taatacgactcactataggggtagtcaatgtatggaaggtgattttggtcaacagaggagagaccaaatgcaccttccaaacctggcggcagcgcaaaagatg

SEQ ID NO: 142706 - DNA, 103 bp, Artificial Sequence
  Synthetic Polynucleotide
taatacgactcactatagggcagtgtgtaagtagtcaatgtatggaaggtaacagaggagaaccttcatgacattgactaacctggcggcagcgcaaaagatg

SEQ ID NO: 142707 - DNA, 103 bp, Artificial Sequence
  Synthetic Polynucleotide
taatacgactcactatagggcagtcagcaccagtgtgtaagtagtcaatgaacagaggagacattgaatgcttacacacaacctggcggcagcgcaaaagatg

SEQ ID NO: 142708 - DNA, 103 bp, Artificial Sequence
  Synthetic Polynucleotide
taatacgactcactatagggataccaaatgcagtcagcaccagtgtgtaaaacagaggagattacacatgggtgctgacaacctggcggcagcgcaaaagatg

SEQ ID NO: 142709 - DNA, 103 bp, Artificial Sequence
  Synthetic Polynucleotide
taatacgactcactatagggcaggaatgcaataccaaatgcagtcagcacaacagaggagagtgctgatggcatttggtaacctggcggcagcgcaaaagatg

SEQ ID NO: 142710 - DNA, 103 bp, Artificial Sequence
  Synthetic Polynucleotide
taatacgactcactatagggtcctcctcagcaggaatgcaataccaaatgaacagaggagacatttgatgttgcattccaacctggcggcagcgcaaaagatg

SEQ ID NO: 142711 - DNA, 103 bp, Artificial Sequence
  Synthetic Polynucleotide
taatacgactcactatagggcagcttgttctcctcctcagcaggaatgcaaacagaggagatgcattatggctgaggagaacctggcggcagcgcaaaagatg

SEQ ID NO: 142712 - DNA, 103 bp, Artificial Sequence
  Synthetic Polynucleotide
taatacgactcactatagggccacatcttccagcttgttctcctcctcagaacagaggagactgaggatgagaacaagcaacctggcggcagcgcaaaagatg

SEQ ID NO: 142713 - DNA, 103 bp, Artificial Sequence
  Synthetic Polynucleotide
taatacgactcactatagggagggtgtggaccacatcttccagcttgttcaacagaggagagaacaaatgggaagatgtaacctggcggcagcgcaaaagatg

SEQ ID NO: 142714 - DNA, 103 bp, Artificial Sequence
  Synthetic Polynucleotide
taatacgactcactatagggggcttgcagcagggtgtggaccacatcttcaacagaggagagaagatatggtccacaccaacctggcggcagcgcaaaagatg

SEQ ID NO: 142715 - DNA, 103 bp, Artificial Sequence
  Synthetic Polynucleotide
taatacgactcactataggggcccttcttcaaaatctgaagaactaacataacagaggagaatgttaatgcttcagattaacctggcggcagcgcaaaagatg

SEQ ID NO: 142716 - DNA, 103 bp, Artificial Sequence
  Synthetic Polynucleotide
taatacgactcactataggggggtgccattggcttgcagcagggtgtggaaacagaggagatccacaatgtgctgcaagaacctggcggcagcgcaaaagatg

SEQ ID NO: 142717 - DNA, 103 bp, Artificial Sequence
  Synthetic Polynucleotide
taatacgactcactatagggtgcagccctggggtgccattggcttgcagcaacagaggagagctgcaatgcaatggcacaacctggcggcagcgcaaaagatg

SEQ ID NO: 142718 - DNA, 103 bp, Artificial Sequence
  Synthetic Polynucleotide
taatacgactcactatagggttccagcatctgcagccctggggtgccattaacagaggagaaatggcatgccagggctgaacctggcggcagcgcaaaagatg

SEQ ID NO: 142719 - DNA, 103 bp, Artificial Sequence
  Synthetic Polynucleotide
taatacgactcactatagggtgacgttgctttccagcatctgcagccctgaacagaggagacagggcatgagatgctggaacctggcggcagcgcaaaagatg

SEQ ID NO: 142720 - DNA, 103 bp, Artificial Sequence
  Synthetic Polynucleotide
taatacgactcactatagggggggagatcatgacgttgctttccagcatcaacagaggagagatgctatgaagcaacgtaacctggcggcagcgcaaaagatg

SEQ ID NO: 142721 - DNA, 103 bp, Artificial Sequence
  Synthetic Polynucleotide
taatacgactcactatagggcagcacctccggggagatcatgacgttgctaacagaggagaagcaacatgatgatctccaacctggcggcagcgcaaaagatg

SEQ ID NO: 142722 - DNA, 103 bp, Artificial Sequence
  Synthetic Polynucleotide
taatacgactcactatagggcctctttgcacagcacctccggggagatcaaacagaggagatgatctatgcggaggtgcaacctggcggcagcgcaaaagatg

SEQ ID NO: 142723 - DNA, 103 bp, Artificial Sequence
  Synthetic Polynucleotide
taatacgactcactatagggaccttgatcccctctttgcacagcacctccaacagaggagaggaggtatggtgcaaagaaacctggcggcagcgcaaaagatg

SEQ ID NO: 142724 - DNA, 103 bp, Artificial Sequence
  Synthetic Polynucleotide
taatacgactcactatagggggtcctgtgcaccttgatcccctctttgcaaacagaggagatgcaaaatggggatcaagaacctggcggcagcgcaaaagatg

SEQ ID NO: 142725 - DNA, 103 bp, Artificial Sequence
  Synthetic Polynucleotide
taatacgactcactatagggtctgctgcacggtcctgtgcaccttgatccaacagaggagaggatcaatgtgcacaggaaacctggcggcagcgcaaaagatg

SEQ ID NO: 142726 - DNA, 103 bp, Artificial Sequence
  Synthetic Polynucleotide
taatacgactcactatagggtcatcgtatttcttctgaatgatattcctcaacagaggagagaggaaatgcattcagaaaacctggcggcagcgcaaaagatg

SEQ ID NO: 142727 - DNA, 103 bp, Artificial Sequence
  Synthetic Polynucleotide
taatacgactcactatagggttcctcgacggcccttcttcaaaatctgaaaacagaggagattcagaatgtgaagaaggaacctggcggcagcgcaaaagatg

SEQ ID NO: 142728 - DNA, 103 bp, Artificial Sequence
  Synthetic Polynucleotide
taatacgactcactatagggaactggccactctgctgcacggtcctgtgcaacagaggagagcacagatgcgtgcagcaaacctggcggcagcgcaaaagatg

SEQ ID NO: 142729 - DNA, 103 bp, Artificial Sequence
  Synthetic Polynucleotide
taatacgactcactataggggcagacgacaaactggccactctgctgcacaacagaggagagtgcagatgagtggccagaacctggcggcagcgcaaaagatg

SEQ ID NO: 142730 - DNA, 103 bp, Artificial Sequence
  Synthetic Polynucleotide
taatacgactcactatagggatcccgggaagcagacgacaaactggccacaacagaggagagtggccatgttgtcgtctaacctggcggcagcgcaaaagatg

SEQ ID NO: 142731 - DNA, 103 bp, Artificial Sequence
  Synthetic Polynucleotide
taatacgactcactataggggacacaaaggatcccgggaagcagacgacaaacagaggagatgtcgtatgcttcccgggaacctggcggcagcgcaaaagatg

SEQ ID NO: 142732 - DNA, 103 bp, Artificial Sequence
  Synthetic Polynucleotide
taatacgactcactataggggcacactttggacacaaaggatcccgggaaaacagaggagattcccgatgtcctttgtgaacctggcggcagcgcaaaagatg

SEQ ID NO: 142733 - DNA, 103 bp, Artificial Sequence
  Synthetic Polynucleotide
taatacgactcactatagggtgtacccacagcacactttggacacaaaggaacagaggagacctttgatgccaaagtgtaacctggcggcagcgcaaaagatg

SEQ ID NO: 142734 - DNA, 103 bp, Artificial Sequence
  Synthetic Polynucleotide
taatacgactcactatagggtcagacacgctgtacccacagcacactttgaacagaggagacaaagtatgctgtgggtaaacctggcggcagcgcaaaagatg

SEQ ID NO: 142735 - DNA, 103 bp, Artificial Sequence
  Synthetic Polynucleotide
taatacgactcactataggggtgcacggtttcagacacgctgtacccacaaacagaggagatgtgggatgagcgtgtctaacctggcggcagcgcaaaagatg

SEQ ID NO: 142736 - DNA, 103 bp, Artificial Sequence
  Synthetic Polynucleotide
taatacgactcactatagggtggtagcaaagtgcacggtttcagacacgcaacagaggagagcgtgtatgaaaccgtgcaacctggcggcagcgcaaaagatg

SEQ ID NO: 142737 - DNA, 103 bp, Artificial Sequence
  Synthetic Polynucleotide
taatacgactcactataggggtccactgggtggtagcaaagtgcacggttaacagaggagaaaccgtatgctttgctacaacctggcggcagcgcaaaagatg

SEQ ID NO: 142738 - DNA, 103 bp, Artificial Sequence
  Synthetic Polynucleotide
taatacgactcactatagggcctgggccttttcctcgacggcccttcttcaacagaggagagaagaaatgccgtcgaggaacctggcggcagcgcaaaagatg

SEQ ID NO: 142739 - DNA, 103 bp, Artificial Sequence
  Synthetic Polynucleotide
taatacgactcactataggggcccatacttgtccactgggtggtagcaaaaacagaggagatttgctatgacccagtggaacctggcggcagcgcaaaagatg

SEQ ID NO: 142740 - DNA, 103 bp, Artificial Sequence
  Synthetic Polynucleotide
taatacgactcactatagggcggtctcaaagcccatacttgtccactgggaacagaggagacccagtatgcaagtatggaacctggcggcagcgcaaaagatg

SEQ ID NO: 142741 - DNA, 103 bp, Artificial Sequence
  Synthetic Polynucleotide
taatacgactcactatagggatttccttggcggtctcaaagcccatacttaacagaggagaaagtatatgctttgagacaacctggcggcagcgcaaaagatg

SEQ ID NO: 142742 - DNA, 103 bp, Artificial Sequence
  Synthetic Polynucleotide
taatacgactcactataggggcgacgcttcatttccttggcggtctcaaaaacagaggagatttgagatggccaaggaaaacctggcggcagcgcaaaagatg

SEQ ID NO: 142743 - DNA, 103 bp, Artificial Sequence
  Synthetic Polynucleotide
taatacgactcactatagggtagctatatggcgacgcttcatttccttggaacagaggagaccaaggatgtgaagcgtcaacctggcggcagcgcaaaagatg

SEQ ID NO: 142744 - DNA, 103 bp, Artificial Sequence
  Synthetic Polynucleotide
taatacgactcactataggggagaatggcttagctatatggcgacgcttcaacagaggagagaagcgatgccatatagcaacctggcggcagcgcaaaagatg

SEQ ID NO: 142745 - DNA, 103 bp, Artificial Sequence
  Synthetic Polynucleotide
taatacgactcactatagggcttctccatggagaatggcttagctatatgaacagaggagacatataatgaagccattcaacctggcggcagcgcaaaagatg

SEQ ID NO: 142746 - DNA, 103 bp, Artificial Sequence
  Synthetic Polynucleotide
taatacgactcactatagggggtagagtaacttctccatggagaatggctaacagaggagaagccatatgccatggagaaacctggcggcagcgcaaaagatg

SEQ ID NO: 142747 - DNA, 103 bp, Artificial Sequence
  Synthetic Polynucleotide
taatacgactcactatagggtgtgcaatctggtagagtaacttctccatgaacagaggagacatggaatggttactctaaacctggcggcagcgcaaaagatg

SEQ ID NO: 142748 - DNA, 103 bp, Artificial Sequence
  Synthetic Polynucleotide
taatacgactcactatagggtgcttctgcttgtgcaatctggtagagtaaaacagaggagattactcatgcagattgcaaacctggcggcagcgcaaaagatg

SEQ ID NO: 142749 - DNA, 103 bp, Artificial Sequence
  Synthetic Polynucleotide
taatacgactcactataggggtgcttgcagcctgggccttttcctcgacgaacagaggagacgtcgaatgaaaggcccaaacctggcggcagcgcaaaagatg

SEQ ID NO: 142750 - DNA, 103 bp, Artificial Sequence
  Synthetic Polynucleotide
taatacgactcactatagggtttctttttttgcttctgcttgtgcaatctaacagaggagaagattgatgaagcagaagaacctggcggcagcgcaaaagatg

SEQ ID NO: 142751 - DNA, 103 bp, Artificial Sequence
  Synthetic Polynucleotide
taatacgactcactataggggtgggaccgttttctttttttgcttctgctaacagaggagaagcagaatgaaaaaaagaaacctggcggcagcgcaaaagatg

SEQ ID NO: 142752 - DNA, 103 bp, Artificial Sequence
  Synthetic Polynucleotide
taatacgactcactatagggggtactgagagtgggaccgttttcttttttaacagaggagaaaaaaaatgaacggtcccaacctggcggcagcgcaaaagatg

SEQ ID NO: 142753 - DNA, 103 bp, Artificial Sequence
  Synthetic Polynucleotide
taatacgactcactataggggggctgagatggtactgagagtgggaccgtaacagaggagaacggtcatgctctcagtaaacctggcggcagcgcaaaagatg

SEQ ID NO: 142754 - DNA, 103 bp, Artificial Sequence
  Synthetic Polynucleotide
taatacgactcactatagggtcatccaggagggctgagatggtactgagaaacagaggagatctcagatgcatctcagcaacctggcggcagcgcaaaagatg

SEQ ID NO: 142755 - DNA, 103 bp, Artificial Sequence
  Synthetic Polynucleotide
taatacgactcactatagggatccctgagctcatccaggagggctgagataacagaggagaatctcaatgctcctggataacctggcggcagcgcaaaagatg

SEQ ID NO: 142756 - DNA, 103 bp, Artificial Sequence
  Synthetic Polynucleotide
taatacgactcactataggggcagctctgtatccctgagctcatccaggaaacagaggagatcctggatgagctcagggaacctggcggcagcgcaaaagatg

SEQ ID NO: 142757 - DNA, 103 bp, Artificial Sequence
  Synthetic Polynucleotide
taatacgactcactatagggctgcgctgccgcagctctgtatccctgagcaacagaggagagctcagatgtacagagctaacctggcggcagcgcaaaagatg

SEQ ID NO: 142758 - DNA, 103 bp, Artificial Sequence
  Synthetic Polynucleotide
taatacgactcactataggggaacagctgcctgcgctgccgcagctctgtaacagaggagaacagagatgcggcagcgcaacctggcggcagcgcaaaagatg

SEQ ID NO: 142759 - DNA, 103 bp, Artificial Sequence
  Synthetic Polynucleotide
taatacgactcactatagggggccagcctcgaacagctgcctgcgctgccaacagaggagaggcagcatgggcagctgtaacctggcggcagcgcaaaagatg

SEQ ID NO: 142760 - DNA, 103 bp, Artificial Sequence
  Synthetic Polynucleotide
taatacgactcactatagggaacttcctttgtgcttgcagcctgggccttaacagaggagaaaggccatggctgcaagcaacctggcggcagcgcaaaagatg

SEQ ID NO: 142761 - DNA, 103 bp, Artificial Sequence
  Synthetic Polynucleotide
taatacgactcactataggggaggagtggaggccagcctcgaacagctgcaacagaggagagcagctatgcgaggctggaacctggcggcagcgcaaaagatg

SEQ ID NO: 142762 - DNA, 103 bp, Artificial Sequence
  Synthetic Polynucleotide
taatacgactcactatagggatagcgtgcggaggagtggaggccagcctcaacagaggagagaggctatgctccactccaacctggcggcagcgcaaaagatg

SEQ ID NO: 142763 - DNA, 103 bp, Artificial Sequence
  Synthetic Polynucleotide
taatacgactcactatagggcgtggctgccatagcgtgcggaggagtggaaacagaggagatccactatgccgcacgctaacctggcggcagcgcaaaagatg

SEQ ID NO: 142764 - DNA, 103 bp, Artificial Sequence
  Synthetic Polynucleotide
taatacgactcactatagggctgctgccatcgtggctgccatagcgtgcgaacagaggagacgcacgatgtggcagccaaacctggcggcagcgcaaaagatg

SEQ ID NO: 142765 - DNA, 103 bp, Artificial Sequence
  Synthetic Polynucleotide
taatacgactcactatagggcgccaccgtgctgctgccatcgtggctgccaacagaggagaggcagcatggatggcagcaacctggcggcagcgcaaaagatg

SEQ ID NO: 142766 - DNA, 103 bp, Artificial Sequence
  Synthetic Polynucleotide
taatacgactcactatagggtcttcccgtccgccaccgtgctgctgccataacagaggagaatggcaatggcacggtggaacctggcggcagcgcaaaagatg

SEQ ID NO: 142767 - DNA, 103 bp, Artificial Sequence
  Synthetic Polynucleotide
taatacgactcactatagggcgaggctttttcttcccgtccgccaccgtgaacagaggagacacggtatgggacgggaaaacctggcggcagcgcaaaagatg

SEQ ID NO: 142768 - DNA, 103 bp, Artificial Sequence
  Synthetic Polynucleotide
taatacgactcactatagggcagccactttcgaggctttttcttcccgtcaacagaggagagacgggatgaaaaagcctaacctggcggcagcgcaaaagatg

SEQ ID NO: 142769 - DNA, 103 bp, Artificial Sequence
  Synthetic Polynucleotide
taatacgactcactatagggtctccaactgcagccactttcgaggcttttaacagaggagaaaaagcatggaaagtggcaacctggcggcagcgcaaaagatg

SEQ ID NO: 142770 - DNA, 103 bp, Artificial Sequence
  Synthetic Polynucleotide
taatacgactcactatagggctctctgacgtctccaactgcagccactttaacagaggagaaaagtgatggcagttggaaacctggcggcagcgcaaaagatg

SEQ ID NO: 142771 - DNA, 103 bp, Artificial Sequence
  Synthetic Polynucleotide
taatacgactcactatagggagactgagcaaacttcctttgtgcttgcagaacagaggagactgcaaatgcaaaggaagaacctggcggcagcgcaaaagatg

SEQ ID NO: 142772 - DNA, 103 bp, Artificial Sequence
  Synthetic Polynucleotide
taatacgactcactatagggctgacacctcctctctgacgtctccaactgaacagaggagacagttgatgacgtcagagaacctggcggcagcgcaaaagatg

SEQ ID NO: 142773 - DNA, 103 bp, Artificial Sequence
  Synthetic Polynucleotide
taatacgactcactataggggctggcagatctgacacctcctctctgacgaacagaggagacgtcagatgggaggtgtcaacctggcggcagcgcaaaagatg

SEQ ID NO: 142774 - DNA, 103 bp, Artificial Sequence
  Synthetic Polynucleotide
taatacgactcactatagggtagcacaggtgctggcagatctgacacctcaacagaggagagaggtgatggatctgccaaacctggcggcagcgcaaaagatg

SEQ ID NO: 142775 - DNA, 103 bp, Artificial Sequence
  Synthetic Polynucleotide
taatacgactcactatagggcatggacaggtagcacaggtgctggcagataacagaggagaatctgcatgcacctgtgcaacctggcggcagcgcaaaagatg

SEQ ID NO: 142776 - DNA, 103 bp, Artificial Sequence
  Synthetic Polynucleotide
taatacgactcactatagggcttgtaccaccatggacaggtagcacaggtaacagaggagaacctgtatgacctgtccaaacctggcggcagcgcaaaagatg

SEQ ID NO: 142777 - DNA, 103 bp, Artificial Sequence
  Synthetic Polynucleotide
taatacgactcactatagggttttcgttctcttgtaccaccatggacaggaacagaggagacctgtcatgggtggtacaaacctggcggcagcgcaaaagatg

SEQ ID NO: 142778 - DNA, 103 bp, Artificial Sequence
  Synthetic Polynucleotide
taatacgactcactataggggaacacgacgttttcgttctcttgtaccacaacagaggagagtggtaatggagaacgaaaacctggcggcagcgcaaaagatg

SEQ ID NO: 142779 - DNA, 103 bp, Artificial Sequence
  Synthetic Polynucleotide
taatacgactcactatagggactccagacagaacacgacgttttcgttctaacagaggagaagaacgatgacgtcgtgtaacctggcggcagcgcaaaagatg

SEQ ID NO: 142780 - DNA, 103 bp, Artificial Sequence
  Synthetic Polynucleotide
taatacgactcactatagggcgcagagcacactccagacagaacacgacgaacagaggagacgtcgtatgctgtctggaaacctggcggcagcgcaaaagatg

SEQ ID NO: 142781 - DNA, 103 bp, Artificial Sequence
  Synthetic Polynucleotide
taatacgactcactatagggctccacgtggcgcagagcacactccagacaaacagaggagatgtctgatgtgtgctctgaacctggcggcagcgcaaaagatg

SEQ ID NO: 142782 - DNA, 103 bp, Artificial Sequence
  Synthetic Polynucleotide
taatacgactcactatagggtattcggctgagactgagcaaacttcctttaacagaggagaaaaggaatgttgctcagtaacctggcggcagcgcaaaagatg

SEQ ID NO: 142783 - DNA, 103 bp, Artificial Sequence
  Synthetic Polynucleotide
taatacgactcactatagggacttctgtttctccacgtggcgcagagcacaacagaggagagtgctcatggccacgtggaacctggcggcagcgcaaaagatg

SEQ ID NO: 142784 - DNA, 103 bp, Artificial Sequence
  Synthetic Polynucleotide
taatacgactcactatagggcctcggcaggacttctgtttctccacgtggaacagaggagaccacgtatggaaacagaaaacctggcggcagcgcaaaagatg

SEQ ID NO: 142785 - DNA, 103 bp, Artificial Sequence
  Synthetic Polynucleotide
taatacgactcactatagggcaacttcagccctcggcaggacttctgtttaacagaggagaaaacagatgtcctgccgaaacctggcggcagcgcaaaagatg

SEQ ID NO: 142786 - DNA, 103 bp, Artificial Sequence
  Synthetic Polynucleotide
taatacgactcactatagggagcggtacatcaacttcagccctcggcaggaacagaggagacctgccatgggctgaagtaacctggcggcagcgcaaaagatg

SEQ ID NO: 142787 - DNA, 103 bp, Artificial Sequence
  Synthetic Polynucleotide
taatacgactcactatagggtcctcatcgtagcggtacatcaacttcagcaacagaggagagctgaaatggatgtaccgaacctggcggcagcgcaaaagatg

SEQ ID NO: 142788 - DNA, 103 bp, Artificial Sequence
  Synthetic Polynucleotide
taatacgactcactataggggataatctgttcctcatcgtagcggtacataacagaggagaatgtacatgtacgatgagaacctggcggcagcgcaaaagatg

SEQ ID NO: 142789 - DNA, 103 bp, Artificial Sequence
  Synthetic Polynucleotide
taatacgactcactatagggtgaccagactgataatctgttcctcatcgtaacagaggagaacgatgatgaacagattaaacctggcggcagcgcaaaagatg

SEQ ID NO: 142790 - DNA, 103 bp, Artificial Sequence
  Synthetic Polynucleotide
taatacgactcactatagggcagatctgattgaccagactgataatctgtaacagaggagaacagatatgcagtctggtaacctggcggcagcgcaaaagatg

SEQ ID NO: 142791 - DNA, 103 bp, Artificial Sequence
  Synthetic Polynucleotide
taatacgactcactatagggcactttgccgcagatctgattgaccagactaacagaggagaagtctgatgaatcagatcaacctggcggcagcgcaaaagatg

SEQ ID NO: 142792 - DNA, 103 bp, Artificial Sequence
  Synthetic Polynucleotide
taatacgactcactatagggttttaccagacactttgccgcagatctgataacagaggagaatcagaatggcggcaaagaacctggcggcagcgcaaaagatg

SEQ ID NO: 142793 - DNA, 103 bp, Artificial Sequence
  Synthetic Polynucleotide
taatacgactcactataggggtgctgggactattcggctgagactgagcaaacagaggagatgctcaatgtcagccgaaaacctggcggcagcgcaaaagatg

SEQ ID NO: 142794 - DNA, 103 bp, Artificial Sequence
  Synthetic Polynucleotide
taatacgactcactatagggatgctgccgtttttaccagacactttgccgaacagaggagacggcaaatggtctggtaaaacctggcggcagcgcaaaagatg

SEQ ID NO: 142795 - DNA, 103 bp, Artificial Sequence
  Synthetic Polynucleotide
taatacgactcactatagggacagttctcaatgctgccgtttttaccagaaacagaggagatctggtatgaacggcagcaacctggcggcagcgcaaaagatg

SEQ ID NO: 142796 - DNA, 103 bp, Artificial Sequence
  Synthetic Polynucleotide
taatacgactcactataggggtttactgagacagttctcaatgctgccgtaacagaggagaacggcaatgttgagaactaacctggcggcagcgcaaaagatg

SEQ ID NO: 142797 - DNA, 103 bp, Artificial Sequence
  Synthetic Polynucleotide
taatacgactcactatagggtttggtgtgggtttactgagacagttctcaaacagaggagatgagaaatgtctcagtaaaacctggcggcagcgcaaaagatg

SEQ ID NO: 142798 - DNA, 103 bp, Artificial Sequence
  Synthetic Polynucleotide
taatacgactcactataggggggacctctttttggtgtgggtttactgagaacagaggagactcagtatgcccacaccaaacctggcggcagcgcaaaagatg

SEQ ID NO: 142799 - DNA, 103 bp, Artificial Sequence
  Synthetic Polynucleotide
taatacgactcactatagggctctcttgcggggacctctttttggtgtggaacagaggagaccacacatgaaagaggtcaacctggcggcagcgcaaaagatg

SEQ ID NO: 142800 - DNA, 103 bp, Artificial Sequence
  Synthetic Polynucleotide
taatacgactcactatagggtccactgtcgctctcttgcggggacctcttaacagaggagaaagaggatgccgcaagagaacctggcggcagcgcaaaagatg

SEQ ID NO: 142801 - DNA, 103 bp, Artificial Sequence
  Synthetic Polynucleotide
taatacgactcactatagggggggggcacgtccactgtcgctctcttgcgaacagaggagacgcaagatggcgacagtgaacctggcggcagcgcaaaagatg

SEQ ID NO: 142802 - DNA, 103 bp, Artificial Sequence
  Synthetic Polynucleotide
taatacgactcactatagggacagacgggaggggggcacgtccactgtcgaacagaggagacgacagatgacgtgccccaacctggcggcagcgcaaaagatg

SEQ ID NO: 142803 - DNA, 103 bp, Artificial Sequence
  Synthetic Polynucleotide
taatacgactcactatagggctggaggctgacagacgggaggggggcacgaacagaggagacgtgccatgctcccgtctaacctggcggcagcgcaaaagatg

SEQ ID NO: 142804 - DNA, 103 bp, Artificial Sequence
  Synthetic Polynucleotide
taatacgactcactatagggtactggagttgtgctgggactattcggctgaacagaggagacagccgatgagtcccagcaacctggcggcagcgcaaaagatg

SEQ ID NO: 142805 - DNA, 103 bp, Artificial Sequence
  Synthetic Polynucleotide
taatacgactcactatagggtttggatgaactggaggctgacagacgggaaacagaggagatcccgtatgtcagcctccaacctggcggcagcgcaaaagatg

SEQ ID NO: 142806 - DNA, 103 bp, Artificial Sequence
  Synthetic Polynucleotide
taatacgactcactatagggtcgaagcacttttggatgaactggaggctgaacagaggagacagcctatggttcatccaaacctggcggcagcgcaaaagatg

SEQ ID NO: 142807 - DNA, 103 bp, Artificial Sequence
  Synthetic Polynucleotide
taatacgactcactatagggcatgatgagctcgaagcacttttggatgaaaacagaggagattcatcatgaagtgcttcaacctggcggcagcgcaaaagatg

SEQ ID NO: 142808 - DNA, 103 bp, Artificial Sequence
  Synthetic Polynucleotide
taatacgactcactatagggccactatctttactggagttgtgctgggacaacagaggagagtcccaatgcaactccagaacctggcggcagcgcaaaagatg

SEQ ID NO: 142809 - DNA, 103 bp, Artificial Sequence
  Synthetic Polynucleotide
taatacgactcactatagggagcaatggctccactatctttactggagttaacagaggagaaactccatgaaagatagtaacctggcggcagcgcaaaagatg

SEQ ID NO: 142810 - DNA, 103 bp, Artificial Sequence
  Synthetic Polynucleotide
taatacgactcactatagggcccatcactgtcatcgtatttcttctgaataacagaggagaattcagatgaaatacgataacctggcggcagcgcaaaagatg

SEQ ID NO: 142811 - DNA, 103 bp, Artificial Sequence
  Synthetic Polynucleotide
taatacgactcactatagggtggagggggtagcaatggctccactatcttaacagaggagaaagataatggagccattgaacctggcggcagcgcaaaagatg

SEQ ID NO: 142812 - DNA, 103 bp, Artificial Sequence
  Synthetic Polynucleotide
taatacgactcactatagggtctgagtagctggagggggtagcaatggctaacagaggagaagccatatgtaccccctcaacctggcggcagcgcaaaagatg

SEQ ID NO: 142813 - DNA, 103 bp, Artificial Sequence
  Synthetic Polynucleotide
taatacgactcactatagggaggtctgatatctgagtagctggagggggtaacagaggagaacccccatgagctactcaaacctggcggcagcgcaaaagatg

SEQ ID NO: 142814 - DNA, 103 bp, Artificial Sequence
  Synthetic Polynucleotide
taatacgactcactatagggccttttagagaggtctgatatctgagtagcaacagaggagagctactatgatatcagacaacctggcggcagcgcaaaagatg

SEQ ID NO: 142815 - DNA, 103 bp, Artificial Sequence
  Synthetic Polynucleotide
taatacgactcactatagggtcttaggcttccttttagagaggtctgataaacagaggagatatcagatgtctctaaaaaacctggcggcagcgcaaaagatg

SEQ ID NO: 142816 - DNA, 103 bp, Artificial Sequence
  Synthetic Polynucleotide
taatacgactcactatagggaaatcttctgtcttaggcttccttttagagaacagaggagactctaaatggaagcctaaaacctggcggcagcgcaaaagatg

SEQ ID NO: 142817 - DNA, 103 bp, Artificial Sequence
  Synthetic Polynucleotide
taatacgactcactatagggaaaggtaagaaaatcttctgtcttaggcttaacagaggagaaagcctatgacagaagataacctggcggcagcgcaaaagatg

SEQ ID NO: 142818 - DNA, 103 bp, Artificial Sequence
  Synthetic Polynucleotide
taatacgactcactataggggaaggcagagaaaggtaagaaaatcttctgaacagaggagacagaagatgttcttacctaacctggcggcagcgcaaaagatg

SEQ ID NO: 142819 - DNA, 103 bp, Artificial Sequence
  Synthetic Polynucleotide
taatacgactcactatagggggagaacctcgaaggcagagaaaggtaagaaacagaggagatcttacatgtctctgcctaacctggcggcagcgcaaaagatg

SEQ ID NO: 142820 - DNA, 103 bp, Artificial Sequence
  Synthetic Polynucleotide
taatacgactcactataggggggcagcgcaggagaacctcgaaggcagagaacagaggagactctgcatgcgaggttctaacctggcggcagcgcaaaagatg

SEQ ID NO: 142821 - DNA, 103 bp, Artificial Sequence
  Synthetic Polynucleotide
taatacgactcactatagggaccacggaatcccatcactgtcatcgtattaacagaggagaaatacgatgacagtgatgaacctggcggcagcgcaaaagatg

SEQ ID NO: 142822 - DNA, 103 bp, Artificial Sequence
  Synthetic Polynucleotide
taatacgactcactatagggccatgctgttgggcagcgcaggagaacctcaacagaggagagaggttatgctgcgctgcaacctggcggcagcgcaaaagatg

SEQ ID NO: 142823 - DNA, 103 bp, Artificial Sequence
  Synthetic Polynucleotide
taatacgactcactatagggccaaaatacaccatgctgttgggcagcgcaaacagaggagatgcgctatgcaacagcataacctggcggcagcgcaaaagatg

SEQ ID NO: 142824 - DNA, 103 bp, Artificial Sequence
  Synthetic Polynucleotide
taatacgactcactatagggctgagagcttccaaaatacaccatgctgttaacagaggagaaacagcatggtgtattttaacctggcggcagcgcaaaagatg

SEQ ID NO: 142825 - DNA, 103 bp, Artificial Sequence
  Synthetic Polynucleotide
taatacgactcactatagggcctcctcatcctgagagcttccaaaatacaaacagaggagatgtattatggaagctctcaacctggcggcagcgcaaaagatg

SEQ ID NO: 142826 - DNA, 103 bp, Artificial Sequence
  Synthetic Polynucleotide
taatacgactcactatagggtcctcgacttcctcctcatcctgagagcttaacagaggagaaagctcatgggatgaggaaacctggcggcagcgcaaaagatg

SEQ ID NO: 142827 - DNA, 103 bp, Artificial Sequence
  Synthetic Polynucleotide
taatacgactcactatagggatcatcttcctcctcgacttcctcctcatcaacagaggagagatgagatggaagtcgagaacctggcggcagcgcaaaagatg

SEQ ID NO: 142828 - DNA, 103 bp, Artificial Sequence
  Synthetic Polynucleotide
taatacgactcactatagggcttctgtctcatcatcttcctcctcgacttaacagaggagaaagtcgatgaggaagatgaacctggcggcagcgcaaaagatg

SEQ ID NO: 142829 - DNA, 103 bp, Artificial Sequence
  Synthetic Polynucleotide
taatacgactcactataggggttttgacgtcttctgtctcatcatcttccaacagaggagaggaagaatgtgagacagaaacctggcggcagcgcaaaagatg

SEQ ID NO: 142830 - DNA, 103 bp, Artificial Sequence
  Synthetic Polynucleotide
taatacgactcactataggggttggtggctgttttgacgtcttctgtctcaacagaggagagagacaatggacgtcaaaaacctggcggcagcgcaaaagatg

SEQ ID NO: 142831 - DNA, 103 bp, Artificial Sequence
  Synthetic Polynucleotide
taatacgactcactatagggatgaagcattgttggtggctgttttgacgtaacagaggagaacgtcaatgcagccaccaaacctggcggcagcgcaaaagatg

SEQ ID NO: 142832 - DNA, 103 bp, Artificial Sequence
  Synthetic Polynucleotide
taatacgactcactatagggcgttcttctgaccacggaatcccatcactgaacagaggagacagtgaatggattccgtgaacctggcggcagcgcaaaagatg

SEQ ID NO: 142833 - DNA, 103 bp, Artificial Sequence
  Synthetic Polynucleotide
taatacgactcactatagggtggcatgaagatgaagcattgttggtggctaacagaggagaagccacatgcaatgcttcaacctggcggcagcgcaaaagatg

SEQ ID NO: 142834 - DNA, 103 bp, Artificial Sequence
  Synthetic Polynucleotide
taatacgactcactataggggggggtcgactggcatgaagatgaagcattaacagaggagaaatgctatgtcttcatgcaacctggcggcagcgcaaaagatg

SEQ ID NO: 142835 - DNA, 103 bp, Artificial Sequence
  Synthetic Polynucleotide
taatacgactcactatagggttcctttcctgggggtcgactggcatgaagaacagaggagacttcatatgagtcgacccaacctggcggcagcgcaaaagatg

SEQ ID NO: 142836 - DNA, 103 bp, Artificial Sequence
  Synthetic Polynucleotide
taatacgactcactatagggttgtgggtttttcctttcctgggggtcgacaacagaggagagtcgacatgcaggaaaggaacctggcggcagcgcaaaagatg

SEQ ID NO: 142837 - DNA, 103 bp, Artificial Sequence
  Synthetic Polynucleotide
taatacgactcactataggggtgaacatgtttgtgggtttttcctttcctaacagaggagaaggaaaatgaaaacccacaacctggcggcagcgcaaaagatg

SEQ ID NO: 142838 - DNA, 103 bp, Artificial Sequence
  Synthetic Polynucleotide
taatacgactcactatagggcatgcccgttgtgaacatgtttgtgggtttaacagaggagaaaacccatgaacatgttcaacctggcggcagcgcaaaagatg

SEQ ID NO: 142839 - DNA, 103 bp, Artificial Sequence
  Synthetic Polynucleotide
taatacgactcactatagggccattgaaaacatgcccgttgtgaacatgtaacagaggagaacatgtatgcaacgggcaaacctggcggcagcgcaaaagatg

SEQ ID NO: 142840 - DNA, 103 bp, Artificial Sequence
  Synthetic Polynucleotide
taatacgactcactatagggcctgctggaaccattgaaaacatgcccgttaacagaggagaaacgggatggttttcaataacctggcggcagcgcaaaagatg

SEQ ID NO: 142841 - DNA, 103 bp, Artificial Sequence
  Synthetic Polynucleotide
taatacgactcactatagggcccgtgttgacctgctggaaccattgaaaaaacagaggagattttcaatggttccagcaaacctggcggcagcgcaaaagatg

SEQ ID NO: 142842 - DNA, 103 bp, Artificial Sequence
  Synthetic Polynucleotide
taatacgactcactatagggggttccttctcccgtgttgacctgctggaaaacagaggagattccagatggtcaacacgaacctggcggcagcgcaaaagatg

SEQ ID NO: 142843 - DNA, 103 bp, Artificial Sequence
  Synthetic Polynucleotide
taatacgactcactatagggacgtaccacccgttcttctgaccacggaataacagaggagaattccgatgtcagaagaaaacctggcggcagcgcaaaagatg

SEQ ID NO: 142844 - DNA, 103 bp, Artificial Sequence
  Synthetic Polynucleotide
taatacgactcactatagggtttttgaacaggttccttctcccgtgttgaaacagaggagatcaacaatggagaaggaaaacctggcggcagcgcaaaagatg

SEQ ID NO: 142845 - DNA, 103 bp, Artificial Sequence
  Synthetic Polynucleotide
taatacgactcactatagggtgcttttgtgtttttgaacaggttccttctaacagaggagaagaaggatgctgttcaaaaacctggcggcagcgcaaaagatg

SEQ ID NO: 142846 - DNA, 103 bp, Artificial Sequence
  Synthetic Polynucleotide
taatacgactcactataggggtggcctctttgcttttgtgtttttgaacaaacagaggagatgttcaatgacacaaaagaacctggcggcagcgcaaaagatg

SEQ ID NO: 142847 - DNA, 103 bp, Artificial Sequence
  Synthetic Polynucleotide
taatacgactcactatagggctttgcgggagtggcctctttgcttttgtgaacagaggagacacaaaatgaaagaggccaacctggcggcagcgcaaaagatg

SEQ ID NO: 142848 - DNA, 103 bp, Artificial Sequence
  Synthetic Polynucleotide
taatacgactcactatagggtgtgcttctcctttgcgggagtggcctcttaacagaggagaaagaggatgctcccgcaaaacctggcggcagcgcaaaagatg

SEQ ID NO: 142849 - DNA, 103 bp, Artificial Sequence
  Synthetic Polynucleotide
taatacgactcactatagggcggtgatcgctgtgcttctcctttgcgggaaacagaggagatcccgcatgggagaagcaaacctggcggcagcgcaaaagatg

SEQ ID NO: 142850 - DNA, 103 bp, Artificial Sequence
  Synthetic Polynucleotide
taatacgactcactataggggctgtcagcccggtgatcgctgtgcttctcaacagaggagagagaagatgagcgatcacaacctggcggcagcgcaaaagatg

SEQ ID NO: 142851 - DNA, 103 bp, Artificial Sequence
  Synthetic Polynucleotide
taatacgactcactataggggctcccggcggctgtcagcccggtgatcgcaacagaggagagcgatcatggggctgacaaacctggcggcagcgcaaaagatg

SEQ ID NO: 142852 - DNA, 103 bp, Artificial Sequence
  Synthetic Polynucleotide
taatacgactcactataggggctgaagcctgctcccggcggctgtcagccaacagaggagaggctgaatgccgccgggaaacctggcggcagcgcaaaagatg

SEQ ID NO: 142853 - DNA, 103 bp, Artificial Sequence
  Synthetic Polynucleotide
taatacgactcactatagggggggtggttagctgaagcctgctcccggcgaacagaggagacgccggatgcaggcttcaaacctggcggcagcgcaaaagatg

SEQ ID NO: 142854 - DNA, 103 bp, Artificial Sequence
  Synthetic Polynucleotide
taatacgactcactatagggaaaggactttacgtaccacccgttcttctgaacagaggagacagaagatggggtggtacaacctggcggcagcgcaaaagatg

SEQ ID NO: 142855 - DNA, 103 bp, Artificial Sequence
  Synthetic Polynucleotide
taatacgactcactataggggggccgctgcggggtggttagctgaagcctaacagaggagaaggcttatgctaaccaccaacctggcggcagcgcaaaagatg

SEQ ID NO: 142856 - DNA, 103 bp, Artificial Sequence
  Synthetic Polynucleotide
taatacgactcactatagggcccgtggagggggccgctgcggggtggttaaacagaggagataaccaatgcgcagcggcaacctggcggcagcgcaaaagatg

SEQ ID NO: 142857 - DNA, 103 bp, Artificial Sequence
  Synthetic Polynucleotide
taatacgactcactatagggggccgaggaacccgtggagggggccgctgcaacagaggagagcagcgatgccctccacgaacctggcggcagcgcaaaagatg

SEQ ID NO: 142858 - DNA, 103 bp, Artificial Sequence
  Synthetic Polynucleotide
taatacgactcactatagggcaagccccttggccgaggaacccgtggaggaacagaggagacctccaatggttcctcggaacctggcggcagcgcaaaagatg

SEQ ID NO: 142859 - DNA, 103 bp, Artificial Sequence
  Synthetic Polynucleotide
taatacgactcactatagggtgggtggcagcaagccccttggccgaggaaaacagaggagattcctcatgcaaggggctaacctggcggcagcgcaaaagatg

SEQ ID NO: 142860 - DNA, 103 bp, Artificial Sequence
  Synthetic Polynucleotide
taatacgactcactatagggggggtggtgatgggtggcagcaagccccttaacagaggagaaaggggatggctgccaccaacctggcggcagcgcaaaagatg

SEQ ID NO: 142861 - DNA, 103 bp, Artificial Sequence
  Synthetic Polynucleotide
taatacgactcactataggggatgcagaggggggtggtgatgggtggcagaacagaggagactgccaatgatcaccaccaacctggcggcagcgcaaaagatg

SEQ ID NO: 142862 - DNA, 103 bp, Artificial Sequence
  Synthetic Polynucleotide
taatacgactcactatagggtgagccgaccgatgcagaggggggtggtgaaacagaggagatcaccaatgccctctgcaaacctggcggcagcgcaaaagatg

SEQ ID NO: 142863 - DNA, 103 bp, Artificial Sequence
  Synthetic Polynucleotide
taatacgactcactatagggccgtaagtcctgagccgaccgatgcagaggaacagaggagacctctgatgcggtcggctaacctggcggcagcgcaaaagatg

SEQ ID NO: 142864 - DNA, 103 bp, Artificial Sequence
  Synthetic Polynucleotide
taatacgactcactatagggaaacctgtttccgtaagtcctgagccgaccaacagaggagaggtcggatgaggacttacaacctggcggcagcgcaaaagatg

SEQ ID NO: 142865 - DNA, 103 bp, Artificial Sequence
  Synthetic Polynucleotide
taatacgactcactatagggagagacaaataaaggactttacgtaccaccaacagaggagaggtggtatgtaaagtcctaacctggcggcagcgcaaaagatg

SEQ ID NO: 142866 - DNA, 103 bp, Artificial Sequence
  Synthetic Polynucleotide
taatacgactcactatagggtttaccttagaaacctgtttccgtaagtccaacagaggagaggacttatggaaacaggtaacctggcggcagcgcaaaagatg

SEQ ID NO: 142867 - DNA, 103 bp, Artificial Sequence
  Synthetic Polynucleotide
taatacgactcactatagggagtgactccgtttaccttagaaacctgtttaacagaggagaaaacagatgtctaaggtaaacctggcggcagcgcaaaagatg

SEQ ID NO: 142868 - DNA, 103 bp, Artificial Sequence
  Synthetic Polynucleotide
taatacgactcactatagggatgacattcgagtgactccgtttaccttagaacagaggagactaaggatgacggagtcaaacctggcggcagcgcaaaagatg

SEQ ID NO: 142869 - DNA, 103 bp, Artificial Sequence
  Synthetic Polynucleotide
taatacgactcactataggggcacccagagatgacattcgagtgactccgaacagaggagacggagtatgtcgaatgtcaacctggcggcagcgcaaaagatg

SEQ ID NO: 142870 - DNA, 103 bp, Artificial Sequence
  Synthetic Polynucleotide
taatacgactcactatagggggttacacctgcacccagagatgacattcgaacagaggagacgaatgatgtctctgggtaacctggcggcagcgcaaaagatg

SEQ ID NO: 142871 - DNA, 103 bp, Artificial Sequence
  Synthetic Polynucleotide
taatacgactcactatagggttttggcactggttacacctgcacccagagaacagaggagactctggatgcaggtgtaaaacctggcggcagcgcaaaagatg

SEQ ID NO: 142872 - DNA, 103 bp, Artificial Sequence
  Synthetic Polynucleotide
taatacgactcactatagggtcgcgcatctttttggcactggttacacctaacagaggagaaggtgtatgcagtgccaaaacctggcggcagcgcaaaagatg

SEQ ID NO: 142873 - DNA, 103 bp, Artificial Sequence
  Synthetic Polynucleotide
taatacgactcactatagggaggtctgacctcgcgcatctttttggcactaacagaggagaagtgccatgaagatgcgcaacctggcggcagcgcaaaagatg

SEQ ID NO: 142874 - DNA, 103 bp, Artificial Sequence
  Synthetic Polynucleotide
taatacgactcactatagggtggatggtgaaggtctgacctcgcgcatctaacagaggagaagatgcatgaggtcagacaacctggcggcagcgcaaaagatg

SEQ ID NO: 142875 - DNA, 103 bp, Artificial Sequence
  Synthetic Polynucleotide
taatacgactcactatagggttcacagttttggatggtgaaggtctgaccaacagaggagaggtcagatgttcaccatcaacctggcggcagcgcaaaagatg

SEQ ID NO: 142876 - DNA, 103 bp, Artificial Sequence
  Synthetic Polynucleotide
taatacgactcactatagggaggaggagtggcaggccagcctgctaccataacagaggagaatggtaatgggctggcctaacctggcggcagcgcaaaagatg

SEQ ID NO: 142877 - DNA, 103 bp, Artificial Sequence
  Synthetic Polynucleotide
taatacgactcactatagggggccgagctggggagcccggtcagggggccaacagaggagaggccccatgaccgggctcaacctggcggcagcgcaaaagatg

SEQ ID NO: 142878 - DNA, 103 bp, Artificial Sequence
  Synthetic Polynucleotide
taatacgactcactatagggccacagtcagggccgagctggggagcccggaacagaggagaccgggcatgccagctcggaacctggcggcagcgcaaaagatg

SEQ ID NO: 142879 - DNA, 103 bp, Artificial Sequence
  Synthetic Polynucleotide
taatacgactcactatagggttcagctcctccacagtcagggccgagctgaacagaggagacagctcatgcctgactgtaacctggcggcagcgcaaaagatg

SEQ ID NO: 142880 - DNA, 103 bp, Artificial Sequence
  Synthetic Polynucleotide
taatacgactcactataggggtcagcgtatttcagctcctccacagtcagaacagaggagactgactatggaggagctgaacctggcggcagcgcaaaagatg

SEQ ID NO: 142881 - DNA, 103 bp, Artificial Sequence
  Synthetic Polynucleotide
taatacgactcactatagggggttgcggatgtcagcgtatttcagctcctaacagaggagaaggagcatgaatacgctgaacctggcggcagcgcaaaagatg

SEQ ID NO: 142882 - DNA, 103 bp, Artificial Sequence
  Synthetic Polynucleotide
taatacgactcactatagggatggccccgaggttgcggatgtcagcgtataacagaggagaatacgcatgcatccgcaaaacctggcggcagcgcaaaagatg

SEQ ID NO: 142883 - DNA, 103 bp, Artificial Sequence
  Synthetic Polynucleotide
taatacgactcactataggggggtgcaatcatggccccgaggttgcggataacagaggagaatccgcatgctcggggccaacctggcggcagcgcaaaagatg

SEQ ID NO: 142884 - DNA, 103 bp, Artificial Sequence
  Synthetic Polynucleotide
taatacgactcactatagggggaagtgcaagggtgcaatcatggccccgaaacagaggagatcggggatgtgattgcacaacctggcggcagcgcaaaagatg

SEQ ID NO: 142885 - DNA, 103 bp, Artificial Sequence
  Synthetic Polynucleotide
taatacgactcactatagggttcacctccaggaagtgcaagggtgcaatcaacagaggagagattgcatgcttgcacttaacctggcggcagcgcaaaagatg

SEQ ID NO: 142886 - DNA, 103 bp, Artificial Sequence
  Synthetic Polynucleotide
taatacgactcactatagggcttgcccagtttcacctccaggaagtgcaaaacagaggagattgcacatgctggaggtgaacctggcggcagcgcaaaagatg

SEQ ID NO: 142887 - DNA, 103 bp, Artificial Sequence
  Synthetic Polynucleotide
taatacgactcactataggggcatcatagcaggaggagtggcaggccagcaacagaggagagctggcatgccactcctcaacctggcggcagcgcaaaagatg

SEQ ID NO: 142888 - DNA, 103 bp, Artificial Sequence
  Synthetic Polynucleotide
taatacgactcactataggggctggggcctcttgcccagtttcacctccaaacagaggagatggaggatgaactgggcaaacctggcggcagcgcaaaagatg

SEQ ID NO: 142889 - DNA, 103 bp, Artificial Sequence
  Synthetic Polynucleotide
taatacgactcactatagggcttttcacgggctggggcctcttgcccagtaacagaggagaactgggatggaggccccaaacctggcggcagcgcaaaagatg

SEQ ID NO: 142890 - DNA, 103 bp, Artificial Sequence
  Synthetic Polynucleotide
taatacgactcactatagggatctagctcacttttcacgggctggggcctaacagaggagaaggcccatgcccgtgaaaaacctggcggcagcgcaaaagatg

SEQ ID NO: 142891 - DNA, 103 bp, Artificial Sequence
  Synthetic Polynucleotide
taatacgactcactatagggcctcttcctcatctagctcacttttcacggaacagaggagaccgtgaatggtgagctagaacctggcggcagcgcaaaagatg

SEQ ID NO: 142892 - DNA, 103 bp, Artificial Sequence
  Synthetic Polynucleotide
taatacgactcactatagggttccttcgctcctcttcctcatctagctcaaacagaggagatgagctatgtgaggaagaaacctggcggcagcgcaaaagatg

SEQ ID NO: 142893 - DNA, 103 bp, Artificial Sequence
  Synthetic Polynucleotide
taatacgactcactatagggccggcgccttttccttcgctcctcttcctcaacagaggagagaggaaatggagcgaaggaacctggcggcagcgcaaaagatg

SEQ ID NO: 142894 - DNA, 103 bp, Artificial Sequence
  Synthetic Polynucleotide
taatacgactcactatagggtgttcttctcccggcgccttttccttcgctaacagaggagaagcgaaatgaaaggcgccaacctggcggcagcgcaaaagatg

SEQ ID NO: 142895 - DNA, 103 bp, Artificial Sequence
  Synthetic Polynucleotide
taatacgactcactataggggctgcgactttgttcttctcccggcgccttaacagaggagaaaggcgatgggagaagaaaacctggcggcagcgcaaaagatg

SEQ ID NO: 142896 - DNA, 103 bp, Artificial Sequence
  Synthetic Polynucleotide
taatacgactcactataggggcatcgggctgctgcgactttgttcttctcaacagaggagagagaagatgaaagtcgcaaacctggcggcagcgcaaaagatg

SEQ ID NO: 142897 - DNA, 103 bp, Artificial Sequence
  Synthetic Polynucleotide
taatacgactcactatagggtcttgttccggcatcgggctgctgcgacttaacagaggagaaagtcgatgcagcccgataacctggcggcagcgcaaaagatg

SEQ ID NO: 142898 - DNA, 103 bp, Artificial Sequence
  Synthetic Polynucleotide
taatacgactcactatagggatctgcccaggcatcatagcaggaggagtgaacagaggagacactccatgtgctatgataacctggcggcagcgcaaaagatg

SEQ ID NO: 142899 - DNA, 103 bp, Artificial Sequence
  Synthetic Polynucleotide
taatacgactcactatagggcgctccttcttcttgttccggcatcgggctaacagaggagaagcccgatgccggaacaaaacctggcggcagcgcaaaagatg

SEQ ID NO: 142900 - DNA, 103 bp, Artificial Sequence
  Synthetic Polynucleotide
taatacgactcactatagggaaactccgtgcgctccttcttcttgttccgaacagaggagacggaacatgaagaaggagaacctggcggcagcgcaaaagatg

SEQ ID NO: 142901 - DNA, 103 bp, Artificial Sequence
  Synthetic Polynucleotide
taatacgactcactatagggcccgctgcagaaactccgtgcgctccttctaacagaggagaagaaggatggcacggagtaacctggcggcagcgcaaaagatg

SEQ ID NO: 142902 - DNA, 103 bp, Artificial Sequence
  Synthetic Polynucleotide
taatacgactcactatagggcgctcggattcccgctgcagaaactccgtgaacagaggagacacggaatgtctgcagcgaacctggcggcagcgcaaaagatg

SEQ ID NO: 142903 - DNA, 103 bp, Artificial Sequence
  Synthetic Polynucleotide
taatacgactcactataggggagttccagccgctcggattcccgctgcagaacagaggagactgcagatggaatccgagaacctggcggcagcgcaaaagatg

SEQ ID NO: 142904 - DNA, 103 bp, Artificial Sequence
  Synthetic Polynucleotide
taatacgactcactatagggctgcgttcatgagttccagccgctcggattaacagaggagaaatccgatgggctggaacaacctggcggcagcgcaaaagatg

SEQ ID NO: 142905 - DNA, 103 bp, Artificial Sequence
  Synthetic Polynucleotide
taatacgactcactataggggtcttcagctctgcgttcatgagttccagcaacagaggagagctggaatgcatgaacgcaacctggcggcagcgcaaaagatg

SEQ ID NO: 142906 - DNA, 103 bp, Artificial Sequence
  Synthetic Polynucleotide
taatacgactcactatagggctcaatctgggtcttcagctctgcgttcataacagaggagaatgaacatggagctgaagaacctggcggcagcgcaaaagatg

SEQ ID NO: 142907 - DNA, 103 bp, Artificial Sequence
  Synthetic Polynucleotide
taatacgactcactataggggcttcagctcctcaatctgggtcttcagctaacagaggagaagctgaatgcccagattgaacctggcggcagcgcaaaagatg

SEQ ID NO: 142908 - DNA, 103 bp, Artificial Sequence
  Synthetic Polynucleotide
taatacgactcactatagggtgccgctcctgcttcagctcctcaatctggaacagaggagaccagatatgggagctgaaaacctggcggcagcgcaaaagatg

SEQ ID NO: 142909 - DNA, 103 bp, Artificial Sequence
  Synthetic Polynucleotide
taatacgactcactatagggagggtccgggatctgcccaggcatcatagcaacagaggagagctatgatgcctgggcagaacctggcggcagcgcaaaagatg

SEQ ID NO: 142910 - DNA, 103 bp, Artificial Sequence
  Synthetic Polynucleotide
taatacgactcactataggggatgagctgctgccgctcctgcttcagctcaacagaggagagagctgatgcaggagcggaacctggcggcagcgcaaaagatg

SEQ ID NO: 142911 - DNA, 103 bp, Artificial Sequence
  Synthetic Polynucleotide
taatacgactcactatagggtcagcatcaggatgagctgctgccgctcctaacagaggagaaggagcatgagcagctcaaacctggcggcagcgcaaaagatg

SEQ ID NO: 142912 - DNA, 103 bp, Artificial Sequence
  Synthetic Polynucleotide
taatacgactcactatagggcggtgtcggttcagcatcaggatgagctgcaacagaggagagcagctatgcctgatgctaacctggcggcagcgcaaaagatg

SEQ ID NO: 142913 - DNA, 103 bp, Artificial Sequence
  Synthetic Polynucleotide
taatacgactcactataggggcaggtggggcggtgtcggttcagcatcagaacagaggagactgatgatgaaccgacacaacctggcggcagcgcaaaagatg

SEQ ID NO: 142914 - DNA, 103 bp, Artificial Sequence
  Synthetic Polynucleotide
taatacgactcactatagggtccggacgatgcaggtggggcggtgtcggtaacagaggagaaccgacatggccccacctaacctggcggcagcgcaaaagatg

SEQ ID NO: 142915 - DNA, 103 bp, Artificial Sequence
  Synthetic Polynucleotide
taatacgactcactatagggacactgtcggtccggacgatgcaggtggggaacagaggagaccccacatgcatcgtccgaacctggcggcagcgcaaaagatg

SEQ ID NO: 142916 - DNA, 103 bp, Artificial Sequence
  Synthetic Polynucleotide
taatacgactcactataggggggggtcttgacactgtcggtccggacgataacagaggagaatcgtcatgaccgacagtaacctggcggcagcgcaaaagatg

SEQ ID NO: 142917 - DNA, 103 bp, Artificial Sequence
  Synthetic Polynucleotide
taatacgactcactatagggcttctgactcgggggtcttgacactgtcggaacagaggagaccgacaatgtcaagacccaacctggcggcagcgcaaaagatg

SEQ ID NO: 142918 - DNA, 103 bp, Artificial Sequence
  Synthetic Polynucleotide
taatacgactcactatagggagtgggttgccttctgactcgggggtcttgaacagaggagacaagacatgcgagtcagaaacctggcggcagcgcaaaagatg

SEQ ID NO: 142919 - DNA, 103 bp, Artificial Sequence
  Synthetic Polynucleotide
taatacgactcactatagggctgctcgagcagtgggttgccttctgactcaacagaggagagagtcaatgggcaacccaaacctggcggcagcgcaaaagatg

SEQ ID NO: 142920 - DNA, 103 bp, Artificial Sequence
  Synthetic Polynucleotide
taatacgactcactatagggtggtcaccgaagggtccgggatctgcccagaacagaggagactgggcatgtcccggaccaacctggcggcagcgcaaaagatg

SEQ ID NO: 142921 - DNA, 103 bp, Artificial Sequence
  Synthetic Polynucleotide
taatacgactcactatagggtcttctcgagctgctcgagcagtgggttgcaacagaggagagcaaccatgtgctcgagcaacctggcggcagcgcaaaagatg

SEQ ID NO: 142922 - DNA, 103 bp, Artificial Sequence
  Synthetic Polynucleotide
taatacgactcactatagggagggagcctgtggtcaccgaagggtccgggaacagaggagacccggaatgttcggtgacaacctggcggcagcgcaaaagatg

SEQ ID NO: 142923 - DNA, 103 bp, Artificial Sequence
  Synthetic Polynucleotide
taatacgactcactatagggaagccctggcagggagcctgtggtcaccgaaacagaggagatcggtgatgacaggctccaacctggcggcagcgcaaaagatg

SEQ ID NO: 142924 - DNA, 103 bp, Artificial Sequence
  Synthetic Polynucleotide
taatacgactcactatagggtcagggggccaagccctggcagggagcctgaacagaggagacaggctatgtgccagggcaacctggcggcagcgcaaaagatg

SEQ ID NO: 142925 - DNA, 103 bp, Artificial Sequence
  Synthetic Polynucleotide
taatacgactcactataggggggagcccggtcagggggccaagccctggcaacagaggagagccaggatgtggccccctaacctggcggcagcgcaaaagatg

SEQ ID NO: 142926 - DNA, 103 bp, Artificial Sequence
  Synthetic Polynucleotide
taatacgactcactatagggcaccagctctgcccgcgtctctaccgccataacagaggagaatggcgatggagacgcggaacctggcggcagcgcaaaagatg

SEQ ID NO: 142927 - DNA, 103 bp, Artificial Sequence
  Synthetic Polynucleotide
taatacgactcactatagggccccgctcgccagcttcgccagccgcgtccaacagaggagaggacgcatgtggcgaagcaacctggcggcagcgcaaaagatg

SEQ ID NO: 142928 - DNA, 103 bp, Artificial Sequence
  Synthetic Polynucleotide
taatacgactcactatagggattttctcctcgtgatatataatcatatttaacagaggagaaaatatatgtatatatcaaacctggcggcagcgcaaaagatg

SEQ ID NO: 142929 - DNA, 103 bp, Artificial Sequence
  Synthetic Polynucleotide
taatacgactcactatagggtacctttaggattttctcctcgtgatatataacagaggagaatatatatggaggagaaaaacctggcggcagcgcaaaagatg

SEQ ID NO: 142930 - DNA, 103 bp, Artificial Sequence
  Synthetic Polynucleotide
taatacgactcactatagggtgtttgtttttacctttaggattttctcctaacagaggagaaggagaatgtcctaaaggaacctggcggcagcgcaaaagatg

SEQ ID NO: 142931 - DNA, 103 bp, Artificial Sequence
  Synthetic Polynucleotide
taatacgactcactatagggattcatcaagtgtttgtttttacctttaggaacagaggagacctaaaatgaaaaacaaaaacctggcggcagcgcaaaagatg

SEQ ID NO: 142932 - DNA, 103 bp, Artificial Sequence
  Synthetic Polynucleotide
taatacgactcactatagggtccttcttttattcatcaagtgtttgttttaacagaggagaaaaacaatgacttgatgaaacctggcggcagcgcaaaagatg

SEQ ID NO: 142933 - DNA, 103 bp, Artificial Sequence
  Synthetic Polynucleotide
taatacgactcactatagggtcctcaggtttccttcttttattcatcaagaacagaggagacttgatatgtaaaagaagaacctggcggcagcgcaaaagatg

SEQ ID NO: 142934 - DNA, 103 bp, Artificial Sequence
  Synthetic Polynucleotide
taatacgactcactatagggcttttcatcctcctcaggtttccttcttttaacagaggagaaaaagaatgaaacctgagaacctggcggcagcgcaaaagatg

SEQ ID NO: 142935 - DNA, 103 bp, Artificial Sequence
  Synthetic Polynucleotide
taatacgactcactatagggtatttagtttcttttcatcctcctcaggttaacagaggagaaacctgatgaggatgaaaaacctggcggcagcgcaaaagatg

SEQ ID NO: 142936 - DNA, 103 bp, Artificial Sequence
  Synthetic Polynucleotide
taatacgactcactatagggagtcttttcatatttagtttcttttcatccaacagaggagaggatgaatggaaactaaaaacctggcggcagcgcaaaagatg

SEQ ID NO: 142937 - DNA, 103 bp, Artificial Sequence
  Synthetic Polynucleotide
taatacgactcactataggggtcagttcgaagtcttttcatatttagtttaacagaggagaaaactaatgatgaaaagaaacctggcggcagcgcaaaagatg

SEQ ID NO: 142938 - DNA, 103 bp, Artificial Sequence
  Synthetic Polynucleotide
taatacgactcactatagggctcggatgacccccgctcgccagcttcgccaacagaggagaggcgaaatgggcgagcggaacctggcggcagcgcaaaagatg

SEQ ID NO: 142939 - DNA, 103 bp, Artificial Sequence
  Synthetic Polynucleotide
taatacgactcactatagggctgaaacattgtcagttcgaagtcttttcaaacagaggagatgaaaaatgttcgaactgaacctggcggcagcgcaaaagatg

SEQ ID NO: 142940 - DNA, 103 bp, Artificial Sequence
  Synthetic Polynucleotide
taatacgactcactatagggtcagaaaagtctgaaacattgtcagttcgaaacagaggagatcgaacatgcaatgtttcaacctggcggcagcgcaaaagatg

SEQ ID NO: 142941 - DNA, 103 bp, Artificial Sequence
  Synthetic Polynucleotide
taatacgactcactataggggtcactgctctcagaaaagtctgaaacattaacagaggagaaatgttatggacttttctaacctggcggcagcgcaaaagatg

SEQ ID NO: 142942 - DNA, 103 bp, Artificial Sequence
  Synthetic Polynucleotide
taatacgactcactatagggaattttctgagtcactgctctcagaaaagtaacagaggagaacttttatgagagcagtgaacctggcggcagcgcaaaagatg

SEQ ID NO: 142943 - DNA, 103 bp, Artificial Sequence
  Synthetic Polynucleotide
taatacgactcactatagggctcttatttgaattttctgagtcactgctcaacagaggagagagcagatgctcagaaaaaacctggcggcagcgcaaaagatg

SEQ ID NO: 142944 - DNA, 103 bp, Artificial Sequence
  Synthetic Polynucleotide
taatacgactcactatagggatctattattctcttatttgaattttctgaaacagaggagatcagaaatgtcaaataagaacctggcggcagcgcaaaagatg

SEQ ID NO: 142945 - DNA, 103 bp, Artificial Sequence
  Synthetic Polynucleotide
taatacgactcactatagggctgaggaattatctattattctcttatttgaacagaggagacaaataatggaataatagaacctggcggcagcgcaaaagatg

SEQ ID NO: 142946 - DNA, 103 bp, Artificial Sequence
  Synthetic Polynucleotide
taatacgactcactatagggggcttctgttctgaggaattatctattattaacagaggagaaataatatgtaattcctcaacctggcggcagcgcaaaagatg

SEQ ID NO: 142947 - DNA, 103 bp, Artificial Sequence
  Synthetic Polynucleotide
taatacgactcactatagggttcattctctggcttctgttctgaggaattaacagaggagaaattccatggaacagaagaacctggcggcagcgcaaaagatg

SEQ ID NO: 142948 - DNA, 103 bp, Artificial Sequence
  Synthetic Polynucleotide
taatacgactcactatagggtatttttcaattcattctctggcttctgttaacagaggagaaacagaatgcagagaatgaacctggcggcagcgcaaaagatg

SEQ ID NO: 142949 - DNA, 103 bp, Artificial Sequence
  Synthetic Polynucleotide
taatacgactcactatagggtgtgacacggctcggatgacccccgctcgcaacagaggagagcgagcatgggtcatccgaacctggcggcagcgcaaaagatg

SEQ ID NO: 142950 - DNA, 103 bp, Artificial Sequence
  Synthetic Polynucleotide
taatacgactcactataggggaagtatttttatttttcaattcattctctaacagaggagaagagaaatgattgaaaaaaacctggcggcagcgcaaaagatg

SEQ ID NO: 142951 - DNA, 103 bp, Artificial Sequence
  Synthetic Polynucleotide
taatacgactcactatagggatttatttttgaagtatttttatttttcaaaacagaggagattgaaaatgaaaaatactaacctggcggcagcgcaaaagatg

SEQ ID NO: 142952 - DNA, 103 bp, Artificial Sequence
  Synthetic Polynucleotide
taatacgactcactatagggcttcttctccatttatttttgaagtattttaacagaggagaaaaataatgcaaaaataaaacctggcggcagcgcaaaagatg

SEQ ID NO: 142953 - DNA, 103 bp, Artificial Sequence
  Synthetic Polynucleotide
taatacgactcactatagggtggggttttccttcttctccatttatttttaacagaggagaaaaaatatgtggagaagaaacctggcggcagcgcaaaagatg

SEQ ID NO: 142954 - DNA, 103 bp, Artificial Sequence
  Synthetic Polynucleotide
taatacgactcactatagggctcattattatggggttttccttcttctccaacagaggagaggagaaatgggaaaacccaacctggcggcagcgcaaaagatg

SEQ ID NO: 142955 - DNA, 103 bp, Artificial Sequence
  Synthetic Polynucleotide
taatacgactcactatagggctcctgccttctcattattatggggttttcaacagaggagagaaaacatgataataatgaacctggcggcagcgcaaaagatg

SEQ ID NO: 142956 - DNA, 103 bp, Artificial Sequence
  Synthetic Polynucleotide
taatacgactcactatagggagggtctcttctcctgccttctcattattaaacagaggagataataaatggaaggcaggaacctggcggcagcgcaaaagatg

SEQ ID NO: 142957 - DNA, 103 bp, Artificial Sequence
  Synthetic Polynucleotide
taatacgactcactataggggctattttttagggtctcttctcctgccttaacagaggagaaaggcaatggaagagaccaacctggcggcagcgcaaaagatg

SEQ ID NO: 142958 - DNA, 103 bp, Artificial Sequence
  Synthetic Polynucleotide
taatacgactcactatagggagggaggctggctattttttagggtctcttaacagaggagaaagagaatgtaaaaaataaacctggcggcagcgcaaaagatg

SEQ ID NO: 142959 - DNA, 103 bp, Artificial Sequence
  Synthetic Polynucleotide
taatacgactcactatagggatttgatcccagggaggctggctattttttaacagaggagaaaaaaaatgccagcctccaacctggcggcagcgcaaaagatg

SEQ ID NO: 142960 - DNA, 103 bp, Artificial Sequence
  Synthetic Polynucleotide
taatacgactcactataggggctgtccctgtgtgacacggctcggatgacaacagaggagagtcatcatggccgtgtcaaacctggcggcagcgcaaaagatg

SEQ ID NO: 142961 - DNA, 103 bp, Artificial Sequence
  Synthetic Polynucleotide
taatacgactcactatagggatcttcctgtatttgatcccagggaggctgaacagaggagacagcctatgtgggatcaaaacctggcggcagcgcaaaagatg

SEQ ID NO: 142962 - DNA, 103 bp, Artificial Sequence
  Synthetic Polynucleotide
taatacgactcactatagggcatgttttttatcttcctgtatttgatcccaacagaggagagggatcatgtacaggaagaacctggcggcagcgcaaaagatg

SEQ ID NO: 142963 - DNA, 103 bp, Artificial Sequence
  Synthetic Polynucleotide
taatacgactcactatagggtctgcttcttcatgttttttatcttcctgtaacagaggagaacaggaatgtaaaaaacaaacctggcggcagcgcaaaagatg

SEQ ID NO: 142964 - DNA, 103 bp, Artificial Sequence
  Synthetic Polynucleotide
taatacgactcactatagggcttccgcttctctgcttcttcatgttttttaacagaggagaaaaaaaatggaagaagcaaacctggcggcagcgcaaaagatg

SEQ ID NO: 142965 - DNA, 103 bp, Artificial Sequence
  Synthetic Polynucleotide
taatacgactcactatagggtgtcaacagacttccgcttctctgcttcttaacagaggagaaagaagatgagaagcggaaacctggcggcagcgcaaaagatg

SEQ ID NO: 142966 - DNA, 103 bp, Artificial Sequence
  Synthetic Polynucleotide
taatacgactcactatagggtgaagctgagtgtcaacagacttccgcttcaacagaggagagaagcgatggtctgttgaaacctggcggcagcgcaaaagatg

SEQ ID NO: 142967 - DNA, 103 bp, Artificial Sequence
  Synthetic Polynucleotide
taatacgactcactatagggcatatcttcttgaagctgagtgtcaacagaaacagaggagatctgttatgactcagcttaacctggcggcagcgcaaaagatg

SEQ ID NO: 142968 - DNA, 103 bp, Artificial Sequence
  Synthetic Polynucleotide
taatacgactcactatagggaatgaataatcatatcttcttgaagctgagaacagaggagactcagcatgaagaagataaacctggcggcagcgcaaaagatg

SEQ ID NO: 142969 - DNA, 103 bp, Artificial Sequence
  Synthetic Polynucleotide
taatacgactcactatagggtgttctgacgaatgaataatcatatcttctaacagaggagaagaagaatggattattcaaacctggcggcagcgcaaaagatg

SEQ ID NO: 142970 - DNA, 103 bp, Artificial Sequence
  Synthetic Polynucleotide
taatacgactcactatagggaactgtggactgttctgacgaatgaataataacagaggagaattattatgtcgtcagaaaacctggcggcagcgcaaaagatg

SEQ ID NO: 142971 - DNA, 103 bp, Artificial Sequence
  Synthetic Polynucleotide
taatacgactcactatagggccggattgcggctgtccctgtgtgacacggaacagaggagaccgtgtatgacagggacaaacctggcggcagcgcaaaagatg

SEQ ID NO: 142972 - DNA, 103 bp, Artificial Sequence
  Synthetic Polynucleotide
taatacgactcactatagggtatgatcagaaactgtggactgttctgacgaacagaggagacgtcagatgagtccacagaacctggcggcagcgcaaaagatg

SEQ ID NO: 142973 - DNA, 103 bp, Artificial Sequence
  Synthetic Polynucleotide
taatacgactcactatagggtcattagaattatgatcagaaactgtggacaacagaggagagtccacatgttctgatcaaacctggcggcagcgcaaaagatg

SEQ ID NO: 142974 - DNA, 103 bp, Artificial Sequence
  Synthetic Polynucleotide
taatacgactcactatagggaggaagtaaatcattagaattatgatcagaaacagaggagatctgatatgaattctaataacctggcggcagcgcaaaagatg

SEQ ID NO: 142975 - DNA, 103 bp, Artificial Sequence
  Synthetic Polynucleotide
taatacgactcactatagggtgcattcctgaggaagtaaatcattagaataacagaggagaattctaatgatttacttcaacctggcggcagcgcaaaagatg

SEQ ID NO: 142976 - DNA, 103 bp, Artificial Sequence
  Synthetic Polynucleotide
taatacgactcactatagggttatccatattgcattcctgaggaagtaaaaacagaggagatttactatgtcaggaatgaacctggcggcagcgcaaaagatg

SEQ ID NO: 142977 - DNA, 103 bp, Artificial Sequence
  Synthetic Polynucleotide
taatacgactcactatagggggtatgtgttttatccatattgcattcctgaacagaggagacaggaaatgaatatggataacctggcggcagcgcaaaagatg

SEQ ID NO: 142978 - DNA, 103 bp, Artificial Sequence
  Synthetic Polynucleotide
taatacgactcactataggggcaattccatggtatgtgttttatccatataacagaggagaatatggatgaaacacataaacctggcggcagcgcaaaagatg

SEQ ID NO: 142979 - DNA, 103 bp, Artificial Sequence
  Synthetic Polynucleotide
taatacgactcactatagggtcctttggtagcaattccatggtatgtgttaacagaggagaaacacaatgcatggaattaacctggcggcagcgcaaaagatg

SEQ ID NO: 142980 - DNA, 103 bp, Artificial Sequence
  Synthetic Polynucleotide
taatacgactcactatagggtacaaacttctcctttggtagcaattccataacagaggagaatggaaatgctaccaaagaacctggcggcagcgcaaaagatg

SEQ ID NO: 142981 - DNA, 103 bp, Artificial Sequence
  Synthetic Polynucleotide
taatacgactcactataggggtggtctggatacaaacttctcctttggtaaacagaggagataccaaatgagaagtttgaacctggcggcagcgcaaaagatg

SEQ ID NO: 142982 - DNA, 103 bp, Artificial Sequence
  Synthetic Polynucleotide
taatacgactcactatagggaccgccaggtccggattgcggctgtccctgaacagaggagacagggaatgccgcaatccaacctggcggcagcgcaaaagatg

SEQ ID NO: 142983 - DNA, 103 bp, Artificial Sequence
  Synthetic Polynucleotide
taatacgactcactatagggtttggtgtgggtggtctggatacaaacttcaacagaggagagaagttatgatccagaccaacctggcggcagcgcaaaagatg

SEQ ID NO: 142984 - DNA, 103 bp, Artificial Sequence
  Synthetic Polynucleotide
taatacgactcactatagggaataacacattttggtgtgggtggtctggaaacagaggagatccagaatgcccacaccaaacctggcggcagcgcaaaagatg

SEQ ID NO: 142985 - DNA, 103 bp, Artificial Sequence
  Synthetic Polynucleotide
taatacgactcactatagggttgtaatatcaataacacattttggtgtggaacagaggagaccacacatgaatgtgttaaacctggcggcagcgcaaaagatg

SEQ ID NO: 142986 - DNA, 103 bp, Artificial Sequence
  Synthetic Polynucleotide
taatacgactcactatagggttagtgtcatttgtaatatcaataacacataacagaggagaatgtgtatgtgatattacaacctggcggcagcgcaaaagatg

SEQ ID NO: 142987 - DNA, 103 bp, Artificial Sequence
  Synthetic Polynucleotide
taatacgactcactatagggcttttctaaattagtgtcatttgtaatatcaacagaggagagatattatgaatgacactaacctggcggcagcgcaaaagatg

SEQ ID NO: 142988 - DNA, 103 bp, Artificial Sequence
  Synthetic Polynucleotide
taatacgactcactatagggcctgagccaccttttctaaattagtgtcataacagaggagaatgacaatgatttagaaaaacctggcggcagcgcaaaagatg

SEQ ID NO: 142989 - DNA, 103 bp, Artificial Sequence
  Synthetic Polynucleotide
taatacgactcactatagggcttgagttttcctgagccaccttttctaaaaacagaggagatttagaatgggtggctcaaacctggcggcagcgcaaaagatg

SEQ ID NO: 142990 - DNA, 103 bp, Artificial Sequence
  Synthetic Polynucleotide
taatacgactcactataggggccaaaggtacttgagttttcctgagccacaacagaggagagtggctatggaaaactcaaacctggcggcagcgcaaaagatg

SEQ ID NO: 142991 - DNA, 103 bp, Artificial Sequence
  Synthetic Polynucleotide
taatacgactcactataggggtgtctgaaggccaaaggtacttgagttttaacagaggagaaaaactatggtacctttgaacctggcggcagcgcaaaagatg

SEQ ID NO: 142992 - DNA, 103 bp, Artificial Sequence
  Synthetic Polynucleotide
taatacgactcactatagggattttctgaagtgtctgaaggccaaaggtaaacagaggagataccttatgccttcagacaacctggcggcagcgcaaaagatg

SEQ ID NO: 142993 - DNA, 103 bp, Artificial Sequence
  Synthetic Polynucleotide
taatacgactcactatagggttccacatacaccgccaggtccggattgcgaacagaggagacgcaatatggacctggcgaacctggcggcagcgcaaaagatg

SEQ ID NO: 142994 - DNA, 103 bp, Artificial Sequence
  Synthetic Polynucleotide
taatacgactcactatagggattaggatccattttctgaagtgtctgaagaacagaggagacttcagatgcttcagaaaaacctggcggcagcgcaaaagatg

SEQ ID NO: 142995 - DNA, 103 bp, Artificial Sequence
  Synthetic Polynucleotide
taatacgactcactatagggaatcactaacattaggatccattttctgaaaacagaggagattcagaatgtggatcctaaacctggcggcagcgcaaaagatg

SEQ ID NO: 142996 - DNA, 103 bp, Artificial Sequence
  Synthetic Polynucleotide
taatacgactcactataggggagtgttttgaatcactaacattaggatccaacagaggagaggatccatgtgttagtgaaacctggcggcagcgcaaaagatg

SEQ ID NO: 142997 - DNA, 103 bp, Artificial Sequence
  Synthetic Polynucleotide
taatacgactcactatagggatttgcaatagagtgttttgaatcactaacaacagaggagagttagtatgtcaaaacacaacctggcggcagcgcaaaagatg

SEQ ID NO: 142998 - DNA, 103 bp, Artificial Sequence
  Synthetic Polynucleotide
taatacgactcactatagggagaattttgcatttgcaatagagtgttttgaacagaggagacaaaacatgctattgcaaaacctggcggcagcgcaaaagatg

SEQ ID NO: 142999 - DNA, 103 bp, Artificial Sequence
  Synthetic Polynucleotide
taatacgactcactataggggctgtttccaagaattttgcatttgcaataaacagaggagatattgcatgtgcaaaattaacctggcggcagcgcaaaagatg

SEQ ID NO: 143000 - DNA, 103 bp, Artificial Sequence
  Synthetic Polynucleotide
taatacgactcactatagggatctttttttgctgtttccaagaattttgcaacagaggagagcaaaaatgttggaaacaaacctggcggcagcgcaaaagatg

SEQ ID NO: 143001 - DNA, 103 bp, Artificial Sequence
  Synthetic Polynucleotide
taatacgactcactatagggtctggtcagaatctttttttgctgtttccaaacagaggagatggaaaatgcaaaaaaagaacctggcggcagcgcaaaagatg

SEQ ID NO: 143002 - DNA, 103 bp, Artificial Sequence
  Synthetic Polynucleotide
taatacgactcactatagggctgacccagctctggtcagaatctttttttaacagaggagaaaaaaaatgttctgaccaaacctggcggcagcgcaaaagatg

SEQ ID NO: 143003 - DNA, 103 bp, Artificial Sequence
  Synthetic Polynucleotide
taatacgactcactatagggaactacatcactgacccagctctggtcagaaacagaggagatctgacatgagctgggtcaacctggcggcagcgcaaaagatg

SEQ ID NO: 143004 - DNA, 103 bp, Artificial Sequence
  Synthetic Polynucleotide
taatacgactcactataggggatcatcaaattccacatacaccgccaggtaacagaggagaacctggatgtgtatgtggaacctggcggcagcgcaaaagatg

SEQ ID NO: 143005 - DNA, 103 bp, Artificial Sequence
  Synthetic Polynucleotide
taatacgactcactataggggatccactttaactacatcactgacccagcaacagaggagagctgggatggtgatgtagaacctggcggcagcgcaaaagatg

SEQ ID NO: 143006 - DNA, 103 bp, Artificial Sequence
  Synthetic Polynucleotide
taatacgactcactataggggattgggttagatccactttaactacatcaaacagaggagatgatgtatgtaaagtggaaacctggcggcagcgcaaaagatg

SEQ ID NO: 143007 - DNA, 103 bp, Artificial Sequence
  Synthetic Polynucleotide
taatacgactcactatagggtgtaacacttgattgggttagatccactttaacagaggagaaaagtgatgctaacccaaaacctggcggcagcgcaaaagatg

SEQ ID NO: 143008 - DNA, 103 bp, Artificial Sequence
  Synthetic Polynucleotide
taatacgactcactatagggaagaagcatttgtaacacttgattgggttaaacagaggagataacccatgcaagtgttaaacctggcggcagcgcaaaagatg

SEQ ID NO: 143009 - DNA, 103 bp, Artificial Sequence
  Synthetic Polynucleotide
taatacgactcactatagggtcatttcctgaagaagcatttgtaacacttaacagaggagaaagtgtatgaaatgcttcaacctggcggcagcgcaaaagatg

SEQ ID NO: 143010 - DNA, 103 bp, Artificial Sequence
  Synthetic Polynucleotide
taatacgactcactataggggttcaagtgatcatttcctgaagaagcattaacagaggagaaatgctatgtcaggaaataacctggcggcagcgcaaaagatg

SEQ ID NO: 143011 - DNA, 103 bp, Artificial Sequence
  Synthetic Polynucleotide
taatacgactcactatagggctttttccatgttcaagtgatcatttcctgaacagaggagacaggaaatgatcacttgaaacctggcggcagcgcaaaagatg

SEQ ID NO: 143012 - DNA, 103 bp, Artificial Sequence
  Synthetic Polynucleotide
taatacgactcactatagggacatacttctctttttccatgttcaagtgaaacagaggagatcacttatgcatggaaaaaacctggcggcagcgcaaaagatg

SEQ ID NO: 143013 - DNA, 103 bp, Artificial Sequence
  Synthetic Polynucleotide
taatacgactcactatagggaatgtaagagacatacttctctttttccataacagaggagaatggaaatggagaagtataacctggcggcagcgcaaaagatg

SEQ ID NO: 143014 - DNA, 103 bp, Artificial Sequence
  Synthetic Polynucleotide
taatacgactcactatagggttaaaggagaaatgtaagagacatacttctaacagaggagaagaagtatgtctcttacaaacctggcggcagcgcaaaagatg

SEQ ID NO: 143015 - DNA, 103 bp, Artificial Sequence
  Synthetic Polynucleotide
taatacgactcactatagggtcccattcaagatcatcaaattccacatacaacagaggagagtatgtatgatttgatgaaacctggcggcagcgcaaaagatg

SEQ ID NO: 143016 - DNA, 103 bp, Artificial Sequence
  Synthetic Polynucleotide
taatacgactcactataggggaaactgcacttaaaggagaaatgtaagagaacagaggagactcttaatgttctcctttaacctggcggcagcgcaaaagatg

SEQ ID NO: 143017 - DNA, 103 bp, Artificial Sequence
  Synthetic Polynucleotide
taatacgactcactatagggttccatgacagaaactgcacttaaaggagaaacagaggagatctcctatgagtgcagttaacctggcggcagcgcaaaagatg

SEQ ID NO: 143018 - DNA, 103 bp, Artificial Sequence
  Synthetic Polynucleotide
taatacgactcactataggggcagcttatcttccatgacagaaactgcacaacagaggagagtgcagatgctgtcatggaacctggcggcagcgcaaaagatg

SEQ ID NO: 143019 - DNA, 103 bp, Artificial Sequence
  Synthetic Polynucleotide
taatacgactcactatagggcttcgcttatgcagcttatcttccatgacaaacagaggagatgtcatatgagataagctaacctggcggcagcgcaaaagatg

SEQ ID NO: 143020 - DNA, 103 bp, Artificial Sequence
  Synthetic Polynucleotide
taatacgactcactatagggtggaggtggacttcgcttatgcagcttatcaacagaggagagataagatgcataagcgaaacctggcggcagcgcaaaagatg

SEQ ID NO: 143021 - DNA, 103 bp, Artificial Sequence
  Synthetic Polynucleotide
taatacgactcactatagggttatagtctctggaggtggacttcgcttataacagaggagaataagcatggtccacctcaacctggcggcagcgcaaaagatg

SEQ ID NO: 143022 - DNA, 103 bp, Artificial Sequence
  Synthetic Polynucleotide
taatacgactcactatagggagtttagattttatagtctctggaggtggaaacagaggagatccaccatgagagactataacctggcggcagcgcaaaagatg

SEQ ID NO: 143023 - DNA, 103 bp, Artificial Sequence
  Synthetic Polynucleotide
taatacgactcactatagggtgaagtattaagtttagattttatagtctcaacagaggagagagactatgaaatctaaaaacctggcggcagcgcaaaagatg

SEQ ID NO: 143024 - DNA, 103 bp, Artificial Sequence
  Synthetic Polynucleotide
taatacgactcactataggggagtatctactgaagtattaagtttagattaacagaggagaaatctaatgttaatacttaacctggcggcagcgcaaaagatg

SEQ ID NO: 143025 - DNA, 103 bp, Artificial Sequence
  Synthetic Polynucleotide
taatacgactcactatagggtttatcttgtgagtatctactgaagtattaaacagaggagataatacatgagtagatacaacctggcggcagcgcaaaagatg

SEQ ID NO: 143026 - DNA, 103 bp, Artificial Sequence
  Synthetic Polynucleotide
taatacgactcactatagggctctcgtttatcccattcaagatcatcaaaaacagaggagatttgatatgcttgaatggaacctggcggcagcgcaaaagatg

SEQ ID NO: 143027 - DNA, 103 bp, Artificial Sequence
  Synthetic Polynucleotide
taatacgactcactatagggtgggctggattttatcttgtgagtatctacaacagaggagagtagatatgcacaagataaacctggcggcagcgcaaaagatg

SEQ ID NO: 143028 - DNA, 103 bp, Artificial Sequence
  Synthetic Polynucleotide
taatacgactcactatagggcttcaggtgatgggctggattttatcttgtaacagaggagaacaagaatgaatccagccaacctggcggcagcgcaaaagatg

SEQ ID NO: 143029 - DNA, 103 bp, Artificial Sequence
  Synthetic Polynucleotide
taatacgactcactatagggggtttaacaacttcaggtgatgggctggataacagaggagaatccagatgatcacctgaaacctggcggcagcgcaaaagatg

SEQ ID NO: 143030 - DNA, 103 bp, Artificial Sequence
  Synthetic Polynucleotide
taatacgactcactatagggagttattttgggtttaacaacttcaggtgaaacagaggagatcacctatggttgttaaaaacctggcggcagcgcaaaagatg

SEQ ID NO: 143031 - DNA, 103 bp, Artificial Sequence
  Synthetic Polynucleotide
taatacgactcactatagggcaggagaatgagttattttgggtttaacaaaacagaggagattgttaatgccaaaataaaacctggcggcagcgcaaaagatg

SEQ ID NO: 143032 - DNA, 103 bp, Artificial Sequence
  Synthetic Polynucleotide
taatacgactcactatagggtttacagaatcaggagaatgagttattttgaacagaggagacaaaatatgtcattctccaacctggcggcagcgcaaaagatg

SEQ ID NO: 143033 - DNA, 103 bp, Artificial Sequence
  Synthetic Polynucleotide
taatacgactcactatagggggccttagactttacagaatcaggagaatgaacagaggagacattctatggattctgtaaacctggcggcagcgcaaaagatg

SEQ ID NO: 143034 - DNA, 103 bp, Artificial Sequence
  Synthetic Polynucleotide
taatacgactcactatagggtcacataagtggccttagactttacagaataacagaggagaattctgatgagtctaaggaacctggcggcagcgcaaaagatg

SEQ ID NO: 143035 - DNA, 103 bp, Artificial Sequence
  Synthetic Polynucleotide
taatacgactcactataggggcttggctgttcacataagtggccttagacaacagaggagagtctaaatgcacttatgtaacctggcggcagcgcaaaagatg

SEQ ID NO: 143036 - DNA, 103 bp, Artificial Sequence
  Synthetic Polynucleotide
taatacgactcactatagggttcaccagtagcttggctgttcacataagtaacagaggagaacttatatgaacagccaaaacctggcggcagcgcaaaagatg

SEQ ID NO: 143037 - DNA, 103 bp, Artificial Sequence
  Synthetic Polynucleotide
taatacgactcactatagggaccgcttacccaccagctctgcccgcgtctaacagaggagaagacgcatgcagagctggaacctggcggcagcgcaaaagatg

SEQ ID NO: 143038 - DNA, 103 bp, Artificial Sequence
  Synthetic Polynucleotide
taatacgactcactatagggctttaacccactctcgtttatcccattcaaaacagaggagattgaatatgataaacgagaacctggcggcagcgcaaaagatg

SEQ ID NO: 143039 - DNA, 103 bp, Artificial Sequence
  Synthetic Polynucleotide
taatacgactcactatagggccaatcttctttcaccagtagcttggctgtaacagaggagaacagccatgctactggtgaacctggcggcagcgcaaaagatg

SEQ ID NO: 143040 - DNA, 103 bp, Artificial Sequence
  Synthetic Polynucleotide
taatacgactcactatagggatcttatttgccaatcttctttcaccagtaaacagaggagatactggatgaagaagattaacctggcggcagcgcaaaagatg

SEQ ID NO: 143041 - DNA, 103 bp, Artificial Sequence
  Synthetic Polynucleotide
taatacgactcactatagggctcatgttctatcttatttgccaatcttctaacagaggagaagaagaatggcaaataagaacctggcggcagcgcaaaagatg

SEQ ID NO: 143042 - DNA, 103 bp, Artificial Sequence
  Synthetic Polynucleotide
taatacgactcactatagggatcttgatagctcatgttctatcttatttgaacagaggagacaaataatgtagaacatgaacctggcggcagcgcaaaagatg

SEQ ID NO: 143043 - DNA, 103 bp, Artificial Sequence
  Synthetic Polynucleotide
taatacgactcactatagggtgaaaactgcatcttgatagctcatgttctaacagaggagaagaacaatggctatcaagaacctggcggcagcgcaaaagatg

SEQ ID NO: 143044 - DNA, 103 bp, Artificial Sequence
  Synthetic Polynucleotide
taatacgactcactatagggaggaattggatgaaaactgcatcttgatagaacagaggagactatcaatgtgcagttttaacctggcggcagcgcaaaagatg

SEQ ID NO: 143045 - DNA, 103 bp, Artificial Sequence
  Synthetic Polynucleotide
taatacgactcactatagggtgcttcgagtaggaattggatgaaaactgcaacagaggagagcagttatgatccaattcaacctggcggcagcgcaaaagatg

SEQ ID NO: 143046 - DNA, 103 bp, Artificial Sequence
  Synthetic Polynucleotide
taatacgactcactatagggtctaatgtactgcttcgagtaggaattggaaacagaggagatccaatatgtactcgaagaacctggcggcagcgcaaaagatg

SEQ ID NO: 143047 - DNA, 103 bp, Artificial Sequence
  Synthetic Polynucleotide
taatacgactcactatagggctttgtagtttctaatgtactgcttcgagtaacagaggagaactcgaatgagtacattaaacctggcggcagcgcaaaagatg

SEQ ID NO: 143048 - DNA, 103 bp, Artificial Sequence
  Synthetic Polynucleotide
taatacgactcactatagggtaagaggactctttgtagtttctaatgtacaacagaggagagtacatatgaaactacaaaacctggcggcagcgcaaaagatg

SEQ ID NO: 143049 - DNA, 103 bp, Artificial Sequence
  Synthetic Polynucleotide
taatacgactcactatagggtcttcataaactttaacccactctcgtttaaacagaggagataaacgatggtgggttaaaacctggcggcagcgcaaaagatg

SEQ ID NO: 143050 - DNA, 103 bp, Artificial Sequence
  Synthetic Polynucleotide
taatacgactcactatagggttatcaatgataagaggactctttgtagttaacagaggagaaactacatggagtcctctaacctggcggcagcgcaaaagatg

SEQ ID NO: 143051 - DNA, 103 bp, Artificial Sequence
  Synthetic Polynucleotide
taatacgactcactatagggatgctcatttttatcaatgataagaggactaacagaggagaagtcctatgatcattgataacctggcggcagcgcaaaagatg

SEQ ID NO: 143052 - DNA, 103 bp, Artificial Sequence
  Synthetic Polynucleotide
taatacgactcactatagggaaactgtaaaatgctcatttttatcaatgaaacagaggagatcattgatgaaaatgagcaacctggcggcagcgcaaaagatg

SEQ ID NO: 143053 - DNA, 103 bp, Artificial Sequence
  Synthetic Polynucleotide
taatacgactcactatagggggatctctgtaaactgtaaaatgctcatttaacagaggagaaaatgaatgttttacagtaacctggcggcagcgcaaaagatg

SEQ ID NO: 143054 - DNA, 103 bp, Artificial Sequence
  Synthetic Polynucleotide
taatacgactcactatagggaataagtgcaggatctctgtaaactgtaaaaacagaggagatttacaatgtacagagataacctggcggcagcgcaaaagatg

SEQ ID NO: 143055 - DNA, 103 bp, Artificial Sequence
  Synthetic Polynucleotide
taatacgactcactatagggtttctgacccaataagtgcaggatctctgtaacagaggagaacagagatgctgcacttaaacctggcggcagcgcaaaagatg

SEQ ID NO: 143056 - DNA, 103 bp, Artificial Sequence
  Synthetic Polynucleotide
taatacgactcactatagggttagctcctgtttctgacccaataagtgcaaacagaggagatgcactatgtgggtcagaaacctggcggcagcgcaaaagatg

SEQ ID NO: 143057 - DNA, 103 bp, Artificial Sequence
  Synthetic Polynucleotide
taatacgactcactatagggtgaaatatgattagctcctgtttctgacccaacagaggagagggtcaatgacaggagctaacctggcggcagcgcaaaagatg

SEQ ID NO: 143058 - DNA, 103 bp, Artificial Sequence
  Synthetic Polynucleotide
taatacgactcactatagggttaggaaaggtgaaatatgattagctcctgaacagaggagacaggagatgatcatatttaacctggcggcagcgcaaaagatg

SEQ ID NO: 143059 - DNA, 103 bp, Artificial Sequence
  Synthetic Polynucleotide
taatacgactcactatagggggatgctggcttaggaaaggtgaaatatgaaacagaggagatcatatatgacctttcctaacctggcggcagcgcaaaagatg

SEQ ID NO: 143060 - DNA, 103 bp, Artificial Sequence
  Synthetic Polynucleotide
taatacgactcactatagggagttgaaaaatcttcataaactttaacccaaacagaggagatgggttatggtttatgaaaacctggcggcagcgcaaaagatg

SEQ ID NO: 143061 - DNA, 103 bp, Artificial Sequence
  Synthetic Polynucleotide
taatacgactcactatagggaagaggaaaaggatgctggcttaggaaaggaacagaggagacctttcatgagccagcataacctggcggcagcgcaaaagatg

SEQ ID NO: 143062 - DNA, 103 bp, Artificial Sequence
  Synthetic Polynucleotide
taatacgactcactatagggatgaggagtgaagaggaaaaggatgctggcaacagaggagagccagcatgcttttcctcaacctggcggcagcgcaaaagatg

SEQ ID NO: 143063 - DNA, 103 bp, Artificial Sequence
  Synthetic Polynucleotide
taatacgactcactataggggttctatgagatgaggagtgaagaggaaaaaacagaggagattttccatgtcactcctcaacctggcggcagcgcaaaagatg

SEQ ID NO: 143064 - DNA, 103 bp, Artificial Sequence
  Synthetic Polynucleotide
taatacgactcactatagggatttaaacaggttctatgagatgaggagtgaacagaggagacactccatgtctcatagaaacctggcggcagcgcaaaagatg

SEQ ID NO: 143065 - DNA, 103 bp, Artificial Sequence
  Synthetic Polynucleotide
taatacgactcactataggggggtacctggatttaaacaggttctatgagaacagaggagactcataatgcctgtttaaaacctggcggcagcgcaaaagatg

SEQ ID NO: 143066 - DNA, 103 bp, Artificial Sequence
  Synthetic Polynucleotide
taatacgactcactataggggcaggatgatgggtacctggatttaaacagaacagaggagactgtttatgtccaggtacaacctggcggcagcgcaaaagatg

SEQ ID NO: 143067 - DNA, 103 bp, Artificial Sequence
  Synthetic Polynucleotide
taatacgactcactatagggaggagttaaggcaggatgatgggtacctggaacagaggagaccaggtatgcatcatcctaacctggcggcagcgcaaaagatg

SEQ ID NO: 143068 - DNA, 103 bp, Artificial Sequence
  Synthetic Polynucleotide
taatacgactcactatagggaatggggtgcaggagttaaggcaggatgataacagaggagaatcatcatgccttaactcaacctggcggcagcgcaaaagatg

SEQ ID NO: 143069 - DNA, 103 bp, Artificial Sequence
  Synthetic Polynucleotide
taatacgactcactatagggccggctagtaaatggggtgcaggagttaagaacagaggagacttaacatgtgcaccccaaacctggcggcagcgcaaaagatg

SEQ ID NO: 143070 - DNA, 103 bp, Artificial Sequence
  Synthetic Polynucleotide
taatacgactcactatagggactagatgatccggctagtaaatggggtgcaacagaggagagcacccatgttactagccaacctggcggcagcgcaaaagatg

SEQ ID NO: 143071 - DNA, 103 bp, Artificial Sequence
  Synthetic Polynucleotide
taatacgactcactatagggccaccaagaaagttgaaaaatcttcataaaaacagaggagatttatgatgatttttcaaaacctggcggcagcgcaaaagatg

SEQ ID NO: 143072 - DNA, 103 bp, Artificial Sequence
  Synthetic Polynucleotide
taatacgactcactatagggatggagtttgactagatgatccggctagtaaacagaggagatactagatggatcatctaaacctggcggcagcgcaaaagatg

SEQ ID NO: 143073 - DNA, 103 bp, Artificial Sequence
  Synthetic Polynucleotide
taatacgactcactatagggatggtaggtaatggagtttgactagatgataacagaggagaatcatcatgtcaaactccaacctggcggcagcgcaaaagatg

SEQ ID NO: 143074 - DNA, 103 bp, Artificial Sequence
  Synthetic Polynucleotide
taatacgactcactatagggatgagtgttaatggtaggtaatggagtttgaacagaggagacaaactatgttacctaccaacctggcggcagcgcaaaagatg

SEQ ID NO: 143075 - DNA, 103 bp, Artificial Sequence
  Synthetic Polynucleotide
taatacgactcactatagggtagtcagaggatgagtgttaatggtaggtaaacagaggagatacctaatgttaacactcaacctggcggcagcgcaaaagatg

SEQ ID NO: 143076 - DNA, 103 bp, Artificial Sequence
  Synthetic Polynucleotide
taatacgactcactatagggtgtggaccactagtcagaggatgagtgttaaacagaggagataacacatgtcctctgacaacctggcggcagcgcaaaagatg

SEQ ID NO: 143077 - DNA, 103 bp, Artificial Sequence
  Synthetic Polynucleotide
taatacgactcactatagggaacagcatggtgtggaccactagtcagaggaacagaggagacctctgatgagtggtccaaacctggcggcagcgcaaaagatg

SEQ ID NO: 143078 - DNA, 103 bp, Artificial Sequence
  Synthetic Polynucleotide
taatacgactcactataggggagggtgatgaacagcatggtgtggaccacaacagaggagagtggtcatgaccatgctgaacctggcggcagcgcaaaagatg

SEQ ID NO: 143079 - DNA, 103 bp, Artificial Sequence
  Synthetic Polynucleotide
taatacgactcactatagggggaagtaaatgagggtgatgaacagcatggaacagaggagaccatgcatgtcatcacccaacctggcggcagcgcaaaagatg

SEQ ID NO: 143080 - DNA, 103 bp, Artificial Sequence
  Synthetic Polynucleotide
taatacgactcactatagggtaacacagtgggaagtaaatgagggtgatgaacagaggagacatcacatgcatttacttaacctggcggcagcgcaaaagatg

SEQ ID NO: 143081 - DNA, 103 bp, Artificial Sequence
  Synthetic Polynucleotide
taatacgactcactataggggcactccaggtaacacagtgggaagtaaataacagaggagaatttacatgccactgtgtaacctggcggcagcgcaaaagatg

SEQ ID NO: 143082 - DNA, 103 bp, Artificial Sequence
  Synthetic Polynucleotide
taatacgactcactatagggaagtggtattccaccaagaaagttgaaaaaaacagaggagatttttcatgtttcttggtaacctggcggcagcgcaaaagatg

SEQ ID NO: 143083 - DNA, 103 bp, Artificial Sequence
  Synthetic Polynucleotide
taatacgactcactataggggaggcagtaggcactccaggtaacacagtgaacagaggagacactgtatgacctggagtaacctggcggcagcgcaaaagatg

SEQ ID NO: 143084 - DNA, 103 bp, Artificial Sequence
  Synthetic Polynucleotide
taatacgactcactatagggaccaagtaaggaggcagtaggcactccaggaacagaggagacctggaatgcctactgccaacctggcggcagcgcaaaagatg

SEQ ID NO: 143085 - DNA, 103 bp, Artificial Sequence
  Synthetic Polynucleotide
taatacgactcactataggggtgggtggccaccaagtaaggaggcagtagaacagaggagactactgatgccttacttgaacctggcggcagcgcaaaagatg

SEQ ID NO: 143086 - DNA, 103 bp, Artificial Sequence
  Synthetic Polynucleotide
taatacgactcactatagggctctctagtcgtgggtggccaccaagtaagaacagaggagacttactatgtggccacccaacctggcggcagcgcaaaagatg

SEQ ID NO: 143087 - DNA, 103 bp, Artificial Sequence
  Synthetic Polynucleotide
taatacgactcactatagggggcatgagcactctctagtcgtgggtggccaacagaggagaggccacatgcgactagagaacctggcggcagcgcaaaagatg

SEQ ID NO: 143088 - DNA, 103 bp, Artificial Sequence
  Synthetic Polynucleotide
taatacgactcactatagggtcaagctgctggcatgagcactctctagtcaacagaggagagactagatggtgctcatgaacctggcggcagcgcaaaagatg

SEQ ID NO: 143089 - DNA, 103 bp, Artificial Sequence
  Synthetic Polynucleotide
taatacgactcactataggggctaagtggctcaagctgctggcatgagcaaacagaggagatgctcaatgcagcagcttaacctggcggcagcgcaaaagatg

SEQ ID NO: 143090 - DNA, 103 bp, Artificial Sequence
  Synthetic Polynucleotide
taatacgactcactataggggtgtgctagcgctaagtggctcaagctgctaacagaggagaagcagcatgagccacttaaacctggcggcagcgcaaaagatg

SEQ ID NO: 143091 - DNA, 103 bp, Artificial Sequence
  Synthetic Polynucleotide
taatacgactcactataggggttgttgctggtgtgctagcgctaagtggcaacagaggagagccactatgcgctagcacaacctggcggcagcgcaaaagatg

SEQ ID NO: 143092 - DNA, 103 bp, Artificial Sequence
  Synthetic Polynucleotide
taatacgactcactatagggaacaactgttgttgttgctggtgtgctagcaacagaggagagctagcatgccagcaacaaacctggcggcagcgcaaaagatg

SEQ ID NO: 143093 - DNA, 103 bp, Artificial Sequence
  Synthetic Polynucleotide
taatacgactcactatagggggcccagattaagtggtattccaccaagaaaacagaggagattcttgatggaataccacaacctggcggcagcgcaaaagatg

SEQ ID NO: 143094 - DNA, 103 bp, Artificial Sequence
  Synthetic Polynucleotide
taatacgactcactatagggctggtgctgtaacaactgttgttgttgctgaacagaggagacagcaaatgcaacagttgaacctggcggcagcgcaaaagatg

SEQ ID NO: 143095 - DNA, 103 bp, Artificial Sequence
  Synthetic Polynucleotide
taatacgactcactataggggatgaggtgactggtgctgtaacaactgttaacagaggagaaacagtatgtacagcaccaacctggcggcagcgcaaaagatg

SEQ ID NO: 143096 - DNA, 103 bp, Artificial Sequence
  Synthetic Polynucleotide
taatacgactcactatagggtgtccaagaagatgaggtgactggtgctgtaacagaggagaacagcaatggtcacctcaaacctggcggcagcgcaaaagatg

SEQ ID NO: 143097 - DNA, 103 bp, Artificial Sequence
  Synthetic Polynucleotide
taatacgactcactatagggaggatgggcttgtccaagaagatgaggtgaaacagaggagatcacctatgcttcttggaaacctggcggcagcgcaaaagatg

SEQ ID NO: 143098 - DNA, 103 bp, Artificial Sequence
  Synthetic Polynucleotide
taatacgactcactatagggatgaagcagaaggatgggcttgtccaagaaaacagaggagattcttgatgaagcccatcaacctggcggcagcgcaaaagatg

SEQ ID NO: 143099 - DNA, 103 bp, Artificial Sequence
  Synthetic Polynucleotide
taatacgactcactatagggagctgattatatgaagcagaaggatgggctaacagaggagaagcccaatgttctgcttcaacctggcggcagcgcaaaagatg

SEQ ID NO: 143100 - DNA, 103 bp, Artificial Sequence
  Synthetic Polynucleotide
taatacgactcactatagggataaagtccaagctgattatatgaagcagaaacagaggagatctgctatgtataatcagaacctggcggcagcgcaaaagatg

SEQ ID NO: 143101 - DNA, 103 bp, Artificial Sequence
  Synthetic Polynucleotide
taatacgactcactatagggaaataattggataaagtccaagctgattataacagaggagaataatcatgttggactttaacctggcggcagcgcaaaagatg

SEQ ID NO: 143102 - DNA, 103 bp, Artificial Sequence
  Synthetic Polynucleotide
taatacgactcactatagggggatactgccaaataattggataaagtccaaacagaggagatggactatgtccaattataacctggcggcagcgcaaaagatg

SEQ ID NO: 143103 - DNA, 103 bp, Artificial Sequence
  Synthetic Polynucleotide
taatacgactcactatagggtgttccatttggatactgccaaataattggaacagaggagaccaattatgtggcagtataacctggcggcagcgcaaaagatg

SEQ ID NO: 143104 - DNA, 103 bp, Artificial Sequence
  Synthetic Polynucleotide
taatacgactcactatagggcattccttttggcccagattaagtggtattaacagaggagaaataccatgtaatctgggaacctggcggcagcgcaaaagatg

SEQ ID NO: 143105 - DNA, 103 bp, Artificial Sequence
  Synthetic Polynucleotide
taatacgactcactatagggagtatgcatgtgttccatttggatactgccaacagaggagaggcagtatgcaaatggaaaacctggcggcagcgcaaaagatg

SEQ ID NO: 143106 - DNA, 103 bp, Artificial Sequence
  Synthetic Polynucleotide
taatacgactcactatagggccaagtcctgagtatgcatgtgttccatttaacagaggagaaaatggatgacatgcataaacctggcggcagcgcaaaagatg

SEQ ID NO: 143107 - DNA, 103 bp, Artificial Sequence
  Synthetic Polynucleotide
taatacgactcactatagggagaaggcaaaccaagtcctgagtatgcatgaacagaggagacatgcaatgtcaggacttaacctggcggcagcgcaaaagatg

SEQ ID NO: 143108 - DNA, 103 bp, Artificial Sequence
  Synthetic Polynucleotide
taatacgactcactatagggcccacttagaagaaggcaaaccaagtcctgaacagaggagacaggacatggtttgccttaacctggcggcagcgcaaaagatg

SEQ ID NO: 143109 - DNA, 103 bp, Artificial Sequence
  Synthetic Polynucleotide
taatacgactcactatagggtctgggtgaacccacttagaagaaggcaaaaacagaggagatttgccatgttctaagtgaacctggcggcagcgcaaaagatg

SEQ ID NO: 143110 - DNA, 103 bp, Artificial Sequence
  Synthetic Polynucleotide
taatacgactcactatagggaactgcattttctgggtgaacccacttagaaacagaggagatctaagatggttcacccaaacctggcggcagcgcaaaagatg

SEQ ID NO: 143111 - DNA, 103 bp, Artificial Sequence
  Synthetic Polynucleotide
taatacgactcactatagggcttcagcattaactgcattttctgggtgaaaacagaggagattcaccatgaaaatgcagaacctggcggcagcgcaaaagatg

SEQ ID NO: 143112 - DNA, 103 bp, Artificial Sequence
  Synthetic Polynucleotide
taatacgactcactatagggcttaatgaagcttcagcattaactgcatttaacagaggagaaaatgcatgtaatgctgaaacctggcggcagcgcaaaagatg

SEQ ID NO: 143113 - DNA, 103 bp, Artificial Sequence
  Synthetic Polynucleotide
taatacgactcactatagggagaattcctccttaatgaagcttcagcattaacagaggagaaatgctatggcttcattaaacctggcggcagcgcaaaagatg

SEQ ID NO: 143114 - DNA, 103 bp, Artificial Sequence
  Synthetic Polynucleotide
taatacgactcactatagggaaggactgggagaattcctccttaatgaagaacagaggagacttcatatgggaggaattaacctggcggcagcgcaaaagatg

SEQ ID NO: 143115 - DNA, 103 bp, Artificial Sequence
  Synthetic Polynucleotide
taatacgactcactatagggtggctagggtcattccttttggcccagattaacagaggagaaatctgatgcaaaaggaaaacctggcggcagcgcaaaagatg

SEQ ID NO: 143116 - DNA, 103 bp, Artificial Sequence
  Synthetic Polynucleotide
taatacgactcactatagggtgatgtagccaaggactgggagaattcctcaacagaggagagaggaaatgtcccagtccaacctggcggcagcgcaaaagatg

SEQ ID NO: 143117 - DNA, 103 bp, Artificial Sequence
  Synthetic Polynucleotide
taatacgactcactatagggaggggtgggctgatgtagccaaggactgggaacagaggagacccagtatgtggctacataacctggcggcagcgcaaaagatg

SEQ ID NO: 143118 - DNA, 103 bp, Artificial Sequence
  Synthetic Polynucleotide
taatacgactcactatagggctgaggtcacaggggtgggctgatgtagccaacagaggagaggctacatgagcccacccaacctggcggcagcgcaaaagatg

SEQ ID NO: 143119 - DNA, 103 bp, Artificial Sequence
  Synthetic Polynucleotide
taatacgactcactatagggataccatctgctgaggtcacaggggtgggcaacagaggagagcccacatgtgtgacctcaacctggcggcagcgcaaaagatg

SEQ ID NO: 143120 - DNA, 103 bp, Artificial Sequence
  Synthetic Polynucleotide
taatacgactcactatagggaagtaatccaataccatctgctgaggtcacaacagaggagagtgaccatggcagatggtaacctggcggcagcgcaaaagatg

SEQ ID NO: 143121 - DNA, 103 bp, Artificial Sequence
  Synthetic Polynucleotide
taatacgactcactataggggaatgtgactaagtaatccaataccatctgaacagaggagacagatgatgttggattacaacctggcggcagcgcaaaagatg

SEQ ID NO: 143122 - DNA, 103 bp, Artificial Sequence
  Synthetic Polynucleotide
taatacgactcactatagggggtctgacaggaatgtgactaagtaatccaaacagaggagatggattatgtagtcacataacctggcggcagcgcaaaagatg

SEQ ID NO: 143123 - DNA, 103 bp, Artificial Sequence
  Synthetic Polynucleotide
taatacgactcactatagggtgcactggaaggtctgacaggaatgtgactaacagaggagaagtcacatgcctgtcagaaacctggcggcagcgcaaaagatg

SEQ ID NO: 143124 - DNA, 103 bp, Artificial Sequence
  Synthetic Polynucleotide
taatacgactcactataggggatgaggctctgcactggaaggtctgacagaacagaggagactgtcaatgcttccagtgaacctggcggcagcgcaaaagatg

SEQ ID NO: 143125 - DNA, 103 bp, Artificial Sequence
  Synthetic Polynucleotide
taatacgactcactatagggttaagaggccgatgaggctctgcactggaaaacagaggagattccagatgagagcctcaaacctggcggcagcgcaaaagatg

SEQ ID NO: 143126 - DNA, 103 bp, Artificial Sequence
  Synthetic Polynucleotide
taatacgactcactatagggtccctgagtctggctagggtcattccttttaacagaggagaaaaaggatggaccctagcaacctggcggcagcgcaaaagatg

SEQ ID NO: 143127 - DNA, 103 bp, Artificial Sequence
  Synthetic Polynucleotide
taatacgactcactatagggggctgtaattttaagaggccgatgaggctcaacagaggagagagcctatgcggcctcttaacctggcggcagcgcaaaagatg

SEQ ID NO: 143128 - DNA, 103 bp, Artificial Sequence
  Synthetic Polynucleotide
taatacgactcactataggggactggaatgggctgtaattttaagaggccaacagaggagaggcctcatgaaattacagaacctggcggcagcgcaaaagatg

SEQ ID NO: 143129 - DNA, 103 bp, Artificial Sequence
  Synthetic Polynucleotide
taatacgactcactataggggtcaatggtggactggaatgggctgtaattaacagaggagaaattacatgccattccagaacctggcggcagcgcaaaagatg

SEQ ID NO: 143130 - DNA, 103 bp, Artificial Sequence
  Synthetic Polynucleotide
taatacgactcactatagggtaaagtttttgtcaatggtggactggaatgaacagaggagacattccatgccaccattgaacctggcggcagcgcaaaagatg

SEQ ID NO: 143131 - DNA, 103 bp, Artificial Sequence
  Synthetic Polynucleotide
taatacgactcactataggggatgatctactaaagtttttgtcaatggtgaacagaggagacaccatatgcaaaaacttaacctggcggcagcgcaaaagatg

SEQ ID NO: 143132 - DNA, 103 bp, Artificial Sequence
  Synthetic Polynucleotide
taatacgactcactatagggtcttccttatgatgatctactaaagtttttaacagaggagaaaaaacatgagtagatcaaacctggcggcagcgcaaaagatg

SEQ ID NO: 143133 - DNA, 103 bp, Artificial Sequence
  Synthetic Polynucleotide
taatacgactcactatagggtctttctaattcttccttatgatgatctacaacagaggagagtagatatgcataaggaaaacctggcggcagcgcaaaagatg

SEQ ID NO: 143134 - DNA, 103 bp, Artificial Sequence
  Synthetic Polynucleotide
taatacgactcactatagggtaaaagcttttctttctaattcttccttataacagaggagaataaggatgaattagaaaaacctggcggcagcgcaaaagatg

SEQ ID NO: 143135 - DNA, 103 bp, Artificial Sequence
  Synthetic Polynucleotide
taatacgactcactatagggaatggttccataaaagcttttctttctaataacagaggagaattagaatgaaaagctttaacctggcggcagcgcaaaagatg

SEQ ID NO: 143136 - DNA, 103 bp, Artificial Sequence
  Synthetic Polynucleotide
taatacgactcactatagggaacagaccgtaatggttccataaaagctttaacagaggagaaaagctatgatggaaccaaacctggcggcagcgcaaaagatg

SEQ ID NO: 143137 - DNA, 103 bp, Artificial Sequence
  Synthetic Polynucleotide
taatacgactcactatagggtgctctttgatccctgagtctggctagggtaacagaggagaaccctaatgagactcaggaacctggcggcagcgcaaaagatg

SEQ ID NO: 143138 - DNA, 103 bp, Artificial Sequence
  Synthetic Polynucleotide
taatacgactcactatagggatgtggatgcaacagaccgtaatggttccaaacagaggagatggaacatgtacggtctgaacctggcggcagcgcaaaagatg

SEQ ID NO: 143139 - DNA, 103 bp, Artificial Sequence
  Synthetic Polynucleotide
taatacgactcactatagggtttttggctgatgtggatgcaacagaccgtaacagaggagaacggtcatgtgcatccacaacctggcggcagcgcaaaagatg

SEQ ID NO: 143140 - DNA, 103 bp, Artificial Sequence
  Synthetic Polynucleotide
taatacgactcactatagggatccaggtcatttttggctgatgtggatgcaacagaggagagcatccatgtcagccaaaaacctggcggcagcgcaaaagatg

SEQ ID NO: 143141 - DNA, 103 bp, Artificial Sequence
  Synthetic Polynucleotide
taatacgactcactatagggacctatttagatccaggtcatttttggctgaacagaggagacagccaatgatgacctggaacctggcggcagcgcaaaagatg

SEQ ID NO: 143142 - DNA, 103 bp, Artificial Sequence
  Synthetic Polynucleotide
taatacgactcactatagggccagtctgtgacctatttagatccaggtcaaacagaggagatgacctatgtctaaatagaacctggcggcagcgcaaaagatg

SEQ ID NO: 143143 - DNA, 103 bp, Artificial Sequence
  Synthetic Polynucleotide
taatacgactcactatagggacaatcttttccagtctgtgacctatttagaacagaggagactaaatatgtcacagactaacctggcggcagcgcaaaagatg

SEQ ID NO: 143144 - DNA, 103 bp, Artificial Sequence
  Synthetic Polynucleotide
taatacgactcactatagggtatgtaagtgacaatcttttccagtctgtgaacagaggagacacagaatggaaaagattaacctggcggcagcgcaaaagatg

SEQ ID NO: 143145 - DNA, 103 bp, Artificial Sequence
  Synthetic Polynucleotide
taatacgactcactatagggacaaaatgcctatgtaagtgacaatcttttaacagaggagaaaaagaatgtcacttacaaacctggcggcagcgcaaaagatg

SEQ ID NO: 143146 - DNA, 103 bp, Artificial Sequence
  Synthetic Polynucleotide
taatacgactcactatagggtactggatccacaaaatgcctatgtaagtgaacagaggagacacttaatgaggcattttaacctggcggcagcgcaaaagatg

SEQ ID NO: 143147 - DNA, 103 bp, Artificial Sequence
  Synthetic Polynucleotide
taatacgactcactatagggactgatttaatactggatccacaaaatgccaacagaggagaggcattatgtggatccagaacctggcggcagcgcaaaagatg

SEQ ID NO: 143148 - DNA, 103 bp, Artificial Sequence
  Synthetic Polynucleotide
taatacgactcactatagggacacacaggaaccgcttacccaccagctctaacagaggagaagagctatggggtaagcgaacctggcggcagcgcaaaagatg

SEQ ID NO: 143149 - DNA, 103 bp, Artificial Sequence
  Synthetic Polynucleotide
taatacgactcactatagggtgaatctgtttgctctttgatccctgagtcaacagaggagagactcaatgatcaaagagaacctggcggcagcgcaaaagatg

SEQ ID NO: 143150 - DNA, 103 bp, Artificial Sequence
  Synthetic Polynucleotide
taatacgactcactatagggggcctctgtaactgatttaatactggatccaacagaggagaggatccatgattaaatcaaacctggcggcagcgcaaaagatg

SEQ ID NO: 143151 - DNA, 103 bp, Artificial Sequence
  Synthetic Polynucleotide
taatacgactcactatagggctcctggggtggcctctgtaactgatttaaaacagaggagattaaatatgttacagaggaacctggcggcagcgcaaaagatg

SEQ ID NO: 143152 - DNA, 103 bp, Artificial Sequence
  Synthetic Polynucleotide
taatacgactcactatagggtctctccagtctcctggggtggcctctgtaaacagaggagatacagaatgcaccccaggaacctggcggcagcgcaaaagatg

SEQ ID NO: 143153 - DNA, 103 bp, Artificial Sequence
  Synthetic Polynucleotide
taatacgactcactatagggttgtttaacctctctccagtctcctggggtaacagaggagaaccccaatggactggagaaacctggcggcagcgcaaaagatg

SEQ ID NO: 143154 - DNA, 103 bp, Artificial Sequence
  Synthetic Polynucleotide
taatacgactcactatagggctctttgtatttgtttaacctctctccagtaacagaggagaactggaatgaggttaaacaacctggcggcagcgcaaaagatg

SEQ ID NO: 143155 - DNA, 103 bp, Artificial Sequence
  Synthetic Polynucleotide
taatacgactcactataggggacggtgttcctctttgtatttgtttaaccaacagaggagaggttaaatgaatacaaagaacctggcggcagcgcaaaagatg

SEQ ID NO: 143156 - DNA, 103 bp, Artificial Sequence
  Synthetic Polynucleotide
taatacgactcactatagggtgaagaattcgacggtgttcctctttgtataacagaggagaatacaaatgggaacaccgaacctggcggcagcgcaaaagatg

SEQ ID NO: 143157 - DNA, 103 bp, Artificial Sequence
  Synthetic Polynucleotide
taatacgactcactatagggaatactttcttgaagaattcgacggtgttcaacagaggagagaacacatgcgaattcttaacctggcggcagcgcaaaagatg

SEQ ID NO: 143158 - DNA, 103 bp, Artificial Sequence
  Synthetic Polynucleotide
taatacgactcactataggggagcaacatcaatactttcttgaagaattcaacagaggagagaattcatgaagaaagtaaacctggcggcagcgcaaaagatg

SEQ ID NO: 143159 - DNA, 103 bp, Artificial Sequence
  Synthetic Polynucleotide
taatacgactcactataggggttgtaaagggagcaacatcaatactttctaacagaggagaagaaagatgtgatgttgcaacctggcggcagcgcaaaagatg

SEQ ID NO: 143160 - DNA, 103 bp, Artificial Sequence
  Synthetic Polynucleotide
taatacgactcactatagggtgcaggccactgaatctgtttgctctttgaaacagaggagatcaaagatgaaacagattaacctggcggcagcgcaaaagatg

SEQ ID NO: 143161 - DNA, 103 bp, Artificial Sequence
  Synthetic Polynucleotide
taatacgactcactatagggcttgattttagttgtaaagggagcaacatcaacagaggagagatgttatgccctttacaaacctggcggcagcgcaaaagatg

SEQ ID NO: 143162 - DNA, 103 bp, Artificial Sequence
  Synthetic Polynucleotide
taatacgactcactatagggcctcaagtcccttgattttagttgtaaaggaacagaggagacctttaatgctaaaatcaaacctggcggcagcgcaaaagatg

SEQ ID NO: 143163 - DNA, 103 bp, Artificial Sequence
  Synthetic Polynucleotide
taatacgactcactatagggtctctctcaccctcaagtcccttgattttaaacagaggagataaaatatggggacttgaaacctggcggcagcgcaaaagatg

SEQ ID NO: 143164 - DNA, 103 bp, Artificial Sequence
  Synthetic Polynucleotide
taatacgactcactatagggggaataattctctctctcaccctcaagtccaacagaggagaggacttatgggtgagagaaacctggcggcagcgcaaaagatg

SEQ ID NO: 143165 - DNA, 103 bp, Artificial Sequence
  Synthetic Polynucleotide
taatacgactcactatagggatgccactctggaataattctctctctcacaacagaggagagtgagaatgagaattattaacctggcggcagcgcaaaagatg

SEQ ID NO: 143166 - DNA, 103 bp, Artificial Sequence
  Synthetic Polynucleotide
taatacgactcactataggggaagatgatgatgccactctggaataattcaacagaggagagaattaatgcagagtggcaacctggcggcagcgcaaaagatg

SEQ ID NO: 143167 - DNA, 103 bp, Artificial Sequence
  Synthetic Polynucleotide
taatacgactcactatagggtttaggactggaagatgatgatgccactctaacagaggagaagagtgatgtcatcatctaacctggcggcagcgcaaaagatg

SEQ ID NO: 143168 - DNA, 103 bp, Artificial Sequence
  Synthetic Polynucleotide
taatacgactcactatagggtgatatggcttttaggactggaagatgatgaacagaggagacatcatatgccagtcctaaacctggcggcagcgcaaaagatg

SEQ ID NO: 143169 - DNA, 103 bp, Artificial Sequence
  Synthetic Polynucleotide
taatacgactcactatagggtcttgtttgatgatatggcttttaggactgaacagaggagacagtccatgaagccatataacctggcggcagcgcaaaagatg

SEQ ID NO: 143170 - DNA, 103 bp, Artificial Sequence
  Synthetic Polynucleotide
taatacgactcactatagggtacatccatatcttgtttgatgatatggctaacagaggagaagccatatgatcaaacaaaacctggcggcagcgcaaaagatg

SEQ ID NO: 143171 - DNA, 103 bp, Artificial Sequence
  Synthetic Polynucleotide
taatacgactcactatagggtgaaagtcaatgcaggccactgaatctgttaacagaggagaaacagaatgagtggcctgaacctggcggcagcgcaaaagatg

SEQ ID NO: 143172 - DNA, 103 bp, Artificial Sequence
  Synthetic Polynucleotide
taatacgactcactatagggctgagcgttctacatccatatcttgtttgaaacagaggagatcaaacatgatatggatgaacctggcggcagcgcaaaagatg

SEQ ID NO: 143173 - DNA, 103 bp, Artificial Sequence
  Synthetic Polynucleotide
taatacgactcactatagggagatctgatactgagcgttctacatccataaacagaggagatatggaatgagaacgctcaacctggcggcagcgcaaaagatg

SEQ ID NO: 143174 - DNA, 103 bp, Artificial Sequence
  Synthetic Polynucleotide
taatacgactcactatagggcattttataaagatctgatactgagcgttcaacagaggagagaacgcatggtatcagataacctggcggcagcgcaaaagatg

SEQ ID NO: 143175 - DNA, 103 bp, Artificial Sequence
  Synthetic Polynucleotide
taatacgactcactatagggctgagtgcttcattttataaagatctgataaacagaggagatatcagatgtttataaaaaacctggcggcagcgcaaaagatg

SEQ ID NO: 143176 - DNA, 103 bp, Artificial Sequence
  Synthetic Polynucleotide
taatacgactcactatagggctctgaggcactgagtgcttcattttataaaacagaggagattataaatggaagcactcaacctggcggcagcgcaaaagatg

SEQ ID NO: 143177 - DNA, 103 bp, Artificial Sequence
  Synthetic Polynucleotide
taatacgactcactatagggttggggtaaactctgaggcactgagtgcttaacagaggagaaagcacatggtgcctcagaacctggcggcagcgcaaaagatg

SEQ ID NO: 143178 - DNA, 103 bp, Artificial Sequence
  Synthetic Polynucleotide
taatacgactcactatagggaatagttactttggggtaaactctgaggcaaacagaggagatgcctcatggtttaccccaacctggcggcagcgcaaaagatg

SEQ ID NO: 143179 - DNA, 103 bp, Artificial Sequence
  Synthetic Polynucleotide
taatacgactcactatagggaatgtagtgaaatagttactttggggtaaaaacagaggagatttaccatgaagtaactaaacctggcggcagcgcaaaagatg

SEQ ID NO: 143180 - DNA, 103 bp, Artificial Sequence
  Synthetic Polynucleotide
taatacgactcactatagggactattagacaatgtagtgaaatagttactaacagaggagaagtaacatgttcactacaaacctggcggcagcgcaaaagatg

SEQ ID NO: 143181 - DNA, 103 bp, Artificial Sequence
  Synthetic Polynucleotide
taatacgactcactatagggcattgaccacactattagacaatgtagtgaaacagaggagatcactaatgtgtctaataaacctggcggcagcgcaaaagatg

SEQ ID NO: 143182 - DNA, 103 bp, Artificial Sequence
  Synthetic Polynucleotide
taatacgactcactatagggaccagaggtttgaaagtcaatgcaggccacaacagaggagagtggccatgattgactttaacctggcggcagcgcaaaagatg

SEQ ID NO: 143183 - DNA, 103 bp, Artificial Sequence
  Synthetic Polynucleotide
taatacgactcactatagggcttggtggttcattgaccacactattagacaacagaggagagtctaaatgtgtggtcaaaacctggcggcagcgcaaaagatg

SEQ ID NO: 143184 - DNA, 103 bp, Artificial Sequence
  Synthetic Polynucleotide
taatacgactcactatagggtgggtatgatcttggtggttcattgaccacaacagaggagagtggtcatggaaccaccaaacctggcggcagcgcaaaagatg

SEQ ID NO: 143185 - DNA, 103 bp, Artificial Sequence
  Synthetic Polynucleotide
taatacgactcactatagggcttctttggatgggtatgatcttggtggttaacagaggagaaaccacatggatcataccaacctggcggcagcgcaaaagatg

SEQ ID NO: 143186 - DNA, 103 bp, Artificial Sequence
  Synthetic Polynucleotide
taatacgactcactatagggatatttgaaacttctttggatgggtatgataacagaggagaatcataatgatccaaagaaacctggcggcagcgcaaaagatg

SEQ ID NO: 143187 - DNA, 103 bp, Artificial Sequence
  Synthetic Polynucleotide
taatacgactcactatagggatcaccgtaaatatttgaaacttctttggaaacagaggagatccaaaatggtttcaaataacctggcggcagcgcaaaagatg

SEQ ID NO: 143188 - DNA, 103 bp, Artificial Sequence
  Synthetic Polynucleotide
taatacgactcactatagggtactctgtttatcaccgtaaatatttgaaaaacagaggagatttcaaatgtttacggtgaacctggcggcagcgcaaaagatg

SEQ ID NO: 143189 - DNA, 103 bp, Artificial Sequence
  Synthetic Polynucleotide
taatacgactcactataggggcaagggcattactctgtttatcaccgtaaaacagaggagattacggatgtaaacagagaacctggcggcagcgcaaaagatg

SEQ ID NO: 143190 - DNA, 103 bp, Artificial Sequence
  Synthetic Polynucleotide
taatacgactcactatagggtgctgccgctgcaagggcattactctgtttaacagaggagaaaacagatgaatgcccttaacctggcggcagcgcaaaagatg

SEQ ID NO: 143191 - DNA, 103 bp, Artificial Sequence
  Synthetic Polynucleotide
taatacgactcactataggggaggattagctgctgccgctgcaagggcataacagaggagaatgcccatgcagcggcagaacctggcggcagcgcaaaagatg

SEQ ID NO: 143192 - DNA, 103 bp, Artificial Sequence
  Synthetic Polynucleotide
taatacgactcactataggggtcagagtttgaggattagctgctgccgctaacagaggagaagcggcatgagctaatccaacctggcggcagcgcaaaagatg

SEQ ID NO: 143193 - DNA, 103 bp, Artificial Sequence
  Synthetic Polynucleotide
taatacgactcactatagggatttctttcaaccagaggtttgaaagtcaaaacagaggagattgactatgaaacctctgaacctggcggcagcgcaaaagatg

SEQ ID NO: 143194 - DNA, 103 bp, Artificial Sequence
  Synthetic Polynucleotide
taatacgactcactatagggtataaatgaagtcagagtttgaggattagcaacagaggagagctaatatgcaaactctgaacctggcggcagcgcaaaagatg

SEQ ID NO: 143195 - DNA, 103 bp, Artificial Sequence
  Synthetic Polynucleotide
taatacgactcactatagggaaagagatgttataaatgaagtcagagtttaacagaggagaaaactcatgcttcatttaaacctggcggcagcgcaaaagatg

SEQ ID NO: 143196 - DNA, 103 bp, Artificial Sequence
  Synthetic Polynucleotide
taatacgactcactatagggggaggctttgaaagagatgttataaatgaaaacagaggagattcattatgaacatctctaacctggcggcagcgcaaaagatg

SEQ ID NO: 143197 - DNA, 103 bp, Artificial Sequence
  Synthetic Polynucleotide
taatacgactcactatagggaatcaaaggtggaggctttgaaagagatgtaacagaggagaacatctatgtcaaagcctaacctggcggcagcgcaaaagatg

SEQ ID NO: 143198 - DNA, 103 bp, Artificial Sequence
  Synthetic Polynucleotide
taatacgactcactataggggttggtgtttaatcaaaggtggaggctttgaacagaggagacaaagcatgcacctttgaaacctggcggcagcgcaaaagatg

SEQ ID NO: 143199 - DNA, 103 bp, Artificial Sequence
  Synthetic Polynucleotide
taatacgactcactatagggtcactttctggttggtgtttaatcaaaggtaacagaggagaacctttatgtaaacaccaaacctggcggcagcgcaaaagatg

SEQ ID NO: 143200 - DNA, 103 bp, Artificial Sequence
  Synthetic Polynucleotide
taatacgactcactatagggtactaaaccttcactttctggttggtgtttaacagaggagaaaacacatgccagaaagtaacctggcggcagcgcaaaagatg

SEQ ID NO: 143201 - DNA, 103 bp, Artificial Sequence
  Synthetic Polynucleotide
taatacgactcactataggggtatcttgcctactaaaccttcactttctgaacagaggagacagaaaatgaaggtttagaacctggcggcagcgcaaaagatg

SEQ ID NO: 143202 - DNA, 103 bp, Artificial Sequence
  Synthetic Polynucleotide
taatacgactcactatagggagatgttctggtatcttgcctactaaacctaacagaggagaaggtttatgaggcaagataacctggcggcagcgcaaaagatg

SEQ ID NO: 143203 - DNA, 103 bp, Artificial Sequence
  Synthetic Polynucleotide
taatacgactcactatagggctgatgtggaagatgttctggtatcttgccaacagaggagaggcaagatgccagaacataacctggcggcagcgcaaaagatg

SEQ ID NO: 143204 - DNA, 103 bp, Artificial Sequence
  Synthetic Polynucleotide
taatacgactcactatagggaactgggtatatttctttcaaccagaggttaacagaggagaaacctcatgttgaaagaaaacctggcggcagcgcaaaagatg

SEQ ID NO: 143205 - DNA, 103 bp, Artificial Sequence
  Synthetic Polynucleotide
taatacgactcactataggggagatgcaatctgatgtggaagatgttctgaacagaggagacagaacatgttccacatcaacctggcggcagcgcaaaagatg

SEQ ID NO: 143206 - DNA, 103 bp, Artificial Sequence
  Synthetic Polynucleotide
taatacgactcactataggggttactgagtgagatgcaatctgatgtggaaacagaggagatccacaatggattgcatcaacctggcggcagcgcaaaagatg

SEQ ID NO: 143207 - DNA, 103 bp, Artificial Sequence
  Synthetic Polynucleotide
taatacgactcactatagggtctgaaggttgttactgagtgagatgcaataacagaggagaattgcaatgcactcagtaaacctggcggcagcgcaaaagatg

SEQ ID NO: 143208 - DNA, 103 bp, Artificial Sequence
  Synthetic Polynucleotide
taatacgactcactatagggtacaatcatttctgaaggttgttactgagtaacagaggagaactcagatgcaaccttcaaacctggcggcagcgcaaaagatg

SEQ ID NO: 143209 - DNA, 103 bp, Artificial Sequence
  Synthetic Polynucleotide
taatacgactcactataggggtaggactcctacaatcatttctgaaggttaacagaggagaaaccttatgaaatgattgaacctggcggcagcgcaaaagatg

SEQ ID NO: 143210 - DNA, 103 bp, Artificial Sequence
  Synthetic Polynucleotide
taatacgactcactatagggtgtcaaatgggtaggactcctacaatcattaacagaggagaaatgatatgaggagtcctaacctggcggcagcgcaaaagatg

SEQ ID NO: 143211 - DNA, 103 bp, Artificial Sequence
  Synthetic Polynucleotide
taatacgactcactatagggtagaagaaactgtcaaatgggtaggactccaacagaggagaggagtcatgcccatttgaaacctggcggcagcgcaaaagatg

SEQ ID NO: 143212 - DNA, 103 bp, Artificial Sequence
  Synthetic Polynucleotide
taatacgactcactatagggagtgtatttgtagaagaaactgtcaaatggaacagaggagaccatttatgagtttcttcaacctggcggcagcgcaaaagatg

SEQ ID NO: 143213 - DNA, 103 bp, Artificial Sequence
  Synthetic Polynucleotide
taatacgactcactatagggcatactgcggagtgtatttgtagaagaaacaacagaggagagtttctatgacaaatacaaacctggcggcagcgcaaaagatg

SEQ ID NO: 143214 - DNA, 103 bp, Artificial Sequence
  Synthetic Polynucleotide
taatacgactcactataggggtaatgcaggcatactgcggagtgtatttgaacagaggagacaaataatgtccgcagtaaacctggcggcagcgcaaaagatg

SEQ ID NO: 143215 - DNA, 103 bp, Artificial Sequence
  Synthetic Polynucleotide
taatacgactcactataggggcagtgactgaactgggtatatttctttcaaacagaggagatgaaagatgtatacccagaacctggcggcagcgcaaaagatg

SEQ ID NO: 143216 - DNA, 103 bp, Artificial Sequence
  Synthetic Polynucleotide
taatacgactcactatagggggtgctctatgtaatgcaggcatactgcggaacagaggagaccgcagatggcctgcattaacctggcggcagcgcaaaagatg

SEQ ID NO: 143217 - DNA, 103 bp, Artificial Sequence
  Synthetic Polynucleotide
taatacgactcactataggggtgaaatactggtgctctatgtaatgcaggaacagaggagacctgcaatgcatagagcaaacctggcggcagcgcaaaagatg

SEQ ID NO: 143218 - DNA, 103 bp, Artificial Sequence
  Synthetic Polynucleotide
taatacgactcactatagggggattggtgggtgaaatactggtgctctataacagaggagaatagagatgcagtatttcaacctggcggcagcgcaaaagatg

SEQ ID NO: 143219 - DNA, 103 bp, Artificial Sequence
  Synthetic Polynucleotide
taatacgactcactatagggaggctgtgatggattggtgggtgaaatactaacagaggagaagtattatgcccaccaataacctggcggcagcgcaaaagatg

SEQ ID NO: 143220 - DNA, 103 bp, Artificial Sequence
  Synthetic Polynucleotide
taatacgactcactatagggctttctttccaggctgtgatggattggtggaacagaggagaccaccaatgcatcacagcaacctggcggcagcgcaaaagatg

SEQ ID NO: 143221 - DNA, 103 bp, Artificial Sequence
  Synthetic Polynucleotide
taatacgactcactatagggagctgccttcctttctttccaggctgtgataacagaggagaatcacaatgtggaaagaaaacctggcggcagcgcaaaagatg

SEQ ID NO: 143222 - DNA, 103 bp, Artificial Sequence
  Synthetic Polynucleotide
taatacgactcactatagggagactactatagctgccttcctttctttccaacagaggagaggaaagatgggaaggcagaacctggcggcagcgcaaaagatg

SEQ ID NO: 143223 - DNA, 103 bp, Artificial Sequence
  Synthetic Polynucleotide
taatacgactcactatagggtggaggggaaagactactatagctgccttcaacagaggagagaaggcatgtatagtagtaacctggcggcagcgcaaaagatg

SEQ ID NO: 143224 - DNA, 103 bp, Artificial Sequence
  Synthetic Polynucleotide
taatacgactcactataggggagttaaagttggaggggaaagactactataacagaggagaatagtaatgtttcccctcaacctggcggcagcgcaaaagatg

SEQ ID NO: 143225 - DNA, 103 bp, Artificial Sequence
  Synthetic Polynucleotide
taatacgactcactatagggggcatcaccggagttaaagttggaggggaaaacagaggagattccccatgaactttaacaacctggcggcagcgcaaaagatg

SEQ ID NO: 143226 - DNA, 103 bp, Artificial Sequence
  Synthetic Polynucleotide
taatacgactcactataggggaattctactgcagtgactgaactgggtataacagaggagaatacccatgtcagtcactaacctggcggcagcgcaaaagatg

SEQ ID NO: 143227 - DNA, 103 bp, Artificial Sequence
  Synthetic Polynucleotide
taatacgactcactatagggagcatttactggcatcaccggagttaaagtaacagaggagaactttaatgccggtgatgaacctggcggcagcgcaaaagatg

SEQ ID NO: 143228 - DNA, 103 bp, Artificial Sequence
  Synthetic Polynucleotide
taatacgactcactatagggctttaccaccagcatttactggcatcaccgaacagaggagacggtgaatgcagtaaatgaacctggcggcagcgcaaaagatg

SEQ ID NO: 143229 - DNA, 103 bp, Artificial Sequence
  Synthetic Polynucleotide
taatacgactcactataggggattcttgaactttaccaccagcatttactaacagaggagaagtaaaatgtggtggtaaaacctggcggcagcgcaaaagatg

SEQ ID NO: 143230 - DNA, 103 bp, Artificial Sequence
  Synthetic Polynucleotide
taatacgactcactatagggaggcttctgtgattcttgaactttaccaccaacagaggagaggtggtatggttcaagaaaacctggcggcagcgcaaaagatg

SEQ ID NO: 143231 - DNA, 103 bp, Artificial Sequence
  Synthetic Polynucleotide
taatacgactcactatagggttagagttggaggcttctgtgattcttgaaaacagaggagattcaagatgcacagaagcaacctggcggcagcgcaaaagatg

SEQ ID NO: 143232 - DNA, 103 bp, Artificial Sequence
  Synthetic Polynucleotide
taatacgactcactatagggggttcgggtattagagttggaggcttctgtaacagaggagaacagaaatgtccaactctaacctggcggcagcgcaaaagatg

SEQ ID NO: 143233 - DNA, 103 bp, Artificial Sequence
  Synthetic Polynucleotide
taatacgactcactatagggggagtcttttggttcgggtattagagttggaacagaggagaccaactatgatacccgaaaacctggcggcagcgcaaaagatg

SEQ ID NO: 143234 - DNA, 103 bp, Artificial Sequence
  Synthetic Polynucleotide
taatacgactcactatagggaatttgcctgggagtcttttggttcgggtaaacagaggagatacccgatgcaaaagactaacctggcggcagcgcaaaagatg

SEQ ID NO: 143235 - DNA, 103 bp, Artificial Sequence
  Synthetic Polynucleotide
taatacgactcactataggggaactcttaaaatttgcctgggagtcttttaacagaggagaaaaagaatgccaggcaaaaacctggcggcagcgcaaaagatg

SEQ ID NO: 143236 - DNA, 103 bp, Artificial Sequence
  Synthetic Polynucleotide
taatacgactcactatagggctgttctgaagaactcttaaaatttgcctgaacagaggagacaggcaatgtttaagagtaacctggcggcagcgcaaaagatg

SEQ ID NO: 143237 - DNA, 103 bp, Artificial Sequence
  Synthetic Polynucleotide
taatacgactcactatagggtatctacaaggaattctactgcagtgactgaacagaggagacagtcaatgcagtagaataacctggcggcagcgcaaaagatg

SEQ ID NO: 143238 - DNA, 103 bp, Artificial Sequence
  Synthetic Polynucleotide
taatacgactcactatagggccgtcaaactctgttctgaagaactcttaaaacagaggagattaagaatgcttcagaacaacctggcggcagcgcaaaagatg

SEQ ID NO: 143239 - DNA, 103 bp, Artificial Sequence
  Synthetic Polynucleotide
taatacgactcactatagggctccacatctccgtcaaactctgttctgaaaacagaggagattcagaatggagtttgacaacctggcggcagcgcaaaagatg

SEQ ID NO: 143240 - DNA, 103 bp, Artificial Sequence
  Synthetic Polynucleotide
taatacgactcactatagggattattaggtctccacatctccgtcaaactaacagaggagaagtttgatggagatgtggaacctggcggcagcgcaaaagatg

SEQ ID NO: 143241 - DNA, 103 bp, Artificial Sequence
  Synthetic Polynucleotide
taatacgactcactatagggtgctgaggttattattaggtctccacatctaacagaggagaagatgtatggacctaataaacctggcggcagcgcaaaagatg

SEQ ID NO: 143242 - DNA, 103 bp, Artificial Sequence
  Synthetic Polynucleotide
taatacgactcactataggggttttctctttgctgaggttattattaggtaacagaggagaacctaaatgtaacctcagaacctggcggcagcgcaaaagatg

SEQ ID NO: 143243 - DNA, 103 bp, Artificial Sequence
  Synthetic Polynucleotide
taatacgactcactatagggatgccattcagttttctctttgctgaggttaacagaggagaaacctcatgaaagagaaaaacctggcggcagcgcaaaagatg

SEQ ID NO: 143244 - DNA, 103 bp, Artificial Sequence
  Synthetic Polynucleotide
taatacgactcactatagggttttctccacatgccattcagttttctcttaacagaggagaaagagaatgctgaatggcaacctggcggcagcgcaaaagatg

SEQ ID NO: 143245 - DNA, 103 bp, Artificial Sequence
  Synthetic Polynucleotide
taatacgactcactatagggtttccgctgcttttctccacatgccattcaaacagaggagatgaatgatgtgtggagaaaacctggcggcagcgcaaaagatg

SEQ ID NO: 143246 - DNA, 103 bp, Artificial Sequence
  Synthetic Polynucleotide
taatacgactcactatagggagcctgtaactttccgctgcttttctccacaacagaggagagtggagatgagcagcggaaacctggcggcagcgcaaaagatg

SEQ ID NO: 143247 - DNA, 103 bp, Artificial Sequence
  Synthetic Polynucleotide
taatacgactcactatagggatgccatagcagcctgtaactttccgctgcaacagaggagagcagcgatgagttacaggaacctggcggcagcgcaaaagatg

SEQ ID NO: 143248 - DNA, 103 bp, Artificial Sequence
  Synthetic Polynucleotide
taatacgactcactatagggtccagttgcttatctacaaggaattctactaacagaggagaagtagaatgccttgtagaaacctggcggcagcgcaaaagatg

SEQ ID NO: 143249 - DNA, 103 bp, Artificial Sequence
  Synthetic Polynucleotide
taatacgactcactatagggacaatgacagatgccatagcagcctgtaacaacagaggagagttacaatgtgctatggcaacctggcggcagcgcaaaagatg

SEQ ID NO: 143250 - DNA, 103 bp, Artificial Sequence
  Synthetic Polynucleotide
taatacgactcactatagggagatggacgcacaatgacagatgccatagcaacagaggagagctatgatgtctgtcattaacctggcggcagcgcaaaagatg

SEQ ID NO: 143251 - DNA, 103 bp, Artificial Sequence
  Synthetic Polynucleotide
taatacgactcactatagggttgtactagaagatggacgcacaatgacagaacagaggagactgtcaatgtgcgtccataacctggcggcagcgcaaaagatg

SEQ ID NO: 143252 - DNA, 103 bp, Artificial Sequence
  Synthetic Polynucleotide
taatacgactcactatagggctatcagtttttgtactagaagatggacgcaacagaggagagcgtccatgttctagtacaacctggcggcagcgcaaaagatg

SEQ ID NO: 143253 - DNA, 103 bp, Artificial Sequence
  Synthetic Polynucleotide
taatacgactcactatagggtgctggcatactatcagtttttgtactagaaacagaggagatctagtatgaaaactgataacctggcggcagcgcaaaagatg

SEQ ID NO: 143254 - DNA, 103 bp, Artificial Sequence
  Synthetic Polynucleotide
taatacgactcactatagggctaactgcattgctggcatactatcagtttaacagaggagaaaactgatggtatgccagaacctggcggcagcgcaaaagatg

SEQ ID NO: 143255 - DNA, 103 bp, Artificial Sequence
  Synthetic Polynucleotide
taatacgactcactatagggtctttagaagctaactgcattgctggcataaacagaggagatatgccatgaatgcagttaacctggcggcagcgcaaaagatg

SEQ ID NO: 143256 - DNA, 103 bp, Artificial Sequence
  Synthetic Polynucleotide
taatacgactcactatagggactaacacgatctttagaagctaactgcataacagaggagaatgcagatggcttctaaaaacctggcggcagcgcaaaagatg

SEQ ID NO: 143257 - DNA, 103 bp, Artificial Sequence
  Synthetic Polynucleotide
taatacgactcactatagggaagatctttcactaacacgatctttagaagaacagaggagacttctaatgatcgtgttaaacctggcggcagcgcaaaagatg

SEQ ID NO: 143258 - DNA, 103 bp, Artificial Sequence
  Synthetic Polynucleotide
taatacgactcactataggggccccagctgaagatctttcactaacacgaaacagaggagatcgtgtatgtgaaagatcaacctggcggcagcgcaaaagatg

SEQ ID NO: 143259 - DNA, 103 bp, Artificial Sequence
  Synthetic Polynucleotide
taatacgactcactataggggccgaccgccacacacaggaaccgcttaccaacagaggagaggtaagatgttcctgtgtaacctggcggcagcgcaaaagatg

SEQ ID NO: 143260 - DNA, 103 bp, Artificial Sequence
  Synthetic Polynucleotide
taatacgactcactatagggagttaaaaaatccagttgcttatctacaagaacagaggagacttgtaatgaagcaactgaacctggcggcagcgcaaaagatg

SEQ ID NO: 143261 - DNA, 103 bp, Artificial Sequence
  Synthetic Polynucleotide
taatacgactcactatagggtgttttatgtgccccagctgaagatctttcaacagaggagagaaagaatgtcagctgggaacctggcggcagcgcaaaagatg

SEQ ID NO: 143262 - DNA, 103 bp, Artificial Sequence
  Synthetic Polynucleotide
taatacgactcactatagggtgaggcaatctgttttatgtgccccagctgaacagaggagacagctgatgcacataaaaaacctggcggcagcgcaaaagatg

SEQ ID NO: 143263 - DNA, 103 bp, Artificial Sequence
  Synthetic Polynucleotide
taatacgactcactatagggtctgctagtttgaggcaatctgttttatgtaacagaggagaacataaatgagattgcctaacctggcggcagcgcaaaagatg

SEQ ID NO: 143264 - DNA, 103 bp, Artificial Sequence
  Synthetic Polynucleotide
taatacgactcactatagggttctccggcttctgctagtttgaggcaatcaacagaggagagattgcatgaaactagcaaacctggcggcagcgcaaaagatg

SEQ ID NO: 143265 - DNA, 103 bp, Artificial Sequence
  Synthetic Polynucleotide
taatacgactcactatagggttcttccagtttctccggcttctgctagttaacagaggagaaactagatgaagccggagaacctggcggcagcgcaaaagatg

SEQ ID NO: 143266 - DNA, 103 bp, Artificial Sequence
  Synthetic Polynucleotide
taatacgactcactatagggggcaaaatgattcttccagtttctccggctaacagaggagaagccggatgaactggaagaacctggcggcagcgcaaaagatg

SEQ ID NO: 143267 - DNA, 103 bp, Artificial Sequence
  Synthetic Polynucleotide
taatacgactcactatagggattcacatttggcaaaatgattcttccagtaacagaggagaactggaatgatcattttgaacctggcggcagcgcaaaagatg

SEQ ID NO: 143268 - DNA, 103 bp, Artificial Sequence
  Synthetic Polynucleotide
taatacgactcactatagggcactgtctgaattcacatttggcaaaatgaaacagaggagatcatttatgcaaatgtgaaacctggcggcagcgcaaaagatg

SEQ ID NO: 143269 - DNA, 103 bp, Artificial Sequence
  Synthetic Polynucleotide
taatacgactcactatagggtttgtgtgaacactgtctgaattcacatttaacagaggagaaaatgtatgttcagacagaacctggcggcagcgcaaaagatg

SEQ ID NO: 143270 - DNA, 103 bp, Artificial Sequence
  Synthetic Polynucleotide
taatacgactcactatagggtttttcagattttgtgtgaacactgtctgaaacagaggagatcagacatggttcacacaaacctggcggcagcgcaaaagatg

SEQ ID NO: 143271 - DNA, 103 bp, Artificial Sequence
  Synthetic Polynucleotide
taatacgactcactatagggcactatcttcagttaaaaaatccagttgctaacagaggagaagcaacatgattttttaaaacctggcggcagcgcaaaagatg

SEQ ID NO: 143272 - DNA, 103 bp, Artificial Sequence
  Synthetic Polynucleotide
taatacgactcactatagggcctgaaagtttttttcagattttgtgtgaaaacagaggagattcacaatgaatctgaaaaacctggcggcagcgcaaaagatg

SEQ ID NO: 143273 - DNA, 103 bp, Artificial Sequence
  Synthetic Polynucleotide
taatacgactcactatagggtgtgagacagcctgaaagtttttttcagataacagaggagaatctgaatgaaactttcaaacctggcggcagcgcaaaagatg

SEQ ID NO: 143274 - DNA, 103 bp, Artificial Sequence
  Synthetic Polynucleotide
taatacgactcactatagggaacactgccctgtgagacagcctgaaagttaacagaggagaaactttatggctgtctcaaacctggcggcagcgcaaaagatg

SEQ ID NO: 143275 - DNA, 103 bp, Artificial Sequence
  Synthetic Polynucleotide
taatacgactcactatagggctgaactgggaacactgccctgtgagacagaacagaggagactgtctatgagggcagtgaacctggcggcagcgcaaaagatg

SEQ ID NO: 143276 - DNA, 103 bp, Artificial Sequence
  Synthetic Polynucleotide
taatacgactcactataggggcagacatgactgaactgggaacactgcccaacagaggagagggcagatgtcccagttcaacctggcggcagcgcaaaagatg

SEQ ID NO: 143277 - DNA, 103 bp, Artificial Sequence
  Synthetic Polynucleotide
taatacgactcactatagggcgtatttacagcagacatgactgaactgggaacagaggagacccagtatggtcatgtctaacctggcggcagcgcaaaagatg

SEQ ID NO: 143278 - DNA, 103 bp, Artificial Sequence
  Synthetic Polynucleotide
taatacgactcactatagggtattacacatcgtatttacagcagacatgaaacagaggagatcatgtatgctgtaaataaacctggcggcagcgcaaaagatg

SEQ ID NO: 143279 - DNA, 103 bp, Artificial Sequence
  Synthetic Polynucleotide
taatacgactcactatagggtccgttttggtattacacatcgtatttacaaacagaggagatgtaaaatggatgtgtaaaacctggcggcagcgcaaaagatg

SEQ ID NO: 143280 - DNA, 103 bp, Artificial Sequence
  Synthetic Polynucleotide
taatacgactcactatagggtgtgattacatccgttttggtattacacataacagaggagaatgtgtatgaccaaaacgaacctggcggcagcgcaaaagatg

SEQ ID NO: 143281 - DNA, 103 bp, Artificial Sequence
  Synthetic Polynucleotide
taatacgactcactatagggcggcagcagatgtgattacatccgttttggaacagaggagaccaaaaatgatgtaatcaaacctggcggcagcgcaaaagatg

SEQ ID NO: 143282 - DNA, 103 bp, Artificial Sequence
  Synthetic Polynucleotide
taatacgactcactatagggggctgaaaggcactatcttcagttaaaaaaaacagaggagattttttatgtgaagatagaacctggcggcagcgcaaaagatg

SEQ ID NO: 143283 - DNA, 103 bp, Artificial Sequence
  Synthetic Polynucleotide
taatacgactcactatagggctggtagtatcggcagcagatgtgattacaaacagaggagatgtaatatgatctgctgcaacctggcggcagcgcaaaagatg

SEQ ID NO: 143284 - DNA, 103 bp, Artificial Sequence
  Synthetic Polynucleotide
taatacgactcactataggggctggaaacactggtagtatcggcagcagaaacagaggagatctgctatggatactaccaacctggcggcagcgcaaaagatg

SEQ ID NO: 143285 - DNA, 103 bp, Artificial Sequence
  Synthetic Polynucleotide
taatacgactcactatagggaaccaccccagctggaaacactggtagtataacagaggagaatactaatggtgtttccaaacctggcggcagcgcaaaagatg

SEQ ID NO: 143286 - DNA, 103 bp, Artificial Sequence
  Synthetic Polynucleotide
taatacgactcactatagggattacttctgaaccaccccagctggaaacaaacagaggagatgtttcatgctggggtggaacctggcggcagcgcaaaagatg

SEQ ID NO: 143287 - DNA, 103 bp, Artificial Sequence
  Synthetic Polynucleotide
taatacgactcactatagggtaaagaggaaattacttctgaaccaccccaaacagaggagatggggtatgtcagaagtaaacctggcggcagcgcaaaagatg

SEQ ID NO: 143288 - DNA, 103 bp, Artificial Sequence
  Synthetic Polynucleotide
taatacgactcactatagggtggtatttgataaagaggaaattacttctgaacagaggagacagaagatgtttcctcttaacctggcggcagcgcaaaagatg

SEQ ID NO: 143289 - DNA, 103 bp, Artificial Sequence
  Synthetic Polynucleotide
taatacgactcactataggggaggccaaaatggtatttgataaagaggaaaacagaggagattcctcatgatcaaatacaacctggcggcagcgcaaaagatg

SEQ ID NO: 143290 - DNA, 103 bp, Artificial Sequence
  Synthetic Polynucleotide
taatacgactcactatagggtgatgatgtagaggccaaaatggtatttgaaacagaggagatcaaatatgattttggccaacctggcggcagcgcaaaagatg

SEQ ID NO: 143291 - DNA, 103 bp, Artificial Sequence
  Synthetic Polynucleotide
taatacgactcactatagggatacacattctgatgatgtagaggccaaaaaacagaggagattttggatgctacatcataacctggcggcagcgcaaaagatg

SEQ ID NO: 143292 - DNA, 103 bp, Artificial Sequence
  Synthetic Polynucleotide
taatacgactcactatagggctttttgaagatacacattctgatgatgtaaacagaggagatacatcatgagaatgtgtaacctggcggcagcgcaaaagatg

SEQ ID NO: 143293 - DNA, 103 bp, Artificial Sequence
  Synthetic Polynucleotide
taatacgactcactataggggtcctggtagggctgaaaggcactatcttcaacagaggagagaagatatggcctttcagaacctggcggcagcgcaaaagatg

SEQ ID NO: 143294 - DNA, 103 bp, Artificial Sequence
  Synthetic Polynucleotide
taatacgactcactatagggctgactgacactttttgaagatacacattcaacagaggagagaatgtatgtcttcaaaaaacctggcggcagcgcaaaagatg

SEQ ID NO: 143295 - DNA, 103 bp, Artificial Sequence
  Synthetic Polynucleotide
taatacgactcactataggggagccactggctgactgacactttttgaagaacagaggagacttcaaatggtgtcagtcaacctggcggcagcgcaaaagatg

SEQ ID NO: 143296 - DNA, 103 bp, Artificial Sequence
  Synthetic Polynucleotide
taatacgactcactatagggtcttgtttttgagccactggctgactgacaaacagaggagatgtcagatggccagtggcaacctggcggcagcgcaaaagatg

SEQ ID NO: 143297 - DNA, 103 bp, Artificial Sequence
  Synthetic Polynucleotide
taatacgactcactataggggaccttgcattcttgtttttgagccactggaacagaggagaccagtgatgcaaaaacaaaacctggcggcagcgcaaaagatg

SEQ ID NO: 143298 - DNA, 103 bp, Artificial Sequence
  Synthetic Polynucleotide
taatacgactcactatagggctgtggtgctgaccttgcattcttgtttttaacagaggagaaaaaacatgaatgcaaggaacctggcggcagcgcaaaagatg

SEQ ID NO: 143299 - DNA, 103 bp, Artificial Sequence
  Synthetic Polynucleotide
taatacgactcactataggggtaactggtgctgtggtgctgaccttgcataacagaggagaatgcaaatgcagcaccacaacctggcggcagcgcaaaagatg

SEQ ID NO: 143300 - DNA, 103 bp, Artificial Sequence
  Synthetic Polynucleotide
taatacgactcactatagggactggctaatgtaactggtgctgtggtgctaacagaggagaagcaccatggcaccagttaacctggcggcagcgcaaaagatg

SEQ ID NO: 143301 - DNA, 103 bp, Artificial Sequence
  Synthetic Polynucleotide
taatacgactcactatagggctgtcttactactggctaatgtaactggtgaacagaggagacaccagatgcattagccaaacctggcggcagcgcaaaagatg

SEQ ID NO: 143302 - DNA, 103 bp, Artificial Sequence
  Synthetic Polynucleotide
taatacgactcactatagggacaacacttcctgtcttactactggctaataacagaggagaattagcatgtagtaagacaacctggcggcagcgcaaaagatg

SEQ ID NO: 143303 - DNA, 103 bp, Artificial Sequence
  Synthetic Polynucleotide
taatacgactcactatagggactgggttgaacaacacttcctgtcttactaacagaggagaagtaagatgggaagtgttaacctggcggcagcgcaaaagatg

SEQ ID NO: 143304 - DNA, 103 bp, Artificial Sequence
  Synthetic Polynucleotide
taatacgactcactatagggtgtctatgtcgtcctggtagggctgaaaggaacagaggagacctttcatgcctaccaggaacctggcggcagcgcaaaagatg

SEQ ID NO: 143305 - DNA, 103 bp, Artificial Sequence
  Synthetic Polynucleotide
taatacgactcactatagggagaacccagaactgggttgaacaacacttcaacagaggagagaagtgatgttcaacccaaacctggcggcagcgcaaaagatg

SEQ ID NO: 143306 - DNA, 103 bp, Artificial Sequence
  Synthetic Polynucleotide
taatacgactcactataggggttgtgcctgagaacccagaactgggttgaaacagaggagatcaaccatgttctgggttaacctggcggcagcgcaaaagatg

SEQ ID NO: 143307 - DNA, 103 bp, Artificial Sequence
  Synthetic Polynucleotide
taatacgactcactataggggataaaatcagttgtgcctgagaacccagaaacagaggagatctgggatgtcaggcacaaacctggcggcagcgcaaaagatg

SEQ ID NO: 143308 - DNA, 103 bp, Artificial Sequence
  Synthetic Polynucleotide
taatacgactcactatagggtttttaaatggataaaatcagttgtgcctgaacagaggagacaggcaatgctgattttaaacctggcggcagcgcaaaagatg

SEQ ID NO: 143309 - DNA, 103 bp, Artificial Sequence
  Synthetic Polynucleotide
taatacgactcactataggggccttgtgcttttttaaatggataaaatcaaacagaggagatgatttatgccatttaaaaacctggcggcagcgcaaaagatg

SEQ ID NO: 143310 - DNA, 103 bp, Artificial Sequence
  Synthetic Polynucleotide
taatacgactcactatagggagccaatgctgccttgtgcttttttaaatgaacagaggagacatttaatgaagcacaagaacctggcggcagcgcaaaagatg

SEQ ID NO: 143311 - DNA, 103 bp, Artificial Sequence
  Synthetic Polynucleotide
taatacgactcactatagggactgagctgcagccaatgctgccttgtgctaacagaggagaagcacaatgcagcattggaacctggcggcagcgcaaaagatg

SEQ ID NO: 143312 - DNA, 103 bp, Artificial Sequence
  Synthetic Polynucleotide
taatacgactcactatagggctacttttatactgagctgcagccaatgctaacagaggagaagcattatgtgcagctcaaacctggcggcagcgcaaaagatg

SEQ ID NO: 143313 - DNA, 103 bp, Artificial Sequence
  Synthetic Polynucleotide
taatacgactcactatagggactggcattactacttttatactgagctgcaacagaggagagcagctatgtataaaagtaacctggcggcagcgcaaaagatg

SEQ ID NO: 143314 - DNA, 103 bp, Artificial Sequence
  Synthetic Polynucleotide
taatacgactcactataggggttcagtctcactggcattactacttttataacagaggagaataaaaatggtaatgccaaacctggcggcagcgcaaaagatg

SEQ ID NO: 143315 - DNA, 103 bp, Artificial Sequence
  Synthetic Polynucleotide
taatacgactcactataggggggtttaggctgtctatgtcgtcctggtagaacagaggagactaccaatgcgacatagaaacctggcggcagcgcaaaagatg

SEQ ID NO: 143316 - DNA, 103 bp, Artificial Sequence
  Synthetic Polynucleotide
taatacgactcactatagggatagcattaggttcagtctcactggcattaaacagaggagataatgcatgtgagactgaaacctggcggcagcgcaaaagatg

SEQ ID NO: 143317 - DNA, 103 bp, Artificial Sequence
  Synthetic Polynucleotide
taatacgactcactatagggctgattttttatagcattaggttcagtctcaacagaggagagagactatgcctaatgctaacctggcggcagcgcaaaagatg

SEQ ID NO: 143318 - DNA, 103 bp, Artificial Sequence
  Synthetic Polynucleotide
taatacgactcactatagggctgaaagtgtctgattttttatagcattagaacagaggagactaatgatgtaaaaaatcaacctggcggcagcgcaaaagatg

SEQ ID NO: 143319 - DNA, 103 bp, Artificial Sequence
  Synthetic Polynucleotide
taatacgactcactatagggggaagggaggctgaaagtgtctgattttttaacagaggagaaaaaaaatggacactttcaacctggcggcagcgcaaaagatg

SEQ ID NO: 143320 - DNA, 103 bp, Artificial Sequence
  Synthetic Polynucleotide
taatacgactcactataggggctatccagaggaagggaggctgaaagtgtaacagaggagaacacttatggcctcccttaacctggcggcagcgcaaaagatg

SEQ ID NO: 143321 - DNA, 103 bp, Artificial Sequence
  Synthetic Polynucleotide
taatacgactcactatagggagattacagtgctatccagaggaagggaggaacagaggagacctcccatgctctggataaacctggcggcagcgcaaaagatg

SEQ ID NO: 143322 - DNA, 103 bp, Artificial Sequence
  Synthetic Polynucleotide
taatacgactcactatagggattgtactacagattacagtgctatccagaaacagaggagatctggaatgcactgtaataacctggcggcagcgcaaaagatg

SEQ ID NO: 143323 - DNA, 103 bp, Artificial Sequence
  Synthetic Polynucleotide
taatacgactcactatagggtgctttgttaattgtactacagattacagtaacagaggagaactgtaatgtgtagtacaaacctggcggcagcgcaaaagatg

SEQ ID NO: 143324 - DNA, 103 bp, Artificial Sequence
  Synthetic Polynucleotide
taatacgactcactatagggctacagagtttgctttgttaattgtactacaacagaggagagtagtaatgttaacaaagaacctggcggcagcgcaaaagatg

SEQ ID NO: 143325 - DNA, 103 bp, Artificial Sequence
  Synthetic Polynucleotide
taatacgactcactatagggtgcccatttcctacagagtttgctttgttaaacagaggagataacaaatgaaactctgtaacctggcggcagcgcaaaagatg

SEQ ID NO: 143326 - DNA, 103 bp, Artificial Sequence
  Synthetic Polynucleotide
taatacgactcactatagggcctgagaactgggtttaggctgtctatgtcaacagaggagagacataatgagcctaaacaacctggcggcagcgcaaaagatg

SEQ ID NO: 143327 - DNA, 103 bp, Artificial Sequence
  Synthetic Polynucleotide
taatacgactcactatagggctgggaagcttgcccatttcctacagagttaacagaggagaaactctatgggaaatgggaacctggcggcagcgcaaaagatg

SEQ ID NO: 143328 - DNA, 103 bp, Artificial Sequence
  Synthetic Polynucleotide
taatacgactcactataggggttgacttgtctgggaagcttgcccatttcaacagaggagagaaatgatgaagcttcccaacctggcggcagcgcaaaagatg

SEQ ID NO: 143329 - DNA, 103 bp, Artificial Sequence
  Synthetic Polynucleotide
taatacgactcactatagggtggtagtttggttgacttgtctgggaagctaacagaggagaagcttcatggacaagtcaaacctggcggcagcgcaaaagatg

SEQ ID NO: 143330 - DNA, 103 bp, Artificial Sequence
  Synthetic Polynucleotide
taatacgactcactatagggcagtttagtatggtagtttggttgacttgtaacagaggagaacaagtatgccaaactacaacctggcggcagcgcaaaagatg

SEQ ID NO: 143331 - DNA, 103 bp, Artificial Sequence
  Synthetic Polynucleotide
taatacgactcactatagggaggcctttttcagtttagtatggtagtttgaacagaggagacaaactatgatactaaacaacctggcggcagcgcaaaagatg

SEQ ID NO: 143332 - DNA, 103 bp, Artificial Sequence
  Synthetic Polynucleotide
taatacgactcactatagggctggtgagccaggcctttttcagtttagtaaacagaggagatactaaatggaaaaaggcaacctggcggcagcgcaaaagatg

SEQ ID NO: 143333 - DNA, 103 bp, Artificial Sequence
  Synthetic Polynucleotide
taatacgactcactatagggttctgagtgtctggtgagccaggcctttttaacagaggagaaaaaagatgtggctcaccaacctggcggcagcgcaaaagatg

SEQ ID NO: 143334 - DNA, 103 bp, Artificial Sequence
  Synthetic Polynucleotide
taatacgactcactatagggttttatcttcttctgagtgtctggtgagccaacagaggagaggctcaatggacactcagaacctggcggcagcgcaaaagatg

SEQ ID NO: 143335 - DNA, 103 bp, Artificial Sequence
  Synthetic Polynucleotide
taatacgactcactatagggttattagtatttttatcttcttctgagtgtaacagaggagaacactcatgagaagataaaacctggcggcagcgcaaaagatg

SEQ ID NO: 143336 - DNA, 103 bp, Artificial Sequence
  Synthetic Polynucleotide
taatacgactcactatagggattttccattttattagtatttttatcttcaacagaggagagaagatatgaatactaataacctggcggcagcgcaaaagatg

SEQ ID NO: 143337 - DNA, 103 bp, Artificial Sequence
  Synthetic Polynucleotide
taatacgactcactataggggcgggttgtccctgagaactgggtttaggcaacagaggagagcctaaatgcagttctcaaacctggcggcagcgcaaaagatg

SEQ ID NO: 143338 - DNA, 103 bp, Artificial Sequence
  Synthetic Polynucleotide
taatacgactcactatagggaattccctgaattttccattttattagtataacagaggagaatactaatgaaatggaaaaacctggcggcagcgcaaaagatg

SEQ ID NO: 143339 - DNA, 103 bp, Artificial Sequence
  Synthetic Polynucleotide
taatacgactcactatagggtctgatacagaattccctgaattttccattaacagaggagaaatggaatgttcagggaaaacctggcggcagcgcaaaagatg

SEQ ID NO: 143340 - DNA, 103 bp, Artificial Sequence
  Synthetic Polynucleotide
taatacgactcactatagggcttaataatttctgatacagaattccctgaaacagaggagatcagggatgtctgtatcaaacctggcggcagcgcaaaagatg

SEQ ID NO: 143341 - DNA, 103 bp, Artificial Sequence
  Synthetic Polynucleotide
taatacgactcactatagggcagaacatggcttaataatttctgatacagaacagaggagactgtatatgaaattattaaacctggcggcagcgcaaaagatg

SEQ ID NO: 143342 - DNA, 103 bp, Artificial Sequence
  Synthetic Polynucleotide
taatacgactcactatagggattaagttgacagaacatggcttaataattaacagaggagaaattatatggccatgttcaacctggcggcagcgcaaaagatg

SEQ ID NO: 143343 - DNA, 103 bp, Artificial Sequence
  Synthetic Polynucleotide
taatacgactcactatagggtgtagaggctattaagttgacagaacatggaacagaggagaccatgtatggtcaacttaaacctggcggcagcgcaaaagatg

SEQ ID NO: 143344 - DNA, 103 bp, Artificial Sequence
  Synthetic Polynucleotide
taatacgactcactatagggtatcactagatgtagaggctattaagttgaaacagaggagatcaactatgtagcctctaaacctggcggcagcgcaaaagatg

SEQ ID NO: 143345 - DNA, 103 bp, Artificial Sequence
  Synthetic Polynucleotide
taatacgactcactatagggctattttgtatatcactagatgtagaggctaacagaggagaagcctcatgatctagtgaaacctggcggcagcgcaaaagatg

SEQ ID NO: 143346 - DNA, 103 bp, Artificial Sequence
  Synthetic Polynucleotide
taatacgactcactatagggactatctacactattttgtatatcactagaaacagaggagatctagtatgatacaaaataacctggcggcagcgcaaaagatg

SEQ ID NO: 143347 - DNA, 103 bp, Artificial Sequence
  Synthetic Polynucleotide
taatacgactcactatagggctatgatcttactatctacactattttgtaaacagaggagatacaaaatggtgtagataaacctggcggcagcgcaaaagatg

SEQ ID NO: 143348 - DNA, 103 bp, Artificial Sequence
  Synthetic Polynucleotide
taatacgactcactatagggtcatgaagctgcgggttgtccctgagaactaacagaggagaagttctatgggacaacccaacctggcggcagcgcaaaagatg

SEQ ID NO: 143349 - DNA, 103 bp, Artificial Sequence
  Synthetic Polynucleotide
taatacgactcactatagggtatttatcaactatgatcttactatctacaaacagaggagatgtagaatgtaagatcataacctggcggcagcgcaaaagatg

SEQ ID NO: 143350 - DNA, 103 bp, Artificial Sequence
  Synthetic Polynucleotide
taatacgactcactatagggatcttttacatatttatcaactatgatcttaacagaggagaaagatcatggttgataaaaacctggcggcagcgcaaaagatg

SEQ ID NO: 143351 - DNA, 103 bp, Artificial Sequence
  Synthetic Polynucleotide
taatacgactcactatagggtgactttatcatcttttacatatttatcaaaacagaggagattgataatgatgtaaaagaacctggcggcagcgcaaaagatg

SEQ ID NO: 143352 - DNA, 103 bp, Artificial Sequence
  Synthetic Polynucleotide
taatacgactcactatagggtttctcctgttgactttatcatcttttacaaacagaggagatgtaaaatgtgataaagtaacctggcggcagcgcaaaagatg

SEQ ID NO: 143353 - DNA, 103 bp, Artificial Sequence
  Synthetic Polynucleotide
taatacgactcactatagggtcttttggcttttctcctgttgactttatcaacagaggagagataaaatgaacaggagaaacctggcggcagcgcaaaagatg

SEQ ID NO: 143354 - DNA, 103 bp, Artificial Sequence
  Synthetic Polynucleotide
taatacgactcactatagggattcataagttcttttggcttttctcctgtaacagaggagaacaggaatgaagccaaaaaacctggcggcagcgcaaaagatg

SEQ ID NO: 143355 - DNA, 103 bp, Artificial Sequence
  Synthetic Polynucleotide
taatacgactcactatagggtcagagccagattcataagttcttttggctaacagaggagaagccaaatgaacttatgaaacctggcggcagcgcaaaagatg

SEQ ID NO: 143356 - DNA, 103 bp, Artificial Sequence
  Synthetic Polynucleotide
taatacgactcactataggggtctccactttcagagccagattcataagtaacagaggagaacttatatgtctggctctaacctggcggcagcgcaaaagatg

SEQ ID NO: 143357 - DNA, 103 bp, Artificial Sequence
  Synthetic Polynucleotide
taatacgactcactatagggtttcatctgagtctccactttcagagccagaacagaggagactggctatgaaagtggagaacctggcggcagcgcaaaagatg

SEQ ID NO: 143358 - DNA, 103 bp, Artificial Sequence
  Synthetic Polynucleotide
taatacgactcactatagggttgctttcactttcatctgagtctccacttaacagaggagaaagtggatgctcagatgaaacctggcggcagcgcaaaagatg

SEQ ID NO: 143359 - DNA, 103 bp, Artificial Sequence
  Synthetic Polynucleotide
taatacgactcactatagggtttcacttcctcatgaagctgcgggttgtcaacagaggagagacaacatgcagcttcataacctggcggcagcgcaaaagatg

SEQ ID NO: 143360 - DNA, 103 bp, Artificial Sequence
  Synthetic Polynucleotide
taatacgactcactatagggttgctctgacttgctttcactttcatctgaaacagaggagatcagatatgagtgaaagcaacctggcggcagcgcaaaagatg

SEQ ID NO: 143361 - DNA, 103 bp, Artificial Sequence
  Synthetic Polynucleotide
taatacgactcactatagggttttagtcctttgctctgacttgctttcacaacagaggagagtgaaaatgagtcagagcaacctggcggcagcgcaaaagatg

SEQ ID NO: 143362 - DNA, 103 bp, Artificial Sequence
  Synthetic Polynucleotide
taatacgactcactatagggttaggttgtcttttagtcctttgctctgacaacagaggagagtcagaatgaaggactaaaacctggcggcagcgcaaaagatg

SEQ ID NO: 143363 - DNA, 103 bp, Artificial Sequence
  Synthetic Polynucleotide
taatacgactcactataggggtaagttggcttaggttgtcttttagtcctaacagaggagaaggactatgagacaacctaacctggcggcagcgcaaaagatg

SEQ ID NO: 143364 - DNA, 103 bp, Artificial Sequence
  Synthetic Polynucleotide
taatacgactcactataggggcttctttttgtaagttggcttaggttgtcaacagaggagagacaacatgagccaacttaacctggcggcagcgcaaaagatg

SEQ ID NO: 143365 - DNA, 103 bp, Artificial Sequence
  Synthetic Polynucleotide
taatacgactcactatagggaaatcattttgcttctttttgtaagttggcaacagaggagagccaacatgcaaaaagaaaacctggcggcagcgcaaaagatg

SEQ ID NO: 143366 - DNA, 103 bp, Artificial Sequence
  Synthetic Polynucleotide
taatacgactcactatagggtctcttttgcaaatcattttgcttctttttaacagaggagaaaaaagatgcaaaatgataacctggcggcagcgcaaaagatg

SEQ ID NO: 143367 - DNA, 103 bp, Artificial Sequence
  Synthetic Polynucleotide
taatacgactcactatagggtttcaccttttctcttttgcaaatcattttaacagaggagaaaaatgatgtgcaaaagaaacctggcggcagcgcaaaagatg

SEQ ID NO: 143368 - DNA, 103 bp, Artificial Sequence
  Synthetic Polynucleotide
taatacgactcactatagggtcttcttctatttcaccttttctcttttgcaacagaggagagcaaaaatgaaaaggtgaaacctggcggcagcgcaaaagatg

SEQ ID NO: 143369 - DNA, 103 bp, Artificial Sequence
  Synthetic Polynucleotide
taatacgactcactataggggggtttcaaatcttcttctatttcacctttaacagaggagaaaaggtatgatagaagaaaacctggcggcagcgcaaaagatg

SEQ ID NO: 143370 - DNA, 103 bp, Artificial Sequence
  Synthetic Polynucleotide
taatacgactcactataggggtgcctcgtcgccgaccgccacacacaggaaacagaggagatcctgtatgtggcggtcgaacctggcggcagcgcaaaagatg

SEQ ID NO: 143371 - DNA, 103 bp, Artificial Sequence
  Synthetic Polynucleotide
taatacgactcactatagggttacccagactttcacttcctcatgaagctaacagaggagaagcttcatgaggaagtgaaacctggcggcagcgcaaaagatg

SEQ ID NO: 143372 - DNA, 103 bp, Artificial Sequence
  Synthetic Polynucleotide
taatacgactcactataggggaactccattgggtttcaaatcttcttctaaacagaggagatagaagatgatttgaaacaacctggcggcagcgcaaaagatg

SEQ ID NO: 143373 - DNA, 103 bp, Artificial Sequence
  Synthetic Polynucleotide
taatacgactcactatagggctcctgctgagaactccattgggtttcaaaaacagaggagatttgaaatgcaatggagtaacctggcggcagcgcaaaagatg

SEQ ID NO: 143374 - DNA, 103 bp, Artificial Sequence
  Synthetic Polynucleotide
taatacgactcactatagggttctttggcactcctgctgagaactccattaacagaggagaaatggaatgctcagcaggaacctggcggcagcgcaaaagatg

SEQ ID NO: 143375 - DNA, 103 bp, Artificial Sequence
  Synthetic Polynucleotide
taatacgactcactataggggtttacttctttctttggcactcctgctgaaacagaggagatcagcaatggtgccaaagaacctggcggcagcgcaaaagatg

SEQ ID NO: 143376 - DNA, 103 bp, Artificial Sequence
  Synthetic Polynucleotide
taatacgactcactatagggtgcaacttcagtttacttctttctttggcaaacagaggagatgccaaatgaagaagtaaaacctggcggcagcgcaaaagatg

SEQ ID NO: 143377 - DNA, 103 bp, Artificial Sequence
  Synthetic Polynucleotide
taatacgactcactatagggactgttgctttgcaacttcagtttacttctaacagaggagaagaagtatgctgaagttgaacctggcggcagcgcaaaagatg

SEQ ID NO: 143378 - DNA, 103 bp, Artificial Sequence
  Synthetic Polynucleotide
taatacgactcactatagggtgccagtattactgttgctttgcaacttcaaacagaggagatgaagtatgaaagcaacaaacctggcggcagcgcaaaagatg

SEQ ID NO: 143379 - DNA, 103 bp, Artificial Sequence
  Synthetic Polynucleotide
taatacgactcactataggggaacgaggaatgccagtattactgttgcttaacagaggagaaagcaaatgtaatactggaacctggcggcagcgcaaaagatg

SEQ ID NO: 143380 - DNA, 103 bp, Artificial Sequence
  Synthetic Polynucleotide
taatacgactcactatagggtttcaatactgaacgaggaatgccagtattaacagaggagaaatactatgattcctcgtaacctggcggcagcgcaaaagatg

SEQ ID NO: 143381 - DNA, 103 bp, Artificial Sequence
  Synthetic Polynucleotide
taatacgactcactatagggtacgccaatctttcaatactgaacgaggaaaacagaggagattcctcatgcagtattgaaacctggcggcagcgcaaaagatg

SEQ ID NO: 143382 - DNA, 103 bp, Artificial Sequence
  Synthetic Polynucleotide
taatacgactcactatagggttttgttcctttacccagactttcacttccaacagaggagaggaagtatgagtctgggtaacctggcggcagcgcaaaagatg

SEQ ID NO: 143383 - DNA, 103 bp, Artificial Sequence
  Synthetic Polynucleotide
taatacgactcactatagggttcttgactttacgccaatctttcaatactaacagaggagaagtattatgagattggcgaacctggcggcagcgcaaaagatg

SEQ ID NO: 143384 - DNA, 103 bp, Artificial Sequence
  Synthetic Polynucleotide
taatacgactcactatagggttgcttcagcttcttgactttacgccaatcaacagaggagagattggatgaaagtcaagaacctggcggcagcgcaaaagatg

SEQ ID NO: 143385 - DNA, 103 bp, Artificial Sequence
  Synthetic Polynucleotide
taatacgactcactatagggattccccagtttgcttcagcttcttgacttaacagaggagaaagtcaatgagctgaagcaacctggcggcagcgcaaaagatg

SEQ ID NO: 143386 - DNA, 103 bp, Artificial Sequence
  Synthetic Polynucleotide
taatacgactcactatagggtgtaaaaaggattccccagtttgcttcagcaacagaggagagctgaaatgaactggggaaacctggcggcagcgcaaaagatg

SEQ ID NO: 143387 - DNA, 103 bp, Artificial Sequence
  Synthetic Polynucleotide
taatacgactcactatagggggagtcatcctgtaaaaaggattccccagtaacagaggagaactgggatgtcctttttaaacctggcggcagcgcaaaagatg

SEQ ID NO: 143388 - DNA, 103 bp, Artificial Sequence
  Synthetic Polynucleotide
taatacgactcactatagggtctcacagcaggagtcatcctgtaaaaaggaacagaggagaccttttatgaggatgactaacctggcggcagcgcaaaagatg

SEQ ID NO: 143389 - DNA, 103 bp, Artificial Sequence
  Synthetic Polynucleotide
taatacgactcactatagggttaggccctatctcacagcaggagtcatccaacagaggagaggatgaatgctgctgtgaaacctggcggcagcgcaaaagatg

SEQ ID NO: 143390 - DNA, 103 bp, Artificial Sequence
  Synthetic Polynucleotide
taatacgactcactatagggcttttgtaaattaggccctatctcacagcaaacagaggagatgctgtatgatagggcctaacctggcggcagcgcaaaagatg

SEQ ID NO: 143391 - DNA, 103 bp, Artificial Sequence
  Synthetic Polynucleotide
taatacgactcactatagggattctcgacacttttgtaaattaggccctaaacagaggagatagggcatgatttacaaaaacctggcggcagcgcaaaagatg

SEQ ID NO: 143392 - DNA, 103 bp, Artificial Sequence
  Synthetic Polynucleotide
taatacgactcactatagggataagtctacattctcgacacttttgtaaaaacagaggagatttacaatggtgtcgagaaacctggcggcagcgcaaaagatg

SEQ ID NO: 143393 - DNA, 103 bp, Artificial Sequence
  Synthetic Polynucleotide
taatacgactcactatagggctcctgaaccttttgttcctttacccagacaacagaggagagtctggatgaaggaacaaaacctggcggcagcgcaaaagatg

SEQ ID NO: 143394 - DNA, 103 bp, Artificial Sequence
  Synthetic Polynucleotide
taatacgactcactatagggtttactgcgaataagtctacattctcgacaaacagaggagatgtcgaatgtgtagacttaacctggcggcagcgcaaaagatg

SEQ ID NO: 143395 - DNA, 103 bp, Artificial Sequence
  Synthetic Polynucleotide
taatacgactcactatagggcttctccttttttactgcgaataagtctacaacagaggagagtagacatgttcgcagtaaacctggcggcagcgcaaaagatg

SEQ ID NO: 143396 - DNA, 103 bp, Artificial Sequence
  Synthetic Polynucleotide
taatacgactcactatagggtgagctggttcttctccttttttactgcgaaacagaggagatcgcagatgaaaaggagaaacctggcggcagcgcaaaagatg

SEQ ID NO: 143397 - DNA, 103 bp, Artificial Sequence
  Synthetic Polynucleotide
taatacgactcactatagggtactggtgagtgagctggttcttctcctttaacagaggagaaaaggaatggaaccagctaacctggcggcagcgcaaaagatg

SEQ ID NO: 143398 - DNA, 103 bp, Artificial Sequence
  Synthetic Polynucleotide
taatacgactcactatagggatctacaaaatactggtgagtgagctggttaacagaggagaaaccagatgactcaccagaacctggcggcagcgcaaaagatg

SEQ ID NO: 143399 - DNA, 103 bp, Artificial Sequence
  Synthetic Polynucleotide
taatacgactcactatagggaagtagtaaaatctacaaaatactggtgagaacagaggagactcaccatgattttgtagaacctggcggcagcgcaaaagatg

SEQ ID NO: 143400 - DNA, 103 bp, Artificial Sequence
  Synthetic Polynucleotide
taatacgactcactatagggcaaccgtctaaagtagtaaaatctacaaaaaacagaggagattttgtatgttttactacaacctggcggcagcgcaaaagatg

SEQ ID NO: 143401 - DNA, 103 bp, Artificial Sequence
  Synthetic Polynucleotide
taatacgactcactatagggtactaaatgacaaccgtctaaagtagtaaaaacagaggagatttactatgttagacggtaacctggcggcagcgcaaaagatg

SEQ ID NO: 143402 - DNA, 103 bp, Artificial Sequence
  Synthetic Polynucleotide
taatacgactcactatagggactccgtttttactaaatgacaaccgtctaaacagaggagatagacgatggtcatttagaacctggcggcagcgcaaaagatg

SEQ ID NO: 143403 - DNA, 103 bp, Artificial Sequence
  Synthetic Polynucleotide
taatacgactcactatagggtattctaactactccgtttttactaaatgaaacagaggagatcatttatgaaaaacggaaacctggcggcagcgcaaaagatg

SEQ ID NO: 143404 - DNA, 103 bp, Artificial Sequence
  Synthetic Polynucleotide
taatacgactcactataggggcataaaaatctcctgaaccttttgttcctaacagaggagaaggaacatgaggttcaggaacctggcggcagcgcaaaagatg

SEQ ID NO: 143405 - DNA, 103 bp, Artificial Sequence
  Synthetic Polynucleotide
taatacgactcactatagggagaaaccatctattctaactactccgttttaacagaggagaaaaacgatgtagttagaaaacctggcggcagcgcaaaagatg

SEQ ID NO: 143406 - DNA, 103 bp, Artificial Sequence
  Synthetic Polynucleotide
taatacgactcactatagggtcaggagaagagaaaccatctattctaactaacagaggagaagttagatgagatggtttaacctggcggcagcgcaaaagatg

SEQ ID NO: 143407 - DNA, 103 bp, Artificial Sequence
  Synthetic Polynucleotide
taatacgactcactatagggatcatattggtcaggagaagagaaaccatcaacagaggagagatggtatgtcttctcctaacctggcggcagcgcaaaagatg

SEQ ID NO: 143408 - DNA, 103 bp, Artificial Sequence
  Synthetic Polynucleotide
taatacgactcactatagggtagcttcatcatcatattggtcaggagaagaacagaggagacttctcatgaccaatatgaacctggcggcagcgcaaaagatg

SEQ ID NO: 143409 - DNA, 103 bp, Artificial Sequence
  Synthetic Polynucleotide
taatacgactcactatagggcacaaactcatagcttcatcatcatattggaacagaggagaccaataatgtgatgaagcaacctggcggcagcgcaaaagatg

SEQ ID NO: 143410 - DNA, 103 bp, Artificial Sequence
  Synthetic Polynucleotide
taatacgactcactatagggttcatgtgtccacaaactcatagcttcatcaacagaggagagatgaaatgatgagtttgaacctggcggcagcgcaaaagatg

SEQ ID NO: 143411 - DNA, 103 bp, Artificial Sequence
  Synthetic Polynucleotide
taatacgactcactatagggcttcaaaattttcatgtgtccacaaactcaaacagaggagatgagttatgggacacatgaacctggcggcagcgcaaaagatg

SEQ ID NO: 143412 - DNA, 103 bp, Artificial Sequence
  Synthetic Polynucleotide
taatacgactcactatagggagttcatcatcttcaaaattttcatgtgtcaacagaggagagacacaatgaaattttgaaacctggcggcagcgcaaaagatg

SEQ ID NO: 143413 - DNA, 103 bp, Artificial Sequence
  Synthetic Polynucleotide
taatacgactcactatagggctctatatctagttcatcatcttcaaaattaacagaggagaaattttatggatgatgaaaacctggcggcagcgcaaaagatg

SEQ ID NO: 143414 - DNA, 103 bp, Artificial Sequence
  Synthetic Polynucleotide
taatacgactcactatagggatttagaagtctctatatctagttcatcataacagaggagaatgatgatgtagatatagaacctggcggcagcgcaaaagatg

SEQ ID NO: 143415 - DNA, 103 bp, Artificial Sequence
  Synthetic Polynucleotide
taatacgactcactatagggtaaggaccttgcataaaaatctcctgaaccaacagaggagaggttcaatggatttttataacctggcggcagcgcaaaagatg

SEQ ID NO: 143416 - DNA, 103 bp, Artificial Sequence
  Synthetic Polynucleotide
taatacgactcactatagggtccaagatatatttagaagtctctatatctaacagaggagaagatatatggacttctaaaacctggcggcagcgcaaaagatg

SEQ ID NO: 143417 - DNA, 103 bp, Artificial Sequence
  Synthetic Polynucleotide
taatacgactcactatagggacctattatatccaagatatatttagaagtaacagaggagaacttctatgtatatcttgaacctggcggcagcgcaaaagatg

SEQ ID NO: 143418 - DNA, 103 bp, Artificial Sequence
  Synthetic Polynucleotide
taatacgactcactatagggagaacttatcacctattatatccaagatataacagaggagaatatctatgatataatagaacctggcggcagcgcaaaagatg

SEQ ID NO: 143419 - DNA, 103 bp, Artificial Sequence
  Synthetic Polynucleotide
taatacgactcactatagggactaattgacagaacttatcacctattataaacagaggagatataatatgtgataagttaacctggcggcagcgcaaaagatg

SEQ ID NO: 143420 - DNA, 103 bp, Artificial Sequence
  Synthetic Polynucleotide
taatacgactcactatagggttcagatgttactaattgacagaacttatcaacagaggagagataagatgtgtcaattaaacctggcggcagcgcaaaagatg

SEQ ID NO: 143421 - DNA, 103 bp, Artificial Sequence
  Synthetic Polynucleotide
taatacgactcactatagggaagctgttttttcagatgttactaattgacaacagaggagagtcaatatgtaacatctgaacctggcggcagcgcaaaagatg

SEQ ID NO: 143422 - DNA, 103 bp, Artificial Sequence
  Synthetic Polynucleotide
taatacgactcactatagggacccaggacaaagctgttttttcagatgttaacagaggagaaacatcatgaaaaacagcaacctggcggcagcgcaaaagatg

SEQ ID NO: 143423 - DNA, 103 bp, Artificial Sequence
  Synthetic Polynucleotide
taatacgactcactatagggatcctttttcacccaggacaaagctgttttaacagaggagaaaaacaatgttgtcctggaacctggcggcagcgcaaaagatg

SEQ ID NO: 143424 - DNA, 103 bp, Artificial Sequence
  Synthetic Polynucleotide
taatacgactcactatagggcaattttggcatcctttttcacccaggacaaacagaggagatgtcctatgtgaaaaaggaacctggcggcagcgcaaaagatg

SEQ ID NO: 143425 - DNA, 103 bp, Artificial Sequence
  Synthetic Polynucleotide
taatacgactcactatagggcttttccaggcaattttggcatcctttttcaacagaggagagaaaaaatgtgccaaaataacctggcggcagcgcaaaagatg

SEQ ID NO: 143426 - DNA, 103 bp, Artificial Sequence
  Synthetic Polynucleotide
taatacgactcactatagggatttaaggaataaggaccttgcataaaaataacagaggagaatttttatgcaaggtcctaacctggcggcagcgcaaaagatg

SEQ ID NO: 143427 - DNA, 103 bp, Artificial Sequence
  Synthetic Polynucleotide
taatacgactcactatagggtctcactgctcttttccaggcaattttggcaacagaggagagccaaaatggcctggaaaaacctggcggcagcgcaaaagatg

SEQ ID NO: 143428 - DNA, 103 bp, Artificial Sequence
  Synthetic Polynucleotide
taatacgactcactatagggcccggactcctctcactgctcttttccaggaacagaggagacctggaatggagcagtgaaacctggcggcagcgcaaaagatg

SEQ ID NO: 143429 - DNA, 103 bp, Artificial Sequence
  Synthetic Polynucleotide
taatacgactcactatagggtcacacatctcccggactcctctcactgctaacagaggagaagcagtatgaggagtccgaacctggcggcagcgcaaaagatg

SEQ ID NO: 143430 - DNA, 103 bp, Artificial Sequence
  Synthetic Polynucleotide
taatacgactcactatagggttcacatgcatcacacatctcccggactccaacagaggagaggagtcatggagatgtgtaacctggcggcagcgcaaaagatg

SEQ ID NO: 143431 - DNA, 103 bp, Artificial Sequence
  Synthetic Polynucleotide
taatacgactcactatagggacaatgttgcttcacatgcatcacacatctaacagaggagaagatgtatgatgcatgtgaacctggcggcagcgcaaaagatg

SEQ ID NO: 143432 - DNA, 103 bp, Artificial Sequence
  Synthetic Polynucleotide
taatacgactcactatagggtgaatgttaaacaatgttgcttcacatgcaaacagaggagatgcatgatgagcaacattaacctggcggcagcgcaaaagatg

SEQ ID NO: 143433 - DNA, 103 bp, Artificial Sequence
  Synthetic Polynucleotide
taatacgactcactataggggcagacccagtgaatgttaaacaatgttgcaacagaggagagcaacaatgtttaacattaacctggcggcagcgcaaaagatg

SEQ ID NO: 143434 - DNA, 103 bp, Artificial Sequence
  Synthetic Polynucleotide
taatacgactcactatagggcacatttttggcagacccagtgaatgttaaaacagaggagattaacaatgactgggtctaacctggcggcagcgcaaaagatg

SEQ ID NO: 143435 - DNA, 103 bp, Artificial Sequence
  Synthetic Polynucleotide
taatacgactcactatagggaccacaaatccacatttttggcagacccagaacagaggagactgggtatgccaaaaatgaacctggcggcagcgcaaaagatg

SEQ ID NO: 143436 - DNA, 103 bp, Artificial Sequence
  Synthetic Polynucleotide
taatacgactcactatagggatctaagcagaccacaaatccacatttttgaacagaggagacaaaaaatgggatttgtgaacctggcggcagcgcaaaagatg

SEQ ID NO: 143437 - DNA, 103 bp, Artificial Sequence
  Synthetic Polynucleotide
taatacgactcactatagggctctgtatccatttaaggaataaggaccttaacagaggagaaaggtcatgattccttaaaacctggcggcagcgcaaaagatg

SEQ ID NO: 143438 - DNA, 103 bp, Artificial Sequence
  Synthetic Polynucleotide
taatacgactcactatagggccttgtaacaatctaagcagaccacaaatcaacagaggagagatttgatgtctgcttagaacctggcggcagcgcaaaagatg

SEQ ID NO: 143439 - DNA, 103 bp, Artificial Sequence
  Synthetic Polynucleotide
taatacgactcactatagggctttcctttgccttgtaacaatctaagcagaacagaggagactgcttatgttgttacaaaacctggcggcagcgcaaaagatg

SEQ ID NO: 143440 - DNA, 103 bp, Artificial Sequence
  Synthetic Polynucleotide
taatacgactcactatagggagaactcttcctttcctttgccttgtaacaaacagaggagatgttacatggcaaaggaaaacctggcggcagcgcaaaagatg

SEQ ID NO: 143441 - DNA, 103 bp, Artificial Sequence
  Synthetic Polynucleotide
taatacgactcactatagggctttatctctagaactcttcctttcctttgaacagaggagacaaaggatgggaagagttaacctggcggcagcgcaaaagatg

SEQ ID NO: 143442 - DNA, 103 bp, Artificial Sequence
  Synthetic Polynucleotide
taatacgactcactataggggcatatagttctttatctctagaactcttcaacagaggagagaagagatgtagagataaaacctggcggcagcgcaaaagatg

SEQ ID NO: 143443 - DNA, 103 bp, Artificial Sequence
  Synthetic Polynucleotide
taatacgactcactatagggcttcatccaagcatatagttctttatctctaacagaggagaagagatatggaactatataacctggcggcagcgcaaaagatg

SEQ ID NO: 143444 - DNA, 103 bp, Artificial Sequence
  Synthetic Polynucleotide
taatacgactcactatagggccttcacacacttcatccaagcatatagttaacagaggagaaactatatgcttggatgaaacctggcggcagcgcaaaagatg

SEQ ID NO: 143445 - DNA, 103 bp, Artificial Sequence
  Synthetic Polynucleotide
taatacgactcactatagggtgaggctgtcccttcacacacttcatccaaaacagaggagattggatatggtgtgtgaaaacctggcggcagcgcaaaagatg

SEQ ID NO: 143446 - DNA, 103 bp, Artificial Sequence
  Synthetic Polynucleotide
taatacgactcactatagggtttgtgatcatgaggctgtcccttcacacaaacagaggagatgtgtgatgggacagcctaacctggcggcagcgcaaaagatg

SEQ ID NO: 143447 - DNA, 103 bp, Artificial Sequence
  Synthetic Polynucleotide
taatacgactcactataggggcattaaatgtttgtgatcatgaggctgtcaacagaggagagacagcatgatgatcacaaacctggcggcagcgcaaaagatg

SEQ ID NO: 143448 - DNA, 103 bp, Artificial Sequence
  Synthetic Polynucleotide
taatacgactcactatagggtatactctcactctgtatccatttaaggaaaacagaggagattccttatgtggatacagaacctggcggcagcgcaaaagatg

SEQ ID NO: 143449 - DNA, 103 bp, Artificial Sequence
  Synthetic Polynucleotide
taatacgactcactatagggatttgggttggcattaaatgtttgtgatcaaacagaggagatgatcaatgacatttaataacctggcggcagcgcaaaagatg

SEQ ID NO: 143450 - DNA, 103 bp, Artificial Sequence
  Synthetic Polynucleotide
taatacgactcactatagggaccaggtataatttgggttggcattaaatgaacagaggagacatttaatgccaacccaaaacctggcggcagcgcaaaagatg

SEQ ID NO: 143451 - DNA, 103 bp, Artificial Sequence
  Synthetic Polynucleotide
taatacgactcactatagggtcaaaacagaaccaggtataatttgggttgaacagaggagacaacccatgttatacctgaacctggcggcagcgcaaaagatg

SEQ ID NO: 143452 - DNA, 103 bp, Artificial Sequence
  Synthetic Polynucleotide
taatacgactcactatagggagaagatctgtcaaaacagaaccaggtataaacagaggagatataccatgttctgttttaacctggcggcagcgcaaaagatg

SEQ ID NO: 143453 - DNA, 103 bp, Artificial Sequence
  Synthetic Polynucleotide
taatacgactcactatagggcatggcatctagaagatctgtcaaaacagaaacagaggagatctgttatgacagatcttaacctggcggcagcgcaaaagatg

SEQ ID NO: 143454 - DNA, 103 bp, Artificial Sequence
  Synthetic Polynucleotide
taatacgactcactatagggtaagagtgtgcatggcatctagaagatctgaacagaggagacagatcatgtagatgccaaacctggcggcagcgcaaaagatg

SEQ ID NO: 143455 - DNA, 103 bp, Artificial Sequence
  Synthetic Polynucleotide
taatacgactcactatagggtatttttccctaagagtgtgcatggcatctaacagaggagaagatgcatggcacactctaacctggcggcagcgcaaaagatg

SEQ ID NO: 143456 - DNA, 103 bp, Artificial Sequence
  Synthetic Polynucleotide
taatacgactcactatagggtttaataccatatttttccctaagagtgtgaacagaggagacacactatgagggaaaaaaacctggcggcagcgcaaaagatg

SEQ ID NO: 143457 - DNA, 103 bp, Artificial Sequence
  Synthetic Polynucleotide
taatacgactcactataggggacaatgggatttaataccatatttttcccaacagaggagagggaaaatgatggtattaaacctggcggcagcgcaaaagatg

SEQ ID NO: 143458 - DNA, 103 bp, Artificial Sequence
  Synthetic Polynucleotide
taatacgactcactatagggttagtacaatgacaatgggatttaataccaaacagaggagatggtatatgatcccattgaacctggcggcagcgcaaaagatg

SEQ ID NO: 143459 - DNA, 103 bp, Artificial Sequence
  Synthetic Polynucleotide
taatacgactcactataggggtcttgtctatatactctcactctgtatccaacagaggagaggatacatggtgagagtaaacctggcggcagcgcaaaagatg

SEQ ID NO: 143460 - DNA, 103 bp, Artificial Sequence
  Synthetic Polynucleotide
taatacgactcactatagggattctgtttgttagtacaatgacaatgggaaacagaggagatcccatatgcattgtactaacctggcggcagcgcaaaagatg

SEQ ID NO: 143461 - DNA, 103 bp, Artificial Sequence
  Synthetic Polynucleotide
taatacgactcactatagggcaacttgtaaattctgtttgttagtacaataacagaggagaattgtaatgacaaacagaaacctggcggcagcgcaaaagatg

SEQ ID NO: 143462 - DNA, 103 bp, Artificial Sequence
  Synthetic Polynucleotide
taatacgactcactatagggggaaaatttccaacttgtaaattctgtttgaacagaggagacaaacaatgtttacaagtaacctggcggcagcgcaaaagatg

SEQ ID NO: 143463 - DNA, 103 bp, Artificial Sequence
  Synthetic Polynucleotide
taatacgactcactatagggattcattgtaggaaaatttccaacttgtaaaacagaggagattacaaatgggaaattttaacctggcggcagcgcaaaagatg

SEQ ID NO: 143464 - DNA, 103 bp, Artificial Sequence
  Synthetic Polynucleotide
taatacgactcactataggggagatacaccattcattgtaggaaaatttcaacagaggagagaaattatgctacaatgaaacctggcggcagcgcaaaagatg

SEQ ID NO: 143465 - DNA, 103 bp, Artificial Sequence
  Synthetic Polynucleotide
taatacgactcactatagggtgtaaaacttgagatacaccattcattgtaaacagaggagatacaatatgtggtgtatcaacctggcggcagcgcaaaagatg

SEQ ID NO: 143466 - DNA, 103 bp, Artificial Sequence
  Synthetic Polynucleotide
taatacgactcactatagggaagaacattctgtaaaacttgagatacaccaacagaggagaggtgtaatgcaagttttaaacctggcggcagcgcaaaagatg

SEQ ID NO: 143467 - DNA, 103 bp, Artificial Sequence
  Synthetic Polynucleotide
taatacgactcactatagggtactgtgattaagaacattctgtaaaacttaacagaggagaaagtttatgagaatgttcaacctggcggcagcgcaaaagatg

SEQ ID NO: 143468 - DNA, 103 bp, Artificial Sequence
  Synthetic Polynucleotide
taatacgactcactataggggaaattttattactgtgattaagaacattcaacagaggagagaatgtatgtaatcacagaacctggcggcagcgcaaaagatg

SEQ ID NO: 143469 - DNA, 103 bp, Artificial Sequence
  Synthetic Polynucleotide
taatacgactcactatagggcatgcacagagaaattttattactgtgattaacagaggagaaatcacatgaataaaattaacctggcggcagcgcaaaagatg

SEQ ID NO: 143470 - DNA, 103 bp, Artificial Sequence
  Synthetic Polynucleotide
taatacgactcactataggggggtggcagagtcttgtctatatactctcaaacagaggagatgagagatgatagacaagaacctggcggcagcgcaaaagatg

SEQ ID NO: 143471 - DNA, 103 bp, Artificial Sequence
  Synthetic Polynucleotide
taatacgactcactataggggagactcaggcatgcacagagaaattttataacagaggagaataaaaatgctctgtgcaaacctggcggcagcgcaaaagatg

SEQ ID NO: 143472 - DNA, 103 bp, Artificial Sequence
  Synthetic Polynucleotide
taatacgactcactatagggttttgctgctgagactcaggcatgcacagaaacagaggagatctgtgatggcctgagtcaacctggcggcagcgcaaaagatg

SEQ ID NO: 143473 - DNA, 103 bp, Artificial Sequence
  Synthetic Polynucleotide
taatacgactcactatagggcggaggagtattttgctgctgagactcaggaacagaggagacctgagatgcagcagcaaaacctggcggcagcgcaaaagatg

SEQ ID NO: 143474 - DNA, 103 bp, Artificial Sequence
  Synthetic Polynucleotide
taatacgactcactatagggtctcagacttcggaggagtattttgctgctaacagaggagaagcagcatgatactcctcaacctggcggcagcgcaaaagatg

SEQ ID NO: 143475 - DNA, 103 bp, Artificial Sequence
  Synthetic Polynucleotide
taatacgactcactatagggccaccatttttctcagacttcggaggagtaaacagaggagatactccatggaagtctgaaacctggcggcagcgcaaaagatg

SEQ ID NO: 143476 - DNA, 103 bp, Artificial Sequence
  Synthetic Polynucleotide
taatacgactcactatagggtgggctgctgccaccatttttctcagacttaacagaggagaaagtctatgaaaaatggtaacctggcggcagcgcaaaagatg

SEQ ID NO: 143477 - DNA, 103 bp, Artificial Sequence
  Synthetic Polynucleotide
taatacgactcactatagggcatcactctctgggctgctgccaccattttaacagaggagaaaaatgatggcagcagccaacctggcggcagcgcaaaagatg

SEQ ID NO: 143478 - DNA, 103 bp, Artificial Sequence
  Synthetic Polynucleotide
taatacgactcactatagggtctgtgcctacatcactctctgggctgctgaacagaggagacagcagatgagagagtgaaacctggcggcagcgcaaaagatg

SEQ ID NO: 143479 - DNA, 103 bp, Artificial Sequence
  Synthetic Polynucleotide
taatacgactcactatagggtaacttgttatctgtgcctacatcactctcaacagaggagagagagtatggtaggcacaaacctggcggcagcgcaaaagatg

SEQ ID NO: 143480 - DNA, 103 bp, Artificial Sequence
  Synthetic Polynucleotide
taatacgactcactatagggctggaggagttaacttgttatctgtgcctaaacagaggagataggcaatgataacaagtaacctggcggcagcgcaaaagatg

SEQ ID NO: 143481 - DNA, 103 bp, Artificial Sequence
  Synthetic Polynucleotide
taatacgactcactatagggcgctccgaacgtgcctcgtcgccgaccgccaacagaggagaggcggtatgcgacgaggcaacctggcggcagcgcaaaagatg

SEQ ID NO: 143482 - DNA, 103 bp, Artificial Sequence
  Synthetic Polynucleotide
taatacgactcactataggggtaaaccactgggtggcagagtcttgtctaaacagaggagatagacaatgctctgccacaacctggcggcagcgcaaaagatg

SEQ ID NO: 143483 - DNA, 103 bp, Artificial Sequence
  Synthetic Polynucleotide
taatacgactcactataggggactgggattctggaggagttaacttgttaaacagaggagataacaaatgaactcctccaacctggcggcagcgcaaaagatg

SEQ ID NO: 143484 - DNA, 103 bp, Artificial Sequence
  Synthetic Polynucleotide
taatacgactcactataggggtgcagtggtgactgggattctggaggagtaacagaggagaactcctatggaatcccagaacctggcggcagcgcaaaagatg

SEQ ID NO: 143485 - DNA, 103 bp, Artificial Sequence
  Synthetic Polynucleotide
taatacgactcactatagggctgctaaccagtgcagtggtgactgggattaacagaggagaaatcccatgcaccactgcaacctggcggcagcgcaaaagatg

SEQ ID NO: 143486 - DNA, 103 bp, Artificial Sequence
  Synthetic Polynucleotide
taatacgactcactatagggtctgcaagatctgctaaccagtgcagtggtaacagaggagaaccactatgctggttagcaacctggcggcagcgcaaaagatg

SEQ ID NO: 143487 - DNA, 103 bp, Artificial Sequence
  Synthetic Polynucleotide
taatacgactcactatagggggctttttgctctgcaagatctgctaaccaaacagaggagatggttaatggatcttgcaaacctggcggcagcgcaaaagatg

SEQ ID NO: 143488 - DNA, 103 bp, Artificial Sequence
  Synthetic Polynucleotide
taatacgactcactatagggtttcctctctggctttttgctctgcaagataacagaggagaatcttgatgagcaaaaagaacctggcggcagcgcaaaagatg

SEQ ID NO: 143489 - DNA, 103 bp, Artificial Sequence
  Synthetic Polynucleotide
taatacgactcactatagggttttcttttttttcctctctggctttttgcaacagaggagagcaaaaatgcagagaggaaacctggcggcagcgcaaaagatg

SEQ ID NO: 143490 - DNA, 103 bp, Artificial Sequence
  Synthetic Polynucleotide
taatacgactcactatagggaagttctttgttttcttttttttcctctctaacagaggagaagagagatgaaaaaagaaaacctggcggcagcgcaaaagatg

SEQ ID NO: 143491 - DNA, 103 bp, Artificial Sequence
  Synthetic Polynucleotide
taatacgactcactatagggtttcaagggtaagttctttgttttctttttaacagaggagaaaaaagatgacaaagaacaacctggcggcagcgcaaaagatg

SEQ ID NO: 143492 - DNA, 103 bp, Artificial Sequence
  Synthetic Polynucleotide
taatacgactcactatagggttaatttggttttcaagggtaagttctttgaacagaggagacaaagaatgtacccttgaaacctggcggcagcgcaaaagatg

SEQ ID NO: 143493 - DNA, 103 bp, Artificial Sequence
  Synthetic Polynucleotide
taatacgactcactatagggaattatgccagtaaaccactgggtggcagaaacagaggagatctgccatgcagtggtttaacctggcggcagcgcaaaagatg

SEQ ID NO: 143494 - DNA, 103 bp, Artificial Sequence
  Synthetic Polynucleotide
taatacgactcactatagggtctttcttctttaatttggttttcaagggtaacagaggagaacccttatgaaccaaattaacctggcggcagcgcaaaagatg

SEQ ID NO: 143495 - DNA, 103 bp, Artificial Sequence
  Synthetic Polynucleotide
taatacgactcactatagggtgtcttgttctctttcttctttaatttggtaacagaggagaaccaaaatgaagaagaaaaacctggcggcagcgcaaaagatg

SEQ ID NO: 143496 - DNA, 103 bp, Artificial Sequence
  Synthetic Polynucleotide
taatacgactcactataggggattcagagttgtcttgttctctttcttctaacagaggagaagaagaatgagaacaagaaacctggcggcagcgcaaaagatg

SEQ ID NO: 143497 - DNA, 103 bp, Artificial Sequence
  Synthetic Polynucleotide
taatacgactcactataggggccatttggagattcagagttgtcttgttcaacagaggagagaacaaatgaactctgaaaacctggcggcagcgcaaaagatg

SEQ ID NO: 143498 - DNA, 103 bp, Artificial Sequence
  Synthetic Polynucleotide
taatacgactcactataggggtgatgttctgccatttggagattcagagtaacagaggagaactctgatgctccaaatgaacctggcggcagcgcaaaagatg

SEQ ID NO: 143499 - DNA, 103 bp, Artificial Sequence
  Synthetic Polynucleotide
taatacgactcactataggggacacaagaggtgatgttctgccatttggaaacagaggagatccaaaatgcagaacatcaacctggcggcagcgcaaaagatg

SEQ ID NO: 143500 - DNA, 103 bp, Artificial Sequence
  Synthetic Polynucleotide
taatacgactcactatagggattattctgggacacaagaggtgatgttctaacagaggagaagaacaatgcctcttgtgaacctggcggcagcgcaaaagatg

SEQ ID NO: 143501 - DNA, 103 bp, Artificial Sequence
  Synthetic Polynucleotide
taatacgactcactatagggagccttgttcattattctgggacacaagagaacagaggagactcttgatgcccagaataaacctggcggcagcgcaaaagatg

SEQ ID NO: 143502 - DNA, 103 bp, Artificial Sequence
  Synthetic Polynucleotide
taatacgactcactatagggcgtaaggttgagccttgttcattattctggaacagaggagaccagaaatgtgaacaaggaacctggcggcagcgcaaaagatg

SEQ ID NO: 143503 - DNA, 103 bp, Artificial Sequence
  Synthetic Polynucleotide
taatacgactcactatagggcagcaaatcccgtaaggttgagccttgttcaacagaggagagaacaaatgtcaaccttaaacctggcggcagcgcaaaagatg

SEQ ID NO: 143504 - DNA, 103 bp, Artificial Sequence
  Synthetic Polynucleotide
taatacgactcactatagggcatgatgagtaattatgccagtaaaccactaacagaggagaagtggtatgctggcataaaacctggcggcagcgcaaaagatg

SEQ ID NO: 143505 - DNA, 103 bp, Artificial Sequence
  Synthetic Polynucleotide
taatacgactcactatagggctgttgtagtcagcaaatcccgtaaggttgaacagaggagacaacctatggggatttgcaacctggcggcagcgcaaaagatg

SEQ ID NO: 143506 - DNA, 103 bp, Artificial Sequence
  Synthetic Polynucleotide
taatacgactcactatagggagctttccagctgttgtagtcagcaaatccaacagaggagaggatttatggactacaacaacctggcggcagcgcaaaagatg

SEQ ID NO: 143507 - DNA, 103 bp, Artificial Sequence
  Synthetic Polynucleotide
taatacgactcactatagggccccacacgtagctttccagctgttgtagtaacagaggagaactacaatggctggaaagaacctggcggcagcgcaaaagatg

SEQ ID NO: 143508 - DNA, 103 bp, Artificial Sequence
  Synthetic Polynucleotide
taatacgactcactatagggcatctgtagaccccacacgtagctttccagaacagaggagactggaaatgtacgtgtggaacctggcggcagcgcaaaagatg

SEQ ID NO: 143509 - DNA, 103 bp, Artificial Sequence
  Synthetic Polynucleotide
taatacgactcactataggggcaatgccagcatctgtagaccccacacgtaacagaggagaacgtgtatggtctacagaaacctggcggcagcgcaaaagatg

SEQ ID NO: 143510 - DNA, 103 bp, Artificial Sequence
  Synthetic Polynucleotide
taatacgactcactatagggtggggcaaaggcaatgccagcatctgtagaaacagaggagatctacaatggctggcattaacctggcggcagcgcaaaagatg

SEQ ID NO: 143511 - DNA, 103 bp, Artificial Sequence
  Synthetic Polynucleotide
taatacgactcactatagggttgaatatactggggcaaaggcaatgccagaacagaggagactggcaatgcctttgcccaacctggcggcagcgcaaaagatg

SEQ ID NO: 143512 - DNA, 103 bp, Artificial Sequence
  Synthetic Polynucleotide
taatacgactcactatagggggggctcccattgaatatactggggcaaagaacagaggagactttgcatgagtatattcaacctggcggcagcgcaaaagatg

SEQ ID NO: 143513 - DNA, 103 bp, Artificial Sequence
  Synthetic Polynucleotide
taatacgactcactatagggtttgctacttggggctcccattgaatatacaacagaggagagtatatatgatgggagccaacctggcggcagcgcaaaagatg

SEQ ID NO: 143514 - DNA, 103 bp, Artificial Sequence
  Synthetic Polynucleotide
taatacgactcactatagggtccgtccacttttgctacttggggctcccaaacagaggagatgggagatgcaagtagcaaacctggcggcagcgcaaaagatg

SEQ ID NO: 143515 - DNA, 103 bp, Artificial Sequence
  Synthetic Polynucleotide
taatacgactcactataggggtgaagagatcatgatgagtaattatgccaaacagaggagatggcatatgtactcatcaaacctggcggcagcgcaaaagatg

SEQ ID NO: 143516 - DNA, 103 bp, Artificial Sequence
  Synthetic Polynucleotide
taatacgactcactatagggttaggcatagtccgtccacttttgctacttaacagaggagaaagtagatgaagtggacgaacctggcggcagcgcaaaagatg

SEQ ID NO: 143517 - DNA, 103 bp, Artificial Sequence
  Synthetic Polynucleotide
taatacgactcactatagggatcaagaatgttaggcatagtccgtccactaacagaggagaagtggaatgactatgcctaacctggcggcagcgcaaaagatg

SEQ ID NO: 143518 - DNA, 103 bp, Artificial Sequence
  Synthetic Polynucleotide
taatacgactcactatagggcaattatgtcatcaagaatgttaggcatagaacagaggagactatgcatgacattcttgaacctggcggcagcgcaaaagatg

SEQ ID NO: 143519 - DNA, 103 bp, Artificial Sequence
  Synthetic Polynucleotide
taatacgactcactatagggacaactgaagcaattatgtcatcaagaatgaacagaggagacattctatgtgacataataacctggcggcagcgcaaaagatg

SEQ ID NO: 143520 - DNA, 103 bp, Artificial Sequence
  Synthetic Polynucleotide
taatacgactcactatagggtttgttttcaacaactgaagcaattatgtcaacagaggagagacataatggcttcagttaacctggcggcagcgcaaaagatg

SEQ ID NO: 143521 - DNA, 103 bp, Artificial Sequence
  Synthetic Polynucleotide
taatacgactcactatagggttggtggaattttgttttcaacaactgaagaacagaggagacttcagatgttgaaaacaaacctggcggcagcgcaaaagatg

SEQ ID NO: 143522 - DNA, 103 bp, Artificial Sequence
  Synthetic Polynucleotide
taatacgactcactataggggaggttttacttggtggaattttgttttcaaacagaggagatgaaaaatgaattccaccaacctggcggcagcgcaaaagatg

SEQ ID NO: 143523 - DNA, 103 bp, Artificial Sequence
  Synthetic Polynucleotide
taatacgactcactatagggatttatcttggaggttttacttggtggaataacagaggagaattccaatgagtaaaaccaacctggcggcagcgcaaaagatg

SEQ ID NO: 143524 - DNA, 103 bp, Artificial Sequence
  Synthetic Polynucleotide
taatacgactcactatagggctggttttacatttatcttggaggttttacaacagaggagagtaaaaatgccaagataaaacctggcggcagcgcaaaagatg

SEQ ID NO: 143525 - DNA, 103 bp, Artificial Sequence
  Synthetic Polynucleotide
taatacgactcactatagggtctttaagctctggttttacatttatcttgaacagaggagacaagatatgtgtaaaaccaacctggcggcagcgcaaaagatg

SEQ ID NO: 143526 - DNA, 103 bp, Artificial Sequence
  Synthetic Polynucleotide
taatacgactcactatagggcatggtgcgggtgaagagatcatgatgagtaacagaggagaactcatatggatctcttcaacctggcggcagcgcaaaagatg

SEQ ID NO: 143527 - DNA, 103 bp, Artificial Sequence
  Synthetic Polynucleotide
taatacgactcactatagggttcaggctcttctttaagctctggttttacaacagaggagagtaaaaatggagcttaaaaacctggcggcagcgcaaaagatg

SEQ ID NO: 143528 - DNA, 103 bp, Artificial Sequence
  Synthetic Polynucleotide
taatacgactcactatagggttatgctttcttcaggctcttctttaagctaacagaggagaagcttaatgaagagcctgaacctggcggcagcgcaaaagatg

SEQ ID NO: 143529 - DNA, 103 bp, Artificial Sequence
  Synthetic Polynucleotide
taatacgactcactatagggactgcagatattatgctttcttcaggctctaacagaggagaagagccatgagaaagcataacctggcggcagcgcaaaagatg

SEQ ID NO: 143530 - DNA, 103 bp, Artificial Sequence
  Synthetic Polynucleotide
taatacgactcactatagggattttcatccactgcagatattatgctttcaacagaggagagaaagcatgatatctgcaaacctggcggcagcgcaaaagatg

SEQ ID NO: 143531 - DNA, 103 bp, Artificial Sequence
  Synthetic Polynucleotide
taatacgactcactatagggataatttattattttcatccactgcagataaacagaggagatatctgatgtggatgaaaaacctggcggcagcgcaaaagatg

SEQ ID NO: 143532 - DNA, 103 bp, Artificial Sequence
  Synthetic Polynucleotide
taatacgactcactatagggatatcactgtataatttattattttcatccaacagaggagaggatgaatgtaataaattaacctggcggcagcgcaaaagatg

SEQ ID NO: 143533 - DNA, 103 bp, Artificial Sequence
  Synthetic Polynucleotide
taatacgactcactatagggagaatgtggtatatcactgtataatttattaacagaggagaaataaaatgtacagtgataacctggcggcagcgcaaaagatg

SEQ ID NO: 143534 - DNA, 103 bp, Artificial Sequence
  Synthetic Polynucleotide
taatacgactcactatagggcacagatccaagaatgtggtatatcactgtaacagaggagaacagtgatgtaccacattaacctggcggcagcgcaaaagatg

SEQ ID NO: 143535 - DNA, 103 bp, Artificial Sequence
  Synthetic Polynucleotide
taatacgactcactatagggatatgcttctcacagatccaagaatgtggtaacagaggagaaccacaatgttggatctgaacctggcggcagcgcaaaagatg

SEQ ID NO: 143536 - DNA, 103 bp, Artificial Sequence
  Synthetic Polynucleotide
taatacgactcactatagggaagccataaaatatgcttctcacagatccaaacagaggagatggatcatggagaagcataacctggcggcagcgcaaaagatg

SEQ ID NO: 143537 - DNA, 103 bp, Artificial Sequence
  Synthetic Polynucleotide
taatacgactcactatagggtcataacgatcatggtgcgggtgaagagataacagaggagaatctctatgcccgcaccaaacctggcggcagcgcaaaagatg

SEQ ID NO: 143538 - DNA, 103 bp, Artificial Sequence
  Synthetic Polynucleotide
taatacgactcactatagggtataatccttaagccataaaatatgcttctaacagaggagaagaagcatgttttatggcaacctggcggcagcgcaaaagatg

SEQ ID NO: 143539 - DNA, 103 bp, Artificial Sequence
  Synthetic Polynucleotide
taatacgactcactatagggctgctattcttataatccttaagccataaaaacagaggagatttatgatgtaaggattaaacctggcggcagcgcaaaagatg

SEQ ID NO: 143540 - DNA, 103 bp, Artificial Sequence
  Synthetic Polynucleotide
taatacgactcactatagggcttccaattactgctattcttataatccttaacagaggagaaaggatatgaagaatagcaacctggcggcagcgcaaaagatg

SEQ ID NO: 143541 - DNA, 103 bp, Artificial Sequence
  Synthetic Polynucleotide
taatacgactcactatagggctttgaaaagcttccaattactgctattctaacagaggagaagaataatggtaattggaaacctggcggcagcgcaaaagatg

SEQ ID NO: 143542 - DNA, 103 bp, Artificial Sequence
  Synthetic Polynucleotide
taatacgactcactatagggttccaacattctttgaaaagcttccaattaaacagaggagataattgatggcttttcaaaacctggcggcagcgcaaaagatg

SEQ ID NO: 143543 - DNA, 103 bp, Artificial Sequence
  Synthetic Polynucleotide
taatacgactcactatagggctgtccttgtttccaacattctttgaaaagaacagaggagacttttcatggaatgttggaacctggcggcagcgcaaaagatg

SEQ ID NO: 143544 - DNA, 103 bp, Artificial Sequence
  Synthetic Polynucleotide
taatacgactcactatagggccactgcaggctgtccttgtttccaacattaacagaggagaaatgttatgaacaaggacaacctggcggcagcgcaaaagatg

SEQ ID NO: 143545 - DNA, 103 bp, Artificial Sequence
  Synthetic Polynucleotide
taatacgactcactatagggacaccagaaaccactgcaggctgtccttgtaacagaggagaacaaggatggcctgcagtaacctggcggcagcgcaaaagatg

SEQ ID NO: 143546 - DNA, 103 bp, Artificial Sequence
  Synthetic Polynucleotide
taatacgactcactatagggtttcttatgcacaccagaaaccactgcaggaacagaggagacctgcaatggtttctggtaacctggcggcagcgcaaaagatg

SEQ ID NO: 143547 - DNA, 103 bp, Artificial Sequence
  Synthetic Polynucleotide
taatacgactcactatagggtaatgttcattttcttatgcacaccagaaaaacagaggagatttctgatgtgcataagaaacctggcggcagcgcaaaagatg

SEQ ID NO: 143548 - DNA, 103 bp, Artificial Sequence
  Synthetic Polynucleotide
taatacgactcactatagggacctgatcattcataacgatcatggtgcggaacagaggagaccgcacatggatcgttataacctggcggcagcgcaaaagatg

SEQ ID NO: 143549 - DNA, 103 bp, Artificial Sequence
  Synthetic Polynucleotide
taatacgactcactatagggttccataggctaatgttcattttcttatgcaacagaggagagcataaatgaatgaacataacctggcggcagcgcaaaagatg

SEQ ID NO: 143550 - DNA, 103 bp, Artificial Sequence
  Synthetic Polynucleotide
taatacgactcactatagggtgattccgccttccataggctaatgttcataacagaggagaatgaacatgagcctatggaacctggcggcagcgcaaaagatg

SEQ ID NO: 143551 - DNA, 103 bp, Artificial Sequence
  Synthetic Polynucleotide
taatacgactcactatagggcaagactaattgattccgccttccataggcaacagaggagagcctatatgaggcggaataacctggcggcagcgcaaaagatg

SEQ ID NO: 143552 - DNA, 103 bp, Artificial Sequence
  Synthetic Polynucleotide
taatacgactcactatagggtctccaaaatcaagactaattgattccgccaacagaggagaggcggaatgaattagtctaacctggcggcagcgcaaaagatg

SEQ ID NO: 143553 - DNA, 103 bp, Artificial Sequence
  Synthetic Polynucleotide
taatacgactcactatagggagcttggtggtctccaaaatcaagactaataacagaggagaattagtatggattttggaaacctggcggcagcgcaaaagatg

SEQ ID NO: 143554 - DNA, 103 bp, Artificial Sequence
  Synthetic Polynucleotide
taatacgactcactatagggtcaggagatcagcttggtggtctccaaaataacagaggagaattttgatgaccaccaagaacctggcggcagcgcaaaagatg

SEQ ID NO: 143555 - DNA, 103 bp, Artificial Sequence
  Synthetic Polynucleotide
taatacgactcactatagggtctttgcagttcaggagatcagcttggtggaacagaggagaccaccaatgtgatctcctaacctggcggcagcgcaaaagatg

SEQ ID NO: 143556 - DNA, 103 bp, Artificial Sequence
  Synthetic Polynucleotide
taatacgactcactatagggaatgatgctatctttgcagttcaggagatcaacagaggagagatctcatgaactgcaaaaacctggcggcagcgcaaaagatg

SEQ ID NO: 143557 - DNA, 103 bp, Artificial Sequence
  Synthetic Polynucleotide
taatacgactcactatagggtggcatttgaaatgatgctatctttgcagtaacagaggagaactgcaatgatagcatcaaacctggcggcagcgcaaaagatg

SEQ ID NO: 143558 - DNA, 103 bp, Artificial Sequence
  Synthetic Polynucleotide
taatacgactcactatagggtccttaacattggcatttgaaatgatgctaaacagaggagatagcatatgttcaaatgcaacctggcggcagcgcaaaagatg

SEQ ID NO: 143559 - DNA, 103 bp, Artificial Sequence
  Synthetic Polynucleotide
taatacgactcactatagggtggttctagtacctgatcattcataacgataacagaggagaatcgttatgaatgatcagaacctggcggcagcgcaaaagatg

SEQ ID NO: 143560 - DNA, 103 bp, Artificial Sequence
  Synthetic Polynucleotide
taatacgactcactatagggatcccagaattccttaacattggcatttgaaacagaggagatcaaatatgaatgttaagaacctggcggcagcgcaaaagatg

SEQ ID NO: 143561 - DNA, 103 bp, Artificial Sequence
  Synthetic Polynucleotide
taatacgactcactatagggcttcaaaaccatcccagaattccttaacataacagaggagaatgttaatgaattctgggaacctggcggcagcgcaaaagatg

SEQ ID NO: 143562 - DNA, 103 bp, Artificial Sequence
  Synthetic Polynucleotide
taatacgactcactatagggtttgaaacttcttcaaaaccatcccagaataacagaggagaattctgatgtggttttgaaacctggcggcagcgcaaaagatg

SEQ ID NO: 143563 - DNA, 103 bp, Artificial Sequence
  Synthetic Polynucleotide
taatacgactcactatagggtttctgccgttttgaaacttcttcaaaaccaacagaggagaggttttatggaagtttcaaacctggcggcagcgcaaaagatg

SEQ ID NO: 143564 - DNA, 103 bp, Artificial Sequence
  Synthetic Polynucleotide
taatacgactcactatagggcactcttgtttttctgccgttttgaaacttaacagaggagaaagtttatgaacggcagaaacctggcggcagcgcaaaagatg

SEQ ID NO: 143565 - DNA, 103 bp, Artificial Sequence
  Synthetic Polynucleotide
taatacgactcactatagggactgtttctccactcttgtttttctgccgtaacagaggagaacggcaatgaaacaagagaacctggcggcagcgcaaaagatg

SEQ ID NO: 143566 - DNA, 103 bp, Artificial Sequence
  Synthetic Polynucleotide
taatacgactcactatagggttttaaaacaactgtttctccactcttgttaacagaggagaaacaagatgggagaaacaaacctggcggcagcgcaaaagatg

SEQ ID NO: 143567 - DNA, 103 bp, Artificial Sequence
  Synthetic Polynucleotide
taatacgactcactatagggagtctttcaattttaaaacaactgtttctcaacagaggagagagaaaatgttgttttaaaacctggcggcagcgcaaaagatg

SEQ ID NO: 143568 - DNA, 103 bp, Artificial Sequence
  Synthetic Polynucleotide
taatacgactcactatagggcctgaaggccagtctttcaattttaaaacaaacagaggagatgttttatgattgaaagaaacctggcggcagcgcaaaagatg

SEQ ID NO: 143569 - DNA, 103 bp, Artificial Sequence
  Synthetic Polynucleotide
taatacgactcactataggggaagtcttctcctgaaggccagtctttcaaaacagaggagattgaaaatgtggccttcaaacctggcggcagcgcaaaagatg

SEQ ID NO: 143570 - DNA, 103 bp, Artificial Sequence
  Synthetic Polynucleotide
taatacgactcactatagggcgacattctgtggttctagtacctgatcataacagaggagaatgatcatgtactagaacaacctggcggcagcgcaaaagatg

SEQ ID NO: 143571 - DNA, 103 bp, Artificial Sequence
  Synthetic Polynucleotide
taatacgactcactatagggtcatagtcttgaagtcttctcctgaaggccaacagaggagaggccttatggagaagactaacctggcggcagcgcaaaagatg

SEQ ID NO: 143572 - DNA, 103 bp, Artificial Sequence
  Synthetic Polynucleotide
taatacgactcactatagggcttgctggcatcatagtcttgaagtcttctaacagaggagaagaagaatgcaagactataacctggcggcagcgcaaaagatg

SEQ ID NO: 143573 - DNA, 103 bp, Artificial Sequence
  Synthetic Polynucleotide
taatacgactcactatagggatcttcgtatcttgctggcatcatagtcttaacagaggagaaagactatgatgccagcaaacctggcggcagcgcaaaagatg

SEQ ID NO: 143574 - DNA, 103 bp, Artificial Sequence
  Synthetic Polynucleotide
taatacgactcactatagggtttttaaaagatcttcgtatcttgctggcaaacagaggagatgccagatggatacgaagaacctggcggcagcgcaaaagatg

SEQ ID NO: 143575 - DNA, 103 bp, Artificial Sequence
  Synthetic Polynucleotide
taatacgactcactatagggaatggcagactttttaaaagatcttcgtataacagaggagaatacgaatgtcttttaaaaacctggcggcagcgcaaaagatg

SEQ ID NO: 143576 - DNA, 103 bp, Artificial Sequence
  Synthetic Polynucleotide
taatacgactcactatagggatattctggcaatggcagactttttaaaagaacagaggagacttttaatgagtctgccaaacctggcggcagcgcaaaagatg

SEQ ID NO: 143577 - DNA, 103 bp, Artificial Sequence
  Synthetic Polynucleotide
taatacgactcactatagggctggattacaatattctggcaatggcagacaacagaggagagtctgcatgtgccagaataacctggcggcagcgcaaaagatg

SEQ ID NO: 143578 - DNA, 103 bp, Artificial Sequence
  Synthetic Polynucleotide
taatacgactcactatagggaattttccttctggattacaatattctggcaacagaggagagccagaatgttgtaatccaacctggcggcagcgcaaaagatg

SEQ ID NO: 143579 - DNA, 103 bp, Artificial Sequence
  Synthetic Polynucleotide
taatacgactcactatagggggccaaattgaattttccttctggattacaaacagaggagatgtaatatggaaggaaaaaacctggcggcagcgcaaaagatg

SEQ ID NO: 143580 - DNA, 103 bp, Artificial Sequence
  Synthetic Polynucleotide
taatacgactcactataggggcaaatgagaggccaaattgaattttccttaacagaggagaaaggaaatgtcaatttggaacctggcggcagcgcaaaagatg

SEQ ID NO: 143581 - DNA, 103 bp, Artificial Sequence
  Synthetic Polynucleotide
taatacgactcactatagggatagaaggatcgacattctgtggttctagtaacagaggagaactagaatgacagaatgtaacctggcggcagcgcaaaagatg

SEQ ID NO: 143582 - DNA, 103 bp, Artificial Sequence
  Synthetic Polynucleotide
taatacgactcactatagggaaaaatcctggcaaatgagaggccaaattgaacagaggagacaatttatgctctcatttaacctggcggcagcgcaaaagatg

SEQ ID NO: 143583 - DNA, 103 bp, Artificial Sequence
  Synthetic Polynucleotide
taatacgactcactatagggaggacgtacaaaaaatcctggcaaatgagaaacagaggagatctcatatgccaggatttaacctggcggcagcgcaaaagatg

SEQ ID NO: 143584 - DNA, 103 bp, Artificial Sequence
  Synthetic Polynucleotide
taatacgactcactataggggtcctagatcaggacgtacaaaaaatcctgaacagaggagacaggatatgttgtacgtcaacctggcggcagcgcaaaagatg

SEQ ID NO: 143585 - DNA, 103 bp, Artificial Sequence
  Synthetic Polynucleotide
taatacgactcactatagggcacaacctgggtcctagatcaggacgtacaaacagaggagatgtacgatgtgatctaggaacctggcggcagcgcaaaagatg

SEQ ID NO: 143586 - DNA, 103 bp, Artificial Sequence
  Synthetic Polynucleotide
taatacgactcactatagggataggcactgcacaacctgggtcctagatcaacagaggagagatctaatgcccaggttgaacctggcggcagcgcaaaagatg

SEQ ID NO: 143587 - DNA, 103 bp, Artificial Sequence
  Synthetic Polynucleotide
taatacgactcactatagggcaactacaccataggcactgcacaacctggaacagaggagaccaggtatggcagtgcctaacctggcggcagcgcaaaagatg

SEQ ID NO: 143588 - DNA, 103 bp, Artificial Sequence
  Synthetic Polynucleotide
taatacgactcactatagggtctttagcagcaactacaccataggcactgaacagaggagacagtgcatgtggtgtagtaacctggcggcagcgcaaaagatg

SEQ ID NO: 143589 - DNA, 103 bp, Artificial Sequence
  Synthetic Polynucleotide
taatacgactcactatagggtatatcatgatctttagcagcaactacaccaacagaggagaggtgtaatggctgctaaaaacctggcggcagcgcaaaagatg

SEQ ID NO: 143590 - DNA, 103 bp, Artificial Sequence
  Synthetic Polynucleotide
taatacgactcactatagggttgttgttcctatatcatgatctttagcagaacagaggagactgctaatgatcatgataaacctggcggcagcgcaaaagatg

SEQ ID NO: 143591 - DNA, 103 bp, Artificial Sequence
  Synthetic Polynucleotide
taatacgactcactatagggatatggagatttgttgttcctatatcatgaaacagaggagatcatgaatgaggaacaacaacctggcggcagcgcaaaagatg

SEQ ID NO: 143592 - DNA, 103 bp, Artificial Sequence
  Synthetic Polynucleotide
taatacgactcactataggggctctcccagcgctccgaacgtgcctcgtcaacagaggagagacgagatgcgttcggagaacctggcggcagcgcaaaagatg

SEQ ID NO: 143593 - DNA, 103 bp, Artificial Sequence
  Synthetic Polynucleotide
taatacgactcactatagggcatttgaaccatagaaggatcgacattctgaacagaggagacagaatatggatccttctaacctggcggcagcgcaaaagatg

SEQ ID NO: 143594 - DNA, 103 bp, Artificial Sequence
  Synthetic Polynucleotide
taatacgactcactatagggagaaacttcaatatggagatttgttgttccaacagaggagaggaacaatgaatctccataacctggcggcagcgcaaaagatg

SEQ ID NO: 143595 - DNA, 103 bp, Artificial Sequence
  Synthetic Polynucleotide
taatacgactcactatagggttacaacatcagaaacttcaatatggagataacagaggagaatctccatgttgaagtttaacctggcggcagcgcaaaagatg

SEQ ID NO: 143596 - DNA, 103 bp, Artificial Sequence
  Synthetic Polynucleotide
taatacgactcactatagggactagtatatttacaacatcagaaacttcaaacagaggagatgaagtatgtgatgttgtaacctggcggcagcgcaaaagatg

SEQ ID NO: 143597 - DNA, 103 bp, Artificial Sequence
  Synthetic Polynucleotide
taatacgactcactataggggccaacataaactagtatatttacaacatcaacagaggagagatgttatgaatatactaaacctggcggcagcgcaaaagatg

SEQ ID NO: 143598 - DNA, 103 bp, Artificial Sequence
  Synthetic Polynucleotide
taatacgactcactatagggcttttgctatgccaacataaactagtatataacagaggagaatatacatgtttatgttgaacctggcggcagcgcaaaagatg

SEQ ID NO: 143599 - DNA, 103 bp, Artificial Sequence
  Synthetic Polynucleotide
taatacgactcactatagggatgccatttccttttgctatgccaacataaaacagaggagattatgtatgcatagcaaaaacctggcggcagcgcaaaagatg

SEQ ID NO: 143600 - DNA, 103 bp, Artificial Sequence
  Synthetic Polynucleotide
taatacgactcactatagggttttgagagaatgccatttccttttgctataacagaggagaatagcaatgggaaatggcaacctggcggcagcgcaaaagatg

SEQ ID NO: 143601 - DNA, 103 bp, Artificial Sequence
  Synthetic Polynucleotide
taatacgactcactataggggaattcctgcttttgagagaatgccatttcaacagaggagagaaatgatgttctctcaaaacctggcggcagcgcaaaagatg

SEQ ID NO: 143602 - DNA, 103 bp, Artificial Sequence
  Synthetic Polynucleotide
taatacgactcactatagggaatttcttgagaattcctgcttttgagagaaacagaggagatctctcatgagcaggaataacctggcggcagcgcaaaagatg

SEQ ID NO: 143603 - DNA, 103 bp, Artificial Sequence
  Synthetic Polynucleotide
taatacgactcactatagggttcttcctcaaatttcttgagaattcctgcaacagaggagagcaggaatgctcaagaaaaacctggcggcagcgcaaaagatg

SEQ ID NO: 143604 - DNA, 103 bp, Artificial Sequence
  Synthetic Polynucleotide
taatacgactcactatagggctagaaaggtcatttgaaccatagaaggataacagaggagaatccttatgtggttcaaaaacctggcggcagcgcaaaagatg

SEQ ID NO: 143605 - DNA, 103 bp, Artificial Sequence
  Synthetic Polynucleotide
taatacgactcactatagggcatccaaatcttcttcctcaaatttcttgaaacagaggagatcaagaatgttgaggaagaacctggcggcagcgcaaaagatg

SEQ ID NO: 143606 - DNA, 103 bp, Artificial Sequence
  Synthetic Polynucleotide
taatacgactcactatagggcttaaaatgtcatccaaatcttcttcctcaaacagaggagatgaggaatgagatttggaaacctggcggcagcgcaaaagatg

SEQ ID NO: 143607 - DNA, 103 bp, Artificial Sequence
  Synthetic Polynucleotide
taatacgactcactatagggcaatcttttccttaaaatgtcatccaaatcaacagaggagagatttgatggacattttaaacctggcggcagcgcaaaagatg

SEQ ID NO: 143608 - DNA, 103 bp, Artificial Sequence
  Synthetic Polynucleotide
taatacgactcactatagggttgagtccttcaatcttttccttaaaatgtaacagaggagaacatttatgggaaaagataacctggcggcagcgcaaaagatg

SEQ ID NO: 143609 - DNA, 103 bp, Artificial Sequence
  Synthetic Polynucleotide
taatacgactcactatagggggtatttcacttgagtccttcaatcttttcaacagaggagagaaaagatggaaggactcaacctggcggcagcgcaaaagatg

SEQ ID NO: 143610 - DNA, 103 bp, Artificial Sequence
  Synthetic Polynucleotide
taatacgactcactatagggcagagcaccaggtatttcacttgagtccttaacagaggagaaaggacatgagtgaaataaacctggcggcagcgcaaaagatg

SEQ ID NO: 143611 - DNA, 103 bp, Artificial Sequence
  Synthetic Polynucleotide
taatacgactcactatagggaaatatgccacagagcaccaggtatttcacaacagaggagagtgaaaatgctggtgctcaacctggcggcagcgcaaaagatg

SEQ ID NO: 143612 - DNA, 103 bp, Artificial Sequence
  Synthetic Polynucleotide
taatacgactcactatagggttcccagcataaatatgccacagagcaccaaacagaggagatggtgcatggtggcatataacctggcggcagcgcaaaagatg

SEQ ID NO: 143613 - DNA, 103 bp, Artificial Sequence
  Synthetic Polynucleotide
taatacgactcactataggggtcaacatctttcccagcataaatatgccaaacagaggagatggcatatgtatgctgggaacctggcggcagcgcaaaagatg

SEQ ID NO: 143614 - DNA, 103 bp, Artificial Sequence
  Synthetic Polynucleotide
taatacgactcactatagggcccttatcttgtcaacatctttcccagcataacagaggagaatgctgatgaagatgttgaacctggcggcagcgcaaaagatg

SEQ ID NO: 143615 - DNA, 103 bp, Artificial Sequence
  Synthetic Polynucleotide
taatacgactcactatagggacaacatcatctagaaaggtcatttgaaccaacagaggagaggttcaatggacctttctaacctggcggcagcgcaaaagatg

SEQ ID NO: 143616 - DNA, 103 bp, Artificial Sequence
  Synthetic Polynucleotide
taatacgactcactatagggtgaagaaattcccttatcttgtcaacatctaacagaggagaagatgtatgcaagataagaacctggcggcagcgcaaaagatg

SEQ ID NO: 143617 - DNA, 103 bp, Artificial Sequence
  Synthetic Polynucleotide
taatacgactcactatagggtgaaatcttttgaagaaattcccttatcttaacagaggagaaagataatggaatttcttaacctggcggcagcgcaaaagatg

SEQ ID NO: 143618 - DNA, 103 bp, Artificial Sequence
  Synthetic Polynucleotide
taatacgactcactatagggcttgttcttttgaaatcttttgaagaaattaacagaggagaaatttcatgaaaagatttaacctggcggcagcgcaaaagatg

SEQ ID NO: 143619 - DNA, 103 bp, Artificial Sequence
  Synthetic Polynucleotide
taatacgactcactatagggacttcaaggccttgttcttttgaaatctttaacagaggagaaaagatatgaaaagaacaaacctggcggcagcgcaaaagatg

SEQ ID NO: 143620 - DNA, 103 bp, Artificial Sequence
  Synthetic Polynucleotide
taatacgactcactatagggttctggtagaacttcaaggccttgttctttaacagaggagaaaagaaatgggccttgaaaacctggcggcagcgcaaaagatg

SEQ ID NO: 143621 - DNA, 103 bp, Artificial Sequence
  Synthetic Polynucleotide
taatacgactcactatagggttggatcatgttctggtagaacttcaaggcaacagaggagagccttgatgttctaccagaacctggcggcagcgcaaaagatg

SEQ ID NO: 143622 - DNA, 103 bp, Artificial Sequence
  Synthetic Polynucleotide
taatacgactcactatagggtggtcacgtattggatcatgttctggtagaaacagaggagatctaccatgacatgatccaacctggcggcagcgcaaaagatg

SEQ ID NO: 143623 - DNA, 103 bp, Artificial Sequence
  Synthetic Polynucleotide
taatacgactcactatagggataccaactttggtcacgtattggatcatgaacagaggagacatgatatgatacgtgacaacctggcggcagcgcaaaagatg

SEQ ID NO: 143624 - DNA, 103 bp, Artificial Sequence
  Synthetic Polynucleotide
taatacgactcactatagggttttgttcacataccaactttggtcacgtaaacagaggagatacgtgatgaaagttggtaacctggcggcagcgcaaaagatg

SEQ ID NO: 143625 - DNA, 103 bp, Artificial Sequence
  Synthetic Polynucleotide
taatacgactcactatagggtgacggagctttttgttcacataccaacttaacagaggagaaagttgatgtgtgaacaaaacctggcggcagcgcaaaagatg

SEQ ID NO: 143626 - DNA, 103 bp, Artificial Sequence
  Synthetic Polynucleotide
taatacgactcactatagggcaaagagtgaacaacatcatctagaaaggtaacagaggagaacctttatggatgatgttaacctggcggcagcgcaaaagatg

SEQ ID NO: 143627 - DNA, 103 bp, Artificial Sequence
  Synthetic Polynucleotide
taatacgactcactatagggaagcagcctttgacggagctttttgttcacaacagaggagagtgaacatgaagctccgtaacctggcggcagcgcaaaagatg

SEQ ID NO: 143628 - DNA, 103 bp, Artificial Sequence
  Synthetic Polynucleotide
taatacgactcactatagggcatattcttcaagcagcctttgacggagctaacagaggagaagctccatgaaaggctgcaacctggcggcagcgcaaaagatg

SEQ ID NO: 143629 - DNA, 103 bp, Artificial Sequence
  Synthetic Polynucleotide
taatacgactcactataggggttctgactccatattcttcaagcagccttaacagaggagaaaggctatgtgaagaataaacctggcggcagcgcaaaagatg

SEQ ID NO: 143630 - DNA, 103 bp, Artificial Sequence
  Synthetic Polynucleotide
taatacgactcactatagggaagagtacaggttctgactccatattcttcaacagaggagagaagaaatgggagtcagaaacctggcggcagcgcaaaagatg

SEQ ID NO: 143631 - DNA, 103 bp, Artificial Sequence
  Synthetic Polynucleotide
taatacgactcactatagggggaactgaataagagtacaggttctgactcaacagaggagagagtcaatgcctgtactcaacctggcggcagcgcaaaagatg

SEQ ID NO: 143632 - DNA, 103 bp, Artificial Sequence
  Synthetic Polynucleotide
taatacgactcactataggggcatcaccaaggaactgaataagagtacagaacagaggagactgtacatgtattcagttaacctggcggcagcgcaaaagatg

SEQ ID NO: 143633 - DNA, 103 bp, Artificial Sequence
  Synthetic Polynucleotide
taatacgactcactatagggcaaaacaatagcatcaccaaggaactgaataacagaggagaattcagatgcttggtgataacctggcggcagcgcaaaagatg

SEQ ID NO: 143634 - DNA, 103 bp, Artificial Sequence
  Synthetic Polynucleotide
taatacgactcactatagggctcccgctggcaaaacaatagcatcaccaaaacagaggagattggtgatgctattgtttaacctggcggcagcgcaaaagatg

SEQ ID NO: 143635 - DNA, 103 bp, Artificial Sequence
  Synthetic Polynucleotide
taatacgactcactatagggtgatgaagtgctcccgctggcaaaacaataaacagaggagatattgtatggccagcgggaacctggcggcagcgcaaaagatg

SEQ ID NO: 143636 - DNA, 103 bp, Artificial Sequence
  Synthetic Polynucleotide
taatacgactcactatagggattctgaacctgatgaagtgctcccgctggaacagaggagaccagcgatggcacttcataacctggcggcagcgcaaaagatg

SEQ ID NO: 143637 - DNA, 103 bp, Artificial Sequence
  Synthetic Polynucleotide
taatacgactcactatagggcaccttttaacaaagagtgaacaacatcataacagaggagaatgatgatgttcactcttaacctggcggcagcgcaaaagatg

SEQ ID NO: 143638 - DNA, 103 bp, Artificial Sequence
  Synthetic Polynucleotide
taatacgactcactatagggagctgtgaaaattctgaacctgatgaagtgaacagaggagacacttcatgaggttcagaaacctggcggcagcgcaaaagatg

SEQ ID NO: 143639 - DNA, 103 bp, Artificial Sequence
  Synthetic Polynucleotide
taatacgactcactatagggacctgaatacagctgtgaaaattctgaaccaacagaggagaggttcaatgttttcacagaacctggcggcagcgcaaaagatg

SEQ ID NO: 143640 - DNA, 103 bp, Artificial Sequence
  Synthetic Polynucleotide
taatacgactcactatagggatcttcagttacctgaatacagctgtgaaaaacagaggagatttcacatgtgtattcagaacctggcggcagcgcaaaagatg

SEQ ID NO: 143641 - DNA, 103 bp, Artificial Sequence
  Synthetic Polynucleotide
taatacgactcactataggggagacacaaaatcttcagttacctgaatacaacagaggagagtattcatgtaactgaagaacctggcggcagcgcaaaagatg

SEQ ID NO: 143642 - DNA, 103 bp, Artificial Sequence
  Synthetic Polynucleotide
taatacgactcactatagggagatgttctggagacacaaaatcttcagttaacagaggagaaactgaatgttttgtgtcaacctggcggcagcgcaaaagatg

SEQ ID NO: 143643 - DNA, 103 bp, Artificial Sequence
  Synthetic Polynucleotide
taatacgactcactatagggtgactctacaagatgttctggagacacaaaaacagaggagatttgtgatgccagaacataacctggcggcagcgcaaaagatg

SEQ ID NO: 143644 - DNA, 103 bp, Artificial Sequence
  Synthetic Polynucleotide
taatacgactcactatagggttaaatgaaatgactctacaagatgttctgaacagaggagacagaacatgttgtagagtaacctggcggcagcgcaaaagatg

SEQ ID NO: 143645 - DNA, 103 bp, Artificial Sequence
  Synthetic Polynucleotide
taatacgactcactatagggagttcctgtgttaaatgaaatgactctacaaacagaggagatgtagaatgatttcatttaacctggcggcagcgcaaaagatg

SEQ ID NO: 143646 - DNA, 103 bp, Artificial Sequence
  Synthetic Polynucleotide
taatacgactcactatagggcaaaagtctcagttcctgtgttaaatgaaaaacagaggagatttcatatgacacaggaaaacctggcggcagcgcaaaagatg

SEQ ID NO: 143647 - DNA, 103 bp, Artificial Sequence
  Synthetic Polynucleotide
taatacgactcactatagggtttcttccttcaaaagtctcagttcctgtgaacagaggagacacaggatgtgagactttaacctggcggcagcgcaaaagatg

SEQ ID NO: 143648 - DNA, 103 bp, Artificial Sequence
  Synthetic Polynucleotide
taatacgactcactatagggccaatattttcaccttttaacaaagagtgaaacagaggagatcactcatggttaaaaggaacctggcggcagcgcaaaagatg

SEQ ID NO: 143649 - DNA, 103 bp, Artificial Sequence
  Synthetic Polynucleotide
taatacgactcactatagggtcataattgatttcttccttcaaaagtctcaacagaggagagagactatggaaggaagaaacctggcggcagcgcaaaagatg

SEQ ID NO: 143650 - DNA, 103 bp, Artificial Sequence
  Synthetic Polynucleotide
taatacgactcactatagggtagtttatcatcataattgatttcttccttaacagaggagaaaggaaatgatcaattataacctggcggcagcgcaaaagatg

SEQ ID NO: 143651 - DNA, 103 bp, Artificial Sequence
  Synthetic Polynucleotide
taatacgactcactatagggttttaacctgtagtttatcatcataattgaaacagaggagatcaattatgatgataaacaacctggcggcagcgcaaaagatg

SEQ ID NO: 143652 - DNA, 103 bp, Artificial Sequence
  Synthetic Polynucleotide
taatacgactcactatagggtacaaaatatttttaacctgtagtttatcaaacagaggagatgataaatgacaggttaaaacctggcggcagcgcaaaagatg

SEQ ID NO: 143653 - DNA, 103 bp, Artificial Sequence
  Synthetic Polynucleotide
taatacgactcactataggggactgcatgatacaaaatatttttaacctgaacagaggagacaggttatgaatattttgaacctggcggcagcgcaaaagatg

SEQ ID NO: 143654 - DNA, 103 bp, Artificial Sequence
  Synthetic Polynucleotide
taatacgactcactatagggccatttctttgactgcatgatacaaaatataacagaggagaatatttatgatcatgcagaacctggcggcagcgcaaaagatg

SEQ ID NO: 143655 - DNA, 103 bp, Artificial Sequence
  Synthetic Polynucleotide
taatacgactcactatagggaaggctctcaccatttctttgactgcatgaaacagaggagatcatgcatgcaaagaaataacctggcggcagcgcaaaagatg

SEQ ID NO: 143656 - DNA, 103 bp, Artificial Sequence
  Synthetic Polynucleotide
taatacgactcactataggggtgtatcttcaaggctctcaccatttctttaacagaggagaaaagaaatggtgagagccaacctggcggcagcgcaaaagatg

SEQ ID NO: 143657 - DNA, 103 bp, Artificial Sequence
  Synthetic Polynucleotide
taatacgactcactatagggcttcatcctcgtgtatcttcaaggctctcaaacagaggagatgagagatgtgaagatacaacctggcggcagcgcaaaagatg

SEQ ID NO: 143658 - DNA, 103 bp, Artificial Sequence
  Synthetic Polynucleotide
taatacgactcactatagggatatcctctacttcatcctcgtgtatcttcaacagaggagagaagatatgcgaggatgaaacctggcggcagcgcaaaagatg

SEQ ID NO: 143659 - DNA, 103 bp, Artificial Sequence
  Synthetic Polynucleotide
taatacgactcactatagggtgatgtaatgccaatattttcaccttttaaaacagaggagattaaaaatggaaaatattaacctggcggcagcgcaaaagatg

SEQ ID NO: 143660 - DNA, 103 bp, Artificial Sequence
  Synthetic Polynucleotide
taatacgactcactatagggattttcttccatatcctctacttcatcctcaacagaggagagaggatatggtagaggataacctggcggcagcgcaaaagatg

SEQ ID NO: 143661 - DNA, 103 bp, Artificial Sequence
  Synthetic Polynucleotide
taatacgactcactatagggacctgcgtcgtgatgtaatgccaatattttaacagaggagaaaaataatggcattacataacctggcggcagcgcaaaagatg

SEQ ID NO: 143662 - DNA, 103 bp, Artificial Sequence
  Synthetic Polynucleotide
taatacgactcactatagggttggcacgagacctgcgtcgtgatgtaatgaacagaggagacattacatgacgacgcagaacctggcggcagcgcaaaagatg

SEQ ID NO: 143663 - DNA, 103 bp, Artificial Sequence
  Synthetic Polynucleotide
taatacgactcactataggggacgttttgattggcacgagacctgcgtcgaacagaggagacgacgcatgtctcgtgccaacctggcggcagcgcaaaagatg

SEQ ID NO: 143664 - DNA, 103 bp, Artificial Sequence
  Synthetic Polynucleotide
taatacgactcactatagggagccgcgtccgctctcccagcgctccgaacaacagaggagagttcggatggctgggagaaacctggcggcagcgcaaaagatg

SEQ ID NO: 143665 - DNA, 103 bp, Artificial Sequence
  Synthetic Polynucleotide
taatacgactcactataggggaacagcgttgacgttttgattggcacgagaacagaggagactcgtgatgatcaaaacgaacctggcggcagcgcaaaagatg

SEQ ID NO: 143666 - DNA, 103 bp, Artificial Sequence
  Synthetic Polynucleotide
taatacgactcactatagggtaatggctgtgaacagcgttgacgttttgaaacagaggagatcaaaaatgcaacgctgtaacctggcggcagcgcaaaagatg

SEQ ID NO: 143667 - DNA, 103 bp, Artificial Sequence
  Synthetic Polynucleotide
taatacgactcactatagggggcacgtgtataatggctgtgaacagcgttaacagaggagaaacgctatgcacagccataacctggcggcagcgcaaaagatg

SEQ ID NO: 143668 - DNA, 103 bp, Artificial Sequence
  Synthetic Polynucleotide
taatacgactcactatagggtatttgcttgggcacgtgtataatggctgtaacagaggagaacagccatgatacacgtgaacctggcggcagcgcaaaagatg

SEQ ID NO: 143669 - DNA, 103 bp, Artificial Sequence
  Synthetic Polynucleotide
taatacgactcactatagggggtctgggactatttgcttgggcacgtgtaaacagaggagatacacgatgccaagcaaaaacctggcggcagcgcaaaagatg

SEQ ID NO: 143670 - DNA, 103 bp, Artificial Sequence
  Synthetic Polynucleotide
taatacgactcactataggggttcattgctggtctgggactatttgcttgaacagaggagacaagcaatgagtcccagaaacctggcggcagcgcaaaagatg

SEQ ID NO: 143671 - DNA, 103 bp, Artificial Sequence
  Synthetic Polynucleotide
taatacgactcactatagggcagcttgggagttcattgctggtctgggacaacagaggagagtcccaatgcagcaatgaaacctggcggcagcgcaaaagatg

SEQ ID NO: 143672 - DNA, 103 bp, Artificial Sequence
  Synthetic Polynucleotide
taatacgactcactatagggtttggtacagcagcttgggagttcattgctaacagaggagaagcaatatgctcccaagcaacctggcggcagcgcaaaagatg

SEQ ID NO: 143673 - DNA, 103 bp, Artificial Sequence
  Synthetic Polynucleotide
taatacgactcactatagggtgtattctgttttggtacagcagcttgggaaacagaggagatcccaaatggctgtaccaaacctggcggcagcgcaaaagatg

SEQ ID NO: 143674 - DNA, 103 bp, Artificial Sequence
  Synthetic Polynucleotide
taatacgactcactataggggttgctggtgtgtattctgttttggtacagaacagaggagactgtacatgaacagaataaacctggcggcagcgcaaaagatg

SEQ ID NO: 143675 - DNA, 103 bp, Artificial Sequence
  Synthetic Polynucleotide
taatacgactcactatagggcagcttcgccagccgcgtccgctctcccagaacagaggagactgggaatgcggacgcggaacctggcggcagcgcaaaagatg

SEQ ID NO: 143676 - DNA, 103 bp, Artificial Sequence
  Synthetic Polynucleotide
taatacgactcactatagggctttgttgctgttgctggtgtgtattctgtaacagaggagaacagaaatgacaccagcaaacctggcggcagcgcaaaagatg

SEQ ID NO: 143677 - DNA, 103 bp, Artificial Sequence
  Synthetic Polynucleotide
taatacgactcactatagggacggatacttctttgttgctgttgctggtgaacagaggagacaccagatgcagcaacaaaacctggcggcagcgcaaaagatg

SEQ ID NO: 143678 - DNA, 103 bp, Artificial Sequence
  Synthetic Polynucleotide
taatacgactcactatagggtcttatttggacggatacttctttgttgctaacagaggagaagcaacatggaagtatccaacctggcggcagcgcaaaagatg

SEQ ID NO: 143679 - DNA, 103 bp, Artificial Sequence
  Synthetic Polynucleotide
taatacgactcactataggggagcccttcctcttatttggacggatacttaacagaggagaaagtatatgtccaaataaaacctggcggcagcgcaaaagatg

SEQ ID NO: 143680 - DNA, 103 bp, Artificial Sequence
  Synthetic Polynucleotide
taatacgactcactatagggactgctatctgagcccttcctcttatttggaacagaggagaccaaatatgaggaagggcaacctggcggcagcgcaaaagatg

SEQ ID NO: 143681 - DNA, 103 bp, Artificial Sequence
  Synthetic Polynucleotide
taatacgactcactatagggcatctggtatactgctatctgagcccttccaacagaggagaggaaggatgcagatagcaaacctggcggcagcgcaaaagatg

SEQ ID NO: 143682 - DNA, 103 bp, Artificial Sequence
  Synthetic Polynucleotide
taatacgactcactatagggatcttctcttcatctggtatactgctatctaacagaggagaagatagatgtataccagaaacctggcggcagcgcaaaagatg

SEQ ID NO: 143683 - DNA, 103 bp, Artificial Sequence
  Synthetic Polynucleotide
taatacgactcactatagggttcctccttcatcttctcttcatctggtataacagaggagaataccaatggaagagaagaacctggcggcagcgcaaaagatg

SEQ ID NO: 143684 - DNA, 103 bp, Artificial Sequence
  Synthetic Polynucleotide
taatacgactcactatagggaatcatatttttcctccttcatcttctcttaacagaggagaaagagaatgtgaaggaggaacctggcggcagcgcaaaagatg

SEQ ID NO: 143685 - DNA, 103 bp, Artificial Sequence
  Synthetic Polynucleotide
taatacgactcactatagggcgtgatatataatcatatttttcctccttcaacagaggagagaaggaatgaaaatatgaaacctggcggcagcgcaaaagatg

SEQ ID NO: 143686 - DNA, 103 bp, Artificial Sequence
  Synthetic Polynucleotide
taatacgactcactatagggatagaaggtcgtttccatctttgcagtcataacagaggagaatgactatgaagatggaaaacctggcggcagcgcaaaagatg

SEQ ID NO: 143687 - DNA, 103 bp, Artificial Sequence
  Synthetic Polynucleotide
taatacgactcactatagggcagggtcatgctctgtttcaggatcttgggaacagaggagacccaagatgctgaaacagaacctggcggcagcgcaaaagatg

SEQ ID NO: 143688 - DNA, 103 bp, Artificial Sequence
  Synthetic Polynucleotide
taatacgactcactatagggcggccaggttcagggtcatgctctgtttcaaacagaggagatgaaacatggcatgacccaacctggcggcagcgcaaaagatg

SEQ ID NO: 143689 - DNA, 103 bp, Artificial Sequence
  Synthetic Polynucleotide
taatacgactcactatagggcccactgggtcggccaggttcagggtcatgaacagaggagacatgacatggaacctggcaacctggcggcagcgcaaaagatg

SEQ ID NO: 143690 - DNA, 103 bp, Artificial Sequence
  Synthetic Polynucleotide
taatacgactcactatagggcttcaggctccccactgggtcggccaggttaacagaggagaaacctgatggacccagtgaacctggcggcagcgcaaaagatg

SEQ ID NO: 143691 - DNA, 103 bp, Artificial Sequence
  Synthetic Polynucleotide
taatacgactcactatagggggaggtgcggcttcaggctccccactgggtaacagaggagaacccagatgggagcctgaaacctggcggcagcgcaaaagatg

SEQ ID NO: 143692 - DNA, 103 bp, Artificial Sequence
  Synthetic Polynucleotide
taatacgactcactatagggttcttggcgcggaggtgcggcttcaggctcaacagaggagagagcctatggccgcacctaacctggcggcagcgcaaaagatg

SEQ ID NO: 143693 - DNA, 103 bp, Artificial Sequence
  Synthetic Polynucleotide
taatacgactcactataggggaggtccgagttcttggcgcggaggtgcggaacagaggagaccgcacatgcgcgccaagaacctggcggcagcgcaaaagatg

SEQ ID NO: 143694 - DNA, 103 bp, Artificial Sequence
  Synthetic Polynucleotide
taatacgactcactataggggcgaggtgaggaggtccgagttcttggcgcaacagaggagagcgccaatgactcggaccaacctggcggcagcgcaaaagatg

SEQ ID NO: 143695 - DNA, 103 bp, Artificial Sequence
  Synthetic Polynucleotide
taatacgactcactatagggcccacgtcgggcgaggtgaggaggtccgagaacagaggagactcggaatgcctcacctcaacctggcggcagcgcaaaagatg

SEQ ID NO: 143696 - DNA, 103 bp, Artificial Sequence
  Synthetic Polynucleotide
taatacgactcactatagggcttgagcagccccacgtcgggcgaggtgagaacagaggagactcaccatgcccgacgtgaacctggcggcagcgcaaaagatg

SEQ ID NO: 143697 - DNA, 103 bp, Artificial Sequence
  Synthetic Polynucleotide
taatacgactcactataggggggcatcgtcatagaaggtcgtttccatctaacagaggagaagatggatgcgaccttctaacctggcggcagcgcaaaagatg

SEQ ID NO: 143698 - DNA, 103 bp, Artificial Sequence
  Synthetic Polynucleotide
taatacgactcactataggggcgacgccagcttgagcagccccacgtcggaacagaggagaccgacgatgggctgctcaaacctggcggcagcgcaaaagatg

SEQ ID NO: 143699 - DNA, 103 bp, Artificial Sequence
  Synthetic Polynucleotide
taatacgactcactatagggtccagctcgggcgacgccagcttgagcagcaacagaggagagctgctatggctggcgtcaacctggcggcagcgcaaaagatg

SEQ ID NO: 143700 - DNA, 103 bp, Artificial Sequence
  Synthetic Polynucleotide
taatacgactcactatagggtatcaggcgctccagctcgggcgacgccagaacagaggagactggcgatgcccgagctgaacctggcggcagcgcaaaagatg

SEQ ID NO: 143701 - DNA, 103 bp, Artificial Sequence
  Synthetic Polynucleotide
taatacgactcactatagggtggactggattatcaggcgctccagctcggaacagaggagaccgagcatgagcgcctgaaacctggcggcagcgcaaaagatg

SEQ ID NO: 143702 - DNA, 103 bp, Artificial Sequence
  Synthetic Polynucleotide
taatacgactcactatagggtgcccgttgctggactggattatcaggcgcaacagaggagagcgcctatgaatccagtcaacctggcggcagcgcaaaagatg

SEQ ID NO: 143703 - DNA, 103 bp, Artificial Sequence
  Synthetic Polynucleotide
taatacgactcactatagggggtggtgatgtgcccgttgctggactggataacagaggagaatccagatgagcaacgggaacctggcggcagcgcaaaagatg

SEQ ID NO: 143704 - DNA, 103 bp, Artificial Sequence
  Synthetic Polynucleotide
taatacgactcactataggggggtcggcgtggtggtgatgtgcccgttgcaacagaggagagcaacgatgacatcaccaaacctggcggcagcgcaaaagatg

SEQ ID NO: 143705 - DNA, 103 bp, Artificial Sequence
  Synthetic Polynucleotide
taatacgactcactatagggaactgggtgggggtcggcgtggtggtgatgaacagaggagacatcacatgcacgccgacaacctggcggcagcgcaaaagatg

SEQ ID NO: 143706 - DNA, 103 bp, Artificial Sequence
  Synthetic Polynucleotide
taatacgactcactatagggggggcacaggaactgggtgggggtcggcgtaacagaggagaacgccgatgcccacccagaacctggcggcagcgcaaaagatg

SEQ ID NO: 143707 - DNA, 103 bp, Artificial Sequence
  Synthetic Polynucleotide
taatacgactcactatagggtcacgttcttggggcacaggaactgggtggaacagaggagaccacccatgtcctgtgccaacctggcggcagcgcaaaagatg

SEQ ID NO: 143708 - DNA, 103 bp, Artificial Sequence
  Synthetic Polynucleotide
taatacgactcactataggggaggcgttgagggcatcgtcatagaaggtcaacagaggagagaccttatgtgacgatgcaacctggcggcagcgcaaaagatg

SEQ ID NO: 143709 - DNA, 103 bp, Artificial Sequence
  Synthetic Polynucleotide
taatacgactcactatagggtgctcatctgtcacgttcttggggcacaggaacagaggagacctgtgatgcaagaacgtaacctggcggcagcgcaaaagatg

SEQ ID NO: 143710 - DNA, 103 bp, Artificial Sequence
  Synthetic Polynucleotide
taatacgactcactataggggaagccctcctgctcatctgtcacgttcttaacagaggagaaagaacatgacagatgagaacctggcggcagcgcaaaagatg

SEQ ID NO: 143711 - DNA, 103 bp, Artificial Sequence
  Synthetic Polynucleotide
taatacgactcactatagggagccctcggcgaagccctcctgctcatctgaacagaggagacagatgatgaggagggctaacctggcggcagcgcaaaagatg

SEQ ID NO: 143712 - DNA, 103 bp, Artificial Sequence
  Synthetic Polynucleotide
taatacgactcactataggggcgcgcacgaagccctcggcgaagccctccaacagaggagaggagggatgcgccgagggaacctggcggcagcgcaaaagatg

SEQ ID NO: 143713 - DNA, 103 bp, Artificial Sequence
  Synthetic Polynucleotide
taatacgactcactatagggttcggccagggcgcgcacgaagccctcggcaacagaggagagccgagatgttcgtgcgcaacctggcggcagcgcaaaagatg

SEQ ID NO: 143714 - DNA, 103 bp, Artificial Sequence
  Synthetic Polynucleotide
taatacgactcactatagggggctgtgcagttcggccagggcgcgcacgaaacagaggagatcgtgcatgccctggccgaacctggcggcagcgcaaaagatg

SEQ ID NO: 143715 - DNA, 103 bp, Artificial Sequence
  Synthetic Polynucleotide
taatacgactcactatagggagcgtgttctggctgtgcagttcggccaggaacagaggagacctggcatgactgcacagaacctggcggcagcgcaaaagatg

SEQ ID NO: 143716 - DNA, 103 bp, Artificial Sequence
  Synthetic Polynucleotide
taatacgactcactataggggacgctgggcagcgtgttctggctgtgcagaacagaggagactgcacatgcagaacacgaacctggcggcagcgcaaaagatg

SEQ ID NO: 143717 - DNA, 103 bp, Artificial Sequence
  Synthetic Polynucleotide
taatacgactcactatagggccgccgacgtgacgctgggcagcgtgttctaacagaggagaagaacaatgtgcccagcgaacctggcggcagcgcaaaagatg

SEQ ID NO: 143718 - DNA, 103 bp, Artificial Sequence
  Synthetic Polynucleotide
taatacgactcactatagggaccggctgcgccgccgacgtgacgctgggcaacagaggagagcccagatgcacgtcggcaacctggcggcagcgcaaaagatg

SEQ ID NO: 143719 - DNA, 103 bp, Artificial Sequence
  Synthetic Polynucleotide
taatacgactcactatagggcgggaggaacgaggcgttgagggcatcgtcaacagaggagagacgatatgctcaacgccaacctggcggcagcgcaaaagatg

SEQ ID NO: 143720 - DNA, 103 bp, Artificial Sequence
  Synthetic Polynucleotide
taatacgactcactatagggtgccccgttgaccggctgcgccgccgacgtaacagaggagaacgtcgatggcgcagccgaacctggcggcagcgcaaaagatg

SEQ ID NO: 143721 - DNA, 103 bp, Artificial Sequence
  Synthetic Polynucleotide
taatacgactcactatagggccaccatgcctgccccgttgaccggctgcgaacagaggagacgcagcatgtcaacggggaacctggcggcagcgcaaaagatg

SEQ ID NO: 143722 - DNA, 103 bp, Artificial Sequence
  Synthetic Polynucleotide
taatacgactcactatagggaccgcgggagccaccatgcctgccccgttgaacagaggagacaacggatgaggcatggtaacctggcggcagcgcaaaagatg

SEQ ID NO: 143723 - DNA, 103 bp, Artificial Sequence
  Synthetic Polynucleotide
taatacgactcactatagggcaccgaggctaccgcgggagccaccatgccaacagaggagaggcatgatggctcccgcgaacctggcggcagcgcaaaagatg

SEQ ID NO: 143724 - DNA, 103 bp, Artificial Sequence
  Synthetic Polynucleotide
taatacgactcactatagggtgccccctgccaccgaggctaccgcgggagaacagaggagactcccgatgtagcctcggaacctggcggcagcgcaaaagatg

SEQ ID NO: 143725 - DNA, 103 bp, Artificial Sequence
  Synthetic Polynucleotide
taatacgactcactatagggccgctgccgctgccccctgccaccgaggctaacagaggagaagcctcatgggcagggggaacctggcggcagcgcaaaagatg

SEQ ID NO: 143726 - DNA, 103 bp, Artificial Sequence
  Synthetic Polynucleotide
taatacgactcactataggggctgaagccgccgctgccgctgccccctgcaacagaggagagcagggatgagcggcagcaacctggcggcagcgcaaaagatg

SEQ ID NO: 143727 - DNA, 103 bp, Artificial Sequence
  Synthetic Polynucleotide
taatacgactcactataggggcaggctggcgctgaagccgccgctgccgcaacagaggagagcggcaatggcggcttcaaacctggcggcagcgcaaaagatg

SEQ ID NO: 143728 - DNA, 103 bp, Artificial Sequence
  Synthetic Polynucleotide
taatacgactcactatagggggctcgctgtgcaggctggcgctgaagccgaacagaggagacggcttatgcgccagcctaacctggcggcagcgcaaaagatg

SEQ ID NO: 143729 - DNA, 103 bp, Artificial Sequence
  Synthetic Polynucleotide
taatacgactcactataggggtagaccggcggctcgctgtgcaggctggcaacagaggagagccagcatgcacagcgagaacctggcggcagcgcaaaagatg

SEQ ID NO: 143730 - DNA, 103 bp, Artificial Sequence
  Synthetic Polynucleotide
taatacgactcactatagggcgctctcggacgggaggaacgaggcgttgaaacagaggagatcaacgatgcgttcctccaacctggcggcagcgcaaaagatg

SEQ ID NO: 143731 - DNA, 103 bp, Artificial Sequence
  Synthetic Polynucleotide
taatacgactcactatagggtgaggtttgcgtagaccggcggctcgctgtaacagaggagaacagcgatgcgccggtctaacctggcggcagcgcaaaagatg

SEQ ID NO: 143732 - DNA, 103 bp, Artificial Sequence
  Synthetic Polynucleotide
taatacgactcactatagggttgaagttgctgaggtttgcgtagaccggcaacagaggagagccggtatgcgcaaacctaacctggcggcagcgcaaaagatg

SEQ ID NO: 143733 - DNA, 103 bp, Artificial Sequence
  Synthetic Polynucleotide
taatacgactcactatagggcgcgcctgggttgaagttgctgaggtttgcaacagaggagagcaaacatgagcaacttcaacctggcggcagcgcaaaagatg

SEQ ID NO: 143734 - DNA, 103 bp, Artificial Sequence
  Synthetic Polynucleotide
taatacgactcactatagggcgctgctcagcgcgcctgggttgaagttgcaacagaggagagcaactatgacccaggcgaacctggcggcagcgcaaaagatg

SEQ ID NO: 143735 - DNA, 103 bp, Artificial Sequence
  Synthetic Polynucleotide
taatacgactcactataggggccccgccgccgctgctcagcgcgcctgggaacagaggagacccaggatggctgagcagaacctggcggcagcgcaaaagatg

SEQ ID NO: 143736 - DNA, 103 bp, Artificial Sequence
  Synthetic Polynucleotide
taatacgactcactataggggtaggagggcgccccgccgccgctgctcagaacagaggagactgagcatgggcggcgggaacctggcggcagcgcaaaagatg

SEQ ID NO: 143737 - DNA, 103 bp, Artificial Sequence
  Synthetic Polynucleotide
taatacgactcactatagggcggccgcgccgtaggagggcgccccgccgcaacagaggagagcggcgatgcgccctcctaacctggcggcagcgcaaaagatg

SEQ ID NO: 143738 - DNA, 103 bp, Artificial Sequence
  Synthetic Polynucleotide
taatacgactcactatagggaaggccaggccggccgcgccgtaggagggcaacagaggagagccctcatgcggcgcggcaacctggcggcagcgcaaaagatg

SEQ ID NO: 143739 - DNA, 103 bp, Artificial Sequence
  Synthetic Polynucleotide
taatacgactcactatagggttgcgcgggaaaggccaggccggccgcgccaacagaggagaggcgcgatgggcctggccaacctggcggcagcgcaaaagatg

SEQ ID NO: 143740 - DNA, 103 bp, Artificial Sequence
  Synthetic Polynucleotide
taatacgactcactataggggctgctggggttgcgcgggaaaggccaggcaacagaggagagcctggatgttcccgcgcaacctggcggcagcgcaaaagatg

SEQ ID NO: 143741 - DNA, 103 bp, Artificial Sequence
  Synthetic Polynucleotide
taatacgactcactatagggccataaggtccgctctcggacgggaggaacaacagaggagagttcctatggtccgagagaacctggcggcagcgcaaaagatg

SEQ ID NO: 143742 - DNA, 103 bp, Artificial Sequence
  Synthetic Polynucleotide
taatacgactcactatagggggctgctgctgctgctggggttgcgcgggaaacagaggagatcccgcatgaccccagcaaacctggcggcagcgcaaaagatg

SEQ ID NO: 143743 - DNA, 103 bp, Artificial Sequence
  Synthetic Polynucleotide
taatacgactcactataggggtggtgcggcggctgctgctgctgctggggaacagaggagaccccagatgcagcagcagaacctggcggcagcgcaaaagatg

SEQ ID NO: 143744 - DNA, 103 bp, Artificial Sequence
  Synthetic Polynucleotide
taatacgactcactataggggctggggcaggtggtgcggcggctgctgctaacagaggagaagcagcatgcgccgcaccaacctggcggcagcgcaaaagatg

SEQ ID NO: 143745 - DNA, 103 bp, Artificial Sequence
  Synthetic Polynucleotide
taatacgactcactatagggacgggcatctgctggggcaggtggtgcggcaacagaggagagccgcaatgcctgccccaaacctggcggcagcgcaaaagatg

SEQ ID NO: 143746 - DNA, 103 bp, Artificial Sequence
  Synthetic Polynucleotide
taatacgactcactatagggcgggtgctgcacgggcatctgctggggcagaacagaggagactgcccatgcagatgcccaacctggcggcagcgcaaaagatg

SEQ ID NO: 143747 - DNA, 103 bp, Artificial Sequence
  Synthetic Polynucleotide
taatacgactcactatagggcctgcagccgcgggtgctgcacgggcatctaacagaggagaagatgcatgtgcagcaccaacctggcggcagcgcaaaagatg

SEQ ID NO: 143748 - DNA, 103 bp, Artificial Sequence
  Synthetic Polynucleotide
taatacgactcactatagggtccttcagggcctgcagccgcgggtgctgcaacagaggagagcagcaatggcggctgcaaacctggcggcagcgcaaaagatg

SEQ ID NO: 143749 - DNA, 103 bp, Artificial Sequence
  Synthetic Polynucleotide
taatacgactcactatagggctgaggctcctccttcagggcctgcagccgaacagaggagacggctgatggccctgaagaacctggcggcagcgcaaaagatg

SEQ ID NO: 143750 - DNA, 103 bp, Artificial Sequence
  Synthetic Polynucleotide
taatacgactcactatagggcgggcactgtctgaggctcctccttcagggaacagaggagaccctgaatgaggagcctcaacctggcggcagcgcaaaagatg

SEQ ID NO: 143751 - DNA, 103 bp, Artificial Sequence
  Synthetic Polynucleotide
taatacgactcactatagggccgggcatctcgggcactgtctgaggctccaacagaggagaggagccatggacagtgccaacctggcggcagcgcaaaagatg

SEQ ID NO: 143752 - DNA, 103 bp, Artificial Sequence
  Synthetic Polynucleotide
taatacgactcactataggggttactgtagccataaggtccgctctcggaaacagaggagatccgagatgggaccttataacctggcggcagcgcaaaagatg

SEQ ID NO: 143753 - DNA, 103 bp, Artificial Sequence
  Synthetic Polynucleotide
taatacgactcactatagggcggtgtctcgccgggcatctcgggcactgtaacagaggagaacagtgatggagatgcccaacctggcggcagcgcaaaagatg

SEQ ID NO: 143754 - DNA, 103 bp, Artificial Sequence
  Synthetic Polynucleotide
taatacgactcactataggggggacaggggcggtgtctcgccgggcatctaacagaggagaagatgcatggcgagacacaacctggcggcagcgcaaaagatg

SEQ ID NO: 143755 - DNA, 103 bp, Artificial Sequence
  Synthetic Polynucleotide
taatacgactcactatagggatgtcgatgggggacaggggcggtgtctcgaacagaggagacgagacatggcccctgtcaacctggcggcagcgcaaaagatg

SEQ ID NO: 143756 - DNA, 103 bp, Artificial Sequence
  Synthetic Polynucleotide
taatacgactcactatagggctgggactccatgtcgatgggggacaggggaacagaggagacccctgatgcccatcgacaacctggcggcagcgcaaaagatg

SEQ ID NO: 143757 - DNA, 103 bp, Artificial Sequence
  Synthetic Polynucleotide
taatacgactcactatagggtgatccgctcctgggactccatgtcgatggaacagaggagaccatcgatgtggagtcccaacctggcggcagcgcaaaagatg

SEQ ID NO: 143758 - DNA, 103 bp, Artificial Sequence
  Synthetic Polynucleotide
taatacgactcactatagggctctccgccttgatccgctcctgggactccaacagaggagaggagtcatgggagcggataacctggcggcagcgcaaaagatg

SEQ ID NO: 143759 - DNA, 103 bp, Artificial Sequence
  Synthetic Polynucleotide
taatacgactcactatagggcatgcgcttcctctccgccttgatccgctcaacagaggagagagcggatgaaggcggagaacctggcggcagcgcaaaagatg

SEQ ID NO: 143760 - DNA, 103 bp, Artificial Sequence
  Synthetic Polynucleotide
taatacgactcactatagggtgcggttcctcatgcgcttcctctccgcctaacagaggagaaggcggatgggaagcgcaaacctggcggcagcgcaaaagatg

SEQ ID NO: 143761 - DNA, 103 bp, Artificial Sequence
  Synthetic Polynucleotide
taatacgactcactataggggaggcagcgatgcggttcctcatgcgcttcaacagaggagagaagcgatggaggaaccgaacctggcggcagcgcaaaagatg

SEQ ID NO: 143762 - DNA, 103 bp, Artificial Sequence
  Synthetic Polynucleotide
taatacgactcactatagggtcggcacttggaggcagcgatgcggttcctaacagaggagaaggaacatgatcgctgccaacctggcggcagcgcaaaagatg

SEQ ID NO: 143763 - DNA, 103 bp, Artificial Sequence
  Synthetic Polynucleotide
taatacgactcactatagggggatcttggggttactgtagccataaggtcaacagaggagagaccttatggctacagtaaacctggcggcagcgcaaaagatg

SEQ ID NO: 143764 - DNA, 103 bp, Artificial Sequence
  Synthetic Polynucleotide
taatacgactcactataggggcttcctttttcggcacttggaggcagcgaaacagaggagatcgctgatgccaagtgccaacctggcggcagcgcaaaagatg

SEQ ID NO: 143765 - DNA, 103 bp, Artificial Sequence
  Synthetic Polynucleotide
taatacgactcactatagggattctctccagcttcctttttcggcacttgaacagaggagacaagtgatgaaaaaggaaaacctggcggcagcgcaaaagatg

SEQ ID NO: 143766 - DNA, 103 bp, Artificial Sequence
  Synthetic Polynucleotide
taatacgactcactatagggcagccgggcgattctctccagcttccttttaacagaggagaaaaaggatgctggagagaaacctggcggcagcgcaaaagatg

SEQ ID NO: 143767 - DNA, 103 bp, Artificial Sequence
  Synthetic Polynucleotide
taatacgactcactatagggctttttcctccagccgggcgattctctccaaacagaggagatggagaatgtcgcccggcaacctggcggcagcgcaaaagatg

SEQ ID NO: 143768 - DNA, 103 bp, Artificial Sequence
  Synthetic Polynucleotide
taatacgactcactatagggaaggttttcactttttcctccagccgggcgaacagaggagacgcccgatgggaggaaaaaacctggcggcagcgcaaaagatg

SEQ ID NO: 143769 - DNA, 103 bp, Artificial Sequence
  Synthetic Polynucleotide
taatacgactcactatagggctgagctttcaaggttttcactttttcctcaacagaggagagaggaaatggtgaaaaccaacctggcggcagcgcaaaagatg

SEQ ID NO: 143770 - DNA, 103 bp, Artificial Sequence
  Synthetic Polynucleotide
taatacgactcactataggggctccgagttctgagctttcaaggttttcaaacagaggagatgaaaaatgtgaaagctcaacctggcggcagcgcaaaagatg

SEQ ID NO: 143771 - DNA, 103 bp, Artificial Sequence
  Synthetic Polynucleotide
taatacgactcactataggggtggacgccagctccgagttctgagctttcaacagaggagagaaagcatggaactcggaaacctggcggcagcgcaaaagatg

SEQ ID NO: 143772 - DNA, 103 bp, Artificial Sequence
  Synthetic Polynucleotide
taatacgactcactatagggcatgttggccgtggacgccagctccgagttaacagaggagaaactcgatgctggcgtccaacctggcggcagcgcaaaagatg

SEQ ID NO: 143773 - DNA, 103 bp, Artificial Sequence
  Synthetic Polynucleotide
taatacgactcactataggggttccctgagcatgttggccgtggacgccaaacagaggagatggcgtatgcggccaacaaacctggcggcagcgcaaaagatg

SEQ ID NO: 143774 - DNA, 103 bp, Artificial Sequence
  Synthetic Polynucleotide
taatacgactcactatagggctctgtttcaggatcttggggttactgtagaacagaggagactacagatgccccaagataacctggcggcagcgcaaaagatg

SEQ ID NO: 143775 - DNA, 103 bp, Artificial Sequence
  Synthetic Polynucleotide
taatacgactcactatagggtgtgccacctgttccctgagcatgttggccaacagaggagaggccaaatggctcagggaaacctggcggcagcgcaaaagatg

SEQ ID NO: 143776 - DNA, 103 bp, Artificial Sequence
  Synthetic Polynucleotide
taatacgactcactatagggctgtttaagctgtgccacctgttccctgagaacagaggagactcaggatgcaggtggcaaacctggcggcagcgcaaaagatg

SEQ ID NO: 143777 - DNA, 103 bp, Artificial Sequence
  Synthetic Polynucleotide
taatacgactcactatagggtcatgactttctgtttaagctgtgccacctaacagaggagaaggtggatgagcttaaacaacctggcggcagcgcaaaagatg

SEQ ID NO: 143778 - DNA, 103 bp, Artificial Sequence
  Synthetic Polynucleotide
taatacgactcactatagggttaacgtggttcatgactttctgtttaagcaacagaggagagcttaaatggaaagtcataacctggcggcagcgcaaaagatg

SEQ ID NO: 143779 - DNA, 103 bp, Artificial Sequence
  Synthetic Polynucleotide
taatacgactcactataggggcacccactgttaacgtggttcatgactttaacagaggagaaaagtcatgaaccacgttaacctggcggcagcgcaaaagatg

SEQ ID NO: 143780 - DNA, 103 bp, Artificial Sequence
  Synthetic Polynucleotide
taatacgactcactataggggcatgagttggcacccactgttaacgtggtaacagaggagaaccacgatgacagtgggtaacctggcggcagcgcaaaagatg

SEQ ID NO: 143781 - DNA, 103 bp, Artificial Sequence
  Synthetic Polynucleotide
taatacgactcactatagggtgctgcgttagcatgagttggcacccactgaacagaggagacagtggatgccaactcataacctggcggcagcgcaaaagatg

SEQ ID NO: 143782 - DNA, 103 bp, Artificial Sequence
  Synthetic Polynucleotide
taatacgactcactatagggtgtttgcaactgctgcgttagcatgagttgaacagaggagacaactcatgctaacgcagaacctggcggcagcgcaaaagatg

SEQ ID NO: 143783 - DNA, 103 bp, Artificial Sequence
  Synthetic Polynucleotide
taatacgactcactataggggtagaagggctgttccattttagtgcacataacagaggagaatgtgcatgaaaatggaaaacctggcggcagcgcaaaagatg

SEQ ID NO: 143784 - DNA, 103 bp, Artificial Sequence
  Synthetic Polynucleotide
taatacgactcactatagggcgccaggctcggtttcaggagtttgtagtcaacagaggagagactacatgctcctgaaaaacctggcggcagcgcaaaagatg

SEQ ID NO: 143785 - DNA, 103 bp, Artificial Sequence
  Synthetic Polynucleotide
taatacgactcactatagggaagcagcagctgacagccgttgctgacgtgaacagaggagacacgtcatgaacggctgtaacctggcggcagcgcaaaagatg

SEQ ID NO: 143786 - DNA, 103 bp, Artificial Sequence
  Synthetic Polynucleotide
taatacgactcactatagggccttgaccccaagcagcagctgacagccgtaacagaggagaacggctatgagctgctgcaacctggcggcagcgcaaaagatg

SEQ ID NO: 143787 - DNA, 103 bp, Artificial Sequence
  Synthetic Polynucleotide
taatacgactcactatagggaaggcgtgtcccttgaccccaagcagcagcaacagaggagagctgctatgtggggtcaaaacctggcggcagcgcaaaagatg

SEQ ID NO: 143788 - DNA, 103 bp, Artificial Sequence
  Synthetic Polynucleotide
taatacgactcactatagggccaggttgaccgccaggctcggtttcaggaaacagaggagatcctgaatgcgagcctggaacctggcggcagcgcaaaagatg

SEQ ID NO: 143789 - DNA, 103 bp, Artificial Sequence
  Synthetic Polynucleotide
taatacgactcactatagggtaggggtcggccaggttgaccgccaggctcaacagaggagagagcctatgggtcaacctaacctggcggcagcgcaaaagatg

SEQ ID NO: 143790 - DNA, 103 bp, Artificial Sequence
  Synthetic Polynucleotide
taatacgactcactataggggagactccggtaggggtcggccaggttgacaacagaggagagtcaacatggccgaccccaacctggcggcagcgcaaaagatg

SEQ ID NO: 143791 - DNA, 103 bp, Artificial Sequence
  Synthetic Polynucleotide
taatacgactcactatagggcaggcgctttgagactccggtaggggtcggaacagaggagaccgaccatgaccggagtcaacctggcggcagcgcaaaagatg

SEQ ID NO: 143792 - DNA, 103 bp, Artificial Sequence
  Synthetic Polynucleotide
taatacgactcactatagggccgcgagccccaggcgctttgagactccggaacagaggagaccggagatgcaaagcgccaacctggcggcagcgcaaaagatg

SEQ ID NO: 143793 - DNA, 103 bp, Artificial Sequence
  Synthetic Polynucleotide
taatacgactcactatagggtgggccgggtccgcgagccccaggcgctttaacagaggagaaaagcgatgggggctcgcaacctggcggcagcgcaaaagatg

SEQ ID NO: 143794 - DNA, 103 bp, Artificial Sequence
  Synthetic Polynucleotide
taatacgactcactatagggcgccgccctctgggccgggtccgcgagcccaacagaggagagggctcatggacccggccaacctggcggcagcgcaaaagatg

SEQ ID NO: 143795 - DNA, 103 bp, Artificial Sequence
  Synthetic Polynucleotide
taatacgactcactatagggctgccgccaccgccgccctctgggccgggtaacagaggagaacccggatgagagggcggaacctggcggcagcgcaaaagatg

SEQ ID NO: 143796 - DNA, 103 bp, Artificial Sequence
  Synthetic Polynucleotide
taatacgactcactatagggagaaaagtagctgccgccaccgccgccctcaacagaggagagagggcatgggtggcggcaacctggcggcagcgcaaaagatg

SEQ ID NO: 143797 - DNA, 103 bp, Artificial Sequence
  Synthetic Polynucleotide
taatacgactcactatagggagtcgtcgtggtagaagggctgttccatttaacagaggagaaaatggatgagcccttctaacctggcggcagcgcaaaagatg

SEQ ID NO: 143798 - DNA, 103 bp, Artificial Sequence
  Synthetic Polynucleotide
taatacgactcactatagggagccctgaccagaaaagtagctgccgccacaacagaggagagtggcgatggctacttttaacctggcggcagcgcaaaagatg

SEQ ID NO: 143799 - DNA, 103 bp, Artificial Sequence
  Synthetic Polynucleotide
taatacgactcactatagggccggtgtccgagccctgaccagaaaagtagaacagaggagactacttatgtggtcagggaacctggcggcagcgcaaaagatg

SEQ ID NO: 143800 - DNA, 103 bp, Artificial Sequence
  Synthetic Polynucleotide
taatacgactcactataggggagagacgcgccggtgtccgagccctgaccaacagaggagaggtcagatgtcggacaccaacctggcggcagcgcaaaagatg

SEQ ID NO: 143801 - DNA, 103 bp, Artificial Sequence
  Synthetic Polynucleotide
taatacgactcactatagggaggcgagcttgagagacgcgccggtgtccgaacagaggagacggacaatggcgcgtctcaacctggcggcagcgcaaaagatg

SEQ ID NO: 143802 - DNA, 103 bp, Artificial Sequence
  Synthetic Polynucleotide
taatacgactcactatagggagctccgaagaggcgagcttgagagacgcgaacagaggagacgcgtcatgcaagctcgcaacctggcggcagcgcaaaagatg

SEQ ID NO: 143803 - DNA, 103 bp, Artificial Sequence
  Synthetic Polynucleotide
taatacgactcactatagggcaggcgttccagctccgaagaggcgagcttaacagaggagaaagctcatgtcttcggagaacctggcggcagcgcaaaagatg

SEQ ID NO: 143804 - DNA, 103 bp, Artificial Sequence
  Synthetic Polynucleotide
taatacgactcactatagggtggggacaatcaggcgttccagctccgaagaacagaggagacttcggatgtggaacgccaacctggcggcagcgcaaaagatg

SEQ ID NO: 143805 - DNA, 103 bp, Artificial Sequence
  Synthetic Polynucleotide
taatacgactcactatagggccgttgctgttggggacaatcaggcgttccaacagaggagaggaacgatggattgtcccaacctggcggcagcgcaaaagatg

SEQ ID NO: 143806 - DNA, 103 bp, Artificial Sequence
  Synthetic Polynucleotide
taatacgactcactatagggcgtgatcacgccgttgctgttggggacaataacagaggagaattgtcatgaacagcaacaacctggcggcagcgcaaaagatg

SEQ ID NO: 143807 - DNA, 103 bp, Artificial Sequence
  Synthetic Polynucleotide
taatacgactcactatagggtaggcgtcgtcgtgatcacgccgttgctgtaacagaggagaacagcaatggcgtgatcaaacctggcggcagcgcaaaagatg

SEQ ID NO: 143808 - DNA, 103 bp, Artificial Sequence
  Synthetic Polynucleotide
taatacgactcactataggggctgtgtatgagtcgtcgtggtagaagggcaacagaggagagcccttatgccacgacgaaacctggcggcagcgcaaaagatg

SEQ ID NO: 143809 - DNA, 103 bp, Artificial Sequence
  Synthetic Polynucleotide
taatacgactcactatagggcccgggggtgtaggcgtcgtcgtgatcacgaacagaggagacgtgatatggacgacgccaacctggcggcagcgcaaaagatg

SEQ ID NO: 143810 - DNA, 103 bp, Artificial Sequence
  Synthetic Polynucleotide
taatacgactcactatagggaaagtactgtcccgggggtgtaggcgtcgtaacagaggagaacgacgatgacacccccgaacctggcggcagcgcaaaagatg

SEQ ID NO: 143811 - DNA, 103 bp, Artificial Sequence
  Synthetic Polynucleotide
taatacgactcactatagggcgcgggggtaaaagtactgtcccgggggtgaacagaggagacaccccatggacagtactaacctggcggcagcgcaaaagatg

SEQ ID NO: 143812 - DNA, 103 bp, Artificial Sequence
  Synthetic Polynucleotide
taatacgactcactatagggctgccacccccgcgggggtaaaagtactgtaacagaggagaacagtaatgttacccccgaacctggcggcagcgcaaaagatg

SEQ ID NO: 143813 - DNA, 103 bp, Artificial Sequence
  Synthetic Polynucleotide
taatacgactcactatagggacctccaccgctgccacccccgcgggggtaaacagaggagataccccatggggggtggcaacctggcggcagcgcaaaagatg

SEQ ID NO: 143814 - DNA, 103 bp, Artificial Sequence
  Synthetic Polynucleotide
taatacgactcactatagggcgccccctgcacctccaccgctgccaccccaacagaggagaggggtgatggcggtggagaacctggcggcagcgcaaaagatg

SEQ ID NO: 143815 - DNA, 103 bp, Artificial Sequence
  Synthetic Polynucleotide
taatacgactcactatagggccgccccctgcgccccctgcacctccaccgaacagaggagacggtggatgtgcagggggaacctggcggcagcgcaaaagatg

SEQ ID NO: 143816 - DNA, 103 bp, Artificial Sequence
  Synthetic Polynucleotide
taatacgactcactatagggctcggtgacgccgccccctgcgccccctgcaacagaggagagcagggatggcagggggcaacctggcggcagcgcaaaagatg

SEQ ID NO: 143817 - DNA, 103 bp, Artificial Sequence
  Synthetic Polynucleotide
taatacgactcactatagggcctcctgctcctcggtgacgccgccccctgaacagaggagacaggggatggcgtcaccgaacctggcggcagcgcaaaagatg

SEQ ID NO: 143818 - DNA, 103 bp, Artificial Sequence
  Synthetic Polynucleotide
taatacgactcactatagggtcggcgaagccctcctgctcctcggtgacgaacagaggagacgtcacatgggagcaggaaacctggcggcagcgcaaaagatg

SEQ ID NO: 143819 - DNA, 103 bp, Artificial Sequence
  Synthetic Polynucleotide
taatacgactcactataggggtatcccgtagctgtgtatgagtcgtcgtgaacagaggagacacgacatgtcatacacaaacctggcggcagcgcaaaagatg

SEQ ID NO: 143820 - DNA, 103 bp, Artificial Sequence
  Synthetic Polynucleotide
taatacgactcactataggggacaaagccgtcggcgaagccctcctgctcaacagaggagagagcagatgggcttcgccaacctggcggcagcgcaaaagatg

SEQ ID NO: 143821 - DNA, 103 bp, Artificial Sequence
  Synthetic Polynucleotide
taatacgactcactatagggccagggctttgacaaagccgtcggcgaagcaacagaggagagcttcgatgacggctttgaacctggcggcagcgcaaaagatg

SEQ ID NO: 143822 - DNA, 103 bp, Artificial Sequence
  Synthetic Polynucleotide
taatacgactcactatagggtgcagatcgtccagggctttgacaaagccgaacagaggagacggcttatgcaaagccctaacctggcggcagcgcaaaagatg

SEQ ID NO: 143823 - DNA, 103 bp, Artificial Sequence
  Synthetic Polynucleotide
taatacgactcactataggggttcatcttgtgcagatcgtccagggctttaacagaggagaaaagccatggacgatctgaacctggcggcagcgcaaaagatg

SEQ ID NO: 143824 - DNA, 103 bp, Artificial Sequence
  Synthetic Polynucleotide
taatacgactcactataggggtgtcacgtggttcatcttgtgcagatcgtaacagaggagaacgatcatgacaagatgaaacctggcggcagcgcaaaagatg

SEQ ID NO: 143825 - DNA, 103 bp, Artificial Sequence
  Synthetic Polynucleotide
taatacgactcactatagggacgttggggggtgtcacgtggttcatcttgaacagaggagacaagatatgccacgtgacaacctggcggcagcgcaaaagatg

SEQ ID NO: 143826 - DNA, 103 bp, Artificial Sequence
  Synthetic Polynucleotide
taatacgactcactataggggcccagggacacgttggggggtgtcacgtgaacagaggagacacgtgatgccccccaacaacctggcggcagcgcaaaagatg

SEQ ID NO: 143827 - DNA, 103 bp, Artificial Sequence
  Synthetic Polynucleotide
taatacgactcactatagggccccggtagcgcccagggacacgttgggggaacagaggagacccccaatgtgtccctggaacctggcggcagcgcaaaagatg

SEQ ID NO: 143828 - DNA, 103 bp, Artificial Sequence
  Synthetic Polynucleotide
taatacgactcactataggggccgggggccccccggtagcgcccagggacaacagaggagagtccctatgcgctaccggaacctggcggcagcgcaaaagatg

SEQ ID NO: 143829 - DNA, 103 bp, Artificial Sequence
  Synthetic Polynucleotide
taatacgactcactatagggcccgggcccagccgggggccccccggtagcaacagaggagagctaccatggggcccccgaacctggcggcagcgcaaaagatg

SEQ ID NO: 143830 - DNA, 103 bp, Artificial Sequence
  Synthetic Polynucleotide
taatacgactcactataggggggcccggccgtatcccgtagctgtgtatgaacagaggagacatacaatgctacgggataacctggcggcagcgcaaaagatg

SEQ ID NO: 143831 - DNA, 103 bp, Artificial Sequence
  Synthetic Polynucleotide
taatacgactcactatagggcgtagacgcccccgggcccagccgggggccaacagaggagaggccccatgctgggcccgaacctggcggcagcgcaaaagatg

SEQ ID NO: 143832 - DNA, 103 bp, Artificial Sequence
  Synthetic Polynucleotide
taatacgactcactatagggtccgggccggcgtagacgcccccgggcccaaacagaggagatgggccatggggcgtctaaacctggcggcagcgcaaaagatg

SEQ ID NO: 143833 - DNA, 103 bp, Artificial Sequence
  Synthetic Polynucleotide
taatacgactcactataggggggaggtggctccgggccggcgtagacgccaacagaggagaggcgtcatggccggcccgaacctggcggcagcgcaaaagatg

SEQ ID NO: 143834 - DNA, 103 bp, Artificial Sequence
  Synthetic Polynucleotide
taatacgactcactatagggtggtgtaaacgggaggtggctccgggccggaacagaggagaccggccatgagccacctcaacctggcggcagcgcaaaagatg

SEQ ID NO: 143835 - DNA, 103 bp, Artificial Sequence
  Synthetic Polynucleotide
taatacgactcactatagggctgctgaggttggtgtaaacgggaggtggcaacagaggagagccaccatgcgtttacacaacctggcggcagcgcaaaagatg

SEQ ID NO: 143836 - DNA, 103 bp, Artificial Sequence
  Synthetic Polynucleotide
taatacgactcactatagggtggggagtagctgctgaggttggtgtaaacaacagaggagagtttacatgaacctcagcaacctggcggcagcgcaaaagatg

SEQ ID NO: 143837 - DNA, 103 bp, Artificial Sequence
  Synthetic Polynucleotide
taatacgactcactatagggacgcagaggctggggagtagctgctgaggtaacagaggagaacctcaatggctactcccaacctggcggcagcgcaaaagatg

SEQ ID NO: 143838 - DNA, 103 bp, Artificial Sequence
  Synthetic Polynucleotide
taatacgactcactatagggcctcccgaggacgcagaggctggggagtagaacagaggagactactcatgagcctctgcaacctggcggcagcgcaaaagatg

SEQ ID NO: 143839 - DNA, 103 bp, Artificial Sequence
  Synthetic Polynucleotide
taatacgactcactatagggagccccggcgcctcccgaggacgcagaggcaacagaggagagcctctatgtcctcgggaaacctggcggcagcgcaaaagatg

SEQ ID NO: 143840 - DNA, 103 bp, Artificial Sequence
  Synthetic Polynucleotide
taatacgactcactatagggtcccgacggcagccccggcgcctcccgaggaacagaggagacctcggatggcgccggggaacctggcggcagcgcaaaagatg

SEQ ID NO: 143841 - DNA, 103 bp, Artificial Sequence
  Synthetic Polynucleotide
taatacgactcactatagggaggccaccaggggcccggccgtatcccgtaaacagaggagatacgggatgcggccgggcaacctggcggcagcgcaaaagatg

SEQ ID NO: 143842 - DNA, 103 bp, Artificial Sequence
  Synthetic Polynucleotide
taatacgactcactataggggagctcccggtcccgacggcagccccggcgaacagaggagacgccggatgtgccgtcggaacctggcggcagcgcaaaagatg

SEQ ID NO: 143843 - DNA, 103 bp, Artificial Sequence
  Synthetic Polynucleotide
taatacgactcactatagggcgtcgggtacgagctcccggtcccgacggcaacagaggagagccgtcatgaccgggagcaacctggcggcagcgcaaaagatg

SEQ ID NO: 143844 - DNA, 103 bp, Artificial Sequence
  Synthetic Polynucleotide
taatacgactcactatagggtgatggtggtcgtcgggtacgagctcccggaacagaggagaccgggaatgcgtacccgaaacctggcggcagcgcaaaagatg

SEQ ID NO: 143845 - DNA, 103 bp, Artificial Sequence
  Synthetic Polynucleotide
taatacgactcactataggggggaggtagctgatggtggtcgtcgggtacaacagaggagagtacccatggaccaccataacctggcggcagcgcaaaagatg

SEQ ID NO: 143846 - DNA, 103 bp, Artificial Sequence
  Synthetic Polynucleotide
taatacgactcactatagggcggcgcgtgtgggaggtagctgatggtggtaacagaggagaaccaccatgagctacctcaacctggcggcagcgcaaaagatg

SEQ ID NO: 143847 - DNA, 103 bp, Artificial Sequence
  Synthetic Polynucleotide
taatacgactcactatagggcggcgaagggcggcgcgtgtgggaggtagcaacagaggagagctaccatgcacacgcgcaacctggcggcagcgcaaaagatg

SEQ ID NO: 143848 - DNA, 103 bp, Artificial Sequence
  Synthetic Polynucleotide
taatacgactcactataggggggtggccaccggcgaagggcggcgcgtgtaacagaggagaacacgcatggcccttcgcaacctggcggcagcgcaaaagatg

SEQ ID NO: 143849 - DNA, 103 bp, Artificial Sequence
  Synthetic Polynucleotide
taatacgactcactatagggcagctgcgccgggtggccaccggcgaagggaacagaggagacccttcatgggtggccacaacctggcggcagcgcaaaagatg

SEQ ID NO: 143850 - DNA, 103 bp, Artificial Sequence
  Synthetic Polynucleotide
taatacgactcactatagggggcccaagcccagctgcgccgggtggccacaacagaggagagtggccatgcggcgcagcaacctggcggcagcgcaaaagatg

SEQ ID NO: 143851 - DNA, 103 bp, Artificial Sequence
  Synthetic Polynucleotide
taatacgactcactataggggaggcgccgcggcccaagcccagctgcgccaacagaggagaggcgcaatggggcttgggaacctggcggcagcgcaaaagatg

SEQ ID NO: 143852 - DNA, 103 bp, Artificial Sequence
  Synthetic Polynucleotide
taatacgactcactataggggtgtagagagaggccaccaggggcccggccaacagaggagaggccggatgcctggtggcaacctggcggcagcgcaaaagatg

SEQ ID NO: 143853 - DNA, 103 bp, Artificial Sequence
  Synthetic Polynucleotide
taatacgactcactatagggcttgaaggtggaggcgccgcggcccaagccaacagaggagaggcttgatgcgcggcgccaacctggcggcagcgcaaaagatg

SEQ ID NO: 143854 - DNA, 103 bp, Artificial Sequence
  Synthetic Polynucleotide
taatacgactcactataggggcggttcctccttgaaggtggaggcgccgcaacagaggagagcggcgatgccaccttcaaacctggcggcagcgcaaaagatg

SEQ ID NO: 143855 - DNA, 103 bp, Artificial Sequence
  Synthetic Polynucleotide
taatacgactcactatagggggcacggtctgcggttcctccttgaaggtgaacagaggagacaccttatgggaggaaccaacctggcggcagcgcaaaagatg

SEQ ID NO: 143856 - DNA, 103 bp, Artificial Sequence
  Synthetic Polynucleotide
taatacgactcactataggggcgcgcctccggcacggtctgcggttcctcaacagaggagagaggaaatgcagaccgtgaacctggcggcagcgcaaaagatg

SEQ ID NO: 143857 - DNA, 103 bp, Artificial Sequence
  Synthetic Polynucleotide
taatacgactcactatagggcgtcccggctgcgcgcctccggcacggtctaacagaggagaagaccgatgcggaggcgcaacctggcggcagcgcaaaagatg

SEQ ID NO: 143858 - DNA, 103 bp, Artificial Sequence
  Synthetic Polynucleotide
taatacgactcactatagggggcggcgtggcgtcccggctgcgcgcctccaacagaggagaggaggcatgcagccgggaaacctggcggcagcgcaaaagatg

SEQ ID NO: 143859 - DNA, 103 bp, Artificial Sequence
  Synthetic Polynucleotide
taatacgactcactataggggggggacaccggcggcgtggcgtcccggctaacagaggagaagccggatggccacgccgaacctggcggcagcgcaaaagatg

SEQ ID NO: 143860 - DNA, 103 bp, Artificial Sequence
  Synthetic Polynucleotide
taatacgactcactatagggccatgttgatgggggacaccggcggcgtggaacagaggagaccacgcatgcggtgtcccaacctggcggcagcgcaaaagatg

SEQ ID NO: 143861 - DNA, 103 bp, Artificial Sequence
  Synthetic Polynucleotide
taatacgactcactatagggtcttggtcttccatgttgatgggggacaccaacagaggagaggtgtcatgcatcaacataacctggcggcagcgcaaaagatg

SEQ ID NO: 143862 - DNA, 103 bp, Artificial Sequence
  Synthetic Polynucleotide
taatacgactcactatagggtttgatgcgctcttggtcttccatgttgataacagaggagaatcaacatggaagaccaaaacctggcggcagcgcaaaagatg

SEQ ID NO: 143863 - DNA, 103 bp, Artificial Sequence
  Synthetic Polynucleotide
taatacgactcactataggggtttgtagtcgtgtagagagaggccaccagaacagaggagactggtgatgtctctctacaacctggcggcagcgcaaaagatg

SEQ ID NO: 143864 - DNA, 103 bp, Artificial Sequence
  Synthetic Polynucleotide
taatacgactcactatagggtgcgctccactttgatgcgctcttggtcttaacagaggagaaagaccatgagcgcatcaaacctggcggcagcgcaaaagatg

SEQ ID NO: 143865 - DNA, 103 bp, Artificial Sequence
  Synthetic Polynucleotide
taatacgactcactatagggcgcagccgcttgcgctccactttgatgcgcaacagaggagagcgcatatgagtggagcgaacctggcggcagcgcaaaagatg

SEQ ID NO: 143866 - DNA, 103 bp, Artificial Sequence
  Synthetic Polynucleotide
taatacgactcactatagggcagccggttccgcagccgcttgcgctccacaacagaggagagtggagatgaagcggctgaacctggcggcagcgcaaaagatg

SEQ ID NO: 143867 - DNA, 103 bp, Artificial Sequence
  Synthetic Polynucleotide
taatacgactcactatagggtggtggccgccagccggttccgcagccgctaacagaggagaagcggcatgggaaccggcaacctggcggcagcgcaaaagatg

SEQ ID NO: 143868 - DNA, 103 bp, Artificial Sequence
  Synthetic Polynucleotide
taatacgactcactatagggttccggcacttggtggccgccagccggttcaacagaggagagaaccgatgggcggccacaacctggcggcagcgcaaaagatg

SEQ ID NO: 143869 - DNA, 103 bp, Artificial Sequence
  Synthetic Polynucleotide
taatacgactcactatagggcagcttccgcttccggcacttggtggccgcaacagaggagagcggccatgaagtgccggaacctggcggcagcgcaaaagatg

SEQ ID NO: 143870 - DNA, 103 bp, Artificial Sequence
  Synthetic Polynucleotide
taatacgactcactatagggcgatgcgctccagcttccgcttccggcactaacagaggagaagtgccatgagcggaagcaacctggcggcagcgcaaaagatg

SEQ ID NO: 143871 - DNA, 103 bp, Artificial Sequence
  Synthetic Polynucleotide
taatacgactcactatagggtccaggcgcgcgatgcgctccagcttccgcaacagaggagagcggaaatgggagcgcataacctggcggcagcgcaaaagatg

SEQ ID NO: 143872 - DNA, 103 bp, Artificial Sequence
  Synthetic Polynucleotide
taatacgactcactatagggcaccttgtcctccaggcgcgcgatgcgctcaacagaggagagagcgcatggcgcgcctgaacctggcggcagcgcaaaagatg

SEQ ID NO: 143873 - DNA, 103 bp, Artificial Sequence
  Synthetic Polynucleotide
taatacgactcactatagggtgagcgtcttcaccttgtcctccaggcgcgaacagaggagacgcgccatgaggacaaggaacctggcggcagcgcaaaagatg

SEQ ID NO: 143874 - DNA, 103 bp, Artificial Sequence
  Synthetic Polynucleotide
taatacgactcactatagggggtttcaggagtttgtagtcgtgtagagagaacagaggagactctctatgcgactacaaaacctggcggcagcgcaaaagatg

SEQ ID NO: 143875 - DNA, 103 bp, Artificial Sequence
  Synthetic Polynucleotide
taatacgactcactatagggttctcggccttgagcgtcttcaccttgtccaacagaggagaggacaaatggaagacgctaacctggcggcagcgcaaaagatg

SEQ ID NO: 143876 - DNA, 103 bp, Artificial Sequence
  Synthetic Polynucleotide
taatacgactcactatagggcagccccgcgttctcggccttgagcgtcttaacagaggagaaagacgatgaaggccgagaacctggcggcagcgcaaaagatg

SEQ ID NO: 143877 - DNA, 103 bp, Artificial Sequence
  Synthetic Polynucleotide
taatacgactcactatagggcggtactcgacagccccgcgttctcggcctaacagaggagaaggccgatgacgcggggcaacctggcggcagcgcaaaagatg

SEQ ID NO: 143878 - DNA, 103 bp, Artificial Sequence
  Synthetic Polynucleotide
taatacgactcactatagggaggaggccggcggtactcgacagccccgcgaacagaggagacgcgggatggtcgagtacaacctggcggcagcgcaaaagatg

SEQ ID NO: 143879 - DNA, 103 bp, Artificial Sequence
  Synthetic Polynucleotide
taatacgactcactatagggctgctcccggaggaggccggcggtactcgaaacagaggagatcgagtatggccggcctcaacctggcggcagcgcaaaagatg

SEQ ID NO: 143880 - DNA, 103 bp, Artificial Sequence
  Synthetic Polynucleotide
taatacgactcactataggggctgggccacctgctcccggaggaggccggaacagaggagaccggccatgtccgggagcaacctggcggcagcgcaaaagatg

SEQ ID NO: 143881 - DNA, 103 bp, Artificial Sequence
  Synthetic Polynucleotide
taatacgactcactatagggttctgtttgagctgggccacctgctcccggaacagaggagaccgggaatgggtggcccaaacctggcggcagcgcaaaagatg

SEQ ID NO: 143882 - DNA, 103 bp, Artificial Sequence
  Synthetic Polynucleotide
taatacgactcactatagggggtcatgaccttctgtttgagctgggccacaacagaggagagtggccatgctcaaacagaacctggcggcagcgcaaaagatg

SEQ ID NO: 143883 - DNA, 103 bp, Artificial Sequence
  Synthetic Polynucleotide
taatacgactcactatagggtgctgacgtgggtcatgaccttctgtttgaaacagaggagatcaaacatgaggtcatgaaacctggcggcagcgcaaaagatg

SEQ ID NO: 143884 - DNA, 103 bp, Artificial Sequence
  Synthetic Polynucleotide
taatacgactcactatagggtgacagccgttgctgacgtgggtcatgaccaacagaggagaggtcatatgccacgtcagaacctggcggcagcgcaaaagatg

SEQ ID NO: 143885 - DNA, 103 bp, Artificial Sequence
  Synthetic Polynucleotide
taatacgactcactatagggcgcctcatcgccgtagaagggtgtttccataacagaggagaatggaaatgcccttctacaacctggcggcagcgcaaaagatg

SEQ ID NO: 143886 - DNA, 103 bp, Artificial Sequence
  Synthetic Polynucleotide
taatacgactcactatagggcgcggccgtcgggggcgccccggggaacaaaacagaggagattgttcatgggggcgcccaacctggcggcagcgcaaaagatg

SEQ ID NO: 143887 - DNA, 103 bp, Artificial Sequence
  Synthetic Polynucleotide
taatacgactcactataggggggcagcagctggcagccgctgttgacgtgaacagaggagacacgtcatgagcggctgcaacctggcggcagcgcaaaagatg

SEQ ID NO: 143888 - DNA, 103 bp, Artificial Sequence
  Synthetic Polynucleotide
taatacgactcactatagggcctggtgctggggcagcagctggcagccgcaacagaggagagcggctatgagctgctgcaacctggcggcagcgcaaaagatg

SEQ ID NO: 143889 - DNA, 103 bp, Artificial Sequence
  Synthetic Polynucleotide
taatacgactcactatagggtacgcgggcacctggtgctggggcagcagcaacagaggagagctgctatgccagcaccaaacctggcggcagcgcaaaagatg

SEQ ID NO: 143890 - DNA, 103 bp, Artificial Sequence
  Synthetic Polynucleotide
taatacgactcactatagggtgctgccggccgcggccgtcgggggcgcccaacagaggagagggcgcatgcgacggccgaacctggcggcagcgcaaaagatg

SEQ ID NO: 143891 - DNA, 103 bp, Artificial Sequence
  Synthetic Polynucleotide
taatacgactcactatagggttcttcatcatgctgccggccgcggccgtcaacagaggagagacggcatgggccggcagaacctggcggcagcgcaaaagatg

SEQ ID NO: 143892 - DNA, 103 bp, Artificial Sequence
  Synthetic Polynucleotide
taatacgactcactatagggcagcgcgtccttcttcatcatgctgccggcaacagaggagagccggcatgatgatgaagaacctggcggcagcgcaaaagatg

SEQ ID NO: 143893 - DNA, 103 bp, Artificial Sequence
  Synthetic Polynucleotide
taatacgactcactatagggggctcagcgtcagcgcgtccttcttcatcaaacagaggagatgatgaatgaggacgcgcaacctggcggcagcgcaaaagatg

SEQ ID NO: 143894 - DNA, 103 bp, Artificial Sequence
  Synthetic Polynucleotide
taatacgactcactatagggtgctcactcaggctcagcgtcagcgcgtccaacagaggagaggacgcatggacgctgagaacctggcggcagcgcaaaagatg

SEQ ID NO: 143895 - DNA, 103 bp, Artificial Sequence
  Synthetic Polynucleotide
taatacgactcactatagggtgccgccacctgctcactcaggctcagcgtaacagaggagaacgctgatgctgagtgagaacctggcggcagcgcaaaagatg

SEQ ID NO: 143896 - DNA, 103 bp, Artificial Sequence
  Synthetic Polynucleotide
taatacgactcactataggggcttgagcgctgccgccacctgctcactcaaacagaggagatgagtgatgaggtggcggaacctggcggcagcgcaaaagatg

SEQ ID NO: 143897 - DNA, 103 bp, Artificial Sequence
  Synthetic Polynucleotide
taatacgactcactataggggcggccgcaggcttgagcgctgccgccaccaacagaggagaggtggcatgagcgctcaaaacctggcggcagcgcaaaagatg

SEQ ID NO: 143898 - DNA, 103 bp, Artificial Sequence
  Synthetic Polynucleotide
taatacgactcactatagggaggaggcggcgcggccgcaggcttgagcgcaacagaggagagcgctcatgcctgcggccaacctggcggcagcgcaaaagatg

SEQ ID NO: 143899 - DNA, 103 bp, Artificial Sequence
  Synthetic Polynucleotide
taatacgactcactatagggggccgctcagcgcctcatcgccgtagaaggaacagaggagaccttctatggcgatgaggaacctggcggcagcgcaaaagatg

SEQ ID NO: 143900 - DNA, 103 bp, Artificial Sequence
  Synthetic Polynucleotide
taatacgactcactataggggcaggggggtaggaggcggcgcggccgcagaacagaggagactgcggatgcgccgcctcaacctggcggcagcgcaaaagatg

SEQ ID NO: 143901 - DNA, 103 bp, Artificial Sequence
  Synthetic Polynucleotide
taatacgactcactatagggccgtcggcgcgcaggggggtaggaggcggcaacagaggagagccgccatgtacccccctaacctggcggcagcgcaaaagatg

SEQ ID NO: 143902 - DNA, 103 bp, Artificial Sequence
  Synthetic Polynucleotide
taatacgactcactataggggctgggggcgccgtcggcgcgcaggggggtaacagaggagaacccccatgcgcgccgacaacctggcggcagcgcaaaagatg

SEQ ID NO: 143903 - DNA, 103 bp, Artificial Sequence
  Synthetic Polynucleotide
taatacgactcactatagggggggtgccgcgctgggggcgccgtcggcgcaacagaggagagcgccgatggcgcccccaaacctggcggcagcgcaaaagatg

SEQ ID NO: 143904 - DNA, 103 bp, Artificial Sequence
  Synthetic Polynucleotide
taatacgactcactatagggaggccgtcggggggtgccgcgctgggggcgaacagaggagacgccccatgcgcggcaccaacctggcggcagcgcaaaagatg

SEQ ID NO: 143905 - DNA, 103 bp, Artificial Sequence
  Synthetic Polynucleotide
taatacgactcactatagggagaggcgagcaggccgtcggggggtgccgcaacagaggagagcggcaatgcccgacggcaacctggcggcagcgcaaaagatg

SEQ ID NO: 143906 - DNA, 103 bp, Artificial Sequence
  Synthetic Polynucleotide
taatacgactcactatagggccaggtcgggagaggcgagcaggccgtcggaacagaggagaccgacgatgtgctcgcctaacctggcggcagcgcaaaagatg

SEQ ID NO: 143907 - DNA, 103 bp, Artificial Sequence
  Synthetic Polynucleotide
taatacgactcactatagggttcagcagccccaggtcgggagaggcgagcaacagaggagagctcgcatgtcccgacctaacctggcggcagcgcaaaagatg

SEQ ID NO: 143908 - DNA, 103 bp, Artificial Sequence
  Synthetic Polynucleotide
taatacgactcactatagggggaggccagcttcagcagccccaggtcgggaacagaggagacccgacatggggctgctgaacctggcggcagcgcaaaagatg

SEQ ID NO: 143909 - DNA, 103 bp, Artificial Sequence
  Synthetic Polynucleotide
taatacgactcactatagggcgagctcgggggaggccagcttcagcagccaacagaggagaggctgcatgagctggcctaacctggcggcagcgcaaaagatg

SEQ ID NO: 143910 - DNA, 103 bp, Artificial Sequence
  Synthetic Polynucleotide
taatacgactcactatagggccgccgcccaggccgctcagcgcctcatcgaacagaggagacgatgaatggctgagcggaacctggcggcagcgcaaaagatg

SEQ ID NO: 143911 - DNA, 103 bp, Artificial Sequence
  Synthetic Polynucleotide
taatacgactcactatagggatgaggcgctcgagctcgggggaggccagcaacagaggagagctggcatgccccgagctaacctggcggcagcgcaaaagatg

SEQ ID NO: 143912 - DNA, 103 bp, Artificial Sequence
  Synthetic Polynucleotide
taatacgactcactatagggggactggatgatgaggcgctcgagctcgggaacagaggagacccgagatggagcgcctcaacctggcggcagcgcaaaagatg

SEQ ID NO: 143913 - DNA, 103 bp, Artificial Sequence
  Synthetic Polynucleotide
taatacgactcactatagggccagcccgttggactggatgatgaggcgctaacagaggagaagcgccatgtcatccagtaacctggcggcagcgcaaaagatg

SEQ ID NO: 143914 - DNA, 103 bp, Artificial Sequence
  Synthetic Polynucleotide
taatacgactcactataggggtggtggtgaccagcccgttggactggatgaacagaggagacatccaatgcaacgggctaacctggcggcagcgcaaaagatg

SEQ ID NO: 143915 - DNA, 103 bp, Artificial Sequence
  Synthetic Polynucleotide
taatacgactcactataggggctcgtcggcgtggtggtgaccagcccgttaacagaggagaaacgggatggtcaccaccaacctggcggcagcgcaaaagatg

SEQ ID NO: 143916 - DNA, 103 bp, Artificial Sequence
  Synthetic Polynucleotide
taatacgactcactatagggggaactgtgagctcgtcggcgtggtggtgaaacagaggagatcaccaatgcgccgacgaaacctggcggcagcgcaaaagatg

SEQ ID NO: 143917 - DNA, 103 bp, Artificial Sequence
  Synthetic Polynucleotide
taatacgactcactatagggttggggtagaggaactgtgagctcgtcggcaacagaggagagccgacatgctcacagttaacctggcggcagcgcaaaagatg

SEQ ID NO: 143918 - DNA, 103 bp, Artificial Sequence
  Synthetic Polynucleotide
taatacgactcactatagggggccgccaccttggggtagaggaactgtgaaacagaggagatcacagatgctctaccccaacctggcggcagcgcaaaagatg

SEQ ID NO: 143919 - DNA, 103 bp, Artificial Sequence
  Synthetic Polynucleotide
taatacgactcactataggggctcctcgctggccgccaccttggggtagaaacagaggagatctaccatgaggtggcggaacctggcggcagcgcaaaagatg

SEQ ID NO: 143920 - DNA, 103 bp, Artificial Sequence
  Synthetic Polynucleotide
taatacgactcactataggggcgaactcctgctcctcgctggccgccaccaacagaggagaggtggcatgcagcgaggaaacctggcggcagcgcaaaagatg

SEQ ID NO: 143921 - DNA, 103 bp, Artificial Sequence
  Synthetic Polynucleotide
taatacgactcactataggggccactggcgccgccgcccaggccgctcagaacagaggagactgagcatgctgggcggcaacctggcggcagcgcaaaagatg

SEQ ID NO: 143922 - DNA, 103 bp, Artificial Sequence
  Synthetic Polynucleotide
taatacgactcactataggggaagccctcggcgaactcctgctcctcgctaacagaggagaagcgagatgcaggagttcaacctggcggcagcgcaaaagatg

SEQ ID NO: 143923 - DNA, 103 bp, Artificial Sequence
  Synthetic Polynucleotide
taatacgactcactataggggggccttgacgaagccctcggcgaactcctaacagaggagaaggagtatgccgagggctaacctggcggcagcgcaaaagatg

SEQ ID NO: 143924 - DNA, 103 bp, Artificial Sequence
  Synthetic Polynucleotide
taatacgactcactatagggaaatcctccagggccttgacgaagccctcgaacagaggagacgagggatgcgtcaaggcaacctggcggcagcgcaaaagatg

SEQ ID NO: 143925 - DNA, 103 bp, Artificial Sequence
  Synthetic Polynucleotide
taatacgactcactatagggctgcttgtgtaaatcctccagggccttgacaacagaggagagtcaagatgctggaggataacctggcggcagcgcaaaagatg

SEQ ID NO: 143926 - DNA, 103 bp, Artificial Sequence
  Synthetic Polynucleotide
taatacgactcactatagggcgagctggttctgcttgtgtaaatcctccaaacagaggagatggaggatgtacacaagcaacctggcggcagcgcaaaagatg

SEQ ID NO: 143927 - DNA, 103 bp, Artificial Sequence
  Synthetic Polynucleotide
taatacgactcactataggggcgcccgcgccgagctggttctgcttgtgtaacagaggagaacacaaatggaaccagctaacctggcggcagcgcaaaagatg

SEQ ID NO: 143928 - DNA, 103 bp, Artificial Sequence
  Synthetic Polynucleotide
taatacgactcactatagggggcagcggccgcgcccgcgccgagctggttaacagaggagaaaccagatgggcgcgggcaacctggcggcagcgcaaaagatg

SEQ ID NO: 143929 - DNA, 103 bp, Artificial Sequence
  Synthetic Polynucleotide
taatacgactcactatagggcggcggcggcggcagcggccgcgcccgcgcaacagaggagagcgcggatgcggccgctgaacctggcggcagcgcaaaagatg

SEQ ID NO: 143930 - DNA, 103 bp, Artificial Sequence
  Synthetic Polynucleotide
taatacgactcactatagggccggcggcggcggcggcggcggcagcggccaacagaggagaggccgcatgcgccgccgcaacctggcggcagcgcaaaagatg

SEQ ID NO: 143931 - DNA, 103 bp, Artificial Sequence
  Synthetic Polynucleotide
taatacgactcactatagggcgagggccccccggcggcggcggcggcggcaacagaggagagccgccatggccgccgccaacctggcggcagcgcaaaagatg

SEQ ID NO: 143932 - DNA, 103 bp, Artificial Sequence
  Synthetic Polynucleotide
taatacgactcactatagggtgccgccgctgccactggcgccgccgcccaaacagaggagatgggcgatggcgccagtgaacctggcggcagcgcaaaagatg

SEQ ID NO: 143933 - DNA, 103 bp, Artificial Sequence
  Synthetic Polynucleotide
taatacgactcactatagggtggccgtgcccgagggccccccggcggcggaacagaggagaccgccgatggggggccctaacctggcggcagcgcaaaagatg

SEQ ID NO: 143934 - DNA, 103 bp, Artificial Sequence
  Synthetic Polynucleotide
taatacgactcactataggggcggagcccgtggccgtgcccgagggccccaacagaggagaggggccatggggcacggcaacctggcggcagcgcaaaagatg

SEQ ID NO: 143935 - DNA, 103 bp, Artificial Sequence
  Synthetic Polynucleotide
taatacgactcactataggggccggggggcgcggagcccgtggccgtgccaacagaggagaggcacgatgacgggctccaacctggcggcagcgcaaaagatg

SEQ ID NO: 143936 - DNA, 103 bp, Artificial Sequence
  Synthetic Polynucleotide
taatacgactcactataggggggccagctcgccggggggcgcggagcccgaacagaggagacgggctatgcgccccccgaacctggcggcagcgcaaaagatg

SEQ ID NO: 143937 - DNA, 103 bp, Artificial Sequence
  Synthetic Polynucleotide
taatacgactcactataggggccgccgccggggccagctcgccggggggcaacagaggagagcccccatgcgagctggcaacctggcggcagcgcaaaagatg

SEQ ID NO: 143938 - DNA, 103 bp, Artificial Sequence
  Synthetic Polynucleotide
taatacgactcactatagggttcgggcgcggccgccgccggggccagctcaacagaggagagagctgatgccggcggcgaacctggcggcagcgcaaaagatg

SEQ ID NO: 143939 - DNA, 103 bp, Artificial Sequence
  Synthetic Polynucleotide
taatacgactcactatagggagacaggcgcttcgggcgcggccgccgccgaacagaggagacggcggatgccgcgcccgaacctggcggcagcgcaaaagatg

SEQ ID NO: 143940 - DNA, 103 bp, Artificial Sequence
  Synthetic Polynucleotide
taatacgactcactatagggaggttcgcgtagacaggcgcttcgggcgcgaacagaggagacgcgccatgagcgcctgtaacctggcggcagcgcaaaagatg

SEQ ID NO: 143941 - DNA, 103 bp, Artificial Sequence
  Synthetic Polynucleotide
taatacgactcactataggggtagctgctcaggttcgcgtagacaggcgcaacagaggagagcgcctatgtacgcgaacaacctggcggcagcgcaaaagatg

SEQ ID NO: 143942 - DNA, 103 bp, Artificial Sequence
  Synthetic Polynucleotide
taatacgactcactatagggcgccgcccgcgtagctgctcaggttcgcgtaacagaggagaacgcgaatgtgagcagctaacctggcggcagcgcaaaagatg

SEQ ID NO: 143943 - DNA, 103 bp, Artificial Sequence
  Synthetic Polynucleotide
taatacgactcactataggggacgcgaagctgccgccgctgccactggcgaacagaggagacgccagatgcagcggcggaacctggcggcagcgcaaaagatg

SEQ ID NO: 143944 - DNA, 103 bp, Artificial Sequence
  Synthetic Polynucleotide
taatacgactcactataggggcgcccccggcgccgcccgcgtagctgctcaacagaggagagagcagatgcgcgggcggaacctggcggcagcgcaaaagatg

SEQ ID NO: 143945 - DNA, 103 bp, Artificial Sequence
  Synthetic Polynucleotide
taatacgactcactatagggggcgccccccgcgcccccggcgccgcccgcaacagaggagagcgggcatggccgggggcaacctggcggcagcgcaaaagatg

SEQ ID NO: 143946 - DNA, 103 bp, Artificial Sequence
  Synthetic Polynucleotide
taatacgactcactatagggcgaccgtcgcggcgccccccgcgcccccggaacagaggagaccggggatgcggggggcgaacctggcggcagcgcaaaagatg

SEQ ID NO: 143947 - DNA, 103 bp, Artificial Sequence
  Synthetic Polynucleotide
taatacgactcactataggggcagcgaaggcgaccgtcgcggcgccccccaacagaggagaggggggatgcgcgacggtaacctggcggcagcgcaaaagatg

SEQ ID NO: 143948 - DNA, 103 bp, Artificial Sequence
  Synthetic Polynucleotide
taatacgactcactatagggcacaggttcggcagcgaaggcgaccgtcgcaacagaggagagcgacgatggccttcgctaacctggcggcagcgcaaaagatg

SEQ ID NO: 143949 - DNA, 103 bp, Artificial Sequence
  Synthetic Polynucleotide
taatacgactcactataggggcgggaagggcacaggttcggcagcgaaggaacagaggagaccttcgatgccgaacctgaacctggcggcagcgcaaaagatg

SEQ ID NO: 143950 - DNA, 103 bp, Artificial Sequence
  Synthetic Polynucleotide
taatacgactcactatagggggtggcggcggcgggaagggcacaggttcgaacagaggagacgaaccatggcccttcccaacctggcggcagcgcaaaagatg

SEQ ID NO: 143951 - DNA, 103 bp, Artificial Sequence
  Synthetic Polynucleotide
taatacgactcactatagggcgcgcctgggggtggcggcggcgggaagggaacagaggagacccttcatgccgccgccaaacctggcggcagcgcaaaagatg

SEQ ID NO: 143952 - DNA, 103 bp, Artificial Sequence
  Synthetic Polynucleotide
taatacgactcactataggggcggccccaacgcgcctgggggtggcggcgaacagaggagacgccgcatgccccaggcgaacctggcggcagcgcaaaagatg

SEQ ID NO: 143953 - DNA, 103 bp, Artificial Sequence
  Synthetic Polynucleotide
taatacgactcactataggggccaggcgcggcggccccaacgcgcctgggaacagaggagacccaggatggttggggccaacctggcggcagcgcaaaagatg

SEQ ID NO: 143954 - DNA, 103 bp, Artificial Sequence
  Synthetic Polynucleotide
taatacgactcactataggggcggcccggggacgcgaagctgccgccgctaacagaggagaagcggcatgagcttcgcgaacctggcggcagcgcaaaagatg

SEQ ID NO: 143955 - DNA, 103 bp, Artificial Sequence
  Synthetic Polynucleotide
taatacgactcactatagggcttgagcgcagccaggcgcggcggccccaaaacagaggagattggggatgccgcgcctgaacctggcggcagcgcaaaagatg

SEQ ID NO: 143956 - DNA, 103 bp, Artificial Sequence
  Synthetic Polynucleotide
taatacgactcactataggggtggctcgtccttgagcgcagccaggcgcgaacagaggagacgcgccatgctgcgctcaaacctggcggcagcgcaaaagatg

SEQ ID NO: 143957 - DNA, 103 bp, Artificial Sequence
  Synthetic Polynucleotide
taatacgactcactatagggggcaccgtctgtggctcgtccttgagcgcaaacagaggagatgcgctatgggacgagccaacctggcggcagcgcaaaagatg

SEQ ID NO: 143958 - DNA, 103 bp, Artificial Sequence
  Synthetic Polynucleotide
taatacgactcactatagggcggcacgtcgggcaccgtctgtggctcgtcaacagaggagagacgagatgcagacggtgaacctggcggcagcgcaaaagatg

SEQ ID NO: 143959 - DNA, 103 bp, Artificial Sequence
  Synthetic Polynucleotide
taatacgactcactatagggcgccgaagctcggcacgtcgggcaccgtctaacagaggagaagacggatgccgacgtgcaacctggcggcagcgcaaaagatg

SEQ ID NO: 143960 - DNA, 103 bp, Artificial Sequence
  Synthetic Polynucleotide
taatacgactcactatagggggcgggctctcgccgaagctcggcacgtcgaacagaggagacgacgtatggagcttcggaacctggcggcagcgcaaaagatg

SEQ ID NO: 143961 - DNA, 103 bp, Artificial Sequence
  Synthetic Polynucleotide
taatacgactcactataggggggcgacaacggcgggctctcgccgaagctaacagaggagaagcttcatggagagcccgaacctggcggcagcgcaaaagatg

SEQ ID NO: 143962 - DNA, 103 bp, Artificial Sequence
  Synthetic Polynucleotide
taatacgactcactatagggccatgtcgatgggcgacaacggcgggctctaacagaggagaagagccatgcgttgtcgcaacctggcggcagcgcaaaagatg

SEQ ID NO: 143963 - DNA, 103 bp, Artificial Sequence
  Synthetic Polynucleotide
taatacgactcactatagggtcctgcgtgtccatgtcgatgggcgacaacaacagaggagagttgtcatgcatcgacataacctggcggcagcgcaaaagatg

SEQ ID NO: 143964 - DNA, 103 bp, Artificial Sequence
  Synthetic Polynucleotide
taatacgactcactatagggcttgatgcgctcctgcgtgtccatgtcgataacagaggagaatcgacatggacacgcagaacctggcggcagcgcaaaagatg

SEQ ID NO: 143965 - DNA, 103 bp, Artificial Sequence
  Synthetic Polynucleotide
taatacgactcactatagggcggggaacaagcggcccggggacgcgaagcaacagaggagagcttcgatgccccgggccaacctggcggcagcgcaaaagatg

SEQ ID NO: 143966 - DNA, 103 bp, Artificial Sequence
  Synthetic Polynucleotide
taatacgactcactatagggtgcgctccgccttgatgcgctcctgcgtgtaacagaggagaacacgcatgagcgcatcaaacctggcggcagcgcaaaagatg

SEQ ID NO: 143967 - DNA, 103 bp, Artificial Sequence
  Synthetic Polynucleotide
taatacgactcactatagggcgcagccgcttgcgctccgccttgatgcgcaacagaggagagcgcatatgggcggagcgaacctggcggcagcgcaaaagatg

SEQ ID NO: 143968 - DNA, 103 bp, Artificial Sequence
  Synthetic Polynucleotide
taatacgactcactataggggatgcggttgcgcagccgcttgcgctccgcaacagaggagagcggagatgaagcggctgaacctggcggcagcgcaaaagatg

SEQ ID NO: 143969 - DNA, 103 bp, Artificial Sequence
  Synthetic Polynucleotide
taatacgactcactatagggtggaggcggcgatgcggttgcgcagccgctaacagaggagaagcggcatggcaaccgcaaacctggcggcagcgcaaaagatg

SEQ ID NO: 143970 - DNA, 103 bp, Artificial Sequence
  Synthetic Polynucleotide
taatacgactcactatagggttgcggcacttggaggcggcgatgcggttgaacagaggagacaaccgatgcgccgcctcaacctggcggcagcgcaaaagatg

SEQ ID NO: 143971 - DNA, 103 bp, Artificial Sequence
  Synthetic Polynucleotide
taatacgactcactatagggcagcttgcgcttgcggcacttggaggcggcaacagaggagagccgccatgaagtgccgcaacctggcggcagcgcaaaagatg

SEQ ID NO: 143972 - DNA, 103 bp, Artificial Sequence
  Synthetic Polynucleotide
taatacgactcactatagggagatgcgctccagcttgcgcttgcggcactaacagaggagaagtgccatgagcgcaagcaacctggcggcagcgcaaaagatg

SEQ ID NO: 143973 - DNA, 103 bp, Artificial Sequence
  Synthetic Polynucleotide
taatacgactcactatagggtccaggcgcgagatgcgctccagcttgcgcaacagaggagagcgcaaatgggagcgcataacctggcggcagcgcaaaagatg

SEQ ID NO: 143974 - DNA, 103 bp, Artificial Sequence
  Synthetic Polynucleotide
taatacgactcactatagggcactttctcttccaggcgcgagatgcgctcaacagaggagagagcgcatgtcgcgcctgaacctggcggcagcgcaaaagatg

SEQ ID NO: 143975 - DNA, 103 bp, Artificial Sequence
  Synthetic Polynucleotide
taatacgactcactatagggtgagggtcttcactttctcttccaggcgcgaacagaggagacgcgccatgaagagaaagaacctggcggcagcgcaaaagatg

SEQ ID NO: 143976 - DNA, 103 bp, Artificial Sequence
  Synthetic Polynucleotide
taatacgactcactataggggggggcgccccggggaacaagcggcccgggaacagaggagacccgggatgcttgttcccaacctggcggcagcgcaaaagatg

SEQ ID NO: 143977 - DNA, 103 bp, Artificial Sequence
  Synthetic Polynucleotide
taatacgactcactatagggttctgactcttgagggtcttcactttctctaacagaggagaagagaaatggaagaccctaacctggcggcagcgcaaaagatg

SEQ ID NO: 143978 - DNA, 103 bp, Artificial Sequence
  Synthetic Polynucleotide
taatacgactcactatagggcagctccgtgttctgactcttgagggtcttaacagaggagaaagaccatgaagagtcagaacctggcggcagcgcaaaagatg

SEQ ID NO: 143979 - DNA, 103 bp, Artificial Sequence
  Synthetic Polynucleotide
taatacgactcactatagggccgtggacgccagctccgtgttctgactctaacagaggagaagagtcatgacacggagcaacctggcggcagcgcaaaagatg

SEQ ID NO: 143980 - DNA, 103 bp, Artificial Sequence
  Synthetic Polynucleotide
taatacgactcactatagggagcaggctcgccgtggacgccagctccgtgaacagaggagacacggaatgggcgtccacaacctggcggcagcgcaaaagatg

SEQ ID NO: 143981 - DNA, 103 bp, Artificial Sequence
  Synthetic Polynucleotide
taatacgactcactatagggctgctcgcgcagcaggctcgccgtggacgcaacagaggagagcgtccatggcgagcctgaacctggcggcagcgcaaaagatg

SEQ ID NO: 143982 - DNA, 103 bp, Artificial Sequence
  Synthetic Polynucleotide
taatacgactcactataggggctgcgccacctgctcgcgcagcaggctcgaacagaggagacgagccatgtgcgcgagcaacctggcggcagcgcaaaagatg

SEQ ID NO: 143983 - DNA, 103 bp, Artificial Sequence
  Synthetic Polynucleotide
taatacgactcactatagggttctgcttgagctgcgccacctgctcgcgcaacagaggagagcgcgaatgggtggcgcaaacctggcggcagcgcaaaagatg

SEQ ID NO: 143984 - DNA, 103 bp, Artificial Sequence
  Synthetic Polynucleotide
taatacgactcactataggggctgaggactttctgcttgagctgcgccacaacagaggagagtggcgatgctcaagcagaacctggcggcagcgcaaaagatg

SEQ ID NO: 143985 - DNA, 103 bp, Artificial Sequence
  Synthetic Polynucleotide
taatacgactcactatagggtgttgacgtggctgaggactttctgcttgaaacagaggagatcaagcatgaagtcctcaaacctggcggcagcgcaaaagatg

SEQ ID NO: 143986 - DNA, 103 bp, Artificial Sequence
  Synthetic Polynucleotide
taatacgactcactatagggtggcagccgctgttgacgtggctgaggactaacagaggagaagtcctatgccacgtcaaaacctggcggcagcgcaaaagatg

SEQ ID NO: 143987 - DNA, 103 bp, Artificial Sequence
  Synthetic Polynucleotide
taatacgactcactataggggcccggcccggccccgccagcctcggacataacagaggagaatgtccatggctggcgggaacctggcggcagcgcaaaagatg

SEQ ID NO: 143988 - DNA, 103 bp, Artificial Sequence
  Synthetic Polynucleotide
taatacgactcactatagggggagccctgcgggggcgcgggcggaagcgcaacagaggagagcgcttatgcccgcgcccaacctggcggcagcgcaaaagatg

SEQ ID NO: 143989 - DNA, 103 bp, Artificial Sequence
  Synthetic Polynucleotide
taatacgactcactatagggagttcgtttttcaagaggcagtttatctttaacagaggagaaaagatatgctgcctcttaacctggcggcagcgcaaaagatg

SEQ ID NO: 143990 - DNA, 103 bp, Artificial Sequence
  Synthetic Polynucleotide
taatacgactcactatagggtgaggattagagttcgtttttcaagaggcaaacagaggagatgcctcatgaaaaacgaaaacctggcggcagcgcaaaagatg

SEQ ID NO: 143991 - DNA, 103 bp, Artificial Sequence
  Synthetic Polynucleotide
taatacgactcactataggggggaaatgagtgaggattagagttcgttttaacagaggagaaaaacgatgtctaatcctaacctggcggcagcgcaaaagatg

SEQ ID NO: 143992 - DNA, 103 bp, Artificial Sequence
  Synthetic Polynucleotide
taatacgactcactatagggcagaaattttgggaaatgagtgaggattagaacagaggagactaatcatgactcatttcaacctggcggcagcgcaaaagatg

SEQ ID NO: 143993 - DNA, 103 bp, Artificial Sequence
  Synthetic Polynucleotide
taatacgactcactatagggctagcatggacagaaattttgggaaatgagaacagaggagactcattatgcaaaatttcaacctggcggcagcgcaaaagatg

SEQ ID NO: 143994 - DNA, 103 bp, Artificial Sequence
  Synthetic Polynucleotide
taatacgactcactatagggacttcttcttctagcatggacagaaattttaacagaggagaaaaattatggtccatgctaacctggcggcagcgcaaaagatg

SEQ ID NO: 143995 - DNA, 103 bp, Artificial Sequence
  Synthetic Polynucleotide
taatacgactcactatagggttgactatatacttcttcttctagcatggaaacagaggagatccatgatggaagaagaaaacctggcggcagcgcaaaagatg

SEQ ID NO: 143996 - DNA, 103 bp, Artificial Sequence
  Synthetic Polynucleotide
taatacgactcactatagggtgggagagttttgactatatacttcttcttaacagaggagaaagaagatgtatatagtcaacctggcggcagcgcaaaagatg

SEQ ID NO: 143997 - DNA, 103 bp, Artificial Sequence
  Synthetic Polynucleotide
taatacgactcactatagggtgatcccagatgggagagttttgactatataacagaggagaatatagatgaaactctccaacctggcggcagcgcaaaagatg

SEQ ID NO: 143998 - DNA, 103 bp, Artificial Sequence
  Synthetic Polynucleotide
taatacgactcactataggggagaaaatcctgatcccagatgggagagttaacagaggagaaactctatgatctgggataacctggcggcagcgcaaaagatg

SEQ ID NO: 143999 - DNA, 103 bp, Artificial Sequence
  Synthetic Polynucleotide
taatacgactcactatagggcggcgcagggggagccctgcgggggcgcggaacagaggagaccgcgcatgcgcagggctaacctggcggcagcgcaaaagatg

SEQ ID NO: 144000 - DNA, 103 bp, Artificial Sequence
  Synthetic Polynucleotide
taatacgactcactatagggaagaggctgagagaaaatcctgatcccagaaacagaggagatctgggatgaggattttcaacctggcggcagcgcaaaagatg

SEQ ID NO: 144001 - DNA, 103 bp, Artificial Sequence
  Synthetic Polynucleotide
taatacgactcactatagggctggttctggaagaggctgagagaaaatccaacagaggagaggatttatgctcagcctcaacctggcggcagcgcaaaagatg

SEQ ID NO: 144002 - DNA, 103 bp, Artificial Sequence
  Synthetic Polynucleotide
taatacgactcactataggggcctagctggctggttctggaagaggctgaaacagaggagatcagccatgtccagaaccaacctggcggcagcgcaaaagatg

SEQ ID NO: 144003 - DNA, 103 bp, Artificial Sequence
  Synthetic Polynucleotide
taatacgactcactatagggctgtttggatgcctagctggctggttctggaacagaggagaccagaaatggccagctagaacctggcggcagcgcaaaagatg

SEQ ID NO: 144004 - DNA, 103 bp, Artificial Sequence
  Synthetic Polynucleotide
taatacgactcactatagggggattgataactgtttggatgcctagctggaacagaggagaccagctatgcatccaaacaacctggcggcagcgcaaaagatg

SEQ ID NO: 144005 - DNA, 103 bp, Artificial Sequence
  Synthetic Polynucleotide
taatacgactcactatagggcacaggaggtggattgataactgtttggataacagaggagaatccaaatggttatcaataacctggcggcagcgcaaaagatg

SEQ ID NO: 144006 - DNA, 103 bp, Artificial Sequence
  Synthetic Polynucleotide
taatacgactcactatagggttgtcccagccacaggaggtggattgataaaacagaggagattatcaatgcacctcctgaacctggcggcagcgcaaaagatg

SEQ ID NO: 144007 - DNA, 103 bp, Artificial Sequence
  Synthetic Polynucleotide
taatacgactcactatagggttgtatgaaattgtcccagccacaggaggtaacagaggagaacctccatgggctgggacaacctggcggcagcgcaaaagatg

SEQ ID NO: 144008 - DNA, 103 bp, Artificial Sequence
  Synthetic Polynucleotide
taatacgactcactatagggtgaggttgaattgtatgaaattgtcccagcaacagaggagagctgggatgatttcatacaacctggcggcagcgcaaaagatg

SEQ ID NO: 144009 - DNA, 103 bp, Artificial Sequence
  Synthetic Polynucleotide
taatacgactcactatagggcaagggaagatgaggttgaattgtatgaaaaacagaggagatttcatatgattcaacctaacctggcggcagcgcaaaagatg

SEQ ID NO: 144010 - DNA, 103 bp, Artificial Sequence
  Synthetic Polynucleotide
taatacgactcactatagggccggcggcagcggcgcagggggagccctgcaacagaggagagcagggatgcccctgcgcaacctggcggcagcgcaaaagatg

SEQ ID NO: 144011 - DNA, 103 bp, Artificial Sequence
  Synthetic Polynucleotide
taatacgactcactatagggtttggctgctcaagggaagatgaggttgaaaacagaggagattcaacatgatcttccctaacctggcggcagcgcaaaagatg

SEQ ID NO: 144012 - DNA, 103 bp, Artificial Sequence
  Synthetic Polynucleotide
taatacgactcactataggggctccctgcgtttggctgctcaagggaagaaacagaggagatcttccatggagcagccaaacctggcggcagcgcaaaagatg

SEQ ID NO: 144013 - DNA, 103 bp, Artificial Sequence
  Synthetic Polynucleotide
taatacgactcactatagggcaggactgctgctccctgcgtttggctgctaacagaggagaagcagcatgacgcagggaaacctggcggcagcgcaaaagatg

SEQ ID NO: 144014 - DNA, 103 bp, Artificial Sequence
  Synthetic Polynucleotide
taatacgactcactataggggctttgcaggcaggactgctgctccctgcgaacagaggagacgcaggatgcagcagtccaacctggcggcagcgcaaaagatg

SEQ ID NO: 144015 - DNA, 103 bp, Artificial Sequence
  Synthetic Polynucleotide
taatacgactcactatagggtccagaagaggctttgcaggcaggactgctaacagaggagaagcagtatggcctgcaaaaacctggcggcagcgcaaaagatg

SEQ ID NO: 144016 - DNA, 103 bp, Artificial Sequence
  Synthetic Polynucleotide
taatacgactcactatagggttgcctcaagtccagaagaggctttgcaggaacagaggagacctgcaatgcctcttctgaacctggcggcagcgcaaaagatg

SEQ ID NO: 144017 - DNA, 103 bp, Artificial Sequence
  Synthetic Polynucleotide
taatacgactcactatagggtctcctgggtttgcctcaagtccagaagagaacagaggagactcttcatgacttgaggcaacctggcggcagcgcaaaagatg

SEQ ID NO: 144018 - DNA, 103 bp, Artificial Sequence
  Synthetic Polynucleotide
taatacgactcactatagggtttcctcttttctcctgggtttgcctcaagaacagaggagacttgagatgaacccaggaaacctggcggcagcgcaaaagatg

SEQ ID NO: 144019 - DNA, 103 bp, Artificial Sequence
  Synthetic Polynucleotide
taatacgactcactatagggaatcagtcattttcctcttttctcctgggtaacagaggagaacccagatgaaaagaggaaacctggcggcagcgcaaaagatg

SEQ ID NO: 144020 - DNA, 103 bp, Artificial Sequence
  Synthetic Polynucleotide
taatacgactcactatagggagaacatgagaatcagtcattttcctctttaacagaggagaaaagagatgaatgactgaaacctggcggcagcgcaaaagatg

SEQ ID NO: 144021 - DNA, 103 bp, Artificial Sequence
  Synthetic Polynucleotide
taatacgactcactataggggcccgagcccccggcggcagcggcgcagggaacagaggagaccctgcatggctgccgccaacctggcggcagcgcaaaagatg

SEQ ID NO: 144022 - DNA, 103 bp, Artificial Sequence
  Synthetic Polynucleotide
taatacgactcactatagggggcctcctccagaacatgagaatcagtcataacagaggagaatgactatgtctcatgttaacctggcggcagcgcaaaagatg

SEQ ID NO: 144023 - DNA, 103 bp, Artificial Sequence
  Synthetic Polynucleotide
taatacgactcactatagggggggtttcttggcctcctccagaacatgagaacagaggagactcatgatgtggaggaggaacctggcggcagcgcaaaagatg

SEQ ID NO: 144024 - DNA, 103 bp, Artificial Sequence
  Synthetic Polynucleotide
taatacgactcactatagggcccataactcggggtttcttggcctcctccaacagaggagaggaggaatgcaagaaaccaacctggcggcagcgcaaaagatg

SEQ ID NO: 144025 - DNA, 103 bp, Artificial Sequence
  Synthetic Polynucleotide
taatacgactcactatagggcggaatatcccccataactcggggtttcttaacagaggagaaagaaaatgcgagttatgaacctggcggcagcgcaaaagatg

SEQ ID NO: 144026 - DNA, 103 bp, Artificial Sequence
  Synthetic Polynucleotide
taatacgactcactatagggttaattccatcggaatatcccccataactcaacagaggagagagttaatggggatattcaacctggcggcagcgcaaaagatg

SEQ ID NO: 144027 - DNA, 103 bp, Artificial Sequence
  Synthetic Polynucleotide
taatacgactcactatagggacctcgttgattaattccatcggaatatccaacagaggagaggatatatggatggaattaacctggcggcagcgcaaaagatg

SEQ ID NO: 144028 - DNA, 103 bp, Artificial Sequence
  Synthetic Polynucleotide
taatacgactcactatagggggtagacataacctcgttgattaattccataacagaggagaatggaaatgatcaacgagaacctggcggcagcgcaaaagatg

SEQ ID NO: 144029 - DNA, 103 bp, Artificial Sequence
  Synthetic Polynucleotide
taatacgactcactatagggggtccgtgatggtagacataacctcgttgaaacagaggagatcaacgatgttatgtctaaacctggcggcagcgcaaaagatg

SEQ ID NO: 144030 - DNA, 103 bp, Artificial Sequence
  Synthetic Polynucleotide
taatacgactcactatagggattgctgcagggtccgtgatggtagacataaacagaggagatatgtcatgcatcacggaaacctggcggcagcgcaaaagatg

SEQ ID NO: 144031 - DNA, 103 bp, Artificial Sequence
  Synthetic Polynucleotide
taatacgactcactatagggtggtccaagcattgctgcagggtccgtgataacagaggagaatcacgatgcctgcagcaaacctggcggcagcgcaaaagatg

SEQ ID NO: 144032 - DNA, 103 bp, Artificial Sequence
  Synthetic Polynucleotide
taatacgactcactataggggaccgcaggcgcccgagcccccggcggcagaacagaggagactgccgatgggggctcggaacctggcggcagcgcaaaagatg

SEQ ID NO: 144033 - DNA, 103 bp, Artificial Sequence
  Synthetic Polynucleotide
taatacgactcactatagggaattggtctctggtccaagcattgctgcagaacagaggagactgcagatgtgcttggacaacctggcggcagcgcaaaagatg

SEQ ID NO: 144034 - DNA, 103 bp, Artificial Sequence
  Synthetic Polynucleotide
taatacgactcactataggggctgacagaaaattggtctctggtccaagcaacagaggagagcttggatgagagaccaaaacctggcggcagcgcaaaagatg

SEQ ID NO: 144035 - DNA, 103 bp, Artificial Sequence
  Synthetic Polynucleotide
taatacgactcactatagggggccgagtgtgctgacagaaaattggtctcaacagaggagagagaccatgtttctgtcaaacctggcggcagcgcaaaagatg

SEQ ID NO: 144036 - DNA, 103 bp, Artificial Sequence
  Synthetic Polynucleotide
taatacgactcactatagggcctcatccctggccgagtgtgctgacagaaaacagaggagattctgtatgcacactcggaacctggcggcagcgcaaaagatg

SEQ ID NO: 144037 - DNA, 103 bp, Artificial Sequence
  Synthetic Polynucleotide
taatacgactcactatagggaaccttgccgcctcatccctggccgagtgtaacagaggagaacactcatgcagggatgaaacctggcggcagcgcaaaagatg

SEQ ID NO: 144038 - DNA, 103 bp, Artificial Sequence
  Synthetic Polynucleotide
taatacgactcactataggggcgctcttccaaccttgccgcctcatccctaacagaggagaagggatatggcggcaaggaacctggcggcagcgcaaaagatg

SEQ ID NO: 144039 - DNA, 103 bp, Artificial Sequence
  Synthetic Polynucleotide
taatacgactcactatagggttacacccctgcgctcttccaaccttgccgaacagaggagacggcaaatgtggaagagcaacctggcggcagcgcaaaagatg

SEQ ID NO: 144040 - DNA, 103 bp, Artificial Sequence
  Synthetic Polynucleotide
taatacgactcactatagggtgaaattcaattacacccctgcgctcttccaacagaggagaggaagaatgcaggggtgtaacctggcggcagcgcaaaagatg

SEQ ID NO: 144041 - DNA, 103 bp, Artificial Sequence
  Synthetic Polynucleotide
taatacgactcactataggggccaaccacgtgaaattcaattacacccctaacagaggagaaggggtatgattgaatttaacctggcggcagcgcaaaagatg

SEQ ID NO: 144042 - DNA, 103 bp, Artificial Sequence
  Synthetic Polynucleotide
taatacgactcactatagggtgagggaattgccaaccacgtgaaattcaaaacagaggagattgaatatgacgtggttgaacctggcggcagcgcaaaagatg

SEQ ID NO: 144043 - DNA, 103 bp, Artificial Sequence
  Synthetic Polynucleotide
taatacgactcactataggggccgtcgccggaccgcaggcgcccgagcccaacagaggagagggctcatgcgcctgcggaacctggcggcagcgcaaaagatg

SEQ ID NO: 144044 - DNA, 103 bp, Artificial Sequence
  Synthetic Polynucleotide
taatacgactcactatagggggtttctggttgagggaattgccaaccacgaacagaggagacgtggtatgcaattccctaacctggcggcagcgcaaaagatg

SEQ ID NO: 144045 - DNA, 103 bp, Artificial Sequence
  Synthetic Polynucleotide
taatacgactcactatagggcttcttgtttggtttctggttgagggaattaacagaggagaaattccatgaaccagaaaaacctggcggcagcgcaaaagatg

SEQ ID NO: 144046 - DNA, 103 bp, Artificial Sequence
  Synthetic Polynucleotide
taatacgactcactatagggacatcaggatcttcttgtttggtttctggtaacagaggagaaccagaatgcaaacaagaaacctggcggcagcgcaaaagatg

SEQ ID NO: 144047 - DNA, 103 bp, Artificial Sequence
  Synthetic Polynucleotide
taatacgactcactatagggccaaccagccacatcaggatcttcttgtttaacagaggagaaaacaaatggatcctgataacctggcggcagcgcaaaagatg

SEQ ID NO: 144048 - DNA, 103 bp, Artificial Sequence
  Synthetic Polynucleotide
taatacgactcactataggggttctgtaggccaaccagccacatcaggataacagaggagaatcctgatgtggctggttaacctggcggcagcgcaaaagatg

SEQ ID NO: 144049 - DNA, 103 bp, Artificial Sequence
  Synthetic Polynucleotide
taatacgactcactataggggggagaaaacgttctgtaggccaaccagccaacagaggagaggctggatggcctacagaaacctggcggcagcgcaaaagatg

SEQ ID NO: 144050 - DNA, 103 bp, Artificial Sequence
  Synthetic Polynucleotide
taatacgactcactatagggggcagctggtgggagaaaacgttctgtaggaacagaggagacctacaatgcgttttctcaacctggcggcagcgcaaaagatg

SEQ ID NO: 144051 - DNA, 103 bp, Artificial Sequence
  Synthetic Polynucleotide
taatacgactcactatagggtggcattcggggcagctggtgggagaaaacaacagaggagagttttcatgcaccagctgaacctggcggcagcgcaaaagatg

SEQ ID NO: 144052 - DNA, 103 bp, Artificial Sequence
  Synthetic Polynucleotide
taatacgactcactatagggtgtattcttttggcattcggggcagctggtaacagaggagaaccagcatgcccgaatgcaacctggcggcagcgcaaaagatg

SEQ ID NO: 144053 - DNA, 103 bp, Artificial Sequence
  Synthetic Polynucleotide
taatacgactcactatagggagccgtgtgatgtattcttttggcattcggaacagaggagaccgaatatgaaaagaataaacctggcggcagcgcaaaagatg

SEQ ID NO: 144054 - DNA, 103 bp, Artificial Sequence
  Synthetic Polynucleotide
taatacgactcactatagggtgcagccactgccgtcgccggaccgcaggcaacagaggagagcctgcatgccggcgacgaacctggcggcagcgcaaaagatg

SEQ ID NO: 144055 - DNA, 103 bp, Artificial Sequence
  Synthetic Polynucleotide
taatacgactcactataggggtcaaagacgagccgtgtgatgtattctttaacagaggagaaaagaaatgatcacacggaacctggcggcagcgcaaaagatg

SEQ ID NO: 144056 - DNA, 103 bp, Artificial Sequence
  Synthetic Polynucleotide
taatacgactcactatagggtgtgtttcgggtcaaagacgagccgtgtgaaacagaggagatcacacatgtcgtctttgaacctggcggcagcgcaaaagatg

SEQ ID NO: 144057 - DNA, 103 bp, Artificial Sequence
  Synthetic Polynucleotide
taatacgactcactataggggcaagggttttgtgtttcgggtcaaagacgaacagaggagacgtcttatgcccgaaacaaacctggcggcagcgcaaaagatg

SEQ ID NO: 144058 - DNA, 103 bp, Artificial Sequence
  Synthetic Polynucleotide
taatacgactcactatagggtttaattaaagcaagggttttgtgtttcggaacagaggagaccgaaaatgaaaacccttaacctggcggcagcgcaaaagatg

SEQ ID NO: 144059 - DNA, 103 bp, Artificial Sequence
  Synthetic Polynucleotide
taatacgactcactatagggcacggccatctttaattaaagcaagggtttaacagaggagaaaacccatgctttaattaaacctggcggcagcgcaaaagatg

SEQ ID NO: 144060 - DNA, 103 bp, Artificial Sequence
  Synthetic Polynucleotide
taatacgactcactatagggccaccaataacacggccatctttaattaaaaacagaggagatttaatatgagatggccgaacctggcggcagcgcaaaagatg

SEQ ID NO: 144061 - DNA, 103 bp, Artificial Sequence
  Synthetic Polynucleotide
taatacgactcactataggggaaacagataccaccaataacacggccatcaacagaggagagatggcatggttattggtaacctggcggcagcgcaaaagatg

SEQ ID NO: 144062 - DNA, 103 bp, Artificial Sequence
  Synthetic Polynucleotide
taatacgactcactatagggggaacatacggaaacagataccaccaataaaacagaggagattattgatggtatctgttaacctggcggcagcgcaaaagatg

SEQ ID NO: 144063 - DNA, 103 bp, Artificial Sequence
  Synthetic Polynucleotide
taatacgactcactatagggccttgagatgggaacatacggaaacagataaacagaggagatatctgatgccgtatgttaacctggcggcagcgcaaaagatg

SEQ ID NO: 144064 - DNA, 103 bp, Artificial Sequence
  Synthetic Polynucleotide
taatacgactcactatagggctctgtgaatccttgagatgggaacatacgaacagaggagacgtatgatgccatctcaaaacctggcggcagcgcaaaagatg

SEQ ID NO: 144065 - DNA, 103 bp, Artificial Sequence
  Synthetic Polynucleotide
taatacgactcactatagggccgtgcccgctgcagccactgccgtcgccgaacagaggagacggcgaatgcagtggctgaacctggcggcagcgcaaaagatg

SEQ ID NO: 144066 - DNA, 103 bp, Artificial Sequence
  Synthetic Polynucleotide
taatacgactcactatagggagaagacaatctctgtgaatccttgagatgaacagaggagacatctcatggattcacagaacctggcggcagcgcaaaagatg

SEQ ID NO: 144067 - DNA, 103 bp, Artificial Sequence
  Synthetic Polynucleotide
taatacgactcactataggggttacagcacagaagacaatctctgtgaataacagaggagaattcacatggattgtcttaacctggcggcagcgcaaaagatg

SEQ ID NO: 144068 - DNA, 103 bp, Artificial Sequence
  Synthetic Polynucleotide
taatacgactcactatagggctcatttgaggttacagcacagaagacaataacagaggagaattgtcatgtgtgctgtaaacctggcggcagcgcaaaagatg

SEQ ID NO: 144069 - DNA, 103 bp, Artificial Sequence
  Synthetic Polynucleotide
taatacgactcactatagggccttgacttgctcatttgaggttacagcacaacagaggagagtgctgatgcctcaaatgaacctggcggcagcgcaaaagatg

SEQ ID NO: 144070 - DNA, 103 bp, Artificial Sequence
  Synthetic Polynucleotide
taatacgactcactataggggttccatagcccttgacttgctcatttgagaacagaggagactcaaaatggcaagtcaaaacctggcggcagcgcaaaagatg

SEQ ID NO: 144071 - DNA, 103 bp, Artificial Sequence
  Synthetic Polynucleotide
taatacgactcactatagggcatcaggtgtgttccatagcccttgacttgaacagaggagacaagtcatgggctatggaaacctggcggcagcgcaaaagatg

SEQ ID NO: 144072 - DNA, 103 bp, Artificial Sequence
  Synthetic Polynucleotide
taatacgactcactatagggtcaaatgattcatcaggtgtgttccatagcaacagaggagagctatgatgcacacctgaaacctggcggcagcgcaaaagatg

SEQ ID NO: 144073 - DNA, 103 bp, Artificial Sequence
  Synthetic Polynucleotide
taatacgactcactatagggtgatattctttcaaatgattcatcaggtgtaacagaggagaacacctatggaatcatttaacctggcggcagcgcaaaagatg

SEQ ID NO: 144074 - DNA, 103 bp, Artificial Sequence
  Synthetic Polynucleotide
taatacgactcactatagggatgctttatgtgatattctttcaaatgattaacagaggagaaatcatatgaaagaatataacctggcggcagcgcaaaagatg

SEQ ID NO: 144075 - DNA, 103 bp, Artificial Sequence
  Synthetic Polynucleotide
taatacgactcactatagggtcaggatgtcatgctttatgtgatattcttaacagaggagaaagaatatgacataaagcaacctggcggcagcgcaaaagatg

SEQ ID NO: 144076 - DNA, 103 bp, Artificial Sequence
  Synthetic Polynucleotide
taatacgactcactatagggggtccttcggccgtgcccgctgcagccactaacagaggagaagtggcatgagcgggcacaacctggcggcagcgcaaaagatg

SEQ ID NO: 144077 - DNA, 103 bp, Artificial Sequence
  Synthetic Polynucleotide
taatacgactcactataggggtgaggaagttcaggatgtcatgctttatgaacagaggagacataaaatgtgacatcctaacctggcggcagcgcaaaagatg

SEQ ID NO: 144078 - DNA, 103 bp, Artificial Sequence
  Synthetic Polynucleotide
taatacgactcactatagggatctgcatatgtgaggaagttcaggatgtcaacagaggagagacatcatgaacttcctcaacctggcggcagcgcaaaagatg

SEQ ID NO: 144079 - DNA, 103 bp, Artificial Sequence
  Synthetic Polynucleotide
taatacgactcactatagggttgcatattcatctgcatatgtgaggaagtaacagaggagaacttccatgcatatgcagaacctggcggcagcgcaaaagatg

SEQ ID NO: 144080 - DNA, 103 bp, Artificial Sequence
  Synthetic Polynucleotide
taatacgactcactatagggaagtatccaattgcatattcatctgcatataacagaggagaatatgcatgtgaatatgcaacctggcggcagcgcaaaagatg

SEQ ID NO: 144081 - DNA, 103 bp, Artificial Sequence
  Synthetic Polynucleotide
taatacgactcactatagggctgtttcttaaagtatccaattgcatattcaacagaggagagaatatatgattggatacaacctggcggcagcgcaaaagatg

SEQ ID NO: 144082 - DNA, 103 bp, Artificial Sequence
  Synthetic Polynucleotide
taatacgactcactatagggtggagaaaccctgtttcttaaagtatccaaaacagaggagattggatatgttaagaaacaacctggcggcagcgcaaaagatg

SEQ ID NO: 144083 - DNA, 103 bp, Artificial Sequence
  Synthetic Polynucleotide
taatacgactcactatagggttaatttctttggagaaaccctgtttcttaaacagaggagataagaaatggggtttctcaacctggcggcagcgcaaaagatg

SEQ ID NO: 144084 - DNA, 103 bp, Artificial Sequence
  Synthetic Polynucleotide
taatacgactcactatagggtttaggtattttaatttctttggagaaaccaacagaggagaggtttcatgaaagaaattaacctggcggcagcgcaaaagatg

SEQ ID NO: 144085 - DNA, 103 bp, Artificial Sequence
  Synthetic Polynucleotide
taatacgactcactatagggcatatttggttttaggtattttaatttcttaacagaggagaaagaaaatgaaatacctaaacctggcggcagcgcaaaagatg

SEQ ID NO: 144086 - DNA, 103 bp, Artificial Sequence
  Synthetic Polynucleotide
taatacgactcactatagggatatagccaacatatttggttttaggtattaacagaggagaaataccatgaaccaaataaacctggcggcagcgcaaaagatg

SEQ ID NO: 144087 - DNA, 103 bp, Artificial Sequence
  Synthetic Polynucleotide
taatacgactcactatagggaccgcctcccggtccttcggccgtgcccgcaacagaggagagcgggcatggccgaaggaaacctggcggcagcgcaaaagatg

SEQ ID NO: 144088 - DNA, 103 bp, Artificial Sequence
  Synthetic Polynucleotide
taatacgactcactatagggataatccttgatatagccaacatatttggtaacagaggagaaccaaaatggttggctataacctggcggcagcgcaaaagatg

SEQ ID NO: 144089 - DNA, 103 bp, Artificial Sequence
  Synthetic Polynucleotide
taatacgactcactatagggtggctccttcataatccttgatatagccaaaacagaggagattggctatgtcaaggattaacctggcggcagcgcaaaagatg

SEQ ID NO: 144090 - DNA, 103 bp, Artificial Sequence
  Synthetic Polynucleotide
taatacgactcactatagggcccattaaagtggctccttcataatccttgaacagaggagacaaggaatgtgaaggagcaacctggcggcagcgcaaaagatg

SEQ ID NO: 144091 - DNA, 103 bp, Artificial Sequence
  Synthetic Polynucleotide
taatacgactcactatagggtagctcacatcccattaaagtggctccttcaacagaggagagaaggaatgactttaatgaacctggcggcagcgcaaaagatg

SEQ ID NO: 144092 - DNA, 103 bp, Artificial Sequence
  Synthetic Polynucleotide
taatacgactcactatagggtccgtggatttagctcacatcccattaaagaacagaggagactttaaatggatgtgagcaacctggcggcagcgcaaaagatg

SEQ ID NO: 144093 - DNA, 103 bp, Artificial Sequence
  Synthetic Polynucleotide
taatacgactcactataggggtgtacgggatccgtggatttagctcacataacagaggagaatgtgaatgaaatccacgaacctggcggcagcgcaaaagatg

SEQ ID NO: 144094 - DNA, 103 bp, Artificial Sequence
  Synthetic Polynucleotide
taatacgactcactatagggagaaaattctgtgtacgggatccgtggattaacagaggagaaatccaatgatcccgtacaacctggcggcagcgcaaaagatg

SEQ ID NO: 144095 - DNA, 103 bp, Artificial Sequence
  Synthetic Polynucleotide
taatacgactcactatagggtaatgatgacagaaaattctgtgtacgggaaacagaggagatcccgtatgcagaattttaacctggcggcagcgcaaaagatg

SEQ ID NO: 144096 - DNA, 103 bp, Artificial Sequence
  Synthetic Polynucleotide
taatacgactcactatagggttctgctttttaatgatgacagaaaattctaacagaggagaagaattatgtgtcatcataacctggcggcagcgcaaaagatg

SEQ ID NO: 144097 - DNA, 103 bp, Artificial Sequence
  Synthetic Polynucleotide
taatacgactcactatagggaattatctccttctgctttttaatgatgacaacagaggagagtcatcatgaaaaagcagaacctggcggcagcgcaaaagatg

SEQ ID NO: 144098 - DNA, 103 bp, Artificial Sequence
  Synthetic Polynucleotide
taatacgactcactatagggccccgcagccgcccggcccggccccgccagaacagaggagactggcgatgccgggccggaacctggcggcagcgcaaaagatg

SEQ ID NO: 144099 - DNA, 103 bp, Artificial Sequence
  Synthetic Polynucleotide
taatacgactcactataggggggccgagccaccgcctcccggtccttcggaacagaggagaccgaagatgcgggaggcgaacctggcggcagcgcaaaagatg

SEQ ID NO: 144100 - DNA, 103 bp, Artificial Sequence
  Synthetic Polynucleotide
taatacgactcactatagggtcagttttttaattatctccttctgcttttaacagaggagaaaaagcatgaggagataaaacctggcggcagcgcaaaagatg

SEQ ID NO: 144101 - DNA, 103 bp, Artificial Sequence
  Synthetic Polynucleotide
taatacgactcactatagggtttctttcaatcagttttttaattatctccaacagaggagaggagatatgtaaaaaactaacctggcggcagcgcaaaagatg

SEQ ID NO: 144102 - DNA, 103 bp, Artificial Sequence
  Synthetic Polynucleotide
taatacgactcactatagggttgtgcctgttttctttcaatcagttttttaacagaggagaaaaaaaatgattgaaagaaacctggcggcagcgcaaaagatg

SEQ ID NO: 144103 - DNA, 103 bp, Artificial Sequence
  Synthetic Polynucleotide
taatacgactcactatagggcttttcgaatttgtgcctgttttctttcaaaacagaggagattgaaaatgaacaggcacaacctggcggcagcgcaaaagatg

SEQ ID NO: 144104 - DNA, 103 bp, Artificial Sequence
  Synthetic Polynucleotide
taatacgactcactatagggccagggtaaacttttcgaatttgtgcctgtaacagaggagaacaggcatgaattcgaaaaacctggcggcagcgcaaaagatg

SEQ ID NO: 144105 - DNA, 103 bp, Artificial Sequence
  Synthetic Polynucleotide
taatacgactcactatagggacatgaaagtccagggtaaacttttcgaataacagaggagaattcgaatggtttaccctaacctggcggcagcgcaaaagatg

SEQ ID NO: 144106 - DNA, 103 bp, Artificial Sequence
  Synthetic Polynucleotide
taatacgactcactatagggcatctttaaaacatgaaagtccagggtaaaaacagaggagatttaccatggactttcataacctggcggcagcgcaaaagatg

SEQ ID NO: 144107 - DNA, 103 bp, Artificial Sequence
  Synthetic Polynucleotide
taatacgactcactatagggtgtcgaactccatctttaaaacatgaaagtaacagaggagaactttcatgttttaaagaaacctggcggcagcgcaaaagatg

SEQ ID NO: 144108 - DNA, 103 bp, Artificial Sequence
  Synthetic Polynucleotide
taatacgactcactatagggtataggaatctgtcgaactccatctttaaaaacagaggagatttaaaatgggagttcgaaacctggcggcagcgcaaaagatg

SEQ ID NO: 144109 - DNA, 103 bp, Artificial Sequence
  Synthetic Polynucleotide
taatacgactcactataggggaatgctttctataggaatctgtcgaactcaacagaggagagagttcatgagattcctaaacctggcggcagcgcaaaagatg

SEQ ID NO: 144110 - DNA, 103 bp, Artificial Sequence
  Synthetic Polynucleotide
taatacgactcactatagggacggcgattcgggccgagccaccgcctcccaacagaggagagggaggatgtggctcggcaacctggcggcagcgcaaaagatg

SEQ ID NO: 144111 - DNA, 103 bp, Artificial Sequence
  Synthetic Polynucleotide
taatacgactcactatagggctaattccaggaatgctttctataggaatcaacagaggagagattccatgagaaagcataacctggcggcagcgcaaaagatg

SEQ ID NO: 144112 - DNA, 103 bp, Artificial Sequence
  Synthetic Polynucleotide
taatacgactcactataggggcctgtctctctaattccaggaatgctttcaacagaggagagaaagcatgcctggaattaacctggcggcagcgcaaaagatg

SEQ ID NO: 144113 - DNA, 103 bp, Artificial Sequence
  Synthetic Polynucleotide
taatacgactcactatagggtcggtttccagcctgtctctctaattccagaacagaggagactggaaatggagagacagaacctggcggcagcgcaaaagatg

SEQ ID NO: 144114 - DNA, 103 bp, Artificial Sequence
  Synthetic Polynucleotide
taatacgactcactatagggtcttttccactcggtttccagcctgtctctaacagaggagaagagacatgctggaaaccaacctggcggcagcgcaaaagatg

SEQ ID NO: 144115 - DNA, 103 bp, Artificial Sequence
  Synthetic Polynucleotide
taatacgactcactatagggtttacttttctcttttccactcggtttccaaacagaggagatggaaaatgagtggaaaaaacctggcggcagcgcaaaagatg

SEQ ID NO: 144116 - DNA, 103 bp, Artificial Sequence
  Synthetic Polynucleotide
taatacgactcactatagggctctgggctctttacttttctcttttccacaacagaggagagtggaaatgagaaaagtaaacctggcggcagcgcaaaagatg

SEQ ID NO: 144117 - DNA, 103 bp, Artificial Sequence
  Synthetic Polynucleotide
taatacgactcactatagggtggtcagggtctctgggctctttacttttcaacagaggagagaaaagatgagagcccagaacctggcggcagcgcaaaagatg

SEQ ID NO: 144118 - DNA, 103 bp, Artificial Sequence
  Synthetic Polynucleotide
taatacgactcactataggggctgtaaagctggtcagggtctctgggctcaacagaggagagagcccatggaccctgacaacctggcggcagcgcaaaagatg

SEQ ID NO: 144119 - DNA, 103 bp, Artificial Sequence
  Synthetic Polynucleotide
taatacgactcactatagggtcttgagcgtgctgtaaagctggtcagggtaacagaggagaaccctgatgagctttacaaacctggcggcagcgcaaaagatg

SEQ ID NO: 144120 - DNA, 103 bp, Artificial Sequence
  Synthetic Polynucleotide
taatacgactcactatagggtggaggatgctcttgagcgtgctgtaaagcaacagaggagagctttaatgcacgctcaaaacctggcggcagcgcaaaagatg

SEQ ID NO: 144121 - DNA, 103 bp, Artificial Sequence
  Synthetic Polynucleotide
taatacgactcactatagggcgctttcttcacggcgattcgggccgagccaacagaggagaggctcgatgcgaatcgccaacctggcggcagcgcaaaagatg

SEQ ID NO: 144122 - DNA, 103 bp, Artificial Sequence
  Synthetic Polynucleotide
taatacgactcactatagggcttcacctgctggaggatgctcttgagcgtaacagaggagaacgctcatgagcatcctcaacctggcggcagcgcaaaagatg

SEQ ID NO: 144123 - DNA, 103 bp, Artificial Sequence
  Synthetic Polynucleotide
taatacgactcactatagggtttgatggctcttcacctgctggaggatgcaacagaggagagcatccatgagcaggtgaaacctggcggcagcgcaaaagatg

SEQ ID NO: 144124 - DNA, 103 bp, Artificial Sequence
  Synthetic Polynucleotide
taatacgactcactatagggggccaagcgctttgatggctcttcacctgcaacagaggagagcaggtatggagccatcaaacctggcggcagcgcaaaagatg

SEQ ID NO: 144125 - DNA, 103 bp, Artificial Sequence
  Synthetic Polynucleotide
taatacgactcactatagggttccatgaagggccaagcgctttgatggctaacagaggagaagccatatgagcgcttggaacctggcggcagcgcaaaagatg

SEQ ID NO: 144126 - DNA, 103 bp, Artificial Sequence
  Synthetic Polynucleotide
taatacgactcactatagggtcttcacaggttccatgaagggccaagcgcaacagaggagagcgcttatgccttcatggaacctggcggcagcgcaaaagatg

SEQ ID NO: 144127 - DNA, 103 bp, Artificial Sequence
  Synthetic Polynucleotide
taatacgactcactataggggcttctgttctcttcacaggttccatgaagaacagaggagacttcatatgacctgtgaaaacctggcggcagcgcaaaagatg

SEQ ID NO: 144128 - DNA, 103 bp, Artificial Sequence
  Synthetic Polynucleotide
taatacgactcactatagggatatcctggagcttctgttctcttcacaggaacagaggagacctgtgatgagaacagaaaacctggcggcagcgcaaaagatg

SEQ ID NO: 144129 - DNA, 103 bp, Artificial Sequence
  Synthetic Polynucleotide
taatacgactcactatagggtaacttcataatatcctggagcttctgttcaacagaggagagaacagatgctccaggataacctggcggcagcgcaaaagatg

SEQ ID NO: 144130 - DNA, 103 bp, Artificial Sequence
  Synthetic Polynucleotide
taatacgactcactataggggggaaccttataacttcataatatcctggaaacagaggagatccaggatgttatgaagtaacctggcggcagcgcaaaagatg

SEQ ID NO: 144131 - DNA, 103 bp, Artificial Sequence
  Synthetic Polynucleotide
taatacgactcactatagggcagatccatggggaaccttataacttcataaacagaggagatatgaaatgataaggttcaacctggcggcagcgcaaaagatg

SEQ ID NO: 144132 - DNA, 103 bp, Artificial Sequence
  Synthetic Polynucleotide
taatacgactcactatagggagcgtagttgcgctttcttcacggcgattcaacagaggagagaatcgatgtgaagaaagaacctggcggcagcgcaaaagatg

SEQ ID NO: 144133 - DNA, 103 bp, Artificial Sequence
  Synthetic Polynucleotide
taatacgactcactatagggtcatggttttcagatccatggggaaccttaaacagaggagataaggtatgccatggatcaacctggcggcagcgcaaaagatg

SEQ ID NO: 144134 - DNA, 103 bp, Artificial Sequence
  Synthetic Polynucleotide
taatacgactcactatagggaggcgttcactcatggttttcagatccatgaacagaggagacatggaatggaaaaccataacctggcggcagcgcaaaagatg

SEQ ID NO: 144135 - DNA, 103 bp, Artificial Sequence
  Synthetic Polynucleotide
taatacgactcactatagggcctattcttgaggcgttcactcatggttttaacagaggagaaaaaccatgagtgaacgcaacctggcggcagcgcaaaagatg

SEQ ID NO: 144136 - DNA, 103 bp, Artificial Sequence
  Synthetic Polynucleotide
taatacgactcactatagggacacgtagtacctattcttgaggcgttcacaacagaggagagtgaacatgtcaagaataaacctggcggcagcgcaaaagatg

SEQ ID NO: 144137 - DNA, 103 bp, Artificial Sequence
  Synthetic Polynucleotide
taatacgactcactatagggaatttcttagacacgtagtacctattcttgaacagaggagacaagaaatggtactacgtaacctggcggcagcgcaaaagatg

SEQ ID NO: 144138 - DNA, 103 bp, Artificial Sequence
  Synthetic Polynucleotide
taatacgactcactatagggtgccatgaataatttcttagacacgtagtaaacagaggagatactacatgtctaagaaaaacctggcggcagcgcaaaagatg

SEQ ID NO: 144139 - DNA, 103 bp, Artificial Sequence
  Synthetic Polynucleotide
taatacgactcactataggggctgtaagtctgccatgaataatttcttagaacagaggagactaagaatgtattcatggaacctggcggcagcgcaaaagatg

SEQ ID NO: 144140 - DNA, 103 bp, Artificial Sequence
  Synthetic Polynucleotide
taatacgactcactataggggtaaagactcgctgtaagtctgccatgaataacagaggagaattcatatgagacttacaaacctggcggcagcgcaaaagatg

SEQ ID NO: 144141 - DNA, 103 bp, Artificial Sequence
  Synthetic Polynucleotide
taatacgactcactatagggtttgcaattggtaaagactcgctgtaagtcaacagaggagagacttaatgcgagtctttaacctggcggcagcgcaaaagatg

SEQ ID NO: 144142 - DNA, 103 bp, Artificial Sequence
  Synthetic Polynucleotide
taatacgactcactatagggggttgtactctttgcaattggtaaagactcaacagaggagagagtctatgccaattgcaaacctggcggcagcgcaaaagatg

SEQ ID NO: 144143 - DNA, 103 bp, Artificial Sequence
  Synthetic Polynucleotide
taatacgactcactatagggcgcggagcggagcgtagttgcgctttcttcaacagaggagagaagaaatggcaactacgaacctggcggcagcgcaaaagatg

SEQ ID NO: 144144 - DNA, 103 bp, Artificial Sequence
  Synthetic Polynucleotide
taatacgactcactatagggctctcaggggggttgtactctttgcaattgaacagaggagacaattgatgagagtacaaaacctggcggcagcgcaaaagatg

SEQ ID NO: 144145 - DNA, 103 bp, Artificial Sequence
  Synthetic Polynucleotide
taatacgactcactataggggtagtattcactctcaggggggttgtactcaacagaggagagagtacatgccccctgagaacctggcggcagcgcaaaagatg

SEQ ID NO: 144146 - DNA, 103 bp, Artificial Sequence
  Synthetic Polynucleotide
taatacgactcactatagggtggcacatttgtagtattcactctcaggggaacagaggagacccctgatggtgaatactaacctggcggcagcgcaaaagatg

SEQ ID NO: 144147 - DNA, 103 bp, Artificial Sequence
  Synthetic Polynucleotide
taatacgactcactatagggtccaggatattggcacatttgtagtattcaaacagaggagatgaataatgcaaatgtgcaacctggcggcagcgcaaaagatg

SEQ ID NO: 144148 - DNA, 103 bp, Artificial Sequence
  Synthetic Polynucleotide
taatacgactcactataggggaagaatttctccaggatattggcacatttaacagaggagaaaatgtatgaatatcctgaacctggcggcagcgcaaaagatg

SEQ ID NO: 144149 - DNA, 103 bp, Artificial Sequence
  Synthetic Polynucleotide
taatacgactcactatagggttttactgaagaagaatttctccaggatataacagaggagaatatccatgagaaattctaacctggcggcagcgcaaaagatg

SEQ ID NO: 144150 - DNA, 103 bp, Artificial Sequence
  Synthetic Polynucleotide
taatacgactcactataggggcttccttaattttactgaagaagaatttcaacagaggagagaaattatgcttcagtaaaacctggcggcagcgcaaaagatg

SEQ ID NO: 144151 - DNA, 103 bp, Artificial Sequence
  Synthetic Polynucleotide
taatacgactcactatagggaattaatccagcttccttaattttactgaaaacagaggagattcagtatgattaaggaaaacctggcggcagcgcaaaagatg

SEQ ID NO: 144152 - DNA, 103 bp, Artificial Sequence
  Synthetic Polynucleotide
taatacgactcactatagggtttcttggcccgcggagcggagcgtagttgaacagaggagacaactaatgtccgctccgaacctggcggcagcgcaaaagatg

SEQ ID NO: 144153 - DNA, 103 bp, Artificial Sequence
  Synthetic Polynucleotide
taatacgactcactataggggtttctccagtttcttggcccgcggagcggaacagaggagaccgctcatggggccaagaaacctggcggcagcgcaaaagatg

SEQ ID NO: 144154 - DNA, 103 bp, Artificial Sequence
  Synthetic Polynucleotide
taatacgactcactatagggtacactccgagtttctccagtttcttggccaacagaggagaggccaaatgactggagaaaacctggcggcagcgcaaaagatg

SEQ ID NO: 144155 - DNA, 103 bp, Artificial Sequence
  Synthetic Polynucleotide
taatacgactcactataggggcaggcggagtacactccgagtttctccagaacagaggagactggagatgctcggagtgaacctggcggcagcgcaaaagatg

SEQ ID NO: 144156 - DNA, 103 bp, Artificial Sequence
  Synthetic Polynucleotide
taatacgactcactatagggcctcggccttgcaggcggagtacactccgaaacagaggagatcggagatgactccgcctaacctggcggcagcgcaaaagatg

SEQ ID NO: 144157 - DNA, 103 bp, Artificial Sequence
  Synthetic Polynucleotide
taatacgactcactatagggccggctcctgccccgcagccgcccggcccgaacagaggagacgggccatgcggctgcggaacctggcggcagcgcaaaagatg

SEQ ID NO: 144158 - DNA, 103 bp, Artificial Sequence
  Synthetic Polynucleotide
taatacgactcactatagggttacaagactcctcggccttgcaggcggagaacagaggagactccgcatgcaaggccgaaacctggcggcagcgcaaaagatg

SEQ ID NO: 144159 - DNA, 103 bp, Artificial Sequence
  Synthetic Polynucleotide
taatacgactcactataggggccattacatttacaagactcctcggccttaacagaggagaaaggccatggagtcttgtaacctggcggcagcgcaaaagatg

SEQ ID NO: 144160 - DNA, 103 bp, Artificial Sequence
  Synthetic Polynucleotide
taatacgactcactatagggggtttttccagccattacatttacaagactaacagaggagaagtcttatgaatgtaatgaacctggcggcagcgcaaaagatg

SEQ ID NO: 144161 - DNA, 103 bp, Artificial Sequence
  Synthetic Polynucleotide
taatacgactcactataggggaggggttagggtttttccagccattacataacagaggagaatgtaaatgctggaaaaaaacctggcggcagcgcaaaagatg

SEQ ID NO: 144162 - DNA, 103 bp, Artificial Sequence
  Synthetic Polynucleotide
taatacgactcactataggggggagtgggtgaggggttagggtttttccaaacagaggagatggaaaatgcctaaccccaacctggcggcagcgcaaaagatg

SEQ ID NO: 144163 - DNA, 103 bp, Artificial Sequence
  Synthetic Polynucleotide
taatacgactcactatagggcggctctggggggagtgggtgaggggttagaacagaggagactaaccatgcacccactcaacctggcggcagcgcaaaagatg

SEQ ID NO: 144164 - DNA, 103 bp, Artificial Sequence
  Synthetic Polynucleotide
taatacgactcactatagggtgctgcaggtcggctctggggggagtgggtaacagaggagaacccacatgccccagagcaacctggcggcagcgcaaaagatg

SEQ ID NO: 144165 - DNA, 103 bp, Artificial Sequence
  Synthetic Polynucleotide
taatacgactcactataggggacaattatttgctgcaggtcggctctgggaacagaggagacccagaatggacctgcagaacctggcggcagcgcaaaagatg

SEQ ID NO: 144166 - DNA, 103 bp, Artificial Sequence
  Synthetic Polynucleotide
taatacgactcactatagggctgttagactgacaattatttgctgcaggtaacagaggagaacctgcatgaaataattgaacctggcggcagcgcaaaagatg

SEQ ID NO: 144167 - DNA, 103 bp, Artificial Sequence
  Synthetic Polynucleotide
taatacgactcactatagggcgacaggattctgttagactgacaattattaacagaggagaaataatatgcagtctaacaacctggcggcagcgcaaaagatg

SEQ ID NO: 144168 - DNA, 103 bp, Artificial Sequence
  Synthetic Polynucleotide
taatacgactcactatagggggcccctgccccggctcctgccccgcagccaacagaggagaggctgcatggcaggagccaacctggcggcagcgcaaaagatg

SEQ ID NO: 144169 - DNA, 103 bp, Artificial Sequence
  Synthetic Polynucleotide
taatacgactcactataggggctacaactccgacaggattctgttagactaacagaggagaagtctaatggaatcctgtaacctggcggcagcgcaaaagatg

SEQ ID NO: 144170 - DNA, 103 bp, Artificial Sequence
  Synthetic Polynucleotide
taatacgactcactatagggctagggcatggctacaactccgacaggattaacagaggagaaatcctatgggagttgtaaacctggcggcagcgcaaaagatg

SEQ ID NO: 144171 - DNA, 103 bp, Artificial Sequence
  Synthetic Polynucleotide
taatacgactcactatagggacatgagcagctagggcatggctacaactcaacagaggagagagttgatgccatgccctaacctggcggcagcgcaaaagatg

SEQ ID NO: 144172 - DNA, 103 bp, Artificial Sequence
  Synthetic Polynucleotide
taatacgactcactatagggcaggtgggaaacatgagcagctagggcatgaacagaggagacatgccatggctgctcataacctggcggcagcgcaaaagatg

SEQ ID NO: 144173 - DNA, 103 bp, Artificial Sequence
  Synthetic Polynucleotide
taatacgactcactatagggacacattctccaggtgggaaacatgagcagaacagaggagactgctcatgtttcccaccaacctggcggcagcgcaaaagatg

SEQ ID NO: 144174 - DNA, 103 bp, Artificial Sequence
  Synthetic Polynucleotide
taatacgactcactatagggtcttcctctgacacattctccaggtgggaaaacagaggagattcccaatgggagaatgtaacctggcggcagcgcaaaagatg

SEQ ID NO: 144175 - DNA, 103 bp, Artificial Sequence
  Synthetic Polynucleotide
taatacgactcactatagggtctgttcatttcttcctctgacacattctcaacagaggagagagaatatgtcagaggaaaacctggcggcagcgcaaaagatg

SEQ ID NO: 144176 - DNA, 103 bp, Artificial Sequence
  Synthetic Polynucleotide
taatacgactcactatagggttcccaggagtctgttcatttcttcctctgaacagaggagacagaggatgaaatgaacaaacctggcggcagcgcaaaagatg

SEQ ID NO: 144177 - DNA, 103 bp, Artificial Sequence
  Synthetic Polynucleotide
taatacgactcactatagggtccaatactattcccaggagtctgttcattaacagaggagaaatgaaatgactcctgggaacctggcggcagcgcaaaagatg

SEQ ID NO: 144178 - DNA, 103 bp, Artificial Sequence
  Synthetic Polynucleotide
taatacgactcactatagggatattccacatccaatactattcccaggagaacagaggagactcctgatgatagtattgaacctggcggcagcgcaaaagatg

SEQ ID NO: 144179 - DNA, 103 bp, Artificial Sequence
  Synthetic Polynucleotide
taatacgactcactatagggccccgggcccggcccctgccccggctcctgaacagaggagacaggagatggggcaggggaacctggcggcagcgcaaaagatg

SEQ ID NO: 144180 - DNA, 103 bp, Artificial Sequence
  Synthetic Polynucleotide
taatacgactcactatagggaggtaaagagatattccacatccaatactaaacagaggagatagtatatgatgtggaataacctggcggcagcgcaaaagatg

SEQ ID NO: 144181 - DNA, 103 bp, Artificial Sequence
  Synthetic Polynucleotide
taatacgactcactatagggttgtggacacaggtaaagagatattccacaaacagaggagatgtggaatgtctctttacaacctggcggcagcgcaaaagatg

SEQ ID NO: 144182 - DNA, 103 bp, Artificial Sequence
  Synthetic Polynucleotide
taatacgactcactatagggatcttcttccttgtggacacaggtaaagagaacagaggagactctttatgtgtgtccacaacctggcggcagcgcaaaagatg

SEQ ID NO: 144183 - DNA, 103 bp, Artificial Sequence
  Synthetic Polynucleotide
taatacgactcactatagggtggtatctgcatcttcttccttgtggacacaacagaggagagtgtccatgaggaagaagaacctggcggcagcgcaaaagatg

SEQ ID NO: 144184 - DNA, 103 bp, Artificial Sequence
  Synthetic Polynucleotide
taatacgactcactatagggtaaacttgtttggtatctgcatcttcttccaacagaggagaggaagaatgtgcagatacaacctggcggcagcgcaaaagatg

SEQ ID NO: 144185 - DNA, 103 bp, Artificial Sequence
  Synthetic Polynucleotide
taatacgactcactatagggtagatagaaataaacttgtttggtatctgcaacagaggagagcagatatgaaacaagttaacctggcggcagcgcaaaagatg

SEQ ID NO: 144186 - DNA, 103 bp, Artificial Sequence
  Synthetic Polynucleotide
taatacgactcactatagggagagcttaaatagatagaaataaacttgttaacagaggagaaacaagatgatttctatcaacctggcggcagcgcaaaagatg

SEQ ID NO: 144187 - DNA, 103 bp, Artificial Sequence
  Synthetic Polynucleotide
taatacgactcactataggggactttctcaagagcttaaatagatagaaaaacagaggagatttctaatgatttaagctaacctggcggcagcgcaaaagatg

SEQ ID NO: 144188 - DNA, 103 bp, Artificial Sequence
  Synthetic Polynucleotide
taatacgactcactatagggttgtaaaatagactttctcaagagcttaaaaacagaggagatttaagatgttgagaaagaacctggcggcagcgcaaaagatg

SEQ ID NO: 144189 - DNA, 103 bp, Artificial Sequence
  Synthetic Polynucleotide
taatacgactcactataggggttttcctctttgtaaaatagactttctcaaacagaggagatgagaaatgctattttacaacctggcggcagcgcaaaagatg

SEQ ID NO: 144190 - DNA, 103 bp, Artificial Sequence
  Synthetic Polynucleotide
taatacgactcactataggggggggcagcgccccgggcccggcccctgccaacagaggagaggcaggatgcgggcccggaacctggcggcagcgcaaaagatg

SEQ ID NO: 144191 - DNA, 103 bp, Artificial Sequence
  Synthetic Polynucleotide
taatacgactcactatagggtcaaccacaggttttcctctttgtaaaataaacagaggagatattttatgaagaggaaaaacctggcggcagcgcaaaagatg

SEQ ID NO: 144192 - DNA, 103 bp, Artificial Sequence
  Synthetic Polynucleotide
taatacgactcactatagggcaaagagccttcaaccacaggttttcctctaacagaggagaagaggaatgcctgtggttaacctggcggcagcgcaaaagatg

SEQ ID NO: 144193 - DNA, 103 bp, Artificial Sequence
  Synthetic Polynucleotide
taatacgactcactataggggtttcttttccaaagagccttcaaccacagaacagaggagactgtggatgaaggctcttaacctggcggcagcgcaaaagatg

SEQ ID NO: 144194 - DNA, 103 bp, Artificial Sequence
  Synthetic Polynucleotide
taatacgactcactatagggtcaaatgggggtttcttttccaaagagcctaacagaggagaaggctcatgggaaaagaaaacctggcggcagcgcaaaagatg

SEQ ID NO: 144195 - DNA, 103 bp, Artificial Sequence
  Synthetic Polynucleotide
taatacgactcactataggggctaggtttttcaaatgggggtttcttttcaacagaggagagaaaagatgcccccatttaacctggcggcagcgcaaaagatg

SEQ ID NO: 144196 - DNA, 103 bp, Artificial Sequence
  Synthetic Polynucleotide
taatacgactcactatagggcctgttcaatgctaggtttttcaaatggggaacagaggagaccccatatgaaaaacctaaacctggcggcagcgcaaaagatg

SEQ ID NO: 144197 - DNA, 103 bp, Artificial Sequence
  Synthetic Polynucleotide
taatacgactcactatagggttattcacaccctgttcaatgctaggttttaacagaggagaaaaaccatgcattgaacaaacctggcggcagcgcaaaagatg

SEQ ID NO: 144198 - DNA, 103 bp, Artificial Sequence
  Synthetic Polynucleotide
taatacgactcactatagggctgcacaaagttattcacaccctgttcaataacagaggagaattgaaatgggtgtgaataacctggcggcagcgcaaaagatg

SEQ ID NO: 144199 - DNA, 103 bp, Artificial Sequence
  Synthetic Polynucleotide
taatacgactcactatagggtaaatttgtactgcacaaagttattcacacaacagaggagagtgtgaatgactttgtgcaacctggcggcagcgcaaaagatg

SEQ ID NO: 144200 - DNA, 103 bp, Artificial Sequence
  Synthetic Polynucleotide
taatacgactcactatagggggcaggtgactaaatttgtactgcacaaagaacagaggagactttgtatggtacaaattaacctggcggcagcgcaaaagatg

SEQ ID NO: 144201 - DNA, 103 bp, Artificial Sequence
  Synthetic Polynucleotide
taatacgactcactatagggcgcaggctgcgggggcagcgccccgggcccaacagaggagagggcccatggcgctgcccaacctggcggcagcgcaaaagatg

SEQ ID NO: 144202 - DNA, 103 bp, Artificial Sequence
  Synthetic Polynucleotide
taatacgactcactatagggttcttttgctggcaggtgactaaatttgtaaacagaggagatacaaaatgagtcacctgaacctggcggcagcgcaaaagatg

SEQ ID NO: 144203 - DNA, 103 bp, Artificial Sequence
  Synthetic Polynucleotide
taatacgactcactatagggttgtttgcctttcttttgctggcaggtgacaacagaggagagtcaccatgcagcaaaagaacctggcggcagcgcaaaagatg

SEQ ID NO: 144204 - DNA, 103 bp, Artificial Sequence
  Synthetic Polynucleotide
taatacgactcactatagggaactcaactattgtttgcctttcttttgctaacagaggagaagcaaaatgaaggcaaacaacctggcggcagcgcaaaagatg

SEQ ID NO: 144205 - DNA, 103 bp, Artificial Sequence
  Synthetic Polynucleotide
taatacgactcactatagggcatttttgccaactcaactattgtttgcctaacagaggagaaggcaaatgatagttgagaacctggcggcagcgcaaaagatg

SEQ ID NO: 144206 - DNA, 103 bp, Artificial Sequence
  Synthetic Polynucleotide
taatacgactcactatagggggtttaggaacatttttgccaactcaactaaacagaggagatagttgatgtggcaaaaaaacctggcggcagcgcaaaagatg

SEQ ID NO: 144207 - DNA, 103 bp, Artificial Sequence
  Synthetic Polynucleotide
taatacgactcactatagggtagttgatgcggtttaggaacatttttgccaacagaggagaggcaaaatggttcctaaaaacctggcggcagcgcaaaagatg

SEQ ID NO: 144208 - DNA, 103 bp, Artificial Sequence
  Synthetic Polynucleotide
taatacgactcactatagggcagatgccaatagttgatgcggtttaggaaaacagaggagattcctaatgcgcatcaacaacctggcggcagcgcaaaagatg

SEQ ID NO: 144209 - DNA, 103 bp, Artificial Sequence
  Synthetic Polynucleotide
taatacgactcactatagggatggtgcctccagatgccaatagttgatgcaacagaggagagcatcaatgattggcatcaacctggcggcagcgcaaaagatg

SEQ ID NO: 144210 - DNA, 103 bp, Artificial Sequence
  Synthetic Polynucleotide
taatacgactcactatagggcttcgttgagatggtgcctccagatgccaaaacagaggagattggcaatgggaggcaccaacctggcggcagcgcaaaagatg

SEQ ID NO: 144211 - DNA, 103 bp, Artificial Sequence
  Synthetic Polynucleotide
taatacgactcactatagggagatcgcagtcttcgttgagatggtgcctcaacagaggagagaggcaatgtctcaacgaaacctggcggcagcgcaaaagatg

SEQ ID NO: 144212 - DNA, 103 bp, Artificial Sequence
  Synthetic Polynucleotide
taatacgactcactataggggcggaagcgccgcaggctgcgggggcagcgaacagaggagacgctgcatgcgcagcctgaacctggcggcagcgcaaaagatg

SEQ ID NO: 144213 - DNA, 103 bp, Artificial Sequence
  Synthetic Polynucleotide
taatacgactcactatagggcatcattgggagatcgcagtcttcgttgagaacagaggagactcaacatggactgcgataacctggcggcagcgcaaaagatg

SEQ ID NO: 144214 - DNA, 103 bp, Artificial Sequence
  Synthetic Polynucleotide
taatacgactcactatagggccagaaatatcatcattgggagatcgcagtaacagaggagaactgcgatgtcccaatgaaacctggcggcagcgcaaaagatg

SEQ ID NO: 144215 - DNA, 103 bp, Artificial Sequence
  Synthetic Polynucleotide
taatacgactcactatagggctctttgtatccagaaatatcatcattgggaacagaggagacccaatatggatatttctaacctggcggcagcgcaaaagatg

SEQ ID NO: 144216 - DNA, 103 bp, Artificial Sequence
  Synthetic Polynucleotide
taatacgactcactatagggttgtgtagttctctttgtatccagaaatataacagaggagaatatttatggatacaaagaacctggcggcagcgcaaaagatg

SEQ ID NO: 144217 - DNA, 103 bp, Artificial Sequence
  Synthetic Polynucleotide
taatacgactcactatagggcacagccaccttgtgtagttctctttgtataacagaggagaatacaaatggaactacacaacctggcggcagcgcaaaagatg

SEQ ID NO: 144218 - DNA, 103 bp, Artificial Sequence
  Synthetic Polynucleotide
taatacgactcactataggggttgcagtaacacagccaccttgtgtagttaacagaggagaaactacatgaggtggctgaacctggcggcagcgcaaaagatg

SEQ ID NO: 144219 - DNA, 103 bp, Artificial Sequence
  Synthetic Polynucleotide
taatacgactcactatagggactgtggcacgttgcagtaacacagccaccaacagaggagaggtggcatggttactgcaaacctggcggcagcgcaaaagatg

SEQ ID NO: 144220 - DNA, 103 bp, Artificial Sequence
  Synthetic Polynucleotide
taatacgactcactatagggctgtcgcagaactgtggcacgttgcagtaaaacagaggagattactgatgcgtgccacaaacctggcggcagcgcaaaagatg

SEQ ID NO: 144221 - DNA, 103 bp, Artificial Sequence
  Synthetic Polynucleotide
taatacgactcactatagggccgaggtagactgtcgcagaactgtggcacaacagaggagagtgccaatgttctgcgacaacctggcggcagcgcaaaagatg

SEQ ID NO: 144222 - DNA, 103 bp, Artificial Sequence
  Synthetic Polynucleotide
taatacgactcactatagggtggtttcgtaccgaggtagactgtcgcagaaacagaggagatctgcgatggtctacctcaacctggcggcagcgcaaaagatg

SEQ ID NO: 144223 - DNA, 103 bp, Artificial Sequence
  Synthetic Polynucleotide
taatacgactcactataggggggggcgcgggcggaagcgccgcaggctgcaacagaggagagcagccatgggcgcttccaacctggcggcagcgcaaaagatg

SEQ ID NO: 144224 - DNA, 103 bp, Artificial Sequence
  Synthetic Polynucleotide
taatacgactcactatagggaacacctgtgtggtttcgtaccgaggtagaaacagaggagatctaccatggtacgaaacaacctggcggcagcgcaaaagatg

SEQ ID NO: 144225 - DNA, 103 bp, Artificial Sequence
  Synthetic Polynucleotide
taatacgactcactatagggtgttctcccaaacacctgtgtggtttcgtaaacagaggagatacgaaatgacacaggtgaacctggcggcagcgcaaaagatg

SEQ ID NO: 144226 - DNA, 103 bp, Artificial Sequence
  Synthetic Polynucleotide
taatacgactcactatagggagcgaagcaatgttctcccaaacacctgtgaacagaggagacacaggatgttgggagaaaacctggcggcagcgcaaaagatg

SEQ ID NO: 144227 - DNA, 103 bp, Artificial Sequence
  Synthetic Polynucleotide
taatacgactcactataggggtgaagaccgagcgaagcaatgttctcccaaacagaggagatgggagatgattgcttcgaacctggcggcagcgcaaaagatg

SEQ ID NO: 144228 - DNA, 103 bp, Artificial Sequence
  Synthetic Polynucleotide
taatacgactcactatagggcctcataacagtgaagaccgagcgaagcaaaacagaggagattgcttatgtcggtcttcaacctggcggcagcgcaaaagatg

SEQ ID NO: 144229 - DNA, 103 bp, Artificial Sequence
  Synthetic Polynucleotide
taatacgactcactatagggggagttgtcgcctcataacagtgaagaccgaacagaggagacggtctatgctgttatgaaacctggcggcagcgcaaaagatg

SEQ ID NO: 144230 - DNA, 103 bp, Artificial Sequence
  Synthetic Polynucleotide
taatacgactcactataggggcttgttccaggagttgtcgcctcataacaaacagaggagatgttatatggcgacaactaacctggcggcagcgcaaaagatg

SEQ ID NO: 144231 - DNA, 103 bp, Artificial Sequence
  Synthetic Polynucleotide
taatacgactcactatagggttcctgtcttgcttgttccaggagttgtcgaacagaggagacgacaaatgctggaacaaaacctggcggcagcgcaaaagatg

SEQ ID NO: 144232 - DNA, 103 bp, Artificial Sequence
  Synthetic Polynucleotide
taatacgactcactataggggtttatctttttcctgtcttgcttgttccaaacagaggagatggaacatgcaagacaggaacctggcggcagcgcaaaagatg

SEQ ID NO: 144233 - DNA, 103 bp, Artificial Sequence
  Synthetic Polynucleotide
taatacgactcactatagggtcaagaggcagtttatctttttcctgtcttaacagaggagaaagacaatgaaaagataaaacctggcggcagcgcaaaagatg

SEQ ID NO: 144234 - DNA, 103 bp, Artificial Sequence
  Synthetic Polynucleotide
taatacgactcactatagggactgcctgcattcctcttccttcgcggcataacagaggagaatgccgatgaggaagaggaacctggcggcagcgcaaaagatg

SEQ ID NO: 144235 - DNA, 103 bp, Artificial Sequence
  Synthetic Polynucleotide
taatacgactcactatagggagcagatcgtcgggatgtgccatcactttcaacagaggagagaaagtatgggcacatccaacctggcggcagcgcaaaagatg

SEQ ID NO: 144236 - DNA, 103 bp, Artificial Sequence
  Synthetic Polynucleotide
taatacgactcactatagggaattgttttaatcatgttgcttccctctgtaacagaggagaacagagatgagcaacatgaacctggcggcagcgcaaaagatg

SEQ ID NO: 144237 - DNA, 103 bp, Artificial Sequence
  Synthetic Polynucleotide
taatacgactcactatagggggccaaaagcaattgttttaatcatgttgcaacagaggagagcaacaatgttaaaacaaaacctggcggcagcgcaaaagatg

SEQ ID NO: 144238 - DNA, 103 bp, Artificial Sequence
  Synthetic Polynucleotide
taatacgactcactatagggagctcatagcggccaaaagcaattgttttaaacagaggagataaaacatgtgcttttggaacctggcggcagcgcaaaagatg

SEQ ID NO: 144239 - DNA, 103 bp, Artificial Sequence
  Synthetic Polynucleotide
taatacgactcactatagggccaggtatcaagctcatagcggccaaaagcaacagaggagagcttttatgcgctatgagaacctggcggcagcgcaaaagatg

SEQ ID NO: 144240 - DNA, 103 bp, Artificial Sequence
  Synthetic Polynucleotide
taatacgactcactataggggagaatgataccaggtatcaagctcatagcaacagaggagagctatgatgttgatacctaacctggcggcagcgcaaaagatg

SEQ ID NO: 144241 - DNA, 103 bp, Artificial Sequence
  Synthetic Polynucleotide
taatacgactcactatagggtcaggatatggagaatgataccaggtatcaaacagaggagatgatacatggtatcattcaacctggcggcagcgcaaaagatg

SEQ ID NO: 144242 - DNA, 103 bp, Artificial Sequence
  Synthetic Polynucleotide
taatacgactcactatagggtgcatattcttcaggatatggagaatgataaacagaggagatatcatatgccatatcctaacctggcggcagcgcaaaagatg

SEQ ID NO: 144243 - DNA, 103 bp, Artificial Sequence
  Synthetic Polynucleotide
taatacgactcactataggggtcccagccgtgcatattcttcaggatatgaacagaggagacatatcatgaagaatatgaacctggcggcagcgcaaaagatg

SEQ ID NO: 144244 - DNA, 103 bp, Artificial Sequence
  Synthetic Polynucleotide
taatacgactcactatagggatatagagacgtcccagccgtgcatattctaacagaggagaagaataatgacggctgggaacctggcggcagcgcaaaagatg

SEQ ID NO: 144245 - DNA, 103 bp, Artificial Sequence
  Synthetic Polynucleotide
taatacgactcactataggggaattcacacatatagagacgtcccagccgaacagaggagacggctgatgcgtctctataacctggcggcagcgcaaaagatg

SEQ ID NO: 144246 - DNA, 103 bp, Artificial Sequence
  Synthetic Polynucleotide
taatacgactcactataggggggtgactcgagcagatcgtcgggatgtgcaacagaggagagcacatatggacgatctgaacctggcggcagcgcaaaagatg

SEQ ID NO: 144247 - DNA, 103 bp, Artificial Sequence
  Synthetic Polynucleotide
taatacgactcactatagggattttaaacagaattcacacatatagagacaacagaggagagtctctatgtgtgtgaataacctggcggcagcgcaaaagatg

SEQ ID NO: 144248 - DNA, 103 bp, Artificial Sequence
  Synthetic Polynucleotide
taatacgactcactatagggctcttcatatattttaaacagaattcacacaacagaggagagtgtgaatgctgtttaaaaacctggcggcagcgcaaaagatg

SEQ ID NO: 144249 - DNA, 103 bp, Artificial Sequence
  Synthetic Polynucleotide
taatacgactcactatagggtatcgtttggctcttcatatattttaaacaaacagaggagatgtttaatgtatatgaagaacctggcggcagcgcaaaagatg

SEQ ID NO: 144250 - DNA, 103 bp, Artificial Sequence
  Synthetic Polynucleotide
taatacgactcactataggggccggcggagtatcgtttggctcttcatataacagaggagaatatgaatggccaaacgaaacctggcggcagcgcaaaagatg

SEQ ID NO: 144251 - DNA, 103 bp, Artificial Sequence
  Synthetic Polynucleotide
taatacgactcactatagggttggccatgtgccggcggagtatcgtttggaacagaggagaccaaacatgactccgccgaacctggcggcagcgcaaaagatg

SEQ ID NO: 144252 - DNA, 103 bp, Artificial Sequence
  Synthetic Polynucleotide
taatacgactcactatagggccacacacatttggccatgtgccggcggagaacagaggagactccgcatgcacatggccaacctggcggcagcgcaaaagatg

SEQ ID NO: 144253 - DNA, 103 bp, Artificial Sequence
  Synthetic Polynucleotide
taatacgactcactataggggtgggtgtttccacacacatttggccatgtaacagaggagaacatggatgaatgtgtgtaacctggcggcagcgcaaaagatg

SEQ ID NO: 144254 - DNA, 103 bp, Artificial Sequence
  Synthetic Polynucleotide
taatacgactcactatagggtcatcaccaggtgggtgtttccacacacataacagaggagaatgtgtatggaaacacccaacctggcggcagcgcaaaagatg

SEQ ID NO: 144255 - DNA, 103 bp, Artificial Sequence
  Synthetic Polynucleotide
taatacgactcactataggggcgatatatctcatcaccaggtgggtgtttaacagaggagaaaacacatgcctggtgataacctggcggcagcgcaaaagatg

SEQ ID NO: 144256 - DNA, 103 bp, Artificial Sequence
  Synthetic Polynucleotide
taatacgactcactatagggttgaacctttgcgatatatctcatcaccagaacagaggagactggtgatgagatatatcaacctggcggcagcgcaaaagatg

SEQ ID NO: 144257 - DNA, 103 bp, Artificial Sequence
  Synthetic Polynucleotide
taatacgactcactataggggctgaggagcgggtgactcgagcagatcgtaacagaggagaacgatcatgtcgagtcacaacctggcggcagcgcaaaagatg

SEQ ID NO: 144258 - DNA, 103 bp, Artificial Sequence
  Synthetic Polynucleotide
taatacgactcactatagggaacacagagattgaacctttgcgatatatcaacagaggagagatataatgcaaaggttcaacctggcggcagcgcaaaagatg

SEQ ID NO: 144259 - DNA, 103 bp, Artificial Sequence
  Synthetic Polynucleotide
taatacgactcactatagggatccacttcaaacacagagattgaacctttaacagaggagaaaaggtatgatctctgtgaacctggcggcagcgcaaaagatg

SEQ ID NO: 144260 - DNA, 103 bp, Artificial Sequence
  Synthetic Polynucleotide
taatacgactcactatagggttttcttgccatccacttcaaacacagagaaacagaggagatctctgatgttgaagtggaacctggcggcagcgcaaaagatg

SEQ ID NO: 144261 - DNA, 103 bp, Artificial Sequence
  Synthetic Polynucleotide
taatacgactcactatagggtagatcttgtttttcttgccatccacttcaaacagaggagatgaagtatgtggcaagaaaacctggcggcagcgcaaaagatg

SEQ ID NO: 144262 - DNA, 103 bp, Artificial Sequence
  Synthetic Polynucleotide
taatacgactcactataggggttttggcagtagatcttgtttttcttgccaacagaggagaggcaagatgaacaagatcaacctggcggcagcgcaaaagatg

SEQ ID NO: 144263 - DNA, 103 bp, Artificial Sequence
  Synthetic Polynucleotide
taatacgactcactatagggacaggcacaggttttggcagtagatcttgtaacagaggagaacaagaatgactgccaaaaacctggcggcagcgcaaaagatg

SEQ ID NO: 144264 - DNA, 103 bp, Artificial Sequence
  Synthetic Polynucleotide
taatacgactcactatagggagtttggccaacaggcacaggttttggcagaacagaggagactgccaatgcctgtgcctaacctggcggcagcgcaaaagatg

SEQ ID NO: 144265 - DNA, 103 bp, Artificial Sequence
  Synthetic Polynucleotide
taatacgactcactataggggtccagaaaaagtttggccaacaggcacagaacagaggagactgtgcatgttggccaaaaacctggcggcagcgcaaaagatg

SEQ ID NO: 144266 - DNA, 103 bp, Artificial Sequence
  Synthetic Polynucleotide
taatacgactcactatagggatgtcttgtggtccagaaaaagtttggccaaacagaggagatggccaatgtttttctggaacctggcggcagcgcaaaagatg

SEQ ID NO: 144267 - DNA, 103 bp, Artificial Sequence
  Synthetic Polynucleotide
taatacgactcactatagggtcataatataatgtcttgtggtccagaaaaaacagaggagattttctatgccacaagacaacctggcggcagcgcaaaagatg

SEQ ID NO: 144268 - DNA, 103 bp, Artificial Sequence
  Synthetic Polynucleotide
taatacgactcactataggggcttagcctggctgaggagcgggtgactcgaacagaggagacgagtcatgcgctcctcaaacctggcggcagcgcaaaagatg

SEQ ID NO: 144269 - DNA, 103 bp, Artificial Sequence
  Synthetic Polynucleotide
taatacgactcactataggggggctccacatcataatataatgtcttgtgaacagaggagacacaagatgttatattataacctggcggcagcgcaaaagatg

SEQ ID NO: 144270 - DNA, 103 bp, Artificial Sequence
  Synthetic Polynucleotide
taatacgactcactatagggagaacaggaagggctccacatcataatataaacagaggagatatattatgatgtggagcaacctggcggcagcgcaaaagatg

SEQ ID NO: 144271 - DNA, 103 bp, Artificial Sequence
  Synthetic Polynucleotide
taatacgactcactataggggtcataacatagaacaggaagggctccacaaacagaggagatgtggaatgcttcctgttaacctggcggcagcgcaaaagatg

SEQ ID NO: 144272 - DNA, 103 bp, Artificial Sequence
  Synthetic Polynucleotide
taatacgactcactataggggtccgcctctgtcataacatagaacaggaaaacagaggagattcctgatgtatgttatgaacctggcggcagcgcaaaagatg

SEQ ID NO: 144273 - DNA, 103 bp, Artificial Sequence
  Synthetic Polynucleotide
taatacgactcactatagggagccagtgttgtccgcctctgtcataacataacagaggagaatgttaatgcagaggcggaacctggcggcagcgcaaaagatg

SEQ ID NO: 144274 - DNA, 103 bp, Artificial Sequence
  Synthetic Polynucleotide
taatacgactcactatagggatcaggtgacagccagtgttgtccgcctctaacagaggagaagaggcatgcaacactggaacctggcggcagcgcaaaagatg

SEQ ID NO: 144275 - DNA, 103 bp, Artificial Sequence
  Synthetic Polynucleotide
taatacgactcactatagggaaaatatccaatcaggtgacagccagtgttaacagaggagaaacactatgtgtcacctgaacctggcggcagcgcaaaagatg

SEQ ID NO: 144276 - DNA, 103 bp, Artificial Sequence
  Synthetic Polynucleotide
taatacgactcactatagggtttccttagaaaaatatccaatcaggtgacaacagaggagagtcaccatgttggatattaacctggcggcagcgcaaaagatg

SEQ ID NO: 144277 - DNA, 103 bp, Artificial Sequence
  Synthetic Polynucleotide
taatacgactcactatagggaatgaattcttttccttagaaaaatatccaaacagaggagatggataatgttctaaggaaacctggcggcagcgcaaaagatg

SEQ ID NO: 144278 - DNA, 103 bp, Artificial Sequence
  Synthetic Polynucleotide
taatacgactcactataggggtagttgaggaatgaattcttttccttagaaacagaggagatctaagatgaagaattcaaacctggcggcagcgcaaaagatg

SEQ ID NO: 144279 - DNA, 103 bp, Artificial Sequence
  Synthetic Polynucleotide
taatacgactcactataggggagaactctggcttagcctggctgaggagcaacagaggagagctcctatgccaggctaaaacctggcggcagcgcaaaagatg

SEQ ID NO: 144280 - DNA, 103 bp, Artificial Sequence
  Synthetic Polynucleotide
taatacgactcactatagggaggagacgttgtagttgaggaatgaattctaacagaggagaagaattatgtcctcaactaacctggcggcagcgcaaaagatg

SEQ ID NO: 144281 - DNA, 103 bp, Artificial Sequence
  Synthetic Polynucleotide
taatacgactcactataggggtaaggatacaggagacgttgtagttgaggaacagaggagacctcaaatgcaacgtctcaacctggcggcagcgcaaaagatg

SEQ ID NO: 144282 - DNA, 103 bp, Artificial Sequence
  Synthetic Polynucleotide
taatacgactcactatagggctgaggcatagtaaggatacaggagacgttaacagaggagaaacgtcatgtgtatccttaacctggcggcagcgcaaaagatg

SEQ ID NO: 144283 - DNA, 103 bp, Artificial Sequence
  Synthetic Polynucleotide
taatacgactcactataggggtctcatgtactgaggcatagtaaggatacaacagaggagagtatccatgctatgcctcaacctggcggcagcgcaaaagatg

SEQ ID NO: 144284 - DNA, 103 bp, Artificial Sequence
  Synthetic Polynucleotide
taatacgactcactatagggccatagccctgtctcatgtactgaggcataaacagaggagatatgccatggtacatgagaacctggcggcagcgcaaaagatg

SEQ ID NO: 144285 - DNA, 103 bp, Artificial Sequence
  Synthetic Polynucleotide
taatacgactcactatagggaagcatcttgccatagccctgtctcatgtaaacagaggagatacatgatgcagggctataacctggcggcagcgcaaaagatg

SEQ ID NO: 144286 - DNA, 103 bp, Artificial Sequence
  Synthetic Polynucleotide
taatacgactcactatagggtgaaatcaataagcatcttgccatagccctaacagaggagaagggctatggcaagatgcaacctggcggcagcgcaaaagatg

SEQ ID NO: 144287 - DNA, 103 bp, Artificial Sequence
  Synthetic Polynucleotide
taatacgactcactatagggagcaaataactgaaatcaataagcatcttgaacagaggagacaagatatgtattgatttaacctggcggcagcgcaaaagatg

SEQ ID NO: 144288 - DNA, 103 bp, Artificial Sequence
  Synthetic Polynucleotide
taatacgactcactataggggactttggaaagcaaataactgaaatcaataacagaggagaattgatatgagttatttgaacctggcggcagcgcaaaagatg

SEQ ID NO: 144289 - DNA, 103 bp, Artificial Sequence
  Synthetic Polynucleotide
taatacgactcactatagggctttttcttcgactttggaaagcaaataacaacagaggagagttattatgtttccaaagaacctggcggcagcgcaaaagatg

SEQ ID NO: 144290 - DNA, 103 bp, Artificial Sequence
  Synthetic Polynucleotide
taatacgactcactatagggctggaatcttgagaactctggcttagcctgaacagaggagacaggctatgccagagttcaacctggcggcagcgcaaaagatg

SEQ ID NO: 144291 - DNA, 103 bp, Artificial Sequence
  Synthetic Polynucleotide
taatacgactcactatagggggggagccaactttttcttcgactttggaaaacagaggagattccaaatgcgaagaaaaaacctggcggcagcgcaaaagatg

SEQ ID NO: 144292 - DNA, 103 bp, Artificial Sequence
  Synthetic Polynucleotide
taatacgactcactatagggtggacgttctggggagccaactttttcttcaacagaggagagaagaaatggttggctccaacctggcggcagcgcaaaagatg

SEQ ID NO: 144293 - DNA, 103 bp, Artificial Sequence
  Synthetic Polynucleotide
taatacgactcactataggggatctgagagtggacgttctggggagccaaaacagaggagattggctatgcagaacgtcaacctggcggcagcgcaaaagatg

SEQ ID NO: 144294 - DNA, 103 bp, Artificial Sequence
  Synthetic Polynucleotide
taatacgactcactatagggataagccccagatctgagagtggacgttctaacagaggagaagaacgatgactctcagaaacctggcggcagcgcaaaagatg

SEQ ID NO: 144295 - DNA, 103 bp, Artificial Sequence
  Synthetic Polynucleotide
taatacgactcactataggggcgatagcttataagccccagatctgagagaacagaggagactctcaatgctggggcttaacctggcggcagcgcaaaagatg

SEQ ID NO: 144296 - DNA, 103 bp, Artificial Sequence
  Synthetic Polynucleotide
taatacgactcactatagggtccagtaactgcgatagcttataagccccaaacagaggagatggggcatgtaagctatcaacctggcggcagcgcaaaagatg

SEQ ID NO: 144297 - DNA, 103 bp, Artificial Sequence
  Synthetic Polynucleotide
taatacgactcactatagggagtacttctttccagtaactgcgatagcttaacagaggagaaagctaatgcagttactgaacctggcggcagcgcaaaagatg

SEQ ID NO: 144298 - DNA, 103 bp, Artificial Sequence
  Synthetic Polynucleotide
taatacgactcactataggggtagcggagaagtacttctttccagtaactaacagaggagaagttacatgaaagaagtaaacctggcggcagcgcaaaagatg

SEQ ID NO: 144299 - DNA, 103 bp, Artificial Sequence
  Synthetic Polynucleotide
taatacgactcactatagggaattatgcaggtagcggagaagtacttcttaacagaggagaaagaagatgttctccgctaacctggcggcagcgcaaaagatg

SEQ ID NO: 144300 - DNA, 103 bp, Artificial Sequence
  Synthetic Polynucleotide
taatacgactcactatagggttgccttgaaaattatgcaggtagcggagaaacagaggagatctccgatgcctgcataaaacctggcggcagcgcaaaagatg

SEQ ID NO: 144301 - DNA, 103 bp, Artificial Sequence
  Synthetic Polynucleotide
taatacgactcactatagggtcgaacaggactggaatcttgagaactctgaacagaggagacagagtatgcaagattccaacctggcggcagcgcaaaagatg

SEQ ID NO: 144302 - DNA, 103 bp, Artificial Sequence
  Synthetic Polynucleotide
taatacgactcactatagggagaaatctctttgccttgaaaattatgcagaacagaggagactgcatatgtttcaaggcaacctggcggcagcgcaaaagatg

SEQ ID NO: 144303 - DNA, 103 bp, Artificial Sequence
  Synthetic Polynucleotide
taatacgactcactatagggtttctttgatagaaatctctttgccttgaaaacagaggagattcaagatgaagagatttaacctggcggcagcgcaaaagatg

SEQ ID NO: 144304 - DNA, 103 bp, Artificial Sequence
  Synthetic Polynucleotide
taatacgactcactatagggtcctgactgatttctttgatagaaatctctaacagaggagaagagatatgtatcaaagaaacctggcggcagcgcaaaagatg

SEQ ID NO: 144305 - DNA, 103 bp, Artificial Sequence
  Synthetic Polynucleotide
taatacgactcactatagggcacagccgtctcctgactgatttctttgataacagaggagaatcaaaatgatcagtcagaacctggcggcagcgcaaaagatg

SEQ ID NO: 144306 - DNA, 103 bp, Artificial Sequence
  Synthetic Polynucleotide
taatacgactcactatagggccacaggattcacagccgtctcctgactgaaacagaggagatcagtcatgagacggctgaacctggcggcagcgcaaaagatg

SEQ ID NO: 144307 - DNA, 103 bp, Artificial Sequence
  Synthetic Polynucleotide
taatacgactcactatagggctgacaatgtccacaggattcacagccgtcaacagaggagagacggcatggaatcctgtaacctggcggcagcgcaaaagatg

SEQ ID NO: 144308 - DNA, 103 bp, Artificial Sequence
  Synthetic Polynucleotide
taatacgactcactatagggttgcagagtgctgacaatgtccacaggattaacagaggagaaatcctatggacattgtcaacctggcggcagcgcaaaagatg

SEQ ID NO: 144309 - DNA, 103 bp, Artificial Sequence
  Synthetic Polynucleotide
taatacgactcactatagggtctgaagggcttgcagagtgctgacaatgtaacagaggagaacattgatggcactctgcaacctggcggcagcgcaaaagatg

SEQ ID NO: 144310 - DNA, 103 bp, Artificial Sequence
  Synthetic Polynucleotide
taatacgactcactatagggtatttgagcatctgaagggcttgcagagtgaacagaggagacactctatgagcccttcaaacctggcggcagcgcaaaagatg

SEQ ID NO: 144311 - DNA, 103 bp, Artificial Sequence
  Synthetic Polynucleotide
taatacgactcactatagggtcccttccagtatttgagcatctgaagggcaacagaggagagcccttatgatgctcaaaaacctggcggcagcgcaaaagatg

SEQ ID NO: 144312 - DNA, 103 bp, Artificial Sequence
  Synthetic Polynucleotide
taatacgactcactatagggactgcagatttcgaacaggactggaatcttaacagaggagaaagattatggtcctgttcaacctggcggcagcgcaaaagatg

SEQ ID NO: 144313 - DNA, 103 bp, Artificial Sequence
  Synthetic Polynucleotide
taatacgactcactatagggctaggtgttttcccttccagtatttgagcaaacagaggagatgctcaatgactggaaggaacctggcggcagcgcaaaagatg

SEQ ID NO: 144314 - DNA, 103 bp, Artificial Sequence
  Synthetic Polynucleotide
taatacgactcactatagggctctttaaaactaggtgttttcccttccagaacagaggagactggaaatgaaaacacctaacctggcggcagcgcaaaagatg

SEQ ID NO: 144315 - DNA, 103 bp, Artificial Sequence
  Synthetic Polynucleotide
taatacgactcactatagggcaggtcctgtctctttaaaactaggtgtttaacagaggagaaaacacatggttttaaagaacctggcggcagcgcaaaagatg

SEQ ID NO: 144316 - DNA, 103 bp, Artificial Sequence
  Synthetic Polynucleotide
taatacgactcactatagggactcatcaatcaggtcctgtctctttaaaaaacagaggagattttaaatggacaggaccaacctggcggcagcgcaaaagatg

SEQ ID NO: 144317 - DNA, 103 bp, Artificial Sequence
  Synthetic Polynucleotide
taatacgactcactatagggttggctatccactcatcaatcaggtcctgtaacagaggagaacaggaatggattgatgaaacctggcggcagcgcaaaagatg

SEQ ID NO: 144318 - DNA, 103 bp, Artificial Sequence
  Synthetic Polynucleotide
taatacgactcactatagggtttggcctctttggctatccactcatcaataacagaggagaattgatatgtggatagccaacctggcggcagcgcaaaagatg

SEQ ID NO: 144319 - DNA, 103 bp, Artificial Sequence
  Synthetic Polynucleotide
taatacgactcactatagggagttggaccttttggcctctttggctatccaacagaggagaggatagatgaagaggccaaacctggcggcagcgcaaaagatg

SEQ ID NO: 144320 - DNA, 103 bp, Artificial Sequence
  Synthetic Polynucleotide
taatacgactcactataggggttttattggagttggaccttttggcctctaacagaggagaagaggcatgaaggtccaaaacctggcggcagcgcaaaagatg

SEQ ID NO: 144321 - DNA, 103 bp, Artificial Sequence
  Synthetic Polynucleotide
taatacgactcactataggggggatccatggttttattggagttggacctaacagaggagaaggtccatgtccaataaaaacctggcggcagcgcaaaagatg

SEQ ID NO: 144322 - DNA, 103 bp, Artificial Sequence
  Synthetic Polynucleotide
taatacgactcactatagggttaagcagctgggatccatggttttattggaacagaggagaccaataatgccatggatcaacctggcggcagcgcaaaagatg

SEQ ID NO: 144323 - DNA, 103 bp, Artificial Sequence
  Synthetic Polynucleotide
taatacgactcactataggggtgccaaaagactgcagatttcgaacaggaaacagaggagatcctgtatgaaatctgcaaacctggcggcagcgcaaaagatg

SEQ ID NO: 144324 - DNA, 103 bp, Artificial Sequence
  Synthetic Polynucleotide
taatacgactcactatagggggggtccattttaagcagctgggatccatgaacagaggagacatggaatgcagctgcttaacctggcggcagcgcaaaagatg

SEQ ID NO: 144325 - DNA, 103 bp, Artificial Sequence
  Synthetic Polynucleotide
taatacgactcactataggggcccttgggaggggtccattttaagcagctaacagaggagaagctgcatgaaatggaccaacctggcggcagcgcaaaagatg

SEQ ID NO: 144326 - DNA, 103 bp, Artificial Sequence
  Synthetic Polynucleotide
taatacgactcactatagggaggctcctcagtgccaaaagactgcagattaacagaggagaaatctgatgtcttttggcaacctggcggcagcgcaaaagatg

SEQ ID NO: 144327 - DNA, 103 bp, Artificial Sequence
  Synthetic Polynucleotide
taatacgactcactatagggcatctgaactactgcctgcattcctcttccaacagaggagaggaagaatgatgcaggcaaacctggcggcagcgcaaaagatg

SEQ ID NO: 144328 - DNA, 103 bp, Artificial Sequence
  Synthetic Polynucleotide
taatacgactcactatagggtagagtaagcaggctcctcagtgccaaaagaacagaggagacttttgatgctgaggagcaacctggcggcagcgcaaaagatg

SEQ ID NO: 144329 - DNA, 103 bp, Artificial Sequence
  Synthetic Polynucleotide
taatacgactcactatagggactcttctggtagagtaagcaggctcctcaaacagaggagatgaggaatgtgcttactcaacctggcggcagcgcaaaagatg

SEQ ID NO: 144330 - DNA, 103 bp, Artificial Sequence
  Synthetic Polynucleotide
taatacgactcactatagggactacgggtcactcttctggtagagtaagcaacagaggagagcttacatgaccagaagaaacctggcggcagcgcaaaagatg

SEQ ID NO: 144331 - DNA, 103 bp, Artificial Sequence
  Synthetic Polynucleotide
taatacgactcactataggggctgctgctgactacgggtcactcttctggaacagaggagaccagaaatgtgacccgtaaacctggcggcagcgcaaaagatg

SEQ ID NO: 144332 - DNA, 103 bp, Artificial Sequence
  Synthetic Polynucleotide
taatacgactcactatagggactggggtaggctgctgctgactacgggtcaacagaggagagacccgatgtcagcagcaaacctggcggcagcgcaaaagatg

SEQ ID NO: 144333 - DNA, 103 bp, Artificial Sequence
  Synthetic Polynucleotide
taatacgactcactatagggtttcggtgtcactggggtaggctgctgctgaacagaggagacagcagatgcctaccccaaacctggcggcagcgcaaaagatg

SEQ ID NO: 144334 - DNA, 103 bp, Artificial Sequence
  Synthetic Polynucleotide
taatacgactcactataggggagggtattttttcggtgtcactggggtagaacagaggagactacccatgtgacaccgaaacctggcggcagcgcaaaagatg

SEQ ID NO: 144335 - DNA, 103 bp, Artificial Sequence
  Synthetic Polynucleotide
taatacgactcactataggggtctgccgaagagggtattttttcggtgtcaacagaggagagacaccatgaaaatacccaacctggcggcagcgcaaaagatg

SEQ ID NO: 144336 - DNA, 103 bp, Artificial Sequence
  Synthetic Polynucleotide
taatacgactcactatagggagatgaacgagtctgccgaagagggtatttaacagaggagaaaatacatgcttcggcagaacctggcggcagcgcaaaagatg

SEQ ID NO: 144337 - DNA, 103 bp, Artificial Sequence
  Synthetic Polynucleotide
taatacgactcactatagggtttctgaaccagatgaacgagtctgccgaaaacagaggagattcggcatgctcgttcataacctggcggcagcgcaaaagatg

SEQ ID NO: 144338 - DNA, 103 bp, Artificial Sequence
  Synthetic Polynucleotide
taatacgactcactatagggtcttcggttccatctgaactactgcctgcaaacagaggagatgcaggatgtagttcagaaacctggcggcagcgcaaaagatg

SEQ ID NO: 144339 - DNA, 103 bp, Artificial Sequence
  Synthetic Polynucleotide
taatacgactcactatagggacttgctcagtttctgaaccagatgaacgaaacagaggagatcgttcatgtggttcagaaacctggcggcagcgcaaaagatg

SEQ ID NO: 144340 - DNA, 103 bp, Artificial Sequence
  Synthetic Polynucleotide
taatacgactcactatagggaaaatcaaccacttgctcagtttctgaaccaacagaggagaggttcaatgactgagcaaaacctggcggcagcgcaaaagatg

SEQ ID NO: 144341 - DNA, 103 bp, Artificial Sequence
  Synthetic Polynucleotide
taatacgactcactatagggctctatctgaaaaatcaaccacttgctcagaacagaggagactgagcatgtggttgattaacctggcggcagcgcaaaagatg

SEQ ID NO: 144342 - DNA, 103 bp, Artificial Sequence
  Synthetic Polynucleotide
taatacgactcactatagggtttttagtttctctatctgaaaaatcaaccaacagaggagaggttgaatgttcagatagaacctggcggcagcgcaaaagatg

SEQ ID NO: 144343 - DNA, 103 bp, Artificial Sequence
  Synthetic Polynucleotide
taatacgactcactatagggatcagctgtatttttagtttctctatctgaaacagaggagatcagatatggaaactaaaaacctggcggcagcgcaaaagatg

SEQ ID NO: 144344 - DNA, 103 bp, Artificial Sequence
  Synthetic Polynucleotide
taatacgactcactatagggactcatcatgatcagctgtatttttagtttaacagaggagaaaactaatgatacagctgaacctggcggcagcgcaaaagatg

SEQ ID NO: 144345 - DNA, 103 bp, Artificial Sequence
  Synthetic Polynucleotide
taatacgactcactatagggcgaggcggtgactcatcatgatcagctgtaaacagaggagatacagcatgtcatgatgaaacctggcggcagcgcaaaagatg

SEQ ID NO: 144346 - DNA, 103 bp, Artificial Sequence
  Synthetic Polynucleotide
taatacgactcactatagggagttggagttcgaggcggtgactcatcatgaacagaggagacatgatatgtcaccgcctaacctggcggcagcgcaaaagatg

SEQ ID NO: 144347 - DNA, 103 bp, Artificial Sequence
  Synthetic Polynucleotide
taatacgactcactataggggcgcatttccagttggagttcgaggcggtgaacagaggagacaccgcatggaactccaaaacctggcggcagcgcaaaagatg

SEQ ID NO: 144348 - DNA, 103 bp, Artificial Sequence
  Synthetic Polynucleotide
taatacgactcactatagggtcagaagaaggcgcatttccagttggagttaacagaggagaaactccatgtggaaatgcaacctggcggcagcgcaaaagatg

SEQ ID NO: 144349 - DNA, 103 bp, Artificial Sequence
  Synthetic Polynucleotide
taatacgactcactatagggaaaatcggaatcttcggttccatctgaactaacagaggagaagttcaatgggaaccgaaaacctggcggcagcgcaaaagatg

SEQ ID NO: 144350 - DNA, 103 bp, Artificial Sequence
  Synthetic Polynucleotide
taatacgactcactatagggtatgtcagactcagaagaaggcgcatttccaacagaggagaggaaatatgccttcttctaacctggcggcagcgcaaaagatg

SEQ ID NO: 144351 - DNA, 103 bp, Artificial Sequence
  Synthetic Polynucleotide
taatacgactcactatagggtggagatgtctatgtcagactcagaagaagaacagaggagacttcttatgagtctgacaaacctggcggcagcgcaaaagatg

SEQ ID NO: 144352 - DNA, 103 bp, Artificial Sequence
  Synthetic Polynucleotide
taatacgactcactatagggacattggggctggagatgtctatgtcagacaacagaggagagtctgaatgagacatctcaacctggcggcagcgcaaaagatg

SEQ ID NO: 144353 - DNA, 103 bp, Artificial Sequence
  Synthetic Polynucleotide
taatacgactcactatagggatcgtgagatacattggggctggagatgtcaacagaggagagacatcatgagccccaataacctggcggcagcgcaaaagatg

SEQ ID NO: 144354 - DNA, 103 bp, Artificial Sequence
  Synthetic Polynucleotide
taatacgactcactatagggcaatgctctcatcgtgagatacattggggcaacagaggagagccccaatgtatctcacgaacctggcggcagcgcaaaagatg

SEQ ID NO: 144355 - DNA, 103 bp, Artificial Sequence
  Synthetic Polynucleotide
taatacgactcactatagggatgtccttggcaatgctctcatcgtgagataacagaggagaatctcaatgtgagagcataacctggcggcagcgcaaaagatg

SEQ ID NO: 144356 - DNA, 103 bp, Artificial Sequence
  Synthetic Polynucleotide
taatacgactcactatagggcttcagggacatgtccttggcaatgctctcaacagaggagagagagcatggccaaggacaacctggcggcagcgcaaaagatg

SEQ ID NO: 144357 - DNA, 103 bp, Artificial Sequence
  Synthetic Polynucleotide
taatacgactcactatagggtgcctgagtccttcagggacatgtccttggaacagaggagaccaaggatgtgtccctgaaacctggcggcagcgcaaaagatg

SEQ ID NO: 144358 - DNA, 103 bp, Artificial Sequence
  Synthetic Polynucleotide
taatacgactcactataggggagagatcactgcctgagtccttcagggacaacagaggagagtccctatgggactcaggaacctggcggcagcgcaaaagatg

SEQ ID NO: 144359 - DNA, 103 bp, Artificial Sequence
  Synthetic Polynucleotide
taatacgactcactatagggggggcgatgagagagatcactgcctgagtcaacagaggagagactcaatgagtgatctcaacctggcggcagcgcaaaagatg

SEQ ID NO: 144360 - DNA, 103 bp, Artificial Sequence
  Synthetic Polynucleotide
taatacgactcactataggggatctgtagaaaaatcggaatcttcggttcaacagaggagagaaccgatgattccgattaacctggcggcagcgcaaaagatg

SEQ ID NO: 144361 - DNA, 103 bp, Artificial Sequence
  Synthetic Polynucleotide
taatacgactcactataggggacggcgcttggggcgatgagagagatcacaacagaggagagtgatcatgctcatcgccaacctggcggcagcgcaaaagatg

SEQ ID NO: 144362 - DNA, 103 bp, Artificial Sequence
  Synthetic Polynucleotide
taatacgactcactatagggtcatggaagcgacggcgcttggggcgatgaaacagaggagatcatcgatgcaagcgccgaacctggcggcagcgcaaaagatg

SEQ ID NO: 144363 - DNA, 103 bp, Artificial Sequence
  Synthetic Polynucleotide
taatacgactcactataggggttgtagctttcatggaagcgacggcgcttaacagaggagaaagcgcatgcgcttccataacctggcggcagcgcaaaagatg

SEQ ID NO: 144364 - DNA, 103 bp, Artificial Sequence
  Synthetic Polynucleotide
taatacgactcactatagggtcatattgaagttgtagctttcatggaagcaacagaggagagcttccatgaaagctacaaacctggcggcagcgcaaaagatg

SEQ ID NO: 144365 - DNA, 103 bp, Artificial Sequence
  Synthetic Polynucleotide
taatacgactcactataggggtaggacacttcatattgaagttgtagcttaacagaggagaaagctaatgcttcaatataacctggcggcagcgcaaaagatg

SEQ ID NO: 144366 - DNA, 103 bp, Artificial Sequence
  Synthetic Polynucleotide
taatacgactcactatagggacagcctggtgtaggacacttcatattgaaaacagaggagattcaatatgaagtgtcctaacctggcggcagcgcaaaagatg

SEQ ID NO: 144367 - DNA, 103 bp, Artificial Sequence
  Synthetic Polynucleotide
taatacgactcactatagggctagagagttacagcctggtgtaggacactaacagaggagaagtgtcatgcaccaggctaacctggcggcagcgcaaaagatg

SEQ ID NO: 144368 - DNA, 103 bp, Artificial Sequence
  Synthetic Polynucleotide
taatacgactcactataggggtaaggtgtcctagagagttacagcctggtaacagaggagaaccaggatgtaactctctaacctggcggcagcgcaaaagatg

SEQ ID NO: 144369 - DNA, 103 bp, Artificial Sequence
  Synthetic Polynucleotide
taatacgactcactatagggatgttttcctgtaaggtgtcctagagagttaacagaggagaaactctatgggacaccttaacctggcggcagcgcaaaagatg

SEQ ID NO: 144370 - DNA, 103 bp, Artificial Sequence
  Synthetic Polynucleotide
taatacgactcactatagggaatgtctctcatgttttcctgtaaggtgtcaacagaggagagacaccatgcaggaaaacaacctggcggcagcgcaaaagatg

SEQ ID NO: 144371 - DNA, 103 bp, Artificial Sequence
  Synthetic Polynucleotide
taatacgactcactataggggtgtgctcgagatctgtagaaaaatcggaaaacagaggagattccgaatgttctacagaaacctggcggcagcgcaaaagatg

SEQ ID NO: 144372 - DNA, 103 bp, Artificial Sequence
  Synthetic Polynucleotide
taatacgactcactataggggagatggagaaatgtctctcatgttttcctaacagaggagaaggaaaatgtgagagacaaacctggcggcagcgcaaaagatg

SEQ ID NO: 144373 - DNA, 103 bp, Artificial Sequence
  Synthetic Polynucleotide
taatacgactcactatagggtgggcatcctgagatggagaaatgtctctcaacagaggagagagagaatgttctccatcaacctggcggcagcgcaaaagatg

SEQ ID NO: 144374 - DNA, 103 bp, Artificial Sequence
  Synthetic Polynucleotide
taatacgactcactatagggtatgatacagtgggcatcctgagatggagaaacagaggagatctccaatgcaggatgccaacctggcggcagcgcaaaagatg

SEQ ID NO: 144375 - DNA, 103 bp, Artificial Sequence
  Synthetic Polynucleotide
taatacgactcactataggggctgagaggttatgatacagtgggcatcctaacagaggagaaggatgatgactgtatcaaacctggcggcagcgcaaaagatg

SEQ ID NO: 144376 - DNA, 103 bp, Artificial Sequence
  Synthetic Polynucleotide
taatacgactcactataggggcattcgtcagctgagaggttatgatacagaacagaggagactgtatatgaacctctcaaacctggcggcagcgcaaaagatg

SEQ ID NO: 144377 - DNA, 103 bp, Artificial Sequence
  Synthetic Polynucleotide
taatacgactcactatagggctctcaccttgcattcgtcagctgagaggtaacagaggagaacctctatgctgacgaataacctggcggcagcgcaaaagatg

SEQ ID NO: 144378 - DNA, 103 bp, Artificial Sequence
  Synthetic Polynucleotide
taatacgactcactatagggcggctctgtgctctcaccttgcattcgtcaaacagaggagatgacgaatgcaaggtgagaacctggcggcagcgcaaaagatg

SEQ ID NO: 144379 - DNA, 103 bp, Artificial Sequence
  Synthetic Polynucleotide
taatacgactcactatagggctgcttatcccggctctgtgctctcaccttaacagaggagaaaggtgatggcacagagcaacctggcggcagcgcaaaagatg

SEQ ID NO: 144380 - DNA, 103 bp, Artificial Sequence
  Synthetic Polynucleotide
taatacgactcactatagggtttcttctatctgcttatcccggctctgtgaacagaggagacacagaatggggataagcaacctggcggcagcgcaaaagatg

SEQ ID NO: 144381 - DNA, 103 bp, Artificial Sequence
  Synthetic Polynucleotide
taatacgactcactataggggacagcatcctttcttctatctgcttatccaacagaggagaggataaatggatagaagaaacctggcggcagcgcaaaagatg

SEQ ID NO: 144382 - DNA, 103 bp, Artificial Sequence
  Synthetic Polynucleotide
taatacgactcactatagggtgaactgtctgtgtgctcgagatctgtagaaacagaggagatctacaatgctcgagcacaacctggcggcagcgcaaaagatg

SEQ ID NO: 144383 - DNA, 103 bp, Artificial Sequence
  Synthetic Polynucleotide
taatacgactcactatagggttgcctgtgagacagcatcctttcttctataacagaggagaatagaaatgaggatgctgaacctggcggcagcgcaaaagatg

SEQ ID NO: 144384 - DNA, 103 bp, Artificial Sequence
  Synthetic Polynucleotide
taatacgactcactatagggtgttgtcatcttgcctgtgagacagcatccaacagaggagaggatgcatgctcacaggcaacctggcggcagcgcaaaagatg

SEQ ID NO: 144385 - DNA, 103 bp, Artificial Sequence
  Synthetic Polynucleotide
taatacgactcactataggggcatgcctgttgttgtcatcttgcctgtgaaacagaggagatcacagatgagatgacaaaacctggcggcagcgcaaaagatg

SEQ ID NO: 144386 - DNA, 103 bp, Artificial Sequence
  Synthetic Polynucleotide
taatacgactcactataggggtgcctggttgcatgcctgttgttgtcatcaacagaggagagatgacatgaacaggcataacctggcggcagcgcaaaagatg

SEQ ID NO: 144387 - DNA, 103 bp, Artificial Sequence
  Synthetic Polynucleotide
taatacgactcactatagggttggtgcctggtgcctggttgcatgcctgtaacagaggagaacaggcatgcaaccaggcaacctggcggcagcgcaaaagatg

SEQ ID NO: 144388 - DNA, 103 bp, Artificial Sequence
  Synthetic Polynucleotide
taatacgactcactatagggtgtctctccgttggtgcctggtgcctggttaacagaggagaaaccagatgccaggcaccaacctggcggcagcgcaaaagatg

SEQ ID NO: 144389 - DNA, 103 bp, Artificial Sequence
  Synthetic Polynucleotide
taatacgactcactatagggatatcgaagctgtctctccgttggtgcctgaacagaggagacaggcaatgacggagagaaacctggcggcagcgcaaaagatg

SEQ ID NO: 144390 - DNA, 103 bp, Artificial Sequence
  Synthetic Polynucleotide
taatacgactcactatagggctttttccttatatcgaagctgtctctccgaacagaggagacggagaatgagcttcgataacctggcggcagcgcaaaagatg

SEQ ID NO: 144391 - DNA, 103 bp, Artificial Sequence
  Synthetic Polynucleotide
taatacgactcactatagggagttcagccactttttccttatatcgaagcaacagaggagagcttcgatgtaaggaaaaaacctggcggcagcgcaaaagatg

SEQ ID NO: 144392 - DNA, 103 bp, Artificial Sequence
  Synthetic Polynucleotide
taatacgactcactatagggtttcttcctgagttcagccactttttccttaacagaggagaaaggaaatggtggctgaaaacctggcggcagcgcaaaagatg

SEQ ID NO: 144393 - DNA, 103 bp, Artificial Sequence
  Synthetic Polynucleotide
taatacgactcactatagggcatcactttctgaactgtctgtgtgctcgaaacagaggagatcgagcatgcagacagttaacctggcggcagcgcaaaagatg

SEQ ID NO: 144394 - DNA, 103 bp, Artificial Sequence
  Synthetic Polynucleotide
taatacgactcactatagggcagaatttcttttcttcctgagttcagccaaacagaggagatggctgatgtcaggaagaaacctggcggcagcgcaaaagatg

SEQ ID NO: 144395 - DNA, 103 bp, Artificial Sequence
  Synthetic Polynucleotide
taatacgactcactatagggttgctcagtccagaatttcttttcttcctgaacagaggagacaggaaatgaagaaattcaacctggcggcagcgcaaaagatg

SEQ ID NO: 144396 - DNA, 103 bp, Artificial Sequence
  Synthetic Polynucleotide
taatacgactcactatagggtttctgttctttgctcagtccagaatttctaacagaggagaagaaatatgggactgagcaacctggcggcagcgcaaaagatg

SEQ ID NO: 144397 - DNA, 103 bp, Artificial Sequence
  Synthetic Polynucleotide
taatacgactcactatagggtatatttctctttctgttctttgctcagtcaacagaggagagactgaatgaagaacagaaacctggcggcagcgcaaaagatg

SEQ ID NO: 144398 - DNA, 103 bp, Artificial Sequence
  Synthetic Polynucleotide
taatacgactcactatagggctgtgttccatatatttctctttctgttctaacagaggagaagaacaatgagagaaataaacctggcggcagcgcaaaagatg

SEQ ID NO: 144399 - DNA, 103 bp, Artificial Sequence
  Synthetic Polynucleotide
taatacgactcactatagggataggtctgtctgtgttccatatatttctcaacagaggagagagaaaatgatggaacacaacctggcggcagcgcaaaagatg

SEQ ID NO: 144400 - DNA, 103 bp, Artificial Sequence
  Synthetic Polynucleotide
taatacgactcactataggggtgtgttcccataggtctgtctgtgttccaaacagaggagatggaacatggacagacctaacctggcggcagcgcaaaagatg

SEQ ID NO: 144401 - DNA, 103 bp, Artificial Sequence
  Synthetic Polynucleotide
taatacgactcactatagggagaggttcccgtgtgttcccataggtctgtaacagaggagaacagacatgtgggaacacaacctggcggcagcgcaaaagatg

SEQ ID NO: 144402 - DNA, 103 bp, Artificial Sequence
  Synthetic Polynucleotide
taatacgactcactataggggttttctaaaagaggttcccgtgtgttcccaacagaggagagggaacatgcgggaacctaacctggcggcagcgcaaaagatg

SEQ ID NO: 144403 - DNA, 103 bp, Artificial Sequence
  Synthetic Polynucleotide
taatacgactcactatagggcgcttgtcaggttttctaaaagaggttcccaacagaggagagggaacatgttttagaaaaacctggcggcagcgcaaaagatg

SEQ ID NO: 144404 - DNA, 103 bp, Artificial Sequence
  Synthetic Polynucleotide
taatacgactcactatagggcgggatgtgccatcactttctgaactgtctaacagaggagaagacagatgagaaagtgaaacctggcggcagcgcaaaagatg

SEQ ID NO: 144405 - DNA, 103 bp, Artificial Sequence
  Synthetic Polynucleotide
taatacgactcactatagggaagtcatactcgcttgtcaggttttctaaaaacagaggagatttagaatgcctgacaagaacctggcggcagcgcaaaagatg

SEQ ID NO: 144406 - DNA, 103 bp, Artificial Sequence
  Synthetic Polynucleotide
taatacgactcactataggggaaaagatccaagtcatactcgcttgtcagaacagaggagactgacaatggagtatgacaacctggcggcagcgcaaaagatg

SEQ ID NO: 144407 - DNA, 103 bp, Artificial Sequence
  Synthetic Polynucleotide
taatacgactcactataggggtgctcttcggaaaagatccaagtcatactaacagaggagaagtatgatgtggatctttaacctggcggcagcgcaaaagatg

SEQ ID NO: 144408 - DNA, 103 bp, Artificial Sequence
  Synthetic Polynucleotide
taatacgactcactataggggcccgggcttgtgctcttcggaaaagatccaacagaggagaggatctatgccgaagagcaacctggcggcagcgcaaaagatg

SEQ ID NO: 144409 - DNA, 103 bp, Artificial Sequence
  Synthetic Polynucleotide
taatacgactcactatagggatcctctgaagcccgggcttgtgctcttcgaacagaggagacgaagaatgcaagcccggaacctggcggcagcgcaaaagatg

SEQ ID NO: 144410 - DNA, 103 bp, Artificial Sequence
  Synthetic Polynucleotide
taatacgactcactatagggacttctccaaatcctctgaagcccgggcttaacagaggagaaagcccatgcttcagaggaacctggcggcagcgcaaaagatg

SEQ ID NO: 144411 - DNA, 103 bp, Artificial Sequence
  Synthetic Polynucleotide
taatacgactcactatagggtgcagccttaacttctccaaatcctctgaaaacagaggagattcagaatgtttggagaaaacctggcggcagcgcaaaagatg

SEQ ID NO: 144412 - DNA, 103 bp, Artificial Sequence
  Synthetic Polynucleotide
taatacgactcactataggggatttggccttgcagccttaacttctccaaaacagaggagattggagatgttaaggctgaacctggcggcagcgcaaaagatg

SEQ ID NO: 144413 - DNA, 103 bp, Artificial Sequence
  Synthetic Polynucleotide
taatacgactcactatagggttccctctgtgatttggccttgcagccttaaacagaggagataaggcatgaaggccaaaaacctggcggcagcgcaaaagatg

SEQ ID NO: 144414 - DNA, 103 bp, Artificial Sequence
  Synthetic Polynucleotide
taatacgactcactatagggatcatgttgcttccctctgtgatttggcctaacagaggagaaggccaatgcacagagggaacctggcggcagcgcaaaagatg

SEQ ID NO: 144415 - DNA, 103 bp, Artificial Sequence
  Synthetic Polynucleotide
taatacgactcactatagggcgcctttgtcacttccttagccggctgcataacagaggagaatgcagatggctaaggaaaacctggcggcagcgcaaaagatg

SEQ ID NO: 144416 - DNA, 103 bp, Artificial Sequence
  Synthetic Polynucleotide
taatacgactcactatagggctggcggctgagcctcggcctctgccacttaacagaggagaaagtggatgaggccgaggaacctggcggcagcgcaaaagatg

SEQ ID NO: 144417 - DNA, 103 bp, Artificial Sequence
  Synthetic Polynucleotide
taatacgactcactatagggtcatcaaagcctggcggctgagcctcggccaacagaggagaggccgaatgtcagccgccaacctggcggcagcgcaaaagatg

SEQ ID NO: 144418 - DNA, 103 bp, Artificial Sequence
  Synthetic Polynucleotide
taatacgactcactatagggaggcagcatctcatcaaagcctggcggctgaacagaggagacagccgatgggctttgataacctggcggcagcgcaaaagatg

SEQ ID NO: 144419 - DNA, 103 bp, Artificial Sequence
  Synthetic Polynucleotide
taatacgactcactatagggccacttgaccaggcagcatctcatcaaagcaacagaggagagctttgatgagatgctgcaacctggcggcagcgcaaaagatg

SEQ ID NO: 144420 - DNA, 103 bp, Artificial Sequence
  Synthetic Polynucleotide
taatacgactcactatagggtggacaggatccacttgaccaggcagcatcaacagaggagagatgctatgtggtcaagtaacctggcggcagcgcaaaagatg

SEQ ID NO: 144421 - DNA, 103 bp, Artificial Sequence
  Synthetic Polynucleotide
taatacgactcactatagggggggctgtgctggacaggatccacttgaccaacagaggagaggtcaaatggatcctgtcaacctggcggcagcgcaaaagatg

SEQ ID NO: 144422 - DNA, 103 bp, Artificial Sequence
  Synthetic Polynucleotide
taatacgactcactatagggtgagccctgtggggctgtgctggacaggataacagaggagaatcctgatgagcacagccaacctggcggcagcgcaaaagatg

SEQ ID NO: 144423 - DNA, 103 bp, Artificial Sequence
  Synthetic Polynucleotide
taatacgactcactatagggcgctgctatctgagccctgtggggctgtgcaacagaggagagcacagatgcacagggctaacctggcggcagcgcaaaagatg

SEQ ID NO: 144424 - DNA, 103 bp, Artificial Sequence
  Synthetic Polynucleotide
taatacgactcactatagggagctcactgtcgctgctatctgagccctgtaacagaggagaacagggatgagatagcagaacctggcggcagcgcaaaagatg

SEQ ID NO: 144425 - DNA, 103 bp, Artificial Sequence
  Synthetic Polynucleotide
taatacgactcactatagggggacagctccagctcactgtcgctgctatcaacagaggagagatagcatggacagtgagaacctggcggcagcgcaaaagatg

SEQ ID NO: 144426 - DNA, 103 bp, Artificial Sequence
  Synthetic Polynucleotide
taatacgactcactatagggtgccgtccgacgcctttgtcacttccttagaacagaggagactaaggatgtgacaaaggaacctggcggcagcgcaaaagatg

SEQ ID NO: 144427 - DNA, 103 bp, Artificial Sequence
  Synthetic Polynucleotide
taatacgactcactatagggggcgcaccgtggacagctccagctcactgtaacagaggagaacagtgatgtggagctgtaacctggcggcagcgcaaaagatg

SEQ ID NO: 144428 - DNA, 103 bp, Artificial Sequence
  Synthetic Polynucleotide
taatacgactcactatagggtctggctggtggcgcaccgtggacagctccaacagaggagaggagctatgcacggtgcgaacctggcggcagcgcaaaagatg

SEQ ID NO: 144429 - DNA, 103 bp, Artificial Sequence
  Synthetic Polynucleotide
taatacgactcactataggggtccagcccctctggctggtggcgcaccgtaacagaggagaacggtgatgcaccagccaaacctggcggcagcgcaaaagatg

SEQ ID NO: 144430 - DNA, 103 bp, Artificial Sequence
  Synthetic Polynucleotide
taatacgactcactatagggcctgcagctggtccagcccctctggctggtaacagaggagaaccagcatgaggggctggaacctggcggcagcgcaaaagatg

SEQ ID NO: 144431 - DNA, 103 bp, Artificial Sequence
  Synthetic Polynucleotide
taatacgactcactatagggttggtctgggcctgcagctggtccagccccaacagaggagaggggctatgccagctgcaaacctggcggcagcgcaaaagatg

SEQ ID NO: 144432 - DNA, 103 bp, Artificial Sequence
  Synthetic Polynucleotide
taatacgactcactatagggcttggtgaacttggtctgggcctgcagctgaacagaggagacagctgatggcccagaccaacctggcggcagcgcaaaagatg

SEQ ID NO: 144433 - DNA, 103 bp, Artificial Sequence
  Synthetic Polynucleotide
taatacgactcactataggggcagctccttcttggtgaacttggtctgggaacagaggagacccagaatgagttcaccaaacctggcggcagcgcaaaagatg

SEQ ID NO: 144434 - DNA, 103 bp, Artificial Sequence
  Synthetic Polynucleotide
taatacgactcactatagggtagagagactgcagctccttcttggtgaacaacagaggagagttcacatggaaggagctaacctggcggcagcgcaaaagatg

SEQ ID NO: 144435 - DNA, 103 bp, Artificial Sequence
  Synthetic Polynucleotide
taatacgactcactatagggaaagcccctgtagagagactgcagctccttaacagaggagaaaggagatgcagtctctcaacctggcggcagcgcaaaagatg

SEQ ID NO: 144436 - DNA, 103 bp, Artificial Sequence
  Synthetic Polynucleotide
taatacgactcactatagggactcattcttaaagcccctgtagagagactaacagaggagaagtctcatgacaggggctaacctggcggcagcgcaaaagatg

SEQ ID NO: 144437 - DNA, 103 bp, Artificial Sequence
  Synthetic Polynucleotide
taatacgactcactatagggcccaggaggctgccgtccgacgcctttgtcaacagaggagagacaaaatggtcggacggaacctggcggcagcgcaaaagatg

SEQ ID NO: 144438 - DNA, 103 bp, Artificial Sequence
  Synthetic Polynucleotide
taatacgactcactatagggcccgtgggacactcattcttaaagcccctgaacagaggagacaggggatgtaagaatgaaacctggcggcagcgcaaaagatg

SEQ ID NO: 144439 - DNA, 103 bp, Artificial Sequence
  Synthetic Polynucleotide
taatacgactcactataggggtccaccaggcccgtgggacactcattcttaacagaggagaaagaatatgtgtcccacgaacctggcggcagcgcaaaagatg

SEQ ID NO: 144440 - DNA, 103 bp, Artificial Sequence
  Synthetic Polynucleotide
taatacgactcactatagggaggtgtcttcgtccaccaggcccgtgggacaacagaggagagtcccaatggcctggtggaacctggcggcagcgcaaaagatg

SEQ ID NO: 144441 - DNA, 103 bp, Artificial Sequence
  Synthetic Polynucleotide
taatacgactcactatagggatgagtttgaaggtgtcttcgtccaccaggaacagaggagacctggtatgcgaagacacaacctggcggcagcgcaaaagatg

SEQ ID NO: 144442 - DNA, 103 bp, Artificial Sequence
  Synthetic Polynucleotide
taatacgactcactatagggctgcgcgtaaatgagtttgaaggtgtcttcaacagaggagagaagacatgttcaaactcaacctggcggcagcgcaaaagatg

SEQ ID NO: 144443 - DNA, 103 bp, Artificial Sequence
  Synthetic Polynucleotide
taatacgactcactataggggagggaagaactgcgcgtaaatgagtttgaaacagaggagatcaaacatgtttacgcgcaacctggcggcagcgcaaaagatg

SEQ ID NO: 144444 - DNA, 103 bp, Artificial Sequence
  Synthetic Polynucleotide
taatacgactcactataggggcatctccctgagggaagaactgcgcgtaaaacagaggagattacgcatggttcttcccaacctggcggcagcgcaaaagatg

SEQ ID NO: 144445 - DNA, 103 bp, Artificial Sequence
  Synthetic Polynucleotide
taatacgactcactatagggataggtggtggcatctccctgagggaagaaaacagaggagattcttcatgcagggagataacctggcggcagcgcaaaagatg

SEQ ID NO: 144446 - DNA, 103 bp, Artificial Sequence
  Synthetic Polynucleotide
taatacgactcactatagggggaagtgtgcataggtggtggcatctccctaacagaggagaagggagatgccaccacctaacctggcggcagcgcaaaagatg

SEQ ID NO: 144447 - DNA, 103 bp, Artificial Sequence
  Synthetic Polynucleotide
taatacgactcactataggggcgttgaagaggaagtgtgcataggtggtgaacagaggagacaccacatgtgcacacttaacctggcggcagcgcaaaagatg

SEQ ID NO: 144448 - DNA, 103 bp, Artificial Sequence
  Synthetic Polynucleotide
taatacgactcactatagggcccgaggtcccccaggaggctgccgtccgaaacagaggagatcggacatgagcctcctgaacctggcggcagcgcaaaagatg

SEQ ID NO: 144449 - DNA, 103 bp, Artificial Sequence
  Synthetic Polynucleotide
taatacgactcactatagggcgcatcaaaggcgttgaagaggaagtgtgcaacagaggagagcacacatgctcttcaacaacctggcggcagcgcaaaagatg

SEQ ID NO: 144450 - DNA, 103 bp, Artificial Sequence
  Synthetic Polynucleotide
taatacgactcactatagggcgttcccgtccgcatcaaaggcgttgaagaaacagaggagatcttcaatgcctttgatgaacctggcggcagcgcaaaagatg

SEQ ID NO: 144451 - DNA, 103 bp, Artificial Sequence
  Synthetic Polynucleotide
taatacgactcactatagggtggatggccccgttcccgtccgcatcaaagaacagaggagactttgaatgggacgggaaaacctggcggcagcgcaaaagatg

SEQ ID NO: 144452 - DNA, 103 bp, Artificial Sequence
  Synthetic Polynucleotide
taatacgactcactataggggtcctcaaagtggatggccccgttcccgtcaacagaggagagacgggatgggggccatcaacctggcggcagcgcaaaagatg

SEQ ID NO: 144453 - DNA, 103 bp, Artificial Sequence
  Synthetic Polynucleotide
taatacgactcactatagggcaaccacaaagtcctcaaagtggatggcccaacagaggagagggccaatgactttgaggaacctggcggcagcgcaaaagatg

SEQ ID NO: 144454 - DNA, 103 bp, Artificial Sequence
  Synthetic Polynucleotide
taatacgactcactatagggatggagaggccaaccacaaagtcctcaaagaacagaggagactttgaatgctttgtggtaacctggcggcagcgcaaaagatg

SEQ ID NO: 144455 - DNA, 103 bp, Artificial Sequence
  Synthetic Polynucleotide
taatacgactcactatagggccgcagcaggatggagaggccaaccacaaaaacagaggagatttgtgatgggcctctccaacctggcggcagcgcaaaagatg

SEQ ID NO: 144456 - DNA, 103 bp, Artificial Sequence
  Synthetic Polynucleotide
taatacgactcactatagggggactgtgccccgcagcaggatggagaggcaacagaggagagcctctatgtcctgctgcaacctggcggcagcgcaaaagatg

SEQ ID NO: 144457 - DNA, 103 bp, Artificial Sequence
  Synthetic Polynucleotide
taatacgactcactatagggagcttctcgtggactgtgccccgcagcaggaacagaggagacctgctatggggcacagtaacctggcggcagcgcaaaagatg

SEQ ID NO: 144458 - DNA, 103 bp, Artificial Sequence
  Synthetic Polynucleotide
taatacgactcactatagggggcccacttgagcttctcgtggactgtgccaacagaggagaggcacaatgcacgagaagaacctggcggcagcgcaaaagatg

SEQ ID NO: 144459 - DNA, 103 bp, Artificial Sequence
  Synthetic Polynucleotide
taatacgactcactataggggtggtgtgtgcccgaggtcccccaggaggcaacagaggagagcctccatggggacctcgaacctggcggcagcgcaaaagatg

SEQ ID NO: 144460 - DNA, 103 bp, Artificial Sequence
  Synthetic Polynucleotide
taatacgactcactatagggagagattaaaggcccacttgagcttctcgtaacagaggagaacgagaatgtcaagtgggaacctggcggcagcgcaaaagatg

SEQ ID NO: 144461 - DNA, 103 bp, Artificial Sequence
  Synthetic Polynucleotide
taatacgactcactatagggttaatgtcgtagagattaaaggcccacttgaacagaggagacaagtgatgctttaatctaacctggcggcagcgcaaaagatg

SEQ ID NO: 144462 - DNA, 103 bp, Artificial Sequence
  Synthetic Polynucleotide
taatacgactcactataggggccatccttgttaatgtcgtagagattaaaaacagaggagatttaatatgtacgacattaacctggcggcagcgcaaaagatg

SEQ ID NO: 144463 - DNA, 103 bp, Artificial Sequence
  Synthetic Polynucleotide
taatacgactcactatagggtggtgatgtagccatccttgttaatgtcgtaacagaggagaacgacaatgacaaggatgaacctggcggcagcgcaaaagatg

SEQ ID NO: 144464 - DNA, 103 bp, Artificial Sequence
  Synthetic Polynucleotide
taatacgactcactatagggatctcctctttggtgatgtagccatccttgaacagaggagacaaggaatgctacatcacaacctggcggcagcgcaaaagatg

SEQ ID NO: 144465 - DNA, 103 bp, Artificial Sequence
  Synthetic Polynucleotide
taatacgactcactataggggatggccagcatctcctctttggtgatgtaaacagaggagatacatcatgaaagaggagaacctggcggcagcgcaaaagatg

SEQ ID NO: 144466 - DNA, 103 bp, Artificial Sequence
  Synthetic Polynucleotide
taatacgactcactatagggtggacttcatgatggccagcatctcctcttaacagaggagaaagaggatgtgctggccaaacctggcggcagcgcaaaagatg

SEQ ID NO: 144467 - DNA, 103 bp, Artificial Sequence
  Synthetic Polynucleotide
taatacgactcactatagggatgtcatagatggacttcatgatggccagcaacagaggagagctggcatgcatgaagtcaacctggcggcagcgcaaaagatg

SEQ ID NO: 144468 - DNA, 103 bp, Artificial Sequence
  Synthetic Polynucleotide
taatacgactcactataggggcggcccatcatgtcatagatggacttcataacagaggagaatgaagatgatctatgacaacctggcggcagcgcaaaagatg

SEQ ID NO: 144469 - DNA, 103 bp, Artificial Sequence
  Synthetic Polynucleotide
taatacgactcactatagggggtaggtgtggcggcccatcatgtcatagaaacagaggagatctatgatgtgatgggccaacctggcggcagcgcaaaagatg

SEQ ID NO: 144470 - DNA, 103 bp, Artificial Sequence
  Synthetic Polynucleotide
taatacgactcactatagggttcttgctaagtggtgtgtgcccgaggtccaacagaggagaggacctatggcacacaccaacctggcggcagcgcaaaagatg

SEQ ID NO: 144471 - DNA, 103 bp, Artificial Sequence
  Synthetic Polynucleotide
taatacgactcactatagggcgcaggatggggtaggtgtggcggcccatcaacagaggagagatgggatgccacacctaaacctggcggcagcgcaaaagatg

SEQ ID NO: 144472 - DNA, 103 bp, Artificial Sequence
  Synthetic Polynucleotide
taatacgactcactatagggcgcgtcctcccgcaggatggggtaggtgtgaacagaggagacacaccatgcccatcctgaacctggcggcagcgcaaaagatg

SEQ ID NO: 144473 - DNA, 103 bp, Artificial Sequence
  Synthetic Polynucleotide
taatacgactcactataggggctccgccggcgcgtcctcccgcaggatggaacagaggagaccatccatggggaggacgaacctggcggcagcgcaaaagatg

SEQ ID NO: 144474 - DNA, 103 bp, Artificial Sequence
  Synthetic Polynucleotide
taatacgactcactatagggctctccacgtgctccgccggcgcgtcctccaacagaggagaggaggaatggccggcggaaacctggcggcagcgcaaaagatg

SEQ ID NO: 144475 - DNA, 103 bp, Artificial Sequence
  Synthetic Polynucleotide
taatacgactcactatagggctcgaagaacctctccacgtgctccgccggaacagaggagaccggcgatgcacgtggagaacctggcggcagcgcaaaagatg

SEQ ID NO: 144476 - DNA, 103 bp, Artificial Sequence
  Synthetic Polynucleotide
taatacgactcactatagggggtccattttctcgaagaacctctccacgtaacagaggagaacgtggatgggttcttcgaacctggcggcagcgcaaaagatg

SEQ ID NO: 144477 - DNA, 103 bp, Artificial Sequence
  Synthetic Polynucleotide
taatacgactcactatagggtcctggttccggtccattttctcgaagaacaacagaggagagttcttatggaaaatggaaacctggcggcagcgcaaaagatg

SEQ ID NO: 144478 - DNA, 103 bp, Artificial Sequence
  Synthetic Polynucleotide
taatacgactcactatagggcactaccccatcctggttccggtccattttaacagaggagaaaaatgatgcggaaccagaacctggcggcagcgcaaaagatg

SEQ ID NO: 144479 - DNA, 103 bp, Artificial Sequence
  Synthetic Polynucleotide
taatacgactcactatagggcttcaatggtcactaccccatcctggttccaacagaggagaggaaccatgatggggtagaacctggcggcagcgcaaaagatg

SEQ ID NO: 144480 - DNA, 103 bp, Artificial Sequence
  Synthetic Polynucleotide
taatacgactcactatagggtccaggaactcttcaatggtcactaccccaaacagaggagatggggtatggaccattgaaacctggcggcagcgcaaaagatg

SEQ ID NO: 144481 - DNA, 103 bp, Artificial Sequence
  Synthetic Polynucleotide
taatacgactcactataggggataccctccttcttgctaagtggtgtgtgaacagaggagacacacaatgcttagcaagaacctggcggcagcgcaaaagatg

SEQ ID NO: 144482 - DNA, 103 bp, Artificial Sequence
  Synthetic Polynucleotide
taatacgactcactatagggctgacaggcctccaggaactcttcaatggtaacagaggagaaccattatggagttcctgaacctggcggcagcgcaaaagatg

SEQ ID NO: 144483 - DNA, 103 bp, Artificial Sequence
  Synthetic Polynucleotide
taatacgactcactatagggtctcatccttctgacaggcctccaggaactaacagaggagaagttccatgaggcctgtcaacctggcggcagcgcaaaagatg

SEQ ID NO: 144484 - DNA, 103 bp, Artificial Sequence
  Synthetic Polynucleotide
taatacgactcactatagggctcatgatgttctcatccttctgacaggccaacagaggagaggcctgatggaaggatgaaacctggcggcagcgcaaaagatg

SEQ ID NO: 144485 - DNA, 103 bp, Artificial Sequence
  Synthetic Polynucleotide
taatacgactcactatagggctgcatggagctcatgatgttctcatccttaacagaggagaaaggatatgaacatcatgaacctggcggcagcgcaaaagatg

SEQ ID NO: 144486 - DNA, 103 bp, Artificial Sequence
  Synthetic Polynucleotide
taatacgactcactatagggtctcaaacagctgcatggagctcatgatgtaacagaggagaacatcaatggctccatgcaacctggcggcagcgcaaaagatg

SEQ ID NO: 144487 - DNA, 103 bp, Artificial Sequence
  Synthetic Polynucleotide
taatacgactcactatagggtagatgacattctcaaacagctgcatggagaacagaggagactccatatggctgtttgaaacctggcggcagcgcaaaagatg

SEQ ID NO: 144488 - DNA, 103 bp, Artificial Sequence
  Synthetic Polynucleotide
taatacgactcactatagggtctgccacttgataccctccttcttgctaaaacagaggagattagcaatgaggagggtaaacctggcggcagcgcaaaagatg

SEQ ID NO: 144489 - DNA, 103 bp, Artificial Sequence
  Synthetic Polynucleotide
taatacgactcactatagggagcctcggcctctgccacttgataccctccaacagaggagaggagggatgcaagtggcaaacctggcggcagcgcaaaagatg

SEQ ID NO: 144490 - DNA, 103 bp, Artificial Sequence
  Synthetic Polynucleotide
taatacgactcactatagggcgcggctgccgccttcttcccagataacataacagaggagaatgttaatggggaagaagaacctggcggcagcgcaaaagatg

SEQ ID NO: 144491 - DNA, 103 bp, Artificial Sequence
  Synthetic Polynucleotide
taatacgactcactatagggctgcgcggccacctcagacccgttctcggaaacagaggagatccgagatggggtctgagaacctggcggcagcgcaaaagatg

SEQ ID NO: 144492 - DNA, 103 bp, Artificial Sequence
  Synthetic Polynucleotide
taatacgactcactatagggaaatgtggcaactcgtccacccacacgatcaacagaggagagatcgtatgggtggacgaaacctggcggcagcgcaaaagatg

SEQ ID NO: 144493 - DNA, 103 bp, Artificial Sequence
  Synthetic Polynucleotide
taatacgactcactatagggttcctttgcgaaatgtggcaactcgtccacaacagaggagagtggacatgttgccacataacctggcggcagcgcaaaagatg

SEQ ID NO: 144494 - DNA, 103 bp, Artificial Sequence
  Synthetic Polynucleotide
taatacgactcactataggggctacatagtttcctttgcgaaatgtggcaaacagaggagatgccacatgtcgcaaaggaacctggcggcagcgcaaaagatg

SEQ ID NO: 144495 - DNA, 103 bp, Artificial Sequence
  Synthetic Polynucleotide
taatacgactcactatagggtccaagatcagctacatagtttcctttgcgaacagaggagacgcaaaatgaactatgtaaacctggcggcagcgcaaaagatg

SEQ ID NO: 144496 - DNA, 103 bp, Artificial Sequence
  Synthetic Polynucleotide
taatacgactcactatagggccaccatggctccaagatcagctacatagtaacagaggagaactatgatgctgatcttgaacctggcggcagcgcaaaagatg

SEQ ID NO: 144497 - DNA, 103 bp, Artificial Sequence
  Synthetic Polynucleotide
taatacgactcactatagggagacctgttaccaccatggctccaagatcaaacagaggagatgatctatgagccatggtaacctggcggcagcgcaaaagatg

SEQ ID NO: 144498 - DNA, 103 bp, Artificial Sequence
  Synthetic Polynucleotide
taatacgactcactatagggattccctccaagacctgttaccaccatggcaacagaggagagccatgatggtaacaggtaacctggcggcagcgcaaaagatg

SEQ ID NO: 144499 - DNA, 103 bp, Artificial Sequence
  Synthetic Polynucleotide
taatacgactcactatagggcagccataggattccctccaagacctgttaaacagaggagataacagatgttggagggaaacctggcggcagcgcaaaagatg

SEQ ID NO: 144500 - DNA, 103 bp, Artificial Sequence
  Synthetic Polynucleotide
taatacgactcactatagggttgctgaccacagccataggattccctccaaacagaggagatggaggatgtcctatggcaacctggcggcagcgcaaaagatg

SEQ ID NO: 144501 - DNA, 103 bp, Artificial Sequence
  Synthetic Polynucleotide
taatacgactcactatagggatttacttgtttgctgaccacagccataggaacagaggagacctatgatggtggtcagcaacctggcggcagcgcaaaagatg

SEQ ID NO: 144502 - DNA, 103 bp, Artificial Sequence
  Synthetic Polynucleotide
taatacgactcactatagggggcccgcgggctgcgcggccacctcagaccaacagaggagaggtctgatgtggccgcgcaacctggcggcagcgcaaaagatg

SEQ ID NO: 144503 - DNA, 103 bp, Artificial Sequence
  Synthetic Polynucleotide
taatacgactcactatagggccagttccatatttacttgtttgctgaccaaacagaggagatggtcaatgaacaagtaaaacctggcggcagcgcaaaagatg

SEQ ID NO: 144504 - DNA, 103 bp, Artificial Sequence
  Synthetic Polynucleotide
taatacgactcactatagggttgatcttggccagttccatatttacttgtaacagaggagaacaagtatgtatggaactaacctggcggcagcgcaaaagatg

SEQ ID NO: 144505 - DNA, 103 bp, Artificial Sequence
  Synthetic Polynucleotide
taatacgactcactataggggcatttttgcttgatcttggccagttccataacagaggagaatggaaatggccaagatcaacctggcggcagcgcaaaagatg

SEQ ID NO: 144506 - DNA, 103 bp, Artificial Sequence
  Synthetic Polynucleotide
taatacgactcactatagggcataaagtgggcatttttgcttgatcttggaacagaggagaccaagaatgagcaaaaataacctggcggcagcgcaaaagatg

SEQ ID NO: 144507 - DNA, 103 bp, Artificial Sequence
  Synthetic Polynucleotide
taatacgactcactatagggccgttggcttcataaagtgggcatttttgcaacagaggagagcaaaaatgcccactttaaacctggcggcagcgcaaaagatg

SEQ ID NO: 144508 - DNA, 103 bp, Artificial Sequence
  Synthetic Polynucleotide
taatacgactcactataggggtcagcttgtccgttggcttcataaagtggaacagaggagaccacttatggaagccaacaacctggcggcagcgcaaaagatg

SEQ ID NO: 144509 - DNA, 103 bp, Artificial Sequence
  Synthetic Polynucleotide
taatacgactcactatagggccttgacagtgtcagcttgtccgttggcttaacagaggagaaagccaatggacaagctgaacctggcggcagcgcaaaagatg

SEQ ID NO: 144510 - DNA, 103 bp, Artificial Sequence
  Synthetic Polynucleotide
taatacgactcactatagggtctttaggaaccttgacagtgtcagcttgtaacagaggagaacaagcatgcactgtcaaaacctggcggcagcgcaaaagatg

SEQ ID NO: 144511 - DNA, 103 bp, Artificial Sequence
  Synthetic Polynucleotide
taatacgactcactatagggttcatctttctctttaggaaccttgacagtaacagaggagaactgtcatggttcctaaaaacctggcggcagcgcaaaagatg

SEQ ID NO: 144512 - DNA, 103 bp, Artificial Sequence
  Synthetic Polynucleotide
taatacgactcactataggggctctaccatttcatctttctctttaggaaaacagaggagattcctaatgagaaagatgaacctggcggcagcgcaaaagatg

SEQ ID NO: 144513 - DNA, 103 bp, Artificial Sequence
  Synthetic Polynucleotide
taatacgactcactataggggggcccgacaggcccgcgggctgcgcggccaacagaggagaggccgcatggcccgcgggaacctggcggcagcgcaaaagatg

SEQ ID NO: 144514 - DNA, 103 bp, Artificial Sequence
  Synthetic Polynucleotide
taatacgactcactatagggttaaactcttgctctaccatttcatctttcaacagaggagagaaagaatgaatggtagaaacctggcggcagcgcaaaagatg

SEQ ID NO: 144515 - DNA, 103 bp, Artificial Sequence
  Synthetic Polynucleotide
taatacgactcactatagggtagcaaccggttaaactcttgctctaccataacagaggagaatggtaatgcaagagtttaacctggcggcagcgcaaaagatg

SEQ ID NO: 144516 - DNA, 103 bp, Artificial Sequence
  Synthetic Polynucleotide
taatacgactcactatagggatgtagcttctagcaaccggttaaactcttaacagaggagaaagagtatgaccggttgcaacctggcggcagcgcaaaagatg

SEQ ID NO: 144517 - DNA, 103 bp, Artificial Sequence
  Synthetic Polynucleotide
taatacgactcactatagggctaaggtaagatgtagcttctagcaaccggaacagaggagaccggttatgagaagctacaacctggcggcagcgcaaaagatg

SEQ ID NO: 144518 - DNA, 103 bp, Artificial Sequence
  Synthetic Polynucleotide
taatacgactcactatagggtagttgatgactaaggtaagatgtagcttcaacagaggagagaagctatgtcttaccttaacctggcggcagcgcaaaagatg

SEQ ID NO: 144519 - DNA, 103 bp, Artificial Sequence
  Synthetic Polynucleotide
taatacgactcactatagggcattgaagtctagttgatgactaaggtaagaacagaggagacttaccatggtcatcaacaacctggcggcagcgcaaaagatg

SEQ ID NO: 144520 - DNA, 103 bp, Artificial Sequence
  Synthetic Polynucleotide
taatacgactcactatagggttattgaggacattgaagtctagttgatgaaacagaggagatcatcaatgagacttcaaaacctggcggcagcgcaaaagatg

SEQ ID NO: 144521 - DNA, 103 bp, Artificial Sequence
  Synthetic Polynucleotide
taatacgactcactatagggcacaggcttattattgaggacattgaagtcaacagaggagagacttcatggtcctcaataacctggcggcagcgcaaaagatg

SEQ ID NO: 144522 - DNA, 103 bp, Artificial Sequence
  Synthetic Polynucleotide
taatacgactcactatagggggccaagggacacaggcttattattgaggaaacagaggagatcctcaatgataagcctgaacctggcggcagcgcaaaagatg

SEQ ID NO: 144523 - DNA, 103 bp, Artificial Sequence
  Synthetic Polynucleotide
taatacgactcactatagggtccaatgcctggccaagggacacaggcttaaacagaggagataagccatggtcccttggaacctggcggcagcgcaaaagatg

SEQ ID NO: 144524 - DNA, 103 bp, Artificial Sequence
  Synthetic Polynucleotide
taatacgactcactataggggacctcggctgggcccgacaggcccgcgggaacagaggagacccgcgatgctgtcgggcaacctggcggcagcgcaaaagatg

SEQ ID NO: 144525 - DNA, 103 bp, Artificial Sequence
  Synthetic Polynucleotide
taatacgactcactatagggaatgacaacttccaatgcctggccaagggaaacagaggagatcccttatgcaggcattgaacctggcggcagcgcaaaagatg

SEQ ID NO: 144526 - DNA, 103 bp, Artificial Sequence
  Synthetic Polynucleotide
taatacgactcactatagggcttgtaactgaatgacaacttccaatgcctaacagaggagaaggcatatgaagttgtcaaacctggcggcagcgcaaaagatg

SEQ ID NO: 144527 - DNA, 103 bp, Artificial Sequence
  Synthetic Polynucleotide
taatacgactcactatagggacatgcttctcttgtaactgaatgacaactaacagaggagaagttgtatgtcagttacaaacctggcggcagcgcaaaagatg

SEQ ID NO: 144528 - DNA, 103 bp, Artificial Sequence
  Synthetic Polynucleotide
taatacgactcactatagggctcatctttgacatgcttctcttgtaactgaacagaggagacagttaatggagaagcataacctggcggcagcgcaaaagatg

SEQ ID NO: 144529 - DNA, 103 bp, Artificial Sequence
  Synthetic Polynucleotide
taatacgactcactataggggttcaatctgctcatctttgacatgcttctaacagaggagaagaagcatgtcaaagatgaacctggcggcagcgcaaaagatg

SEQ ID NO: 144530 - DNA, 103 bp, Artificial Sequence
  Synthetic Polynucleotide
taatacgactcactatagggttcttccaatgttcaatctgctcatctttgaacagaggagacaaagaatggcagattgaaacctggcggcagcgcaaaagatg

SEQ ID NO: 144531 - DNA, 103 bp, Artificial Sequence
  Synthetic Polynucleotide
taatacgactcactatagggtttcactatcttcttccaatgttcaatctgaacagaggagacagattatgcattggaagaacctggcggcagcgcaaaagatg

SEQ ID NO: 144532 - DNA, 103 bp, Artificial Sequence
  Synthetic Polynucleotide
taatacgactcactatagggcttcctgagttttcactatcttcttccaataacagaggagaattggaatgagatagtgaaacctggcggcagcgcaaaagatg

SEQ ID NO: 144533 - DNA, 103 bp, Artificial Sequence
  Synthetic Polynucleotide
taatacgactcactatagggtctttcaattcttcctgagttttcactatcaacagaggagagatagtatgaactcaggaaacctggcggcagcgcaaaagatg

SEQ ID NO: 144534 - DNA, 103 bp, Artificial Sequence
  Synthetic Polynucleotide
taatacgactcactatagggattaagaagttctttcaattcttcctgagtaacagaggagaactcagatggaattgaaaaacctggcggcagcgcaaaagatg

SEQ ID NO: 144535 - DNA, 103 bp, Artificial Sequence
  Synthetic Polynucleotide
taatacgactcactatagggcccccggcccgacctcggctgggcccgacaaacagaggagatgtcggatgcagccgaggaacctggcggcagcgcaaaagatg

SEQ ID NO: 144536 - DNA, 103 bp, Artificial Sequence
  Synthetic Polynucleotide
taatacgactcactatagggttaccatcttattaagaagttctttcaattaacagaggagaaattgaatgaacttcttaaacctggcggcagcgcaaaagatg

SEQ ID NO: 144537 - DNA, 103 bp, Artificial Sequence
  Synthetic Polynucleotide
taatacgactcactatagggtctttcaaatttaccatcttattaagaagtaacagaggagaacttctatgtaagatggtaacctggcggcagcgcaaaagatg

SEQ ID NO: 144538 - DNA, 103 bp, Artificial Sequence
  Synthetic Polynucleotide
taatacgactcactatagggtttaattttctctttcaaatttaccatcttaacagaggagaaagatgatgaatttgaaaaacctggcggcagcgcaaaagatg

SEQ ID NO: 144539 - DNA, 103 bp, Artificial Sequence
  Synthetic Polynucleotide
taatacgactcactataggggatggagttctttaattttctctttcaaataacagaggagaatttgaatgagaaaattaaacctggcggcagcgcaaaagatg

SEQ ID NO: 144540 - DNA, 103 bp, Artificial Sequence
  Synthetic Polynucleotide
taatacgactcactatagggttgtattgctgatggagttctttaattttcaacagaggagagaaaatatgagaactccaaacctggcggcagcgcaaaagatg

SEQ ID NO: 144541 - DNA, 103 bp, Artificial Sequence
  Synthetic Polynucleotide
taatacgactcactatagggagatgcttctttgtattgctgatggagttcaacagaggagagaactcatgcagcaatacaacctggcggcagcgcaaaagatg

SEQ ID NO: 144542 - DNA, 103 bp, Artificial Sequence
  Synthetic Polynucleotide
taatacgactcactataggggctttacttcagatgcttctttgtattgctaacagaggagaagcaatatgaagaagcataacctggcggcagcgcaaaagatg

SEQ ID NO: 144543 - DNA, 103 bp, Artificial Sequence
  Synthetic Polynucleotide
taatacgactcactatagggtctctgggtggctttacttcagatgcttctaacagaggagaagaagcatgtgaagtaaaaacctggcggcagcgcaaaagatg

SEQ ID NO: 144544 - DNA, 103 bp, Artificial Sequence
  Synthetic Polynucleotide
taatacgactcactatagggggcagtaatatctctgggtggctttacttcaacagaggagagaagtaatgccacccagaaacctggcggcagcgcaaaagatg

SEQ ID NO: 144545 - DNA, 103 bp, Artificial Sequence
  Synthetic Polynucleotide
taatacgactcactatagggctaagaactcggcagtaatatctctgggtgaacagaggagacacccaatgatattactgaacctggcggcagcgcaaaagatg

SEQ ID NO: 144546 - DNA, 103 bp, Artificial Sequence
  Synthetic Polynucleotide
taatacgactcactatagggtcccccaccgcccccggcccgacctcggctaacagaggagaagccgaatgcgggccgggaacctggcggcagcgcaaaagatg

SEQ ID NO: 144547 - DNA, 103 bp, Artificial Sequence
  Synthetic Polynucleotide
taatacgactcactatagggttgcttttcactaagaactcggcagtaataaacagaggagatattacatgcgagttcttaacctggcggcagcgcaaaagatg

SEQ ID NO: 144548 - DNA, 103 bp, Artificial Sequence
  Synthetic Polynucleotide
taatacgactcactatagggatccctgtgtttgcttttcactaagaactcaacagaggagagagttcatggtgaaaagcaacctggcggcagcgcaaaagatg

SEQ ID NO: 144549 - DNA, 103 bp, Artificial Sequence
  Synthetic Polynucleotide
taatacgactcactataggggggcggtcagatccctgtgtttgcttttcaaacagaggagatgaaaaatgaacacagggaacctggcggcagcgcaaaagatg

SEQ ID NO: 144550 - DNA, 103 bp, Artificial Sequence
  Synthetic Polynucleotide
taatacgactcactatagggtccttgcatagggcggtcagatccctgtgtaacagaggagaacacagatgtctgaccgcaacctggcggcagcgcaaaagatg

SEQ ID NO: 144551 - DNA, 103 bp, Artificial Sequence
  Synthetic Polynucleotide
taatacgactcactatagggttcatcatattccttgcatagggcggtcagaacagaggagactgaccatgctatgcaagaacctggcggcagcgcaaaagatg

SEQ ID NO: 144552 - DNA, 103 bp, Artificial Sequence
  Synthetic Polynucleotide
taatacgactcactatagggtttcagctaattcatcatattccttgcataaacagaggagatatgcaatgaatatgatgaacctggcggcagcgcaaaagatg

SEQ ID NO: 144553 - DNA, 103 bp, Artificial Sequence
  Synthetic Polynucleotide
taatacgactcactatagggtttccttgtgtttcagctaattcatcatataacagaggagaatatgaatgattagctgaaacctggcggcagcgcaaaagatg

SEQ ID NO: 144554 - DNA, 103 bp, Artificial Sequence
  Synthetic Polynucleotide
taatacgactcactatagggttcttctagctttccttgtgtttcagctaaaacagaggagattagctatgacacaaggaaacctggcggcagcgcaaaagatg

SEQ ID NO: 144555 - DNA, 103 bp, Artificial Sequence
  Synthetic Polynucleotide
taatacgactcactatagggcctgaagtttttcttctagctttccttgtgaacagaggagacacaagatgagctagaagaacctggcggcagcgcaaaagatg

SEQ ID NO: 144556 - DNA, 103 bp, Artificial Sequence
  Synthetic Polynucleotide
taatacgactcactataggggcttccaactcctgaagtttttcttctagcaacagaggagagctagaatgaaaacttcaaacctggcggcagcgcaaaagatg

SEQ ID NO: 144557 - DNA, 103 bp, Artificial Sequence
  Synthetic Polynucleotide
taatacgactcactataggggggtgtgcgctcccccaccgcccccggcccaacagaggagagggccgatggcggtggggaacctggcggcagcgcaaaagatg

SEQ ID NO: 144558 - DNA, 103 bp, Artificial Sequence
  Synthetic Polynucleotide
taatacgactcactatagggtgggggattcgcttccaactcctgaagtttaacagaggagaaaacttatggagttggaaaacctggcggcagcgcaaaagatg

SEQ ID NO: 144559 - DNA, 103 bp, Artificial Sequence
  Synthetic Polynucleotide
taatacgactcactatagggatacatcacttgggggattcgcttccaactaacagaggagaagttggatgcgaatccccaacctggcggcagcgcaaaagatg

SEQ ID NO: 144560 - DNA, 103 bp, Artificial Sequence
  Synthetic Polynucleotide
taatacgactcactataggggatgagagatatacatcacttgggggattcaacagaggagagaatccatgaagtgatgtaacctggcggcagcgcaaaagatg

SEQ ID NO: 144561 - DNA, 103 bp, Artificial Sequence
  Synthetic Polynucleotide
taatacgactcactatagggtctgtctcttgatgagagatatacatcactaacagaggagaagtgatatgtatctctcaaacctggcggcagcgcaaaagatg

SEQ ID NO: 144562 - DNA, 103 bp, Artificial Sequence
  Synthetic Polynucleotide
taatacgactcactatagggcaagtatttgtctgtctcttgatgagagataacagaggagaatctctatgcaagagacaaacctggcggcagcgcaaaagatg

SEQ ID NO: 144563 - DNA, 103 bp, Artificial Sequence
  Synthetic Polynucleotide
taatacgactcactatagggaaatgccaatcaagtatttgtctgtctcttaacagaggagaaagagaatgacaaatactaacctggcggcagcgcaaaagatg

SEQ ID NO: 144564 - DNA, 103 bp, Artificial Sequence
  Synthetic Polynucleotide
taatacgactcactatagggaagatttgcaaaatgccaatcaagtatttgaacagaggagacaaataatggattggcataacctggcggcagcgcaaaagatg

SEQ ID NO: 144565 - DNA, 103 bp, Artificial Sequence
  Synthetic Polynucleotide
taatacgactcactatagggtagcaaattcaagatttgcaaaatgccaataacagaggagaattggcatgttgcaaatcaacctggcggcagcgcaaaagatg

SEQ ID NO: 144566 - DNA, 103 bp, Artificial Sequence
  Synthetic Polynucleotide
taatacgactcactatagggggtgtggcattagcaaattcaagatttgcaaacagaggagatgcaaaatgtgaatttgcaacctggcggcagcgcaaaagatg

SEQ ID NO: 144567 - DNA, 103 bp, Artificial Sequence
  Synthetic Polynucleotide
taatacgactcactatagggagttgagagaggtgtggcattagcaaattcaacagaggagagaatttatgaatgccacaaacctggcggcagcgcaaaagatg

SEQ ID NO: 144568 - DNA, 103 bp, Artificial Sequence
  Synthetic Polynucleotide
taatacgactcactatagggctttcttgcggggtgtgcgctcccccaccgaacagaggagacggtggatgagcgcacacaacctggcggcagcgcaaaagatg

SEQ ID NO: 144569 - DNA, 103 bp, Artificial Sequence
  Synthetic Polynucleotide
taatacgactcactatagggtaagggagagagttgagagaggtgtggcataacagaggagaatgccaatgctctctcaaaacctggcggcagcgcaaaagatg

SEQ ID NO: 144570 - DNA, 103 bp, Artificial Sequence
  Synthetic Polynucleotide
taatacgactcactatagggtcccagtgcttaagggagagagttgagagaaacagaggagatctctcatgtctctccctaacctggcggcagcgcaaaagatg

SEQ ID NO: 144571 - DNA, 103 bp, Artificial Sequence
  Synthetic Polynucleotide
taatacgactcactatagggatcatcctgatcccagtgcttaagggagagaacagaggagactctccatgaagcactggaacctggcggcagcgcaaaagatg

SEQ ID NO: 144572 - DNA, 103 bp, Artificial Sequence
  Synthetic Polynucleotide
taatacgactcactatagggactcaaagtcatcatcctgatcccagtgctaacagaggagaagcactatgatcaggatgaacctggcggcagcgcaaaagatg

SEQ ID NO: 144573 - DNA, 103 bp, Artificial Sequence
  Synthetic Polynucleotide
taatacgactcactatagggctgccagtgaactcaaagtcatcatcctgaaacagaggagatcaggaatgtgactttgaaacctggcggcagcgcaaaagatg

SEQ ID NO: 144574 - DNA, 103 bp, Artificial Sequence
  Synthetic Polynucleotide
taatacgactcactatagggtgtcaggtggctgccagtgaactcaaagtcaacagaggagagactttatgttcactggcaacctggcggcagcgcaaaagatg

SEQ ID NO: 144575 - DNA, 103 bp, Artificial Sequence
  Synthetic Polynucleotide
taatacgactcactatagggcattccttactgtcaggtggctgccagtgaaacagaggagatcactgatggccacctgaaacctggcggcagcgcaaaagatg

SEQ ID NO: 144576 - DNA, 103 bp, Artificial Sequence
  Synthetic Polynucleotide
taatacgactcactatagggcacgagtagccattccttactgtcaggtggaacagaggagaccacctatgagtaaggaaaacctggcggcagcgcaaaagatg

SEQ ID NO: 144577 - DNA, 103 bp, Artificial Sequence
  Synthetic Polynucleotide
taatacgactcactatagggcacaggcacacacgagtagccattccttacaacagaggagagtaaggatgggctactcgaacctggcggcagcgcaaaagatg

SEQ ID NO: 144578 - DNA, 103 bp, Artificial Sequence
  Synthetic Polynucleotide
taatacgactcactatagggctgctaaagccacaggcacacacgagtagcaacagaggagagctactatggtgtgcctgaacctggcggcagcgcaaaagatg

SEQ ID NO: 144579 - DNA, 103 bp, Artificial Sequence
  Synthetic Polynucleotide
taatacgactcactatagggcgcggaggctctttcttgcggggtgtgcgcaacagaggagagcgcacatgccgcaagaaaacctggcggcagcgcaaaagatg

SEQ ID NO: 144580 - DNA, 103 bp, Artificial Sequence
  Synthetic Polynucleotide
taatacgactcactatagggtctaggccttctgctaaagccacaggcacaaacagaggagatgtgccatgggctttagcaacctggcggcagcgcaaaagatg

SEQ ID NO: 144581 - DNA, 103 bp, Artificial Sequence
  Synthetic Polynucleotide
taatacgactcactatagggcagtttaatgtctaggccttctgctaaagcaacagaggagagctttaatggaaggcctaaacctggcggcagcgcaaaagatg

SEQ ID NO: 144582 - DNA, 103 bp, Artificial Sequence
  Synthetic Polynucleotide
taatacgactcactatagggctgctgtattcagtttaatgtctaggccttaacagaggagaaaggccatgacattaaacaacctggcggcagcgcaaaagatg

SEQ ID NO: 144583 - DNA, 103 bp, Artificial Sequence
  Synthetic Polynucleotide
taatacgactcactatagggacctgtcgcactgctgtattcagtttaatgaacagaggagacattaaatggaatacagcaacctggcggcagcgcaaaagatg

SEQ ID NO: 144584 - DNA, 103 bp, Artificial Sequence
  Synthetic Polynucleotide
taatacgactcactatagggcgtgtagcgaacctgtcgcactgctgtattaacagaggagaaatacaatggtgcgacagaacctggcggcagcgcaaaagatg

SEQ ID NO: 144585 - DNA, 103 bp, Artificial Sequence
  Synthetic Polynucleotide
taatacgactcactatagggatcctgaagccgtgtagcgaacctgtcgcaaacagaggagatgcgacatgttcgctacaaacctggcggcagcgcaaaagatg

SEQ ID NO: 144586 - DNA, 103 bp, Artificial Sequence
  Synthetic Polynucleotide
taatacgactcactatagggatcacttcacatcctgaagccgtgtagcgaaacagaggagatcgctaatgggcttcaggaacctggcggcagcgcaaaagatg

SEQ ID NO: 144587 - DNA, 103 bp, Artificial Sequence
  Synthetic Polynucleotide
taatacgactcactatagggattcacagctatcacttcacatcctgaagcaacagaggagagcttcaatgtgtgaagtgaacctggcggcagcgcaaaagatg

SEQ ID NO: 144588 - DNA, 103 bp, Artificial Sequence
  Synthetic Polynucleotide
taatacgactcactatagggtggagcgggtattcacagctatcacttcacaacagaggagagtgaagatgtagctgtgaaacctggcggcagcgcaaaagatg

SEQ ID NO: 144589 - DNA, 103 bp, Artificial Sequence
  Synthetic Polynucleotide
taatacgactcactataggggtttgactcgtggagcgggtattcacagctaacagaggagaagctgtatgtacccgctcaacctggcggcagcgcaaaagatg

SEQ ID NO: 144590 - DNA, 103 bp, Artificial Sequence
  Synthetic Polynucleotide
taatacgactcactataggggggcgaggcccgcggaggctctttcttgcgaacagaggagacgcaagatggagcctccgaacctggcggcagcgcaaaagatg

SEQ ID NO: 144591 - DNA, 103 bp, Artificial Sequence
  Synthetic Polynucleotide
taatacgactcactatagggataaataaaggtttgactcgtggagcgggtaacagaggagaacccgcatgacgagtcaaaacctggcggcagcgcaaaagatg

SEQ ID NO: 144592 - DNA, 103 bp, Artificial Sequence
  Synthetic Polynucleotide
taatacgactcactatagggcgtcgcatttataaataaaggtttgactcgaacagaggagacgagtcatgcctttatttaacctggcggcagcgcaaaagatg

SEQ ID NO: 144593 - DNA, 103 bp, Artificial Sequence
  Synthetic Polynucleotide
taatacgactcactatagggcagagaactgcgtcgcatttataaataaagaacagaggagactttatatgtaaatgcgaaacctggcggcagcgcaaaagatg

SEQ ID NO: 144594 - DNA, 103 bp, Artificial Sequence
  Synthetic Polynucleotide
taatacgactcactataggggggaagggtacagagaactgcgtcgcatttaacagaggagaaaatgcatggcagttctcaacctggcggcagcgcaaaagatg

SEQ ID NO: 144595 - DNA, 103 bp, Artificial Sequence
  Synthetic Polynucleotide
taatacgactcactataggggcacacccaggggaagggtacagagaactgaacagaggagacagttcatggtacccttcaacctggcggcagcgcaaaagatg

SEQ ID NO: 144596 - DNA, 103 bp, Artificial Sequence
  Synthetic Polynucleotide
taatacgactcactatagggtgctgcttcagcacacccaggggaagggtaaacagaggagataccctatgcctgggtgtaacctggcggcagcgcaaaagatg

SEQ ID NO: 144597 - DNA, 103 bp, Artificial Sequence
  Synthetic Polynucleotide
taatacgactcactatagggggctggtggctgctgcttcagcacacccagaacagaggagactgggtatgctgaagcagaacctggcggcagcgcaaaagatg

SEQ ID NO: 144598 - DNA, 103 bp, Artificial Sequence
  Synthetic Polynucleotide
taatacgactcactatagggcaaactgaacggctggtggctgctgcttcaaacagaggagatgaagcatgagccaccagaacctggcggcagcgcaaaagatg

SEQ ID NO: 144599 - DNA, 103 bp, Artificial Sequence
  Synthetic Polynucleotide
taatacgactcactatagggagaggtggcacaaactgaacggctggtggcaacagaggagagccaccatgcgttcagttaacctggcggcagcgcaaaagatg

SEQ ID NO: 144600 - DNA, 103 bp, Artificial Sequence
  Synthetic Polynucleotide
taatacgactcactatagggccactcagggagaggtggcacaaactgaacaacagaggagagttcagatggtgccacctaacctggcggcagcgcaaaagatg

SEQ ID NO: 144601 - DNA, 103 bp, Artificial Sequence
  Synthetic Polynucleotide
taatacgactcactatagggccgccgccgccgcggctgccgccttcttccaacagaggagaggaagaatgcggcagccgaacctggcggcagcgcaaaagatg

SEQ ID NO: 144602 - DNA, 103 bp, Artificial Sequence
  Synthetic Polynucleotide
taatacgactcactatagggggcccccggggggcgaggcccgcggaggctaacagaggagaagcctcatggggcctcgcaacctggcggcagcgcaaaagatg

SEQ ID NO: 144603 - DNA, 103 bp, Artificial Sequence
  Synthetic Polynucleotide
taatacgactcactatagggcagatgttttccactcagggagaggtggcaaacagaggagatgccacatgtccctgagtaacctggcggcagcgcaaaagatg

SEQ ID NO: 144604 - DNA, 103 bp, Artificial Sequence
  Synthetic Polynucleotide
taatacgactcactatagggctttggactgcagatgttttccactcagggaacagaggagaccctgaatggaaaacatcaacctggcggcagcgcaaaagatg

SEQ ID NO: 144605 - DNA, 103 bp, Artificial Sequence
  Synthetic Polynucleotide
taatacgactcactatagggaaatcccatcctttggactgcagatgttttaacagaggagaaaaacaatggcagtccaaaacctggcggcagcgcaaaagatg

SEQ ID NO: 144606 - DNA, 103 bp, Artificial Sequence
  Synthetic Polynucleotide
taatacgactcactatagggtaaggttgccaaatcccatcctttggactgaacagaggagacagtccatgggatgggataacctggcggcagcgcaaaagatg

SEQ ID NO: 144607 - DNA, 103 bp, Artificial Sequence
  Synthetic Polynucleotide
taatacgactcactatagggaccaccttgttaaggttgccaaatcccatcaacagaggagagatgggatgtggcaacctaacctggcggcagcgcaaaagatg

SEQ ID NO: 144608 - DNA, 103 bp, Artificial Sequence
  Synthetic Polynucleotide
taatacgactcactatagggaaaacacaacaccaccttgttaaggttgccaacagaggagaggcaacatgaacaaggtgaacctggcggcagcgcaaaagatg

SEQ ID NO: 144609 - DNA, 103 bp, Artificial Sequence
  Synthetic Polynucleotide
taatacgactcactatagggacacccgatcaaaacacaacaccaccttgtaacagaggagaacaaggatgtgttgtgttaacctggcggcagcgcaaaagatg

SEQ ID NO: 144610 - DNA, 103 bp, Artificial Sequence
  Synthetic Polynucleotide
taatacgactcactatagggggatcccagaacacccgatcaaaacacaacaacagaggagagttgtgatgtgatcgggtaacctggcggcagcgcaaaagatg

SEQ ID NO: 144611 - DNA, 103 bp, Artificial Sequence
  Synthetic Polynucleotide
taatacgactcactatagggattgacacttggatcccagaacacccgatcaacagaggagagatcggatgttctgggataacctggcggcagcgcaaaagatg

SEQ ID NO: 144612 - DNA, 103 bp, Artificial Sequence
  Synthetic Polynucleotide
taatacgactcactataggggcccgaacaaattgacacttggatcccagaaacagaggagatctgggatgcaagtgtcaaacctggcggcagcgcaaaagatg

SEQ ID NO: 144613 - DNA, 103 bp, Artificial Sequence
  Synthetic Polynucleotide
taatacgactcactatagggggttccgccaggcccccggggggcgaggccaacagaggagaggcctcatgccccgggggaacctggcggcagcgcaaaagatg

SEQ ID NO: 144614 - DNA, 103 bp, Artificial Sequence
  Synthetic Polynucleotide
taatacgactcactatagggctgccaacatgcccgaacaaattgacacttaacagaggagaaagtgtatgtttgttcggaacctggcggcagcgcaaaagatg

SEQ ID NO: 144615 - DNA, 103 bp, Artificial Sequence
  Synthetic Polynucleotide
taatacgactcactatagggggcagtcgtactgccaacatgcccgaacaaaacagaggagattgttcatgcatgttggcaacctggcggcagcgcaaaagatg

SEQ ID NO: 144616 - DNA, 103 bp, Artificial Sequence
  Synthetic Polynucleotide
taatacgactcactatagggcacccctgctggcagtcgtactgccaacataacagaggagaatgttgatggtacgactgaacctggcggcagcgcaaaagatg

SEQ ID NO: 144617 - DNA, 103 bp, Artificial Sequence
  Synthetic Polynucleotide
taatacgactcactatagggaggaagagctcacccctgctggcagtcgtaaacagaggagatacgacatgcagcaggggaacctggcggcagcgcaaaagatg

SEQ ID NO: 144618 - DNA, 103 bp, Artificial Sequence
  Synthetic Polynucleotide
taatacgactcactataggggttccagaagaggaagagctcacccctgctaacagaggagaagcaggatggagctcttcaacctggcggcagcgcaaaagatg

SEQ ID NO: 144619 - DNA, 103 bp, Artificial Sequence
  Synthetic Polynucleotide
taatacgactcactatagggctttatagaggttccagaagaggaagagctaacagaggagaagctctatgtcttctggaaacctggcggcagcgcaaaagatg

SEQ ID NO: 144620 - DNA, 103 bp, Artificial Sequence
  Synthetic Polynucleotide
taatacgactcactatagggagtattggagctttatagaggttccagaagaacagaggagacttctgatgcctctataaaacctggcggcagcgcaaaagatg

SEQ ID NO: 144621 - DNA, 103 bp, Artificial Sequence
  Synthetic Polynucleotide
taatacgactcactatagggtagtgccaacagtattggagctttatagagaacagaggagactctatatggctccaataaacctggcggcagcgcaaaagatg

SEQ ID NO: 144622 - DNA, 103 bp, Artificial Sequence
  Synthetic Polynucleotide
taatacgactcactatagggctcctgccactagtgccaacagtattggagaacagaggagactccaaatgtgttggcacaacctggcggcagcgcaaaagatg

SEQ ID NO: 144623 - DNA, 103 bp, Artificial Sequence
  Synthetic Polynucleotide
taatacgactcactatagggccagcagcttctcctgccactagtgccaacaacagaggagagttggcatgagtggcaggaacctggcggcagcgcaaaagatg

SEQ ID NO: 144624 - DNA, 103 bp, Artificial Sequence
  Synthetic Polynucleotide
taatacgactcactatagggggaccccggcggttccgccaggcccccgggaacagaggagacccgggatgctggcggaaaacctggcggcagcgcaaaagatg

SEQ ID NO: 144625 - DNA, 103 bp, Artificial Sequence
  Synthetic Polynucleotide
taatacgactcactatagggttccatgataccagcagcttctcctgccacaacagaggagagtggcaatggaagctgctaacctggcggcagcgcaaaagatg

SEQ ID NO: 144626 - DNA, 103 bp, Artificial Sequence
  Synthetic Polynucleotide
taatacgactcactatagggcacttatgttttccatgataccagcagcttaacagaggagaaagctgatggtatcatggaacctggcggcagcgcaaaagatg

SEQ ID NO: 144627 - DNA, 103 bp, Artificial Sequence
  Synthetic Polynucleotide
taatacgactcactatagggatcacatcgtcacttatgttttccatgataaacagaggagatatcatatgaaacataagaacctggcggcagcgcaaaagatg

SEQ ID NO: 144628 - DNA, 103 bp, Artificial Sequence
  Synthetic Polynucleotide
taatacgactcactatagggtcggccaacaatcacatcgtcacttatgttaacagaggagaaacataatggacgatgtgaacctggcggcagcgcaaaagatg

SEQ ID NO: 144629 - DNA, 103 bp, Artificial Sequence
  Synthetic Polynucleotide
taatacgactcactatagggtggccaggcatcggccaacaatcacatcgtaacagaggagaacgatgatgttgttggccaacctggcggcagcgcaaaagatg

SEQ ID NO: 144630 - DNA, 103 bp, Artificial Sequence
  Synthetic Polynucleotide
taatacgactcactatagggcctttgagaatggccaggcatcggccaacaaacagaggagatgttggatgatgcctggcaacctggcggcagcgcaaaagatg

SEQ ID NO: 144631 - DNA, 103 bp, Artificial Sequence
  Synthetic Polynucleotide
taatacgactcactatagggaccaaaaatccctttgagaatggccaggcaaacagaggagatgcctgatgattctcaaaaacctggcggcagcgcaaaagatg

SEQ ID NO: 144632 - DNA, 103 bp, Artificial Sequence
  Synthetic Polynucleotide
taatacgactcactatagggctgcactgctaccaaaaatccctttgagaaaacagaggagattctcaatgggatttttgaacctggcggcagcgcaaaagatg

SEQ ID NO: 144633 - DNA, 103 bp, Artificial Sequence
  Synthetic Polynucleotide
taatacgactcactatagggggctgaggtactgcactgctaccaaaaatcaacagaggagagattttatgtagcagtgcaacctggcggcagcgcaaaagatg

SEQ ID NO: 144634 - DNA, 103 bp, Artificial Sequence
  Synthetic Polynucleotide
taatacgactcactatagggagtttctttgggctgaggtactgcactgctaacagaggagaagcagtatggtacctcagaacctggcggcagcgcaaaagatg

SEQ ID NO: 144635 - DNA, 103 bp, Artificial Sequence
  Synthetic Polynucleotide
taatacgactcactataggggaggccctgcggaccccggcggttccgccaaacagaggagatggcggatgcgccggggtaacctggcggcagcgcaaaagatg

SEQ ID NO: 144636 - DNA, 103 bp, Artificial Sequence
  Synthetic Polynucleotide
taatacgactcactataggggagacaccacagtttctttgggctgaggtaaacagaggagatacctcatgccaaagaaaaacctggcggcagcgcaaaagatg

SEQ ID NO: 144637 - DNA, 103 bp, Artificial Sequence
  Synthetic Polynucleotide
taatacgactcactataggggcacgccaacgagacaccacagtttctttgaacagaggagacaaagaatgtgtggtgtcaacctggcggcagcgcaaaagatg

SEQ ID NO: 144638 - DNA, 103 bp, Artificial Sequence
  Synthetic Polynucleotide
taatacgactcactatagggccagggatcagcacgccaacgagacaccacaacagaggagagtggtgatgcgttggcgtaacctggcggcagcgcaaaagatg

SEQ ID NO: 144639 - DNA, 103 bp, Artificial Sequence
  Synthetic Polynucleotide
taatacgactcactatagggagccccgagcccagggatcagcacgccaacaacagaggagagttggcatgctgatccctaacctggcggcagcgcaaaagatg

SEQ ID NO: 144640 - DNA, 103 bp, Artificial Sequence
  Synthetic Polynucleotide
taatacgactcactatagggtaggaataagagccccgagcccagggatcaaacagaggagatgatccatgggctcggggaacctggcggcagcgcaaaagatg

SEQ ID NO: 144641 - DNA, 103 bp, Artificial Sequence
  Synthetic Polynucleotide
taatacgactcactatagggtgcagcaacataggaataagagccccgagcaacagaggagagctcggatgtcttattccaacctggcggcagcgcaaaagatg

SEQ ID NO: 144642 - DNA, 103 bp, Artificial Sequence
  Synthetic Polynucleotide
taatacgactcactatagggcagatgatcctgcagcaacataggaataagaacagaggagacttattatgatgttgctgaacctggcggcagcgcaaaagatg

SEQ ID NO: 144643 - DNA, 103 bp, Artificial Sequence
  Synthetic Polynucleotide
taatacgactcactatagggtagtcatttccagatgatcctgcagcaacaaacagaggagatgttgcatgaggatcatcaacctggcggcagcgcaaaagatg

SEQ ID NO: 144644 - DNA, 103 bp, Artificial Sequence
  Synthetic Polynucleotide
taatacgactcactatagggcattaaatcatagtcatttccagatgatccaacagaggagaggatcaatgggaaatgacaacctggcggcagcgcaaaagatg

SEQ ID NO: 144645 - DNA, 103 bp, Artificial Sequence
  Synthetic Polynucleotide
taatacgactcactatagggttggctgagccattaaatcatagtcatttcaacagaggagagaaatgatgatgatttaaaacctggcggcagcgcaaaagatg

SEQ ID NO: 144646 - DNA, 103 bp, Artificial Sequence
  Synthetic Polynucleotide
taatacgactcactataggggggccggcctgaggccctgcggaccccggcaacagaggagagccgggatgcgcagggccaacctggcggcagcgcaaaagatg

SEQ ID NO: 144647 - DNA, 103 bp, Artificial Sequence
  Synthetic Polynucleotide
taatacgactcactatagggccaggagtgattggctgagccattaaatcaaacagaggagatgatttatgggctcagccaacctggcggcagcgcaaaagatg

SEQ ID NO: 144648 - DNA, 103 bp, Artificial Sequence
  Synthetic Polynucleotide
taatacgactcactatagggaatcgaggggccaggagtgattggctgagcaacagaggagagctcagatgatcactcctaacctggcggcagcgcaaaagatg

SEQ ID NO: 144649 - DNA, 103 bp, Artificial Sequence
  Synthetic Polynucleotide
taatacgactcactataggggggcacctggaatcgaggggccaggagtgaaacagaggagatcactcatggcccctcgaaacctggcggcagcgcaaaagatg

SEQ ID NO: 144650 - DNA, 103 bp, Artificial Sequence
  Synthetic Polynucleotide
taatacgactcactatagggatcggctgtggggcacctggaatcgaggggaacagaggagacccctcatgtccaggtgcaacctggcggcagcgcaaaagatg

SEQ ID NO: 144651 - DNA, 103 bp, Artificial Sequence
  Synthetic Polynucleotide
taatacgactcactataggggagtcgtggaatcggctgtggggcacctggaacagaggagaccaggtatgccacagccgaacctggcggcagcgcaaaagatg

SEQ ID NO: 144652 - DNA, 103 bp, Artificial Sequence
  Synthetic Polynucleotide
taatacgactcactatagggccgcaaagaagagtcgtggaatcggctgtgaacagaggagacacagcatgttccacgacaacctggcggcagcgcaaaagatg

SEQ ID NO: 144653 - DNA, 103 bp, Artificial Sequence
  Synthetic Polynucleotide
taatacgactcactataggggtatgttctcccgcaaagaagagtcgtggaaacagaggagatccacgatgcttctttgcaacctggcggcagcgcaaaagatg

SEQ ID NO: 144654 - DNA, 103 bp, Artificial Sequence
  Synthetic Polynucleotide
taatacgactcactataggggttacggatcgtatgttctcccgcaaagaaaacagaggagattctttatgggagaacataacctggcggcagcgcaaaagatg

SEQ ID NO: 144655 - DNA, 103 bp, Artificial Sequence
  Synthetic Polynucleotide
taatacgactcactatagggtggctgggtagttacggatcgtatgttctcaacagaggagagagaacatgcgatccgtaaacctggcggcagcgcaaaagatg

SEQ ID NO: 144656 - DNA, 103 bp, Artificial Sequence
  Synthetic Polynucleotide
taatacgactcactatagggccatgcactgtggctgggtagttacggatcaacagaggagagatccgatgctacccagcaacctggcggcagcgcaaaagatg

SEQ ID NO: 144657 - DNA, 103 bp, Artificial Sequence
  Synthetic Polynucleotide
taatacgactcactatagggcacgacagtagggccggcctgaggccctgcaacagaggagagcagggatgcaggccggcaacctggcggcagcgcaaaagatg

SEQ ID NO: 144658 - DNA, 103 bp, Artificial Sequence
  Synthetic Polynucleotide
taatacgactcactatagggcagcagagcaccatgcactgtggctgggtaaacagaggagatacccaatgacagtgcataacctggcggcagcgcaaaagatg

SEQ ID NO: 144659 - DNA, 103 bp, Artificial Sequence
  Synthetic Polynucleotide
taatacgactcactataggggcagcccactcagcagagcaccatgcactgaacagaggagacagtgcatggtgctctgcaacctggcggcagcgcaaaagatg

SEQ ID NO: 144660 - DNA, 103 bp, Artificial Sequence
  Synthetic Polynucleotide
taatacgactcactatagggcccgcttctcgcagcccactcagcagagcaaacagaggagatgctctatggagtgggctaacctggcggcagcgcaaaagatg

SEQ ID NO: 144661 - DNA, 103 bp, Artificial Sequence
  Synthetic Polynucleotide
taatacgactcactatagggtgcaattcttcccgcttctcgcagcccactaacagaggagaagtgggatgcgagaagcgaacctggcggcagcgcaaaagatg

SEQ ID NO: 144662 - DNA, 103 bp, Artificial Sequence
  Synthetic Polynucleotide
taatacgactcactatagggaaaactggtctgcaattcttcccgcttctcaacagaggagagagaagatggaagaattgaacctggcggcagcgcaaaagatg

SEQ ID NO: 144663 - DNA, 103 bp, Artificial Sequence
  Synthetic Polynucleotide
taatacgactcactatagggatggcccccaaaaactggtctgcaattcttaacagaggagaaagaatatgagaccagttaacctggcggcagcgcaaaagatg

SEQ ID NO: 144664 - DNA, 103 bp, Artificial Sequence
  Synthetic Polynucleotide
taatacgactcactatagggcagcgtatacatggcccccaaaaactggtcaacagaggagagaccagatgttgggggccaacctggcggcagcgcaaaagatg

SEQ ID NO: 144665 - DNA, 103 bp, Artificial Sequence
  Synthetic Polynucleotide
taatacgactcactatagggcctggcgaggcagcgtatacatggcccccaaacagaggagatgggggatgtgtatacgcaacctggcggcagcgcaaaagatg

SEQ ID NO: 144666 - DNA, 103 bp, Artificial Sequence
  Synthetic Polynucleotide
taatacgactcactatagggcctggtgtggcctggcgaggcagcgtatacaacagaggagagtatacatggcctcgccaaacctggcggcagcgcaaaagatg

SEQ ID NO: 144667 - DNA, 103 bp, Artificial Sequence
  Synthetic Polynucleotide
taatacgactcactatagggtgcaggaacacctggtgtggcctggcgaggaacagaggagacctcgcatggccacaccaaacctggcggcagcgcaaaagatg

SEQ ID NO: 144668 - DNA, 103 bp, Artificial Sequence
  Synthetic Polynucleotide
taatacgactcactatagggcagacccaggcacgacagtagggccggcctaacagaggagaaggccgatgctactgtcgaacctggcggcagcgcaaaagatg

SEQ ID NO: 144669 - DNA, 103 bp, Artificial Sequence
  Synthetic Polynucleotide
taatacgactcactataggggggactgctgtgcaggaacacctggtgtggaacagaggagaccacacatggtgttcctgaacctggcggcagcgcaaaagatg

SEQ ID NO: 144670 - DNA, 103 bp, Artificial Sequence
  Synthetic Polynucleotide
taatacgactcactatagggcacatgcttggggactgctgtgcaggaacaaacagaggagatgttccatgacagcagtcaacctggcggcagcgcaaaagatg

SEQ ID NO: 144671 - DNA, 103 bp, Artificial Sequence
  Synthetic Polynucleotide
taatacgactcactatagggatgggggtcgcagacccaggcacgacagtaaacagaggagatactgtatggcctgggtcaacctggcggcagcgcaaaagatg

SEQ ID NO: 144672 - DNA, 103 bp, Artificial Sequence
  Synthetic Polynucleotide
taatacgactcactatagggtccagtttccatgggggtcgcagacccaggaacagaggagacctgggatggcgacccccaacctggcggcagcgcaaaagatg

SEQ ID NO: 144673 - DNA, 103 bp, Artificial Sequence
  Synthetic Polynucleotide
taatacgactcactatagggtctctgctattccagtttccatgggggtcgaacagaggagacgacccatgtggaaactgaacctggcggcagcgcaaaagatg

SEQ ID NO: 144674 - DNA, 103 bp, Artificial Sequence
  Synthetic Polynucleotide
taatacgactcactataggggccgctgcagccgccgccgccgcggctgccaacagaggagaggcagcatgggcggcggcaacctggcggcagcgcaaaagatg

SEQ ID NO: 144675 - DNA, 103 bp, Artificial Sequence
  Synthetic Polynucleotide
taatacgactcactatagggccctccggagtctctgctattccagtttccaacagaggagaggaaacatgaatagcagaaacctggcggcagcgcaaaagatg

SEQ ID NO: 144676 - DNA, 103 bp, Artificial Sequence
  Synthetic Polynucleotide
taatacgactcactatagggggtccgacgcccctccggagtctctgctataacagaggagaatagcaatgactccggagaacctggcggcagcgcaaaagatg

SEQ ID NO: 144677 - DNA, 103 bp, Artificial Sequence
  Synthetic Polynucleotide
taatacgactcactatagggtgcgccggctggtccgacgcccctccggagaacagaggagactccggatgggcgtcggaaacctggcggcagcgcaaaagatg

SEQ ID NO: 144678 - DNA, 103 bp, Artificial Sequence
  Synthetic Polynucleotide
taatacgactcactatagggttcgcccgcttgcgccggctggtccgacgcaacagaggagagcgtcgatgcagccggcgaacctggcggcagcgcaaaagatg

SEQ ID NO: 144679 - DNA, 103 bp, Artificial Sequence
  Synthetic Polynucleotide
taatacgactcactataggggtactctaccttcgcccgcttgcgccggctaacagaggagaagccggatgaagcgggcgaacctggcggcagcgcaaaagatg

SEQ ID NO: 144680 - DNA, 103 bp, Artificial Sequence
  Synthetic Polynucleotide
taatacgactcactatagggccatctctctgtactctaccttcgcccgctaacagaggagaagcgggatgaggtagagtaacctggcggcagcgcaaaagatg

SEQ ID NO: 144681 - DNA, 103 bp, Artificial Sequence
  Synthetic Polynucleotide
taatacgactcactatagggaagctttcatccatctctctgtactctaccaacagaggagaggtagaatgcagagagataacctggcggcagcgcaaaagatg

SEQ ID NO: 144682 - DNA, 103 bp, Artificial Sequence
  Synthetic Polynucleotide
taatacgactcactataggggaggttggccaagctttcatccatctctctaacagaggagaagagagatggatgaaagcaacctggcggcagcgcaaaagatg

SEQ ID NO: 144683 - DNA, 103 bp, Artificial Sequence
  Synthetic Polynucleotide
taatacgactcactatagggcatcttctgagaggttggccaagctttcataacagaggagaatgaaaatgtggccaaccaacctggcggcagcgcaaaagatg

SEQ ID NO: 144684 - DNA, 103 bp, Artificial Sequence
  Synthetic Polynucleotide
taatacgactcactataggggaataatactcatcttctgagaggttggccaacagaggagaggccaaatgctcagaagaaacctggcggcagcgcaaaagatg

SEQ ID NO: 144685 - DNA, 103 bp, Artificial Sequence
  Synthetic Polynucleotide
taatacgactcactatagggcccggttgctgccgctgcagccgccgccgcaacagaggagagcggcgatggctgcagcgaacctggcggcagcgcaaaagatg

SEQ ID NO: 144686 - DNA, 103 bp, Artificial Sequence
  Synthetic Polynucleotide
taatacgactcactatagggctcttcttctgaataatactcatcttctgaaacagaggagatcagaaatggagtattataacctggcggcagcgcaaaagatg

SEQ ID NO: 144687 - DNA, 103 bp, Artificial Sequence
  Synthetic Polynucleotide
taatacgactcactatagggtggcatttctctcttcttctgaataatactaacagaggagaagtattatgcagaagaagaacctggcggcagcgcaaaagatg

SEQ ID NO: 144688 - DNA, 103 bp, Artificial Sequence
  Synthetic Polynucleotide
taatacgactcactatagggttctctgctttggcatttctctcttcttctaacagaggagaagaagaatggagaaatgcaacctggcggcagcgcaaaagatg

SEQ ID NO: 144689 - DNA, 103 bp, Artificial Sequence
  Synthetic Polynucleotide
taatacgactcactatagggcttcttttccttctctgctttggcatttctaacagaggagaagaaatatgaaagcagagaacctggcggcagcgcaaaagatg

SEQ ID NO: 144690 - DNA, 103 bp, Artificial Sequence
  Synthetic Polynucleotide
taatacgactcactataggggtgggggaagcttcttttccttctctgcttaacagaggagaaagcagatgaggaaaagaaacctggcggcagcgcaaaagatg

SEQ ID NO: 144691 - DNA, 103 bp, Artificial Sequence
  Synthetic Polynucleotide
taatacgactcactatagggtgagggggtggtgggggaagcttcttttccaacagaggagaggaaaaatggcttcccccaacctggcggcagcgcaaaagatg

SEQ ID NO: 144692 - DNA, 103 bp, Artificial Sequence
  Synthetic Polynucleotide
taatacgactcactatagggaggtggggcttgagggggtggtgggggaagaacagaggagacttcccatgccaccccctaacctggcggcagcgcaaaagatg

SEQ ID NO: 144693 - DNA, 103 bp, Artificial Sequence
  Synthetic Polynucleotide
taatacgactcactatagggtttcttcctcaggtggggcttgagggggtgaacagaggagacaccccatgaagccccacaacctggcggcagcgcaaaagatg

SEQ ID NO: 144694 - DNA, 103 bp, Artificial Sequence
  Synthetic Polynucleotide
taatacgactcactatagggtcactttcattttcttcctcaggtggggctaacagaggagaagccccatgtgaggaagaaacctggcggcagcgcaaaagatg

SEQ ID NO: 144695 - DNA, 103 bp, Artificial Sequence
  Synthetic Polynucleotide
taatacgactcactatagggttcttcaggctcactttcattttcttcctcaacagaggagagaggaaatgaatgaaagtaacctggcggcagcgcaaaagatg

SEQ ID NO: 144696 - DNA, 103 bp, Artificial Sequence
  Synthetic Polynucleotide
taatacgactcactatagggcagcctccgtcccggttgctgccgctgcagaacagaggagactgcagatgcagcaaccgaacctggcggcagcgcaaaagatg

SEQ ID NO: 144697 - DNA, 103 bp, Artificial Sequence
  Synthetic Polynucleotide
taatacgactcactataggggccccgatggttcttcaggctcactttcataacagaggagaatgaaaatgagcctgaagaacctggcggcagcgcaaaagatg

SEQ ID NO: 144698 - DNA, 103 bp, Artificial Sequence
  Synthetic Polynucleotide
taatacgactcactatagggcctcctgcttgccccgatggttcttcaggcaacagaggagagcctgaatgaccatcgggaacctggcggcagcgcaaaagatg

SEQ ID NO: 144699 - DNA, 103 bp, Artificial Sequence
  Synthetic Polynucleotide
taatacgactcactataggggtcttgaagtcctcctgcttgccccgatggaacagaggagaccatcgatgcaagcaggaaacctggcggcagcgcaaaagatg

SEQ ID NO: 144700 - DNA, 103 bp, Artificial Sequence
  Synthetic Polynucleotide
taatacgactcactatagggcagaactgtcgtcttgaagtcctcctgcttaacagaggagaaagcagatggacttcaagaacctggcggcagcgcaaaagatg

SEQ ID NO: 144701 - DNA, 103 bp, Artificial Sequence
  Synthetic Polynucleotide
taatacgactcactatagggccataccctccagaactgtcgtcttgaagtaacagaggagaacttcaatgcgacagttcaacctggcggcagcgcaaaagatg

SEQ ID NO: 144702 - DNA, 103 bp, Artificial Sequence
  Synthetic Polynucleotide
taatacgactcactatagggttggccgtctccataccctccagaactgtcaacagaggagagacagtatgggagggtataacctggcggcagcgcaaaagatg

SEQ ID NO: 144703 - DNA, 103 bp, Artificial Sequence
  Synthetic Polynucleotide
taatacgactcactatagggcacctgatgcttggccgtctccataccctcaacagaggagagagggtatggagacggccaacctggcggcagcgcaaaagatg

SEQ ID NO: 144704 - DNA, 103 bp, Artificial Sequence
  Synthetic Polynucleotide
taatacgactcactataggggcgccctccacacctgatgcttggccgtctaacagaggagaagacggatgagcatcaggaacctggcggcagcgcaaaagatg

SEQ ID NO: 144705 - DNA, 103 bp, Artificial Sequence
  Synthetic Polynucleotide
taatacgactcactatagggctggaaagctgcgccctccacacctgatgcaacagaggagagcatcaatggtggagggcaacctggcggcagcgcaaaagatg

SEQ ID NO: 144706 - DNA, 103 bp, Artificial Sequence
  Synthetic Polynucleotide
taatacgactcactataggggaagtcggctctggaaagctgcgccctccaaacagaggagatggaggatgcagctttccaacctggcggcagcgcaaaagatg

SEQ ID NO: 144707 - DNA, 103 bp, Artificial Sequence
  Synthetic Polynucleotide
taatacgactcactataggggtcccagggccagcctccgtcccggttgctaacagaggagaagcaacatggacggaggcaacctggcggcagcgcaaaagatg

SEQ ID NO: 144708 - DNA, 103 bp, Artificial Sequence
  Synthetic Polynucleotide
taatacgactcactatagggcggtcatgaggaagtcggctctggaaagctaacagaggagaagctttatggagccgactaacctggcggcagcgcaaaagatg

SEQ ID NO: 144709 - DNA, 103 bp, Artificial Sequence
  Synthetic Polynucleotide
taatacgactcactatagggagaagtcatccggtcatgaggaagtcggctaacagaggagaagccgaatgcctcatgacaacctggcggcagcgcaaaagatg

SEQ ID NO: 144710 - DNA, 103 bp, Artificial Sequence
  Synthetic Polynucleotide
taatacgactcactatagggctgcttcttgagaagtcatccggtcatgagaacagaggagactcatgatgggatgacttaacctggcggcagcgcaaaagatg

SEQ ID NO: 144711 - DNA, 103 bp, Artificial Sequence
  Synthetic Polynucleotide
taatacgactcactatagggggaaaacaggctgcttcttgagaagtcatcaacagaggagagatgacatgtcaagaagcaacctggcggcagcgcaaaagatg

SEQ ID NO: 144712 - DNA, 103 bp, Artificial Sequence
  Synthetic Polynucleotide
taatacgactcactataggggataatatctggaaaacaggctgcttcttgaacagaggagacaagaaatggcctgttttaacctggcggcagcgcaaaagatg

SEQ ID NO: 144713 - DNA, 103 bp, Artificial Sequence
  Synthetic Polynucleotide
taatacgactcactataggggtggtccactgataatatctggaaaacaggaacagaggagacctgttatgcagatattaaacctggcggcagcgcaaaagatg

SEQ ID NO: 144714 - DNA, 103 bp, Artificial Sequence
  Synthetic Polynucleotide
taatacgactcactatagggtgggtctgttgtggtccactgataatatctaacagaggagaagatatatgcagtggaccaacctggcggcagcgcaaaagatg

SEQ ID NO: 144715 - DNA, 103 bp, Artificial Sequence
  Synthetic Polynucleotide
taatacgactcactatagggaaaaaccttctgggtctgttgtggtccactaacagaggagaagtggaatgcaacagaccaacctggcggcagcgcaaaagatg

SEQ ID NO: 144716 - DNA, 103 bp, Artificial Sequence
  Synthetic Polynucleotide
taatacgactcactatagggtaatgaaaagaaaaaccttctgggtctgttaacagaggagaaacagaatgagaaggtttaacctggcggcagcgcaaaagatg

SEQ ID NO: 144717 - DNA, 103 bp, Artificial Sequence
  Synthetic Polynucleotide
taatacgactcactataggggtgcggtttctaatgaaaagaaaaaccttcaacagaggagagaaggtatgtcttttcataacctggcggcagcgcaaaagatg

SEQ ID NO: 144718 - DNA, 103 bp, Artificial Sequence
  Synthetic Polynucleotide
taatacgactcactataggggccgcctgctgtcccagggccagcctccgtaacagaggagaacggagatgggccctgggaacctggcggcagcgcaaaagatg

SEQ ID NO: 144719 - DNA, 103 bp, Artificial Sequence
  Synthetic Polynucleotide
taatacgactcactatagggcaactgcagtgtgcggtttctaatgaaaagaacagaggagacttttcatgagaaaccgcaacctggcggcagcgcaaaagatg

SEQ ID NO: 144720 - DNA, 103 bp, Artificial Sequence
  Synthetic Polynucleotide
taatacgactcactatagggtatccaaccacaactgcagtgtgcggtttcaacagaggagagaaaccatgcactgcagtaacctggcggcagcgcaaaagatg

SEQ ID NO: 144721 - DNA, 103 bp, Artificial Sequence
  Synthetic Polynucleotide
taatacgactcactatagggatctttggattatccaaccacaactgcagtaacagaggagaactgcaatggtggttggaaacctggcggcagcgcaaaagatg

SEQ ID NO: 144722 - DNA, 103 bp, Artificial Sequence
  Synthetic Polynucleotide
taatacgactcactatagggtgtcagctgaatctttggattatccaaccaaacagaggagatggttgatgaatccaaagaacctggcggcagcgcaaaagatg

SEQ ID NO: 144723 - DNA, 103 bp, Artificial Sequence
  Synthetic Polynucleotide
taatacgactcactatagggtagcctcaaatgtcagctgaatctttggataacagaggagaatccaaatgttcagctgaaacctggcggcagcgcaaaagatg

SEQ ID NO: 144724 - DNA, 103 bp, Artificial Sequence
  Synthetic Polynucleotide
taatacgactcactatagggtgttggagagtagcctcaaatgtcagctgaaacagaggagatcagctatgatttgaggcaacctggcggcagcgcaaaagatg

SEQ ID NO: 144725 - DNA, 103 bp, Artificial Sequence
  Synthetic Polynucleotide
taatacgactcactatagggtgcttctaattgttggagagtagcctcaaaaacagaggagatttgagatgactctccaaaacctggcggcagcgcaaaagatg

SEQ ID NO: 144726 - DNA, 103 bp, Artificial Sequence
  Synthetic Polynucleotide
taatacgactcactatagggtgttataaggtgcttctaattgttggagagaacagaggagactctccatgaattagaagaacctggcggcagcgcaaaagatg

SEQ ID NO: 144727 - DNA, 103 bp, Artificial Sequence
  Synthetic Polynucleotide
taatacgactcactatagggacagtatcactgttataaggtgcttctaataacagaggagaattagaatgaccttataaaacctggcggcagcgcaaaagatg

SEQ ID NO: 144728 - DNA, 103 bp, Artificial Sequence
  Synthetic Polynucleotide
taatacgactcactataggggtggacaagcacagtatcactgttataaggaacagaggagaccttatatgagtgatactaacctggcggcagcgcaaaagatg

SEQ ID NO: 144729 - DNA, 103 bp, Artificial Sequence
  Synthetic Polynucleotide
taatacgactcactatagggcgttctcggagccgcctgctgtcccagggcaacagaggagagccctgatgcagcaggcgaacctggcggcagcgcaaaagatg

SEQ ID NO: 144730 - DNA, 103 bp, Artificial Sequence
  Synthetic Polynucleotide
taatacgactcactatagggtgtgaactcggtggacaagcacagtatcacaacagaggagagtgataatgtgcttgtccaacctggcggcagcgcaaaagatg

SEQ ID NO: 144731 - DNA, 103 bp, Artificial Sequence
  Synthetic Polynucleotide
taatacgactcactatagggtctaaataactgtgaactcggtggacaagcaacagaggagagcttgtatgccgagttcaaacctggcggcagcgcaaaagatg

SEQ ID NO: 144732 - DNA, 103 bp, Artificial Sequence
  Synthetic Polynucleotide
taatacgactcactatagggaccatgacgctctaaataactgtgaactcgaacagaggagacgagttatgagttatttaaacctggcggcagcgcaaaagatg

SEQ ID NO: 144733 - DNA, 103 bp, Artificial Sequence
  Synthetic Polynucleotide
taatacgactcactatagggagttgataagaccatgacgctctaaataacaacagaggagagttattatgagcgtcatgaacctggcggcagcgcaaaagatg

SEQ ID NO: 144734 - DNA, 103 bp, Artificial Sequence
  Synthetic Polynucleotide
taatacgactcactatagggtagatgccgaagttgataagaccatgacgcaacagaggagagcgtcaatgtcttatcaaaacctggcggcagcgcaaaagatg

SEQ ID NO: 144735 - DNA, 103 bp, Artificial Sequence
  Synthetic Polynucleotide
taatacgactcactatagggtatcctcttatagatgccgaagttgataagaacagaggagacttatcatgttcggcatcaacctggcggcagcgcaaaagatg

SEQ ID NO: 144736 - DNA, 103 bp, Artificial Sequence
  Synthetic Polynucleotide
taatacgactcactataggggtaggggttttatcctcttatagatgccgaaacagaggagatcggcaatgataagaggaaacctggcggcagcgcaaaagatg

SEQ ID NO: 144737 - DNA, 103 bp, Artificial Sequence
  Synthetic Polynucleotide
taatacgactcactatagggtttttagttggtaggggttttatcctcttaaacagaggagataagagatgaaaacccctaacctggcggcagcgcaaaagatg

SEQ ID NO: 144738 - DNA, 103 bp, Artificial Sequence
  Synthetic Polynucleotide
taatacgactcactatagggctttcctgtctttttagttggtaggggtttaacagaggagaaaacccatgccaactaaaaacctggcggcagcgcaaaagatg

SEQ ID NO: 144739 - DNA, 103 bp, Artificial Sequence
  Synthetic Polynucleotide
taatacgactcactatagggtaataattacctttcctgtctttttagttgaacagaggagacaactaatgagacaggaaaacctggcggcagcgcaaaagatg

SEQ ID NO: 144740 - DNA, 103 bp, Artificial Sequence
  Synthetic Polynucleotide
taatacgactcactatagggacctcagacccgttctcggagccgcctgctaacagaggagaagcaggatgctccgagaaaacctggcggcagcgcaaaagatg

SEQ ID NO: 144741 - DNA, 103 bp, Artificial Sequence
  Synthetic Polynucleotide
taatacgactcactatagggccagagcctataataattacctttcctgtcaacagaggagagacaggatgggtaattataacctggcggcagcgcaaaagatg

SEQ ID NO: 144742 - DNA, 103 bp, Artificial Sequence
  Synthetic Polynucleotide
taatacgactcactataggggcctgagaccccagagcctataataattacaacagaggagagtaattatgataggctctaacctggcggcagcgcaaaagatg

SEQ ID NO: 144743 - DNA, 103 bp, Artificial Sequence
  Synthetic Polynucleotide
taatacgactcactatagggctgctgccaagcctgagaccccagagcctaaacagaggagataggctatggggtctcagaacctggcggcagcgcaaaagatg

SEQ ID NO: 144744 - DNA, 103 bp, Artificial Sequence
  Synthetic Polynucleotide
taatacgactcactatagggaactgtcgagctgctgccaagcctgagaccaacagaggagaggtctcatgcttggcagcaacctggcggcagcgcaaaagatg

SEQ ID NO: 144745 - DNA, 103 bp, Artificial Sequence
  Synthetic Polynucleotide
taatacgactcactatagggaaaactttgtaactgtcgagctgctgccaaaacagaggagattggcaatggctcgacagaacctggcggcagcgcaaaagatg

SEQ ID NO: 144746 - DNA, 103 bp, Artificial Sequence
  Synthetic Polynucleotide
taatacgactcactatagggcatccattccaaaactttgtaactgtcgagaacagaggagactcgacatgtacaaagttaacctggcggcagcgcaaaagatg

SEQ ID NO: 144747 - DNA, 103 bp, Artificial Sequence
  Synthetic Polynucleotide
taatacgactcactatagggaaaagtgtgacatccattccaaaactttgtaacagaggagaacaaagatgtggaatggaaacctggcggcagcgcaaaagatg

SEQ ID NO: 144748 - DNA, 103 bp, Artificial Sequence
  Synthetic Polynucleotide
taatacgactcactatagggcctggcttccaaaagtgtgacatccattccaacagaggagaggaatgatggtcacacttaacctggcggcagcgcaaaagatg

SEQ ID NO: 144749 - DNA, 103 bp, Artificial Sequence
  Synthetic Polynucleotide
taatacgactcactatagggccacacgatccctggcttccaaaagtgtgaaacagaggagatcacacatgtggaagccaaacctggcggcagcgcaaaagatg

SEQ ID NO: 144750 - DNA, 103 bp, Artificial Sequence
  Synthetic Polynucleotide
taatacgactcactatagggactcgtccacccacacgatccctggcttccaacagaggagaggaagcatgggatcgtgtaacctggcggcagcgcaaaagatg

SEQ ID NO: 144751 - DNA, 103 bp, Artificial Sequence
  Synthetic Polynucleotide
taatacgactcactatagggtgcagatccccccatttgcggacccgccataacagaggagaatggcgatgccgcaaatgaacctggcggcagcgcaaaagatg

SEQ ID NO: 144752 - DNA, 103 bp, Artificial Sequence
  Synthetic Polynucleotide
taatacgactcactatagggggccgactcaaattcaaagcattttgtataaacagaggagatatacaatgtgctttgaaaacctggcggcagcgcaaaagatg

SEQ ID NO: 144753 - DNA, 103 bp, Artificial Sequence
  Synthetic Polynucleotide
taatacgactcactatagggccgcagctgcatgggcacgttaaagctgtgaacagaggagacacagcatgaacgtgcccaacctggcggcagcgcaaaagatg

SEQ ID NO: 144754 - DNA, 103 bp, Artificial Sequence
  Synthetic Polynucleotide
taatacgactcactatagggtctcgtagatccgcagctgcatgggcacgtaacagaggagaacgtgcatgtgcagctgcaacctggcggcagcgcaaaagatg

SEQ ID NO: 144755 - DNA, 103 bp, Artificial Sequence
  Synthetic Polynucleotide
taatacgactcactatagggctgtcctcgatctcgtagatccgcagctgcaacagaggagagcagctatggatctacgaaacctggcggcagcgcaaaagatg

SEQ ID NO: 144756 - DNA, 103 bp, Artificial Sequence
  Synthetic Polynucleotide
taatacgactcactatagggcacccgcgtcctgtcctcgatctcgtagataacagaggagaatctacatgatcgaggacaacctggcggcagcgcaaaagatg

SEQ ID NO: 144757 - DNA, 103 bp, Artificial Sequence
  Synthetic Polynucleotide
taatacgactcactatagggatttgggctgcacccgcgtcctgtcctcgaaacagaggagatcgaggatgggacgcgggaacctggcggcagcgcaaaagatg

SEQ ID NO: 144758 - DNA, 103 bp, Artificial Sequence
  Synthetic Polynucleotide
taatacgactcactataggggggtaacggaatttgggctgcacccgcgtcaacagaggagagacgcgatggcagcccaaaacctggcggcagcgcaaaagatg

SEQ ID NO: 144759 - DNA, 103 bp, Artificial Sequence
  Synthetic Polynucleotide
taatacgactcactatagggatagtagaaggggtaacggaatttgggctgaacagaggagacagcccatgttccgttacaacctggcggcagcgcaaaagatg

SEQ ID NO: 144760 - DNA, 103 bp, Artificial Sequence
  Synthetic Polynucleotide
taatacgactcactatagggagcacatctcatagtagaaggggtaacggaaacagaggagatccgttatgccttctactaacctggcggcagcgcaaaagatg

SEQ ID NO: 144761 - DNA, 103 bp, Artificial Sequence
  Synthetic Polynucleotide
taatacgactcactatagggaggacataccagcacatctcatagtagaagaacagaggagacttctaatgtgagatgtgaacctggcggcagcgcaaaagatg

SEQ ID NO: 144762 - DNA, 103 bp, Artificial Sequence
  Synthetic Polynucleotide
taatacgactcactataggggtatctctccaggacataccagcacatctcaacagaggagagagatgatgtggtatgtcaacctggcggcagcgcaaaagatg

SEQ ID NO: 144763 - DNA, 103 bp, Artificial Sequence
  Synthetic Polynucleotide
taatacgactcactatagggggcgctgtgtggccgactcaaattcaaagcaacagaggagagctttgatgttgagtcggaacctggcggcagcgcaaaagatg

SEQ ID NO: 144764 - DNA, 103 bp, Artificial Sequence
  Synthetic Polynucleotide
taatacgactcactatagggcacagtacacgtatctctccaggacataccaacagaggagaggtatgatgtggagagataacctggcggcagcgcaaaagatg

SEQ ID NO: 144765 - DNA, 103 bp, Artificial Sequence
  Synthetic Polynucleotide
taatacgactcactatagggcgctgggtcacacagtacacgtatctctccaacagaggagaggagagatgcgtgtactgaacctggcggcagcgcaaaagatg

SEQ ID NO: 144766 - DNA, 103 bp, Artificial Sequence
  Synthetic Polynucleotide
taatacgactcactataggggaggtgggagcgctgggtcacacagtacacaacagaggagagtgtacatggtgacccagaacctggcggcagcgcaaaagatg

SEQ ID NO: 144767 - DNA, 103 bp, Artificial Sequence
  Synthetic Polynucleotide
taatacgactcactatagggattcctgagtgaggtgggagcgctgggtcaaacagaggagatgacccatggctcccaccaacctggcggcagcgcaaaagatg

SEQ ID NO: 144768 - DNA, 103 bp, Artificial Sequence
  Synthetic Polynucleotide
taatacgactcactatagggtccctctggtattcctgagtgaggtgggagaacagaggagactcccaatgcactcaggaaacctggcggcagcgcaaaagatg

SEQ ID NO: 144769 - DNA, 103 bp, Artificial Sequence
  Synthetic Polynucleotide
taatacgactcactatagggaagcatcgactccctctggtattcctgagtaacagaggagaactcagatgtaccagaggaacctggcggcagcgcaaaagatg

SEQ ID NO: 144770 - DNA, 103 bp, Artificial Sequence
  Synthetic Polynucleotide
taatacgactcactataggggggcatcaataagcatcgactccctctggtaacagaggagaaccagaatgagtcgatgcaacctggcggcagcgcaaaagatg

SEQ ID NO: 144771 - DNA, 103 bp, Artificial Sequence
  Synthetic Polynucleotide
taatacgactcactatagggggcttcctcggggcatcaataagcatcgacaacagaggagagtcgatatgtattgatgcaacctggcggcagcgcaaaagatg

SEQ ID NO: 144772 - DNA, 103 bp, Artificial Sequence
  Synthetic Polynucleotide
taatacgactcactataggggtctatgctgggcttcctcggggcatcaataacagaggagaattgatatgccgaggaagaacctggcggcagcgcaaaagatg

SEQ ID NO: 144773 - DNA, 103 bp, Artificial Sequence
  Synthetic Polynucleotide
taatacgactcactatagggaagagaagccgtctatgctgggcttcctcgaacagaggagacgaggaatgccagcatagaacctggcggcagcgcaaaagatg

SEQ ID NO: 144774 - DNA, 103 bp, Artificial Sequence
  Synthetic Polynucleotide
taatacgactcactatagggcggtcaatcgggcgctgtgtggccgactcaaacagaggagatgagtcatgcacacagcgaacctggcggcagcgcaaaagatg

SEQ ID NO: 144775 - DNA, 103 bp, Artificial Sequence
  Synthetic Polynucleotide
taatacgactcactatagggcaggaatccgaagagaagccgtctatgctgaacagaggagacagcatatgcggcttctcaacctggcggcagcgcaaaagatg

SEQ ID NO: 144776 - DNA, 103 bp, Artificial Sequence
  Synthetic Polynucleotide
taatacgactcactatagggcatctccagccaggaatccgaagagaagccaacagaggagaggcttcatgtcggattccaacctggcggcagcgcaaaagatg

SEQ ID NO: 144777 - DNA, 103 bp, Artificial Sequence
  Synthetic Polynucleotide
taatacgactcactatagggcctcctcctccatctccagccaggaatccgaacagaggagacggattatgggctggagaaacctggcggcagcgcaaaagatg

SEQ ID NO: 144778 - DNA, 103 bp, Artificial Sequence
  Synthetic Polynucleotide
taatacgactcactatagggtgatcacaggcctcctcctccatctccagcaacagaggagagctggaatgggaggaggaaacctggcggcagcgcaaaagatg

SEQ ID NO: 144779 - DNA, 103 bp, Artificial Sequence
  Synthetic Polynucleotide
taatacgactcactatagggctgaggctgctgatcacaggcctcctcctcaacagaggagagaggagatggcctgtgataacctggcggcagcgcaaaagatg

SEQ ID NO: 144780 - DNA, 103 bp, Artificial Sequence
  Synthetic Polynucleotide
taatacgactcactatagggcctcctcctcctgaggctgctgatcacaggaacagaggagacctgtgatgagcagcctcaacctggcggcagcgcaaaagatg

SEQ ID NO: 144781 - DNA, 103 bp, Artificial Sequence
  Synthetic Polynucleotide
taatacgactcactatagggtcgtccttctcctcctcctcctgaggctgcaacagaggagagcagccatgggaggaggaaacctggcggcagcgcaaaagatg

SEQ ID NO: 144782 - DNA, 103 bp, Artificial Sequence
  Synthetic Polynucleotide
taatacgactcactatagggctcgccctcctcgtccttctcctcctcctcaacagaggagagaggagatggagaaggacaacctggcggcagcgcaaaagatg

SEQ ID NO: 144783 - DNA, 103 bp, Artificial Sequence
  Synthetic Polynucleotide
taatacgactcactatagggtgtccctgccctcgccctcctcgtccttctaacagaggagaagaaggatgaggagggcgaacctggcggcagcgcaaaagatg

SEQ ID NO: 144784 - DNA, 103 bp, Artificial Sequence
  Synthetic Polynucleotide
taatacgactcactatagggttgggtgccctgtccctgccctcgccctccaacagaggagaggagggatggggcagggaaacctggcggcagcgcaaaagatg

SEQ ID NO: 144785 - DNA, 103 bp, Artificial Sequence
  Synthetic Polynucleotide
taatacgactcactataggggtatcgctggcggtcaatcgggcgctgtgtaacagaggagaacacagatgccgattgacaacctggcggcagcgcaaaagatg

SEQ ID NO: 144786 - DNA, 103 bp, Artificial Sequence
  Synthetic Polynucleotide
taatacgactcactatagggggtgggcggtttgggtgccctgtccctgccaacagaggagaggcaggatgagggcacccaacctggcggcagcgcaaaagatg

SEQ ID NO: 144787 - DNA, 103 bp, Artificial Sequence
  Synthetic Polynucleotide
taatacgactcactatagggtggagccatcggtgggcggtttgggtgcccaacagaggagagggcacatgaaccgcccaaacctggcggcagcgcaaaagatg

SEQ ID NO: 144788 - DNA, 103 bp, Artificial Sequence
  Synthetic Polynucleotide
taatacgactcactataggggtgggtgaagtggagccatcggtgggcggtaacagaggagaaccgccatgcgatggctcaacctggcggcagcgcaaaagatg

SEQ ID NO: 144789 - DNA, 103 bp, Artificial Sequence
  Synthetic Polynucleotide
taatacgactcactataggggggcgtgctggtgggtgaagtggagccatcaacagaggagagatggcatgacttcacccaacctggcggcagcgcaaaagatg

SEQ ID NO: 144790 - DNA, 103 bp, Artificial Sequence
  Synthetic Polynucleotide
taatacgactcactatagggggtcctcagagggcgtgctggtgggtgaagaacagaggagacttcacatgccagcacgcaacctggcggcagcgcaaaagatg

SEQ ID NO: 144791 - DNA, 103 bp, Artificial Sequence
  Synthetic Polynucleotide
taatacgactcactatagggagggcctcctggtcctcagagggcgtgctgaacagaggagacagcacatgctctgaggaaacctggcggcagcgcaaaagatg

SEQ ID NO: 144792 - DNA, 103 bp, Artificial Sequence
  Synthetic Polynucleotide
taatacgactcactatagggcttcttcccgagggcctcctggtcctcagaaacagaggagatctgagatgcaggaggccaacctggcggcagcgcaaaagatg

SEQ ID NO: 144793 - DNA, 103 bp, Artificial Sequence
  Synthetic Polynucleotide
taatacgactcactataggggtgctttgggcttcttcccgagggcctcctaacagaggagaaggaggatgtcgggaagaaacctggcggcagcgcaaaagatg

SEQ ID NO: 144794 - DNA, 103 bp, Artificial Sequence
  Synthetic Polynucleotide
taatacgactcactatagggcgcagggcaggtgctttgggcttcttcccgaacagaggagacgggaaatggcccaaagcaacctggcggcagcgcaaaagatg

SEQ ID NO: 144795 - DNA, 103 bp, Artificial Sequence
  Synthetic Polynucleotide
taatacgactcactatagggtttgaggaatcgcagggcaggtgctttgggaacagaggagacccaaaatgcctgccctgaacctggcggcagcgcaaaagatg

SEQ ID NO: 144796 - DNA, 103 bp, Artificial Sequence
  Synthetic Polynucleotide
taatacgactcactatagggcgttctcgtcgtatcgctggcggtcaatcgaacagaggagacgattgatggccagcgataacctggcggcagcgcaaaagatg

SEQ ID NO: 144797 - DNA, 103 bp, Artificial Sequence
  Synthetic Polynucleotide
taatacgactcactatagggacaaagtccttttgaggaatcgcagggcagaacagaggagactgcccatggattcctcaaacctggcggcagcgcaaaagatg

SEQ ID NO: 144798 - DNA, 103 bp, Artificial Sequence
  Synthetic Polynucleotide
taatacgactcactataggggactcattagacaaagtccttttgaggaataacagaggagaattcctatgaaggactttaacctggcggcagcgcaaaagatg

SEQ ID NO: 144799 - DNA, 103 bp, Artificial Sequence
  Synthetic Polynucleotide
taatacgactcactatagggactttcctccgactcattagacaaagtcctaacagaggagaaggactatgtctaatgagaacctggcggcagcgcaaaagatg

SEQ ID NO: 144800 - DNA, 103 bp, Artificial Sequence
  Synthetic Polynucleotide
taatacgactcactatagggtggacttcacactttcctccgactcattagaacagaggagactaatgatgcggaggaaaaacctggcggcagcgcaaaagatg

SEQ ID NO: 144801 - DNA, 103 bp, Artificial Sequence
  Synthetic Polynucleotide
taatacgactcactataggggccaatgtggtggacttcacactttcctccaacagaggagaggaggaatgtgtgaagtcaacctggcggcagcgcaaaagatg

SEQ ID NO: 144802 - DNA, 103 bp, Artificial Sequence
  Synthetic Polynucleotide
taatacgactcactataggggtagtctacggccaatgtggtggacttcacaacagaggagagtgaagatgaccacattgaacctggcggcagcgcaaaagatg

SEQ ID NO: 144803 - DNA, 103 bp, Artificial Sequence
  Synthetic Polynucleotide
taatacgactcactataggggggtcttggggtagtctacggccaatgtggaacagaggagaccacatatgccgtagactaacctggcggcagcgcaaaagatg

SEQ ID NO: 144804 - DNA, 103 bp, Artificial Sequence
  Synthetic Polynucleotide
taatacgactcactataggggagccggtgggggtcttggggtagtctacgaacagaggagacgtagaatgccccaagacaacctggcggcagcgcaaaagatg

SEQ ID NO: 144805 - DNA, 103 bp, Artificial Sequence
  Synthetic Polynucleotide
taatacgactcactatagggcgtggcgggagagccggtgggggtcttgggaacagaggagacccaagatgcccaccggcaacctggcggcagcgcaaaagatg

SEQ ID NO: 144806 - DNA, 103 bp, Artificial Sequence
  Synthetic Polynucleotide
taatacgactcactatagggcagagacctccgtggcgggagagccggtggaacagaggagaccaccgatgctcccgccaaacctggcggcagcgcaaaagatg

SEQ ID NO: 144807 - DNA, 103 bp, Artificial Sequence
  Synthetic Polynucleotide
taatacgactcactataggggacaagtcctcgttctcgtcgtatcgctggaacagaggagaccagcgatgcgacgagaaaacctggcggcagcgcaaaagatg

SEQ ID NO: 144808 - DNA, 103 bp, Artificial Sequence
  Synthetic Polynucleotide
taatacgactcactataggggtccatttggcagagacctccgtggcgggaaacagaggagatcccgcatgggaggtctcaacctggcggcagcgcaaaagatg

SEQ ID NO: 144809 - DNA, 103 bp, Artificial Sequence
  Synthetic Polynucleotide
taatacgactcactatagggagtgagatgggtccatttggcagagacctcaacagaggagagaggtcatggccaaatggaacctggcggcagcgcaaaagatg

SEQ ID NO: 144810 - DNA, 103 bp, Artificial Sequence
  Synthetic Polynucleotide
taatacgactcactataggggttcaaactcagtgagatgggtccatttggaacagaggagaccaaatatgcccatctcaaacctggcggcagcgcaaaagatg

SEQ ID NO: 144811 - DNA, 103 bp, Artificial Sequence
  Synthetic Polynucleotide
taatacgactcactatagggaggcccttcagttcaaactcagtgagatggaacagaggagaccatctatgtgagtttgaaacctggcggcagcgcaaaagatg

SEQ ID NO: 144812 - DNA, 103 bp, Artificial Sequence
  Synthetic Polynucleotide
taatacgactcactatagggcagagctttcaggcccttcagttcaaactcaacagaggagagagtttatgctgaagggcaacctggcggcagcgcaaaagatg

SEQ ID NO: 144813 - DNA, 103 bp, Artificial Sequence
  Synthetic Polynucleotide
taatacgactcactataggggtttctccaccagagctttcaggcccttcaaacagaggagatgaaggatgtgaaagctcaacctggcggcagcgcaaaagatg

SEQ ID NO: 144814 - DNA, 103 bp, Artificial Sequence
  Synthetic Polynucleotide
taatacgactcactatagggagggattccagtttctccaccagagctttcaacagaggagagaaagcatgggtggagaaaacctggcggcagcgcaaaagatg

SEQ ID NO: 144815 - DNA, 103 bp, Artificial Sequence
  Synthetic Polynucleotide
taatacgactcactataggggttctccgggagggattccagtttctccacaacagaggagagtggagatgctggaatccaacctggcggcagcgcaaaagatg

SEQ ID NO: 144816 - DNA, 103 bp, Artificial Sequence
  Synthetic Polynucleotide
taatacgactcactatagggcacacttcttgttctccgggagggattccaaacagaggagatggaatatgtcccggagaaacctggcggcagcgcaaaagatg

SEQ ID NO: 144817 - DNA, 103 bp, Artificial Sequence
  Synthetic Polynucleotide
taatacgactcactatagggccctcggggacacacttcttgttctccgggaacagaggagacccggaatgcaagaagtgaacctggcggcagcgcaaaagatg

SEQ ID NO: 144818 - DNA, 103 bp, Artificial Sequence
  Synthetic Polynucleotide
taatacgactcactatagggctccacgtccgacaagtcctcgttctcgtcaacagaggagagacgagatggaggacttgaacctggcggcagcgcaaaagatg

SEQ ID NO: 144819 - DNA, 103 bp, Artificial Sequence
  Synthetic Polynucleotide
taatacgactcactataggggtcctcgatgccctcggggacacacttcttaacagaggagaaagaagatggtccccgagaacctggcggcagcgcaaaagatg

SEQ ID NO: 144820 - DNA, 103 bp, Artificial Sequence
  Synthetic Polynucleotide
taatacgactcactataggggtgcctgggggtcctcgatgccctcggggaaacagaggagatccccgatggcatcgaggaacctggcggcagcgcaaaagatg

SEQ ID NO: 144821 - DNA, 103 bp, Artificial Sequence
  Synthetic Polynucleotide
taatacgactcactatagggccctccaggagtgcctgggggtcctcgatgaacagaggagacatcgaatgcccccaggcaacctggcggcagcgcaaaagatg

SEQ ID NO: 144822 - DNA, 103 bp, Artificial Sequence
  Synthetic Polynucleotide
taatacgactcactataggggttcttcacaccctccaggagtgcctggggaacagaggagaccccagatgctcctggagaacctggcggcagcgcaaaagatg

SEQ ID NO: 144823 - DNA, 103 bp, Artificial Sequence
  Synthetic Polynucleotide
taatacgactcactatagggccttcaggacgttcttcacaccctccaggaaacagaggagatcctggatggtgtgaagaaacctggcggcagcgcaaaagatg

SEQ ID NO: 144824 - DNA, 103 bp, Artificial Sequence
  Synthetic Polynucleotide
taatacgactcactatagggtctgcgtgctccttcaggacgttcttcacaaacagaggagatgtgaaatgcgtcctgaaaacctggcggcagcgcaaaagatg

SEQ ID NO: 144825 - DNA, 103 bp, Artificial Sequence
  Synthetic Polynucleotide
taatacgactcactatagggagggtcatcatctgcgtgctccttcaggacaacagaggagagtcctgatggagcacgcaaacctggcggcagcgcaaaagatg

SEQ ID NO: 144826 - DNA, 103 bp, Artificial Sequence
  Synthetic Polynucleotide
taatacgactcactatagggtggccagactagggtcatcatctgcgtgctaacagaggagaagcacgatgatgatgaccaacctggcggcagcgcaaaagatg

SEQ ID NO: 144827 - DNA, 103 bp, Artificial Sequence
  Synthetic Polynucleotide
taatacgactcactatagggaccccagtgatggccagactagggtcatcaaacagaggagatgatgaatgtagtctggcaacctggcggcagcgcaaaagatg

SEQ ID NO: 144828 - DNA, 103 bp, Artificial Sequence
  Synthetic Polynucleotide
taatacgactcactatagggcaccacagggaccccagtgatggccagactaacagaggagaagtctgatgatcactgggaacctggcggcagcgcaaaagatg

SEQ ID NO: 144829 - DNA, 103 bp, Artificial Sequence
  Synthetic Polynucleotide
taatacgactcactatagggtgacgatctcctccacgtccgacaagtcctaacagaggagaaggactatgcggacgtggaacctggcggcagcgcaaaagatg

SEQ ID NO: 144830 - DNA, 103 bp, Artificial Sequence
  Synthetic Polynucleotide
taatacgactcactatagggttggccaagtcaccacagggaccccagtgaaacagaggagatcactgatgtccctgtggaacctggcggcagcgcaaaagatg

SEQ ID NO: 144831 - DNA, 103 bp, Artificial Sequence
  Synthetic Polynucleotide
taatacgactcactatagggggagtcttctttggccaagtcaccacagggaacagaggagaccctgtatggacttggccaacctggcggcagcgcaaaagatg

SEQ ID NO: 144832 - DNA, 103 bp, Artificial Sequence
  Synthetic Polynucleotide
taatacgactcactatagggccggttctttggagtcttctttggccaagtaacagaggagaacttggatgaagaagactaacctggcggcagcgcaaaagatg

SEQ ID NO: 144833 - DNA, 103 bp, Artificial Sequence
  Synthetic Polynucleotide
taatacgactcactataggggacccacagcccggttctttggagtcttctaacagaggagaagaagaatgcaaagaaccaacctggcggcagcgcaaaagatg

SEQ ID NO: 144834 - DNA, 103 bp, Artificial Sequence
  Synthetic Polynucleotide
taatacgactcactatagggcccttgggccgacccacagcccggttctttaacagaggagaaaagaaatgggctgtgggaacctggcggcagcgcaaaagatg

SEQ ID NO: 144835 - DNA, 103 bp, Artificial Sequence
  Synthetic Polynucleotide
taatacgactcactataggggcccagcttccccttgggccgacccacagcaacagaggagagctgtgatgcggcccaagaacctggcggcagcgcaaaagatg

SEQ ID NO: 144836 - DNA, 103 bp, Artificial Sequence
  Synthetic Polynucleotide
taatacgactcactatagggcggaggccgggcccagcttccccttgggccaacagaggagaggcccaatgggaagctggaacctggcggcagcgcaaaagatg

SEQ ID NO: 144837 - DNA, 103 bp, Artificial Sequence
  Synthetic Polynucleotide
taatacgactcactatagggaacttcaccgcggaggccgggcccagcttcaacagaggagagaagctatgcccggcctcaacctggcggcagcgcaaaagatg

SEQ ID NO: 144838 - DNA, 103 bp, Artificial Sequence
  Synthetic Polynucleotide
taatacgactcactataggggttggcggccaacttcaccgcggaggccggaacagaggagaccggccatggcggtgaagaacctggcggcagcgcaaaagatg

SEQ ID NO: 144839 - DNA, 103 bp, Artificial Sequence
  Synthetic Polynucleotide
taatacgactcactatagggccgttgtccggttggcggccaacttcaccgaacagaggagacggtgaatgtggccgccaaacctggcggcagcgcaaaagatg

SEQ ID NO: 144840 - DNA, 103 bp, Artificial Sequence
  Synthetic Polynucleotide
taatacgactcactatagggccgcggacgctgacgatctcctccacgtccaacagaggagaggacgtatgggagatcgtaacctggcggcagcgcaaaagatg

SEQ ID NO: 144841 - DNA, 103 bp, Artificial Sequence
  Synthetic Polynucleotide
taatacgactcactatagggcgagctcctgccgttgtccggttggcggccaacagaggagaggccgcatgccggacaacaacctggcggcagcgcaaaagatg

SEQ ID NO: 144842 - DNA, 103 bp, Artificial Sequence
  Synthetic Polynucleotide
taatacgactcactatagggccggcgccgccgagctcctgccgttgtccgaacagaggagacggacaatggcaggagctaacctggcggcagcgcaaaagatg

SEQ ID NO: 144843 - DNA, 103 bp, Artificial Sequence
  Synthetic Polynucleotide
taatacgactcactatagggggcatcgcgtccggcgccgccgagctcctgaacagaggagacaggagatgggcggcgccaacctggcggcagcgcaaaagatg

SEQ ID NO: 144844 - DNA, 103 bp, Artificial Sequence
  Synthetic Polynucleotide
taatacgactcactatagggtcgcacttgcggcatcgcgtccggcgccgcaacagaggagagcggcgatggacgcgatgaacctggcggcagcgcaaaagatg

SEQ ID NO: 144845 - DNA, 103 bp, Artificial Sequence
  Synthetic Polynucleotide
taatacgactcactatagggcaggcaggcctcgcacttgcggcatcgcgtaacagaggagaacgcgaatgcgcaagtgcaacctggcggcagcgcaaaagatg

SEQ ID NO: 144846 - DNA, 103 bp, Artificial Sequence
  Synthetic Polynucleotide
taatacgactcactatagggactcggtccgcaggcaggcctcgcacttgcaacagaggagagcaagtatgaggcctgccaacctggcggcagcgcaaaagatg

SEQ ID NO: 144847 - DNA, 103 bp, Artificial Sequence
  Synthetic Polynucleotide
taatacgactcactatagggcactctccgcactcggtccgcaggcaggccaacagaggagaggcctgatggcggaccgaaacctggcggcagcgcaaaagatg

SEQ ID NO: 144848 - DNA, 103 bp, Artificial Sequence
  Synthetic Polynucleotide
taatacgactcactataggggcagaagtggcactctccgcactcggtccgaacagaggagacggaccatgtgcggagagaacctggcggcagcgcaaaagatg

SEQ ID NO: 144849 - DNA, 103 bp, Artificial Sequence
  Synthetic Polynucleotide
taatacgactcactatagggtcatgtccttgcagaagtggcactctccgcaacagaggagagcggagatggccacttctaacctggcggcagcgcaaaagatg

SEQ ID NO: 144850 - DNA, 103 bp, Artificial Sequence
  Synthetic Polynucleotide
taatacgactcactatagggccgaacttcttcatgtccttgcagaagtggaacagaggagaccacttatgcaaggacataacctggcggcagcgcaaaagatg

SEQ ID NO: 144851 - DNA, 103 bp, Artificial Sequence
  Synthetic Polynucleotide
taatacgactcactatagggcaggctgaagccgcggacgctgacgatctcaacagaggagagagatcatgagcgtccgcaacctggcggcagcgcaaaagatg

SEQ ID NO: 144852 - DNA, 103 bp, Artificial Sequence
  Synthetic Polynucleotide
taatacgactcactatagggcccggggcccccgaacttcttcatgtccttaacagaggagaaaggacatgaagaagttcaacctggcggcagcgcaaaagatg

SEQ ID NO: 144853 - DNA, 103 bp, Artificial Sequence
  Synthetic Polynucleotide
taatacgactcactataggggcttcatgcgcccggggcccccgaacttctaacagaggagaagaagtatgggggccccgaacctggcggcagcgcaaaagatg

SEQ ID NO: 144854 - DNA, 103 bp, Artificial Sequence
  Synthetic Polynucleotide
taatacgactcactatagggatgcagctctgcttcatgcgcccggggcccaacagaggagagggcccatggcgcatgaaaacctggcggcagcgcaaaagatg

SEQ ID NO: 144855 - DNA, 103 bp, Artificial Sequence
  Synthetic Polynucleotide
taatacgactcactatagggctgccgcatgatgcagctctgcttcatgcgaacagaggagacgcatgatgcagagctgcaacctggcggcagcgcaaaagatg

SEQ ID NO: 144856 - DNA, 103 bp, Artificial Sequence
  Synthetic Polynucleotide
taatacgactcactataggggcgcgatgcactgccgcatgatgcagctctaacagaggagaagagctatgtcatgcggcaacctggcggcagcgcaaaagatg

SEQ ID NO: 144857 - DNA, 103 bp, Artificial Sequence
  Synthetic Polynucleotide
taatacgactcactatagggggcagcactggcgcgatgcactgccgcatgaacagaggagacatgcgatggtgcatcgcaacctggcggcagcgcaaaagatg

SEQ ID NO: 144858 - DNA, 103 bp, Artificial Sequence
  Synthetic Polynucleotide
taatacgactcactatagggggcggtgtggggcagcactggcgcgatgcaaacagaggagatgcatcatgccagtgctgaacctggcggcagcgcaaaagatg

SEQ ID NO: 144859 - DNA, 103 bp, Artificial Sequence
  Synthetic Polynucleotide
taatacgactcactatagggcaaggcacacggcggtgtggggcagcactgaacagaggagacagtgcatgcccacaccgaacctggcggcagcgcaaaagatg

SEQ ID NO: 144860 - DNA, 103 bp, Artificial Sequence
  Synthetic Polynucleotide
taatacgactcactatagggtcgccacacacaaggcacacggcggtgtggaacagaggagaccacacatgcgtgtgcctaacctggcggcagcgcaaaagatg

SEQ ID NO: 144861 - DNA, 103 bp, Artificial Sequence
  Synthetic Polynucleotide
taatacgactcactatagggcttccccgcctcgccacacacaaggcacacaacagaggagagtgtgcatggtgtgtggcaacctggcggcagcgcaaaagatg

SEQ ID NO: 144862 - DNA, 103 bp, Artificial Sequence
  Synthetic Polynucleotide
taatacgactcactatagggggtgatcctctgcagatccccccatttgcgaacagaggagacgcaaaatgggggatctgaacctggcggcagcgcaaaagatg

SEQ ID NO: 144863 - DNA, 103 bp, Artificial Sequence
  Synthetic Polynucleotide
taatacgactcactataggggcttctcctccaggctgaagccgcggacgcaacagaggagagcgtccatggcttcagccaacctggcggcagcgcaaaagatg

SEQ ID NO: 144864 - DNA, 103 bp, Artificial Sequence
  Synthetic Polynucleotide
taatacgactcactatagggccgtgtcttccttccccgcctcgccacacaaacagaggagatgtgtgatgaggcggggaaacctggcggcagcgcaaaagatg

SEQ ID NO: 144865 - DNA, 103 bp, Artificial Sequence
  Synthetic Polynucleotide
taatacgactcactatagggtcctcttccaccgtgtcttccttccccgccaacagaggagaggcgggatgggaagacacaacctggcggcagcgcaaaagatg

SEQ ID NO: 144866 - DNA, 103 bp, Artificial Sequence
  Synthetic Polynucleotide
taatacgactcactatagggcttgccttcctcctcttccaccgtgtcttcaacagaggagagaagacatggtggaagagaacctggcggcagcgcaaaagatg

SEQ ID NO: 144867 - DNA, 103 bp, Artificial Sequence
  Synthetic Polynucleotide
taatacgactcactatagggtgaggttaaacttgccttcctcctcttccaaacagaggagatggaagatgaggaaggcaaacctggcggcagcgcaaaagatg

SEQ ID NO: 144868 - DNA, 103 bp, Artificial Sequence
  Synthetic Polynucleotide
taatacgactcactatagggtccatgagcatgaggttaaacttgccttccaacagaggagaggaaggatggtttaacctaacctggcggcagcgcaaaagatg

SEQ ID NO: 144869 - DNA, 103 bp, Artificial Sequence
  Synthetic Polynucleotide
taatacgactcactataggggatggagcactccatgagcatgaggttaaaaacagaggagatttaacatgatgctcatgaacctggcggcagcgcaaaagatg

SEQ ID NO: 144870 - DNA, 103 bp, Artificial Sequence
  Synthetic Polynucleotide
taatacgactcactatagggtttcattgcagatggagcactccatgagcaaacagaggagatgctcaatgagtgctccaaacctggcggcagcgcaaaagatg

SEQ ID NO: 144871 - DNA, 103 bp, Artificial Sequence
  Synthetic Polynucleotide
taatacgactcactataggggggtggatgatttcattgcagatggagcacaacagaggagagtgctcatgctgcaatgaaacctggcggcagcgcaaaagatg

SEQ ID NO: 144872 - DNA, 103 bp, Artificial Sequence
  Synthetic Polynucleotide
taatacgactcactatagggaaggcatccagggtggatgatttcattgcaaacagaggagatgcaatatgatcatccacaacctggcggcagcgcaaaagatg

SEQ ID NO: 144873 - DNA, 103 bp, Artificial Sequence
  Synthetic Polynucleotide
taatacgactcactatagggccttaatcttaaggcatccagggtggatgaaacagaggagatcatccatgctggatgccaacctggcggcagcgcaaaagatg

SEQ ID NO: 144874 - DNA, 103 bp, Artificial Sequence
  Synthetic Polynucleotide
taatacgactcactatagggtggctgcgaagcttctcctccaggctgaagaacagaggagacttcagatgggaggagaaaacctggcggcagcgcaaaagatg

SEQ ID NO: 144875 - DNA, 103 bp, Artificial Sequence
  Synthetic Polynucleotide
taatacgactcactatagggccctctgactccttaatcttaaggcatccaaacagaggagatggatgatgtaagattaaaacctggcggcagcgcaaaagatg

SEQ ID NO: 144876 - DNA, 103 bp, Artificial Sequence
  Synthetic Polynucleotide
taatacgactcactataggggttgaccacaccctctgactccttaatcttaacagaggagaaagattatggagtcagagaacctggcggcagcgcaaaagatg

SEQ ID NO: 144877 - DNA, 103 bp, Artificial Sequence
  Synthetic Polynucleotide
taatacgactcactataggggaagctcgtcgttgaccacaccctctgactaacagaggagaagtcagatggtgtggtcaaacctggcggcagcgcaaaagatg

SEQ ID NO: 144878 - DNA, 103 bp, Artificial Sequence
  Synthetic Polynucleotide
taatacgactcactatagggcagcagtttggaagctcgtcgttgaccacaaacagaggagatgtggtatgcgacgagctaacctggcggcagcgcaaaagatg

SEQ ID NO: 144879 - DNA, 103 bp, Artificial Sequence
  Synthetic Polynucleotide
taatacgactcactatagggcggacactcccagcagtttggaagctcgtcaacagaggagagacgagatgccaaactgcaacctggcggcagcgcaaaagatg

SEQ ID NO: 144880 - DNA, 103 bp, Artificial Sequence
  Synthetic Polynucleotide
taatacgactcactatagggggttacacttcggacactcccagcagtttgaacagaggagacaaactatggggagtgtcaacctggcggcagcgcaaaagatg

SEQ ID NO: 144881 - DNA, 103 bp, Artificial Sequence
  Synthetic Polynucleotide
taatacgactcactatagggttgccggcgtggttacacttcggacactccaacagaggagaggagtgatggaagtgtaaaacctggcggcagcgcaaaagatg

SEQ ID NO: 144882 - DNA, 103 bp, Artificial Sequence
  Synthetic Polynucleotide
taatacgactcactatagggtttcccggtcttgccggcgtggttacacttaacagaggagaaagtgtatgcacgccggcaacctggcggcagcgcaaaagatg

SEQ ID NO: 144883 - DNA, 103 bp, Artificial Sequence
  Synthetic Polynucleotide
taatacgactcactatagggcacgcttttgtttcccggtcttgccggcgtaacagaggagaacgccgatgagaccgggaaacctggcggcagcgcaaaagatg

SEQ ID NO: 144884 - DNA, 103 bp, Artificial Sequence
  Synthetic Polynucleotide
taatacgactcactatagggaagccagggccacgcttttgtttcccggtcaacagaggagagaccggatgacaaaagcgaacctggcggcagcgcaaaagatg

SEQ ID NO: 144885 - DNA, 103 bp, Artificial Sequence
  Synthetic Polynucleotide
taatacgactcactatagggctggtacagctggctgcgaagcttctcctcaacagaggagagaggagatgcttcgcagcaacctggcggcagcgcaaaagatg

SEQ ID NO: 144886 - DNA, 103 bp, Artificial Sequence
  Synthetic Polynucleotide
taatacgactcactatagggggcgtacttaaagccagggccacgcttttgaacagaggagacaaaagatgggccctggcaacctggcggcagcgcaaaagatg

SEQ ID NO: 144887 - DNA, 103 bp, Artificial Sequence
  Synthetic Polynucleotide
taatacgactcactataggggcaggttggaggcgtacttaaagccagggcaacagaggagagccctgatgttaagtacgaacctggcggcagcgcaaaagatg

SEQ ID NO: 144888 - DNA, 103 bp, Artificial Sequence
  Synthetic Polynucleotide
taatacgactcactatagggagggagccgggcaggttggaggcgtacttaaacagaggagataagtaatgctccaacctaacctggcggcagcgcaaaagatg

SEQ ID NO: 144889 - DNA, 103 bp, Artificial Sequence
  Synthetic Polynucleotide
taatacgactcactatagggctccttgagcagggagccgggcaggttggaaacagaggagatccaacatgcccggctccaacctggcggcagcgcaaaagatg

SEQ ID NO: 144890 - DNA, 103 bp, Artificial Sequence
  Synthetic Polynucleotide
taatacgactcactatagggtcatcttctgctccttgagcagggagccggaacagaggagaccggctatgtgctcaaggaacctggcggcagcgcaaaagatg

SEQ ID NO: 144891 - DNA, 103 bp, Artificial Sequence
  Synthetic Polynucleotide
taatacgactcactatagggttgtcccggttcatcttctgctccttgagcaacagaggagagctcaaatggcagaagataacctggcggcagcgcaaaagatg

SEQ ID NO: 144892 - DNA, 103 bp, Artificial Sequence
  Synthetic Polynucleotide
taatacgactcactatagggcccttccttgttgtcccggttcatcttctgaacagaggagacagaagatgaaccgggacaacctggcggcagcgcaaaagatg

SEQ ID NO: 144893 - DNA, 103 bp, Artificial Sequence
  Synthetic Polynucleotide
taatacgactcactatagggcaggttcctgcccttccttgttgtcccggtaacagaggagaaccgggatgacaaggaagaacctggcggcagcgcaaaagatg

SEQ ID NO: 144894 - DNA, 103 bp, Artificial Sequence
  Synthetic Polynucleotide
taatacgactcactatagggctccgcttggcaggttcctgcccttccttgaacagaggagacaaggaatggcaggaaccaacctggcggcagcgcaaaagatg

SEQ ID NO: 144895 - DNA, 103 bp, Artificial Sequence
  Synthetic Polynucleotide
taatacgactcactatagggacactcactcctccgcttggcaggttcctgaacagaggagacaggaaatggccaagcggaacctggcggcagcgcaaaagatg

SEQ ID NO: 144896 - DNA, 103 bp, Artificial Sequence
  Synthetic Polynucleotide
taatacgactcactatagggcgaagtccccctggtacagctggctgcgaaaacagaggagattcgcaatgagctgtaccaacctggcggcagcgcaaaagatg

SEQ ID NO: 144897 - DNA, 103 bp, Artificial Sequence
  Synthetic Polynucleotide
taatacgactcactataggggcgcctcctcacactcactcctccgcttggaacagaggagaccaagcatgggagtgagtaacctggcggcagcgcaaaagatg

SEQ ID NO: 144898 - DNA, 103 bp, Artificial Sequence
  Synthetic Polynucleotide
taatacgactcactatagggctgcgccggggcgcctcctcacactcactcaacagaggagagagtgaatgtgaggaggcaacctggcggcagcgcaaaagatg

SEQ ID NO: 144899 - DNA, 103 bp, Artificial Sequence
  Synthetic Polynucleotide
taatacgactcactatagggctcatccgacctgcgccggggcgcctcctcaacagaggagagaggagatgccccggcgcaacctggcggcagcgcaaaagatg

SEQ ID NO: 144900 - DNA, 103 bp, Artificial Sequence
  Synthetic Polynucleotide
taatacgactcactatagggtcttcgagtgctcatccgacctgcgccgggaacagaggagacccggcatgggtcggatgaacctggcggcagcgcaaaagatg

SEQ ID NO: 144901 - DNA, 103 bp, Artificial Sequence
  Synthetic Polynucleotide
taatacgactcactatagggggcggcaccttcttcgagtgctcatccgacaacagaggagagtcggaatggcactcgaaaacctggcggcagcgcaaaagatg

SEQ ID NO: 144902 - DNA, 103 bp, Artificial Sequence
  Synthetic Polynucleotide
taatacgactcactatagggaaggccgtccggcggcaccttcttcgagtgaacagaggagacactcgatgaaggtgccgaacctggcggcagcgcaaaagatg

SEQ ID NO: 144903 - DNA, 103 bp, Artificial Sequence
  Synthetic Polynucleotide
taatacgactcactatagggttctgcgcagaaggccgtccggcggcacctaacagaggagaaggtgcatgcggacggccaacctggcggcagcgcaaaagatg

SEQ ID NO: 144904 - DNA, 103 bp, Artificial Sequence
  Synthetic Polynucleotide
taatacgactcactatagggtcgtcagactttctgcgcagaaggccgtccaacagaggagaggacggatgtctgcgcagaacctggcggcagcgcaaaagatg

SEQ ID NO: 144905 - DNA, 103 bp, Artificial Sequence
  Synthetic Polynucleotide
taatacgactcactatagggcaggtgcacgtcgtcagactttctgcgcagaacagaggagactgcgcatgaagtctgacaacctggcggcagcgcaaaagatg

SEQ ID NO: 144906 - DNA, 103 bp, Artificial Sequence
  Synthetic Polynucleotide
taatacgactcactataggggcttcttcctcaggtgcacgtcgtcagactaacagaggagaagtctgatgacgtgcaccaacctggcggcagcgcaaaagatg

SEQ ID NO: 144907 - DNA, 103 bp, Artificial Sequence
  Synthetic Polynucleotide
taatacgactcactatagggatggcgtgcacgaagtccccctggtacagcaacagaggagagctgtaatggggggacttaacctggcggcagcgcaaaagatg

SEQ ID NO: 144908 - DNA, 103 bp, Artificial Sequence
  Synthetic Polynucleotide
taatacgactcactatagggtcgtatttccgcttcttcctcaggtgcacgaacagaggagacgtgcaatggaggaagaaaacctggcggcagcgcaaaagatg

SEQ ID NO: 144909 - DNA, 103 bp, Artificial Sequence
  Synthetic Polynucleotide
taatacgactcactatagggctggggcttctcgtatttccgcttcttcctaacagaggagaaggaagatgcggaaatacaacctggcggcagcgcaaaagatg

SEQ ID NO: 144910 - DNA, 103 bp, Artificial Sequence
  Synthetic Polynucleotide
taatacgactcactatagggcactcagctcctggggcttctcgtatttccaacagaggagaggaaatatgagaagccccaacctggcggcagcgcaaaagatg

SEQ ID NO: 144911 - DNA, 103 bp, Artificial Sequence
  Synthetic Polynucleotide
taatacgactcactatagggcgcttgcgtccactcagctcctggggcttcaacagaggagagaagccatgggagctgagaacctggcggcagcgcaaaagatg

SEQ ID NO: 144912 - DNA, 103 bp, Artificial Sequence
  Synthetic Polynucleotide
taatacgactcactatagggcgatgaggcccgcttgcgtccactcagctcaacagaggagagagctgatgggacgcaagaacctggcggcagcgcaaaagatg

SEQ ID NO: 144913 - DNA, 103 bp, Artificial Sequence
  Synthetic Polynucleotide
taatacgactcactatagggacgtttgaagcgatgaggcccgcttgcgtcaacagaggagagacgcaatggggcctcataacctggcggcagcgcaaaagatg

SEQ ID NO: 144914 - DNA, 103 bp, Artificial Sequence
  Synthetic Polynucleotide
taatacgactcactataggggaaccgggggacgtttgaagcgatgaggccaacagaggagaggcctcatggcttcaaacaacctggcggcagcgcaaaagatg

SEQ ID NO: 144915 - DNA, 103 bp, Artificial Sequence
  Synthetic Polynucleotide
taatacgactcactataggggtgagaggaggaaccgggggacgtttgaagaacagaggagacttcaaatgtcccccggtaacctggcggcagcgcaaaagatg

SEQ ID NO: 144916 - DNA, 103 bp, Artificial Sequence
  Synthetic Polynucleotide
taatacgactcactatagggtcggcgagaggtgagaggaggaaccgggggaacagaggagacccccgatgcctcctctcaacctggcggcagcgcaaaagatg

SEQ ID NO: 144917 - DNA, 103 bp, Artificial Sequence
  Synthetic Polynucleotide
taatacgactcactatagggagagggggcctcggcgagaggtgagaggagaacagaggagactcctcatgcctctcgccaacctggcggcagcgcaaaagatg

SEQ ID NO: 144918 - DNA, 103 bp, Artificial Sequence
  Synthetic Polynucleotide
taatacgactcactatagggtttgccctccatggcgtgcacgaagtccccaacagaggagaggggacatggtgcacgccaacctggcggcagcgcaaaagatg

SEQ ID NO: 144919 - DNA, 103 bp, Artificial Sequence
  Synthetic Polynucleotide
taatacgactcactataggggctgctgcctagagggggcctcggcgagagaacagaggagactctcgatgaggccccctaacctggcggcagcgcaaaagatg

SEQ ID NO: 144920 - DNA, 103 bp, Artificial Sequence
  Synthetic Polynucleotide
taatacgactcactatagggaggggctgaggctgctgcctagagggggccaacagaggagaggccccatgtaggcagcaaacctggcggcagcgcaaaagatg

SEQ ID NO: 144921 - DNA, 103 bp, Artificial Sequence
  Synthetic Polynucleotide
taatacgactcactataggggatctccaccaggggctgaggctgctgcctaacagaggagaaggcagatgcctcagcccaacctggcggcagcgcaaaagatg

SEQ ID NO: 144922 - DNA, 103 bp, Artificial Sequence
  Synthetic Polynucleotide
taatacgactcactatagggagtgagactggatctccaccaggggctgagaacagaggagactcagcatgtggtggagaaacctggcggcagcgcaaaagatg

SEQ ID NO: 144923 - DNA, 103 bp, Artificial Sequence
  Synthetic Polynucleotide
taatacgactcactataggggctggaagtaagtgagactggatctccaccaacagaggagaggtggaatgccagtctcaaacctggcggcagcgcaaaagatg

SEQ ID NO: 144924 - DNA, 103 bp, Artificial Sequence
  Synthetic Polynucleotide
taatacgactcactatagggttgagctgctgctggaagtaagtgagactgaacagaggagacagtctatgttacttccaaacctggcggcagcgcaaaagatg

SEQ ID NO: 144925 - DNA, 103 bp, Artificial Sequence
  Synthetic Polynucleotide
taatacgactcactatagggtttgccaggtttgagctgctgctggaagtaaacagaggagatacttcatgcagcagctcaacctggcggcagcgcaaaagatg

SEQ ID NO: 144926 - DNA, 103 bp, Artificial Sequence
  Synthetic Polynucleotide
taatacgactcactataggggcttatcttctttgccaggtttgagctgctaacagaggagaagcagcatgaacctggcaaacctggcggcagcgcaaaagatg

SEQ ID NO: 144927 - DNA, 103 bp, Artificial Sequence
  Synthetic Polynucleotide
taatacgactcactatagggttcctgaaaagcttatcttctttgccaggtaacagaggagaacctggatgagaagataaaacctggcggcagcgcaaaagatg

SEQ ID NO: 144928 - DNA, 103 bp, Artificial Sequence
  Synthetic Polynucleotide
taatacgactcactatagggccgccgctttttcctgaaaagcttatcttcaacagaggagagaagatatgcttttcaggaacctggcggcagcgcaaaagatg

SEQ ID NO: 144929 - DNA, 103 bp, Artificial Sequence
  Synthetic Polynucleotide
taatacgactcactatagggagttgaaatctttgccctccatggcgtgcaaacagaggagatgcacgatgtggagggcaaacctggcggcagcgcaaaagatg

SEQ ID NO: 144930 - DNA, 103 bp, Artificial Sequence
  Synthetic Polynucleotide
taatacgactcactatagggtcttccaggaccgccgctttttcctgaaaaaacagaggagattttcaatgaaaagcggcaacctggcggcagcgcaaaagatg

SEQ ID NO: 144931 - DNA, 103 bp, Artificial Sequence
  Synthetic Polynucleotide
taatacgactcactatagggtcctcggcgttcttccaggaccgccgctttaacagaggagaaaagcgatggtcctggaaaacctggcggcagcgcaaaagatg

SEQ ID NO: 144932 - DNA, 103 bp, Artificial Sequence
  Synthetic Polynucleotide
taatacgactcactatagggcgccatgcggtcctcggcgttcttccaggaaacagaggagatcctggatgaacgccgagaacctggcggcagcgcaaaagatg

SEQ ID NO: 144933 - DNA, 103 bp, Artificial Sequence
  Synthetic Polynucleotide
taatacgactcactatagggtgttggccagcgccatgcggtcctcggcgtaacagaggagaacgccgatgaccgcatggaacctggcggcagcgcaaaagatg

SEQ ID NO: 144934 - DNA, 103 bp, Artificial Sequence
  Synthetic Polynucleotide
taatacgactcactatagggcggaggggcttgttggccagcgccatgcggaacagaggagaccgcatatggctggccaaaacctggcggcagcgcaaaagatg

SEQ ID NO: 144935 - DNA, 103 bp, Artificial Sequence
  Synthetic Polynucleotide
taatacgactcactatagggcttgaagcgccggaggggcttgttggccagaacagaggagactggccatgaagcccctcaacctggcggcagcgcaaaagatg

SEQ ID NO: 144936 - DNA, 103 bp, Artificial Sequence
  Synthetic Polynucleotide
taatacgactcactatagggcgggttcctgcttgaagcgccggaggggctaacagaggagaagccccatgggcgcttcaaacctggcggcagcgcaaaagatg

SEQ ID NO: 144937 - DNA, 103 bp, Artificial Sequence
  Synthetic Polynucleotide
taatacgactcactatagggagttcgtcctcgggttcctgcttgaagcgcaacagaggagagcgcttatggcaggaaccaacctggcggcagcgcaaaagatg

SEQ ID NO: 144938 - DNA, 103 bp, Artificial Sequence
  Synthetic Polynucleotide
taatacgactcactatagggcgcctcgggcagttcgtcctcgggttcctgaacagaggagacaggaaatggaggacgaaaacctggcggcagcgcaaaagatg

SEQ ID NO: 144939 - DNA, 103 bp, Artificial Sequence
  Synthetic Polynucleotide
taatacgactcactatagggtcttggggggcgcctcgggcagttcgtcctaacagaggagaaggacgatgtgcccgaggaacctggcggcagcgcaaaagatg

SEQ ID NO: 144940 - DNA, 103 bp, Artificial Sequence
  Synthetic Polynucleotide
taatacgactcactatagggacgtactcatagttgaaatctttgccctccaacagaggagaggagggatgagatttcaaaacctggcggcagcgcaaaagatg

SEQ ID NO: 144941 - DNA, 103 bp, Artificial Sequence
  Synthetic Polynucleotide
taatacgactcactatagggctctccctggtcttggggggcgcctcgggcaacagaggagagcccgaatggccccccaaaacctggcggcagcgcaaaagatg

SEQ ID NO: 144942 - DNA, 103 bp, Artificial Sequence
  Synthetic Polynucleotide
taatacgactcactatagggggagtggtcgctctccctggtcttggggggaacagaggagaccccccatgaccagggagaacctggcggcagcgcaaaagatg

SEQ ID NO: 144943 - DNA, 103 bp, Artificial Sequence
  Synthetic Polynucleotide
taatacgactcactatagggagctggagcgggagtggtcgctctccctggaacagaggagaccagggatggcgaccactaacctggcggcagcgcaaaagatg

SEQ ID NO: 144944 - DNA, 103 bp, Artificial Sequence
  Synthetic Polynucleotide
taatacgactcactataggggcggtgggggagctggagcgggagtggtcgaacagaggagacgaccaatgccgctccagaacctggcggcagcgcaaaagatg

SEQ ID NO: 144945 - DNA, 103 bp, Artificial Sequence
  Synthetic Polynucleotide
taatacgactcactataggggctgggtcccgcggtgggggagctggagcgaacagaggagacgctccatgtcccccaccaacctggcggcagcgcaaaagatg

SEQ ID NO: 144946 - DNA, 103 bp, Artificial Sequence
  Synthetic Polynucleotide
taatacgactcactatagggccccttcggtgctgggtcccgcggtgggggaacagaggagacccccaatgcgggacccaaacctggcggcagcgcaaaagatg

SEQ ID NO: 144947 - DNA, 103 bp, Artificial Sequence
  Synthetic Polynucleotide
taatacgactcactataggggggccctcggccccttcggtgctgggtcccaacagaggagagggaccatgcaccgaaggaacctggcggcagcgcaaaagatg

SEQ ID NO: 144948 - DNA, 103 bp, Artificial Sequence
  Synthetic Polynucleotide
taatacgactcactatagggcttctcctccgggccctcggccccttcggtaacagaggagaaccgaaatggccgagggcaacctggcggcagcgcaaaagatg

SEQ ID NO: 144949 - DNA, 103 bp, Artificial Sequence
  Synthetic Polynucleotide
taatacgactcactatagggtcaccttcttcttctcctccgggccctcggaacagaggagaccgaggatgcggaggagaaacctggcggcagcgcaaaagatg

SEQ ID NO: 144950 - DNA, 103 bp, Artificial Sequence
  Synthetic Polynucleotide
taatacgactcactatagggcggcgcatcttcaccttcttcttctcctccaacagaggagaggaggaatggaagaaggtaacctggcggcagcgcaaaagatg

SEQ ID NO: 144951 - DNA, 103 bp, Artificial Sequence
  Synthetic Polynucleotide
taatacgactcactatagggttctctctgtacgtactcatagttgaaatcaacagaggagagatttcatgtatgagtacaacctggcggcagcgcaaaagatg

SEQ ID NO: 144952 - DNA, 103 bp, Artificial Sequence
  Synthetic Polynucleotide
taatacgactcactatagggccgccgcttccggcgcatcttcaccttcttaacagaggagaaagaagatgaagatgcgcaacctggcggcagcgcaaaagatg

SEQ ID NO: 144953 - DNA, 103 bp, Artificial Sequence
  Synthetic Polynucleotide
taatacgactcactatagggtgttgggaagccgccgcttccggcgcatctaacagaggagaagatgcatgggaagcggcaacctggcggcagcgcaaaagatg

SEQ ID NO: 144954 - DNA, 103 bp, Artificial Sequence
  Synthetic Polynucleotide
taatacgactcactatagggctcagctccttgttgggaagccgccgcttcaacagaggagagaagcgatggcttcccaaaacctggcggcagcgcaaaagatg

SEQ ID NO: 144955 - DNA, 103 bp, Artificial Sequence
  Synthetic Polynucleotide
taatacgactcactatagggcagctccctgctcagctccttgttgggaagaacagaggagacttcccatgaaggagctgaacctggcggcagcgcaaaagatg

SEQ ID NO: 144956 - DNA, 103 bp, Artificial Sequence
  Synthetic Polynucleotide
taatacgactcactataggggctccttgctcagctccctgctcagctcctaacagaggagaaggagcatggcagggagcaacctggcggcagcgcaaaagatg

SEQ ID NO: 144957 - DNA, 103 bp, Artificial Sequence
  Synthetic Polynucleotide
taatacgactcactatagggtcgtggttgagctccttgctcagctccctgaacagaggagacagggaatggagcaaggaaacctggcggcagcgcaaaagatg

SEQ ID NO: 144958 - DNA, 103 bp, Artificial Sequence
  Synthetic Polynucleotide
taatacgactcactatagggcctctggatctcgtggttgagctccttgctaacagaggagaagcaagatgctcaaccacaacctggcggcagcgcaaaagatg

SEQ ID NO: 144959 - DNA, 103 bp, Artificial Sequence
  Synthetic Polynucleotide
taatacgactcactatagggtgttctccgtcctctggatctcgtggttgaaacagaggagatcaaccatgagatccagaaacctggcggcagcgcaaaagatg

SEQ ID NO: 144960 - DNA, 103 bp, Artificial Sequence
  Synthetic Polynucleotide
taatacgactcactatagggttggccaggctgttctccgtcctctggatcaacagaggagagatccaatggacggagaaaacctggcggcagcgcaaaagatg

SEQ ID NO: 144961 - DNA, 103 bp, Artificial Sequence
  Synthetic Polynucleotide
taatacgactcactatagggctggttctcgttggccaggctgttctccgtaacagaggagaacggagatgagcctggccaacctggcggcagcgcaaaagatg

SEQ ID NO: 144962 - DNA, 103 bp, Artificial Sequence
  Synthetic Polynucleotide
taatacgactcactatagggccctgagagcttctctctgtacgtactcataacagaggagaatgagtatgtacagagagaacctggcggcagcgcaaaagatg

SEQ ID NO: 144963 - DNA, 103 bp, Artificial Sequence
  Synthetic Polynucleotide
taatacgactcactatagggtgatgggctgctggttctcgttggccaggcaacagaggagagcctggatgacgagaaccaacctggcggcagcgcaaaagatg

SEQ ID NO: 144964 - DNA, 103 bp, Artificial Sequence
  Synthetic Polynucleotide
taatacgactcactatagggggctccgacttgatgggctgctggttctcgaacagaggagacgagaaatggcagcccataacctggcggcagcgcaaaagatg

SEQ ID NO: 144965 - DNA, 103 bp, Artificial Sequence
  Synthetic Polynucleotide
taatacgactcactatagggctcgctctcaggctccgacttgatgggctgaacagaggagacagcccatgaagtcggagaacctggcggcagcgcaaaagatg

SEQ ID NO: 144966 - DNA, 103 bp, Artificial Sequence
  Synthetic Polynucleotide
taatacgactcactataggggctcctcgccctcgctctcaggctccgactaacagaggagaagtcggatgctgagagcgaacctggcggcagcgcaaaagatg

SEQ ID NO: 144967 - DNA, 103 bp, Artificial Sequence
  Synthetic Polynucleotide
taatacgactcactatagggggccgcttgggctcctcgccctcgctctcaaacagaggagatgagagatggggcgaggaaacctggcggcagcgcaaaagatg

SEQ ID NO: 144968 - DNA, 103 bp, Artificial Sequence
  Synthetic Polynucleotide
taatacgactcactataggggatgcccgggggccgcttgggctcctcgccaacagaggagaggcgagatgcccaagcggaacctggcggcagcgcaaaagatg

SEQ ID NO: 144969 - DNA, 103 bp, Artificial Sequence
  Synthetic Polynucleotide
taatacgactcactataggggacgctcgcagatgcccgggggccgcttggaacagaggagaccaagcatgccccgggcaaacctggcggcagcgcaaaagatg

SEQ ID NO: 144970 - DNA, 103 bp, Artificial Sequence
  Synthetic Polynucleotide
taatacgactcactatagggaagcggtggggacgctcgcagatgcccgggaacagaggagacccgggatgctgcgagcgaacctggcggcagcgcaaaagatg

SEQ ID NO: 144971 - DNA, 103 bp, Artificial Sequence
  Synthetic Polynucleotide
taatacgactcactatagggccccttgctgaagcggtggggacgctcgcaaacagaggagatgcgagatgccccaccgcaacctggcggcagcgcaaaagatg

SEQ ID NO: 144972 - DNA, 103 bp, Artificial Sequence
  Synthetic Polynucleotide
taatacgactcactatagggtgccgttgagccccttgctgaagcggtgggaacagaggagacccaccatgtcagcaaggaacctggcggcagcgcaaaagatg

SEQ ID NO: 144973 - DNA, 103 bp, Artificial Sequence
  Synthetic Polynucleotide
taatacgactcactatagggtttcgtggggggtgatcctctgcagatcccaacagaggagagggatcatgagaggatcaaacctggcggcagcgcaaaagatg

SEQ ID NO: 144974 - DNA, 103 bp, Artificial Sequence
  Synthetic Polynucleotide
taatacgactcactatagggatcaggggaaccctgagagcttctctctgtaacagaggagaacagagatgagctctcagaacctggcggcagcgcaaaagatg

SEQ ID NO: 144975 - DNA, 103 bp, Artificial Sequence
  Synthetic Polynucleotide
taatacgactcactatagggtcccggggggtgccgttgagccccttgctgaacagaggagacagcaaatggctcaacggaacctggcggcagcgcaaaagatg

SEQ ID NO: 144976 - DNA, 103 bp, Artificial Sequence
  Synthetic Polynucleotide
taatacgactcactataggggtgccgcagctcccggggggtgccgttgagaacagaggagactcaacatgaccccccggaacctggcggcagcgcaaaagatg

SEQ ID NO: 144977 - DNA, 103 bp, Artificial Sequence
  Synthetic Polynucleotide
taatacgactcactataggggccccagctggtgccgcagctcccggggggaacagaggagaccccccatgagctgcggcaacctggcggcagcgcaaaagatg

SEQ ID NO: 144978 - DNA, 103 bp, Artificial Sequence
  Synthetic Polynucleotide
taatacgactcactatagggcgcaggctgggccccagctggtgccgcagcaacagaggagagctgcgatgccagctgggaacctggcggcagcgcaaaagatg

SEQ ID NO: 144979 - DNA, 103 bp, Artificial Sequence
  Synthetic Polynucleotide
taatacgactcactataggggggcgggctgcgcaggctgggccccagctgaacagaggagacagctgatgcccagcctgaacctggcggcagcgcaaaagatg

SEQ ID NO: 144980 - DNA, 103 bp, Artificial Sequence
  Synthetic Polynucleotide
taatacgactcactatagggagatgacacggggcgggctgcgcaggctggaacagaggagaccagccatggcagcccgcaacctggcggcagcgcaaaagatg

SEQ ID NO: 144981 - DNA, 103 bp, Artificial Sequence
  Synthetic Polynucleotide
taatacgactcactataggggggggccgggagatgacacggggcgggctgaacagaggagacagcccatgccgtgtcataacctggcggcagcgcaaaagatg

SEQ ID NO: 144982 - DNA, 103 bp, Artificial Sequence
  Synthetic Polynucleotide
taatacgactcactatagggcacggagggtgggggccgggagatgacacgaacagaggagacgtgtcatgtcccggcccaacctggcggcagcgcaaaagatg

SEQ ID NO: 144983 - DNA, 103 bp, Artificial Sequence
  Synthetic Polynucleotide
taatacgactcactatagggtgggcggggacacggagggtgggggccgggaacagaggagacccggcatgcaccctccgaacctggcggcagcgcaaaagatg

SEQ ID NO: 144984 - DNA, 103 bp, Artificial Sequence
  Synthetic Polynucleotide
taatacgactcactatagggtggatacacttgggcggggacacggagggtaacagaggagaaccctcatggtccccgccaacctggcggcagcgcaaaagatg

SEQ ID NO: 144985 - DNA, 103 bp, Artificial Sequence
  Synthetic Polynucleotide
taatacgactcactatagggttctcgaaatatcaggggaaccctgagagcaacagaggagagctctcatggttcccctgaacctggcggcagcgcaaaagatg

SEQ ID NO: 144986 - DNA, 103 bp, Artificial Sequence
  Synthetic Polynucleotide
taatacgactcactataggggcgctccatctggatacacttgggcggggaaacagaggagatccccgatgaagtgtatcaacctggcggcagcgcaaaagatg

SEQ ID NO: 144987 - DNA, 103 bp, Artificial Sequence
  Synthetic Polynucleotide
taatacgactcactatagggggatcacatggcgctccatctggatacactaacagaggagaagtgtaatgagatggagcaacctggcggcagcgcaaaagatg

SEQ ID NO: 144988 - DNA, 103 bp, Artificial Sequence
  Synthetic Polynucleotide
taatacgactcactataggggggggtggccggatcacatggcgctccatcaacagaggagagatggaatgccatgtgataacctggcggcagcgcaaaagatg

SEQ ID NO: 144989 - DNA, 103 bp, Artificial Sequence
  Synthetic Polynucleotide
taatacgactcactatagggggggctgatggggggtggccggatcacatgaacagaggagacatgtgatgcggccacccaacctggcggcagcgcaaaagatg

SEQ ID NO: 144990 - DNA, 103 bp, Artificial Sequence
  Synthetic Polynucleotide
taatacgactcactatagggagtcaggcggggggctgatggggggtggccaacagaggagaggccacatgccatcagccaacctggcggcagcgcaaaagatg

SEQ ID NO: 144991 - DNA, 103 bp, Artificial Sequence
  Synthetic Polynucleotide
taatacgactcactatagggaggggtagcgagtcaggcggggggctgatgaacagaggagacatcagatgcccgcctgaaacctggcggcagcgcaaaagatg

SEQ ID NO: 144992 - DNA, 103 bp, Artificial Sequence
  Synthetic Polynucleotide
taatacgactcactatagggcccatcgtccaggggtagcgagtcaggcggaacagaggagaccgcctatgtcgctacccaacctggcggcagcgcaaaagatg

SEQ ID NO: 144993 - DNA, 103 bp, Artificial Sequence
  Synthetic Polynucleotide
taatacgactcactatagggcgtgggctgccccatcgtccaggggtagcgaacagaggagacgctacatgtggacgatgaacctggcggcagcgcaaaagatg

SEQ ID NO: 144994 - DNA, 103 bp, Artificial Sequence
  Synthetic Polynucleotide
taatacgactcactatagggctgtgcatgacgtgggctgccccatcgtccaacagaggagaggacgaatgggcagcccaaacctggcggcagcgcaaaagatg

SEQ ID NO: 144995 - DNA, 103 bp, Artificial Sequence
  Synthetic Polynucleotide
taatacgactcactatagggccacacctccctgtgcatgacgtgggctgcaacagaggagagcagccatggtcatgcacaacctggcggcagcgcaaaagatg

SEQ ID NO: 144996 - DNA, 103 bp, Artificial Sequence
  Synthetic Polynucleotide
taatacgactcactataggggtccatccttttctcgaaatatcaggggaaaacagaggagattccccatgtatttcgagaacctggcggcagcgcaaaagatg

SEQ ID NO: 144997 - DNA, 103 bp, Artificial Sequence
  Synthetic Polynucleotide
taatacgactcactatagggagacggccatccacacctccctgtgcatgaaacagaggagatcatgcatggggaggtgtaacctggcggcagcgcaaaagatg

SEQ ID NO: 144998 - DNA, 103 bp, Artificial Sequence
  Synthetic Polynucleotide
taatacgactcactatagggaggtagctgaagacggccatccacacctccaacagaggagaggaggtatggatggccgtaacctggcggcagcgcaaaagatg

SEQ ID NO: 144999 - DNA, 103 bp, Artificial Sequence
  Synthetic Polynucleotide
taatacgactcactatagggttggtggctgaggtagctgaagacggccataacagaggagaatggccatgttcagctacaacctggcggcagcgcaaaagatg

SEQ ID NO: 145000 - DNA, 103 bp, Artificial Sequence
  Synthetic Polynucleotide
taatacgactcactatagggcacacaggtcttggtggctgaggtagctgaaacagaggagatcagctatgtcagccaccaacctggcggcagcgcaaaagatg

SEQ ID NO: 145001 - DNA, 103 bp, Artificial Sequence
  Synthetic Polynucleotide
taatacgactcactatagggcgcatgcacacacacaggtcttggtggctgaacagaggagacagccaatgagacctgtgaacctggcggcagcgcaaaagatg

SEQ ID NO: 145002 - DNA, 103 bp, Artificial Sequence
  Synthetic Polynucleotide
taatacgactcactatagggcctgcagacccgcatgcacacacacaggtcaacagaggagagacctgatggtgtgcatgaacctggcggcagcgcaaaagatg

SEQ ID NO: 145003 - DNA, 103 bp, Artificial Sequence
  Synthetic Polynucleotide
taatacgactcactatagggggttccaggtcctgcagacccgcatgcacaaacagaggagatgtgcaatggggtctgcaaacctggcggcagcgcaaaagatg

SEQ ID NO: 145004 - DNA, 103 bp, Artificial Sequence
  Synthetic Polynucleotide
taatacgactcactatagggcagcaccagcggttccaggtcctgcagaccaacagaggagaggtctgatggacctggaaaacctggcggcagcgcaaaagatg

SEQ ID NO: 145005 - DNA, 103 bp, Artificial Sequence
  Synthetic Polynucleotide
taatacgactcactatagggccgcttatcgcagcaccagcggttccaggtaacagaggagaacctggatgcgctggtgcaacctggcggcagcgcaaaagatg

SEQ ID NO: 145006 - DNA, 103 bp, Artificial Sequence
  Synthetic Polynucleotide
taatacgactcactataggggggtccacaaccgcttatcgcagcaccagcaacagaggagagctggtatggcgataagcaacctggcggcagcgcaaaagatg

SEQ ID NO: 145007 - DNA, 103 bp, Artificial Sequence
  Synthetic Polynucleotide
taatacgactcactatagggttaattcccagtccatccttttctcgaaataacagaggagaatttcgatgaaaggatggaacctggcggcagcgcaaaagatg

SEQ ID NO: 145008 - DNA, 103 bp, Artificial Sequence
  Synthetic Polynucleotide
taatacgactcactatagggaggtcaatgcgggtccacaaccgcttatcgaacagaggagacgataaatggttgtggacaacctggcggcagcgcaaaagatg

SEQ ID NO: 145009 - DNA, 103 bp, Artificial Sequence
  Synthetic Polynucleotide
taatacgactcactataggggcagtggttcaggtcaatgcgggtccacaaaacagaggagattgtggatgcgcattgacaacctggcggcagcgcaaaagatg

SEQ ID NO: 145010 - DNA, 103 bp, Artificial Sequence
  Synthetic Polynucleotide
taatacgactcactatagggtgatagacttgcagtggttcaggtcaatgcaacagaggagagcattgatgtgaaccactaacctggcggcagcgcaaaagatg

SEQ ID NO: 145011 - DNA, 103 bp, Artificial Sequence
  Synthetic Polynucleotide
taatacgactcactatagggatcaggggtgtgatagacttgcagtggttcaacagaggagagaaccaatgcaagtctataacctggcggcagcgcaaaagatg

SEQ ID NO: 145012 - DNA, 103 bp, Artificial Sequence
  Synthetic Polynucleotide
taatacgactcactataggggccactcagcatcaggggtgtgatagacttaacagaggagaaagtctatgacacccctgaacctggcggcagcgcaaaagatg

SEQ ID NO: 145013 - DNA, 103 bp, Artificial Sequence
  Synthetic Polynucleotide
taatacgactcactataggggccggatgatgccactcagcatcaggggtgaacagaggagacaccccatgtgctgagtgaacctggcggcagcgcaaaagatg

SEQ ID NO: 145014 - DNA, 103 bp, Artificial Sequence
  Synthetic Polynucleotide
taatacgactcactatagggacgggctgtcgccggatgatgccactcagcaacagaggagagctgagatgcatcatccgaacctggcggcagcgcaaaagatg

SEQ ID NO: 145015 - DNA, 103 bp, Artificial Sequence
  Synthetic Polynucleotide
taatacgactcactataggggtcgagggagacgggctgtcgccggatgataacagaggagaatcatcatgcgacagcccaacctggcggcagcgcaaaagatg

SEQ ID NO: 145016 - DNA, 103 bp, Artificial Sequence
  Synthetic Polynucleotide
taatacgactcactatagggtccagctgaggtcgagggagacgggctgtcaacagaggagagacagcatgtctccctcgaacctggcggcagcgcaaaagatg

SEQ ID NO: 145017 - DNA, 103 bp, Artificial Sequence
  Synthetic Polynucleotide
taatacgactcactataggggagatattggtccagctgaggtcgagggagaacagaggagactccctatgcctcagctgaacctggcggcagcgcaaaagatg

SEQ ID NO: 145018 - DNA, 103 bp, Artificial Sequence
  Synthetic Polynucleotide
taatacgactcactataggggtcaggcatcttaattcccagtccatccttaacagaggagaaaggatatgctgggaattaacctggcggcagcgcaaaagatg

SEQ ID NO: 145019 - DNA, 103 bp, Artificial Sequence
  Synthetic Polynucleotide
taatacgactcactatagggctgcttcttggagatattggtccagctgagaacagaggagactcagcatgaccaatatcaacctggcggcagcgcaaaagatg

SEQ ID NO: 145020 - DNA, 103 bp, Artificial Sequence
  Synthetic Polynucleotide
taatacgactcactataggggccagctcagctgcttcttggagatattggaacagaggagaccaataatgccaagaagcaacctggcggcagcgcaaaagatg

SEQ ID NO: 145021 - DNA, 103 bp, Artificial Sequence
  Synthetic Polynucleotide
taatacgactcactatagggcggttgatgagccagctcagctgcttcttgaacagaggagacaagaaatggctgagctgaacctggcggcagcgcaaaagatg

SEQ ID NO: 145022 - DNA, 103 bp, Artificial Sequence
  Synthetic Polynucleotide
taatacgactcactatagggcccaggcagccggttgatgagccagctcagaacagaggagactgagcatgctcatcaacaacctggcggcagcgcaaaagatg

SEQ ID NO: 145023 - DNA, 103 bp, Artificial Sequence
  Synthetic Polynucleotide
taatacgactcactatagggagtcccggagcccaggcagccggttgatgaaacagaggagatcatcaatgggctgcctgaacctggcggcagcgcaaaagatg

SEQ ID NO: 145024 - DNA, 103 bp, Artificial Sequence
  Synthetic Polynucleotide
taatacgactcactataggggacagcaccaagtcccggagcccaggcagcaacagaggagagctgccatggctccgggaaacctggcggcagcgcaaaagatg

SEQ ID NO: 145025 - DNA, 103 bp, Artificial Sequence
  Synthetic Polynucleotide
taatacgactcactatagggtgagcagcctgacagcaccaagtcccggagaacagaggagactccggatgttggtgctgaacctggcggcagcgcaaaagatg

SEQ ID NO: 145026 - DNA, 103 bp, Artificial Sequence
  Synthetic Polynucleotide
taatacgactcactatagggccgcgatccatgagcagcctgacagcaccaaacagaggagatggtgcatgcaggctgctaacctggcggcagcgcaaaagatg

SEQ ID NO: 145027 - DNA, 103 bp, Artificial Sequence
  Synthetic Polynucleotide
taatacgactcactatagggagggccgagaccgcgatccatgagcagcctaacagaggagaaggctgatgatggatcgcaacctggcggcagcgcaaaagatg

SEQ ID NO: 145028 - DNA, 103 bp, Artificial Sequence
  Synthetic Polynucleotide
taatacgactcactatagggggagctgcaaagggccgagaccgcgatccaaacagaggagatggatcatggtctcggccaacctggcggcagcgcaaaagatg

SEQ ID NO: 145029 - DNA, 103 bp, Artificial Sequence
  Synthetic Polynucleotide
taatacgactcactatagggtgaaatcagggtcaggcatcttaattcccaaacagaggagatgggaaatgagatgcctgaacctggcggcagcgcaaaagatg

SEQ ID NO: 145030 - DNA, 103 bp, Artificial Sequence
  Synthetic Polynucleotide
taatacgactcactataggggcggacaactggagctgcaaagggccgagaaacagaggagatctcggatgtttgcagctaacctggcggcagcgcaaaagatg

SEQ ID NO: 145031 - DNA, 103 bp, Artificial Sequence
  Synthetic Polynucleotide
taatacgactcactataggggtccggagcagcggacaactggagctgcaaaacagaggagattgcagatgcagttgtccaacctggcggcagcgcaaaagatg

SEQ ID NO: 145032 - DNA, 103 bp, Artificial Sequence
  Synthetic Polynucleotide
taatacgactcactataggggacatccagggtccggagcagcggacaactaacagaggagaagttgtatgctgctccggaacctggcggcagcgcaaaagatg

SEQ ID NO: 145033 - DNA, 103 bp, Artificial Sequence
  Synthetic Polynucleotide
taatacgactcactatagggccacccactggacatccagggtccggagcaaacagaggagatgctccatgccctggatgaacctggcggcagcgcaaaagatg

SEQ ID NO: 145034 - DNA, 103 bp, Artificial Sequence
  Synthetic Polynucleotide
taatacgactcactatagggtttagtccctccacccactggacatccaggaacagaggagacctggaatgccagtgggtaacctggcggcagcgcaaaagatg

SEQ ID NO: 145035 - DNA, 103 bp, Artificial Sequence
  Synthetic Polynucleotide
taatacgactcactatagggctgggcatcctttagtccctccacccactgaacagaggagacagtggatggagggactaaacctggcggcagcgcaaaagatg

SEQ ID NO: 145036 - DNA, 103 bp, Artificial Sequence
  Synthetic Polynucleotide
taatacgactcactataggggatcccgcatctgggcatcctttagtccctaacagaggagaagggacatgaggatgcccaacctggcggcagcgcaaaagatg

SEQ ID NO: 145037 - DNA, 103 bp, Artificial Sequence
  Synthetic Polynucleotide
taatacgactcactatagggggggacaggagatcccgcatctgggcatccaacagaggagaggatgcatggatgcgggaaacctggcggcagcgcaaaagatg

SEQ ID NO: 145038 - DNA, 103 bp, Artificial Sequence
  Synthetic Polynucleotide
taatacgactcactataggggtctgtgggcggggacaggagatcccgcataacagaggagaatgcggatgctcctgtccaacctggcggcagcgcaaaagatg

SEQ ID NO: 145039 - DNA, 103 bp, Artificial Sequence
  Synthetic Polynucleotide
taatacgactcactatagggctggcctgttgtctgtgggcggggacaggaaacagaggagatcctgtatgcgcccacagaacctggcggcagcgcaaaagatg

SEQ ID NO: 145040 - DNA, 103 bp, Artificial Sequence
  Synthetic Polynucleotide
taatacgactcactatagggtctcggactgtgaaatcagggtcaggcatcaacagaggagagatgccatgccctgatttaacctggcggcagcgcaaaagatg

SEQ ID NO: 145041 - DNA, 103 bp, Artificial Sequence
  Synthetic Polynucleotide
taatacgactcactatagggtccatctgacctggcctgttgtctgtgggcaacagaggagagcccacatgcaacaggccaacctggcggcagcgcaaaagatg

SEQ ID NO: 145042 - DNA, 103 bp, Artificial Sequence
  Synthetic Polynucleotide
taatacgactcactataggggctccgattgtccatctgacctggcctgttaacagaggagaaacaggatgggtcagatgaacctggcggcagcgcaaaagatg

SEQ ID NO: 145043 - DNA, 103 bp, Artificial Sequence
  Synthetic Polynucleotide
taatacgactcactatagggtccggagcttgctccgattgtccatctgacaacagaggagagtcagaatgacaatcggaaacctggcggcagcgcaaaagatg

SEQ ID NO: 145044 - DNA, 103 bp, Artificial Sequence
  Synthetic Polynucleotide
taatacgactcactatagggtccacgatgttccggagcttgctccgattgaacagaggagacaatcgatgcaagctccgaacctggcggcagcgcaaaagatg

SEQ ID NO: 145045 - DNA, 103 bp, Artificial Sequence
  Synthetic Polynucleotide
taatacgactcactatagggcaggcgcagctccacgatgttccggagcttaacagaggagaaagctcatgaacatcgtgaacctggcggcagcgcaaaagatg

SEQ ID NO: 145046 - DNA, 103 bp, Artificial Sequence
  Synthetic Polynucleotide
taatacgactcactatagggccaggcctgccaggcgcagctccacgatgtaacagaggagaacatcgatgagctgcgccaacctggcggcagcgcaaaagatg

SEQ ID NO: 145047 - DNA, 103 bp, Artificial Sequence
  Synthetic Polynucleotide
taatacgactcactatagggtctgtgatgtccaggcctgccaggcgcagcaacagaggagagctgcgatgggcaggcctaacctggcggcagcgcaaaagatg

SEQ ID NO: 145048 - DNA, 103 bp, Artificial Sequence
  Synthetic Polynucleotide
taatacgactcactatagggcagggaggcatctgtgatgtccaggcctgcaacagaggagagcaggcatggacatcacaaacctggcggcagcgcaaaagatg

SEQ ID NO: 145049 - DNA, 103 bp, Artificial Sequence
  Synthetic Polynucleotide
taatacgactcactatagggtgatgagccgcagggaggcatctgtgatgtaacagaggagaacatcaatgatgcctcccaacctggcggcagcgcaaaagatg

SEQ ID NO: 145050 - DNA, 103 bp, Artificial Sequence
  Synthetic Polynucleotide
taatacgactcactatagggatgtggcggatgatgagccgcagggaggcaaacagaggagatgcctcatggcggctcataacctggcggcagcgcaaaagatg

SEQ ID NO: 145051 - DNA, 103 bp, Artificial Sequence
  Synthetic Polynucleotide
taatacgactcactataggggagtttgacgtctcggactgtgaaatcaggaacagaggagacctgatatgacagtccgaaacctggcggcagcgcaaaagatg

SEQ ID NO: 145052 - DNA, 103 bp, Artificial Sequence
  Synthetic Polynucleotide
taatacgactcactataggggagcaggggcatgtggcggatgatgagccgaacagaggagacggctcatgatccgccacaacctggcggcagcgcaaaagatg

SEQ ID NO: 145053 - DNA, 103 bp, Artificial Sequence
  Synthetic Polynucleotide
taatacgactcactatagggggagcttggagagcaggggcatgtggcggaaacagaggagatccgccatgtgcccctgcaacctggcggcagcgcaaaagatg

SEQ ID NO: 145054 - DNA, 103 bp, Artificial Sequence
  Synthetic Polynucleotide
taatacgactcactatagggtaactgaggtggagcttggagagcaggggcaacagaggagagcccctatgctccaagctaacctggcggcagcgcaaaagatg

SEQ ID NO: 145055 - DNA, 103 bp, Artificial Sequence
  Synthetic Polynucleotide
taatacgactcactataggggtggttacagtaactgaggtggagcttggaaacagaggagatccaagatgcacctcagtaacctggcggcagcgcaaaagatg

SEQ ID NO: 145056 - DNA, 103 bp, Artificial Sequence
  Synthetic Polynucleotide
taatacgactcactatagggggtcggtgacgtggttacagtaactgaggtaacagaggagaacctcaatgactgtaaccaacctggcggcagcgcaaaagatg

SEQ ID NO: 145057 - DNA, 103 bp, Artificial Sequence
  Synthetic Polynucleotide
taatacgactcactatagggttgatagactggtcggtgacgtggttacagaacagaggagactgtaaatgcgtcaccgaaacctggcggcagcgcaaaagatg

SEQ ID NO: 145058 - DNA, 103 bp, Artificial Sequence
  Synthetic Polynucleotide
taatacgactcactatagggagtgagcaggttgatagactggtcggtgacaacagaggagagtcaccatgcagtctatcaacctggcggcagcgcaaaagatg

SEQ ID NO: 145059 - DNA, 103 bp, Artificial Sequence
  Synthetic Polynucleotide
taatacgactcactatagggtgccaacagcagtgagcaggttgatagactaacagaggagaagtctaatgacctgctcaaacctggcggcagcgcaaaagatg

SEQ ID NO: 145060 - DNA, 103 bp, Artificial Sequence
  Synthetic Polynucleotide
taatacgactcactatagggcgggtggtggtgccaacagcagtgagcaggaacagaggagacctgctatgtgctgttggaacctggcggcagcgcaaaagatg

SEQ ID NO: 145061 - DNA, 103 bp, Artificial Sequence
  Synthetic Polynucleotide
taatacgactcactatagggtaaggagtctcgggtggtggtgccaacagcaacagaggagagctgttatgaccaccaccaacctggcggcagcgcaaaagatg

SEQ ID NO: 145062 - DNA, 103 bp, Artificial Sequence
  Synthetic Polynucleotide
taatacgactcactatagggtccccactaggagtttgacgtctcggactgaacagaggagacagtccatgacgtcaaacaacctggcggcagcgcaaaagatg

SEQ ID NO: 145063 - DNA, 103 bp, Artificial Sequence
  Synthetic Polynucleotide
taatacgactcactatagggtgatctcggttaaggagtctcgggtggtggaacagaggagaccaccaatggagactcctaacctggcggcagcgcaaaagatg

SEQ ID NO: 145064 - DNA, 103 bp, Artificial Sequence
  Synthetic Polynucleotide
taatacgactcactatagggtcagacaggttgatctcggttaaggagtctaacagaggagaagactcatgaaccgagataacctggcggcagcgcaaaagatg

SEQ ID NO: 145065 - DNA, 103 bp, Artificial Sequence
  Synthetic Polynucleotide
taatacgactcactatagggcttattgcagtcagacaggttgatctcggtaacagaggagaaccgagatgaacctgtctaacctggcggcagcgcaaaagatg

SEQ ID NO: 145066 - DNA, 103 bp, Artificial Sequence
  Synthetic Polynucleotide
taatacgactcactataggggatcagtgaccttattgcagtcagacaggtaacagaggagaacctgtatgactgcaataaacctggcggcagcgcaaaagatg

SEQ ID NO: 145067 - DNA, 103 bp, Artificial Sequence
  Synthetic Polynucleotide
taatacgactcactataggggacaggcactgatcagtgaccttattgcagaacagaggagactgcaaatgggtcactgaaacctggcggcagcgcaaaagatg

SEQ ID NO: 145068 - DNA, 103 bp, Artificial Sequence
  Synthetic Polynucleotide
taatacgactcactatagggtttgaagaaggacaggcactgatcagtgacaacagaggagagtcactatgcagtgcctgaacctggcggcagcgcaaaagatg

SEQ ID NO: 145069 - DNA, 103 bp, Artificial Sequence
  Synthetic Polynucleotide
taatacgactcactatagggttccacagcgtttgaagaaggacaggcactaacagaggagaagtgccatgccttcttcaaacctggcggcagcgcaaaagatg

SEQ ID NO: 145070 - DNA, 103 bp, Artificial Sequence
  Synthetic Polynucleotide
taatacgactcactatagggtgacagatgtttccacagcgtttgaagaagaacagaggagacttcttatgacgctgtggaacctggcggcagcgcaaaagatg

SEQ ID NO: 145071 - DNA, 103 bp, Artificial Sequence
  Synthetic Polynucleotide
taatacgactcactatagggcaggtcaatatgacagatgtttccacagcgaacagaggagacgctgtatgaacatctgtaacctggcggcagcgcaaaagatg

SEQ ID NO: 145072 - DNA, 103 bp, Artificial Sequence
  Synthetic Polynucleotide
taatacgactcactatagggtgcagtacctcaggtcaatatgacagatgtaacagaggagaacatctatgatattgaccaacctggcggcagcgcaaaagatg

SEQ ID NO: 145073 - DNA, 103 bp, Artificial Sequence
  Synthetic Polynucleotide
taatacgactcactatagggagccgccggctccccactaggagtttgacgaacagaggagacgtcaaatgcctagtgggaacctggcggcagcgcaaaagatg

SEQ ID NO: 145074 - DNA, 103 bp, Artificial Sequence
  Synthetic Polynucleotide
taatacgactcactataggggtgacttgcttgcagtacctcaggtcaataaacagaggagatattgaatggaggtactgaacctggcggcagcgcaaaagatg

SEQ ID NO: 145075 - DNA, 103 bp, Artificial Sequence
  Synthetic Polynucleotide
taatacgactcactataggggccttccttggtgacttgcttgcagtacctaacagaggagaaggtacatgaagcaagtcaacctggcggcagcgcaaaagatg

SEQ ID NO: 145076 - DNA, 103 bp, Artificial Sequence
  Synthetic Polynucleotide
taatacgactcactatagggactgctcacagccttccttggtgacttgctaacagaggagaagcaagatgccaaggaagaacctggcggcagcgcaaaagatg

SEQ ID NO: 145077 - DNA, 103 bp, Artificial Sequence
  Synthetic Polynucleotide
taatacgactcactatagggtcggctatgaactgctcacagccttccttgaacagaggagacaaggaatgctgtgagcaaacctggcggcagcgcaaaagatg

SEQ ID NO: 145078 - DNA, 103 bp, Artificial Sequence
  Synthetic Polynucleotide
taatacgactcactatagggcacagacatctcggctatgaactgctcacaaacagaggagatgtgagatgttcatagccaacctggcggcagcgcaaaagatg

SEQ ID NO: 145079 - DNA, 103 bp, Artificial Sequence
  Synthetic Polynucleotide
taatacgactcactatagggactggacactcacagacatctcggctatgaaacagaggagatcatagatgagatgtctgaacctggcggcagcgcaaaagatg

SEQ ID NO: 145080 - DNA, 103 bp, Artificial Sequence
  Synthetic Polynucleotide
taatacgactcactatagggacttgcccaaactggacactcacagacatcaacagaggagagatgtcatggagtgtccaaacctggcggcagcgcaaaagatg

SEQ ID NO: 145081 - DNA, 103 bp, Artificial Sequence
  Synthetic Polynucleotide
taatacgactcactatagggtttttcttctacttgcccaaactggacactaacagaggagaagtgtcatgtttgggcaaaacctggcggcagcgcaaaagatg

SEQ ID NO: 145082 - DNA, 103 bp, Artificial Sequence
  Synthetic Polynucleotide
taatacgactcactatagggtttgcaggagtttttcttctacttgcccaaaacagaggagattgggcatgtagaagaaaaacctggcggcagcgcaaaagatg

SEQ ID NO: 145083 - DNA, 103 bp, Artificial Sequence
  Synthetic Polynucleotide
taatacgactcactatagggtaactcagtttttgcaggagtttttcttctaacagaggagaagaagaatgactcctgcaaacctggcggcagcgcaaaagatg

SEQ ID NO: 145084 - DNA, 103 bp, Artificial Sequence
  Synthetic Polynucleotide
taatacgactcactatagggtgcatgtctttttcgtggggggtgatcctcaacagaggagagaggatatgcccccacgaaacctggcggcagcgcaaaagatg

SEQ ID NO: 145085 - DNA, 103 bp, Artificial Sequence
  Synthetic Polynucleotide
taatacgactcactatagggcacgtccacaagccgccggctccccactagaacagaggagactagtgatgagccggcggaacctggcggcagcgcaaaagatg

SEQ ID NO: 145086 - DNA, 103 bp, Artificial Sequence
  Synthetic Polynucleotide
taatacgactcactatagggtcacatccatcacgtccacaagccgccggcaacagaggagagccggcatgttgtggacgaacctggcggcagcgcaaaagatg

SEQ ID NO: 145087 - DNA, 103 bp, Artificial Sequence
  Synthetic Polynucleotide
taatacgactcactatagggttctgggtgttcacatccatcacgtccacaaacagaggagatgtggaatggatggatgtaacctggcggcagcgcaaaagatg

SEQ ID NO: 145088 - DNA, 103 bp, Artificial Sequence
  Synthetic Polynucleotide
taatacgactcactatagggctccgtgcccttctgggtgttcacatccataacagaggagaatggatatgaacacccagaacctggcggcagcgcaaaagatg

SEQ ID NO: 145089 - DNA, 103 bp, Artificial Sequence
  Synthetic Polynucleotide
taatacgactcactatagggacatgctcatctccgtgcccttctgggtgtaacagaggagaacacccatgagggcacggaacctggcggcagcgcaaaagatg

SEQ ID NO: 145090 - DNA, 103 bp, Artificial Sequence
  Synthetic Polynucleotide
taatacgactcactatagggacaaactgggacatgctcatctccgtgcccaacagaggagagggcacatggatgagcataacctggcggcagcgcaaaagatg

SEQ ID NO: 145091 - DNA, 103 bp, Artificial Sequence
  Synthetic Polynucleotide
taatacgactcactataggggtagtaacgcacaaactgggacatgctcataacagaggagaatgagcatgtcccagtttaacctggcggcagcgcaaaagatg

SEQ ID NO: 145092 - DNA, 103 bp, Artificial Sequence
  Synthetic Polynucleotide
taatacgactcactatagggcgggcgtctcgtagtaacgcacaaactgggaacagaggagacccagtatgtgcgttactaacctggcggcagcgcaaaagatg

SEQ ID NO: 145093 - DNA, 103 bp, Artificial Sequence
  Synthetic Polynucleotide
taatacgactcactatagggcgctgggcctcgggcgtctcgtagtaacgcaacagaggagagcgttaatgcgagacgccaacctggcggcagcgcaaaagatg

SEQ ID NO: 145094 - DNA, 103 bp, Artificial Sequence
  Synthetic Polynucleotide
taatacgactcactatagggcagcttgtcccgctgggcctcgggcgtctcaacagaggagagagacgatggaggcccagaacctggcggcagcgcaaaagatg

SEQ ID NO: 145095 - DNA, 103 bp, Artificial Sequence
  Synthetic Polynucleotide
taatacgactcactataggggcttttctgctgcatgtctttttcgtggggaacagaggagaccccacatgaaagacatgaacctggcggcagcgcaaaagatg

SEQ ID NO: 145096 - DNA, 103 bp, Artificial Sequence
  Synthetic Polynucleotide
taatacgactcactatagggtgacgttgtacagcttgtcccgctgggcctaacagaggagaaggcccatggggacaagcaacctggcggcagcgcaaaagatg

SEQ ID NO: 145097 - DNA, 103 bp, Artificial Sequence
  Synthetic Polynucleotide
taatacgactcactatagggtctaggctgatgacgttgtacagcttgtccaacagaggagaggacaaatggtacaacgtaacctggcggcagcgcaaaagatg

SEQ ID NO: 145098 - DNA, 103 bp, Artificial Sequence
  Synthetic Polynucleotide
taatacgactcactataggggtggctgaactctaggctgatgacgttgtaaacagaggagatacaacatgatcagcctaaacctggcggcagcgcaaaagatg

SEQ ID NO: 145099 - DNA, 103 bp, Artificial Sequence
  Synthetic Polynucleotide
taatacgactcactatagggccagcttggtgtggctgaactctaggctgaaacagaggagatcagccatgagttcagccaacctggcggcagcgcaaaagatg

SEQ ID NO: 145100 - DNA, 103 bp, Artificial Sequence
  Synthetic Polynucleotide
taatacgactcactatagggaccaagtgctccagcttggtgtggctgaacaacagaggagagttcagatgcaccaagctaacctggcggcagcgcaaaagatg

SEQ ID NO: 145101 - DNA, 103 bp, Artificial Sequence
  Synthetic Polynucleotide
taatacgactcactatagggcggacgcttgaccaagtgctccagcttggtaacagaggagaaccaagatggagcacttgaacctggcggcagcgcaaaagatg

SEQ ID NO: 145102 - DNA, 103 bp, Artificial Sequence
  Synthetic Polynucleotide
taatacgactcactatagggctaccacagtcggacgcttgaccaagtgctaacagaggagaagcactatgtcaagcgtcaacctggcggcagcgcaaaagatg

SEQ ID NO: 145103 - DNA, 103 bp, Artificial Sequence
  Synthetic Polynucleotide
taatacgactcactatagggtccaccaggtctaccacagtcggacgcttgaacagaggagacaagcgatggactgtggtaacctggcggcagcgcaaaagatg

SEQ ID NO: 145104 - DNA, 103 bp, Artificial Sequence
  Synthetic Polynucleotide
taatacgactcactataggggtccacccagtccaccaggtctaccacagtaacagaggagaactgtgatggacctggtgaacctggcggcagcgcaaaagatg

SEQ ID NO: 145105 - DNA, 103 bp, Artificial Sequence
  Synthetic Polynucleotide
taatacgactcactataggggccacatgttgtccacccagtccaccaggtaacagaggagaacctggatgactgggtggaacctggcggcagcgcaaaagatg

SEQ ID NO: 145106 - DNA, 103 bp, Artificial Sequence
  Synthetic Polynucleotide
taatacgactcactatagggttctttttttgcttttctgctgcatgtcttaacagaggagaaagacaatgagcagaaaaaacctggcggcagcgcaaaagatg

SEQ ID NO: 145107 - DNA, 103 bp, Artificial Sequence
  Synthetic Polynucleotide
taatacgactcactatagggagatgctggggccacatgttgtccacccagaacagaggagactgggtatgcaacatgtgaacctggcggcagcgcaaaagatg

SEQ ID NO: 145108 - DNA, 103 bp, Artificial Sequence
  Synthetic Polynucleotide
taatacgactcactatagggcttctccttcagatgctggggccacatgttaacagaggagaaacatgatgccccagcataacctggcggcagcgcaaaagatg

SEQ ID NO: 145109 - DNA, 103 bp, Artificial Sequence
  Synthetic Polynucleotide
taatacgactcactatagggcttctgtctgcttctccttcagatgctgggaacagaggagacccagcatgtgaaggagaaacctggcggcagcgcaaaagatg

SEQ ID NO: 145110 - DNA, 103 bp, Artificial Sequence
  Synthetic Polynucleotide
taatacgactcactataggggcgttcgtggcttctgtctgcttctccttcaacagaggagagaaggaatggcagacagaaacctggcggcagcgcaaaagatg

SEQ ID NO: 145111 - DNA, 103 bp, Artificial Sequence
  Synthetic Polynucleotide
taatacgactcactatagggctctgcaatggcgttcgtggcttctgtctgaacagaggagacagacaatggccacgaacaacctggcggcagcgcaaaagatg

SEQ ID NO: 145112 - DNA, 103 bp, Artificial Sequence
  Synthetic Polynucleotide
taatacgactcactatagggggtacttcatctctgcaatggcgttcgtggaacagaggagaccacgaatgccattgcagaacctggcggcagcgcaaaagatg

SEQ ID NO: 145113 - DNA, 103 bp, Artificial Sequence
  Synthetic Polynucleotide
taatacgactcactatagggttcactttcgggtacttcatctctgcaatgaacagaggagacattgcatggatgaagtaaacctggcggcagcgcaaaagatg

SEQ ID NO: 145114 - DNA, 103 bp, Artificial Sequence
  Synthetic Polynucleotide
taatacgactcactatagggacagtactttttcactttcgggtacttcataacagaggagaatgaagatgccgaaagtgaacctggcggcagcgcaaaagatg

SEQ ID NO: 145115 - DNA, 103 bp, Artificial Sequence
  Synthetic Polynucleotide
taatacgactcactatagggcgctcatcagacagtactttttcactttcgaacagaggagacgaaagatgaaaagtactaacctggcggcagcgcaaaagatg

SEQ ID NO: 145116 - DNA, 103 bp, Artificial Sequence
  Synthetic Polynucleotide
taatacgactcactatagggcaacctttcacgctcatcagacagtactttaacagaggagaaaagtaatgtctgatgagaacctggcggcagcgcaaaagatg

SEQ ID NO: 145117 - DNA, 103 bp, Artificial Sequence
  Synthetic Polynucleotide
taatacgactcactatagggtataactgttttctttttttgcttttctgcaacagaggagagcagaaatgcaaaaaaagaacctggcggcagcgcaaaagatg

SEQ ID NO: 145118 - DNA, 103 bp, Artificial Sequence
  Synthetic Polynucleotide
taatacgactcactataggggtcggtgaaacaacctttcacgctcatcagaacagaggagactgatgatggtgaaaggtaacctggcggcagcgcaaaagatg

SEQ ID NO: 145119 - DNA, 103 bp, Artificial Sequence
  Synthetic Polynucleotide
taatacgactcactatagggcgatgtggaagtcggtgaaacaacctttcaaacagaggagatgaaagatggtttcaccgaacctggcggcagcgcaaaagatg

SEQ ID NO: 145120 - DNA, 103 bp, Artificial Sequence
  Synthetic Polynucleotide
taatacgactcactatagggcctccaaagtcgatgtggaagtcggtgaaaaacagaggagatttcacatgcttccacataacctggcggcagcgcaaaagatg

SEQ ID NO: 145121 - DNA, 103 bp, Artificial Sequence
  Synthetic Polynucleotide
taatacgactcactatagggaacggaagtgcctccaaagtcgatgtggaaaacagaggagattccacatggactttggaaacctggcggcagcgcaaaagatg

SEQ ID NO: 145122 - DNA, 103 bp, Artificial Sequence
  Synthetic Polynucleotide
taatacgactcactatagggcatggtaccaaacggaagtgcctccaaagtaacagaggagaactttgatggcacttccgaacctggcggcagcgcaaaagatg

SEQ ID NO: 145123 - DNA, 103 bp, Artificial Sequence
  Synthetic Polynucleotide
taatacgactcactatagggccccggaaaacatggtaccaaacggaagtgaacagaggagacacttcatgttggtaccaaacctggcggcagcgcaaaagatg

SEQ ID NO: 145124 - DNA, 103 bp, Artificial Sequence
  Synthetic Polynucleotide
taatacgactcactatagggaatcttcccaccccggaaaacatggtaccaaacagaggagatggtacatggttttccggaacctggcggcagcgcaaaagatg

SEQ ID NO: 145125 - DNA, 103 bp, Artificial Sequence
  Synthetic Polynucleotide
taatacgactcactatagggtcagccaaaaaatcttcccaccccggaaaaaacagaggagattttccatggtgggaagaaacctggcggcagcgcaaaagatg

SEQ ID NO: 145126 - DNA, 103 bp, Artificial Sequence
  Synthetic Polynucleotide
taatacgactcactataggggttggaggaatcagccaaaaaatcttcccaaacagaggagatgggaaatgtttttggctaacctggcggcagcgcaaaagatg

SEQ ID NO: 145127 - DNA, 103 bp, Artificial Sequence
  Synthetic Polynucleotide
taatacgactcactatagggattgtgcagcgttggaggaatcagccaaaaaacagaggagattttggatgattcctccaaacctggcggcagcgcaaaagatg

SEQ ID NO: 145128 - DNA, 103 bp, Artificial Sequence
  Synthetic Polynucleotide
taatacgactcactatagggattttgtatatataactgttttctttttttaacagaggagaaaaaaaatgaaacagttaaacctggcggcagcgcaaaagatg

SEQ ID NO: 145129 - DNA, 103 bp, Artificial Sequence
  Synthetic Polynucleotide
taatacgactcactatagggacagcgccaaattgtgcagcgttggaggaaaacagaggagattcctcatgcgctgcacaaacctggcggcagcgcaaaagatg

SEQ ID NO: 145130 - DNA, 103 bp, Artificial Sequence
  Synthetic Polynucleotide
taatacgactcactatagggcactcctcgtacagcgccaaattgtgcagcaacagaggagagctgcaatgtttggcgctaacctggcggcagcgcaaaagatg

SEQ ID NO: 145131 - DNA, 103 bp, Artificial Sequence
  Synthetic Polynucleotide
taatacgactcactatagggtgacagcacccactcctcgtacagcgccaaaacagaggagattggcgatgtacgaggagaacctggcggcagcgcaaaagatg

SEQ ID NO: 145132 - DNA, 103 bp, Artificial Sequence
  Synthetic Polynucleotide
taatacgactcactatagggtctgtttgcctgacagcacccactcctcgtaacagaggagaacgaggatggggtgctgtaacctggcggcagcgcaaaagatg

SEQ ID NO: 145133 - DNA, 103 bp, Artificial Sequence
  Synthetic Polynucleotide
taatacgactcactatagggaagatgtcactctgtttgcctgacagcaccaacagaggagaggtgctatgaggcaaacaaacctggcggcagcgcaaaagatg

SEQ ID NO: 145134 - DNA, 103 bp, Artificial Sequence
  Synthetic Polynucleotide
taatacgactcactataggggtctcccagaaagatgtcactctgtttgccaacagaggagaggcaaaatgagtgacatcaacctggcggcagcgcaaaagatg

SEQ ID NO: 145135 - DNA, 103 bp, Artificial Sequence
  Synthetic Polynucleotide
taatacgactcactataggggttccacacggtctcccagaaagatgtcacaacagaggagagtgacaatgttctgggagaacctggcggcagcgcaaaagatg

SEQ ID NO: 145136 - DNA, 103 bp, Artificial Sequence
  Synthetic Polynucleotide
taatacgactcactatagggctttggcatcgttccacacggtctcccagaaacagaggagatctgggatgccgtgtggaaacctggcggcagcgcaaaagatg

SEQ ID NO: 145137 - DNA, 103 bp, Artificial Sequence
  Synthetic Polynucleotide
taatacgactcactatagggcagctcaattctttggcatcgttccacacgaacagaggagacgtgtgatgcgatgccaaaacctggcggcagcgcaaaagatg

SEQ ID NO: 145138 - DNA, 103 bp, Artificial Sequence
  Synthetic Polynucleotide
taatacgactcactatagggagccctgcttcagctcaattctttggcatcaacagaggagagatgccatggaattgagcaacctggcggcagcgcaaaagatg

SEQ ID NO: 145139 - DNA, 103 bp, Artificial Sequence
  Synthetic Polynucleotide
taatacgactcactatagggaattcaaagcattttgtatatataactgttaacagaggagaaacagtatgatatacaaaaacctggcggcagcgcaaaagatg

SEQ ID NO: 145140 - DNA, 103 bp, Artificial Sequence
  Synthetic Polynucleotide
taatacgactcactatagggaaaaatgtgtagccctgcttcagctcaattaacagaggagaaattgaatggaagcagggaacctggcggcagcgcaaaagatg

SEQ ID NO: 145141 - DNA, 103 bp, Artificial Sequence
  Synthetic Polynucleotide
taatacgactcactatagggggaagggatgaaaaatgtgtagccctgcttaacagaggagaaagcagatgtacacatttaacctggcggcagcgcaaaagatg

SEQ ID NO: 145142 - DNA, 103 bp, Artificial Sequence
  Synthetic Polynucleotide
taatacgactcactatagggggatccaaccggaagggatgaaaaatgtgtaacagaggagaacacatatgtcatcccttaacctggcggcagcgcaaaagatg

SEQ ID NO: 145143 - DNA, 103 bp, Artificial Sequence
  Synthetic Polynucleotide
taatacgactcactatagggtagacggcatggatccaaccggaagggatgaacagaggagacatcccatgcggttggataacctggcggcagcgcaaaagatg

SEQ ID NO: 145144 - DNA, 103 bp, Artificial Sequence
  Synthetic Polynucleotide
taatacgactcactatagggtacaggggtgtagacggcatggatccaaccaacagaggagaggttggatgcatgccgtcaacctggcggcagcgcaaaagatg

SEQ ID NO: 145145 - DNA, 103 bp, Artificial Sequence
  Synthetic Polynucleotide
taatacgactcactatagggccaaagagtctacaggggtgtagacggcataacagaggagaatgccgatgacacccctgaacctggcggcagcgcaaaagatg

SEQ ID NO: 145146 - DNA, 103 bp, Artificial Sequence
  Synthetic Polynucleotide
taatacgactcactatagggccgccgaacaccaaagagtctacaggggtgaacagaggagacaccccatgagactctttaacctggcggcagcgcaaaagatg

SEQ ID NO: 145147 - DNA, 103 bp, Artificial Sequence
  Synthetic Polynucleotide
taatacgactcactatagggcaggatgtttccgccgaacaccaaagagtcaacagaggagagactctatggtgttcggcaacctggcggcagcgcaaaagatg

SEQ ID NO: 145148 - DNA, 103 bp, Artificial Sequence
  Synthetic Polynucleotide
taatacgactcactatagggtaaagctgtgcaggatgtttccgccgaacaaacagaggagatgttcgatggaaacatccaacctggcggcagcgcaaaagatg

SEQ ID NO: 145149 - DNA, 103 bp, Artificial Sequence
  Synthetic Polynucleotide
taatacgactcactatagggatgggcacgttaaagctgtgcaggatgtttaacagaggagaaaacatatggcacagcttaacctggcggcagcgcaaaagatg

SEQ ID NO: 145150 - DNA, 103 bp, Artificial Sequence
  Synthetic Polynucleotide
taatacgactcactatagggcggccaactttctccgagcgtgagcaccataacagaggagaatggtgatgacgctcggaaacctggcggcagcgcaaaagatg

SEQ ID NO: 145151 - DNA, 103 bp, Artificial Sequence
  Synthetic Polynucleotide
taatacgactcactatagggctcggcgacgcgctccacgtcccagctgtcaacagaggagagacagcatggacgtggagaacctggcggcagcgcaaaagatg

SEQ ID NO: 145152 - DNA, 103 bp, Artificial Sequence
  Synthetic Polynucleotide
taatacgactcactatagggttgtttatgacatccttgaggaatttttgcaacagaggagagcaaaaatgcctcaaggaaacctggcggcagcgcaaaagatg

SEQ ID NO: 145153 - DNA, 103 bp, Artificial Sequence
  Synthetic Polynucleotide
taatacgactcactatagggctggtaaactttgtttatgacatccttgagaacagaggagactcaagatggtcataaacaacctggcggcagcgcaaaagatg

SEQ ID NO: 145154 - DNA, 103 bp, Artificial Sequence
  Synthetic Polynucleotide
taatacgactcactataggggaaatttcctctggtaaactttgtttatgaaacagaggagatcataaatgaagtttaccaacctggcggcagcgcaaaagatg

SEQ ID NO: 145155 - DNA, 103 bp, Artificial Sequence
  Synthetic Polynucleotide
taatacgactcactatagggtagacaggaagaaatttcctctggtaaactaacagaggagaagtttaatggaggaaattaacctggcggcagcgcaaaagatg

SEQ ID NO: 145156 - DNA, 103 bp, Artificial Sequence
  Synthetic Polynucleotide
taatacgactcactatagggactttgtatttagacaggaagaaatttcctaacagaggagaaggaaaatgcttcctgtcaacctggcggcagcgcaaaagatg

SEQ ID NO: 145157 - DNA, 103 bp, Artificial Sequence
  Synthetic Polynucleotide
taatacgactcactatagggagagcttcagactttgtatttagacaggaaaacagaggagattcctgatgaaatacaaaaacctggcggcagcgcaaaagatg

SEQ ID NO: 145158 - DNA, 103 bp, Artificial Sequence
  Synthetic Polynucleotide
taatacgactcactatagggttttgttctcagagcttcagactttgtattaacagaggagaaatacaatgtctgaagctaacctggcggcagcgcaaaagatg

SEQ ID NO: 145159 - DNA, 103 bp, Artificial Sequence
  Synthetic Polynucleotide
taatacgactcactatagggagacatctggttttgttctcagagcttcagaacagaggagactgaagatgtgagaacaaaacctggcggcagcgcaaaagatg

SEQ ID NO: 145160 - DNA, 103 bp, Artificial Sequence
  Synthetic Polynucleotide
taatacgactcactatagggcctgctttgcagacatctggttttgttctcaacagaggagagagaacatgaccagatgtaacctggcggcagcgcaaaagatg

SEQ ID NO: 145161 - DNA, 103 bp, Artificial Sequence
  Synthetic Polynucleotide
taatacgactcactatagggtgagagcaaccctgctttgcagacatctggaacagaggagaccagatatgtgcaaagcaaacctggcggcagcgcaaaagatg

SEQ ID NO: 145162 - DNA, 103 bp, Artificial Sequence
  Synthetic Polynucleotide
taatacgactcactataggggccagggccactcggcgacgcgctccacgtaacagaggagaacgtggatggcgtcgccgaacctggcggcagcgcaaaagatg

SEQ ID NO: 145163 - DNA, 103 bp, Artificial Sequence
  Synthetic Polynucleotide
taatacgactcactataggggagaggactttgagagcaaccctgctttgcaacagaggagagcaaagatgggttgctctaacctggcggcagcgcaaaagatg

SEQ ID NO: 145164 - DNA, 103 bp, Artificial Sequence
  Synthetic Polynucleotide
taatacgactcactataggggttccaatctgagaggactttgagagcaacaacagaggagagttgctatgaaagtcctcaacctggcggcagcgcaaaagatg

SEQ ID NO: 145165 - DNA, 103 bp, Artificial Sequence
  Synthetic Polynucleotide
taatacgactcactatagggcaagtctccagttccaatctgagaggacttaacagaggagaaagtccatgcagattggaaacctggcggcagcgcaaaagatg

SEQ ID NO: 145166 - DNA, 103 bp, Artificial Sequence
  Synthetic Polynucleotide
taatacgactcactatagggtcagaattttcaagtctccagttccaatctaacagaggagaagattgatgctggagactaacctggcggcagcgcaaaagatg

SEQ ID NO: 145167 - DNA, 103 bp, Artificial Sequence
  Synthetic Polynucleotide
taatacgactcactatagggtttggctcagtcagaattttcaagtctccaaacagaggagatggagaatggaaaattctaacctggcggcagcgcaaaagatg

SEQ ID NO: 145168 - DNA, 103 bp, Artificial Sequence
  Synthetic Polynucleotide
taatacgactcactatagggacagctgccttttggctcagtcagaattttaacagaggagaaaaattatgactgagccaaacctggcggcagcgcaaaagatg

SEQ ID NO: 145169 - DNA, 103 bp, Artificial Sequence
  Synthetic Polynucleotide
taatacgactcactatagggtaggctgagtacagctgccttttggctcagaacagaggagactgagcatgaaggcagctaacctggcggcagcgcaaaagatg

SEQ ID NO: 145170 - DNA, 103 bp, Artificial Sequence
  Synthetic Polynucleotide
taatacgactcactataggggtgtttgtcttaggctgagtacagctgcctaacagaggagaaggcagatgtactcagccaacctggcggcagcgcaaaagatg

SEQ ID NO: 145171 - DNA, 103 bp, Artificial Sequence
  Synthetic Polynucleotide
taatacgactcactatagggttcctgatcagtgtttgtcttaggctgagtaacagaggagaactcagatgaagacaaacaacctggcggcagcgcaaaagatg

SEQ ID NO: 145172 - DNA, 103 bp, Artificial Sequence
  Synthetic Polynucleotide
taatacgactcactatagggccaatctgttttcctgatcagtgtttgtctaacagaggagaagacaaatgctgatcaggaacctggcggcagcgcaaaagatg

SEQ ID NO: 145173 - DNA, 103 bp, Artificial Sequence
  Synthetic Polynucleotide
taatacgactcactataggggtcccggagagccagggccactcggcgacgaacagaggagacgtcgcatggtggccctgaacctggcggcagcgcaaaagatg

SEQ ID NO: 145174 - DNA, 103 bp, Artificial Sequence
  Synthetic Polynucleotide
taatacgactcactatagggggaacagactccaatctgttttcctgatcaaacagaggagatgatcaatgaaacagattaacctggcggcagcgcaaaagatg

SEQ ID NO: 145175 - DNA, 103 bp, Artificial Sequence
  Synthetic Polynucleotide
taatacgactcactatagggcaatgcttgtggaacagactccaatctgttaacagaggagaaacagaatggagtctgttaacctggcggcagcgcaaaagatg

SEQ ID NO: 145176 - DNA, 103 bp, Artificial Sequence
  Synthetic Polynucleotide
taatacgactcactataggggaaggccagtcaatgcttgtggaacagactaacagaggagaagtctgatgcacaagcataacctggcggcagcgcaaaagatg

SEQ ID NO: 145177 - DNA, 103 bp, Artificial Sequence
  Synthetic Polynucleotide
taatacgactcactatagggcactccttaggaaggccagtcaatgcttgtaacagaggagaacaagcatggactggcctaacctggcggcagcgcaaaagatg

SEQ ID NO: 145178 - DNA, 103 bp, Artificial Sequence
  Synthetic Polynucleotide
taatacgactcactatagggtgtaggtaagcactccttaggaaggccagtaacagaggagaactggcatgcctaaggagaacctggcggcagcgcaaaagatg

SEQ ID NO: 145179 - DNA, 103 bp, Artificial Sequence
  Synthetic Polynucleotide
taatacgactcactatagggaagaagcctttgtaggtaagcactccttagaacagaggagactaaggatggcttacctaaacctggcggcagcgcaaaagatg

SEQ ID NO: 145180 - DNA, 103 bp, Artificial Sequence
  Synthetic Polynucleotide
taatacgactcactatagggtctgccttagaagaagcctttgtaggtaagaacagaggagacttaccatgaaaggcttcaacctggcggcagcgcaaaagatg

SEQ ID NO: 145181 - DNA, 103 bp, Artificial Sequence
  Synthetic Polynucleotide
taatacgactcactatagggaatttccaattctgccttagaagaagccttaacagaggagaaaggctatgtctaaggcaaacctggcggcagcgcaaaagatg

SEQ ID NO: 145182 - DNA, 103 bp, Artificial Sequence
  Synthetic Polynucleotide
taatacgactcactataggggaggattggcaatttccaattctgccttagaacagaggagactaaggatgaattggaaaaacctggcggcagcgcaaaagatg

SEQ ID NO: 145183 - DNA, 103 bp, Artificial Sequence
  Synthetic Polynucleotide
taatacgactcactatagggtgcagttcaggaggattggcaatttccaataacagaggagaattggaatgtgccaatccaacctggcggcagcgcaaaagatg

SEQ ID NO: 145184 - DNA, 103 bp, Artificial Sequence
  Synthetic Polynucleotide
taatacgactcactatagggagctcgaatggtcccggagagccagggccaaacagaggagatggcccatgctctccgggaacctggcggcagcgcaaaagatg

SEQ ID NO: 145185 - DNA, 103 bp, Artificial Sequence
  Synthetic Polynucleotide
taatacgactcactatagggtaggtgcttctgcagttcaggaggattggcaacagaggagagccaatatgcctgaactgaacctggcggcagcgcaaaagatg

SEQ ID NO: 145186 - DNA, 103 bp, Artificial Sequence
  Synthetic Polynucleotide
taatacgactcactataggggtgcatgttctaggtgcttctgcagttcagaacagaggagactgaacatgagaagcaccaacctggcggcagcgcaaaagatg

SEQ ID NO: 145187 - DNA, 103 bp, Artificial Sequence
  Synthetic Polynucleotide
taatacgactcactataggggatggggaaggtgcatgttctaggtgcttcaacagaggagagaagcaatgagaacatgcaacctggcggcagcgcaaaagatg

SEQ ID NO: 145188 - DNA, 103 bp, Artificial Sequence
  Synthetic Polynucleotide
taatacgactcactatagggtgaaacatccgatggggaaggtgcatgttcaacagaggagagaacatatgccttccccaaacctggcggcagcgcaaaagatg

SEQ ID NO: 145189 - DNA, 103 bp, Artificial Sequence
  Synthetic Polynucleotide
taatacgactcactatagggctggtgcatttgaaacatccgatggggaagaacagaggagacttcccatgcggatgtttaacctggcggcagcgcaaaagatg

SEQ ID NO: 145190 - DNA, 103 bp, Artificial Sequence
  Synthetic Polynucleotide
taatacgactcactataggggctttcacttctggtgcatttgaaacatccaacagaggagaggatgtatgaaatgcaccaacctggcggcagcgcaaaagatg

SEQ ID NO: 145191 - DNA, 103 bp, Artificial Sequence
  Synthetic Polynucleotide
taatacgactcactatagggattgacacctgctttcacttctggtgcattaacagaggagaaatgcaatggaagtgaaaaacctggcggcagcgcaaaagatg

SEQ ID NO: 145192 - DNA, 103 bp, Artificial Sequence
  Synthetic Polynucleotide
taatacgactcactatagggggctatcactattgacacctgctttcacttaacagaggagaaagtgaatgcaggtgtcaaacctggcggcagcgcaaaagatg

SEQ ID NO: 145193 - DNA, 103 bp, Artificial Sequence
  Synthetic Polynucleotide
taatacgactcactatagggcagttattagggctatcactattgacacctaacagaggagaaggtgtatgtagtgatagaacctggcggcagcgcaaaagatg

SEQ ID NO: 145194 - DNA, 103 bp, Artificial Sequence
  Synthetic Polynucleotide
taatacgactcactatagggttttcctgaacagttattagggctatcactaacagaggagaagtgatatgcctaataacaacctggcggcagcgcaaaagatg

SEQ ID NO: 145195 - DNA, 103 bp, Artificial Sequence
  Synthetic Polynucleotide
taatacgactcactatagggtgtgggaaacagctcgaatggtcccggagaaacagaggagatctccgatgccattcgagaacctggcggcagcgcaaaagatg

SEQ ID NO: 145196 - DNA, 103 bp, Artificial Sequence
  Synthetic Polynucleotide
taatacgactcactataggggttctaccttttttcctgaacagttattagaacagaggagactaataatggttcaggaaaacctggcggcagcgcaaaagatg

SEQ ID NO: 145197 - DNA, 103 bp, Artificial Sequence
  Synthetic Polynucleotide
taatacgactcactatagggaaagctgaaggttctaccttttttcctgaaaacagaggagattcaggatgaaaggtagaaacctggcggcagcgcaaaagatg

SEQ ID NO: 145198 - DNA, 103 bp, Artificial Sequence
  Synthetic Polynucleotide
taatacgactcactatagggtcggcaagctaaagctgaaggttctaccttaacagaggagaaaggtaatgccttcagctaacctggcggcagcgcaaaagatg

SEQ ID NO: 145199 - DNA, 103 bp, Artificial Sequence
  Synthetic Polynucleotide
taatacgactcactatagggaattctgtgatcggcaagctaaagctgaagaacagaggagacttcagatgtagcttgccaacctggcggcagcgcaaaagatg

SEQ ID NO: 145200 - DNA, 103 bp, Artificial Sequence
  Synthetic Polynucleotide
taatacgactcactataggggattcctttaaattctgtgatcggcaagctaacagaggagaagcttgatgatcacagaaaacctggcggcagcgcaaaagatg

SEQ ID NO: 145201 - DNA, 103 bp, Artificial Sequence
  Synthetic Polynucleotide
taatacgactcactatagggttttactgaagattcctttaaattctgtgaaacagaggagatcacagatgttaaaggaaaacctggcggcagcgcaaaagatg

SEQ ID NO: 145202 - DNA, 103 bp, Artificial Sequence
  Synthetic Polynucleotide
taatacgactcactatagggcattatctacttttactgaagattcctttaaacagaggagataaaggatgcttcagtaaaacctggcggcagcgcaaaagatg

SEQ ID NO: 145203 - DNA, 103 bp, Artificial Sequence
  Synthetic Polynucleotide
taatacgactcactatagggcaacagctttcattatctacttttactgaaaacagaggagattcagtatgagtagataaaacctggcggcagcgcaaaagatg

SEQ ID NO: 145204 - DNA, 103 bp, Artificial Sequence
  Synthetic Polynucleotide
taatacgactcactataggggcttcttgaacaacagctttcattatctacaacagaggagagtagatatggaaagctgtaacctggcggcagcgcaaaagatg

SEQ ID NO: 145205 - DNA, 103 bp, Artificial Sequence
  Synthetic Polynucleotide
taatacgactcactatagggttttattgttgcttcttgaacaacagctttaacagaggagaaaagctatggttcaagaaaacctggcggcagcgcaaaagatg

SEQ ID NO: 145206 - DNA, 103 bp, Artificial Sequence
  Synthetic Polynucleotide
taatacgactcactataggggtaacgtcggtgtgggaaacagctcgaatgaacagaggagacattcgatgtgtttcccaaacctggcggcagcgcaaaagatg

SEQ ID NO: 145207 - DNA, 103 bp, Artificial Sequence
  Synthetic Polynucleotide
taatacgactcactataggggcattctggattttattgttgcttcttgaaaacagaggagattcaagatgcaacaataaaacctggcggcagcgcaaaagatg

SEQ ID NO: 145208 - DNA, 103 bp, Artificial Sequence
  Synthetic Polynucleotide
taatacgactcactatagggcctggatggggcattctggattttattgttaacagaggagaaacaatatgatccagaataacctggcggcagcgcaaaagatg

SEQ ID NO: 145209 - DNA, 103 bp, Artificial Sequence
  Synthetic Polynucleotide
taatacgactcactatagggaaaccgacttcctggatggggcattctggaaacagaggagatccagaatgccccatccaaacctggcggcagcgcaaaagatg

SEQ ID NO: 145210 - DNA, 103 bp, Artificial Sequence
  Synthetic Polynucleotide
taatacgactcactataggggggtctgtcaaaaccgacttcctggatgggaacagaggagacccatcatggaagtcggtaacctggcggcagcgcaaaagatg

SEQ ID NO: 145211 - DNA, 103 bp, Artificial Sequence
  Synthetic Polynucleotide
taatacgactcactataggggagtttagctgggtctgtcaaaaccgacttaacagaggagaaagtcgatgttgacagacaacctggcggcagcgcaaaagatg

SEQ ID NO: 145212 - DNA, 103 bp, Artificial Sequence
  Synthetic Polynucleotide
taatacgactcactataggggcagctttttgagtttagctgggtctgtcaaacagaggagatgacagatgcagctaaacaacctggcggcagcgcaaaagatg

SEQ ID NO: 145213 - DNA, 103 bp, Artificial Sequence
  Synthetic Polynucleotide
taatacgactcactatagggccactctgttgcagctttttgagtttagctaacagaggagaagctaaatgcaaaaagctaacctggcggcagcgcaaaagatg

SEQ ID NO: 145214 - DNA, 103 bp, Artificial Sequence
  Synthetic Polynucleotide
taatacgactcactataggggaaggcctcgccactctgttgcagctttttaacagaggagaaaaaagatgcaacagagtaacctggcggcagcgcaaaagatg

SEQ ID NO: 145215 - DNA, 103 bp, Artificial Sequence
  Synthetic Polynucleotide
taatacgactcactatagggcatcctgtacgaaggcctcgccactctgttaacagaggagaaacagaatggcgaggcctaacctggcggcagcgcaaaagatg

SEQ ID NO: 145216 - DNA, 103 bp, Artificial Sequence
  Synthetic Polynucleotide
taatacgactcactatagggacacaagaatcatcctgtacgaaggcctcgaacagaggagacgaggcatgcgtacaggaaacctggcggcagcgcaaaagatg

SEQ ID NO: 145217 - DNA, 103 bp, Artificial Sequence
  Synthetic Polynucleotide
taatacgactcactatagggatccttcttggtaacgtcggtgtgggaaacaacagaggagagtttccatgaccgacgttaacctggcggcagcgcaaaagatg

SEQ ID NO: 145218 - DNA, 103 bp, Artificial Sequence
  Synthetic Polynucleotide
taatacgactcactatagggcacgatgttcacacaagaatcatcctgtacaacagaggagagtacagatggattcttgtaacctggcggcagcgcaaaagatg

SEQ ID NO: 145219 - DNA, 103 bp, Artificial Sequence
  Synthetic Polynucleotide
taatacgactcactataggggcaactgtgccacgatgttcacacaagaataacagaggagaattcttatgtgaacatcgaacctggcggcagcgcaaaagatg

SEQ ID NO: 145220 - DNA, 103 bp, Artificial Sequence
  Synthetic Polynucleotide
taatacgactcactatagggcggcatttaggcaactgtgccacgatgttcaacagaggagagaacatatgggcacagttaacctggcggcagcgcaaaagatg

SEQ ID NO: 145221 - DNA, 103 bp, Artificial Sequence
  Synthetic Polynucleotide
taatacgactcactataggggcgacactctcggcatttaggcaactgtgcaacagaggagagcacagatgcctaaatgcaacctggcggcagcgcaaaagatg

SEQ ID NO: 145222 - DNA, 103 bp, Artificial Sequence
  Synthetic Polynucleotide
taatacgactcactataggggactgtccaagcgacactctcggcatttagaacagaggagactaaatatggagagtgtcaacctggcggcagcgcaaaagatg

SEQ ID NO: 145223 - DNA, 103 bp, Artificial Sequence
  Synthetic Polynucleotide
taatacgactcactatagggtccttgcggagactgtccaagcgacactctaacagaggagaagagtgatgcttggacagaacctggcggcagcgcaaaagatg

SEQ ID NO: 145224 - DNA, 103 bp, Artificial Sequence
  Synthetic Polynucleotide
taatacgactcactatagggttgctccttatccttgcggagactgtccaaaacagaggagattggacatgctccgcaagaacctggcggcagcgcaaaagatg

SEQ ID NO: 145225 - DNA, 103 bp, Artificial Sequence
  Synthetic Polynucleotide
taatacgactcactatagggagtccttctgttgctccttatccttgcggaaacagaggagatccgcaatgataaggagcaacctggcggcagcgcaaaagatg

SEQ ID NO: 145226 - DNA, 103 bp, Artificial Sequence
  Synthetic Polynucleotide
taatacgactcactatagggaacacaggtgagtccttctgttgctccttaaacagaggagataaggaatgacagaaggaaacctggcggcagcgcaaaagatg

SEQ ID NO: 145227 - DNA, 103 bp, Artificial Sequence
  Synthetic Polynucleotide
taatacgactcactataggggaagcggcaaaacacaggtgagtccttctgaacagaggagacagaagatgtcacctgtgaacctggcggcagcgcaaaagatg

SEQ ID NO: 145228 - DNA, 103 bp, Artificial Sequence
  Synthetic Polynucleotide
taatacgactcactatagggacaccttcagatccttcttggtaacgtcggaacagaggagaccgacgatgccaagaaggaacctggcggcagcgcaaaagatg

SEQ ID NO: 145229 - DNA, 103 bp, Artificial Sequence
  Synthetic Polynucleotide
taatacgactcactatagggtgaagtgaaagaagcggcaaaacacaggtgaacagaggagacacctgatgtttgccgctaacctggcggcagcgcaaaagatg

SEQ ID NO: 145230 - DNA, 103 bp, Artificial Sequence
  Synthetic Polynucleotide
taatacgactcactatagggtgtaacctcctgaagtgaaagaagcggcaaaacagaggagattgccgatgctttcacttaacctggcggcagcgcaaaagatg

SEQ ID NO: 145231 - DNA, 103 bp, Artificial Sequence
  Synthetic Polynucleotide
taatacgactcactatagggtttgttgaattgtaacctcctgaagtgaaaaacagaggagatttcacatgaggaggttaaacctggcggcagcgcaaaagatg

SEQ ID NO: 145232 - DNA, 103 bp, Artificial Sequence
  Synthetic Polynucleotide
taatacgactcactatagggacacaccatgtttgttgaattgtaacctccaacagaggagaggaggtatgaattcaacaaacctggcggcagcgcaaaagatg

SEQ ID NO: 145233 - DNA, 103 bp, Artificial Sequence
  Synthetic Polynucleotide
taatacgactcactatagggtctacccgcaacacaccatgtttgttgaataacagaggagaattcaaatgacatggtgtaacctggcggcagcgcaaaagatg

SEQ ID NO: 145234 - DNA, 103 bp, Artificial Sequence
  Synthetic Polynucleotide
taatacgactcactatagggtaagaagccttctacccgcaacacaccatgaacagaggagacatggtatgttgcgggtaaacctggcggcagcgcaaaagatg

SEQ ID NO: 145235 - DNA, 103 bp, Artificial Sequence
  Synthetic Polynucleotide
taatacgactcactatagggtgtttggtgttaagaagccttctacccgcaaacagaggagatgcgggatgaaggcttctaacctggcggcagcgcaaaagatg

SEQ ID NO: 145236 - DNA, 103 bp, Artificial Sequence
  Synthetic Polynucleotide
taatacgactcactatagggttgtcatacttgtttggtgttaagaagcctaacagaggagaaggcttatgaacaccaaaaacctggcggcagcgcaaaagatg

SEQ ID NO: 145237 - DNA, 103 bp, Artificial Sequence
  Synthetic Polynucleotide
taatacgactcactatagggaattgcttcattgtcatacttgtttggtgtaacagaggagaacaccaatgaagtatgacaacctggcggcagcgcaaaagatg

SEQ ID NO: 145238 - DNA, 103 bp, Artificial Sequence
  Synthetic Polynucleotide
taatacgactcactatagggaccacaagccaattgcttcattgtcatactaacagaggagaagtatgatgatgaagcaaaacctggcggcagcgcaaaagatg

SEQ ID NO: 145239 - DNA, 103 bp, Artificial Sequence
  Synthetic Polynucleotide
taatacgactcactatagggaattccacacacaccttcagatccttcttgaacagaggagacaagaaatgtctgaaggtaacctggcggcagcgcaaaagatg

SEQ ID NO: 145240 - DNA, 103 bp, Artificial Sequence
  Synthetic Polynucleotide
taatacgactcactataggggttaaaggtaaccacaagccaattgcttcaaacagaggagatgaagcatgtggcttgtgaacctggcggcagcgcaaaagatg

SEQ ID NO: 145241 - DNA, 103 bp, Artificial Sequence
  Synthetic Polynucleotide
taatacgactcactatagggaacgtttttggttaaaggtaaccacaagccaacagaggagaggcttgatgttacctttaaacctggcggcagcgcaaaagatg

SEQ ID NO: 145242 - DNA, 103 bp, Artificial Sequence
  Synthetic Polynucleotide
taatacgactcactatagggcaatccccacaacgtttttggttaaaggtaaacagaggagataccttatgccaaaaacgaacctggcggcagcgcaaaagatg

SEQ ID NO: 145243 - DNA, 103 bp, Artificial Sequence
  Synthetic Polynucleotide
taatacgactcactataggggtgtccaaatcaatccccacaacgtttttgaacagaggagacaaaaaatgtgtggggataacctggcggcagcgcaaaagatg

SEQ ID NO: 145244 - DNA, 103 bp, Artificial Sequence
  Synthetic Polynucleotide
taatacgactcactataggggtactttgctgtgtccaaatcaatccccacaacagaggagagtggggatggatttggacaacctggcggcagcgcaaaagatg

SEQ ID NO: 145245 - DNA, 103 bp, Artificial Sequence
  Synthetic Polynucleotide
taatacgactcactatagggtggccaagatgtactttgctgtgtccaaataacagaggagaatttggatgcagcaaagtaacctggcggcagcgcaaaagatg

SEQ ID NO: 145246 - DNA, 103 bp, Artificial Sequence
  Synthetic Polynucleotide
taatacgactcactatagggtctccaatgttggccaagatgtactttgctaacagaggagaagcaaaatgcatcttggcaacctggcggcagcgcaaaagatg

SEQ ID NO: 145247 - DNA, 103 bp, Artificial Sequence
  Synthetic Polynucleotide
taatacgactcactatagggacagaagtggtctccaatgttggccaagataacagaggagaatcttgatgaacattggaaacctggcggcagcgcaaaagatg

SEQ ID NO: 145248 - DNA, 103 bp, Artificial Sequence
  Synthetic Polynucleotide
taatacgactcactatagggtcaccatttgacagaagtggtctccaatgtaacagaggagaacattgatgaccacttctaacctggcggcagcgcaaaagatg

SEQ ID NO: 145249 - DNA, 103 bp, Artificial Sequence
  Synthetic Polynucleotide
taatacgactcactatagggttttcagaaatcaccatttgacagaagtggaacagaggagaccacttatgtcaaatggtaacctggcggcagcgcaaaagatg

SEQ ID NO: 145250 - DNA, 103 bp, Artificial Sequence
  Synthetic Polynucleotide
taatacgactcactatagggttccccatcaaattccacacacaccttcagaacagaggagactgaagatgtgtgtggaaaacctggcggcagcgcaaaagatg

SEQ ID NO: 145251 - DNA, 103 bp, Artificial Sequence
  Synthetic Polynucleotide
taatacgactcactatagggcatagcttccttttcagaaatcaccatttgaacagaggagacaaatgatgatttctgaaaacctggcggcagcgcaaaagatg

SEQ ID NO: 145252 - DNA, 103 bp, Artificial Sequence
  Synthetic Polynucleotide
taatacgactcactatagggcaatagttgacatagcttccttttcagaaaaacagaggagatttctgatgaggaagctaaacctggcggcagcgcaaaagatg

SEQ ID NO: 145253 - DNA, 103 bp, Artificial Sequence
  Synthetic Polynucleotide
taatacgactcactatagggctgtgtggctcaatagttgacatagcttccaacagaggagaggaagcatggtcaactataacctggcggcagcgcaaaagatg

SEQ ID NO: 145254 - DNA, 103 bp, Artificial Sequence
  Synthetic Polynucleotide
taatacgactcactatagggagcaacctgtctgtgtggctcaatagttgaaacagaggagatcaactatggagccacacaacctggcggcagcgcaaaagatg

SEQ ID NO: 145255 - DNA, 103 bp, Artificial Sequence
  Synthetic Polynucleotide
taatacgactcactatagggctcgcttccaagcaacctgtctgtgtggctaacagaggagaagccacatggacaggttgaacctggcggcagcgcaaaagatg

SEQ ID NO: 145256 - DNA, 103 bp, Artificial Sequence
  Synthetic Polynucleotide
taatacgactcactatagggcctttgacagctcgcttccaagcaacctgtaacagaggagaacaggtatgttggaagcgaacctggcggcagcgcaaaagatg

SEQ ID NO: 145257 - DNA, 103 bp, Artificial Sequence
  Synthetic Polynucleotide
taatacgactcactatagggttctcgaacacctttgacagctcgcttccaaacagaggagatggaagatggctgtcaaaaacctggcggcagcgcaaaagatg

SEQ ID NO: 145258 - DNA, 103 bp, Artificial Sequence
  Synthetic Polynucleotide
taatacgactcactatagggcatcacacatttctcgaacacctttgacagaacagaggagactgtcaatggtgttcgagaacctggcggcagcgcaaaagatg

SEQ ID NO: 145259 - DNA, 103 bp, Artificial Sequence
  Synthetic Polynucleotide
taatacgactcactataggggtgtcgcacacatcacacatttctcgaacaaacagaggagatgttcgatgaatgtgtgaaacctggcggcagcgcaaaagatg

SEQ ID NO: 145260 - DNA, 103 bp, Artificial Sequence
  Synthetic Polynucleotide
taatacgactcactataggggaagatggtggtgtcgcacacatcacacataacagaggagaatgtgtatggtgtgcgacaacctggcggcagcgcaaaagatg

SEQ ID NO: 145261 - DNA, 103 bp, Artificial Sequence
  Synthetic Polynucleotide
taatacgactcactatagggccaccaataccggccaactttctccgagcgaacagaggagacgctcgatgaaagttggcaacctggcggcagcgcaaaagatg

SEQ ID NO: 145262 - DNA, 103 bp, Artificial Sequence
  Synthetic Polynucleotide
taatacgactcactatagggtcctccaagattccccatcaaattccacacaacagaggagagtgtggatgttgatggggaacctggcggcagcgcaaaagatg

SEQ ID NO: 145263 - DNA, 103 bp, Artificial Sequence
  Synthetic Polynucleotide
taatacgactcactatagggagtgcaggttgaagatggtggtgtcgcacaaacagaggagatgtgcgatgccaccatctaacctggcggcagcgcaaaagatg

SEQ ID NO: 145264 - DNA, 103 bp, Artificial Sequence
  Synthetic Polynucleotide
taatacgactcactatagggggacacacccagtgcaggttgaagatggtgaacagaggagacaccatatgcaacctgcaaacctggcggcagcgcaaaagatg

SEQ ID NO: 145265 - DNA, 103 bp, Artificial Sequence
  Synthetic Polynucleotide
taatacgactcactatagggcccacaccgaggacacacccagtgcaggttaacagaggagaaacctgatgtgggtgtgtaacctggcggcagcgcaaaagatg

SEQ ID NO: 145266 - DNA, 103 bp, Artificial Sequence
  Synthetic Polynucleotide
taatacgactcactatagggatactccaaacccacaccgaggacacacccaacagaggagagggtgtatgctcggtgtgaacctggcggcagcgcaaaagatg

SEQ ID NO: 145267 - DNA, 103 bp, Artificial Sequence
  Synthetic Polynucleotide
taatacgactcactatagggcagtccacacatactccaaacccacaccgaaacagaggagatcggtgatggtttggagtaacctggcggcagcgcaaaagatg

SEQ ID NO: 145268 - DNA, 103 bp, Artificial Sequence
  Synthetic Polynucleotide
taatacgactcactatagggcatccggtagcagtccacacatactccaaaaacagaggagatttggaatgtgtgtggacaacctggcggcagcgcaaaagatg

SEQ ID NO: 145269 - DNA, 103 bp, Artificial Sequence
  Synthetic Polynucleotide
taatacgactcactatagggtctttctcttcatccggtagcagtccacacaacagaggagagtgtggatggctaccggaaacctggcggcagcgcaaaagatg

SEQ ID NO: 145270 - DNA, 103 bp, Artificial Sequence
  Synthetic Polynucleotide
taatacgactcactatagggtgttggcaattctttctcttcatccggtagaacagaggagactaccgatggaagagaaaaacctggcggcagcgcaaaagatg

SEQ ID NO: 145271 - DNA, 103 bp, Artificial Sequence
  Synthetic Polynucleotide
taatacgactcactatagggagcagcaccctgttggcaattctttctcttaacagaggagaaagagaatgaattgccaaaacctggcggcagcgcaaaagatg

SEQ ID NO: 145272 - DNA, 103 bp, Artificial Sequence
  Synthetic Polynucleotide
taatacgactcactatagggaagtcttgtaagcagcaccctgttggcaataacagaggagaattgccatgagggtgctgaacctggcggcagcgcaaaagatg

SEQ ID NO: 145273 - DNA, 103 bp, Artificial Sequence
  Synthetic Polynucleotide
taatacgactcactatagggcatcttcttttcctccaagattccccatcaaacagaggagatgatggatgatcttggagaacctggcggcagcgcaaaagatg

SEQ ID NO: 145274 - DNA, 103 bp, Artificial Sequence
  Synthetic Polynucleotide
taatacgactcactatagggagccaagagaaagtcttgtaagcagcacccaacagaggagagggtgcatgttacaagacaacctggcggcagcgcaaaagatg

SEQ ID NO: 145275 - DNA, 103 bp, Artificial Sequence
  Synthetic Polynucleotide
taatacgactcactatagggcacacattttagccaagagaaagtcttgtaaacagaggagatacaagatgttctcttggaacctggcggcagcgcaaaagatg

SEQ ID NO: 145276 - DNA, 103 bp, Artificial Sequence
  Synthetic Polynucleotide
taatacgactcactatagggtctgactcttcacacattttagccaagagaaacagaggagatctcttatgtaaaatgtgaacctggcggcagcgcaaaagatg

SEQ ID NO: 145277 - DNA, 103 bp, Artificial Sequence
  Synthetic Polynucleotide
taatacgactcactatagggggttcatgtatctgactcttcacacattttaacagaggagaaaaatgatggaagagtcaaacctggcggcagcgcaaaagatg

SEQ ID NO: 145278 - DNA, 103 bp, Artificial Sequence
  Synthetic Polynucleotide
taatacgactcactatagggtaagttctctggttcatgtatctgactcttaacagaggagaaagagtatgatacatgaaaacctggcggcagcgcaaaagatg

SEQ ID NO: 145279 - DNA, 103 bp, Artificial Sequence
  Synthetic Polynucleotide
taatacgactcactataggggtgtgggcattaagttctctggttcatgtaaacagaggagatacatgatgcagagaactaacctggcggcagcgcaaaagatg

SEQ ID NO: 145280 - DNA, 103 bp, Artificial Sequence
  Synthetic Polynucleotide
taatacgactcactatagggggaatgatctgtgtgggcattaagttctctaacagaggagaagagaaatgaatgcccacaacctggcggcagcgcaaaagatg

SEQ ID NO: 145281 - DNA, 103 bp, Artificial Sequence
  Synthetic Polynucleotide
taatacgactcactatagggtgcttttccaggaatgatctgtgtgggcataacagaggagaatgcccatgcagatcattaacctggcggcagcgcaaaagatg

SEQ ID NO: 145282 - DNA, 103 bp, Artificial Sequence
  Synthetic Polynucleotide
taatacgactcactatagggcatcatagagtgcttttccaggaatgatctaacagaggagaagatcaatgctggaaaagaacctggcggcagcgcaaaagatg

SEQ ID NO: 145283 - DNA, 103 bp, Artificial Sequence
  Synthetic Polynucleotide
taatacgactcactatagggatgtctccaacatcatagagtgcttttccaaacagaggagatggaaaatgactctatgaaacctggcggcagcgcaaaagatg

SEQ ID NO: 145284 - DNA, 103 bp, Artificial Sequence
  Synthetic Polynucleotide
taatacgactcactataggggacttctatccatcttcttttcctccaagaaacagaggagatcttggatgaaaagaagaaacctggcggcagcgcaaaagatg

SEQ ID NO: 145285 - DNA, 103 bp, Artificial Sequence
  Synthetic Polynucleotide
taatacgactcactatagggagaatgaacaatgtctccaacatcatagagaacagaggagactctatatggttggagacaacctggcggcagcgcaaaagatg

SEQ ID NO: 145286 - DNA, 103 bp, Artificial Sequence
  Synthetic Polynucleotide
taatacgactcactatagggtcgctcttacagaatgaacaatgtctccaaaacagaggagattggagatgttgttcattaacctggcggcagcgcaaaagatg

SEQ ID NO: 145287 - DNA, 103 bp, Artificial Sequence
  Synthetic Polynucleotide
taatacgactcactatagggattccccatttcgctcttacagaatgaacaaacagaggagatgttcaatgtgtaagagcaacctggcggcagcgcaaaagatg

SEQ ID NO: 145288 - DNA, 103 bp, Artificial Sequence
  Synthetic Polynucleotide
taatacgactcactataggggtttgcctttattccccatttcgctcttacaacagaggagagtaagaatgaaatggggaaacctggcggcagcgcaaaagatg

SEQ ID NO: 145289 - DNA, 103 bp, Artificial Sequence
  Synthetic Polynucleotide
taatacgactcactatagggaacaagggcagtttgcctttattccccattaacagaggagaaatgggatgtaaaggcaaaacctggcggcagcgcaaaagatg

SEQ ID NO: 145290 - DNA, 103 bp, Artificial Sequence
  Synthetic Polynucleotide
taatacgactcactatagggtgcctgtttgaacaagggcagtttgcctttaacagaggagaaaaggcatgctgcccttgaacctggcggcagcgcaaaagatg

SEQ ID NO: 145291 - DNA, 103 bp, Artificial Sequence
  Synthetic Polynucleotide
taatacgactcactataggggagtttgaattgcctgtttgaacaagggcaaacagaggagatgccctatgtcaaacaggaacctggcggcagcgcaaaagatg

SEQ ID NO: 145292 - DNA, 103 bp, Artificial Sequence
  Synthetic Polynucleotide
taatacgactcactataggggctttgaaaagagtttgaattgcctgtttgaacagaggagacaaacaatgaattcaaacaacctggcggcagcgcaaaagatg

SEQ ID NO: 145293 - DNA, 103 bp, Artificial Sequence
  Synthetic Polynucleotide
taatacgactcactatagggtttgaggctggctttgaaaagagtttgaataacagaggagaattcaaatgcttttcaaaaacctggcggcagcgcaaaagatg

SEQ ID NO: 145294 - DNA, 103 bp, Artificial Sequence
  Synthetic Polynucleotide
taatacgactcactatagggtaggtcttcctttgaggctggctttgaaaaaacagaggagattttcaatgccagcctcaaacctggcggcagcgcaaaagatg

SEQ ID NO: 145295 - DNA, 103 bp, Artificial Sequence
  Synthetic Polynucleotide
taatacgactcactataggggaaggctgtagacttctatccatcttctttaacagaggagaaaagaaatgggatagaagaacctggcggcagcgcaaaagatg

SEQ ID NO: 145296 - DNA, 103 bp, Artificial Sequence
  Synthetic Polynucleotide
taatacgactcactatagggaagtctgttttaggtcttcctttgaggctgaacagaggagacagcctatgaggaagaccaacctggcggcagcgcaaaagatg

SEQ ID NO: 145297 - DNA, 103 bp, Artificial Sequence
  Synthetic Polynucleotide
taatacgactcactatagggccagctaaagaagtctgttttaggtcttccaacagaggagaggaagaatgaaaacagacaacctggcggcagcgcaaaagatg

SEQ ID NO: 145298 - DNA, 103 bp, Artificial Sequence
  Synthetic Polynucleotide
taatacgactcactatagggcggtttttctccagctaaagaagtctgtttaacagaggagaaaacagatgtctttagctaacctggcggcagcgcaaaagatg

SEQ ID NO: 145299 - DNA, 103 bp, Artificial Sequence
  Synthetic Polynucleotide
taatacgactcactatagggcaccaagagtcggtttttctccagctaaagaacagaggagactttagatggagaaaaacaacctggcggcagcgcaaaagatg

SEQ ID NO: 145300 - DNA, 103 bp, Artificial Sequence
  Synthetic Polynucleotide
taatacgactcactatagggtggagcactgcaccaagagtcggtttttctaacagaggagaagaaaaatggactcttggaacctggcggcagcgcaaaagatg

SEQ ID NO: 145301 - DNA, 103 bp, Artificial Sequence
  Synthetic Polynucleotide
taatacgactcactataggggggattctgctggagcactgcaccaagagtaacagaggagaactcttatggcagtgctcaacctggcggcagcgcaaaagatg

SEQ ID NO: 145302 - DNA, 103 bp, Artificial Sequence
  Synthetic Polynucleotide
taatacgactcactatagggccaacactgagggattctgctggagcactgaacagaggagacagtgcatgagcagaatcaacctggcggcagcgcaaaagatg

SEQ ID NO: 145303 - DNA, 103 bp, Artificial Sequence
  Synthetic Polynucleotide
taatacgactcactataggggctgctggctccaacactgagggattctgcaacagaggagagcagaaatgctcagtgttaacctggcggcagcgcaaaagatg

SEQ ID NO: 145304 - DNA, 103 bp, Artificial Sequence
  Synthetic Polynucleotide
taatacgactcactatagggcccacccacagctgctggctccaacactgaaacagaggagatcagtgatggagccagcaaacctggcggcagcgcaaaagatg

SEQ ID NO: 145305 - DNA, 103 bp, Artificial Sequence
  Synthetic Polynucleotide
taatacgactcactatagggaggctgcttccccacccacagctgctggctaacagaggagaagccagatgctgtgggtgaacctggcggcagcgcaaaagatg

SEQ ID NO: 145306 - DNA, 103 bp, Artificial Sequence
  Synthetic Polynucleotide
taatacgactcactataggggctctccttagaaggctgtagacttctatcaacagaggagagatagaatgctacagcctaacctggcggcagcgcaaaagatg

SEQ ID NO: 145307 - DNA, 103 bp, Artificial Sequence
  Synthetic Polynucleotide
taatacgactcactataggggctggcttggaggctgcttccccacccacaaacagaggagatgtgggatgggaagcagcaacctggcggcagcgcaaaagatg

SEQ ID NO: 145308 - DNA, 103 bp, Artificial Sequence
  Synthetic Polynucleotide
taatacgactcactatagggcatgctgccggctggcttggaggctgcttcaacagaggagagaagcaatgtccaagccaaacctggcggcagcgcaaaagatg

SEQ ID NO: 145309 - DNA, 103 bp, Artificial Sequence
  Synthetic Polynucleotide
taatacgactcactatagggaggcaggcttcatgctgccggctggcttggaacagaggagaccaagcatgccggcagcaaacctggcggcagcgcaaaagatg

SEQ ID NO: 145310 - DNA, 103 bp, Artificial Sequence
  Synthetic Polynucleotide
taatacgactcactatagggctggctggacaggcaggcttcatgctgccgaacagaggagacggcagatggaagcctgcaacctggcggcagcgcaaaagatg

SEQ ID NO: 145311 - DNA, 103 bp, Artificial Sequence
  Synthetic Polynucleotide
taatacgactcactatagggaggagatgtgctggctggacaggcaggcttaacagaggagaaagcctatgtgtccagccaacctggcggcagcgcaaaagatg

SEQ ID NO: 145312 - DNA, 103 bp, Artificial Sequence
  Synthetic Polynucleotide
taatacgactcactataggggccagtttagaggagatgtgctggctggacaacagaggagagtccagatggcacatctcaacctggcggcagcgcaaaagatg

SEQ ID NO: 145313 - DNA, 103 bp, Artificial Sequence
  Synthetic Polynucleotide
taatacgactcactatagggaggtcggccagccagtttagaggagatgtgaacagaggagacacatcatgtctaaactgaacctggcggcagcgcaaaagatg

SEQ ID NO: 145314 - DNA, 103 bp, Artificial Sequence
  Synthetic Polynucleotide
taatacgactcactatagggcccgctggttaggtcggccagccagtttagaacagaggagactaaacatgctggccgacaacctggcggcagcgcaaaagatg

SEQ ID NO: 145315 - DNA, 103 bp, Artificial Sequence
  Synthetic Polynucleotide
taatacgactcactatagggtgttgacattcccgctggttaggtcggccaaacagaggagatggccgatgtaaccagcgaacctggcggcagcgcaaaagatg

SEQ ID NO: 145316 - DNA, 103 bp, Artificial Sequence
  Synthetic Polynucleotide
taatacgactcactatagggttgttttccttgttgacattcccgctggttaacagaggagaaaccagatggaatgtcaaaacctggcggcagcgcaaaagatg

SEQ ID NO: 145317 - DNA, 103 bp, Artificial Sequence
  Synthetic Polynucleotide
taatacgactcactatagggtactaaaaatgctctccttagaaggctgtaaacagaggagatacagcatgctaaggagaaacctggcggcagcgcaaaagatg

SEQ ID NO: 145318 - DNA, 103 bp, Artificial Sequence
  Synthetic Polynucleotide
taatacgactcactatagggttgtttttccttgttttccttgttgacattaacagaggagaaatgtcatgaaggaaaacaacctggcggcagcgcaaaagatg

SEQ ID NO: 145319 - DNA, 103 bp, Artificial Sequence
  Synthetic Polynucleotide
taatacgactcactataggggcattgttggttgtttttccttgttttcctaacagaggagaaggaaaatgaggaaaaacaacctggcggcagcgcaaaagatg

SEQ ID NO: 145320 - DNA, 103 bp, Artificial Sequence
  Synthetic Polynucleotide
taatacgactcactatagggtttaaaattggcattgttggttgtttttccaacagaggagaggaaaaatgaccaacaataacctggcggcagcgcaaaagatg

SEQ ID NO: 145321 - DNA, 103 bp, Artificial Sequence
  Synthetic Polynucleotide
taatacgactcactataggggatttcattctttaaaattggcattgttggaacagaggagaccaacaatgccaattttaaacctggcggcagcgcaaaagatg

SEQ ID NO: 145322 - DNA, 103 bp, Artificial Sequence
  Synthetic Polynucleotide
taatacgactcactataggggaaggcatttgatttcattctttaaaattgaacagaggagacaatttatgagaatgaaaaacctggcggcagcgcaaaagatg

SEQ ID NO: 145323 - DNA, 103 bp, Artificial Sequence
  Synthetic Polynucleotide
taatacgactcactataggggggaggggtggaaggcatttgatttcattcaacagaggagagaatgaatgcaaatgcctaacctggcggcagcgcaaaagatg

SEQ ID NO: 145324 - DNA, 103 bp, Artificial Sequence
  Synthetic Polynucleotide
taatacgactcactataggggcttaaaggtgggaggggtggaaggcatttaacagaggagaaaatgcatgccacccctcaacctggcggcagcgcaaaagatg

SEQ ID NO: 145325 - DNA, 103 bp, Artificial Sequence
  Synthetic Polynucleotide
taatacgactcactatagggtgctggatttgcttaaaggtgggaggggtgaacagaggagacaccccatgcacctttaaaacctggcggcagcgcaaaagatg

SEQ ID NO: 145326 - DNA, 103 bp, Artificial Sequence
  Synthetic Polynucleotide
taatacgactcactatagggtggaggactgtgctggatttgcttaaaggtaacagaggagaacctttatgcaaatccagaacctggcggcagcgcaaaagatg

SEQ ID NO: 145327 - DNA, 103 bp, Artificial Sequence
  Synthetic Polynucleotide
taatacgactcactataggggttaaacgtatggaggactgtgctggatttaacagaggagaaaatccatgacagtcctcaacctggcggcagcgcaaaagatg

SEQ ID NO: 145328 - DNA, 103 bp, Artificial Sequence
  Synthetic Polynucleotide
taatacgactcactatagggaattatgttctactaaaaatgctctccttaaacagaggagataaggaatgcatttttagaacctggcggcagcgcaaaagatg

SEQ ID NO: 145329 - DNA, 103 bp, Artificial Sequence
  Synthetic Polynucleotide
taatacgactcactatagggaaattgtgctgttaaacgtatggaggactgaacagaggagacagtccatgatacgtttaaacctggcggcagcgcaaaagatg

SEQ ID NO: 145330 - DNA, 103 bp, Artificial Sequence
  Synthetic Polynucleotide
taatacgactcactatagggacgggtgtcaaaattgtgctgttaaacgtaaacagaggagatacgttatgcagcacaataacctggcggcagcgcaaaagatg

SEQ ID NO: 145331 - DNA, 103 bp, Artificial Sequence
  Synthetic Polynucleotide
taatacgactcactataggggttgttgcttacgggtgtcaaaattgtgctaacagaggagaagcacaatgttgacacccaacctggcggcagcgcaaaagatg

SEQ ID NO: 145332 - DNA, 103 bp, Artificial Sequence
  Synthetic Polynucleotide
taatacgactcactatagggaaccagaattgttgttgcttacgggtgtcaaacagaggagatgacacatgtaagcaacaaacctggcggcagcgcaaaagatg

SEQ ID NO: 145333 - DNA, 103 bp, Artificial Sequence
  Synthetic Polynucleotide
taatacgactcactatagggttccggaggaaaccagaattgttgttgcttaacagaggagaaagcaaatgcaattctggaacctggcggcagcgcaaaagatg

SEQ ID NO: 145334 - DNA, 103 bp, Artificial Sequence
  Synthetic Polynucleotide
taatacgactcactatagggattcaagagattccggaggaaaccagaattaacagaggagaaattctatgttcctccggaacctggcggcagcgcaaaagatg

SEQ ID NO: 145335 - DNA, 103 bp, Artificial Sequence
  Synthetic Polynucleotide
taatacgactcactatagggctgtagaagaattcaagagattccggaggaaacagaggagatcctccatgatctcttgaaacctggcggcagcgcaaaagatg

SEQ ID NO: 145336 - DNA, 103 bp, Artificial Sequence
  Synthetic Polynucleotide
taatacgactcactatagggtctgtctttcctgtagaagaattcaagagaaacagaggagatctcttatgttcttctacaacctggcggcagcgcaaaagatg

SEQ ID NO: 145337 - DNA, 103 bp, Artificial Sequence
  Synthetic Polynucleotide
taatacgactcactataggggagtccattttctgtctttcctgtagaagaaacagaggagatcttctatgggaaagacaaacctggcggcagcgcaaaagatg

SEQ ID NO: 145338 - DNA, 103 bp, Artificial Sequence
  Synthetic Polynucleotide
taatacgactcactataggggtgtattcttgagtccattttctgtctttcaacagaggagagaaagaatgaaaatggacaacctggcggcagcgcaaaagatg

SEQ ID NO: 145339 - DNA, 103 bp, Artificial Sequence
  Synthetic Polynucleotide
taatacgactcactataggggctaaaaccaaattatgttctactaaaaataacagaggagaatttttatgagaacataaaacctggcggcagcgcaaaagatg

SEQ ID NO: 145340 - DNA, 103 bp, Artificial Sequence
  Synthetic Polynucleotide
taatacgactcactatagggaggatttttggtgtattcttgagtccatttaacagaggagaaaatggatgcaagaatacaacctggcggcagcgcaaaagatg

SEQ ID NO: 145341 - DNA, 103 bp, Artificial Sequence
  Synthetic Polynucleotide
taatacgactcactataggggatgtcatcaaggatttttggtgtattcttaacagaggagaaagaatatgccaaaaatcaacctggcggcagcgcaaaagatg

SEQ ID NO: 145342 - DNA, 103 bp, Artificial Sequence
  Synthetic Polynucleotide
taatacgactcactatagggaagaggcaaagatgtcatcaaggatttttgaacagaggagacaaaaaatgttgatgacaaacctggcggcagcgcaaaagatg

SEQ ID NO: 145343 - DNA, 103 bp, Artificial Sequence
  Synthetic Polynucleotide
taatacgactcactatagggttttgcaccaaagaggcaaagatgtcatcaaacagaggagatgatgaatgctttgcctcaacctggcggcagcgcaaaagatg

SEQ ID NO: 145344 - DNA, 103 bp, Artificial Sequence
  Synthetic Polynucleotide
taatacgactcactatagggagtcgtcttattttgcaccaaagaggcaaaaacagaggagatttgccatgttggtgcaaaacctggcggcagcgcaaaagatg

SEQ ID NO: 145345 - DNA, 103 bp, Artificial Sequence
  Synthetic Polynucleotide
taatacgactcactatagggataaatcagaagtcgtcttattttgcaccaaacagaggagatggtgcatgataagacgaaacctggcggcagcgcaaaagatg

SEQ ID NO: 145346 - DNA, 103 bp, Artificial Sequence
  Synthetic Polynucleotide
taatacgactcactatagggggcctcttagataaatcagaagtcgtcttaaacagaggagataagacatgttctgatttaacctggcggcagcgcaaaagatg

SEQ ID NO: 145347 - DNA, 103 bp, Artificial Sequence
  Synthetic Polynucleotide
taatacgactcactatagggtagtccttgaggcctcttagataaatcagaaacagaggagatctgatatgtctaagaggaacctggcggcagcgcaaaagatg

SEQ ID NO: 145348 - DNA, 103 bp, Artificial Sequence
  Synthetic Polynucleotide
taatacgactcactataggggcttgatggttagtccttgaggcctcttagaacagaggagactaagaatgctcaaggacaacctggcggcagcgcaaaagatg

SEQ ID NO: 145349 - DNA, 103 bp, Artificial Sequence
  Synthetic Polynucleotide
taatacgactcactatagggagaatgctgggcttgatggttagtccttgaaacagaggagatcaaggatgaaccatcaaaacctggcggcagcgcaaaagatg

SEQ ID NO: 145350 - DNA, 103 bp, Artificial Sequence
  Synthetic Polynucleotide
taatacgactcactatagggctttcgttcagctaaaaccaaattatgttcaacagaggagagaacatatgttggttttaaacctggcggcagcgcaaaagatg

SEQ ID NO: 145351 - DNA, 103 bp, Artificial Sequence
  Synthetic Polynucleotide
taatacgactcactataggggtcaaagcccagaatgctgggcttgatggtaacagaggagaaccatcatgcccagcattaacctggcggcagcgcaaaagatg

SEQ ID NO: 145352 - DNA, 103 bp, Artificial Sequence
  Synthetic Polynucleotide
taatacgactcactatagggagtgaggagtgtcaaagcccagaatgctggaacagaggagaccagcaatgtgggctttgaacctggcggcagcgcaaaagatg

SEQ ID NO: 145353 - DNA, 103 bp, Artificial Sequence
  Synthetic Polynucleotide
taatacgactcactatagggcaaagccaatagtgaggagtgtcaaagcccaacagaggagagggcttatgcactcctcaaacctggcggcagcgcaaaagatg

SEQ ID NO: 145354 - DNA, 103 bp, Artificial Sequence
  Synthetic Polynucleotide
taatacgactcactataggggcgattatcacaaagccaatagtgaggagtaacagaggagaactcctatgtattggcttaacctggcggcagcgcaaaagatg

SEQ ID NO: 145355 - DNA, 103 bp, Artificial Sequence
  Synthetic Polynucleotide
taatacgactcactatagggagcacagcaagcgattatcacaaagccaataacagaggagaattggcatggtgataatcaacctggcggcagcgcaaaagatg

SEQ ID NO: 145356 - DNA, 103 bp, Artificial Sequence
  Synthetic Polynucleotide
taatacgactcactataggggggtcttgcaagcacagcaagcgattatcaaacagaggagatgataaatgcttgctgtgaacctggcggcagcgcaaaagatg

SEQ ID NO: 145357 - DNA, 103 bp, Artificial Sequence
  Synthetic Polynucleotide
taatacgactcactatagggcttattgttggggtcttgcaagcacagcaaaacagaggagattgctgatgttgcaagacaacctggcggcagcgcaaaagatg

SEQ ID NO: 145358 - DNA, 103 bp, Artificial Sequence
  Synthetic Polynucleotide
taatacgactcactatagggtccagttgctcttattgttggggtcttgcaaacagaggagatgcaagatgccaacaataaacctggcggcagcgcaaaagatg

SEQ ID NO: 145359 - DNA, 103 bp, Artificial Sequence
  Synthetic Polynucleotide
taatacgactcactatagggctaaacacattccagttgctcttattgttgaacagaggagacaacaaatggagcaactgaacctggcggcagcgcaaaagatg

SEQ ID NO: 145360 - DNA, 103 bp, Artificial Sequence
  Synthetic Polynucleotide
taatacgactcactatagggccagcactccctaaacacattccagttgctaacagaggagaagcaacatgaatgtgtttaacctggcggcagcgcaaaagatg

SEQ ID NO: 145361 - DNA, 103 bp, Artificial Sequence
  Synthetic Polynucleotide
taatacgactcactatagggtttcaggtgactttcgttcagctaaaaccaaacagaggagatggtttatgctgaacgaaaacctggcggcagcgcaaaagatg

SEQ ID NO: 145362 - DNA, 103 bp, Artificial Sequence
  Synthetic Polynucleotide
taatacgactcactataggggcccttgtttccagcactccctaaacacataacagaggagaatgtgtatggggagtgctaacctggcggcagcgcaaaagatg

SEQ ID NO: 145363 - DNA, 103 bp, Artificial Sequence
  Synthetic Polynucleotide
taatacgactcactatagggatcactggctgcccttgtttccagcactccaacagaggagaggagtgatggaaacaaggaacctggcggcagcgcaaaagatg

SEQ ID NO: 145364 - DNA, 103 bp, Artificial Sequence
  Synthetic Polynucleotide
taatacgactcactatagggtccagacaccatcactggctgcccttgtttaacagaggagaaaacaaatgcagccagtgaacctggcggcagcgcaaaagatg

SEQ ID NO: 145365 - DNA, 103 bp, Artificial Sequence
  Synthetic Polynucleotide
taatacgactcactatagggtatgatgcactccagacaccatcactggctaacagaggagaagccagatgtggtgtctgaacctggcggcagcgcaaaagatg

SEQ ID NO: 145366 - DNA, 103 bp, Artificial Sequence
  Synthetic Polynucleotide
taatacgactcactataggggagttcaatttatgatgcactccagacaccaacagaggagaggtgtcatgagtgcatcaaacctggcggcagcgcaaaagatg

SEQ ID NO: 145367 - DNA, 103 bp, Artificial Sequence
  Synthetic Polynucleotide
taatacgactcactatagggccaaagttcagagttcaatttatgatgcacaacagaggagagtgcatatgaaattgaacaacctggcggcagcgcaaaagatg

SEQ ID NO: 145368 - DNA, 103 bp, Artificial Sequence
  Synthetic Polynucleotide
taatacgactcactatagggattcaggtttccaaagttcagagttcaattaacagaggagaaattgaatgctgaactttaacctggcggcagcgcaaaagatg

SEQ ID NO: 145369 - DNA, 103 bp, Artificial Sequence
  Synthetic Polynucleotide
taatacgactcactatagggttcctgaaggattcaggtttccaaagttcaaacagaggagatgaactatggaaacctgaaacctggcggcagcgcaaaagatg

SEQ ID NO: 145370 - DNA, 103 bp, Artificial Sequence
  Synthetic Polynucleotide
taatacgactcactatagggaccaaactctttcctgaaggattcaggtttaacagaggagaaaacctatgtccttcaggaacctggcggcagcgcaaaagatg

SEQ ID NO: 145371 - DNA, 103 bp, Artificial Sequence
  Synthetic Polynucleotide
taatacgactcactatagggcttcctgctcaccaaactctttcctgaaggaacagaggagaccttcaatgaagagtttgaacctggcggcagcgcaaaagatg

SEQ ID NO: 145372 - DNA, 103 bp, Artificial Sequence
  Synthetic Polynucleotide
taatacgactcactatagggaacctcctccccaccaataccggccaacttaacagaggagaaagttgatgggtattggtaacctggcggcagcgcaaaagatg

SEQ ID NO: 145373 - DNA, 103 bp, Artificial Sequence
  Synthetic Polynucleotide
taatacgactcactatagggcgttcagaaatttcaggtgactttcgttcaaacagaggagatgaacgatggtcacctgaaacctggcggcagcgcaaaagatg

SEQ ID NO: 145374 - DNA, 103 bp, Artificial Sequence
  Synthetic Polynucleotide
taatacgactcactatagggactaggtctacttcctgctcaccaaactctaacagaggagaagagttatgtgagcaggaaacctggcggcagcgcaaaagatg

SEQ ID NO: 145375 - DNA, 103 bp, Artificial Sequence
  Synthetic Polynucleotide
taatacgactcactatagggcctacaattaactaggtctacttcctgctcaacagaggagagagcagatggtagacctaaacctggcggcagcgcaaaagatg

SEQ ID NO: 145376 - DNA, 103 bp, Artificial Sequence
  Synthetic Polynucleotide
taatacgactcactatagggtttcattggtcctacaattaactaggtctaaacagaggagatagaccatgttaattgtaaacctggcggcagcgcaaaagatg

SEQ ID NO: 145377 - DNA, 103 bp, Artificial Sequence
  Synthetic Polynucleotide
taatacgactcactatagggcctgtgatgatttcattggtcctacaattaaacagaggagataattgatggaccaatgaaacctggcggcagcgcaaaagatg

SEQ ID NO: 145378 - DNA, 103 bp, Artificial Sequence
  Synthetic Polynucleotide
taatacgactcactatagggtactgtggctcctgtgatgatttcattggtaacagaggagaaccaatatgatcatcacaaacctggcggcagcgcaaaagatg

SEQ ID NO: 145379 - DNA, 103 bp, Artificial Sequence
  Synthetic Polynucleotide
taatacgactcactatagggagaagtctcctactgtggctcctgtgatgaaacagaggagatcatcaatggagccacagaacctggcggcagcgcaaaagatg

SEQ ID NO: 145380 - DNA, 103 bp, Artificial Sequence
  Synthetic Polynucleotide
taatacgactcactatagggaatccatcccagaagtctcctactgtggctaacagaggagaagccacatgaggagacttaacctggcggcagcgcaaaagatg

SEQ ID NO: 145381 - DNA, 103 bp, Artificial Sequence
  Synthetic Polynucleotide
taatacgactcactatagggaacatcttcaaatccatcccagaagtctccaacagaggagaggagacatgtgggatggaaacctggcggcagcgcaaaagatg

SEQ ID NO: 145382 - DNA, 103 bp, Artificial Sequence
  Synthetic Polynucleotide
taatacgactcactatagggaacgatttggaacatcttcaaatccatcccaacagaggagagggatgatgttgaagatgaacctggcggcagcgcaaaagatg

SEQ ID NO: 145383 - DNA, 103 bp, Artificial Sequence
  Synthetic Polynucleotide
taatacgactcactatagggtcatttttcaaacgatttggaacatcttcaaacagaggagatgaagaatgtccaaatcgaacctggcggcagcgcaaaagatg

SEQ ID NO: 145384 - DNA, 103 bp, Artificial Sequence
  Synthetic Polynucleotide
taatacgactcactatagggctgtacaattcgttcagaaatttcaggtgaaacagaggagatcacctatgatttctgaaaacctggcggcagcgcaaaagatg

SEQ ID NO: 145385 - DNA, 103 bp, Artificial Sequence
  Synthetic Polynucleotide
taatacgactcactatagggtggttctttttcatttttcaaacgatttggaacagaggagaccaaatatgttgaaaaataacctggcggcagcgcaaaagatg

SEQ ID NO: 145386 - DNA, 103 bp, Artificial Sequence
  Synthetic Polynucleotide
taatacgactcactatagggtcaacaccattggttctttttcatttttcaaacagaggagatgaaaaatgaaaaagaacaacctggcggcagcgcaaaagatg

SEQ ID NO: 145387 - DNA, 103 bp, Artificial Sequence
  Synthetic Polynucleotide
taatacgactcactatagggtccttaagtttcaacaccattggttcttttaacagaggagaaaaagaatgaatggtgttaacctggcggcagcgcaaaagatg

SEQ ID NO: 145388 - DNA, 103 bp, Artificial Sequence
  Synthetic Polynucleotide
taatacgactcactatagggtggtggccagtccttaagtttcaacaccataacagaggagaatggtgatgaaacttaagaacctggcggcagcgcaaaagatg

SEQ ID NO: 145389 - DNA, 103 bp, Artificial Sequence
  Synthetic Polynucleotide
taatacgactcactatagggaatcttctcctggtggccagtccttaagttaacagaggagaaacttaatgactggccacaacctggcggcagcgcaaaagatg

SEQ ID NO: 145390 - DNA, 103 bp, Artificial Sequence
  Synthetic Polynucleotide
taatacgactcactatagggatatctctaaaatcttctcctggtggccagaacagaggagactggccatgaggagaagaaacctggcggcagcgcaaaagatg

SEQ ID NO: 145391 - DNA, 103 bp, Artificial Sequence
  Synthetic Polynucleotide
taatacgactcactatagggggaaggcatcatatctctaaaatcttctccaacagaggagaggagaaatgtttagagataacctggcggcagcgcaaaagatg

SEQ ID NO: 145392 - DNA, 103 bp, Artificial Sequence
  Synthetic Polynucleotide
taatacgactcactatagggcatcaaacctggaaggcatcatatctctaaaacagaggagattagagatgtgatgccttaacctggcggcagcgcaaaagatg

SEQ ID NO: 145393 - DNA, 103 bp, Artificial Sequence
  Synthetic Polynucleotide
taatacgactcactataggggccatcagatcatcaaacctggaaggcatcaacagaggagagatgccatgcaggtttgaaacctggcggcagcgcaaaagatg

SEQ ID NO: 145394 - DNA, 103 bp, Artificial Sequence
  Synthetic Polynucleotide
taatacgactcactatagggtggaatgttggccatcagatcatcaaacctaacagaggagaaggtttatggatctgatgaacctggcggcagcgcaaaagatg

SEQ ID NO: 145395 - DNA, 103 bp, Artificial Sequence
  Synthetic Polynucleotide
taatacgactcactatagggttgcaggccactgtacaattcgttcagaaaaacagaggagatttctgatggaattgtacaacctggcggcagcgcaaaagatg

SEQ ID NO: 145396 - DNA, 103 bp, Artificial Sequence
  Synthetic Polynucleotide
taatacgactcactatagggactcgggcagtggaatgttggccatcagataacagaggagaatctgaatgccaacattcaacctggcggcagcgcaaaagatg

SEQ ID NO: 145397 - DNA, 103 bp, Artificial Sequence
  Synthetic Polynucleotide
taatacgactcactatagggcgccttgtgtactcgggcagtggaatgttgaacagaggagacaacatatgactgcccgaaacctggcggcagcgcaaaagatg

SEQ ID NO: 145398 - DNA, 103 bp, Artificial Sequence
  Synthetic Polynucleotide
taatacgactcactatagggtttgccatctcgccttgtgtactcgggcagaacagaggagactgcccatgtacacaaggaacctggcggcagcgcaaaagatg

SEQ ID NO: 145399 - DNA, 103 bp, Artificial Sequence
  Synthetic Polynucleotide
taatacgactcactatagggccaaattcagtttgccatctcgccttgtgtaacagaggagaacacaaatggagatggcaaacctggcggcagcgcaaaagatg

SEQ ID NO: 145400 - DNA, 103 bp, Artificial Sequence
  Synthetic Polynucleotide
taatacgactcactatagggagcctagaggccaaattcagtttgccatctaacagaggagaagatggatgactgaatttaacctggcggcagcgcaaaagatg

SEQ ID NO: 145401 - DNA, 103 bp, Artificial Sequence
  Synthetic Polynucleotide
taatacgactcactataggggtagtttggcagcctagaggccaaattcagaacagaggagactgaatatggcctctaggaacctggcggcagcgcaaaagatg

SEQ ID NO: 145402 - DNA, 103 bp, Artificial Sequence
  Synthetic Polynucleotide
taatacgactcactataggggccgaacaaagtagtttggcagcctagaggaacagaggagacctctaatgtgccaaactaacctggcggcagcgcaaaagatg

SEQ ID NO: 145403 - DNA, 103 bp, Artificial Sequence
  Synthetic Polynucleotide
taatacgactcactatagggcccagatctggccgaacaaagtagtttggcaacagaggagagccaaaatgctttgttcgaacctggcggcagcgcaaaagatg

SEQ ID NO: 145404 - DNA, 103 bp, Artificial Sequence
  Synthetic Polynucleotide
taatacgactcactatagggcatcttggggcccagatctggccgaacaaaaacagaggagatttgttatgccagatctgaacctggcggcagcgcaaaagatg

SEQ ID NO: 145405 - DNA, 103 bp, Artificial Sequence
  Synthetic Polynucleotide
taatacgactcactatagggaagcattatacatcttggggcccagatctgaacagaggagacagatcatggccccaagaaacctggcggcagcgcaaaagatg

SEQ ID NO: 145406 - DNA, 103 bp, Artificial Sequence
  Synthetic Polynucleotide
taatacgactcactatagggttgtacgttattgcaggccactgtacaattaacagaggagaaattgtatggtggcctgcaacctggcggcagcgcaaaagatg

SEQ ID NO: 145407 - DNA, 103 bp, Artificial Sequence
  Synthetic Polynucleotide
taatacgactcactatagggattaatccataagcattatacatcttggggaacagaggagaccccaaatggtataatgcaacctggcggcagcgcaaaagatg

SEQ ID NO: 145408 - DNA, 103 bp, Artificial Sequence
  Synthetic Polynucleotide
taatacgactcactatagggttcaggagtgattaatccataagcattataaacagaggagatataatatgtatggattaaacctggcggcagcgcaaaagatg

SEQ ID NO: 145409 - DNA, 103 bp, Artificial Sequence
  Synthetic Polynucleotide
taatacgactcactatagggatttccgatcttcaggagtgattaatccataacagaggagaatggatatgtcactcctgaacctggcggcagcgcaaaagatg

SEQ ID NO: 145410 - DNA, 103 bp, Artificial Sequence
  Synthetic Polynucleotide
taatacgactcactataggggttgttccatatttccgatcttcaggagtgaacagaggagacactccatgagatcggaaaacctggcggcagcgcaaaagatg

SEQ ID NO: 145411 - DNA, 103 bp, Artificial Sequence
  Synthetic Polynucleotide
taatacgactcactataggggtgaagatttgttgttccatatttccgatcaacagaggagagatcggatgtatggaacaaacctggcggcagcgcaaaagatg

SEQ ID NO: 145412 - DNA, 103 bp, Artificial Sequence
  Synthetic Polynucleotide
taatacgactcactatagggatacatctaagtgaagatttgttgttccataacagaggagaatggaaatgcaaatcttcaacctggcggcagcgcaaaagatg

SEQ ID NO: 145413 - DNA, 103 bp, Artificial Sequence
  Synthetic Polynucleotide
taatacgactcactataggggctgcatcagatacatctaagtgaagatttaacagaggagaaaatctatgcttagatgtaacctggcggcagcgcaaaagatg

SEQ ID NO: 145414 - DNA, 103 bp, Artificial Sequence
  Synthetic Polynucleotide
taatacgactcactatagggcatgacattagctgcatcagatacatctaaaacagaggagattagatatgtctgatgcaaacctggcggcagcgcaaaagatg

SEQ ID NO: 145415 - DNA, 103 bp, Artificial Sequence
  Synthetic Polynucleotide
taatacgactcactatagggccacatagaccatgacattagctgcatcagaacagaggagactgatgatgctaatgtcaaacctggcggcagcgcaaaagatg

SEQ ID NO: 145416 - DNA, 103 bp, Artificial Sequence
  Synthetic Polynucleotide
taatacgactcactatagggttgggaattcccacatagaccatgacattaaacagaggagataatgtatgggtctatgtaacctggcggcagcgcaaaagatg

SEQ ID NO: 145417 - DNA, 103 bp, Artificial Sequence
  Synthetic Polynucleotide
taatacgactcactatagggcaacagaggtttgtacgttattgcaggccaaacagaggagatggcctatgataacgtacaacctggcggcagcgcaaaagatg

SEQ ID NO: 145418 - DNA, 103 bp, Artificial Sequence
  Synthetic Polynucleotide
taatacgactcactatagggacactgtcctttgggaattcccacatagacaacagaggagagtctatatgggaattcccaacctggcggcagcgcaaaagatg

SEQ ID NO: 145419 - DNA, 103 bp, Artificial Sequence
  Synthetic Polynucleotide
taatacgactcactatagggcttcttgctcacactgtcctttgggaattcaacagaggagagaattcatgaaggacagtaacctggcggcagcgcaaaagatg

SEQ ID NO: 145420 - DNA, 103 bp, Artificial Sequence
  Synthetic Polynucleotide
taatacgactcactatagggaggacttcttcttcttgctcacactgtcctaacagaggagaaggacaatgtgagcaagaaacctggcggcagcgcaaaagatg

SEQ ID NO: 145421 - DNA, 103 bp, Artificial Sequence
  Synthetic Polynucleotide
taatacgactcactataggggatggtcttaaggacttcttcttcttgctcaacagaggagagagcaaatggaagaagtcaacctggcggcagcgcaaaagatg

SEQ ID NO: 145422 - DNA, 103 bp, Artificial Sequence
  Synthetic Polynucleotide
taatacgactcactatagggctccatcttggatggtcttaaggacttcttaacagaggagaaagaagatgttaagaccaaacctggcggcagcgcaaaagatg

SEQ ID NO: 145423 - DNA, 103 bp, Artificial Sequence
  Synthetic Polynucleotide
taatacgactcactatagggtcgtcagaatctccatcttggatggtcttaaacagaggagataagacatgccaagatggaacctggcggcagcgcaaaagatg

SEQ ID NO: 145424 - DNA, 103 bp, Artificial Sequence
  Synthetic Polynucleotide
taatacgactcactatagggtattgtgagttcgtcagaatctccatcttgaacagaggagacaagatatggattctgacaacctggcggcagcgcaaaagatg

SEQ ID NO: 145425 - DNA, 103 bp, Artificial Sequence
  Synthetic Polynucleotide
taatacgactcactatagggtaaatcgctttattgtgagttcgtcagaataacagaggagaattctgatgaactcacaaaacctggcggcagcgcaaaagatg

SEQ ID NO: 145426 - DNA, 103 bp, Artificial Sequence
  Synthetic Polynucleotide
taatacgactcactatagggtttccttcaataaatcgctttattgtgagtaacagaggagaactcacatgaaagcgattaacctggcggcagcgcaaaagatg

SEQ ID NO: 145427 - DNA, 103 bp, Artificial Sequence
  Synthetic Polynucleotide
taatacgactcactatagggtggcttctcttttccttcaataaatcgcttaacagaggagaaagcgaatgattgaaggaaacctggcggcagcgcaaaagatg

SEQ ID NO: 145428 - DNA, 103 bp, Artificial Sequence
  Synthetic Polynucleotide
taatacgactcactatagggcagctttgtccaacagaggtttgtacgttaaacagaggagataacgtatgaacctctgtaacctggcggcagcgcaaaagatg

SEQ ID NO: 145429 - DNA, 103 bp, Artificial Sequence
  Synthetic Polynucleotide
taatacgactcactatagggacagtgctcctggcttctcttttccttcaaaacagaggagattgaagatgaagagaagcaacctggcggcagcgcaaaagatg

SEQ ID NO: 145430 - DNA, 103 bp, Artificial Sequence
  Synthetic Polynucleotide
taatacgactcactatagggtatatgtgccacagtgctcctggcttctctaacagaggagaagagaaatgaggagcactaacctggcggcagcgcaaaagatg

SEQ ID NO: 145431 - DNA, 103 bp, Artificial Sequence
  Synthetic Polynucleotide
taatacgactcactatagggctttgcagcatatatgtgccacagtgctccaacagaggagaggagcaatgtggcacataaacctggcggcagcgcaaaagatg

SEQ ID NO: 145432 - DNA, 103 bp, Artificial Sequence
  Synthetic Polynucleotide
taatacgactcactatagggtctccgtgtcctttgcagcatatatgtgccaacagaggagaggcacaatgatgctgcaaaacctggcggcagcgcaaaagatg

SEQ ID NO: 145433 - DNA, 103 bp, Artificial Sequence
  Synthetic Polynucleotide
taatacgactcactatagggtcccttatcttctccgtgtcctttgcagcaaacagaggagatgctgcatgggacacggaaacctggcggcagcgcaaaagatg

SEQ ID NO: 145434 - DNA, 103 bp, Artificial Sequence
  Synthetic Polynucleotide
taatacgactcactatagggtttaagaaattcccttatcttctccgtgtcaacagaggagagacacgatgaagataaggaacctggcggcagcgcaaaagatg

SEQ ID NO: 145435 - DNA, 103 bp, Artificial Sequence
  Synthetic Polynucleotide
taatacgactcactatagggctgatacctttttaagaaattcccttatctaacagaggagaagataaatgaatttcttaaacctggcggcagcgcaaaagatg

SEQ ID NO: 145436 - DNA, 103 bp, Artificial Sequence
  Synthetic Polynucleotide
taatacgactcactatagggccttgctcttctgatacctttttaagaaataacagaggagaatttctatgaaaggtatcaacctggcggcagcgcaaaagatg

SEQ ID NO: 145437 - DNA, 103 bp, Artificial Sequence
  Synthetic Polynucleotide
taatacgactcactataggggttttcttgaccttgctcttctgataccttaacagaggagaaaggtaatggaagagcaaaacctggcggcagcgcaaaagatg

SEQ ID NO: 145438 - DNA, 103 bp, Artificial Sequence
  Synthetic Polynucleotide
taatacgactcactatagggggtctgctgggttttcttgaccttgctcttaacagaggagaaagagcatggtcaagaaaaacctggcggcagcgcaaaagatg

SEQ ID NO: 145439 - DNA, 103 bp, Artificial Sequence
  Synthetic Polynucleotide
taatacgactcactataggggatcccaaaccagctttgtccaacagaggtaacagaggagaacctctatgggacaaagcaacctggcggcagcgcaaaagatg

SEQ ID NO: 145440 - DNA, 103 bp, Artificial Sequence
  Synthetic Polynucleotide
taatacgactcactatagggataggatcgtggtctgctgggttttcttgaaacagaggagatcaagaatgcccagcagaaacctggcggcagcgcaaaagatg

SEQ ID NO: 145441 - DNA, 103 bp, Artificial Sequence
  Synthetic Polynucleotide
taatacgactcactatagggttgatcatgaataggatcgtggtctgctggaacagaggagaccagcaatgcacgatcctaacctggcggcagcgcaaaagatg

SEQ ID NO: 145442 - DNA, 103 bp, Artificial Sequence
  Synthetic Polynucleotide
taatacgactcactatagggaataccagctttgatcatgaataggatcgtaacagaggagaacgatcatgttcatgatcaacctggcggcagcgcaaaagatg

SEQ ID NO: 145443 - DNA, 103 bp, Artificial Sequence
  Synthetic Polynucleotide
taatacgactcactataggggatcggtctaaataccagctttgatcatgaaacagaggagatcatgaatgaagctggtaaacctggcggcagcgcaaaagatg

SEQ ID NO: 145444 - DNA, 103 bp, Artificial Sequence
  Synthetic Polynucleotide
taatacgactcactatagggttttcttaatgatcggtctaaataccagctaacagaggagaagctggatgttagaccgaaacctggcggcagcgcaaaagatg

SEQ ID NO: 145445 - DNA, 103 bp, Artificial Sequence
  Synthetic Polynucleotide
taatacgactcactataggggatgaagacgttttcttaatgatcggtctaaacagaggagatagaccatgcattaagaaaacctggcggcagcgcaaaagatg

SEQ ID NO: 145446 - DNA, 103 bp, Artificial Sequence
  Synthetic Polynucleotide
taatacgactcactatagggccatactcttgatgaagacgttttcttaataacagaggagaattaagatgacgtcttcaaacctggcggcagcgcaaaagatg

SEQ ID NO: 145447 - DNA, 103 bp, Artificial Sequence
  Synthetic Polynucleotide
taatacgactcactataggggccttgaactccatactcttgatgaagacgaacagaggagacgtcttatgcaagagtataacctggcggcagcgcaaaagatg

SEQ ID NO: 145448 - DNA, 103 bp, Artificial Sequence
  Synthetic Polynucleotide
taatacgactcactatagggcaatagcccagccttgaactccatactcttaacagaggagaaagagtatggagttcaagaacctggcggcagcgcaaaagatg

SEQ ID NO: 145449 - DNA, 103 bp, Artificial Sequence
  Synthetic Polynucleotide
taatacgactcactatagggagaaactgtacaatagcccagccttgaactaacagaggagaagttcaatgctgggctataacctggcggcagcgcaaaagatg

SEQ ID NO: 145450 - DNA, 103 bp, Artificial Sequence
  Synthetic Polynucleotide
taatacgactcactatagggagaagttatggatcccaaaccagctttgtcaacagaggagagacaaaatgggtttgggaaacctggcggcagcgcaaaagatg

SEQ ID NO: 145451 - DNA, 103 bp, Artificial Sequence
  Synthetic Polynucleotide
taatacgactcactatagggcacatccccaagaaactgtacaatagcccaaacagaggagatgggctatggtacagtttaacctggcggcagcgcaaaagatg

SEQ ID NO: 145452 - DNA, 103 bp, Artificial Sequence
  Synthetic Polynucleotide
taatacgactcactatagggggataaacaccacatccccaagaaactgtaaacagaggagatacagtatgttggggatgaacctggcggcagcgcaaaagatg

SEQ ID NO: 145453 - DNA, 103 bp, Artificial Sequence
  Synthetic Polynucleotide
taatacgactcactataggggctcctgccgggataaacaccacatccccaaacagaggagatggggaatgggtgtttataacctggcggcagcgcaaaagatg

SEQ ID NO: 145454 - DNA, 103 bp, Artificial Sequence
  Synthetic Polynucleotide
taatacgactcactatagggctgatgtggagctcctgccgggataaacacaacagaggagagtgtttatgccggcaggaaacctggcggcagcgcaaaagatg

SEQ ID NO: 145455 - DNA, 103 bp, Artificial Sequence
  Synthetic Polynucleotide
taatacgactcactatagggagttatgaacctgatgtggagctcctgccgaacagaggagacggcagatgctccacatcaacctggcggcagcgcaaaagatg

SEQ ID NO: 145456 - DNA, 103 bp, Artificial Sequence
  Synthetic Polynucleotide
taatacgactcactatagggcagctatataagttatgaacctgatgtggaaacagaggagatccacaatgggttcataaaacctggcggcagcgcaaaagatg

SEQ ID NO: 145457 - DNA, 103 bp, Artificial Sequence
  Synthetic Polynucleotide
taatacgactcactatagggcactttgatgcagctatataagttatgaacaacagaggagagttcatatgttatatagcaacctggcggcagcgcaaaagatg

SEQ ID NO: 145458 - DNA, 103 bp, Artificial Sequence
  Synthetic Polynucleotide
taatacgactcactatagggaatcttcagccactttgatgcagctatataaacagaggagatatataatggcatcaaagaacctggcggcagcgcaaaagatg

SEQ ID NO: 145459 - DNA, 103 bp, Artificial Sequence
  Synthetic Polynucleotide
taatacgactcactatagggggagaaacaaaatcttcagccactttgatgaacagaggagacatcaaatgggctgaagaaacctggcggcagcgcaaaagatg

SEQ ID NO: 145460 - DNA, 103 bp, Artificial Sequence
  Synthetic Polynucleotide
taatacgactcactatagggaacatgctctggagaaacaaaatcttcagcaacagaggagagctgaaatgtttgtttctaacctggcggcagcgcaaaagatg

SEQ ID NO: 145461 - DNA, 103 bp, Artificial Sequence
  Synthetic Polynucleotide
taatacgactcactataggggaaagcgaacagaagttatggatcccaaacaacagaggagagtttggatgccataacttaacctggcggcagcgcaaaagatg

SEQ ID NO: 145462 - DNA, 103 bp, Artificial Sequence
  Synthetic Polynucleotide
taatacgactcactatagggagcagtgtttaacatgctctggagaaacaaaacagaggagattgtttatgcagagcatgaacctggcggcagcgcaaaagatg

SEQ ID NO: 145463 - DNA, 103 bp, Artificial Sequence
  Synthetic Polynucleotide
taatacgactcactataggggtaagccagaagcagtgtttaacatgctctaacagaggagaagagcaatgtaaacactgaacctggcggcagcgcaaaagatg

SEQ ID NO: 145464 - DNA, 103 bp, Artificial Sequence
  Synthetic Polynucleotide
taatacgactcactataggggaattcctgagtaagccagaagcagtgtttaacagaggagaaaacacatgttctggcttaacctggcggcagcgcaaaagatg

SEQ ID NO: 145465 - DNA, 103 bp, Artificial Sequence
  Synthetic Polynucleotide
taatacgactcactatagggacagatatcggaattcctgagtaagccagaaacagaggagatctggcatgctcaggaataacctggcggcagcgcaaaagatg

SEQ ID NO: 145466 - DNA, 103 bp, Artificial Sequence
  Synthetic Polynucleotide
taatacgactcactatagggtgagtctgtgacagatatcggaattcctgaaacagaggagatcaggaatgccgatatctaacctggcggcagcgcaaaagatg

SEQ ID NO: 145467 - DNA, 103 bp, Artificial Sequence
  Synthetic Polynucleotide
taatacgactcactataggggtgattggtatgagtctgtgacagatatcgaacagaggagacgatatatgtcacagactaacctggcggcagcgcaaaagatg

SEQ ID NO: 145468 - DNA, 103 bp, Artificial Sequence
  Synthetic Polynucleotide
taatacgactcactatagggatttatcttcgtgattggtatgagtctgtgaacagaggagacacagaatgataccaatcaacctggcggcagcgcaaaagatg

SEQ ID NO: 145469 - DNA, 103 bp, Artificial Sequence
  Synthetic Polynucleotide
taatacgactcactatagggttcacctgtaatttatcttcgtgattggtaaacagaggagataccaaatgcgaagataaaacctggcggcagcgcaaaagatg

SEQ ID NO: 145470 - DNA, 103 bp, Artificial Sequence
  Synthetic Polynucleotide
taatacgactcactataggggataacattcttcacctgtaatttatcttcaacagaggagagaagatatgttacaggtgaacctggcggcagcgcaaaagatg

SEQ ID NO: 145471 - DNA, 103 bp, Artificial Sequence
  Synthetic Polynucleotide
taatacgactcactatagggctgcatggtagataacattcttcacctgtaaacagaggagatacaggatgagaatgttaaacctggcggcagcgcaaaagatg

SEQ ID NO: 145472 - DNA, 103 bp, Artificial Sequence
  Synthetic Polynucleotide
taatacgactcactatagggtgatctcccagaaagcgaacagaagttatgaacagaggagacataacatgtgttcgcttaacctggcggcagcgcaaaagatg

SEQ ID NO: 145473 - DNA, 103 bp, Artificial Sequence
  Synthetic Polynucleotide
taatacgactcactataggggcatctttcactgcatggtagataacattcaacagaggagagaatgtatgctaccatgcaacctggcggcagcgcaaaagatg

SEQ ID NO: 145474 - DNA, 103 bp, Artificial Sequence
  Synthetic Polynucleotide
taatacgactcactatagggcatagcaactgcatctttcactgcatggtaaacagaggagataccatatggtgaaagataacctggcggcagcgcaaaagatg

SEQ ID NO: 145475 - DNA, 103 bp, Artificial Sequence
  Synthetic Polynucleotide
taatacgactcactatagggtggctttcagcatagcaactgcatctttcaaacagaggagatgaaagatgcagttgctaaacctggcggcagcgcaaaagatg

SEQ ID NO: 145476 - DNA, 103 bp, Artificial Sequence
  Synthetic Polynucleotide
taatacgactcactatagggctggattcactggctttcagcatagcaactaacagaggagaagttgcatggctgaaagcaacctggcggcagcgcaaaagatg

SEQ ID NO: 145477 - DNA, 103 bp, Artificial Sequence
  Synthetic Polynucleotide
taatacgactcactatagggtttgccaaaactggattcactggctttcagaacagaggagactgaaaatgagtgaatccaacctggcggcagcgcaaaagatg

SEQ ID NO: 145478 - DNA, 103 bp, Artificial Sequence
  Synthetic Polynucleotide
taatacgactcactatagggcagactgagaaacctcctccccaccaatacaacagaggagagtattgatggggaggaggaacctggcggcagcgcaaaagatg

SEQ ID NO: 145479 - DNA, 103 bp, Artificial Sequence
  Synthetic Polynucleotide
taatacgactcactatagggtactctttgttgatctcccagaaagcgaacaacagaggagagttcgcatgctgggagataacctggcggcagcgcaaaagatg

SEQ ID NO: 145480 - DNA, 103 bp, Artificial Sequence
  Synthetic Polynucleotide
taatacgactcactatagggtagaaagaaatactctttgttgatctcccaaacagaggagatgggagatgaacaaagagaacctggcggcagcgcaaaagatg

SEQ ID NO: 145481 - DNA, 103 bp, Artificial Sequence
  Synthetic Polynucleotide
taatacgactcactatagggaaaaggtctttagaaagaaatactctttgtaacagaggagaacaaagatgatttctttcaacctggcggcagcgcaaaagatg

SEQ ID NO: 145482 - DNA, 103 bp, Artificial Sequence
  Synthetic Polynucleotide
taatacgactcactatagggtataggcttcaaaaggtctttagaaagaaaaacagaggagatttcttatgaaagaccttaacctggcggcagcgcaaaagatg

SEQ ID NO: 145483 - DNA, 103 bp, Artificial Sequence
  Synthetic Polynucleotide
taatacgactcactatagggttacatcctgtataggcttcaaaaggtcttaacagaggagaaagaccatgtgaagcctaaacctggcggcagcgcaaaagatg

SEQ ID NO: 145484 - DNA, 103 bp, Artificial Sequence
  Synthetic Polynucleotide
taatacgactcactatagggcgaagactgtttacatcctgtataggcttcaacagaggagagaagccatgacaggatgtaacctggcggcagcgcaaaagatg

SEQ ID NO: 145485 - DNA, 103 bp, Artificial Sequence
  Synthetic Polynucleotide
taatacgactcactatagggaagagaaagtcgaagactgtttacatcctgaacagaggagacaggatatgaacagtcttaacctggcggcagcgcaaaagatg

SEQ ID NO: 145486 - DNA, 103 bp, Artificial Sequence
  Synthetic Polynucleotide
taatacgactcactataggggattatccgtaagagaaagtcgaagactgtaacagaggagaacagtcatggactttctcaacctggcggcagcgcaaaagatg

SEQ ID NO: 145487 - DNA, 103 bp, Artificial Sequence
  Synthetic Polynucleotide
taatacgactcactatagggctgacaatctgattatccgtaagagaaagtaacagaggagaactttcatgtacggataaaacctggcggcagcgcaaaagatg

SEQ ID NO: 145488 - DNA, 103 bp, Artificial Sequence
  Synthetic Polynucleotide
taatacgactcactatagggaaattctttactgacaatctgattatccgtaacagaggagaacggatatgcagattgtcaacctggcggcagcgcaaaagatg

SEQ ID NO: 145489 - DNA, 103 bp, Artificial Sequence
  Synthetic Polynucleotide
taatacgactcactatagggcggctgcggacagactgagaaacctcctccaacagaggagaggaggaatgttctcagtcaacctggcggcagcgcaaaagatg

SEQ ID NO: 145490 - DNA, 103 bp, Artificial Sequence
  Synthetic Polynucleotide
taatacgactcactatagggtcaaagcttgaaattctttactgacaatctaacagaggagaagattgatggtaaagaataacctggcggcagcgcaaaagatg

SEQ ID NO: 145491 - DNA, 103 bp, Artificial Sequence
  Synthetic Polynucleotide
taatacgactcactatagggtgcttcacaatcaaagcttgaaattctttaaacagaggagataaagaatgtcaagctttaacctggcggcagcgcaaaagatg

SEQ ID NO: 145492 - DNA, 103 bp, Artificial Sequence
  Synthetic Polynucleotide
taatacgactcactatagggttcatctaaatgcttcacaatcaaagcttgaacagaggagacaagctatgattgtgaagaacctggcggcagcgcaaaagatg

SEQ ID NO: 145493 - DNA, 103 bp, Artificial Sequence
  Synthetic Polynucleotide
taatacgactcactatagggaaagatggctttcatctaaatgcttcacaaaacagaggagattgtgaatgatttagatgaacctggcggcagcgcaaaagatg

SEQ ID NO: 145494 - DNA, 103 bp, Artificial Sequence
  Synthetic Polynucleotide
taatacgactcactatagggtcaccttttaaaagatggctttcatctaaaaacagaggagatttagaatgaagccatctaacctggcggcagcgcaaaagatg

SEQ ID NO: 145495 - DNA, 103 bp, Artificial Sequence
  Synthetic Polynucleotide
taatacgactcactatagggtaagtttttgtcaccttttaaaagatggctaacagaggagaagccatatgttaaaaggtaacctggcggcagcgcaaaagatg

SEQ ID NO: 145496 - DNA, 103 bp, Artificial Sequence
  Synthetic Polynucleotide
taatacgactcactatagggctgaaccaactaagtttttgtcaccttttaaacagaggagataaaagatgacaaaaactaacctggcggcagcgcaaaagatg

SEQ ID NO: 145497 - DNA, 103 bp, Artificial Sequence
  Synthetic Polynucleotide
taatacgactcactatagggatttttacttctgaaccaactaagtttttgaacagaggagacaaaaaatgagttggttcaacctggcggcagcgcaaaagatg

SEQ ID NO: 145498 - DNA, 103 bp, Artificial Sequence
  Synthetic Polynucleotide
taatacgactcactatagggcaagctataaatttttacttctgaaccaacaacagaggagagttggtatggaagtaaaaaacctggcggcagcgcaaaagatg

SEQ ID NO: 145499 - DNA, 103 bp, Artificial Sequence
  Synthetic Polynucleotide
taatacgactcactatagggtagatgggtccaagctataaatttttacttaacagaggagaaagtaaatgtttatagctaacctggcggcagcgcaaaagatg

SEQ ID NO: 145500 - DNA, 103 bp, Artificial Sequence
  Synthetic Polynucleotide
taatacgactcactatagggtcgctgccgtcggctgcggacagactgagaaacagaggagatctcagatggtccgcagcaacctggcggcagcgcaaaagatg

SEQ ID NO: 145501 - DNA, 103 bp, Artificial Sequence
  Synthetic Polynucleotide
taatacgactcactatagggaaccactgagtagatgggtccaagctataaaacagaggagattatagatgggacccatcaacctggcggcagcgcaaaagatg

SEQ ID NO: 145502 - DNA, 103 bp, Artificial Sequence
  Synthetic Polynucleotide
taatacgactcactatagggggttgctgaaaaccactgagtagatgggtcaacagaggagagacccaatgactcagtggaacctggcggcagcgcaaaagatg

SEQ ID NO: 145503 - DNA, 103 bp, Artificial Sequence
  Synthetic Polynucleotide
taatacgactcactatagggcatttataacggttgctgaaaaccactgagaacagaggagactcagtatgtttcagcaaaacctggcggcagcgcaaaagatg

SEQ ID NO: 145504 - DNA, 103 bp, Artificial Sequence
  Synthetic Polynucleotide
taatacgactcactataggggctgggtttccatttataacggttgctgaaaacagaggagattcagcatgcgttataaaaacctggcggcagcgcaaaagatg

SEQ ID NO: 145505 - DNA, 103 bp, Artificial Sequence
  Synthetic Polynucleotide
taatacgactcactatagggagtttttgatgctgggtttccatttataacaacagaggagagttataatgggaaacccaaacctggcggcagcgcaaaagatg

SEQ ID NO: 145506 - DNA, 103 bp, Artificial Sequence
  Synthetic Polynucleotide
taatacgactcactatagggtgacttgaagagtttttgatgctgggtttcaacagaggagagaaaccatgcatcaaaaaaacctggcggcagcgcaaaagatg

SEQ ID NO: 145507 - DNA, 103 bp, Artificial Sequence
  Synthetic Polynucleotide
taatacgactcactatagggtcctcacagttgacttgaagagtttttgataacagaggagaatcaaaatgtcttcaagtaacctggcggcagcgcaaaagatg

SEQ ID NO: 145508 - DNA, 103 bp, Artificial Sequence
  Synthetic Polynucleotide
taatacgactcactatagggtgctggaatctcctcacagttgacttgaagaacagaggagacttcaaatgaactgtgagaacctggcggcagcgcaaaagatg

SEQ ID NO: 145509 - DNA, 103 bp, Artificial Sequence
  Synthetic Polynucleotide
taatacgactcactatagggcaattttcagtgctggaatctcctcacagtaacagaggagaactgtgatgagattccagaacctggcggcagcgcaaaagatg

SEQ ID NO: 145510 - DNA, 103 bp, Artificial Sequence
  Synthetic Polynucleotide
taatacgactcactataggggacggatcaacaattttcagtgctggaatcaacagaggagagattccatgactgaaaataacctggcggcagcgcaaaagatg

SEQ ID NO: 145511 - DNA, 103 bp, Artificial Sequence
  Synthetic Polynucleotide
taatacgactcactataggggtggctgccatcgctgccgtcggctgcggaaacagaggagatccgcaatggacggcagcaacctggcggcagcgcaaaagatg

SEQ ID NO: 145512 - DNA, 103 bp, Artificial Sequence
  Synthetic Polynucleotide
taatacgactcactatagggatgaatcagtgacggatcaacaattttcagaacagaggagactgaaaatggttgatccgaacctggcggcagcgcaaaagatg

SEQ ID NO: 145513 - DNA, 103 bp, Artificial Sequence
  Synthetic Polynucleotide
taatacgactcactatagggcaacttcaacatgaatcagtgacggatcaaaacagaggagattgatcatgcactgattcaacctggcggcagcgcaaaagatg

SEQ ID NO: 145514 - DNA, 103 bp, Artificial Sequence
  Synthetic Polynucleotide
taatacgactcactatagggttatcgtgtacaacttcaacatgaatcagtaacagaggagaactgatatgtgttgaagtaacctggcggcagcgcaaaagatg

SEQ ID NO: 145515 - DNA, 103 bp, Artificial Sequence
  Synthetic Polynucleotide
taatacgactcactatagggtgtcacaaggttatcgtgtacaacttcaacaacagaggagagttgaaatggtacacgataacctggcggcagcgcaaaagatg

SEQ ID NO: 145516 - DNA, 103 bp, Artificial Sequence
  Synthetic Polynucleotide
taatacgactcactatagggaattaccacatgtcacaaggttatcgtgtaaacagaggagatacacgatgaccttgtgaaacctggcggcagcgcaaaagatg

SEQ ID NO: 145517 - DNA, 103 bp, Artificial Sequence
  Synthetic Polynucleotide
taatacgactcactatagggattcttgcagaattaccacatgtcacaaggaacagaggagaccttgtatgatgtggtaaaacctggcggcagcgcaaaagatg

SEQ ID NO: 145518 - DNA, 103 bp, Artificial Sequence
  Synthetic Polynucleotide
taatacgactcactatagggtacagctccaattcttgcagaattaccacaaacagaggagatgtggtatgtctgcaagaaacctggcggcagcgcaaaagatg

SEQ ID NO: 145519 - DNA, 103 bp, Artificial Sequence
  Synthetic Polynucleotide
taatacgactcactatagggacttgcgttttacagctccaattcttgcagaacagaggagactgcaaatgttggagctgaacctggcggcagcgcaaaagatg

SEQ ID NO: 145520 - DNA, 103 bp, Artificial Sequence
  Synthetic Polynucleotide
taatacgactcactatagggttctcagaagacttgcgttttacagctccaaacagaggagatggagcatgaaaacgcaaaacctggcggcagcgcaaaagatg

SEQ ID NO: 145521 - DNA, 103 bp, Artificial Sequence
  Synthetic Polynucleotide
taatacgactcactatagggggttccattattctcagaagacttgcgtttaacagaggagaaaacgcatgtcttctgagaacctggcggcagcgcaaaagatg

SEQ ID NO: 145522 - DNA, 103 bp, Artificial Sequence
  Synthetic Polynucleotide
taatacgactcactatagggcccagctgtcgtggctgccatcgctgccgtaacagaggagaacggcaatgatggcagccaacctggcggcagcgcaaaagatg

SEQ ID NO: 145523 - DNA, 103 bp, Artificial Sequence
  Synthetic Polynucleotide
taatacgactcactatagggtggaaaccagggttccattattctcagaagaacagaggagacttctgatgataatggaaaacctggcggcagcgcaaaagatg

SEQ ID NO: 145524 - DNA, 103 bp, Artificial Sequence
  Synthetic Polynucleotide
taatacgactcactatagggtttgcttgtttggaaaccagggttccattaaacagaggagataatggatgcctggtttcaacctggcggcagcgcaaaagatg

SEQ ID NO: 145525 - DNA, 103 bp, Artificial Sequence
  Synthetic Polynucleotide
taatacgactcactatagggagagcaagattttgcttgtttggaaaccagaacagaggagactggttatgaaacaagcaaacctggcggcagcgcaaaagatg

SEQ ID NO: 145526 - DNA, 103 bp, Artificial Sequence
  Synthetic Polynucleotide
taatacgactcactataggggagaggcctcagagcaagattttgcttgttaacagaggagaaacaagatgaatcttgctaacctggcggcagcgcaaaagatg

SEQ ID NO: 145527 - DNA, 103 bp, Artificial Sequence
  Synthetic Polynucleotide
taatacgactcactatagggcacatactgggagaggcctcagagcaagataacagaggagaatcttgatgtgaggcctcaacctggcggcagcgcaaaagatg

SEQ ID NO: 145528 - DNA, 103 bp, Artificial Sequence
  Synthetic Polynucleotide
taatacgactcactatagggctgcacaggacacatactgggagaggcctcaacagaggagagaggccatgcccagtatgaacctggcggcagcgcaaaagatg

SEQ ID NO: 145529 - DNA, 103 bp, Artificial Sequence
  Synthetic Polynucleotide
taatacgactcactatagggtaggtacagactgcacaggacacatactggaacagaggagaccagtaatggtcctgtgcaacctggcggcagcgcaaaagatg

SEQ ID NO: 145530 - DNA, 103 bp, Artificial Sequence
  Synthetic Polynucleotide
taatacgactcactatagggaaaactgttgtaggtacagactgcacaggaaacagaggagatcctgtatggtctgtaccaacctggcggcagcgcaaaagatg

SEQ ID NO: 145531 - DNA, 103 bp, Artificial Sequence
  Synthetic Polynucleotide
taatacgactcactatagggtatctccttaaaaactgttgtaggtacagaaacagaggagatctgtaatgacaacagttaacctggcggcagcgcaaaagatg

SEQ ID NO: 145532 - DNA, 103 bp, Artificial Sequence
  Synthetic Polynucleotide
taatacgactcactatagggagccaagcagtatctccttaaaaactgttgaacagaggagacaacagatgttaaggagaaacctggcggcagcgcaaaagatg

SEQ ID NO: 145533 - DNA, 103 bp, Artificial Sequence
  Synthetic Polynucleotide
taatacgactcactatagggcgctccacgtcccagctgtcgtggctgccaaacagaggagatggcagatgcgacagctgaacctggcggcagcgcaaaagatg

SEQ ID NO: 145534 - DNA, 103 bp, Artificial Sequence
  Synthetic Polynucleotide
taatacgactcactataggggccgcagtacagccaagcagtatctccttaaacagaggagataaggaatgactgcttggaacctggcggcagcgcaaaagatg

SEQ ID NO: 145535 - DNA, 103 bp, Artificial Sequence
  Synthetic Polynucleotide
taatacgactcactatagggaggtggagttgccgcagtacagccaagcagaacagaggagactgcttatgtgtactgcgaacctggcggcagcgcaaaagatg

SEQ ID NO: 145536 - DNA, 103 bp, Artificial Sequence
  Synthetic Polynucleotide
taatacgactcactatagggggtccttactaggtggagttgccgcagtacaacagaggagagtactgatgcaactccacaacctggcggcagcgcaaaagatg

SEQ ID NO: 145537 - DNA, 103 bp, Artificial Sequence
  Synthetic Polynucleotide
taatacgactcactatagggtgctgtcttgggtccttactaggtggagttaacagaggagaaactccatgtagtaaggaaacctggcggcagcgcaaaagatg

SEQ ID NO: 145538 - DNA, 103 bp, Artificial Sequence
  Synthetic Polynucleotide
taatacgactcactataggggggagtactttgctgtcttgggtccttactaacagaggagaagtaagatgccaagacagaacctggcggcagcgcaaaagatg

SEQ ID NO: 145539 - DNA, 103 bp, Artificial Sequence
  Synthetic Polynucleotide
taatacgactcactatagggtggcagcctggggagtactttgctgtcttgaacagaggagacaagacatgaaagtactcaacctggcggcagcgcaaaagatg

SEQ ID NO: 145540 - DNA, 103 bp, Artificial Sequence
  Synthetic Polynucleotide
taatacgactcactatagggggtggagagttggcagcctggggagtacttaacagaggagaaagtacatgccaggctgcaacctggcggcagcgcaaaagatg

SEQ ID NO: 145541 - DNA, 103 bp, Artificial Sequence
  Synthetic Polynucleotide
taatacgactcactatagggtccaaggttaggtggagagttggcagcctgaacagaggagacaggctatgaactctccaaacctggcggcagcgcaaaagatg

SEQ ID NO: 145542 - DNA, 103 bp, Artificial Sequence
  Synthetic Polynucleotide
taatacgactcactataggggaatttttgctccaaggttaggtggagagtaacagaggagaactctcatgctaaccttgaacctggcggcagcgcaaaagatg

SEQ ID NO: 145543 - DNA, 103 bp, Artificial Sequence
  Synthetic Polynucleotide
taatacgactcactatagggcatccttgaggaatttttgctccaaggttaaacagaggagataacctatgagcaaaaataacctggcggcagcgcaaaagatg

SEQ ID NO: 145544 - DNA, 103 bp, Artificial Sequence
  Synthetic Polynucleotide
taatacgactcactataggggcccaccggggaggccgccgcgtccgccataacagaggagaatggcgatggcggcggccaacctggcggcagcgcaaaagatg

SEQ ID NO: 145545 - DNA, 103 bp, Artificial Sequence
  Synthetic Polynucleotide
taatacgactcactatagggaggccccggatctccgctcgccgctgccgcaacagaggagagcggcaatggcgagcggaaacctggcggcagcgcaaaagatg

SEQ ID NO: 145546 - DNA, 103 bp, Artificial Sequence
  Synthetic Polynucleotide
taatacgactcactatagggcttggctctctgatccagccctggctctccaacagaggagaggagagatggggctggataacctggcggcagcgcaaaagatg

SEQ ID NO: 145547 - DNA, 103 bp, Artificial Sequence
  Synthetic Polynucleotide
taatacgactcactatagggacggtggctgcttggctctctgatccagccaacagaggagaggctggatgagagagccaaacctggcggcagcgcaaaagatg

SEQ ID NO: 145548 - DNA, 103 bp, Artificial Sequence
  Synthetic Polynucleotide
taatacgactcactatagggacaaatgtagacggtggctgcttggctctcaacagaggagagagagcatggcagccaccaacctggcggcagcgcaaaagatg

SEQ ID NO: 145549 - DNA, 103 bp, Artificial Sequence
  Synthetic Polynucleotide
taatacgactcactatagggtatctgggggacaaatgtagacggtggctgaacagaggagacagccaatgtctacatttaacctggcggcagcgcaaaagatg

SEQ ID NO: 145550 - DNA, 103 bp, Artificial Sequence
  Synthetic Polynucleotide
taatacgactcactatagggtgttgcggtttatctgggggacaaatgtagaacagaggagactacatatgtcccccagaaacctggcggcagcgcaaaagatg

SEQ ID NO: 145551 - DNA, 103 bp, Artificial Sequence
  Synthetic Polynucleotide
taatacgactcactataggggcaaagcgaatgttgcggtttatctgggggaacagaggagacccccaatgaaaccgcaaaacctggcggcagcgcaaaagatg

SEQ ID NO: 145552 - DNA, 103 bp, Artificial Sequence
  Synthetic Polynucleotide
taatacgactcactatagggggtgtaagtggcaaagcgaatgttgcggttaacagaggagaaaccgcatgattcgctttaacctggcggcagcgcaaaagatg

SEQ ID NO: 145553 - DNA, 103 bp, Artificial Sequence
  Synthetic Polynucleotide
taatacgactcactatagggcgttttctttggtgtaagtggcaaagcgaaaacagaggagattcgctatgccacttacaaacctggcggcagcgcaaaagatg

SEQ ID NO: 145554 - DNA, 103 bp, Artificial Sequence
  Synthetic Polynucleotide
taatacgactcactatagggagagtcctgccgttttctttggtgtaagtgaacagaggagacacttaatgcaaagaaaaaacctggcggcagcgcaaaagatg

SEQ ID NO: 145555 - DNA, 103 bp, Artificial Sequence
  Synthetic Polynucleotide
taatacgactcactatagggctgcaccaccagagtcctgccgttttctttaacagaggagaaaagaaatgggcaggactaacctggcggcagcgcaaaagatg

SEQ ID NO: 145556 - DNA, 103 bp, Artificial Sequence
  Synthetic Polynucleotide
taatacgactcactatagggtgcgcagcgcaggccccggatctccgctcgaacagaggagacgagcgatgatccggggcaacctggcggcagcgcaaaagatg

SEQ ID NO: 145557 - DNA, 103 bp, Artificial Sequence
  Synthetic Polynucleotide
taatacgactcactatagggcaggctcatcctgcaccaccagagtcctgcaacagaggagagcaggaatgtggtggtgcaacctggcggcagcgcaaaagatg

SEQ ID NO: 145558 - DNA, 103 bp, Artificial Sequence
  Synthetic Polynucleotide
taatacgactcactatagggtccccacctacaggctcatcctgcaccaccaacagaggagaggtggtatgggatgagccaacctggcggcagcgcaaaagatg

SEQ ID NO: 145559 - DNA, 103 bp, Artificial Sequence
  Synthetic Polynucleotide
taatacgactcactatagggtgcaggtgtgtccccacctacaggctcatcaacagaggagagatgagatggtaggtgggaacctggcggcagcgcaaaagatg

SEQ ID NO: 145560 - DNA, 103 bp, Artificial Sequence
  Synthetic Polynucleotide
taatacgactcactataggggagtgaaagatgcaggtgtgtccccacctaaacagaggagataggtgatgacacacctgaacctggcggcagcgcaaaagatg

SEQ ID NO: 145561 - DNA, 103 bp, Artificial Sequence
  Synthetic Polynucleotide
taatacgactcactataggggtagaatatggagtgaaagatgcaggtgtgaacagaggagacacaccatgatctttcacaacctggcggcagcgcaaaagatg

SEQ ID NO: 145562 - DNA, 103 bp, Artificial Sequence
  Synthetic Polynucleotide
taatacgactcactatagggacctgtggctgtagaatatggagtgaaagaaacagaggagatctttcatgccatattctaacctggcggcagcgcaaaagatg

SEQ ID NO: 145563 - DNA, 103 bp, Artificial Sequence
  Synthetic Polynucleotide
taatacgactcactatagggaaggtgtctgacctgtggctgtagaatatgaacagaggagacatattatgcagccacagaacctggcggcagcgcaaaagatg

SEQ ID NO: 145564 - DNA, 103 bp, Artificial Sequence
  Synthetic Polynucleotide
taatacgactcactatagggtctggggccaaaggtgtctgacctgtggctaacagaggagaagccacatgtcagacaccaacctggcggcagcgcaaaagatg

SEQ ID NO: 145565 - DNA, 103 bp, Artificial Sequence
  Synthetic Polynucleotide
taatacgactcactatagggtccacccacctctggggccaaaggtgtctgaacagaggagacagacaatgttggccccaaacctggcggcagcgcaaaagatg

SEQ ID NO: 145566 - DNA, 103 bp, Artificial Sequence
  Synthetic Polynucleotide
taatacgactcactatagggtgttttcggctccacccacctctggggccaaacagaggagatggcccatgaggtgggtgaacctggcggcagcgcaaaagatg

SEQ ID NO: 145567 - DNA, 103 bp, Artificial Sequence
  Synthetic Polynucleotide
taatacgactcactatagggcaggctcgagtgcgcagcgcaggccccggaaacagaggagatccgggatgtgcgctgcgaacctggcggcagcgcaaaagatg

SEQ ID NO: 145568 - DNA, 103 bp, Artificial Sequence
  Synthetic Polynucleotide
taatacgactcactatagggcctgcctctttgttttcggctccacccaccaacagaggagaggtgggatgagccgaaaaaacctggcggcagcgcaaaagatg

SEQ ID NO: 145569 - DNA, 103 bp, Artificial Sequence
  Synthetic Polynucleotide
taatacgactcactatagggcagtgtttttcctgcctctttgttttcggcaacagaggagagccgaaatgaaagaggcaaacctggcggcagcgcaaaagatg

SEQ ID NO: 145570 - DNA, 103 bp, Artificial Sequence
  Synthetic Polynucleotide
taatacgactcactatagggcaacttgttccagtgtttttcctgcctcttaacagaggagaaagaggatggaaaaacacaacctggcggcagcgcaaaagatg

SEQ ID NO: 145571 - DNA, 103 bp, Artificial Sequence
  Synthetic Polynucleotide
taatacgactcactatagggatgccctggccaacttgttccagtgtttttaacagaggagaaaaaacatgggaacaagtaacctggcggcagcgcaaaagatg

SEQ ID NO: 145572 - DNA, 103 bp, Artificial Sequence
  Synthetic Polynucleotide
taatacgactcactatagggggaagccactatgccctggccaacttgttcaacagaggagagaacaaatgggccagggcaacctggcggcagcgcaaaagatg

SEQ ID NO: 145573 - DNA, 103 bp, Artificial Sequence
  Synthetic Polynucleotide
taatacgactcactatagggccacagctgcggaagccactatgccctggcaacagaggagagccaggatgtagtggcttaacctggcggcagcgcaaaagatg

SEQ ID NO: 145574 - DNA, 103 bp, Artificial Sequence
  Synthetic Polynucleotide
taatacgactcactataggggcggtagtgaccacagctgcggaagccactaacagaggagaagtggcatgcgcagctgtaacctggcggcagcgcaaaagatg

SEQ ID NO: 145575 - DNA, 103 bp, Artificial Sequence
  Synthetic Polynucleotide
taatacgactcactatagggggtggagctggcggtagtgaccacagctgcaacagaggagagcagctatggtcactaccaacctggcggcagcgcaaaagatg

SEQ ID NO: 145576 - DNA, 103 bp, Artificial Sequence
  Synthetic Polynucleotide
taatacgactcactatagggctgtgtttggggtggagctggcggtagtgaaacagaggagatcactaatgccagctccaaacctggcggcagcgcaaaagatg

SEQ ID NO: 145577 - DNA, 103 bp, Artificial Sequence
  Synthetic Polynucleotide
taatacgactcactataggggagatcctcactgtgtttggggtggagctgaacagaggagacagctcatgcccaaacacaacctggcggcagcgcaaaagatg

SEQ ID NO: 145578 - DNA, 103 bp, Artificial Sequence
  Synthetic Polynucleotide
taatacgactcactataggggccggcccgccaggctcgagtgcgcagcgcaacagaggagagcgctgatgactcgagccaacctggcggcagcgcaaaagatg

SEQ ID NO: 145579 - DNA, 103 bp, Artificial Sequence
  Synthetic Polynucleotide
taatacgactcactataggggccagtgtctgagatcctcactgtgtttggaacagaggagaccaaacatggtgaggatcaacctggcggcagcgcaaaagatg

SEQ ID NO: 145580 - DNA, 103 bp, Artificial Sequence
  Synthetic Polynucleotide
taatacgactcactatagggctgctgcaaggccagtgtctgagatcctcaaacagaggagatgaggaatgcagacactgaacctggcggcagcgcaaaagatg

SEQ ID NO: 145581 - DNA, 103 bp, Artificial Sequence
  Synthetic Polynucleotide
taatacgactcactatagggggcacagtccctgctgcaaggccagtgtctaacagaggagaagacacatgccttgcagcaacctggcggcagcgcaaaagatg

SEQ ID NO: 145582 - DNA, 103 bp, Artificial Sequence
  Synthetic Polynucleotide
taatacgactcactatagggctgtttttctggcacagtccctgctgcaagaacagaggagacttgcaatggggactgtgaacctggcggcagcgcaaaagatg

SEQ ID NO: 145583 - DNA, 103 bp, Artificial Sequence
  Synthetic Polynucleotide
taatacgactcactatagggggctgcctttctgtttttctggcacagtccaacagaggagaggactgatgcagaaaaacaacctggcggcagcgcaaaagatg

SEQ ID NO: 145584 - DNA, 103 bp, Artificial Sequence
  Synthetic Polynucleotide
taatacgactcactataggggcctgcgaccggctgcctttctgtttttctaacagaggagaagaaaaatggaaaggcagaacctggcggcagcgcaaaagatg

SEQ ID NO: 145585 - DNA, 103 bp, Artificial Sequence
  Synthetic Polynucleotide
taatacgactcactatagggctctcccgaggcctgcgaccggctgcctttaacagaggagaaaaggcatgcggtcgcagaacctggcggcagcgcaaaagatg

SEQ ID NO: 145586 - DNA, 103 bp, Artificial Sequence
  Synthetic Polynucleotide
taatacgactcactatagggttcttgaattctctcccgaggcctgcgaccaacagaggagaggtcgcatgcctcgggagaacctggcggcagcgcaaaagatg

SEQ ID NO: 145587 - DNA, 103 bp, Artificial Sequence
  Synthetic Polynucleotide
taatacgactcactatagggagaatagaatttcttgaattctctcccgagaacagaggagactcgggatggaattcaagaacctggcggcagcgcaaaagatg

SEQ ID NO: 145588 - DNA, 103 bp, Artificial Sequence
  Synthetic Polynucleotide
taatacgactcactatagggagaagaggccagaatagaatttcttgaattaacagaggagaaattcaatgaattctattaacctggcggcagcgcaaaagatg

SEQ ID NO: 145589 - DNA, 103 bp, Artificial Sequence
  Synthetic Polynucleotide
taatacgactcactatagggcccgcaccgtgccggcccgccaggctcgagaacagaggagactcgagatgggcgggccgaacctggcggcagcgcaaaagatg

SEQ ID NO: 145590 - DNA, 103 bp, Artificial Sequence
  Synthetic Polynucleotide
taatacgactcactatagggctccaaatccagaagaggccagaatagaataacagaggagaattctaatgtggcctcttaacctggcggcagcgcaaaagatg

SEQ ID NO: 145591 - DNA, 103 bp, Artificial Sequence
  Synthetic Polynucleotide
taatacgactcactataggggggagaggtgctccaaatccagaagaggccaacagaggagaggcctcatgtggatttggaacctggcggcagcgcaaaagatg

SEQ ID NO: 145592 - DNA, 103 bp, Artificial Sequence
  Synthetic Polynucleotide
taatacgactcactatagggcgatgaactagggagaggtgctccaaatccaacagaggagaggatttatggcacctctcaacctggcggcagcgcaaaagatg

SEQ ID NO: 145593 - DNA, 103 bp, Artificial Sequence
  Synthetic Polynucleotide
taatacgactcactatagggtcaaaggttgcgatgaactagggagaggtgaacagaggagacacctcatgctagttcataacctggcggcagcgcaaaagatg

SEQ ID NO: 145594 - DNA, 103 bp, Artificial Sequence
  Synthetic Polynucleotide
taatacgactcactatagggcttccaaaagtcaaaggttgcgatgaactaaacagaggagatagttcatggcaacctttaacctggcggcagcgcaaaagatg

SEQ ID NO: 145595 - DNA, 103 bp, Artificial Sequence
  Synthetic Polynucleotide
taatacgactcactataggggctccttccacttccaaaagtcaaaggttgaacagaggagacaacctatgacttttggaaacctggcggcagcgcaaaagatg

SEQ ID NO: 145596 - DNA, 103 bp, Artificial Sequence
  Synthetic Polynucleotide
taatacgactcactatagggcattggactggctccttccacttccaaaagaacagaggagacttttgatggtggaaggaaacctggcggcagcgcaaaagatg

SEQ ID NO: 145597 - DNA, 103 bp, Artificial Sequence
  Synthetic Polynucleotide
taatacgactcactataggggctagaacaccattggactggctccttccaaacagaggagatggaagatgccagtccaaaacctggcggcagcgcaaaagatg

SEQ ID NO: 145598 - DNA, 103 bp, Artificial Sequence
  Synthetic Polynucleotide
taatacgactcactataggggttctctgtggctagaacaccattggactgaacagaggagacagtccatgggtgttctaaacctggcggcagcgcaaaagatg

SEQ ID NO: 145599 - DNA, 103 bp, Artificial Sequence
  Synthetic Polynucleotide
taatacgactcactatagggccaaaggtttgttctctgtggctagaacacaacagaggagagtgttcatgccacagagaaacctggcggcagcgcaaaagatg

SEQ ID NO: 145600 - DNA, 103 bp, Artificial Sequence
  Synthetic Polynucleotide
taatacgactcactatagggccgctcatggcccgcaccgtgccggcccgcaacagaggagagcgggcatgcacggtgcgaacctggcggcagcgcaaaagatg

SEQ ID NO: 145601 - DNA, 103 bp, Artificial Sequence
  Synthetic Polynucleotide
taatacgactcactatagggaaagagaagcccaaaggtttgttctctgtgaacagaggagacacagaatgcaaacctttaacctggcggcagcgcaaaagatg

SEQ ID NO: 145602 - DNA, 103 bp, Artificial Sequence
  Synthetic Polynucleotide
taatacgactcactataggggctacagccaaaagagaagcccaaaggtttaacagaggagaaaacctatgggcttctctaacctggcggcagcgcaaaagatg

SEQ ID NO: 145603 - DNA, 103 bp, Artificial Sequence
  Synthetic Polynucleotide
taatacgactcactatagggcttgtgcagagctacagccaaaagagaagcaacagaggagagcttctatgttggctgtaaacctggcggcagcgcaaaagatg

SEQ ID NO: 145604 - DNA, 103 bp, Artificial Sequence
  Synthetic Polynucleotide
taatacgactcactatagggttctgtgcctcttgtgcagagctacagccaaacagaggagatggctgatgctctgcacaaacctggcggcagcgcaaaagatg

SEQ ID NO: 145605 - DNA, 103 bp, Artificial Sequence
  Synthetic Polynucleotide
taatacgactcactatagggatcagtgtctttctgtgcctcttgtgcagaaacagaggagatctgcaatggaggcacagaacctggcggcagcgcaaaagatg

SEQ ID NO: 145606 - DNA, 103 bp, Artificial Sequence
  Synthetic Polynucleotide
taatacgactcactatagggttttggagagatcagtgtctttctgtgcctaacagaggagaaggcacatgaagacactgaacctggcggcagcgcaaaagatg

SEQ ID NO: 145607 - DNA, 103 bp, Artificial Sequence
  Synthetic Polynucleotide
taatacgactcactatagggaaaaacaagtttttggagagatcagtgtctaacagaggagaagacacatgtctctccaaaacctggcggcagcgcaaaagatg

SEQ ID NO: 145608 - DNA, 103 bp, Artificial Sequence
  Synthetic Polynucleotide
taatacgactcactatagggcatgcattgaaaaaacaagtttttggagagaacagaggagactctccatgaacttgtttaacctggcggcagcgcaaaagatg

SEQ ID NO: 145609 - DNA, 103 bp, Artificial Sequence
  Synthetic Polynucleotide
taatacgactcactatagggaagtttgggacatgcattgaaaaaacaagtaacagaggagaacttgtatgttcaatgcaaacctggcggcagcgcaaaagatg

SEQ ID NO: 145610 - DNA, 103 bp, Artificial Sequence
  Synthetic Polynucleotide
taatacgactcactatagggctggtaggtaaagtttgggacatgcattgaaacagaggagatcaatgatggtcccaaacaacctggcggcagcgcaaaagatg

SEQ ID NO: 145611 - DNA, 103 bp, Artificial Sequence
  Synthetic Polynucleotide
taatacgactcactataggggggcaccgccccgctcatggcccgcaccgtaacagaggagaacggtgatggccatgagcaacctggcggcagcgcaaaagatg

SEQ ID NO: 145612 - DNA, 103 bp, Artificial Sequence
  Synthetic Polynucleotide
taatacgactcactataggggaagtagttactggtaggtaaagtttgggaaacagaggagatcccaaatgttacctaccaacctggcggcagcgcaaaagatg

SEQ ID NO: 145613 - DNA, 103 bp, Artificial Sequence
  Synthetic Polynucleotide
taatacgactcactatagggaaacagtagtgaagtagttactggtaggtaaacagaggagatacctaatggtaactactaacctggcggcagcgcaaaagatg

SEQ ID NO: 145614 - DNA, 103 bp, Artificial Sequence
  Synthetic Polynucleotide
taatacgactcactatagggaaactctctgaaacagtagtgaagtagttaaacagaggagataactaatgcactactgtaacctggcggcagcgcaaaagatg

SEQ ID NO: 145615 - DNA, 103 bp, Artificial Sequence
  Synthetic Polynucleotide
taatacgactcactatagggatcatcagccaaactctctgaaacagtagtaacagaggagaactactatgtcagagagtaacctggcggcagcgcaaaagatg

SEQ ID NO: 145616 - DNA, 103 bp, Artificial Sequence
  Synthetic Polynucleotide
taatacgactcactataggggactagaagaatcatcagccaaactctctgaacagaggagacagagaatgtggctgatgaacctggcggcagcgcaaaagatg

SEQ ID NO: 145617 - DNA, 103 bp, Artificial Sequence
  Synthetic Polynucleotide
taatacgactcactatagggaatgagtcccgactagaagaatcatcagccaacagaggagaggctgaatgttcttctagaacctggcggcagcgcaaaagatg

SEQ ID NO: 145618 - DNA, 103 bp, Artificial Sequence
  Synthetic Polynucleotide
taatacgactcactataggggctttgtttgaatgagtcccgactagaagaaacagaggagatcttctatgcgggactcaaacctggcggcagcgcaaaagatg

SEQ ID NO: 145619 - DNA, 103 bp, Artificial Sequence
  Synthetic Polynucleotide
taatacgactcactatagggggctctcaaggctttgtttgaatgagtcccaacagaggagagggactatgtcaaacaaaaacctggcggcagcgcaaaagatg

SEQ ID NO: 145620 - DNA, 103 bp, Artificial Sequence
  Synthetic Polynucleotide
taatacgactcactatagggcctgagctcaggctctcaaggctttgtttgaacagaggagacaaacaatgccttgagagaacctggcggcagcgcaaaagatg

SEQ ID NO: 145621 - DNA, 103 bp, Artificial Sequence
  Synthetic Polynucleotide
taatacgactcactatagggtttacacaggcctgagctcaggctctcaagaacagaggagacttgagatgctgagctcaaacctggcggcagcgcaaaagatg

SEQ ID NO: 145622 - DNA, 103 bp, Artificial Sequence
  Synthetic Polynucleotide
taatacgactcactatagggctaggtcctggggcaccgccccgctcatggaacagaggagaccatgaatggggcggtgcaacctggcggcagcgcaaaagatg

SEQ ID NO: 145623 - DNA, 103 bp, Artificial Sequence
  Synthetic Polynucleotide
taatacgactcactatagggcggatctgcctttacacaggcctgagctcaaacagaggagatgagctatggcctgtgtaaacctggcggcagcgcaaaagatg

SEQ ID NO: 145624 - DNA, 103 bp, Artificial Sequence
  Synthetic Polynucleotide
taatacgactcactataggggttccaagaacggatctgcctttacacaggaacagaggagacctgtgatgaggcagatcaacctggcggcagcgcaaaagatg

SEQ ID NO: 145625 - DNA, 103 bp, Artificial Sequence
  Synthetic Polynucleotide
taatacgactcactatagggcttagtgtctgttccaagaacggatctgccaacagaggagaggcagaatggttcttggaaacctggcggcagcgcaaaagatg

SEQ ID NO: 145626 - DNA, 103 bp, Artificial Sequence
  Synthetic Polynucleotide
taatacgactcactatagggtagagcctggcttagtgtctgttccaagaaaacagaggagattcttgatgcagacactaaacctggcggcagcgcaaaagatg

SEQ ID NO: 145627 - DNA, 103 bp, Artificial Sequence
  Synthetic Polynucleotide
taatacgactcactatagggctgccagccttagagcctggcttagtgtctaacagaggagaagacacatggccaggctcaacctggcggcagcgcaaaagatg

SEQ ID NO: 145628 - DNA, 103 bp, Artificial Sequence
  Synthetic Polynucleotide
taatacgactcactataggggtccacagagctgccagccttagagcctggaacagaggagaccaggcatgaaggctggcaacctggcggcagcgcaaaagatg

SEQ ID NO: 145629 - DNA, 103 bp, Artificial Sequence
  Synthetic Polynucleotide
taatacgactcactataggggcactttccggtccacagagctgccagcctaacagaggagaaggctgatggctctgtggaacctggcggcagcgcaaaagatg

SEQ ID NO: 145630 - DNA, 103 bp, Artificial Sequence
  Synthetic Polynucleotide
taatacgactcactataggggactctgcaggcactttccggtccacagagaacagaggagactctgtatgccggaaagtaacctggcggcagcgcaaaagatg

SEQ ID NO: 145631 - DNA, 103 bp, Artificial Sequence
  Synthetic Polynucleotide
taatacgactcactatagggggtgggcatggactctgcaggcactttccgaacagaggagacggaaaatgcctgcagagaacctggcggcagcgcaaaagatg

SEQ ID NO: 145632 - DNA, 103 bp, Artificial Sequence
  Synthetic Polynucleotide
taatacgactcactatagggctggagtgagggtgggcatggactctgcagaacagaggagactgcagatgccatgcccaaacctggcggcagcgcaaaagatg

SEQ ID NO: 145633 - DNA, 103 bp, Artificial Sequence
  Synthetic Polynucleotide
taatacgactcactatagggacaaagatcgctaggtcctggggcaccgccaacagaggagaggcggtatgccaggacctaacctggcggcagcgcaaaagatg

SEQ ID NO: 145634 - DNA, 103 bp, Artificial Sequence
  Synthetic Polynucleotide
taatacgactcactatagggcgtgggaaggctggagtgagggtgggcatgaacagaggagacatgccatgcctcactccaacctggcggcagcgcaaaagatg

SEQ ID NO: 145635 - DNA, 103 bp, Artificial Sequence
  Synthetic Polynucleotide
taatacgactcactatagggtaggaggctccgtgggaaggctggagtgagaacagaggagactcactatggccttcccaaacctggcggcagcgcaaaagatg

SEQ ID NO: 145636 - DNA, 103 bp, Artificial Sequence
  Synthetic Polynucleotide
taatacgactcactatagggtacgggcatttaggaggctccgtgggaaggaacagaggagaccttccatgggagcctccaacctggcggcagcgcaaaagatg

SEQ ID NO: 145637 - DNA, 103 bp, Artificial Sequence
  Synthetic Polynucleotide
taatacgactcactatagggttctctggggtacgggcatttaggaggctcaacagaggagagagcctatgaaatgcccgaacctggcggcagcgcaaaagatg

SEQ ID NO: 145638 - DNA, 103 bp, Artificial Sequence
  Synthetic Polynucleotide
taatacgactcactatagggattttcatgattctctggggtacgggcattaacagaggagaaatgccatgaccccagagaacctggcggcagcgcaaaagatg

SEQ ID NO: 145639 - DNA, 103 bp, Artificial Sequence
  Synthetic Polynucleotide
taatacgactcactataggggtaaaaatagattttcatgattctctggggaacagaggagaccccagatgatcatgaaaaacctggcggcagcgcaaaagatg

SEQ ID NO: 145640 - DNA, 103 bp, Artificial Sequence
  Synthetic Polynucleotide
taatacgactcactatagggttggggggctgtaaaaatagattttcatgaaacagaggagatcatgaatgtctatttttaacctggcggcagcgcaaaagatg

SEQ ID NO: 145641 - DNA, 103 bp, Artificial Sequence
  Synthetic Polynucleotide
taatacgactcactatagggtcgggacaatttggggggctgtaaaaatagaacagaggagactatttatgcagccccccaacctggcggcagcgcaaaagatg

SEQ ID NO: 145642 - DNA, 103 bp, Artificial Sequence
  Synthetic Polynucleotide
taatacgactcactatagggaaggctcttctcgggacaatttggggggctaacagaggagaagccccatgaattgtcccaacctggcggcagcgcaaaagatg

SEQ ID NO: 145643 - DNA, 103 bp, Artificial Sequence
  Synthetic Polynucleotide
taatacgactcactatagggaaaggattagaaggctcttctcgggacaataacagaggagaattgtcatgagaagagccaacctggcggcagcgcaaaagatg

SEQ ID NO: 145644 - DNA, 103 bp, Artificial Sequence
  Synthetic Polynucleotide
taatacgactcactatagggatcaaattctacaaagatcgctaggtcctgaacagaggagacaggacatggcgatctttaacctggcggcagcgcaaaagatg

SEQ ID NO: 145645 - DNA, 103 bp, Artificial Sequence
  Synthetic Polynucleotide
taatacgactcactatagggaaatgccaggaaaggattagaaggctcttcaacagaggagagaagagatgtctaatcctaacctggcggcagcgcaaaagatg

SEQ ID NO: 145646 - DNA, 103 bp, Artificial Sequence
  Synthetic Polynucleotide
taatacgactcactatagggctttctccacaaatgccaggaaaggattagaacagaggagactaatcatgtcctggcataacctggcggcagcgcaaaagatg

SEQ ID NO: 145647 - DNA, 103 bp, Artificial Sequence
  Synthetic Polynucleotide
taatacgactcactatagggctgtgttcaactttctccacaaatgccaggaacagaggagacctggcatgtgtggagaaaacctggcggcagcgcaaaagatg

SEQ ID NO: 145648 - DNA, 103 bp, Artificial Sequence
  Synthetic Polynucleotide
taatacgactcactatagggactgaaagggctgtgttcaactttctccacaacagaggagagtggagatggttgaacacaacctggcggcagcgcaaaagatg

SEQ ID NO: 145649 - DNA, 103 bp, Artificial Sequence
  Synthetic Polynucleotide
taatacgactcactatagggatgcaaaactactgaaagggctgtgttcaaaacagaggagattgaacatggccctttcaaacctggcggcagcgcaaaagatg

SEQ ID NO: 145650 - DNA, 103 bp, Artificial Sequence
  Synthetic Polynucleotide
taatacgactcactataggggatgcctgagatgcaaaactactgaaagggaacagaggagaccctttatgtagttttgcaacctggcggcagcgcaaaagatg

SEQ ID NO: 145651 - DNA, 103 bp, Artificial Sequence
  Synthetic Polynucleotide
taatacgactcactatagggggagctacctgatgcctgagatgcaaaactaacagaggagaagttttatgtctcaggcaaacctggcggcagcgcaaaagatg

SEQ ID NO: 145652 - DNA, 103 bp, Artificial Sequence
  Synthetic Polynucleotide
taatacgactcactatagggtagcagaagaggagctacctgatgcctgagaacagaggagactcaggatgcaggtagctaacctggcggcagcgcaaaagatg

SEQ ID NO: 145653 - DNA, 103 bp, Artificial Sequence
  Synthetic Polynucleotide
taatacgactcactataggggtgacagtggtagcagaagaggagctacctaacagaggagaaggtagatgctcttctgcaacctggcggcagcgcaaaagatg

SEQ ID NO: 145654 - DNA, 103 bp, Artificial Sequence
  Synthetic Polynucleotide
taatacgactcactatagggcaccttggaggtgacagtggtagcagaagaaacagaggagatcttctatgaccactgtcaacctggcggcagcgcaaaagatg

SEQ ID NO: 145655 - DNA, 103 bp, Artificial Sequence
  Synthetic Polynucleotide
taatacgactcactataggggcagccgcttgcccaccggggaggccgccgaacagaggagacggcggatgccccggtggaacctggcggcagcgcaaaagatg

SEQ ID NO: 145656 - DNA, 103 bp, Artificial Sequence
  Synthetic Polynucleotide
taatacgactcactatagggagttacagccatcaaattctacaaagatcgaacagaggagacgatctatgtagaatttgaacctggcggcagcgcaaaagatg

SEQ ID NO: 145657 - DNA, 103 bp, Artificial Sequence
  Synthetic Polynucleotide
taatacgactcactatagggagctgggtgccaccttggaggtgacagtggaacagaggagaccactgatgcctccaaggaacctggcggcagcgcaaaagatg

SEQ ID NO: 145658 - DNA, 103 bp, Artificial Sequence
  Synthetic Polynucleotide
taatacgactcactataggggactcgggccagctgggtgccaccttggagaacagaggagactccaaatgggcacccagaacctggcggcagcgcaaaagatg

SEQ ID NO: 145659 - DNA, 103 bp, Artificial Sequence
  Synthetic Polynucleotide
taatacgactcactatagggagaggagtgagactcgggccagctgggtgcaacagaggagagcacccatgtggcccgagaacctggcggcagcgcaaaagatg

SEQ ID NO: 145660 - DNA, 103 bp, Artificial Sequence
  Synthetic Polynucleotide
taatacgactcactatagggccgaatctgcagaggagtgagactcgggccaacagaggagaggcccgatgctcactcctaacctggcggcagcgcaaaagatg

SEQ ID NO: 145661 - DNA, 103 bp, Artificial Sequence
  Synthetic Polynucleotide
taatacgactcactataggggctaaagatgccgaatctgcagaggagtgaaacagaggagatcactcatgtgcagattcaacctggcggcagcgcaaaagatg

SEQ ID NO: 145662 - DNA, 103 bp, Artificial Sequence
  Synthetic Polynucleotide
taatacgactcactatagggtttcttctttgctaaagatgccgaatctgcaacagaggagagcagatatggcatctttaaacctggcggcagcgcaaaagatg

SEQ ID NO: 145663 - DNA, 103 bp, Artificial Sequence
  Synthetic Polynucleotide
taatacgactcactatagggtgaagaggggtttcttctttgctaaagatgaacagaggagacatcttatgcaaagaagaaacctggcggcagcgcaaaagatg

SEQ ID NO: 145664 - DNA, 103 bp, Artificial Sequence
  Synthetic Polynucleotide
taatacgactcactatagggtcagttgtaatgaagaggggtttcttctttaacagaggagaaaagaaatgacccctcttaacctggcggcagcgcaaaagatg

SEQ ID NO: 145665 - DNA, 103 bp, Artificial Sequence
  Synthetic Polynucleotide
taatacgactcactatagggcttggaggagtcagttgtaatgaagaggggaacagaggagacccctcatgattacaactaacctggcggcagcgcaaaagatg

SEQ ID NO: 145666 - DNA, 103 bp, Artificial Sequence
  Synthetic Polynucleotide
taatacgactcactatagggcagatactagcttggaggagtcagttgtaaaacagaggagattacaaatgactcctccaaacctggcggcagcgcaaaagatg

SEQ ID NO: 145667 - DNA, 103 bp, Artificial Sequence
  Synthetic Polynucleotide
taatacgactcactatagggtgttgcttccagttacagccatcaaattctaacagaggagaagaattatgtggctgtaaaacctggcggcagcgcaaaagatg

SEQ ID NO: 145668 - DNA, 103 bp, Artificial Sequence
  Synthetic Polynucleotide
taatacgactcactatagggcccagaacaccagatactagcttggaggagaacagaggagactcctcatggctagtatcaacctggcggcagcgcaaaagatg

SEQ ID NO: 145669 - DNA, 103 bp, Artificial Sequence
  Synthetic Polynucleotide
taatacgactcactatagggaagagctgagcccagaacaccagatactagaacagaggagactagtaatgggtgttctgaacctggcggcagcgcaaaagatg

SEQ ID NO: 145670 - DNA, 103 bp, Artificial Sequence
  Synthetic Polynucleotide
taatacgactcactatagggccccactggtaagagctgagcccagaacacaacagaggagagtgttcatggctcagctcaacctggcggcagcgcaaaagatg

SEQ ID NO: 145671 - DNA, 103 bp, Artificial Sequence
  Synthetic Polynucleotide
taatacgactcactatagggaggcttgggcccccactggtaagagctgagaacagaggagactcagcatgtaccagtggaacctggcggcagcgcaaaagatg

SEQ ID NO: 145672 - DNA, 103 bp, Artificial Sequence
  Synthetic Polynucleotide
taatacgactcactatagggcatggcagagaggcttgggcccccactggtaacagaggagaaccagtatgggcccaagcaacctggcggcagcgcaaaagatg

SEQ ID NO: 145673 - DNA, 103 bp, Artificial Sequence
  Synthetic Polynucleotide
taatacgactcactatagggggccattccccatggcagagaggcttgggcaacagaggagagcccaaatgtctctgccaaacctggcggcagcgcaaaagatg

SEQ ID NO: 145674 - DNA, 103 bp, Artificial Sequence
  Synthetic Polynucleotide
taatacgactcactataggggagctggagcggccattccccatggcagagaacagaggagactctgcatgggggaatggaacctggcggcagcgcaaaagatg

SEQ ID NO: 145675 - DNA, 103 bp, Artificial Sequence
  Synthetic Polynucleotide
taatacgactcactataggggctggtgggcgagctggagcggccattcccaacagaggagagggaatatgcgctccagcaacctggcggcagcgcaaaagatg

SEQ ID NO: 145676 - DNA, 103 bp, Artificial Sequence
  Synthetic Polynucleotide
taatacgactcactataggggagtgaggctgctggtgggcgagctggagcaacagaggagagctccaatgcgcccaccaaacctggcggcagcgcaaaagatg

SEQ ID NO: 145677 - DNA, 103 bp, Artificial Sequence
  Synthetic Polynucleotide
taatacgactcactatagggtcaatgggctgagtgaggctgctggtgggcaacagaggagagcccacatgcagcctcacaacctggcggcagcgcaaaagatg

SEQ ID NO: 145678 - DNA, 103 bp, Artificial Sequence
  Synthetic Polynucleotide
taatacgactcactatagggtacccaggagtgttgcttccagttacagccaacagaggagaggctgtatgtggaagcaaaacctggcggcagcgcaaaagatg

SEQ ID NO: 145679 - DNA, 103 bp, Artificial Sequence
  Synthetic Polynucleotide
taatacgactcactatagggagttggcatctcaatgggctgagtgaggctaacagaggagaagcctcatgcagcccattaacctggcggcagcgcaaaagatg

SEQ ID NO: 145680 - DNA, 103 bp, Artificial Sequence
  Synthetic Polynucleotide
taatacgactcactatagggtagaggagagagttggcatctcaatgggctaacagaggagaagcccaatgagatgccaaaacctggcggcagcgcaaaagatg

SEQ ID NO: 145681 - DNA, 103 bp, Artificial Sequence
  Synthetic Polynucleotide
taatacgactcactatagggtctgtggggctagaggagagagttggcatcaacagaggagagatgccatgtctctcctcaacctggcggcagcgcaaaagatg

SEQ ID NO: 145682 - DNA, 103 bp, Artificial Sequence
  Synthetic Polynucleotide
taatacgactcactatagggtggcctctcctctgtggggctagaggagagaacagaggagactctccatgagccccacaaacctggcggcagcgcaaaagatg

SEQ ID NO: 145683 - DNA, 103 bp, Artificial Sequence
  Synthetic Polynucleotide
taatacgactcactataggggccccacagttggcctctcctctgtggggcaacagaggagagccccaatgaggagaggcaacctggcggcagcgcaaaagatg

SEQ ID NO: 145684 - DNA, 103 bp, Artificial Sequence
  Synthetic Polynucleotide
taatacgactcactatagggtgctgcccaggccccacagttggcctctccaacagaggagaggagagatgaactgtgggaacctggcggcagcgcaaaagatg

SEQ ID NO: 145685 - DNA, 103 bp, Artificial Sequence
  Synthetic Polynucleotide
taatacgactcactataggggggattgtcctgctgcccaggccccacagtaacagaggagaactgtgatgcctgggcagaacctggcggcagcgcaaaagatg

SEQ ID NO: 145686 - DNA, 103 bp, Artificial Sequence
  Synthetic Polynucleotide
taatacgactcactatagggttttgaggaggggattgtcctgctgcccagaacagaggagactgggcatgaggacaatcaacctggcggcagcgcaaaagatg

SEQ ID NO: 145687 - DNA, 103 bp, Artificial Sequence
  Synthetic Polynucleotide
taatacgactcactatagggttactaaaggttttgaggaggggattgtccaacagaggagaggacaaatgcctcctcaaaacctggcggcagcgcaaaagatg

SEQ ID NO: 145688 - DNA, 103 bp, Artificial Sequence
  Synthetic Polynucleotide
taatacgactcactataggggccaaagacgttactaaaggttttgaggagaacagaggagactcctcatgacctttagtaacctggcggcagcgcaaaagatg

SEQ ID NO: 145689 - DNA, 103 bp, Artificial Sequence
  Synthetic Polynucleotide
taatacgactcactatagggcatgaacttttacccaggagtgttgcttccaacagaggagaggaagcatgactcctgggaacctggcggcagcgcaaaagatg

SEQ ID NO: 145690 - DNA, 103 bp, Artificial Sequence
  Synthetic Polynucleotide
taatacgactcactatagggctgagtgcctgccaaagacgttactaaaggaacagaggagacctttaatgacgtctttgaacctggcggcagcgcaaaagatg

SEQ ID NO: 145691 - DNA, 103 bp, Artificial Sequence
  Synthetic Polynucleotide
taatacgactcactatagggagaaagccgcctgagtgcctgccaaagacgaacagaggagacgtcttatgcaggcactcaacctggcggcagcgcaaaagatg

SEQ ID NO: 145692 - DNA, 103 bp, Artificial Sequence
  Synthetic Polynucleotide
taatacgactcactatagggcggggaggacagaaagccgcctgagtgcctaacagaggagaaggcacatgggcggctttaacctggcggcagcgcaaaagatg

SEQ ID NO: 145693 - DNA, 103 bp, Artificial Sequence
  Synthetic Polynucleotide
taatacgactcactatagggaaaaatctgccggggaggacagaaagccgcaacagaggagagcggctatgtgtcctcccaacctggcggcagcgcaaaagatg

SEQ ID NO: 145694 - DNA, 103 bp, Artificial Sequence
  Synthetic Polynucleotide
taatacgactcactatagggttctcctgtgaaaaatctgccggggaggacaacagaggagagtcctcatgggcagatttaacctggcggcagcgcaaaagatg

SEQ ID NO: 145695 - DNA, 103 bp, Artificial Sequence
  Synthetic Polynucleotide
taatacgactcactatagggaggagctttgttctcctgtgaaaaatctgcaacagaggagagcagatatgtcacaggagaacctggcggcagcgcaaaagatg

SEQ ID NO: 145696 - DNA, 103 bp, Artificial Sequence
  Synthetic Polynucleotide
taatacgactcactatagggcagcttcaaaaggagctttgttctcctgtgaacagaggagacacaggatgacaaagctcaacctggcggcagcgcaaaagatg

SEQ ID NO: 145697 - DNA, 103 bp, Artificial Sequence
  Synthetic Polynucleotide
taatacgactcactatagggaaccttttcacagcttcaaaaggagctttgaacagaggagacaaagcatgttttgaagcaacctggcggcagcgcaaaagatg

SEQ ID NO: 145698 - DNA, 103 bp, Artificial Sequence
  Synthetic Polynucleotide
taatacgactcactatagggatccagtgagaaccttttcacagcttcaaaaacagaggagatttgaaatggtgaaaaggaacctggcggcagcgcaaaagatg

SEQ ID NO: 145699 - DNA, 103 bp, Artificial Sequence
  Synthetic Polynucleotide
taatacgactcactatagggagcttcgttcatccagtgagaaccttttcaaacagaggagatgaaaaatgtctcactggaacctggcggcagcgcaaaagatg

SEQ ID NO: 145700 - DNA, 103 bp, Artificial Sequence
  Synthetic Polynucleotide
taatacgactcactatagggacttcctcagcatgaacttttacccaggagaacagaggagactcctgatgaaaagttcaaacctggcggcagcgcaaaagatg

SEQ ID NO: 145701 - DNA, 103 bp, Artificial Sequence
  Synthetic Polynucleotide
taatacgactcactatagggctgcaagccaagcttcgttcatccagtgagaacagaggagactcactatgtgaacgaagaacctggcggcagcgcaaaagatg

SEQ ID NO: 145702 - DNA, 103 bp, Artificial Sequence
  Synthetic Polynucleotide
taatacgactcactatagggcgagtcttgtctgcaagccaagcttcgttcaacagaggagagaacgaatgttggcttgcaacctggcggcagcgcaaaagatg

SEQ ID NO: 145703 - DNA, 103 bp, Artificial Sequence
  Synthetic Polynucleotide
taatacgactcactatagggtgctggagtccgagtcttgtctgcaagccaaacagaggagatggcttatggacaagactaacctggcggcagcgcaaaagatg

SEQ ID NO: 145704 - DNA, 103 bp, Artificial Sequence
  Synthetic Polynucleotide
taatacgactcactatagggtcactgttggtgctggagtccgagtcttgtaacagaggagaacaagaatgggactccagaacctggcggcagcgcaaaagatg

SEQ ID NO: 145705 - DNA, 103 bp, Artificial Sequence
  Synthetic Polynucleotide
taatacgactcactatagggatctgacaggtcactgttggtgctggagtcaacagaggagagactccatgaccaacagtaacctggcggcagcgcaaaagatg

SEQ ID NO: 145706 - DNA, 103 bp, Artificial Sequence
  Synthetic Polynucleotide
taatacgactcactatagggagtcactcaaatctgacaggtcactgttggaacagaggagaccaacaatgacctgtcagaacctggcggcagcgcaaaagatg

SEQ ID NO: 145707 - DNA, 103 bp, Artificial Sequence
  Synthetic Polynucleotide
taatacgactcactatagggtgctcctcagagtcactcaaatctgacaggaacagaggagacctgtcatgtttgagtgaaacctggcggcagcgcaaaagatg

SEQ ID NO: 145708 - DNA, 103 bp, Artificial Sequence
  Synthetic Polynucleotide
taatacgactcactatagggagcctgcagctgctcctcagagtcactcaaaacagaggagattgagtatgtctgaggagaacctggcggcagcgcaaaagatg

SEQ ID NO: 145709 - DNA, 103 bp, Artificial Sequence
  Synthetic Polynucleotide
taatacgactcactatagggggcctgtcttagcctgcagctgctcctcagaacagaggagactgaggatgagctgcaggaacctggcggcagcgcaaaagatg

SEQ ID NO: 145710 - DNA, 103 bp, Artificial Sequence
  Synthetic Polynucleotide
taatacgactcactatagggattcccttcaggcctgtcttagcctgcagcaacagaggagagctgcaatgtaagacaggaacctggcggcagcgcaaaagatg

SEQ ID NO: 145711 - DNA, 103 bp, Artificial Sequence
  Synthetic Polynucleotide
taatacgactcactatagggaagcacgataacttcctcagcatgaactttaacagaggagaaaagttatggctgaggaaaacctggcggcagcgcaaaagatg

SEQ ID NO: 145712 - DNA, 103 bp, Artificial Sequence
  Synthetic Polynucleotide
taatacgactcactataggggtgctctggaattcccttcaggcctgtcttaacagaggagaaagacaatgctgaagggaaacctggcggcagcgcaaaagatg

SEQ ID NO: 145713 - DNA, 103 bp, Artificial Sequence
  Synthetic Polynucleotide
taatacgactcactatagggtccccatcaggtgctctggaattcccttcaaacagaggagatgaaggatgttccagagcaacctggcggcagcgcaaaagatg

SEQ ID NO: 145714 - DNA, 103 bp, Artificial Sequence
  Synthetic Polynucleotide
taatacgactcactataggggggcccagcttccccatcaggtgctctggaaacagaggagatccagaatgcctgatgggaacctggcggcagcgcaaaagatg

SEQ ID NO: 145715 - DNA, 103 bp, Artificial Sequence
  Synthetic Polynucleotide
taatacgactcactatagggctccccattggggcccagcttccccatcagaacagaggagactgatgatgaagctgggcaacctggcggcagcgcaaaagatg

SEQ ID NO: 145716 - DNA, 103 bp, Artificial Sequence
  Synthetic Polynucleotide
taatacgactcactatagggcagcactgcgctccccattggggcccagctaacagaggagaagctggatgccaatggggaacctggcggcagcgcaaaagatg

SEQ ID NO: 145717 - DNA, 103 bp, Artificial Sequence
  Synthetic Polynucleotide
taatacgactcactatagggagcaacagctcagcactgcgctccccattgaacagaggagacaatggatggcgcagtgcaacctggcggcagcgcaaaagatg

SEQ ID NO: 145718 - DNA, 103 bp, Artificial Sequence
  Synthetic Polynucleotide
taatacgactcactataggggcttttgcccagcaacagctcagcactgcgaacagaggagacgcagtatggagctgttgaacctggcggcagcgcaaaagatg

SEQ ID NO: 145719 - DNA, 103 bp, Artificial Sequence
  Synthetic Polynucleotide
taatacgactcactataggggcttccctttgcttttgcccagcaacagctaacagaggagaagctgtatgtgggcaaaaaacctggcggcagcgcaaaagatg

SEQ ID NO: 145720 - DNA, 103 bp, Artificial Sequence
  Synthetic Polynucleotide
taatacgactcactatagggttgggggcctgcttccctttgcttttgcccaacagaggagagggcaaatgcaaagggaaaacctggcggcagcgcaaaagatg

SEQ ID NO: 145721 - DNA, 103 bp, Artificial Sequence
  Synthetic Polynucleotide
taatacgactcactatagggaggccggcccttgggggcctgcttccctttaacagaggagaaaagggatgcaggcccccaacctggcggcagcgcaaaagatg

SEQ ID NO: 145722 - DNA, 103 bp, Artificial Sequence
  Synthetic Polynucleotide
taatacgactcactatagggcttccagcagaagcacgataacttcctcagaacagaggagactgaggatgttatcgtgcaacctggcggcagcgcaaaagatg

SEQ ID NO: 145723 - DNA, 103 bp, Artificial Sequence
  Synthetic Polynucleotide
taatacgactcactataggggggcagtccgaggccggcccttgggggcctaacagaggagaaggcccatgagggccggcaacctggcggcagcgcaaaagatg

SEQ ID NO: 145724 - DNA, 103 bp, Artificial Sequence
  Synthetic Polynucleotide
taatacgactcactatagggactttcaggggggcagtccgaggccggcccaacagaggagagggccgatgtcggactgcaacctggcggcagcgcaaaagatg

SEQ ID NO: 145725 - DNA, 103 bp, Artificial Sequence
  Synthetic Polynucleotide
taatacgactcactatagggtgactggccaactttcaggggggcagtccgaacagaggagacggactatgcccctgaaaaacctggcggcagcgcaaaagatg

SEQ ID NO: 145726 - DNA, 103 bp, Artificial Sequence
  Synthetic Polynucleotide
taatacgactcactatagggctttcagcactgactggccaactttcagggaacagaggagaccctgaatgttggccagtaacctggcggcagcgcaaaagatg

SEQ ID NO: 145727 - DNA, 103 bp, Artificial Sequence
  Synthetic Polynucleotide
taatacgactcactatagggttgcttacatctttcagcactgactggccaaacagaggagatggccaatgagtgctgaaaacctggcggcagcgcaaaagatg

SEQ ID NO: 145728 - DNA, 103 bp, Artificial Sequence
  Synthetic Polynucleotide
taatacgactcactatagggcttcttcactttgcttacatctttcagcacaacagaggagagtgctgatggatgtaagcaacctggcggcagcgcaaaagatg

SEQ ID NO: 145729 - DNA, 103 bp, Artificial Sequence
  Synthetic Polynucleotide
taatacgactcactatagggattgcttcagcttcttcactttgcttacataacagaggagaatgtaaatgaagtgaagaaacctggcggcagcgcaaaagatg

SEQ ID NO: 145730 - DNA, 103 bp, Artificial Sequence
  Synthetic Polynucleotide
taatacgactcactatagggggctctccagattgcttcagcttcttcactaacagaggagaagtgaaatggctgaagcaaacctggcggcagcgcaaaagatg

SEQ ID NO: 145731 - DNA, 103 bp, Artificial Sequence
  Synthetic Polynucleotide
taatacgactcactatagggctgcaggaagggctctccagattgcttcagaacagaggagactgaagatgtctggagagaacctggcggcagcgcaaaagatg

SEQ ID NO: 145732 - DNA, 103 bp, Artificial Sequence
  Synthetic Polynucleotide
taatacgactcactatagggatgacccatcctgcaggaagggctctccagaacagaggagactggagatgccttcctgcaacctggcggcagcgcaaaagatg

SEQ ID NO: 145733 - DNA, 103 bp, Artificial Sequence
  Synthetic Polynucleotide
taatacgactcactatagggacaagagacccttccagcagaagcacgataaacagaggagatatcgtatgtctgctggaaacctggcggcagcgcaaaagatg

SEQ ID NO: 145734 - DNA, 103 bp, Artificial Sequence
  Synthetic Polynucleotide
taatacgactcactatagggacattgatgcatgacccatcctgcaggaagaacagaggagacttcctatgggatgggtcaacctggcggcagcgcaaaagatg

SEQ ID NO: 145735 - DNA, 103 bp, Artificial Sequence
  Synthetic Polynucleotide
taatacgactcactatagggatgaggtgccacattgatgcatgacccatcaacagaggagagatgggatgtgcatcaataacctggcggcagcgcaaaagatg

SEQ ID NO: 145736 - DNA, 103 bp, Artificial Sequence
  Synthetic Polynucleotide
taatacgactcactatagggacttgtgcagatgaggtgccacattgatgcaacagaggagagcatcaatgtggcacctcaacctggcggcagcgcaaaagatg

SEQ ID NO: 145737 - DNA, 103 bp, Artificial Sequence
  Synthetic Polynucleotide
taatacgactcactatagggcattcacgacacttgtgcagatgaggtgccaacagaggagaggcaccatgtctgcacaaaacctggcggcagcgcaaaagatg

SEQ ID NO: 145738 - DNA, 103 bp, Artificial Sequence
  Synthetic Polynucleotide
taatacgactcactatagggctccaggcggcattcacgacacttgtgcagaacagaggagactgcacatgtgtcgtgaaaacctggcggcagcgcaaaagatg

SEQ ID NO: 145739 - DNA, 103 bp, Artificial Sequence
  Synthetic Polynucleotide
taatacgactcactatagggtccggtaccgctccaggcggcattcacgacaacagaggagagtcgtgatggccgcctggaacctggcggcagcgcaaaagatg

SEQ ID NO: 145740 - DNA, 103 bp, Artificial Sequence
  Synthetic Polynucleotide
taatacgactcactatagggtccttaaacttccggtaccgctccaggcggaacagaggagaccgcctatggcggtaccgaacctggcggcagcgcaaaagatg

SEQ ID NO: 145741 - DNA, 103 bp, Artificial Sequence
  Synthetic Polynucleotide
taatacgactcactatagggttgctcctgttccttaaacttccggtaccgaacagaggagacggtacatgaagtttaagaacctggcggcagcgcaaaagatg

SEQ ID NO: 145742 - DNA, 103 bp, Artificial Sequence
  Synthetic Polynucleotide
taatacgactcactatagggtagaatcatcttgctcctgttccttaaactaacagaggagaagtttaatgaacaggagcaacctggcggcagcgcaaaagatg

SEQ ID NO: 145743 - DNA, 103 bp, Artificial Sequence
  Synthetic Polynucleotide
taatacgactcactatagggcaggctacagtagaatcatcttgctcctgtaacagaggagaacaggaatgagatgattcaacctggcggcagcgcaaaagatg

SEQ ID NO: 145744 - DNA, 103 bp, Artificial Sequence
  Synthetic Polynucleotide
taatacgactcactataggggggcgcccatacaagagacccttccagcagaacagaggagactgctgatggggtctcttaacctggcggcagcgcaaaagatg

SEQ ID NO: 145745 - DNA, 103 bp, Artificial Sequence
  Synthetic Polynucleotide
taatacgactcactatagggaaagaaacggcaggctacagtagaatcatcaacagaggagagatgatatgactgtagccaacctggcggcagcgcaaaagatg

SEQ ID NO: 145746 - DNA, 103 bp, Artificial Sequence
  Synthetic Polynucleotide
taatacgactcactatagggtccggaagtgaaagaaacggcaggctacagaacagaggagactgtagatggccgtttctaacctggcggcagcgcaaaagatg

SEQ ID NO: 145747 - DNA, 103 bp, Artificial Sequence
  Synthetic Polynucleotide
taatacgactcactatagggaagatcaacctccggaagtgaaagaaacggaacagaggagaccgtttatgtcacttccgaacctggcggcagcgcaaaagatg

SEQ ID NO: 145748 - DNA, 103 bp, Artificial Sequence
  Synthetic Polynucleotide
taatacgactcactatagggttttcgagtgaagatcaacctccggaagtgaacagaggagacacttcatgaggttgatcaacctggcggcagcgcaaaagatg

SEQ ID NO: 145749 - DNA, 103 bp, Artificial Sequence
  Synthetic Polynucleotide
taatacgactcactatagggggagtaccccttttcgagtgaagatcaaccaacagaggagaggttgaatgtcactcgaaaacctggcggcagcgcaaaagatg

SEQ ID NO: 145750 - DNA, 103 bp, Artificial Sequence
  Synthetic Polynucleotide
taatacgactcactatagggccctccacacggagtaccccttttcgagtgaacagaggagacactcgatgaggggtactaacctggcggcagcgcaaaagatg

SEQ ID NO: 145751 - DNA, 103 bp, Artificial Sequence
  Synthetic Polynucleotide
taatacgactcactataggggcttaaaaacccctccacacggagtaccccaacagaggagaggggtaatgcgtgtggagaacctggcggcagcgcaaaagatg

SEQ ID NO: 145752 - DNA, 103 bp, Artificial Sequence
  Synthetic Polynucleotide
taatacgactcactatagggtttgctgggggcttaaaaacccctccacacaacagaggagagtgtggatgggtttttaaaacctggcggcagcgcaaaagatg

SEQ ID NO: 145753 - DNA, 103 bp, Artificial Sequence
  Synthetic Polynucleotide
taatacgactcactatagggtcagggtcactttgctgggggcttaaaaacaacagaggagagtttttatgcccccagcaaacctggcggcagcgcaaaagatg

SEQ ID NO: 145754 - DNA, 103 bp, Artificial Sequence
  Synthetic Polynucleotide
taatacgactcactataggggttcatggcatcagggtcactttgctggggaacagaggagaccccagatgagtgaccctaacctggcggcagcgcaaaagatg

SEQ ID NO: 145755 - DNA, 103 bp, Artificial Sequence
  Synthetic Polynucleotide
taatacgactcactatagggggtcctcacggggcgcccatacaagagaccaacagaggagaggtctcatgtatgggcgcaacctggcggcagcgcaaaagatg

SEQ ID NO: 145756 - DNA, 103 bp, Artificial Sequence
  Synthetic Polynucleotide
taatacgactcactataggggaatccacaggttcatggcatcagggtcacaacagaggagagtgaccatgatgccatgaaacctggcggcagcgcaaaagatg

SEQ ID NO: 145757 - DNA, 103 bp, Artificial Sequence
  Synthetic Polynucleotide
taatacgactcactataggggaggaagagggaatccacaggttcatggcaaacagaggagatgccatatgcctgtggataacctggcggcagcgcaaaagatg

SEQ ID NO: 145758 - DNA, 103 bp, Artificial Sequence
  Synthetic Polynucleotide
taatacgactcactatagggttctgctagggaggaagagggaatccacagaacagaggagactgtggatgccctcttccaacctggcggcagcgcaaaagatg

SEQ ID NO: 145759 - DNA, 103 bp, Artificial Sequence
  Synthetic Polynucleotide
taatacgactcactataggggatctatcccttctgctagggaggaagaggaacagaggagacctcttatgccctagcagaacctggcggcagcgcaaaagatg

SEQ ID NO: 145760 - DNA, 103 bp, Artificial Sequence
  Synthetic Polynucleotide
taatacgactcactataggggaggtctctagatctatcccttctgctaggaacagaggagacctagcatgagggatagaaacctggcggcagcgcaaaagatg

SEQ ID NO: 145761 - DNA, 103 bp, Artificial Sequence
  Synthetic Polynucleotide
taatacgactcactataggggatgtattttgaggtctctagatctatcccaacagaggagagggataatgctagagaccaacctggcggcagcgcaaaagatg

SEQ ID NO: 145762 - DNA, 103 bp, Artificial Sequence
  Synthetic Polynucleotide
taatacgactcactatagggcattggccaggatgtattttgaggtctctaaacagaggagatagagaatgcaaaatacaaacctggcggcagcgcaaaagatg

SEQ ID NO: 145763 - DNA, 103 bp, Artificial Sequence
  Synthetic Polynucleotide
taatacgactcactatagggtggtccccaacattggccaggatgtattttaacagaggagaaaaataatgcctggccaaaacctggcggcagcgcaaaagatg

SEQ ID NO: 145764 - DNA, 103 bp, Artificial Sequence
  Synthetic Polynucleotide
taatacgactcactatagggctggcagaactggtccccaacattggccagaacagaggagactggccatggttggggacaacctggcggcagcgcaaaagatg

SEQ ID NO: 145765 - DNA, 103 bp, Artificial Sequence
  Synthetic Polynucleotide
taatacgactcactatagggacattacgagctggcagaactggtccccaaaacagaggagattggggatgagttctgccaacctggcggcagcgcaaaagatg

SEQ ID NO: 145766 - DNA, 103 bp, Artificial Sequence
  Synthetic Polynucleotide
taatacgactcactatagggaacagcagcagcagccgcttgcccaccgggaacagaggagacccggtatgcaagcggctaacctggcggcagcgcaaaagatg

SEQ ID NO: 145767 - DNA, 103 bp, Artificial Sequence
  Synthetic Polynucleotide
taatacgactcactatagggagaaggactgggtcctcacggggcgcccataacagaggagaatgggcatgccgtgaggaaacctggcggcagcgcaaaagatg

SEQ ID NO: 145768 - DNA, 103 bp, Artificial Sequence
  Synthetic Polynucleotide
taatacgactcactatagggtccttctcagacattacgagctggcagaacaacagaggagagttctgatggctcgtaataacctggcggcagcgcaaaagatg

SEQ ID NO: 145769 - DNA, 103 bp, Artificial Sequence
  Synthetic Polynucleotide
taatacgactcactatagggcatcatggcctccttctcagacattacgagaacagaggagactcgtaatgtctgagaagaacctggcggcagcgcaaaagatg

SEQ ID NO: 145770 - DNA, 103 bp, Artificial Sequence
  Synthetic Polynucleotide
taatacgactcactataggggctccaccatcatcatggcctccttctcagaacagaggagactgagaatgaggccatgaaacctggcggcagcgcaaaagatg

SEQ ID NO: 145771 - DNA, 103 bp, Artificial Sequence
  Synthetic Polynucleotide
taatacgactcactatagggttctggtgtggctccaccatcatcatggccaacagaggagaggccatatggatggtggaaacctggcggcagcgcaaaagatg

SEQ ID NO: 145772 - DNA, 103 bp, Artificial Sequence
  Synthetic Polynucleotide
taatacgactcactatagggccatgccactttctggtgtggctccaccataacagaggagaatggtgatgccacaccagaacctggcggcagcgcaaaagatg

SEQ ID NO: 145773 - DNA, 103 bp, Artificial Sequence
  Synthetic Polynucleotide
taatacgactcactatagggcagctcgcttccatgccactttctggtgtgaacagaggagacacaccatgaagtggcataacctggcggcagcgcaaaagatg

SEQ ID NO: 145774 - DNA, 103 bp, Artificial Sequence
  Synthetic Polynucleotide
taatacgactcactatagggacaccacgcacagctcgcttccatgccactaacagaggagaagtggcatggaagcgagcaacctggcggcagcgcaaaagatg

SEQ ID NO: 145775 - DNA, 103 bp, Artificial Sequence
  Synthetic Polynucleotide
taatacgactcactatagggcatctcccgtacaccacgcacagctcgcttaacagaggagaaagcgaatggtgcgtggtaacctggcggcagcgcaaaagatg

SEQ ID NO: 145776 - DNA, 103 bp, Artificial Sequence
  Synthetic Polynucleotide
taatacgactcactatagggacacatcacacatctcccgtacaccacgcaaacagaggagatgcgtgatgtacgggagaaacctggcggcagcgcaaaagatg

SEQ ID NO: 145777 - DNA, 103 bp, Artificial Sequence
  Synthetic Polynucleotide
taatacgactcactataggggttgtttcacacacatcacacatctcccgtaacagaggagaacgggaatggtgtgatgtaacctggcggcagcgcaaaagatg

SEQ ID NO: 145778 - DNA, 103 bp, Artificial Sequence
  Synthetic Polynucleotide
taatacgactcactatagggaatgccctggagaaggactgggtcctcacgaacagaggagacgtgagatgccagtccttaacctggcggcagcgcaaaagatg

SEQ ID NO: 145779 - DNA, 103 bp, Artificial Sequence
  Synthetic Polynucleotide
taatacgactcactataggggttgaagagagttgtttcacacacatcacaaacagaggagatgtgatatgtgtgaaacaaacctggcggcagcgcaaaagatg

SEQ ID NO: 145780 - DNA, 103 bp, Artificial Sequence
  Synthetic Polynucleotide
taatacgactcactatagggcccagtggatgttgaagagagttgtttcacaacagaggagagtgaaaatgctctcttcaaacctggcggcagcgcaaaagatg

SEQ ID NO: 145781 - DNA, 103 bp, Artificial Sequence
  Synthetic Polynucleotide
taatacgactcactatagggttgcgacaaacccagtggatgttgaagagaaacagaggagatctcttatgcatccactgaacctggcggcagcgcaaaagatg

SEQ ID NO: 145782 - DNA, 103 bp, Artificial Sequence
  Synthetic Polynucleotide
taatacgactcactatagggaaatccacatttgcgacaaacccagtggataacagaggagaatccacatggtttgtcgcaacctggcggcagcgcaaaagatg

SEQ ID NO: 145783 - DNA, 103 bp, Artificial Sequence
  Synthetic Polynucleotide
taatacgactcactatagggggcagaccccaaatccacatttgcgacaaaaacagaggagatttgtcatgaatgtggataacctggcggcagcgcaaaagatg

SEQ ID NO: 145784 - DNA, 103 bp, Artificial Sequence
  Synthetic Polynucleotide
taatacgactcactatagggtaacagtcaaggcagaccccaaatccacataacagaggagaatgtggatgtggggtctgaacctggcggcagcgcaaaagatg

SEQ ID NO: 145785 - DNA, 103 bp, Artificial Sequence
  Synthetic Polynucleotide
taatacgactcactatagggcctgagccggtaacagtcaaggcagaccccaacagaggagaggggtcatgcttgactgtaacctggcggcagcgcaaaagatg

SEQ ID NO: 145786 - DNA, 103 bp, Artificial Sequence
  Synthetic Polynucleotide
taatacgactcactataggggccggcttttcctgagccggtaacagtcaaaacagaggagattgactatgaccggctcaaacctggcggcagcgcaaaagatg

SEQ ID NO: 145787 - DNA, 103 bp, Artificial Sequence
  Synthetic Polynucleotide
taatacgactcactatagggtcactgcgtggccggcttttcctgagccggaacagaggagaccggctatggaaaagccgaacctggcggcagcgcaaaagatg

SEQ ID NO: 145788 - DNA, 103 bp, Artificial Sequence
  Synthetic Polynucleotide
taatacgactcactatagggctcttctgtctcactgcgtggccggcttttaacagaggagaaaaagcatgccacgcagtaacctggcggcagcgcaaaagatg

SEQ ID NO: 145789 - DNA, 103 bp, Artificial Sequence
  Synthetic Polynucleotide
taatacgactcactatagggtggagactcgaatgccctggagaaggactgaacagaggagacagtccatgtccagggcaaacctggcggcagcgcaaaagatg

SEQ ID NO: 145790 - DNA, 103 bp, Artificial Sequence
  Synthetic Polynucleotide
taatacgactcactatagggcatcacccatctcttctgtctcactgcgtgaacagaggagacacgcaatgagacagaagaacctggcggcagcgcaaaagatg

SEQ ID NO: 145791 - DNA, 103 bp, Artificial Sequence
  Synthetic Polynucleotide
taatacgactcactatagggaaaacttcttcatcacccatctcttctgtcaacagaggagagacagaatggatgggtgaaacctggcggcagcgcaaaagatg

SEQ ID NO: 145792 - DNA, 103 bp, Artificial Sequence
  Synthetic Polynucleotide
taatacgactcactatagggcaaccaggagaaaacttcttcatcacccataacagaggagaatgggtatggaagaagttaacctggcggcagcgcaaaagatg

SEQ ID NO: 145793 - DNA, 103 bp, Artificial Sequence
  Synthetic Polynucleotide
taatacgactcactatagggttgcacacttcaaccaggagaaaacttcttaacagaggagaaagaagatgtctcctggtaacctggcggcagcgcaaaagatg

SEQ ID NO: 145794 - DNA, 103 bp, Artificial Sequence
  Synthetic Polynucleotide
taatacgactcactataggggactgtccctttgcacacttcaaccaggagaacagaggagactcctgatggaagtgtgcaacctggcggcagcgcaaaagatg

SEQ ID NO: 145795 - DNA, 103 bp, Artificial Sequence
  Synthetic Polynucleotide
taatacgactcactatagggtggttcgtgggactgtccctttgcacacttaacagaggagaaagtgtatgaagggacagaacctggcggcagcgcaaaagatg

SEQ ID NO: 145796 - DNA, 103 bp, Artificial Sequence
  Synthetic Polynucleotide
taatacgactcactatagggtgagattctctggttcgtgggactgtccctaacagaggagaagggacatgcccacgaacaacctggcggcagcgcaaaagatg

SEQ ID NO: 145797 - DNA, 103 bp, Artificial Sequence
  Synthetic Polynucleotide
taatacgactcactatagggtgtgtgggcatgagattctctggttcgtggaacagaggagaccacgaatgagagaatctaacctggcggcagcgcaaaagatg

SEQ ID NO: 145798 - DNA, 103 bp, Artificial Sequence
  Synthetic Polynucleotide
taatacgactcactatagggaggaataatttgtgtgggcatgagattctcaacagaggagagagaatatgatgcccacaaacctggcggcagcgcaaaagatg

SEQ ID NO: 145799 - DNA, 103 bp, Artificial Sequence
  Synthetic Polynucleotide
taatacgactcactataggggagctgtgccaggaataatttgtgtgggcaaacagaggagatgcccaatgaaattattcaacctggcggcagcgcaaaagatg

SEQ ID NO: 145800 - DNA, 103 bp, Artificial Sequence
  Synthetic Polynucleotide
taatacgactcactatagggcattgtgcaatggagactcgaatgccctggaacagaggagaccagggatgtcgagtctcaacctggcggcagcgcaaaagatg

SEQ ID NO: 145801 - DNA, 103 bp, Artificial Sequence
  Synthetic Polynucleotide
taatacgactcactatagggatattgtaaagagctgtgccaggaataattaacagaggagaaattatatgtggcacagcaacctggcggcagcgcaaaagatg

SEQ ID NO: 145802 - DNA, 103 bp, Artificial Sequence
  Synthetic Polynucleotide
taatacgactcactatagggcatgtctccaatattgtaaagagctgtgccaacagaggagaggcacaatgctttacaataacctggcggcagcgcaaaagatg

SEQ ID NO: 145803 - DNA, 103 bp, Artificial Sequence
  Synthetic Polynucleotide
taatacgactcactatagggcagcatgtaccatgtctccaatattgtaaaaacagaggagatttacaatgttggagacaaacctggcggcagcgcaaaagatg

SEQ ID NO: 145804 - DNA, 103 bp, Artificial Sequence
  Synthetic Polynucleotide
taatacgactcactatagggttgccccgggcagcatgtaccatgtctccaaacagaggagatggagaatgggtacatgcaacctggcggcagcgcaaaagatg

SEQ ID NO: 145805 - DNA, 103 bp, Artificial Sequence
  Synthetic Polynucleotide
taatacgactcactatagggaattccccacttgccccgggcagcatgtacaacagaggagagtacatatggcccggggcaacctggcggcagcgcaaaagatg

SEQ ID NO: 145806 - DNA, 103 bp, Artificial Sequence
  Synthetic Polynucleotide
taatacgactcactatagggagtttgctttaattccccacttgccccgggaacagaggagacccgggatgagtggggaaaacctggcggcagcgcaaaagatg

SEQ ID NO: 145807 - DNA, 103 bp, Artificial Sequence
  Synthetic Polynucleotide
taatacgactcactatagggatacaagggcagtttgctttaattccccacaacagaggagagtggggatgtaaagcaaaaacctggcggcagcgcaaaagatg

SEQ ID NO: 145808 - DNA, 103 bp, Artificial Sequence
  Synthetic Polynucleotide
taatacgactcactatagggctgtcgactgatacaagggcagtttgctttaacagaggagaaaagcaatgtgcccttgtaacctggcggcagcgcaaaagatg

SEQ ID NO: 145809 - DNA, 103 bp, Artificial Sequence
  Synthetic Polynucleotide
taatacgactcactatagggcagatttgttctgtcgactgatacaagggcaacagaggagagcccttatgtcagtcgacaacctggcggcagcgcaaaagatg

SEQ ID NO: 145810 - DNA, 103 bp, Artificial Sequence
  Synthetic Polynucleotide
taatacgactcactatagggggtctcaatacagatttgttctgtcgactgaacagaggagacagtcgatggaacaaatcaacctggcggcagcgcaaaagatg

SEQ ID NO: 145811 - DNA, 103 bp, Artificial Sequence
  Synthetic Polynucleotide
taatacgactcactatagggcagggctggccattgtgcaatggagactcgaacagaggagacgagtcatgattgcacaaaacctggcggcagcgcaaaagatg

SEQ ID NO: 145812 - DNA, 103 bp, Artificial Sequence
  Synthetic Polynucleotide
taatacgactcactatagggggtgacggcaggtctcaatacagatttgttaacagaggagaaacaaaatggtattgagaaacctggcggcagcgcaaaagatg

SEQ ID NO: 145813 - DNA, 103 bp, Artificial Sequence
  Synthetic Polynucleotide
taatacgactcactatagggacatcccattggtgacggcaggtctcaataaacagaggagatattgaatgctgccgtcaaacctggcggcagcgcaaaagatg

SEQ ID NO: 145814 - DNA, 103 bp, Artificial Sequence
  Synthetic Polynucleotide
taatacgactcactatagggggaagctgtgacatcccattggtgacggcaaacagaggagatgccgtatgcaatgggataacctggcggcagcgcaaaagatg

SEQ ID NO: 145815 - DNA, 103 bp, Artificial Sequence
  Synthetic Polynucleotide
taatacgactcactataggggtttatgctaggaagctgtgacatcccattaacagaggagaaatgggatgtcacagcttaacctggcggcagcgcaaaagatg

SEQ ID NO: 145816 - DNA, 103 bp, Artificial Sequence
  Synthetic Polynucleotide
taatacgactcactatagggaggcactagggtttatgctaggaagctgtgaacagaggagacacagcatgctagcataaaacctggcggcagcgcaaaagatg

SEQ ID NO: 145817 - DNA, 103 bp, Artificial Sequence
  Synthetic Polynucleotide
taatacgactcactatagggtttccagaagaggcactagggtttatgctaaacagaggagatagcatatgccctagtgcaacctggcggcagcgcaaaagatg

SEQ ID NO: 145818 - DNA, 103 bp, Artificial Sequence
  Synthetic Polynucleotide
taatacgactcactatagggggtagtttcgtttccagaagaggcactaggaacagaggagacctagtatgtcttctggaaacctggcggcagcgcaaaagatg

SEQ ID NO: 145819 - DNA, 103 bp, Artificial Sequence
  Synthetic Polynucleotide
taatacgactcactatagggcaccagagaaggtagtttcgtttccagaagaacagaggagacttctgatgacgaaactaaacctggcggcagcgcaaaagatg

SEQ ID NO: 145820 - DNA, 103 bp, Artificial Sequence
  Synthetic Polynucleotide
taatacgactcactatagggggtcctcctccaccagagaaggtagtttcgaacagaggagacgaaacatgcttctctggaacctggcggcagcgcaaaagatg

SEQ ID NO: 145821 - DNA, 103 bp, Artificial Sequence
  Synthetic Polynucleotide
taatacgactcactatagggtactggtgccggtcctcctccaccagagaaaacagaggagattctctatgggaggaggaaacctggcggcagcgcaaaagatg

SEQ ID NO: 145822 - DNA, 103 bp, Artificial Sequence
  Synthetic Polynucleotide
taatacgactcactataggggagtaaaagtcagggctggccattgtgcaaaacagaggagattgcacatgggccagcccaacctggcggcagcgcaaaagatg

SEQ ID NO: 145823 - DNA, 103 bp, Artificial Sequence
  Synthetic Polynucleotide
taatacgactcactatagggctggagttgttactggtgccggtcctcctcaacagaggagagaggagatgcggcaccagaacctggcggcagcgcaaaagatg

SEQ ID NO: 145824 - DNA, 103 bp, Artificial Sequence
  Synthetic Polynucleotide
taatacgactcactatagggtggtccggctctggagttgttactggtgccaacagaggagaggcaccatgaacaactccaacctggcggcagcgcaaaagatg

SEQ ID NO: 145825 - DNA, 103 bp, Artificial Sequence
  Synthetic Polynucleotide
taatacgactcactatagggtttgggaacatggtccggctctggagttgtaacagaggagaacaactatggagccggacaacctggcggcagcgcaaaagatg

SEQ ID NO: 145826 - DNA, 103 bp, Artificial Sequence
  Synthetic Polynucleotide
taatacgactcactatagggtgctgtcggctttgggaacatggtccggctaacagaggagaagccggatgatgttcccaaacctggcggcagcgcaaaagatg

SEQ ID NO: 145827 - DNA, 103 bp, Artificial Sequence
  Synthetic Polynucleotide
taatacgactcactatagggctgatgtcagtgctgtcggctttgggaacaaacagaggagatgttccatgagccgacagaacctggcggcagcgcaaaagatg

SEQ ID NO: 145828 - DNA, 103 bp, Artificial Sequence
  Synthetic Polynucleotide
taatacgactcactatagggctcttcagatctgatgtcagtgctgtcggcaacagaggagagccgacatgactgacatcaacctggcggcagcgcaaaagatg

SEQ ID NO: 145829 - DNA, 103 bp, Artificial Sequence
  Synthetic Polynucleotide
taatacgactcactatagggttttcagaggctcttcagatctgatgtcagaacagaggagactgacaatggatctgaagaacctggcggcagcgcaaaagatg

SEQ ID NO: 145830 - DNA, 103 bp, Artificial Sequence
  Synthetic Polynucleotide
taatacgactcactataggggaactgtctgttttcagaggctcttcagataacagaggagaatctgaatggcctctgaaaacctggcggcagcgcaaaagatg

SEQ ID NO: 145831 - DNA, 103 bp, Artificial Sequence
  Synthetic Polynucleotide
taatacgactcactatagggatttgatgccgaactgtctgttttcagaggaacagaggagacctctgatgacagacagtaacctggcggcagcgcaaaagatg

SEQ ID NO: 145832 - DNA, 103 bp, Artificial Sequence
  Synthetic Polynucleotide
taatacgactcactatagggcactattgctatttgatgccgaactgtctgaacagaggagacagacaatgcggcatcaaaacctggcggcagcgcaaaagatg

SEQ ID NO: 145833 - DNA, 103 bp, Artificial Sequence
  Synthetic Polynucleotide
taatacgactcactatagggtctacaaggggagtaaaagtcagggctggcaacagaggagagccagcatggacttttacaacctggcggcagcgcaaaagatg

SEQ ID NO: 145834 - DNA, 103 bp, Artificial Sequence
  Synthetic Polynucleotide
taatacgactcactataggggctttcagttcactattgctatttgatgccaacagaggagaggcatcatgtagcaatagaacctggcggcagcgcaaaagatg

SEQ ID NO: 145835 - DNA, 103 bp, Artificial Sequence
  Synthetic Polynucleotide
taatacgactcactatagggaggcctgatggctttcagttcactattgctaacagaggagaagcaatatggaactgaaaaacctggcggcagcgcaaaagatg

SEQ ID NO: 145836 - DNA, 103 bp, Artificial Sequence
  Synthetic Polynucleotide
taatacgactcactatagggcagggcaaggaggcctgatggctttcagttaacagaggagaaactgaatgccatcaggcaacctggcggcagcgcaaaagatg

SEQ ID NO: 145837 - DNA, 103 bp, Artificial Sequence
  Synthetic Polynucleotide
taatacgactcactatagggggggccgtgtcagggcaaggaggcctgatgaacagaggagacatcagatgtccttgcccaacctggcggcagcgcaaaagatg

SEQ ID NO: 145838 - DNA, 103 bp, Artificial Sequence
  Synthetic Polynucleotide
taatacgactcactatagggggaggagggtggggccgtgtcagggcaaggaacagaggagaccttgcatggacacggccaacctggcggcagcgcaaaagatg

SEQ ID NO: 145839 - DNA, 103 bp, Artificial Sequence
  Synthetic Polynucleotide
taatacgactcactatagggagtgcagggcggaggagggtggggccgtgtaacagaggagaacacggatgcaccctcctaacctggcggcagcgcaaaagatg

SEQ ID NO: 145840 - DNA, 103 bp, Artificial Sequence
  Synthetic Polynucleotide
taatacgactcactatagggtctgccaaccagtgcagggcggaggagggtaacagaggagaaccctcatgcgccctgcaaacctggcggcagcgcaaaagatg

SEQ ID NO: 145841 - DNA, 103 bp, Artificial Sequence
  Synthetic Polynucleotide
taatacgactcactatagggagttgctaaatctgccaaccagtgcagggcaacagaggagagccctgatgtggttggcaaacctggcggcagcgcaaaagatg

SEQ ID NO: 145842 - DNA, 103 bp, Artificial Sequence
  Synthetic Polynucleotide
taatacgactcactatagggtagccttctgagttgctaaatctgccaaccaacagaggagaggttggatgatttagcaaaacctggcggcagcgcaaaagatg

SEQ ID NO: 145843 - DNA, 103 bp, Artificial Sequence
  Synthetic Polynucleotide
taatacgactcactataggggtttcttctttagccttctgagttgctaaaaacagaggagatttagcatgtcagaaggcaacctggcggcagcgcaaaagatg

SEQ ID NO: 145844 - DNA, 103 bp, Artificial Sequence
  Synthetic Polynucleotide
taatacgactcactatagggacccagtttatctacaaggggagtaaaagtaacagaggagaacttttatgccccttgtaaacctggcggcagcgcaaaagatg

SEQ ID NO: 145845 - DNA, 103 bp, Artificial Sequence
  Synthetic Polynucleotide
taatacgactcactatagggtgcttcttttgtttcttctttagccttctgaacagaggagacagaagatgaaagaagaaaacctggcggcagcgcaaaagatg

SEQ ID NO: 145846 - DNA, 103 bp, Artificial Sequence
  Synthetic Polynucleotide
taatacgactcactatagggtcagggaccctgcttcttttgtttcttcttaacagaggagaaagaagatgcaaaagaagaacctggcggcagcgcaaaagatg

SEQ ID NO: 145847 - DNA, 103 bp, Artificial Sequence
  Synthetic Polynucleotide
taatacgactcactatagggagcaccgacctcagggaccctgcttcttttaacagaggagaaaaagaatgagggtccctaacctggcggcagcgcaaaagatg

SEQ ID NO: 145848 - DNA, 103 bp, Artificial Sequence
  Synthetic Polynucleotide
taatacgactcactatagggctctttattgagcaccgacctcagggacccaacagaggagagggtccatgaggtcggtgaacctggcggcagcgcaaaagatg

SEQ ID NO: 145849 - DNA, 103 bp, Artificial Sequence
  Synthetic Polynucleotide
taatacgactcactataggggtgaatgagactctttattgagcaccgaccaacagaggagaggtcggatgtcaataaagaacctggcggcagcgcaaaagatg

SEQ ID NO: 145850 - DNA, 103 bp, Artificial Sequence
  Synthetic Polynucleotide
taatacgactcactatagggagcccaaagggtgaatgagactctttattgaacagaggagacaataaatggtctcattcaacctggcggcagcgcaaaagatg

SEQ ID NO: 145851 - DNA, 103 bp, Artificial Sequence
  Synthetic Polynucleotide
taatacgactcactataggggaacgagtccagcccaaagggtgaatgagaaacagaggagatctcatatgccctttgggaacctggcggcagcgcaaaagatg

SEQ ID NO: 145852 - DNA, 103 bp, Artificial Sequence
  Synthetic Polynucleotide
taatacgactcactatagggcagtggagttgaacgagtccagcccaaaggaacagaggagacctttgatgtggactcgtaacctggcggcagcgcaaaagatg

SEQ ID NO: 145853 - DNA, 103 bp, Artificial Sequence
  Synthetic Polynucleotide
taatacgactcactataggggagacctttgcagtggagttgaacgagtccaacagaggagaggactcatgcaactccacaacctggcggcagcgcaaaagatg

SEQ ID NO: 145854 - DNA, 103 bp, Artificial Sequence
  Synthetic Polynucleotide
taatacgactcactatagggagtcagcggagagacctttgcagtggagttaacagaggagaaactccatggcaaaggtcaacctggcggcagcgcaaaagatg

SEQ ID NO: 145855 - DNA, 103 bp, Artificial Sequence
  Synthetic Polynucleotide
taatacgactcactatagggcagaacccaaacccagtttatctacaagggaacagaggagacccttgatgataaactggaacctggcggcagcgcaaaagatg

SEQ ID NO: 145856 - DNA, 103 bp, Artificial Sequence
  Synthetic Polynucleotide
taatacgactcactatagggaaagctttggagtcagcggagagacctttgaacagaggagacaaaggatgctccgctgaaacctggcggcagcgcaaaagatg

SEQ ID NO: 145857 - DNA, 103 bp, Artificial Sequence
  Synthetic Polynucleotide
taatacgactcactatagggagactgttaaaaagctttggagtcagcggaaacagaggagatccgctatgtccaaagctaacctggcggcagcgcaaaagatg

SEQ ID NO: 145858 - DNA, 103 bp, Artificial Sequence
  Synthetic Polynucleotide
taatacgactcactatagggacccagcaacagactgttaaaaagctttggaacagaggagaccaaagatgtttaacagtaacctggcggcagcgcaaaagatg

SEQ ID NO: 145859 - DNA, 103 bp, Artificial Sequence
  Synthetic Polynucleotide
taatacgactcactatagggaggcagtgggacccagcaacagactgttaaaacagaggagattaacaatgtgttgctggaacctggcggcagcgcaaaagatg

SEQ ID NO: 145860 - DNA, 103 bp, Artificial Sequence
  Synthetic Polynucleotide
taatacgactcactatagggttgttgttggaggcagtgggacccagcaacaacagaggagagttgctatgtcccactgcaacctggcggcagcgcaaaagatg

SEQ ID NO: 145861 - DNA, 103 bp, Artificial Sequence
  Synthetic Polynucleotide
taatacgactcactatagggcccttcggttttgttgttggaggcagtgggaacagaggagacccactatgtccaacaacaacctggcggcagcgcaaaagatg

SEQ ID NO: 145862 - DNA, 103 bp, Artificial Sequence
  Synthetic Polynucleotide
taatacgactcactataggggaaggctagacccttcggttttgttgttggaacagaggagaccaacaatgaaaccgaagaacctggcggcagcgcaaaagatg

SEQ ID NO: 145863 - DNA, 103 bp, Artificial Sequence
  Synthetic Polynucleotide
taatacgactcactatagggaggaggtctcgaaggctagacccttcggttaacagaggagaaaccgaatggtctagcctaacctggcggcagcgcaaaagatg

SEQ ID NO: 145864 - DNA, 103 bp, Artificial Sequence
  Synthetic Polynucleotide
taatacgactcactatagggcccggagtgaaggaggtctcgaaggctagaaacagaggagatctagcatgcgagacctcaacctggcggcagcgcaaaagatg

SEQ ID NO: 145865 - DNA, 103 bp, Artificial Sequence
  Synthetic Polynucleotide
taatacgactcactataggggttttcccggcccggagtgaaggaggtctcaacagaggagagagaccatgttcactccgaacctggcggcagcgcaaaagatg

SEQ ID NO: 145866 - DNA, 103 bp, Artificial Sequence
  Synthetic Polynucleotide
taatacgactcactatagggactggaaccacagaacccaaacccagtttaaacagaggagataaactatgtttgggttcaacctggcggcagcgcaaaagatg

SEQ ID NO: 145867 - DNA, 103 bp, Artificial Sequence
  Synthetic Polynucleotide
taatacgactcactataggggtttgaggaagttttcccggcccggagtgaaacagaggagatcactcatggccgggaaaaacctggcggcagcgcaaaagatg

SEQ ID NO: 145868 - DNA, 103 bp, Artificial Sequence
  Synthetic Polynucleotide
taatacgactcactataggggtccaagggggtttgaggaagttttcccggaacagaggagaccgggaatgcttcctcaaaacctggcggcagcgcaaaagatg

SEQ ID NO: 145869 - DNA, 103 bp, Artificial Sequence
  Synthetic Polynucleotide
taatacgactcactataggggtatgcctgtgtccaagggggtttgaggaaaacagaggagattcctcatgcccccttggaacctggcggcagcgcaaaagatg

SEQ ID NO: 145870 - DNA, 103 bp, Artificial Sequence
  Synthetic Polynucleotide
taatacgactcactataggggggggaaagggtatgcctgtgtccaaggggaacagaggagaccccttatgcacaggcataacctggcggcagcgcaaaagatg

SEQ ID NO: 145871 - DNA, 103 bp, Artificial Sequence
  Synthetic Polynucleotide
taatacgactcactatagggagagaagaccgggggaaagggtatgcctgtaacagaggagaacaggcatgccctttcccaacctggcggcagcgcaaaagatg

SEQ ID NO: 145872 - DNA, 103 bp, Artificial Sequence
  Synthetic Polynucleotide
taatacgactcactatagggctgaggatgtagagaagaccgggggaaaggaacagaggagacctttcatgcggtcttctaacctggcggcagcgcaaaagatg

SEQ ID NO: 145873 - DNA, 103 bp, Artificial Sequence
  Synthetic Polynucleotide
taatacgactcactatagggttcactcctgctgaggatgtagagaagaccaacagaggagaggtcttatgtacatcctcaacctggcggcagcgcaaaagatg

SEQ ID NO: 145874 - DNA, 103 bp, Artificial Sequence
  Synthetic Polynucleotide
taatacgactcactatagggggccttgctcttcactcctgctgaggatgtaacagaggagaacatccatggcaggagtgaacctggcggcagcgcaaaagatg

SEQ ID NO: 145875 - DNA, 103 bp, Artificial Sequence
  Synthetic Polynucleotide
taatacgactcactatagggtgggtaggctggccttgctcttcactcctgaacagaggagacaggagatgagagcaaggaacctggcggcagcgcaaaagatg

SEQ ID NO: 145876 - DNA, 103 bp, Artificial Sequence
  Synthetic Polynucleotide
taatacgactcactatagggtcaagaaagttgggtaggctggccttgctcaacagaggagagagcaaatgcagcctaccaacctggcggcagcgcaaaagatg

SEQ ID NO: 145877 - DNA, 103 bp, Artificial Sequence
  Synthetic Polynucleotide
taatacgactcactatagggagtgtccgcgaacagcagcagcagccgcttaacagaggagaaagcggatgctgctgctgaacctggcggcagcgcaaaagatg

SEQ ID NO: 145878 - DNA, 103 bp, Artificial Sequence
  Synthetic Polynucleotide
taatacgactcactatagggaagatattccactggaaccacagaacccaaaacagaggagattgggtatggtggttccaaacctggcggcagcgcaaaagatg

SEQ ID NO: 145879 - DNA, 103 bp, Artificial Sequence
  Synthetic Polynucleotide
taatacgactcactatagggaatgatgtggtcaagaaagttgggtaggctaacagaggagaagcctaatgaactttcttaacctggcggcagcgcaaaagatg

SEQ ID NO: 145880 - DNA, 103 bp, Artificial Sequence
  Synthetic Polynucleotide
taatacgactcactatagggccactgaggcaatgatgtggtcaagaaagtaacagaggagaactttcatgaccacatcaaacctggcggcagcgcaaaagatg

SEQ ID NO: 145881 - DNA, 103 bp, Artificial Sequence
  Synthetic Polynucleotide
taatacgactcactatagggttattttctaccactgaggcaatgatgtggaacagaggagaccacatatgtgcctcagtaacctggcggcagcgcaaaagatg

SEQ ID NO: 145882 - DNA, 103 bp, Artificial Sequence
  Synthetic Polynucleotide
taatacgactcactatagggtgaggttttcttattttctaccactgaggcaacagaggagagcctcaatggtagaaaataacctggcggcagcgcaaaagatg

SEQ ID NO: 145883 - DNA, 103 bp, Artificial Sequence
  Synthetic Polynucleotide
taatacgactcactatagggttgaagcatctgaggttttcttattttctaaacagaggagatagaaaatgagaaaacctaacctggcggcagcgcaaaagatg

SEQ ID NO: 145884 - DNA, 103 bp, Artificial Sequence
  Synthetic Polynucleotide
taatacgactcactatagggcaggcccgctttgaagcatctgaggttttcaacagaggagagaaaacatgagatgcttcaacctggcggcagcgcaaaagatg

SEQ ID NO: 145885 - DNA, 103 bp, Artificial Sequence
  Synthetic Polynucleotide
taatacgactcactatagggagtcaagttgcaggcccgctttgaagcatcaacagaggagagatgctatgaagcgggccaacctggcggcagcgcaaaagatg

SEQ ID NO: 145886 - DNA, 103 bp, Artificial Sequence
  Synthetic Polynucleotide
taatacgactcactatagggtctgggtatcagtcaagttgcaggcccgctaacagaggagaagcgggatggcaacttgaaacctggcggcagcgcaaaagatg

SEQ ID NO: 145887 - DNA, 103 bp, Artificial Sequence
  Synthetic Polynucleotide
taatacgactcactatagggttcacttccttctgggtatcagtcaagttgaacagaggagacaacttatgtgatacccaaacctggcggcagcgcaaaagatg

SEQ ID NO: 145888 - DNA, 103 bp, Artificial Sequence
  Synthetic Polynucleotide
taatacgactcactatagggcaccatctccttcacttccttctgggtatcaacagaggagagataccatgaaggaagtgaacctggcggcagcgcaaaagatg

SEQ ID NO: 145889 - DNA, 103 bp, Artificial Sequence
  Synthetic Polynucleotide
taatacgactcactatagggctcgatccagaagatattccactggaaccaaacagaggagatggttcatgtggaatatcaacctggcggcagcgcaaaagatg

SEQ ID NO: 145890 - DNA, 103 bp, Artificial Sequence
  Synthetic Polynucleotide
taatacgactcactatagggttaaccccatcaccatctccttcacttcctaacagaggagaaggaagatgaggagatggaacctggcggcagcgcaaaagatg

SEQ ID NO: 145891 - DNA, 103 bp, Artificial Sequence
  Synthetic Polynucleotide
taatacgactcactatagggtctagcacatttaaccccatcaccatctccaacagaggagaggagatatggatggggttaacctggcggcagcgcaaaagatg

SEQ ID NO: 145892 - DNA, 103 bp, Artificial Sequence
  Synthetic Polynucleotide
taatacgactcactatagggagtatggggatctagcacatttaaccccataacagaggagaatggggatgaatgtgctaaacctggcggcagcgcaaaagatg

SEQ ID NO: 145893 - DNA, 103 bp, Artificial Sequence
  Synthetic Polynucleotide
taatacgactcactatagggaggagtgagaagtatggggatctagcacataacagaggagaatgtgcatgatccccataaacctggcggcagcgcaaaagatg

SEQ ID NO: 145894 - DNA, 103 bp, Artificial Sequence
  Synthetic Polynucleotide
taatacgactcactatagggtcacaaagccaggagtgagaagtatggggaaacagaggagatccccaatgttctcactcaacctggcggcagcgcaaaagatg

SEQ ID NO: 145895 - DNA, 103 bp, Artificial Sequence
  Synthetic Polynucleotide
taatacgactcactatagggaagcctcccatcacaaagccaggagtgagaaacagaggagatctcacatgtggctttgtaacctggcggcagcgcaaaagatg

SEQ ID NO: 145896 - DNA, 103 bp, Artificial Sequence
  Synthetic Polynucleotide
taatacgactcactatagggggagacacagaagcctcccatcacaaagccaacagaggagaggctttatgatgggaggcaacctggcggcagcgcaaaagatg

SEQ ID NO: 145897 - DNA, 103 bp, Artificial Sequence
  Synthetic Polynucleotide
taatacgactcactatagggctggggtcatggagacacagaagcctcccaaacagaggagatgggagatgtctgtgtctaacctggcggcagcgcaaaagatg

SEQ ID NO: 145898 - DNA, 103 bp, Artificial Sequence
  Synthetic Polynucleotide
taatacgactcactataggggtttttgttgctggggtcatggagacacagaacagaggagactgtgtatgcatgaccccaacctggcggcagcgcaaaagatg

SEQ ID NO: 145899 - DNA, 103 bp, Artificial Sequence
  Synthetic Polynucleotide
taatacgactcactatagggtcttccaattgtttttgttgctggggtcataacagaggagaatgaccatggcaacaaaaaacctggcggcagcgcaaaagatg

SEQ ID NO: 145900 - DNA, 103 bp, Artificial Sequence
  Synthetic Polynucleotide
taatacgactcactatagggaaccgaagctctcgatccagaagatattccaacagaggagaggaataatgtctggatcgaacctggcggcagcgcaaaagatg

SEQ ID NO: 145901 - DNA, 103 bp, Artificial Sequence
  Synthetic Polynucleotide
taatacgactcactatagggtcccggaagatcttccaattgtttttgttgaacagaggagacaacaaatgcaattggaaaacctggcggcagcgcaaaagatg

SEQ ID NO: 145902 - DNA, 103 bp, Artificial Sequence
  Synthetic Polynucleotide
taatacgactcactatagggcttccaacactcccggaagatcttccaattaacagaggagaaattggatgatcttccggaacctggcggcagcgcaaaagatg

SEQ ID NO: 145903 - DNA, 103 bp, Artificial Sequence
  Synthetic Polynucleotide
taatacgactcactataggggctgaccttgcttccaacactcccggaagaaacagaggagatcttccatgagtgttggaaacctggcggcagcgcaaaagatg

SEQ ID NO: 145904 - DNA, 103 bp, Artificial Sequence
  Synthetic Polynucleotide
taatacgactcactatagggaccagcactggctgaccttgcttccaacacaacagaggagagtgttgatggcaaggtcaaacctggcggcagcgcaaaagatg

SEQ ID NO: 145905 - DNA, 103 bp, Artificial Sequence
  Synthetic Polynucleotide
taatacgactcactatagggtacccccgaaaccagcactggctgaccttgaacagaggagacaaggtatgccagtgctgaacctggcggcagcgcaaaagatg

SEQ ID NO: 145906 - DNA, 103 bp, Artificial Sequence
  Synthetic Polynucleotide
taatacgactcactataggggctttttatgtacccccgaaaccagcactgaacagaggagacagtgcatgtttcgggggaacctggcggcagcgcaaaagatg

SEQ ID NO: 145907 - DNA, 103 bp, Artificial Sequence
  Synthetic Polynucleotide
taatacgactcactatagggtcagacttgagctttttatgtacccccgaaaacagaggagattcgggatgacataaaaaaacctggcggcagcgcaaaagatg

SEQ ID NO: 145908 - DNA, 103 bp, Artificial Sequence
  Synthetic Polynucleotide
taatacgactcactatagggcttccagagctcagacttgagctttttatgaacagaggagacataaaatgctcaagtctaacctggcggcagcgcaaaagatg

SEQ ID NO: 145909 - DNA, 103 bp, Artificial Sequence
  Synthetic Polynucleotide
taatacgactcactatagggaggcttctggcttccagagctcagacttgaaacagaggagatcaagtatgagctctggaaacctggcggcagcgcaaaagatg

SEQ ID NO: 145910 - DNA, 103 bp, Artificial Sequence
  Synthetic Polynucleotide
taatacgactcactatagggtcctggctaaaggcttctggcttccagagcaacagaggagagctctgatggccagaagcaacctggcggcagcgcaaaagatg

SEQ ID NO: 145911 - DNA, 103 bp, Artificial Sequence
  Synthetic Polynucleotide
taatacgactcactatagggatctgacaggaaccgaagctctcgatccagaacagaggagactggatatggagcttcggaacctggcggcagcgcaaaagatg

SEQ ID NO: 145912 - DNA, 103 bp, Artificial Sequence
  Synthetic Polynucleotide
taatacgactcactataggggtctccaaattcctggctaaaggcttctggaacagaggagaccagaaatgtttagccagaacctggcggcagcgcaaaagatg

SEQ ID NO: 145913 - DNA, 103 bp, Artificial Sequence
  Synthetic Polynucleotide
taatacgactcactatagggctacatcctggtctccaaattcctggctaaaacagaggagattagccatgaatttggagaacctggcggcagcgcaaaagatg

SEQ ID NO: 145914 - DNA, 103 bp, Artificial Sequence
  Synthetic Polynucleotide
taatacgactcactatagggttcaccaagtctacatcctggtctccaaataacagaggagaatttggatgccaggatgtaacctggcggcagcgcaaaagatg

SEQ ID NO: 145915 - DNA, 103 bp, Artificial Sequence
  Synthetic Polynucleotide
taatacgactcactataggggttcctgcagttcaccaagtctacatcctgaacagaggagacaggatatggacttggtgaacctggcggcagcgcaaaagatg

SEQ ID NO: 145916 - DNA, 103 bp, Artificial Sequence
  Synthetic Polynucleotide
taatacgactcactatagggttatagcacagttcctgcagttcaccaagtaacagaggagaacttggatgactgcaggaaacctggcggcagcgcaaaagatg

SEQ ID NO: 145917 - DNA, 103 bp, Artificial Sequence
  Synthetic Polynucleotide
taatacgactcactatagggacatcggaaattatagcacagttcctgcagaacagaggagactgcagatgctgtgctataacctggcggcagcgcaaaagatg

SEQ ID NO: 145918 - DNA, 103 bp, Artificial Sequence
  Synthetic Polynucleotide
taatacgactcactatagggccgaactttcacatcggaaattatagcacaaacagaggagatgtgctatgatttccgataacctggcggcagcgcaaaagatg

SEQ ID NO: 145919 - DNA, 103 bp, Artificial Sequence
  Synthetic Polynucleotide
taatacgactcactatagggcccagaaatcccgaactttcacatcggaaaaacagaggagatttccgatgtgaaagttcaacctggcggcagcgcaaaagatg

SEQ ID NO: 145920 - DNA, 103 bp, Artificial Sequence
  Synthetic Polynucleotide
taatacgactcactatagggtcgaaaccatcccagaaatcccgaactttcaacagaggagagaaagtatgggatttctgaacctggcggcagcgcaaaagatg

SEQ ID NO: 145921 - DNA, 103 bp, Artificial Sequence
  Synthetic Polynucleotide
taatacgactcactataggggcatatgatctcgaaaccatcccagaaatcaacagaggagagatttcatggatggtttcaacctggcggcagcgcaaaagatg

SEQ ID NO: 145922 - DNA, 103 bp, Artificial Sequence
  Synthetic Polynucleotide
taatacgactcactatagggacccattggcatctgacaggaaccgaagctaacagaggagaagcttcatgtcctgtcagaacctggcggcagcgcaaaagatg

SEQ ID NO: 145923 - DNA, 103 bp, Artificial Sequence
  Synthetic Polynucleotide
taatacgactcactataggggtagtcgtttgcatatgatctcgaaaccataacagaggagaatggttatgagatcatataacctggcggcagcgcaaaagatg

SEQ ID NO: 145924 - DNA, 103 bp, Artificial Sequence
  Synthetic Polynucleotide
taatacgactcactatagggtcttctgaccgtagtcgtttgcatatgatcaacagaggagagatcatatgcaaacgactaacctggcggcagcgcaaaagatg

SEQ ID NO: 145925 - DNA, 103 bp, Artificial Sequence
  Synthetic Polynucleotide
taatacgactcactatagggtggctgcccatcttctgaccgtagtcgtttaacagaggagaaaacgaatgcggtcagaaaacctggcggcagcgcaaaagatg

SEQ ID NO: 145926 - DNA, 103 bp, Artificial Sequence
  Synthetic Polynucleotide
taatacgactcactatagggtgagcaccattggctgcccatcttctgaccaacagaggagaggtcagatgatgggcagcaacctggcggcagcgcaaaagatg

SEQ ID NO: 145927 - DNA, 103 bp, Artificial Sequence
  Synthetic Polynucleotide
taatacgactcactatagggtccttgagtttgagcaccattggctgcccaaacagaggagatgggcaatgaatggtgctaacctggcggcagcgcaaaagatg

SEQ ID NO: 145928 - DNA, 103 bp, Artificial Sequence
  Synthetic Polynucleotide
taatacgactcactatagggaggaggccagtccttgagtttgagcaccataacagaggagaatggtgatgaaactcaagaacctggcggcagcgcaaaagatg

SEQ ID NO: 145929 - DNA, 103 bp, Artificial Sequence
  Synthetic Polynucleotide
taatacgactcactatagggaatcttccccaggaggccagtccttgagttaacagaggagaaactcaatgactggcctcaacctggcggcagcgcaaaagatg

SEQ ID NO: 145930 - DNA, 103 bp, Artificial Sequence
  Synthetic Polynucleotide
taatacgactcactatagggatgtctcgaaaatcttccccaggaggccagaacagaggagactggccatgtggggaagaaacctggcggcagcgcaaaagatg

SEQ ID NO: 145931 - DNA, 103 bp, Artificial Sequence
  Synthetic Polynucleotide
taatacgactcactatagggggttggcatcatgtctcgaaaatcttccccaacagaggagaggggaaatgtttcgagacaacctggcggcagcgcaaaagatg

SEQ ID NO: 145932 - DNA, 103 bp, Artificial Sequence
  Synthetic Polynucleotide
taatacgactcactatagggcttcaaacctggttggcatcatgtctcgaaaacagaggagattcgagatgtgatgccaaaacctggcggcagcgcaaaagatg

SEQ ID NO: 145933 - DNA, 103 bp, Artificial Sequence
  Synthetic Polynucleotide
taatacgactcactatagggaacagatgcaacccattggcatctgacaggaacagaggagacctgtcatgtgccaatggaacctggcggcagcgcaaaagatg

SEQ ID NO: 145934 - DNA, 103 bp, Artificial Sequence
  Synthetic Polynucleotide
taatacgactcactatagggtccatcagatcttcaaacctggttggcatcaacagaggagagatgccatgcaggtttgaaacctggcggcagcgcaaaagatg

SEQ ID NO: 145935 - DNA, 103 bp, Artificial Sequence
  Synthetic Polynucleotide
taatacgactcactatagggaggaaggttctccatcagatcttcaaacctaacagaggagaaggtttatggatctgatgaacctggcggcagcgcaaaagatg

SEQ ID NO: 145936 - DNA, 103 bp, Artificial Sequence
  Synthetic Polynucleotide
taatacgactcactatagggattctggcagaggaaggttctccatcagataacagaggagaatctgaatgagaaccttcaacctggcggcagcgcaaaagatg

SEQ ID NO: 145937 - DNA, 103 bp, Artificial Sequence
  Synthetic Polynucleotide
taatacgactcactatagggcgtttggtatattctggcagaggaaggttcaacagaggagagaacctatgtctgccagaaacctggcggcagcgcaaaagatg

SEQ ID NO: 145938 - DNA, 103 bp, Artificial Sequence
  Synthetic Polynucleotide
taatacgactcactatagggcctgccatctcgtttggtatattctggcagaacagaggagactgccaatgtataccaaaaacctggcggcagcgcaaaagatg

SEQ ID NO: 145939 - DNA, 103 bp, Artificial Sequence
  Synthetic Polynucleotide
taatacgactcactatagggccagattgagcctgccatctcgtttggtataacagaggagaataccaatggagatggcaaacctggcggcagcgcaaaagatg

SEQ ID NO: 145940 - DNA, 103 bp, Artificial Sequence
  Synthetic Polynucleotide
taatacgactcactatagggagcctagaggccagattgagcctgccatctaacagaggagaagatggatggctcaatctaacctggcggcagcgcaaaagatg

SEQ ID NO: 145941 - DNA, 103 bp, Artificial Sequence
  Synthetic Polynucleotide
taatacgactcactataggggtagctaggtagcctagaggccagattgagaacagaggagactcaatatggcctctaggaacctggcggcagcgcaaaagatg

SEQ ID NO: 145942 - DNA, 103 bp, Artificial Sequence
  Synthetic Polynucleotide
taatacgactcactataggggccttacaaagtagctaggtagcctagaggaacagaggagacctctaatgtacctagctaacctggcggcagcgcaaaagatg

SEQ ID NO: 145943 - DNA, 103 bp, Artificial Sequence
  Synthetic Polynucleotide
taatacgactcactatagggcccagatcaggccttacaaagtagctaggtaacagaggagaacctagatgctttgtaagaacctggcggcagcgcaaaagatg

SEQ ID NO: 145944 - DNA, 103 bp, Artificial Sequence
  Synthetic Polynucleotide
taatacgactcactatagggtcccatctgaaacagatgcaacccattggcaacagaggagagccaatatgttgcatctgaacctggcggcagcgcaaaagatg

SEQ ID NO: 145945 - DNA, 103 bp, Artificial Sequence
  Synthetic Polynucleotide
taatacgactcactatagggcatcttggggcccagatcaggccttacaaaaacagaggagatttgtaatgcctgatctgaacctggcggcagcgcaaaagatg

SEQ ID NO: 145946 - DNA, 103 bp, Artificial Sequence
  Synthetic Polynucleotide
taatacgactcactatagggaggcgttgtacatcttggggcccagatcagaacagaggagactgatcatggccccaagaaacctggcggcagcgcaaaagatg

SEQ ID NO: 145947 - DNA, 103 bp, Artificial Sequence
  Synthetic Polynucleotide
taatacgactcactatagggatcaacccataggcgttgtacatcttggggaacagaggagaccccaaatggtacaacgcaacctggcggcagcgcaaaagatg

SEQ ID NO: 145948 - DNA, 103 bp, Artificial Sequence
  Synthetic Polynucleotide
taatacgactcactatagggttctgctgttatcaacccataggcgttgtaaacagaggagatacaacatgtatgggttgaacctggcggcagcgcaaaagatg

SEQ ID NO: 145949 - DNA, 103 bp, Artificial Sequence
  Synthetic Polynucleotide
taatacgactcactatagggctcttctatcttctgctgttatcaacccataacagaggagaatgggtatgtaacagcagaacctggcggcagcgcaaaagatg

SEQ ID NO: 145950 - DNA, 103 bp, Artificial Sequence
  Synthetic Polynucleotide
taatacgactcactataggggttgtaccaactcttctatcttctgctgttaacagaggagaaacagcatgagatagaagaacctggcggcagcgcaaaagatg

SEQ ID NO: 145951 - DNA, 103 bp, Artificial Sequence
  Synthetic Polynucleotide
taatacgactcactataggggtgaagatttgttgtaccaactcttctatcaacagaggagagatagaatggttggtacaaacctggcggcagcgcaaaagatg

SEQ ID NO: 145952 - DNA, 103 bp, Artificial Sequence
  Synthetic Polynucleotide
taatacgactcactatagggacacatctaagtgaagatttgttgtaccaaaacagaggagattggtaatgcaaatcttcaacctggcggcagcgcaaaagatg

SEQ ID NO: 145953 - DNA, 103 bp, Artificial Sequence
  Synthetic Polynucleotide
taatacgactcactatagggacagcatcagacacatctaagtgaagatttaacagaggagaaaatctatgcttagatgtaacctggcggcagcgcaaaagatg

SEQ ID NO: 145954 - DNA, 103 bp, Artificial Sequence
  Synthetic Polynucleotide
taatacgactcactatagggcatcacattaacagcatcagacacatctaaaacagaggagattagatatgtctgatgctaacctggcggcagcgcaaaagatg

SEQ ID NO: 145955 - DNA, 103 bp, Artificial Sequence
  Synthetic Polynucleotide
taatacgactcactatagggggctatctgttcccatctgaaacagatgcaaacagaggagatgcatcatgttcagatggaacctggcggcagcgcaaaagatg

SEQ ID NO: 145956 - DNA, 103 bp, Artificial Sequence
  Synthetic Polynucleotide
taatacgactcactatagggcaacatacaccatcacattaacagcatcagaacagaggagactgatgatgttaatgtgaaacctggcggcagcgcaaaagatg

SEQ ID NO: 145957 - DNA, 103 bp, Artificial Sequence
  Synthetic Polynucleotide
taatacgactcactatagggatgggaatcccaacatacaccatcacattaaacagaggagataatgtatgggtgtatgtaacctggcggcagcgcaaaagatg

SEQ ID NO: 145958 - DNA, 103 bp, Artificial Sequence
  Synthetic Polynucleotide
taatacgactcactatagggaccctccccgatgggaatcccaacatacacaacagaggagagtgtatatggggattcccaacctggcggcagcgcaaaagatg

SEQ ID NO: 145959 - DNA, 103 bp, Artificial Sequence
  Synthetic Polynucleotide
taatacgactcactatagggcatcatgagcaccctccccgatgggaatccaacagaggagaggattcatgtcggggaggaacctggcggcagcgcaaaagatg

SEQ ID NO: 145960 - DNA, 103 bp, Artificial Sequence
  Synthetic Polynucleotide
taatacgactcactatagggagtacctcttcatcatgagcaccctccccgaacagaggagacggggaatgtgctcatgaaacctggcggcagcgcaaaagatg

SEQ ID NO: 145961 - DNA, 103 bp, Artificial Sequence
  Synthetic Polynucleotide
taatacgactcactatagggaattgtcttgagtacctcttcatcatgagcaacagaggagagctcatatggaagaggtaaacctggcggcagcgcaaaagatg

SEQ ID NO: 145962 - DNA, 103 bp, Artificial Sequence
  Synthetic Polynucleotide
taatacgactcactatagggctccctcgtcaattgtcttgagtacctcttaacagaggagaaagaggatgtcaagacaaaacctggcggcagcgcaaaagatg

SEQ ID NO: 145963 - DNA, 103 bp, Artificial Sequence
  Synthetic Polynucleotide
taatacgactcactatagggtcatcggcatctccctcgtcaattgtcttgaacagaggagacaagacatgtgacgagggaacctggcggcagcgcaaaagatg

SEQ ID NO: 145964 - DNA, 103 bp, Artificial Sequence
  Synthetic Polynucleotide
taatacgactcactatagggcttcgtcacctcatcggcatctccctcgtcaacagaggagagacgagatggatgccgataacctggcggcagcgcaaaagatg

SEQ ID NO: 145965 - DNA, 103 bp, Artificial Sequence
  Synthetic Polynucleotide
taatacgactcactataggggaatcctctgcttcgtcacctcatcggcataacagaggagaatgccgatgaggtgacgaaacctggcggcagcgcaaaagatg

SEQ ID NO: 145966 - DNA, 103 bp, Artificial Sequence
  Synthetic Polynucleotide
taatacgactcactatagggatctggttttggctatctgttcccatctgaaacagaggagatcagatatgaacagatagaacctggcggcagcgcaaaagatg

SEQ ID NO: 145967 - DNA, 103 bp, Artificial Sequence
  Synthetic Polynucleotide
taatacgactcactatagggtttccatcatgaatcctctgcttcgtcaccaacagaggagaggtgacatggcagaggataacctggcggcagcgcaaaagatg

SEQ ID NO: 145968 - DNA, 103 bp, Artificial Sequence
  Synthetic Polynucleotide
taatacgactcactatagggtggcttctcttttccatcatgaatcctctgaacagaggagacagaggatgcatgatggaaacctggcggcagcgcaaaagatg

SEQ ID NO: 145969 - DNA, 103 bp, Artificial Sequence
  Synthetic Polynucleotide
taatacgactcactatagggataaagcacctggcttctcttttccatcataacagaggagaatgatgatgaagagaagcaacctggcggcagcgcaaaagatg

SEQ ID NO: 145970 - DNA, 103 bp, Artificial Sequence
  Synthetic Polynucleotide
taatacgactcactatagggtagatgtgccataaagcacctggcttctctaacagaggagaagagaaatgaggtgctttaacctggcggcagcgcaaaagatg

SEQ ID NO: 145971 - DNA, 103 bp, Artificial Sequence
  Synthetic Polynucleotide
taatacgactcactatagggcttggctgcatagatgtgccataaagcaccaacagaggagaggtgctatgtggcacatcaacctggcggcagcgcaaaagatg

SEQ ID NO: 145972 - DNA, 103 bp, Artificial Sequence
  Synthetic Polynucleotide
taatacgactcactatagggtctctgcatccttggctgcatagatgtgccaacagaggagaggcacaatgatgcagccaaacctggcggcagcgcaaaagatg

SEQ ID NO: 145973 - DNA, 103 bp, Artificial Sequence
  Synthetic Polynucleotide
taatacgactcactatagggtcccggatcttctctgcatccttggctgcaaacagaggagatgcagcatgggatgcagaaacctggcggcagcgcaaaagatg

SEQ ID NO: 145974 - DNA, 103 bp, Artificial Sequence
  Synthetic Polynucleotide
taatacgactcactatagggtcggagcagctcccggatcttctctgcatcaacagaggagagatgcaatgaagatccggaacctggcggcagcgcaaaagatg

SEQ ID NO: 145975 - DNA, 103 bp, Artificial Sequence
  Synthetic Polynucleotide
taatacgactcactatagggctccaacctttcggagcagctcccggatctaacagaggagaagatccatgagctgctccaacctggcggcagcgcaaaagatg

SEQ ID NO: 145976 - DNA, 103 bp, Artificial Sequence
  Synthetic Polynucleotide
taatacgactcactatagggccttgttcttctccaacctttcggagcagcaacagaggagagctgctatgaaaggttggaacctggcggcagcgcaaaagatg

SEQ ID NO: 145977 - DNA, 103 bp, Artificial Sequence
  Synthetic Polynucleotide
taatacgactcactatagggttccaaaagaatctggttttggctatctgtaacagaggagaacagatatgcaaaaccagaacctggcggcagcgcaaaagatg

SEQ ID NO: 145978 - DNA, 103 bp, Artificial Sequence
  Synthetic Polynucleotide
taatacgactcactataggggttctcttggccttgttcttctccaaccttaacagaggagaaaggttatggaagaacaaaacctggcggcagcgcaaaagatg

SEQ ID NO: 145979 - DNA, 103 bp, Artificial Sequence
  Synthetic Polynucleotide
taatacgactcactataggggatcaggggggttctcttggccttgttcttaacagaggagaaagaacatggccaagagaaacctggcggcagcgcaaaagatg

SEQ ID NO: 145980 - DNA, 103 bp, Artificial Sequence
  Synthetic Polynucleotide
taatacgactcactatagggattgggtcatgatcaggggggttctcttggaacagaggagaccaagaatgcccccctgaaacctggcggcagcgcaaaagatg

SEQ ID NO: 145981 - DNA, 103 bp, Artificial Sequence
  Synthetic Polynucleotide
taatacgactcactatagggttggtcatgaattgggtcatgatcagggggaacagaggagaccccctatgcatgacccaaacctggcggcagcgcaaaagatg

SEQ ID NO: 145982 - DNA, 103 bp, Artificial Sequence
  Synthetic Polynucleotide
taatacgactcactatagggggtaccaactttggtcatgaattgggtcataacagaggagaatgaccatgttcatgaccaacctggcggcagcgcaaaagatg

SEQ ID NO: 145983 - DNA, 103 bp, Artificial Sequence
  Synthetic Polynucleotide
taatacgactcactataggggtctggtccaggtaccaactttggtcatgaaacagaggagatcatgaatgaagttggtaaacctggcggcagcgcaaaagatg

SEQ ID NO: 145984 - DNA, 103 bp, Artificial Sequence
  Synthetic Polynucleotide
taatacgactcactatagggcttacggagggtctggtccaggtaccaactaacagaggagaagttggatgctggaccagaacctggcggcagcgcaaaagatg

SEQ ID NO: 145985 - DNA, 103 bp, Artificial Sequence
  Synthetic Polynucleotide
taatacgactcactatagggcatagagtcgcttacggagggtctggtccaaacagaggagatggaccatgccctccgtaaacctggcggcagcgcaaaagatg

SEQ ID NO: 145986 - DNA, 103 bp, Artificial Sequence
  Synthetic Polynucleotide
taatacgactcactatagggccatactcctcatagagtcgcttacggaggaacagaggagacctccgatggcgactctaaacctggcggcagcgcaaaagatg

SEQ ID NO: 145987 - DNA, 103 bp, Artificial Sequence
  Synthetic Polynucleotide
taatacgactcactataggggccttgcacgccatactcctcatagagtcgaacagaggagacgactcatggaggagtataacctggcggcagcgcaaaagatg

SEQ ID NO: 145988 - DNA, 103 bp, Artificial Sequence
  Synthetic Polynucleotide
taatacgactcactatagggctgaggccgcagtgtccgcgaacagcagcaaacagaggagatgctgcatgtcgcggacaaacctggcggcagcgcaaaagatg

SEQ ID NO: 145989 - DNA, 103 bp, Artificial Sequence
  Synthetic Polynucleotide
taatacgactcactataggggtgcagcatgttccaaaagaatctggttttaacagaggagaaaaaccatgttcttttggaacctggcggcagcgcaaaagatg

SEQ ID NO: 145990 - DNA, 103 bp, Artificial Sequence
  Synthetic Polynucleotide
taatacgactcactatagggcaatagcccagccttgcacgccatactcctaacagaggagaaggagtatggcgtgcaagaacctggcggcagcgcaaaagatg

SEQ ID NO: 145991 - DNA, 103 bp, Artificial Sequence
  Synthetic Polynucleotide
taatacgactcactatagggaggaactgcacaatagcccagccttgcacgaacagaggagacgtgcaatgctgggctataacctggcggcagcgcaaaagatg

SEQ ID NO: 145992 - DNA, 103 bp, Artificial Sequence
  Synthetic Polynucleotide
taatacgactcactatagggagcatcacctaggaactgcacaatagcccaaacagaggagatgggctatggtgcagttcaacctggcggcagcgcaaaagatg

SEQ ID NO: 145993 - DNA, 103 bp, Artificial Sequence
  Synthetic Polynucleotide
taatacgactcactataggggtatgaaaacagcatcacctaggaactgcaaacagaggagatgcagtatgtaggtgatgaacctggcggcagcgcaaaagatg

SEQ ID NO: 145994 - DNA, 103 bp, Artificial Sequence
  Synthetic Polynucleotide
taatacgactcactataggggctccagcaggtatgaaaacagcatcacctaacagaggagaaggtgaatgtgttttcataacctggcggcagcgcaaaagatg

SEQ ID NO: 145995 - DNA, 103 bp, Artificial Sequence
  Synthetic Polynucleotide
taatacgactcactatagggctggtgtggggctccagcaggtatgaaaacaacagaggagagttttcatgcctgctggaaacctggcggcagcgcaaaagatg

SEQ ID NO: 145996 - DNA, 103 bp, Artificial Sequence
  Synthetic Polynucleotide
taatacgactcactataggggattgtgaacctggtgtggggctccagcagaacagaggagactgctgatgccccacaccaacctggcggcagcgcaaaagatg

SEQ ID NO: 145997 - DNA, 103 bp, Artificial Sequence
  Synthetic Polynucleotide
taatacgactcactatagggcaactgtatagattgtgaacctggtgtgggaacagaggagacccacaatgggttcacaaaacctggcggcagcgcaaaagatg

SEQ ID NO: 145998 - DNA, 103 bp, Artificial Sequence
  Synthetic Polynucleotide
taatacgactcactatagggtacttttatgcaactgtatagattgtgaacaacagaggagagttcacatgctatacagtaacctggcggcagcgcaaaagatg

SEQ ID NO: 145999 - DNA, 103 bp, Artificial Sequence
  Synthetic Polynucleotide
taatacgactcactatagggagtcttctgctacttttatgcaactgtataaacagaggagatatacaatggcataaaagaacctggcggcagcgcaaaagatg

SEQ ID NO: 146000 - DNA, 103 bp, Artificial Sequence
  Synthetic Polynucleotide
taatacgactcactataggggtttctctcagtgcagcatgttccaaaagaaacagaggagatcttttatgacatgctgcaacctggcggcagcgcaaaagatg

SEQ ID NO: 146001 - DNA, 103 bp, Artificial Sequence
  Synthetic Polynucleotide
taatacgactcactatagggggagatacaaagtcttctgctacttttatgaacagaggagacataaaatgagcagaagaaacctggcggcagcgcaaaagatg

SEQ ID NO: 146002 - DNA, 103 bp, Artificial Sequence
  Synthetic Polynucleotide
taatacgactcactatagggtacatgttctggagatacaaagtcttctgcaacagaggagagcagaaatgtttgtatctaacctggcggcagcgcaaaagatg

SEQ ID NO: 146003 - DNA, 103 bp, Artificial Sequence
  Synthetic Polynucleotide
taatacgactcactatagggaacagtgctttacatgttctggagatacaaaacagaggagattgtatatgcagaacatgaacctggcggcagcgcaaaagatg

SEQ ID NO: 146004 - DNA, 103 bp, Artificial Sequence
  Synthetic Polynucleotide
taatacgactcactataggggtcaggcggaaacagtgctttacatgttctaacagaggagaagaacaatgaaagcactgaacctggcggcagcgcaaaagatg

SEQ ID NO: 146005 - DNA, 103 bp, Artificial Sequence
  Synthetic Polynucleotide
taatacgactcactataggggaattcctgagtcaggcggaaacagtgcttaacagaggagaaagcacatgttccgcctgaacctggcggcagcgcaaaagatg

SEQ ID NO: 146006 - DNA, 103 bp, Artificial Sequence
  Synthetic Polynucleotide
taatacgactcactatagggagagatgcctgaattcctgagtcaggcggaaacagaggagatccgccatgctcaggaataacctggcggcagcgcaaaagatg

SEQ ID NO: 146007 - DNA, 103 bp, Artificial Sequence
  Synthetic Polynucleotide
taatacgactcactatagggtgagtgttagagagatgcctgaattcctgaaacagaggagatcaggaatgcaggcatctaacctggcggcagcgcaaaagatg

SEQ ID NO: 146008 - DNA, 103 bp, Artificial Sequence
  Synthetic Polynucleotide
taatacgactcactatagggatgatttgtatgagtgttagagagatgcctaacagaggagaaggcatatgtctaacactaacctggcggcagcgcaaaagatg

SEQ ID NO: 146009 - DNA, 103 bp, Artificial Sequence
  Synthetic Polynucleotide
taatacgactcactataggggtttatcctcatgatttgtatgagtgttagaacagaggagactaacaatgatacaaatcaacctggcggcagcgcaaaagatg

SEQ ID NO: 146010 - DNA, 103 bp, Artificial Sequence
  Synthetic Polynucleotide
taatacgactcactatagggttcacctgcagtttatcctcatgatttgtaaacagaggagatacaaaatgtgaggataaaacctggcggcagcgcaaaagatg

SEQ ID NO: 146011 - DNA, 103 bp, Artificial Sequence
  Synthetic Polynucleotide
taatacgactcactatagggagcattaactgtttctctcagtgcagcatgaacagaggagacatgctatgctgagagaaaacctggcggcagcgcaaaagatg

SEQ ID NO: 146012 - DNA, 103 bp, Artificial Sequence
  Synthetic Polynucleotide
taatacgactcactatagggaatgatgttcttcacctgcagtttatcctcaacagaggagagaggatatgctgcaggtgaacctggcggcagcgcaaaagatg

SEQ ID NO: 146013 - DNA, 103 bp, Artificial Sequence
  Synthetic Polynucleotide
taatacgactcactatagggctgcatggtaaatgatgttcttcacctgcaaacagaggagatgcaggatgagaacatcaaacctggcggcagcgcaaaagatg

SEQ ID NO: 146014 - DNA, 103 bp, Artificial Sequence
  Synthetic Polynucleotide
taatacgactcactataggggcatctttcactgcatggtaaatgatgttcaacagaggagagaacatatgttaccatgcaacctggcggcagcgcaaaagatg

SEQ ID NO: 146015 - DNA, 103 bp, Artificial Sequence
  Synthetic Polynucleotide
taatacgactcactatagggggtgccaaccgcatctttcactgcatggtaaacagaggagataccatatggtgaaagataacctggcggcagcgcaaaagatg

SEQ ID NO: 146016 - DNA, 103 bp, Artificial Sequence
  Synthetic Polynucleotide
taatacgactcactataggggagccttgagggtgccaaccgcatctttcaaacagaggagatgaaagatgcggttggcaaacctggcggcagcgcaaaagatg

SEQ ID NO: 146017 - DNA, 103 bp, Artificial Sequence
  Synthetic Polynucleotide
taatacgactcactatagggttggattcatgagccttgagggtgccaaccaacagaggagaggttggatgcctcaaggcaacctggcggcagcgcaaaagatg

SEQ ID NO: 146018 - DNA, 103 bp, Artificial Sequence
  Synthetic Polynucleotide
taatacgactcactatagggccttgccagtttggattcatgagccttgagaacagaggagactcaagatgcatgaatccaacctggcggcagcgcaaaagatg

SEQ ID NO: 146019 - DNA, 103 bp, Artificial Sequence
  Synthetic Polynucleotide
taatacgactcactatagggcactgatcaaagcattaactgtttctctcaaacagaggagatgagagatgcagttaatgaacctggcggcagcgcaaaagatg

SEQ ID NO: 146020 - DNA, 103 bp, Artificial Sequence
  Synthetic Polynucleotide
taatacgactcactatagggagcttttggtcactgatcaaagcattaactaacagaggagaagttaaatgtttgatcagaacctggcggcagcgcaaaagatg

SEQ ID NO: 146021 - DNA, 103 bp, Artificial Sequence
  Synthetic Polynucleotide
taatacgactcactatagggtatctcttgtagcttttggtcactgatcaaaacagaggagattgatcatggaccaaaagaacctggcggcagcgcaaaagatg

SEQ ID NO: 146022 - DNA, 103 bp, Artificial Sequence
  Synthetic Polynucleotide
taatacgactcactatagggctcggctgaatatctcttgtagcttttggtaacagaggagaaccaaaatgtacaagagaaacctggcggcagcgcaaaagatg

SEQ ID NO: 146023 - DNA, 103 bp, Artificial Sequence
  Synthetic Polynucleotide
taatacgactcactatagggctgtagggacctcggctgaatatctcttgtaacagaggagaacaagaatgattcagccgaacctggcggcagcgcaaaagatg

SEQ ID NO: 146024 - DNA, 103 bp, Artificial Sequence
  Synthetic Polynucleotide
taatacgactcactatagggaccttgaacactgtagggacctcggctgaaaacagaggagattcagcatgggtccctacaacctggcggcagcgcaaaagatg

SEQ ID NO: 146025 - DNA, 103 bp, Artificial Sequence
  Synthetic Polynucleotide
taatacgactcactatagggtgaccctgtgaccttgaacactgtagggacaacagaggagagtccctatggtgttcaagaacctggcggcagcgcaaaagatg

SEQ ID NO: 146026 - DNA, 103 bp, Artificial Sequence
  Synthetic Polynucleotide
taatacgactcactataggggaggccgaggctgaggccgcagtgtccgcgaacagaggagacgcggaatgtgcggcctcaacctggcggcagcgcaaaagatg

SEQ ID NO: 146027 - DNA, 103 bp, Artificial Sequence
  Synthetic Polynucleotide
taatacgactcactatagggtgatatattttgaccctgtgaccttgaacaaacagaggagatgttcaatgtcacagggtaacctggcggcagcgcaaaagatg

SEQ ID NO: 146028 - DNA, 103 bp, Artificial Sequence
  Synthetic Polynucleotide
taatacgactcactatagggcccctctggctgatatattttgaccctgtgaacagaggagacacaggatgaaaatatataacctggcggcagcgcaaaagatg

SEQ ID NO: 146029 - DNA, 103 bp, Artificial Sequence
  Synthetic Polynucleotide
taatacgactcactatagggacccttcttccccctctggctgatatatttaacagaggagaaaatatatgagccagaggaacctggcggcagcgcaaaagatg

SEQ ID NO: 146030 - DNA, 103 bp, Artificial Sequence
  Synthetic Polynucleotide
taatacgactcactatagggccatagagccacccttcttccccctctggcaacagaggagagccagaatgggaagaaggaacctggcggcagcgcaaaagatg

SEQ ID NO: 146031 - DNA, 103 bp, Artificial Sequence
  Synthetic Polynucleotide
taatacgactcactataggggctcacaacaccatagagccacccttcttcaacagaggagagaagaaatgtggctctataacctggcggcagcgcaaaagatg

SEQ ID NO: 146032 - DNA, 103 bp, Artificial Sequence
  Synthetic Polynucleotide
taatacgactcactatagggagtcctgatggctcacaacaccatagagccaacagaggagaggctctatggtgttgtgaaacctggcggcagcgcaaaagatg

SEQ ID NO: 146033 - DNA, 103 bp, Artificial Sequence
  Synthetic Polynucleotide
taatacgactcactatagggcgagtgatggagtcctgatggctcacaacaaacagaggagatgttgtatgccatcaggaaacctggcggcagcgcaaaagatg

SEQ ID NO: 146034 - DNA, 103 bp, Artificial Sequence
  Synthetic Polynucleotide
taatacgactcactatagggctccataagacgagtgatggagtcctgatgaacagaggagacatcagatgtccatcactaacctggcggcagcgcaaaagatg

SEQ ID NO: 146035 - DNA, 103 bp, Artificial Sequence
  Synthetic Polynucleotide
taatacgactcactatagggttacagacacctccataagacgagtgatggaacagaggagaccatcaatggtcttatggaacctggcggcagcgcaaaagatg

SEQ ID NO: 146036 - DNA, 103 bp, Artificial Sequence
  Synthetic Polynucleotide
taatacgactcactatagggccactctcagttacagacacctccataagaaacagaggagatcttatatgggtgtctgtaacctggcggcagcgcaaaagatg

SEQ ID NO: 146037 - DNA, 103 bp, Artificial Sequence
  Synthetic Polynucleotide
taatacgactcactatagggcgcgggagccgaggccgaggctgaggccgcaacagaggagagcggccatggcctcggccaacctggcggcagcgcaaaagatg

SEQ ID NO: 146038 - DNA, 103 bp, Artificial Sequence
  Synthetic Polynucleotide
taatacgactcactatagggcttgatctcaccactctcagttacagacacaacagaggagagtgtctatgactgagagtaacctggcggcagcgcaaaagatg

SEQ ID NO: 146039 - DNA, 103 bp, Artificial Sequence
  Synthetic Polynucleotide
taatacgactcactataggggatctaccgacttgatctcaccactctcagaacagaggagactgagaatggtgagatcaaacctggcggcagcgcaaaagatg

SEQ ID NO: 146040 - DNA, 103 bp, Artificial Sequence
  Synthetic Polynucleotide
taatacgactcactatagggattagtctgggatctaccgacttgatctcaaacagaggagatgagatatggtcggtagaaacctggcggcagcgcaaaagatg

SEQ ID NO: 146041 - DNA, 103 bp, Artificial Sequence
  Synthetic Polynucleotide
taatacgactcactatagggcatcacatggattagtctgggatctaccgaaacagaggagatcggtaatgcccagactaaacctggcggcagcgcaaaagatg

SEQ ID NO: 146042 - DNA, 103 bp, Artificial Sequence
  Synthetic Polynucleotide
taatacgactcactatagggtatccatcagcatcacatggattagtctggaacagaggagaccagacatgtccatgtgaaacctggcggcagcgcaaaagatg

SEQ ID NO: 146043 - DNA, 103 bp, Artificial Sequence
  Synthetic Polynucleotide
taatacgactcactatagggggcgctgaattatccatcagcatcacatggaacagaggagaccatgtatggctgatggaaacctggcggcagcgcaaaagatg

SEQ ID NO: 146044 - DNA, 103 bp, Artificial Sequence
  Synthetic Polynucleotide
taatacgactcactatagggctcgctttgaggcgctgaattatccatcagaacagaggagactgatgatgaattcagcgaacctggcggcagcgcaaaagatg

SEQ ID NO: 146045 - DNA, 103 bp, Artificial Sequence
  Synthetic Polynucleotide
taatacgactcactatagggacgtacccccctcgctttgaggcgctgaataacagaggagaattcagatgctcaaagcgaacctggcggcagcgcaaaagatg

SEQ ID NO: 146046 - DNA, 103 bp, Artificial Sequence
  Synthetic Polynucleotide
taatacgactcactatagggactgcttttaacgtacccccctcgctttgaaacagaggagatcaaagatgggggggtacaacctggcggcagcgcaaaagatg

SEQ ID NO: 146047 - DNA, 103 bp, Artificial Sequence
  Synthetic Polynucleotide
taatacgactcactatagggggaagattttactgcttttaacgtacccccaacagaggagagggggtatgttaaaagcaaacctggcggcagcgcaaaagatg

SEQ ID NO: 146048 - DNA, 103 bp, Artificial Sequence
  Synthetic Polynucleotide
taatacgactcactatagggccgctgccgccgcgggagccgaggccgaggaacagaggagacctcggatgcggctcccgaacctggcggcagcgcaaaagatg

SEQ ID NO: 146049 - DNA, 103 bp, Artificial Sequence
  Synthetic Polynucleotide
taatacgactcactatagggtctttcctttggaagattttactgcttttaaacagaggagataaaagatgtaaaatcttaacctggcggcagcgcaaaagatg

SEQ ID NO: 146050 - DNA, 103 bp, Artificial Sequence
  Synthetic Polynucleotide
taatacgactcactatagggtctctcttcttctttcctttggaagattttaacagaggagaaaaatcatgcaaaggaaaaacctggcggcagcgcaaaagatg

SEQ ID NO: 146051 - DNA, 103 bp, Artificial Sequence
  Synthetic Polynucleotide
taatacgactcactatagggctctatgctttctctcttcttctttcctttaacagaggagaaaaggaatgaagaagagaaacctggcggcagcgcaaaagatg

SEQ ID NO: 146052 - DNA, 103 bp, Artificial Sequence
  Synthetic Polynucleotide
taatacgactcactatagggcatctttcccctctatgctttctctcttctaacagaggagaagaagaatgaaagcatagaacctggcggcagcgcaaaagatg

SEQ ID NO: 146053 - DNA, 103 bp, Artificial Sequence
  Synthetic Polynucleotide
taatacgactcactatagggctcctccggccatctttcccctctatgcttaacagaggagaaagcatatgggggaaagaaacctggcggcagcgcaaaagatg

SEQ ID NO: 146054 - DNA, 103 bp, Artificial Sequence
  Synthetic Polynucleotide
taatacgactcactatagggagcacttttcctcctccggccatctttcccaacagaggagagggaaaatgggccggaggaacctggcggcagcgcaaaagatg

SEQ ID NO: 146055 - DNA, 103 bp, Artificial Sequence
  Synthetic Polynucleotide
taatacgactcactatagggcagagtccgaagcacttttcctcctccggcaacagaggagagccggaatgggaaaagtgaacctggcggcagcgcaaaagatg

SEQ ID NO: 146056 - DNA, 103 bp, Artificial Sequence
  Synthetic Polynucleotide
taatacgactcactataggggggtcacacccagagtccgaagcacttttcaacagaggagagaaaagatgttcggactcaacctggcggcagcgcaaaagatg

SEQ ID NO: 146057 - DNA, 103 bp, Artificial Sequence
  Synthetic Polynucleotide
taatacgactcactatagggctttgatgcagggtcacacccagagtccgaaacagaggagatcggacatggggtgtgacaacctggcggcagcgcaaaagatg

SEQ ID NO: 146058 - DNA, 103 bp, Artificial Sequence
  Synthetic Polynucleotide
taatacgactcactatagggcttttaatttctttgatgcagggtcacaccaacagaggagaggtgtgatgctgcatcaaaacctggcggcagcgcaaaagatg

SEQ ID NO: 146059 - DNA, 103 bp, Artificial Sequence
  Synthetic Polynucleotide
taatacgactcactatagggtctccgctcgccgctgccgccgcgggagccaacagaggagaggctccatgggcggcagcaacctggcggcagcgcaaaagatg

SEQ ID NO: 146060 - DNA, 103 bp, Artificial Sequence
  Synthetic Polynucleotide
taatacgactcactatagggcccctgtctccttttaatttctttgatgcaaacagaggagatgcatcatggaaattaaaaacctggcggcagcgcaaaagatg

SEQ ID NO: 146061 - DNA, 103 bp, Artificial Sequence
  Synthetic Polynucleotide
taatacgactcactataggggtctacttcacccctgtctccttttaatttaacagaggagaaaattaatgggagacaggaacctggcggcagcgcaaaagatg

SEQ ID NO: 146062 - DNA, 103 bp, Artificial Sequence
  Synthetic Polynucleotide
taatacgactcactatagggtcccattactgtctacttcacccctgtctcaacagaggagagagacaatggtgaagtagaacctggcggcagcgcaaaagatg

SEQ ID NO: 146063 - DNA, 103 bp, Artificial Sequence
  Synthetic Polynucleotide
taatacgactcactatagggcctccatcgctcccattactgtctacttcaaacagaggagatgaagtatgcagtaatggaacctggcggcagcgcaaaagatg

SEQ ID NO: 146064 - DNA, 103 bp, Artificial Sequence
  Synthetic Polynucleotide
taatacgactcactataggggcttgcctcacctccatcgctcccattactaacagaggagaagtaatatgagcgatggaaacctggcggcagcgcaaaagatg

SEQ ID NO: 146065 - DNA, 103 bp, Artificial Sequence
  Synthetic Polynucleotide
taatacgactcactatagggagggccctcggcttgcctcacctccatcgcaacagaggagagcgatgatggtgaggcaaaacctggcggcagcgcaaaagatg

SEQ ID NO: 146066 - DNA, 103 bp, Artificial Sequence
  Synthetic Polynucleotide
taatacgactcactatagggcctcctttccagggccctcggcttgcctcaaacagaggagatgaggcatgccgagggccaacctggcggcagcgcaaaagatg

SEQ ID NO: 146067 - DNA, 103 bp, Artificial Sequence
  Synthetic Polynucleotide
taatacgactcactatagggactggcattccctcctttccagggccctcgaacagaggagacgagggatgtggaaaggaaacctggcggcagcgcaaaagatg

SEQ ID NO: 146068 - DNA, 103 bp, Artificial Sequence
  Synthetic Polynucleotide
taatacgactcactatagggctggctctccactggcattccctcctttccaacagaggagaggaaagatgggaatgccaaacctggcggcagcgcaaaagatg

SEQ ID NO: 146069 - DNA, 103 bp, Artificial Sequence
  Synthetic Polynucleotide
taatacgactcactatagggtgatccagccctggctctccactggcattcaacagaggagagaatgcatgtggagagccaacctggcggcagcgcaaaagatg

SEQ ID NO: 146070 - DNA, 103 bp, Artificial Sequence
  Synthetic Polynucleotide
taatacgactcactatagggcgcgtagccccccggccccacgcccgccataacagaggagaatggcgatggtggggccgaacctggcggcagcgcaaaagatg

SEQ ID NO: 146071 - DNA, 103 bp, Artificial Sequence
  Synthetic Polynucleotide
taatacgactcactatagggccggatgcggccgataaagctgagcggatcaacagaggagagatccgatgagctttatcaacctggcggcagcgcaaaagatg

SEQ ID NO: 146072 - DNA, 103 bp, Artificial Sequence
  Synthetic Polynucleotide
taatacgactcactatagggacatttaggacacctccagtctcctttgggaacagaggagacccaaaatggactggaggaacctggcggcagcgcaaaagatg

SEQ ID NO: 146073 - DNA, 103 bp, Artificial Sequence
  Synthetic Polynucleotide
taatacgactcactatagggcctcggcgacacatttaggacacctccagtaacagaggagaactggaatggtcctaaataacctggcggcagcgcaaaagatg

SEQ ID NO: 146074 - DNA, 103 bp, Artificial Sequence
  Synthetic Polynucleotide
taatacgactcactatagggttgctacattcctcggcgacacatttaggaaacagaggagatcctaaatgtgtcgccgaaacctggcggcagcgcaaaagatg

SEQ ID NO: 146075 - DNA, 103 bp, Artificial Sequence
  Synthetic Polynucleotide
taatacgactcactatagggttctcgaggtttgctacattcctcggcgacaacagaggagagtcgccatggaatgtagcaacctggcggcagcgcaaaagatg

SEQ ID NO: 146076 - DNA, 103 bp, Artificial Sequence
  Synthetic Polynucleotide
taatacgactcactatagggatccaaaggcttctcgaggtttgctacattaacagaggagaaatgtaatgaacctcgagaacctggcggcagcgcaaaagatg

SEQ ID NO: 146077 - DNA, 103 bp, Artificial Sequence
  Synthetic Polynucleotide
taatacgactcactataggggcttgttcaaatccaaaggcttctcgaggtaacagaggagaacctcgatgagcctttggaacctggcggcagcgcaaaagatg

SEQ ID NO: 146078 - DNA, 103 bp, Artificial Sequence
  Synthetic Polynucleotide
taatacgactcactatagggctctcgtacagcttgttcaaatccaaaggcaacagaggagagcctttatgtttgaacaaaacctggcggcagcgcaaaagatg

SEQ ID NO: 146079 - DNA, 103 bp, Artificial Sequence
  Synthetic Polynucleotide
taatacgactcactataggggaagtgtatactctcgtacagcttgttcaaaacagaggagattgaacatgctgtacgagaacctggcggcagcgcaaaagatg

SEQ ID NO: 146080 - DNA, 103 bp, Artificial Sequence
  Synthetic Polynucleotide
taatacgactcactatagggccaaagctctgaagtgtatactctcgtacaaacagaggagatgtacgatggtatacactaacctggcggcagcgcaaaagatg

SEQ ID NO: 146081 - DNA, 103 bp, Artificial Sequence
  Synthetic Polynucleotide
taatacgactcactatagggtgccatctctccaaagctctgaagtgtataaacagaggagatatacaatgcagagctttaacctggcggcagcgcaaaagatg

SEQ ID NO: 146082 - DNA, 103 bp, Artificial Sequence
  Synthetic Polynucleotide
taatacgactcactatagggccgccaaaggccggatgcggccgataaagcaacagaggagagctttaatggccgcatccaacctggcggcagcgcaaaagatg

SEQ ID NO: 146083 - DNA, 103 bp, Artificial Sequence
  Synthetic Polynucleotide
taatacgactcactatagggtaaaattatctgccatctctccaaagctctaacagaggagaagagctatggagagatggaacctggcggcagcgcaaaagatg

SEQ ID NO: 146084 - DNA, 103 bp, Artificial Sequence
  Synthetic Polynucleotide
taatacgactcactatagggtaatcagacttaaaattatctgccatctctaacagaggagaagagatatgagataatttaacctggcggcagcgcaaaagatg

SEQ ID NO: 146085 - DNA, 103 bp, Artificial Sequence
  Synthetic Polynucleotide
taatacgactcactatagggcatattaaaataatcagacttaaaattatcaacagaggagagataatatgaagtctgataacctggcggcagcgcaaaagatg

SEQ ID NO: 146086 - DNA, 103 bp, Artificial Sequence
  Synthetic Polynucleotide
taatacgactcactatagggtatggactggcatattaaaataatcagactaacagaggagaagtctgatgattttaataaacctggcggcagcgcaaaagatg

SEQ ID NO: 146087 - DNA, 103 bp, Artificial Sequence
  Synthetic Polynucleotide
taatacgactcactataggggtgggaaccatatggactggcatattaaaaaacagaggagattttaaatggccagtccaaacctggcggcagcgcaaaagatg

SEQ ID NO: 146088 - DNA, 103 bp, Artificial Sequence
  Synthetic Polynucleotide
taatacgactcactatagggtactagttctgtgggaaccatatggactggaacagaggagaccagtcatgatggttcccaacctggcggcagcgcaaaagatg

SEQ ID NO: 146089 - DNA, 103 bp, Artificial Sequence
  Synthetic Polynucleotide
taatacgactcactatagggattccttttctactagttctgtgggaaccaaacagaggagatggttcatgcagaactagaacctggcggcagcgcaaaagatg

SEQ ID NO: 146090 - DNA, 103 bp, Artificial Sequence
  Synthetic Polynucleotide
taatacgactcactatagggagccgccaaaattccttttctactagttctaacagaggagaagaactatgagaaaaggaaacctggcggcagcgcaaaagatg

SEQ ID NO: 146091 - DNA, 103 bp, Artificial Sequence
  Synthetic Polynucleotide
taatacgactcactataggggctgcttaccagccgccaaaattccttttcaacagaggagagaaaagatgttttggcggaacctggcggcagcgcaaaagatg

SEQ ID NO: 146092 - DNA, 103 bp, Artificial Sequence
  Synthetic Polynucleotide
taatacgactcactatagggcttcttcaatgctgcttaccagccgccaaaaacagaggagatttggcatgtggtaagcaaacctggcggcagcgcaaaagatg

SEQ ID NO: 146093 - DNA, 103 bp, Artificial Sequence
  Synthetic Polynucleotide
taatacgactcactatagggccggttttctccgccaaaggccggatgcggaacagaggagaccgcatatggcctttggcaacctggcggcagcgcaaaagatg

SEQ ID NO: 146094 - DNA, 103 bp, Artificial Sequence
  Synthetic Polynucleotide
taatacgactcactatagggacaataacatcttcttcaatgctgcttaccaacagaggagaggtaagatgcattgaagaaacctggcggcagcgcaaaagatg

SEQ ID NO: 146095 - DNA, 103 bp, Artificial Sequence
  Synthetic Polynucleotide
taatacgactcactatagggtccatattccacaataacatcttcttcaataacagaggagaattgaaatggatgttattaacctggcggcagcgcaaaagatg

SEQ ID NO: 146096 - DNA, 103 bp, Artificial Sequence
  Synthetic Polynucleotide
taatacgactcactatagggagatatctgctccatattccacaataacataacagaggagaatgttaatgtggaatatgaacctggcggcagcgcaaaagatg

SEQ ID NO: 146097 - DNA, 103 bp, Artificial Sequence
  Synthetic Polynucleotide
taatacgactcactatagggtcttttgaggagatatctgctccatattccaacagaggagaggaataatgagcagatataacctggcggcagcgcaaaagatg

SEQ ID NO: 146098 - DNA, 103 bp, Artificial Sequence
  Synthetic Polynucleotide
taatacgactcactatagggacttccaaagtcttttgaggagatatctgcaacagaggagagcagatatgtcctcaaaaaacctggcggcagcgcaaaagatg

SEQ ID NO: 146099 - DNA, 103 bp, Artificial Sequence
  Synthetic Polynucleotide
taatacgactcactatagggccggaaatccacttccaaagtcttttgaggaacagaggagacctcaaatgactttggaaaacctggcggcagcgcaaaagatg

SEQ ID NO: 146100 - DNA, 103 bp, Artificial Sequence
  Synthetic Polynucleotide
taatacgactcactatagggccatccttcaccggaaatccacttccaaagaacagaggagactttggatgtggatttccaacctggcggcagcgcaaaagatg

SEQ ID NO: 146101 - DNA, 103 bp, Artificial Sequence
  Synthetic Polynucleotide
taatacgactcactatagggctttctccgcccatccttcaccggaaatccaacagaggagaggatttatggtgaaggataacctggcggcagcgcaaaagatg

SEQ ID NO: 146102 - DNA, 103 bp, Artificial Sequence
  Synthetic Polynucleotide
taatacgactcactatagggctggcagaatctttctccgcccatccttcaaacagaggagatgaaggatgggcggagaaaacctggcggcagcgcaaaagatg

SEQ ID NO: 146103 - DNA, 103 bp, Artificial Sequence
  Synthetic Polynucleotide
taatacgactcactatagggtcctcttcttctggcagaatctttctccgcaacagaggagagcggagatggattctgccaacctggcggcagcgcaaaagatg

SEQ ID NO: 146104 - DNA, 103 bp, Artificial Sequence
  Synthetic Polynucleotide
taatacgactcactatagggtttgcagatgccggttttctccgccaaaggaacagaggagacctttgatggagaaaaccaacctggcggcagcgcaaaagatg

SEQ ID NO: 146105 - DNA, 103 bp, Artificial Sequence
  Synthetic Polynucleotide
taatacgactcactatagggaagtgcatattcctcttcttctggcagaataacagaggagaattctgatggaagaagagaacctggcggcagcgcaaaagatg

SEQ ID NO: 146106 - DNA, 103 bp, Artificial Sequence
  Synthetic Polynucleotide
taatacgactcactatagggtccaaccagaaagtgcatattcctcttcttaacagaggagaaagaagatgaatatgcacaacctggcggcagcgcaaaagatg

SEQ ID NO: 146107 - DNA, 103 bp, Artificial Sequence
  Synthetic Polynucleotide
taatacgactcactatagggttattcaaattccaaccagaaagtgcatataacagaggagaatatgcatgttctggttgaacctggcggcagcgcaaaagatg

SEQ ID NO: 146108 - DNA, 103 bp, Artificial Sequence
  Synthetic Polynucleotide
taatacgactcactataggggacaggcatgttattcaaattccaaccagaaacagaggagatctggtatgaatttgaataacctggcggcagcgcaaaagatg

SEQ ID NO: 146109 - DNA, 103 bp, Artificial Sequence
  Synthetic Polynucleotide
taatacgactcactatagggactgttccaggacaggcatgttattcaaataacagaggagaatttgaatgacatgcctgaacctggcggcagcgcaaaagatg

SEQ ID NO: 146110 - DNA, 103 bp, Artificial Sequence
  Synthetic Polynucleotide
taatacgactcactataggggcaagaacagactgttccaggacaggcatgaacagaggagacatgccatgcctggaacaaacctggcggcagcgcaaaagatg

SEQ ID NO: 146111 - DNA, 103 bp, Artificial Sequence
  Synthetic Polynucleotide
taatacgactcactatagggattaatatgtgcaagaacagactgttccagaacagaggagactggaaatgtctgttcttaacctggcggcagcgcaaaagatg

SEQ ID NO: 146112 - DNA, 103 bp, Artificial Sequence
  Synthetic Polynucleotide
taatacgactcactatagggagatgtccacattaatatgtgcaagaacagaacagaggagactgttcatgcacatattaaacctggcggcagcgcaaaagatg

SEQ ID NO: 146113 - DNA, 103 bp, Artificial Sequence
  Synthetic Polynucleotide
taatacgactcactatagggttcataccagagatgtccacattaatatgtaacagaggagaacatatatgtgtggacataacctggcggcagcgcaaaagatg

SEQ ID NO: 146114 - DNA, 103 bp, Artificial Sequence
  Synthetic Polynucleotide
taatacgactcactatagggccacggcactttcataccagagatgtccacaacagaggagagtggacatgtctggtatgaacctggcggcagcgcaaaagatg

SEQ ID NO: 146115 - DNA, 103 bp, Artificial Sequence
  Synthetic Polynucleotide
taatacgactcactataggggcggccgaattttgcagatgccggttttctaacagaggagaagaaaaatggcatctgcaaacctggcggcagcgcaaaagatg

SEQ ID NO: 146116 - DNA, 103 bp, Artificial Sequence
  Synthetic Polynucleotide
taatacgactcactatagggccacatagagccacggcactttcataccagaacagaggagactggtaatgaagtgccgtaacctggcggcagcgcaaaagatg

SEQ ID NO: 146117 - DNA, 103 bp, Artificial Sequence
  Synthetic Polynucleotide
taatacgactcactatagggaagcacattcccacatagagccacggcactaacagaggagaagtgccatggctctatgtaacctggcggcagcgcaaaagatg

SEQ ID NO: 146118 - DNA, 103 bp, Artificial Sequence
  Synthetic Polynucleotide
taatacgactcactatagggaaaagaagagaagcacattcccacatagagaacagaggagactctatatgggaatgtgcaacctggcggcagcgcaaaagatg

SEQ ID NO: 146119 - DNA, 103 bp, Artificial Sequence
  Synthetic Polynucleotide
taatacgactcactatagggtgtgccagcaaaaagaagagaagcacattcaacagaggagagaatgtatgtctcttcttaacctggcggcagcgcaaaagatg

SEQ ID NO: 146120 - DNA, 103 bp, Artificial Sequence
  Synthetic Polynucleotide
taatacgactcactatagggtgatcctcaatgtgccagcaaaaagaagagaacagaggagactcttcatgttgctggcaaacctggcggcagcgcaaaagatg

SEQ ID NO: 146121 - DNA, 103 bp, Artificial Sequence
  Synthetic Polynucleotide
taatacgactcactatagggataactccagtgatcctcaatgtgccagcaaacagaggagatgctggatgattgaggataacctggcggcagcgcaaaagatg

SEQ ID NO: 146122 - DNA, 103 bp, Artificial Sequence
  Synthetic Polynucleotide
taatacgactcactatagggagttgatggaataactccagtgatcctcaaaacagaggagattgaggatgactggagttaacctggcggcagcgcaaaagatg

SEQ ID NO: 146123 - DNA, 103 bp, Artificial Sequence
  Synthetic Polynucleotide
taatacgactcactatagggcagtgcaagtagttgatggaataactccagaacagaggagactggagatgttccatcaaaacctggcggcagcgcaaaagatg

SEQ ID NO: 146124 - DNA, 103 bp, Artificial Sequence
  Synthetic Polynucleotide
taatacgactcactatagggtggctccccccagtgcaagtagttgatggaaacagaggagatccatcatgtacttgcacaacctggcggcagcgcaaaagatg

SEQ ID NO: 146125 - DNA, 103 bp, Artificial Sequence
  Synthetic Polynucleotide
taatacgactcactatagggaccatgtctttggctccccccagtgcaagtaacagaggagaacttgcatgggggggagcaacctggcggcagcgcaaaagatg

SEQ ID NO: 146126 - DNA, 103 bp, Artificial Sequence
  Synthetic Polynucleotide
taatacgactcactatagggcagtccttgggcggccgaattttgcagatgaacagaggagacatctgatgaattcggccaacctggcggcagcgcaaaagatg

SEQ ID NO: 146127 - DNA, 103 bp, Artificial Sequence
  Synthetic Polynucleotide
taatacgactcactatagggggcacaccataccatgtctttggctcccccaacagaggagagggggaatgaaagacatgaacctggcggcagcgcaaaagatg

SEQ ID NO: 146128 - DNA, 103 bp, Artificial Sequence
  Synthetic Polynucleotide
taatacgactcactatagggagcatgagatggcacaccataccatgtcttaacagaggagaaagacaatgtatggtgtgaacctggcggcagcgcaaaagatg

SEQ ID NO: 146129 - DNA, 103 bp, Artificial Sequence
  Synthetic Polynucleotide
taatacgactcactataggggttgctctgcagcatgagatggcacaccataacagaggagaatggtgatgcatctcatgaacctggcggcagcgcaaaagatg

SEQ ID NO: 146130 - DNA, 103 bp, Artificial Sequence
  Synthetic Polynucleotide
taatacgactcactatagggacctcctccagttgctctgcagcatgagataacagaggagaatctcaatgtgcagagcaaacctggcggcagcgcaaaagatg

SEQ ID NO: 146131 - DNA, 103 bp, Artificial Sequence
  Synthetic Polynucleotide
taatacgactcactatagggctctctcatcacctcctccagttgctctgcaacagaggagagcagagatgctggaggagaacctggcggcagcgcaaaagatg

SEQ ID NO: 146132 - DNA, 103 bp, Artificial Sequence
  Synthetic Polynucleotide
taatacgactcactatagggcgggggccagctctctcatcacctcctccaaacagaggagatggaggatgtgatgagagaacctggcggcagcgcaaaagatg

SEQ ID NO: 146133 - DNA, 103 bp, Artificial Sequence
  Synthetic Polynucleotide
taatacgactcactatagggtcaaataactcgggggccagctctctcatcaacagaggagagatgagatggctggccccaacctggcggcagcgcaaaagatg

SEQ ID NO: 146134 - DNA, 103 bp, Artificial Sequence
  Synthetic Polynucleotide
taatacgactcactatagggaggctgggattcaaataactcgggggccagaacagaggagactggccatggagttatttaacctggcggcagcgcaaaagatg

SEQ ID NO: 146135 - DNA, 103 bp, Artificial Sequence
  Synthetic Polynucleotide
taatacgactcactataggggcagaagatcaggctgggattcaaataactaacagaggagaagttatatgaatcccagcaacctggcggcagcgcaaaagatg

SEQ ID NO: 146136 - DNA, 103 bp, Artificial Sequence
  Synthetic Polynucleotide
taatacgactcactatagggactaactgatgcagaagatcaggctgggataacagaggagaatcccaatgtgatcttctaacctggcggcagcgcaaaagatg

SEQ ID NO: 146137 - DNA, 103 bp, Artificial Sequence
  Synthetic Polynucleotide
taatacgactcactatagggtggaggctgccagtccttgggcggccgaataacagaggagaattcggatgcccaaggacaacctggcggcagcgcaaaagatg

SEQ ID NO: 146138 - DNA, 103 bp, Artificial Sequence
  Synthetic Polynucleotide
taatacgactcactatagggcatgatggtaactaactgatgcagaagatcaacagaggagagatcttatgcatcagttaaacctggcggcagcgcaaaagatg

SEQ ID NO: 146139 - DNA, 103 bp, Artificial Sequence
  Synthetic Polynucleotide
taatacgactcactatagggcgttggggttcatgatggtaactaactgataacagaggagaatcagtatgttaccatcaaacctggcggcagcgcaaaagatg

SEQ ID NO: 146140 - DNA, 103 bp, Artificial Sequence
  Synthetic Polynucleotide
taatacgactcactatagggtccattagcacgttggggttcatgatggtaaacagaggagataccatatggaaccccaaaacctggcggcagcgcaaaagatg

SEQ ID NO: 146141 - DNA, 103 bp, Artificial Sequence
  Synthetic Polynucleotide
taatacgactcactatagggcacaccatgctccattagcacgttggggttaacagaggagaaaccccatggtgctaatgaacctggcggcagcgcaaaagatg

SEQ ID NO: 146142 - DNA, 103 bp, Artificial Sequence
  Synthetic Polynucleotide
taatacgactcactatagggtgtacacaggcacaccatgctccattagcaaacagaggagatgctaaatgagcatggtgaacctggcggcagcgcaaaagatg

SEQ ID NO: 146143 - DNA, 103 bp, Artificial Sequence
  Synthetic Polynucleotide
taatacgactcactatagggtgattggtcctgtacacaggcacaccatgcaacagaggagagcatggatggcctgtgtaaacctggcggcagcgcaaaagatg

SEQ ID NO: 146144 - DNA, 103 bp, Artificial Sequence
  Synthetic Polynucleotide
taatacgactcactataggggccagcacactgattggtcctgtacacaggaacagaggagacctgtgatgaggaccaataacctggcggcagcgcaaaagatg

SEQ ID NO: 146145 - DNA, 103 bp, Artificial Sequence
  Synthetic Polynucleotide
taatacgactcactatagggcaacaaactcgccagcacactgattggtccaacagaggagaggaccaatgagtgtgctgaacctggcggcagcgcaaaagatg

SEQ ID NO: 146146 - DNA, 103 bp, Artificial Sequence
  Synthetic Polynucleotide
taatacgactcactatagggggaaatgtcacaacaaactcgccagcacacaacagaggagagtgtgcatgcgagtttgtaacctggcggcagcgcaaaagatg

SEQ ID NO: 146147 - DNA, 103 bp, Artificial Sequence
  Synthetic Polynucleotide
taatacgactcactatagggataggcacgaggaaatgtcacaacaaactcaacagaggagagagtttatggtgacatttaacctggcggcagcgcaaaagatg

SEQ ID NO: 146148 - DNA, 103 bp, Artificial Sequence
  Synthetic Polynucleotide
taatacgactcactatagggcacaggcaaatggaggctgccagtccttggaacagaggagaccaaggatgggcagcctcaacctggcggcagcgcaaaagatg

SEQ ID NO: 146149 - DNA, 103 bp, Artificial Sequence
  Synthetic Polynucleotide
taatacgactcactatagggatccagagtgataggcacgaggaaatgtcaaacagaggagatgacatatgctcgtgcctaacctggcggcagcgcaaaagatg

SEQ ID NO: 146150 - DNA, 103 bp, Artificial Sequence
  Synthetic Polynucleotide
taatacgactcactatagggccctggttaaatccagagtgataggcacgaaacagaggagatcgtgcatgtcactctggaacctggcggcagcgcaaaagatg

SEQ ID NO: 146151 - DNA, 103 bp, Artificial Sequence
  Synthetic Polynucleotide
taatacgactcactatagggaaagttgtagccctggttaaatccagagtgaacagaggagacactctatgtttaaccagaacctggcggcagcgcaaaagatg

SEQ ID NO: 146152 - DNA, 103 bp, Artificial Sequence
  Synthetic Polynucleotide
taatacgactcactatagggcagcttcagcaaagttgtagccctggttaaaacagaggagattaaccatggctacaactaacctggcggcagcgcaaaagatg

SEQ ID NO: 146153 - DNA, 103 bp, Artificial Sequence
  Synthetic Polynucleotide
taatacgactcactatagggcagaagttcacagcttcagcaaagttgtagaacagaggagactacaaatgtgctgaagcaacctggcggcagcgcaaaagatg

SEQ ID NO: 146154 - DNA, 103 bp, Artificial Sequence
  Synthetic Polynucleotide
taatacgactcactataggggtcagcagtacagaagttcacagcttcagcaacagaggagagctgaaatggtgaacttcaacctggcggcagcgcaaaagatg

SEQ ID NO: 146155 - DNA, 103 bp, Artificial Sequence
  Synthetic Polynucleotide
taatacgactcactatagggtgggcaaccagtcagcagtacagaagttcaaacagaggagatgaactatggtactgctgaacctggcggcagcgcaaaagatg

SEQ ID NO: 146156 - DNA, 103 bp, Artificial Sequence
  Synthetic Polynucleotide
taatacgactcactatagggtgacgtccaatgggcaaccagtcagcagtaaacagaggagatactgcatgctggttgccaacctggcggcagcgcaaaagatg

SEQ ID NO: 146157 - DNA, 103 bp, Artificial Sequence
  Synthetic Polynucleotide
taatacgactcactatagggatttacacattgacgtccaatgggcaaccaaacagaggagatggttgatgattggacgtaacctggcggcagcgcaaaagatg

SEQ ID NO: 146158 - DNA, 103 bp, Artificial Sequence
  Synthetic Polynucleotide
taatacgactcactataggggtcggtaatgatttacacattgacgtccaaaacagaggagattggacatgaatgtgtaaaacctggcggcagcgcaaaagatg

SEQ ID NO: 146159 - DNA, 103 bp, Artificial Sequence
  Synthetic Polynucleotide
taatacgactcactatagggctttttacttcacaggcaaatggaggctgcaacagaggagagcagccatgatttgcctgaacctggcggcagcgcaaaagatg

SEQ ID NO: 146160 - DNA, 103 bp, Artificial Sequence
  Synthetic Polynucleotide
taatacgactcactatagggcgccttaggcgtcggtaatgatttacacataacagaggagaatgtgtatgtcattaccgaacctggcggcagcgcaaaagatg

SEQ ID NO: 146161 - DNA, 103 bp, Artificial Sequence
  Synthetic Polynucleotide
taatacgactcactataggggacacagtggcgccttaggcgtcggtaatgaacagaggagacattacatgcgcctaaggaacctggcggcagcgcaaaagatg

SEQ ID NO: 146162 - DNA, 103 bp, Artificial Sequence
  Synthetic Polynucleotide
taatacgactcactatagggcgtgtgaaaagacacagtggcgccttaggcaacagaggagagcctaaatggccactgtgaacctggcggcagcgcaaaagatg

SEQ ID NO: 146163 - DNA, 103 bp, Artificial Sequence
  Synthetic Polynucleotide
taatacgactcactatagggattagttcctcgtgtgaaaagacacagtggaacagaggagaccactgatgcttttcacaaacctggcggcagcgcaaaagatg

SEQ ID NO: 146164 - DNA, 103 bp, Artificial Sequence
  Synthetic Polynucleotide
taatacgactcactatagggcatcttgaaaattagttcctcgtgtgaaaaaacagaggagattttcaatggaggaactaaacctggcggcagcgcaaaagatg

SEQ ID NO: 146165 - DNA, 103 bp, Artificial Sequence
  Synthetic Polynucleotide
taatacgactcactataggggatctgctgccatcttgaaaattagttcctaacagaggagaaggaacatgttttcaagaaacctggcggcagcgcaaaagatg

SEQ ID NO: 146166 - DNA, 103 bp, Artificial Sequence
  Synthetic Polynucleotide
taatacgactcactatagggaagcattctggatctgctgccatcttgaaaaacagaggagatttcaaatgggcagcagaaacctggcggcagcgcaaaagatg

SEQ ID NO: 146167 - DNA, 103 bp, Artificial Sequence
  Synthetic Polynucleotide
taatacgactcactatagggccccacatctaagcattctggatctgctgcaacagaggagagcagcaatgccagaatgcaacctggcggcagcgcaaaagatg

SEQ ID NO: 146168 - DNA, 103 bp, Artificial Sequence
  Synthetic Polynucleotide
taatacgactcactatagggtggcagccagccccacatctaagcattctgaacagaggagacagaatatgtagatgtggaacctggcggcagcgcaaaagatg

SEQ ID NO: 146169 - DNA, 103 bp, Artificial Sequence
  Synthetic Polynucleotide
taatacgactcactatagggttgcagaccatggcagccagccccacatctaacagaggagaagatgtatggctggctgcaacctggcggcagcgcaaaagatg

SEQ ID NO: 146170 - DNA, 103 bp, Artificial Sequence
  Synthetic Polynucleotide
taatacgactcactataggggaaacgaaagctttttacttcacaggcaaaaacagaggagatttgccatggaagtaaaaaacctggcggcagcgcaaaagatg

SEQ ID NO: 146171 - DNA, 103 bp, Artificial Sequence
  Synthetic Polynucleotide
taatacgactcactatagggagtcaattctttgcagaccatggcagccagaacagaggagactggctatgatggtctgcaacctggcggcagcgcaaaagatg

SEQ ID NO: 146172 - DNA, 103 bp, Artificial Sequence
  Synthetic Polynucleotide
taatacgactcactatagggcagtcatgagagtcaattctttgcagaccaaacagaggagatggtctatgaagaattgaaacctggcggcagcgcaaaagatg

SEQ ID NO: 146173 - DNA, 103 bp, Artificial Sequence
  Synthetic Polynucleotide
taatacgactcactataggggtttcttcttcagtcatgagagtcaattctaacagaggagaagaattatgtctcatgacaacctggcggcagcgcaaaagatg

SEQ ID NO: 146174 - DNA, 103 bp, Artificial Sequence
  Synthetic Polynucleotide
taatacgactcactatagggtcttaatcgtgtttcttcttcagtcatgagaacagaggagactcatgatggaagaagaaaacctggcggcagcgcaaaagatg

SEQ ID NO: 146175 - DNA, 103 bp, Artificial Sequence
  Synthetic Polynucleotide
taatacgactcactatagggcaacagactctcttaatcgtgtttcttcttaacagaggagaaagaagatgcacgattaaaacctggcggcagcgcaaaagatg

SEQ ID NO: 146176 - DNA, 103 bp, Artificial Sequence
  Synthetic Polynucleotide
taatacgactcactatagggcccatctgtacaacagactctcttaatcgtaacagaggagaacgattatgagagtctgtaacctggcggcagcgcaaaagatg

SEQ ID NO: 146177 - DNA, 103 bp, Artificial Sequence
  Synthetic Polynucleotide
taatacgactcactatagggcatcaggacacccatctgtacaacagactcaacagaggagagagtctatggtacagatgaacctggcggcagcgcaaaagatg

SEQ ID NO: 146178 - DNA, 103 bp, Artificial Sequence
  Synthetic Polynucleotide
taatacgactcactatagggcttcttctgacatcaggacacccatctgtaaacagaggagatacagaatggtgtcctgaaacctggcggcagcgcaaaagatg

SEQ ID NO: 146179 - DNA, 103 bp, Artificial Sequence
  Synthetic Polynucleotide
taatacgactcactatagggtcaaacacttcttcttctgacatcaggacaaacagaggagatgtcctatggtcagaagaaacctggcggcagcgcaaaagatg

SEQ ID NO: 146180 - DNA, 103 bp, Artificial Sequence
  Synthetic Polynucleotide
taatacgactcactatagggaggaacaagttcaaacacttcttcttctgaaacagaggagatcagaaatggaagtgtttaacctggcggcagcgcaaaagatg

SEQ ID NO: 146181 - DNA, 103 bp, Artificial Sequence
  Synthetic Polynucleotide
taatacgactcactatagggcgaactccgccgcgtagccccccggccccaaacagaggagatggggcatgggggctacgaacctggcggcagcgcaaaagatg

SEQ ID NO: 146182 - DNA, 103 bp, Artificial Sequence
  Synthetic Polynucleotide
taatacgactcactatagggctcttggagtgaaacgaaagctttttacttaacagaggagaaagtaaatggctttcgttaacctggcggcagcgcaaaagatg

SEQ ID NO: 146183 - DNA, 103 bp, Artificial Sequence
  Synthetic Polynucleotide
taatacgactcactataggggctcatcatcaggaacaagttcaaacacttaacagaggagaaagtgtatgaacttgttcaacctggcggcagcgcaaaagatg

SEQ ID NO: 146184 - DNA, 103 bp, Artificial Sequence
  Synthetic Polynucleotide
taatacgactcactataggggaacactgccgctcatcatcaggaacaagtaacagaggagaacttgtatgtgatgatgaaacctggcggcagcgcaaaagatg

SEQ ID NO: 146185 - DNA, 103 bp, Artificial Sequence
  Synthetic Polynucleotide
taatacgactcactatagggtctgcatgctgaacactgccgctcatcatcaacagaggagagatgatatgcggcagtgtaacctggcggcagcgcaaaagatg

SEQ ID NO: 146186 - DNA, 103 bp, Artificial Sequence
  Synthetic Polynucleotide
taatacgactcactatagggaacatgtggttctgcatgctgaacactgccaacagaggagaggcagtatgcagcatgcaaacctggcggcagcgcaaaagatg

SEQ ID NO: 146187 - DNA, 103 bp, Artificial Sequence
  Synthetic Polynucleotide
taatacgactcactataggggcagagagaaaacatgtggttctgcatgctaacagaggagaagcatgatgaaccacatgaacctggcggcagcgcaaaagatg

SEQ ID NO: 146188 - DNA, 103 bp, Artificial Sequence
  Synthetic Polynucleotide
taatacgactcactatagggacatgtgagagcagagagaaaacatgtggtaacagaggagaaccacaatgtttctctctaacctggcggcagcgcaaaagatg

SEQ ID NO: 146189 - DNA, 103 bp, Artificial Sequence
  Synthetic Polynucleotide
taatacgactcactataggggattacaggaacatgtgagagcagagagaaaacagaggagattctctatgctctcacataacctggcggcagcgcaaaagatg

SEQ ID NO: 146190 - DNA, 103 bp, Artificial Sequence
  Synthetic Polynucleotide
taatacgactcactatagggagccgctcaggattacaggaacatgtgagaaacagaggagatctcacatgttcctgtaaaacctggcggcagcgcaaaagatg

SEQ ID NO: 146191 - DNA, 103 bp, Artificial Sequence
  Synthetic Polynucleotide
taatacgactcactataggggagacatacaagccgctcaggattacaggaaacagaggagatcctgtatgcctgagcggaacctggcggcagcgcaaaagatg

SEQ ID NO: 146192 - DNA, 103 bp, Artificial Sequence
  Synthetic Polynucleotide
taatacgactcactatagggttggatggtagagacatacaagccgctcagaacagaggagactgagcatgttgtatgtcaacctggcggcagcgcaaaagatg

SEQ ID NO: 146193 - DNA, 103 bp, Artificial Sequence
  Synthetic Polynucleotide
taatacgactcactatagggaggcgctggactcttggagtgaaacgaaagaacagaggagactttcgatgcactccaagaacctggcggcagcgcaaaagatg

SEQ ID NO: 146194 - DNA, 103 bp, Artificial Sequence
  Synthetic Polynucleotide
taatacgactcactatagggcacagatcagttggatggtagagacatacaaacagaggagatgtatgatgctaccatccaacctggcggcagcgcaaaagatg

SEQ ID NO: 146195 - DNA, 103 bp, Artificial Sequence
  Synthetic Polynucleotide
taatacgactcactatagggggggcaggggcacagatcagttggatggtaaacagaggagataccatatgactgatctgaacctggcggcagcgcaaaagatg

SEQ ID NO: 146196 - DNA, 103 bp, Artificial Sequence
  Synthetic Polynucleotide
taatacgactcactatagggtcttctgcatggggcaggggcacagatcagaacagaggagactgatcatggcccctgccaacctggcggcagcgcaaaagatg

SEQ ID NO: 146197 - DNA, 103 bp, Artificial Sequence
  Synthetic Polynucleotide
taatacgactcactatagggctaagacatttcttctgcatggggcaggggaacagaggagacccctgatgcatgcagaaaacctggcggcagcgcaaaagatg

SEQ ID NO: 146198 - DNA, 103 bp, Artificial Sequence
  Synthetic Polynucleotide
taatacgactcactataggggtagcgatatctaagacatttcttctgcataacagaggagaatgcagatgaaatgtcttaacctggcggcagcgcaaaagatg

SEQ ID NO: 146199 - DNA, 103 bp, Artificial Sequence
  Synthetic Polynucleotide
taatacgactcactatagggcttctaatgggtagcgatatctaagacattaacagaggagaaatgtcatggatatcgctaacctggcggcagcgcaaaagatg

SEQ ID NO: 146200 - DNA, 103 bp, Artificial Sequence
  Synthetic Polynucleotide
taatacgactcactataggggaagggaggtcttctaatgggtagcgatataacagaggagaatatcgatgcccattagaaacctggcggcagcgcaaaagatg

SEQ ID NO: 146201 - DNA, 103 bp, Artificial Sequence
  Synthetic Polynucleotide
taatacgactcactatagggatatagcagagaagggaggtcttctaatggaacagaggagaccattaatggacctccctaacctggcggcagcgcaaaagatg

SEQ ID NO: 146202 - DNA, 103 bp, Artificial Sequence
  Synthetic Polynucleotide
taatacgactcactatagggcttttacaccatatagcagagaagggaggtaacagaggagaacctccatgctctgctataacctggcggcagcgcaaaagatg

SEQ ID NO: 146203 - DNA, 103 bp, Artificial Sequence
  Synthetic Polynucleotide
taatacgactcactatagggtgtgccctgacttttacaccatatagcagaaacagaggagatctgctatgtggtgtaaaaacctggcggcagcgcaaaagatg

SEQ ID NO: 146204 - DNA, 103 bp, Artificial Sequence
  Synthetic Polynucleotide
taatacgactcactatagggaagttcattcaggcgctggactcttggagtaacagaggagaactccaatggtccagcgcaacctggcggcagcgcaaaagatg

SEQ ID NO: 146205 - DNA, 103 bp, Artificial Sequence
  Synthetic Polynucleotide
taatacgactcactataggggtcataggactgtgccctgacttttacaccaacagaggagaggtgtaatggtcagggcaaacctggcggcagcgcaaaagatg

SEQ ID NO: 146206 - DNA, 103 bp, Artificial Sequence
  Synthetic Polynucleotide
taatacgactcactatagggtgacccaagtgtcataggactgtgccctgaaacagaggagatcagggatgagtcctatgaacctggcggcagcgcaaaagatg

SEQ ID NO: 146207 - DNA, 103 bp, Artificial Sequence
  Synthetic Polynucleotide
taatacgactcactataggggtaacacgactgacccaagtgtcataggacaacagaggagagtcctaatgcacttgggtaacctggcggcagcgcaaaagatg

SEQ ID NO: 146208 - DNA, 103 bp, Artificial Sequence
  Synthetic Polynucleotide
taatacgactcactatagggcaatgcttctgtaacacgactgacccaagtaacagaggagaacttggatgagtcgtgttaacctggcggcagcgcaaaagatg

SEQ ID NO: 146209 - DNA, 103 bp, Artificial Sequence
  Synthetic Polynucleotide
taatacgactcactatagggagttagcagacaatgcttctgtaacacgacaacagaggagagtcgtgatgcagaagcataacctggcggcagcgcaaaagatg

SEQ ID NO: 146210 - DNA, 103 bp, Artificial Sequence
  Synthetic Polynucleotide
taatacgactcactatagggttgtggttgaagttagcagacaatgcttctaacagaggagaagaagcatggtctgctaaaacctggcggcagcgcaaaagatg

SEQ ID NO: 146211 - DNA, 103 bp, Artificial Sequence
  Synthetic Polynucleotide
taatacgactcactatagggcaaatcttttttgtggttgaagttagcagaaacagaggagatctgctatgttcaaccacaacctggcggcagcgcaaaagatg

SEQ ID NO: 146212 - DNA, 103 bp, Artificial Sequence
  Synthetic Polynucleotide
taatacgactcactataggggcaattcaatcaaatcttttttgtggttgaaacagaggagatcaaccatgaaaaagattaacctggcggcagcgcaaaagatg

SEQ ID NO: 146213 - DNA, 103 bp, Artificial Sequence
  Synthetic Polynucleotide
taatacgactcactatagggagcattactcgcaattcaatcaaatcttttaacagaggagaaaaagaatggattgaattaacctggcggcagcgcaaaagatg

SEQ ID NO: 146214 - DNA, 103 bp, Artificial Sequence
  Synthetic Polynucleotide
taatacgactcactatagggagcatcttccagcattactcgcaattcaataacagaggagaattgaaatgcgagtaatgaacctggcggcagcgcaaaagatg

SEQ ID NO: 146215 - DNA, 103 bp, Artificial Sequence
  Synthetic Polynucleotide
taatacgactcactatagggtcattgcctcaagttcattcaggcgctggaaacagaggagatccagcatgtgaatgaacaacctggcggcagcgcaaaagatg

SEQ ID NO: 146216 - DNA, 103 bp, Artificial Sequence
  Synthetic Polynucleotide
taatacgactcactatagggtcctatcctcagcatcttccagcattactcaacagaggagagagtaaatgtggaagatgaacctggcggcagcgcaaaagatg

SEQ ID NO: 146217 - DNA, 103 bp, Artificial Sequence
  Synthetic Polynucleotide
taatacgactcactatagggtctgggtatttcctatcctcagcatcttccaacagaggagaggaagaatgtgaggatagaacctggcggcagcgcaaaagatg

SEQ ID NO: 146218 - DNA, 103 bp, Artificial Sequence
  Synthetic Polynucleotide
taatacgactcactataggggagatcattctctgggtatttcctatcctcaacagaggagagaggatatgaaatacccaaacctggcggcagcgcaaaagatg

SEQ ID NO: 146219 - DNA, 103 bp, Artificial Sequence
  Synthetic Polynucleotide
taatacgactcactataggggttttcgaaagagatcattctctgggtattaacagaggagaaataccatgagaatgatcaacctggcggcagcgcaaaagatg

SEQ ID NO: 146220 - DNA, 103 bp, Artificial Sequence
  Synthetic Polynucleotide
taatacgactcactataggggcatccctgagttttcgaaagagatcattcaacagaggagagaatgaatgctttcgaaaaacctggcggcagcgcaaaagatg

SEQ ID NO: 146221 - DNA, 103 bp, Artificial Sequence
  Synthetic Polynucleotide
taatacgactcactatagggttcttttacagcatccctgagttttcgaaaaacagaggagatttcgaatgctcagggataacctggcggcagcgcaaaagatg

SEQ ID NO: 146222 - DNA, 103 bp, Artificial Sequence
  Synthetic Polynucleotide
taatacgactcactatagggaggtctcagcttcttttacagcatccctgaaacagaggagatcagggatgctgtaaaagaacctggcggcagcgcaaaagatg

SEQ ID NO: 146223 - DNA, 103 bp, Artificial Sequence
  Synthetic Polynucleotide
taatacgactcactatagggacagaagcacaggtctcagcttcttttacaaacagaggagatgtaaaatgagctgagacaacctggcggcagcgcaaaagatg

SEQ ID NO: 146224 - DNA, 103 bp, Artificial Sequence
  Synthetic Polynucleotide
taatacgactcactatagggcagctgagccacagaagcacaggtctcagcaacagaggagagctgagatgtgtgcttctaacctggcggcagcgcaaaagatg

SEQ ID NO: 146225 - DNA, 103 bp, Artificial Sequence
  Synthetic Polynucleotide
taatacgactcactatagggtgctcagaagcagctgagccacagaagcacaacagaggagagtgcttatgtggctcagcaacctggcggcagcgcaaaagatg

SEQ ID NO: 146226 - DNA, 103 bp, Artificial Sequence
  Synthetic Polynucleotide
taatacgactcactatagggctcactctggtcattgcctcaagttcattcaacagaggagagaatgaatgtgaggcaataacctggcggcagcgcaaaagatg

SEQ ID NO: 146227 - DNA, 103 bp, Artificial Sequence
  Synthetic Polynucleotide
taatacgactcactatagggttctgctttttgctcagaagcagctgagccaacagaggagaggctcaatggcttctgagaacctggcggcagcgcaaaagatg

SEQ ID NO: 146228 - DNA, 103 bp, Artificial Sequence
  Synthetic Polynucleotide
taatacgactcactatagggctgtctgtgtttctgctttttgctcagaagaacagaggagacttctgatgaaaaagcagaacctggcggcagcgcaaaagatg

SEQ ID NO: 146229 - DNA, 103 bp, Artificial Sequence
  Synthetic Polynucleotide
taatacgactcactatagggtatctgggctctgtctgtgtttctgcttttaacagaggagaaaaagcatgaacacagacaacctggcggcagcgcaaaagatg

SEQ ID NO: 146230 - DNA, 103 bp, Artificial Sequence
  Synthetic Polynucleotide
taatacgactcactataggggtcctcccactatctgggctctgtctgtgtaacagaggagaacacagatggagcccagaaacctggcggcagcgcaaaagatg

SEQ ID NO: 146231 - DNA, 103 bp, Artificial Sequence
  Synthetic Polynucleotide
taatacgactcactatagggtttggtccgagtcctcccactatctgggctaacagaggagaagcccaatgagtgggaggaacctggcggcagcgcaaaagatg

SEQ ID NO: 146232 - DNA, 103 bp, Artificial Sequence
  Synthetic Polynucleotide
taatacgactcactatagggccactgtcagtttggtccgagtcctcccacaacagaggagagtgggaatgctcggaccaaacctggcggcagcgcaaaagatg

SEQ ID NO: 146233 - DNA, 103 bp, Artificial Sequence
  Synthetic Polynucleotide
taatacgactcactatagggttcaattcttccactgtcagtttggtccgaaacagaggagatcggacatgactgacagtaacctggcggcagcgcaaaagatg

SEQ ID NO: 146234 - DNA, 103 bp, Artificial Sequence
  Synthetic Polynucleotide
taatacgactcactataggggacaaaggccttcaattcttccactgtcagaacagaggagactgacaatggaagaattgaacctggcggcagcgcaaaagatg

SEQ ID NO: 146235 - DNA, 103 bp, Artificial Sequence
  Synthetic Polynucleotide
taatacgactcactatagggaaagttgttggacaaaggccttcaattcttaacagaggagaaagaatatgaggcctttgaacctggcggcagcgcaaaagatg

SEQ ID NO: 146236 - DNA, 103 bp, Artificial Sequence
  Synthetic Polynucleotide
taatacgactcactatagggggaagactaaaaagttgttggacaaaggccaacagaggagaggccttatgccaacaactaacctggcggcagcgcaaaagatg

SEQ ID NO: 146237 - DNA, 103 bp, Artificial Sequence
  Synthetic Polynucleotide
taatacgactcactataggggaaatccaatctcactctggtcattgcctcaacagaggagagaggcaatgaccagagtgaacctggcggcagcgcaaaagatg

SEQ ID NO: 146238 - DNA, 103 bp, Artificial Sequence
  Synthetic Polynucleotide
taatacgactcactataggggatgacacacggaagactaaaaagttgttgaacagaggagacaacaaatgtttagtcttaacctggcggcagcgcaaaagatg

SEQ ID NO: 146239 - DNA, 103 bp, Artificial Sequence
  Synthetic Polynucleotide
taatacgactcactataggggagcttggctgatgacacacggaagactaaaacagaggagattagtcatgcgtgtgtcaaacctggcggcagcgcaaaagatg

SEQ ID NO: 146240 - DNA, 103 bp, Artificial Sequence
  Synthetic Polynucleotide
taatacgactcactatagggtttacttgccgagcttggctgatgacacacaacagaggagagtgtgtatgcagccaagcaacctggcggcagcgcaaaagatg

SEQ ID NO: 146241 - DNA, 103 bp, Artificial Sequence
  Synthetic Polynucleotide
taatacgactcactatagggtagcagattctttacttgccgagcttggctaacagaggagaagccaaatgcggcaagtaaacctggcggcagcgcaaaagatg

SEQ ID NO: 146242 - DNA, 103 bp, Artificial Sequence
  Synthetic Polynucleotide
taatacgactcactatagggccacatcatctagcagattctttacttgccaacagaggagaggcaagatgagaatctgcaacctggcggcagcgcaaaagatg

SEQ ID NO: 146243 - DNA, 103 bp, Artificial Sequence
  Synthetic Polynucleotide
taatacgactcactatagggtgaaactcttccacatcatctagcagattcaacagaggagagaatctatgagatgatgtaacctggcggcagcgcaaaagatg

SEQ ID NO: 146244 - DNA, 103 bp, Artificial Sequence
  Synthetic Polynucleotide
taatacgactcactatagggagcacgttcatgaaactcttccacatcatcaacagaggagagatgatatggaagagtttaacctggcggcagcgcaaaagatg

SEQ ID NO: 146245 - DNA, 103 bp, Artificial Sequence
  Synthetic Polynucleotide
taatacgactcactatagggtggcctcctgagcacgttcatgaaactcttaacagaggagaaagagtatgatgaacgtgaacctggcggcagcgcaaaagatg

SEQ ID NO: 146246 - DNA, 103 bp, Artificial Sequence
  Synthetic Polynucleotide
taatacgactcactatagggtcatccatcatggcctcctgagcacgttcaaacagaggagatgaacgatgtcaggaggcaacctggcggcagcgcaaaagatg

SEQ ID NO: 146247 - DNA, 103 bp, Artificial Sequence
  Synthetic Polynucleotide
taatacgactcactatagggatctggggtttcatccatcatggcctcctgaacagaggagacaggagatgatgatggataacctggcggcagcgcaaaagatg

SEQ ID NO: 146248 - DNA, 103 bp, Artificial Sequence
  Synthetic Polynucleotide
taatacgactcactataggggttgatccaagaaatccaatctcactctggaacagaggagaccagagatggattggattaacctggcggcagcgcaaaagatg

SEQ ID NO: 146249 - DNA, 103 bp, Artificial Sequence
  Synthetic Polynucleotide
taatacgactcactataggggtttggaagaatctggggtttcatccatcaaacagaggagatgatggatgaaaccccagaacctggcggcagcgcaaaagatg

SEQ ID NO: 146250 - DNA, 103 bp, Artificial Sequence
  Synthetic Polynucleotide
taatacgactcactatagggaacatctggagtttggaagaatctggggttaacagaggagaaaccccatgttcttccaaaacctggcggcagcgcaaaagatg

SEQ ID NO: 146251 - DNA, 103 bp, Artificial Sequence
  Synthetic Polynucleotide
taatacgactcactatagggcatatctatcaacatctggagtttggaagaaacagaggagatcttccatgctccagatgaacctggcggcagcgcaaaagatg

SEQ ID NO: 146252 - DNA, 103 bp, Artificial Sequence
  Synthetic Polynucleotide
taatacgactcactataggggactagagcccatatctatcaacatctggaaacagaggagatccagaatgtgatagataaacctggcggcagcgcaaaagatg

SEQ ID NO: 146253 - DNA, 103 bp, Artificial Sequence
  Synthetic Polynucleotide
taatacgactcactatagggtccacatagagactagagcccatatctatcaacagaggagagatagaatggggctctagaacctggcggcagcgcaaaagatg

SEQ ID NO: 146254 - DNA, 103 bp, Artificial Sequence
  Synthetic Polynucleotide
taatacgactcactatagggttcagggagttccacatagagactagagccaacagaggagaggctctatgctctatgtgaacctggcggcagcgcaaaagatg

SEQ ID NO: 146255 - DNA, 103 bp, Artificial Sequence
  Synthetic Polynucleotide
taatacgactcactataggggtcgtggtaattcagggagttccacatagaaacagaggagatctatgatgaactccctgaacctggcggcagcgcaaaagatg

SEQ ID NO: 146256 - DNA, 103 bp, Artificial Sequence
  Synthetic Polynucleotide
taatacgactcactatagggtcttgcttcagtcgtggtaattcagggagtaacagaggagaactcccatgattaccacgaacctggcggcagcgcaaaagatg

SEQ ID NO: 146257 - DNA, 103 bp, Artificial Sequence
  Synthetic Polynucleotide
taatacgactcactatagggctgttgtagctcttgcttcagtcgtggtaaaacagaggagattaccaatgctgaagcaaaacctggcggcagcgcaaaagatg

SEQ ID NO: 146258 - DNA, 103 bp, Artificial Sequence
  Synthetic Polynucleotide
taatacgactcactatagggaccaccgagcctgttgtagctcttgcttcaaacagaggagatgaagcatgagctacaacaacctggcggcagcgcaaaagatg

SEQ ID NO: 146259 - DNA, 103 bp, Artificial Sequence
  Synthetic Polynucleotide
taatacgactcactatagggaattttgctagttgatccaagaaatccaataacagaggagaattggaatgcttggatcaaacctggcggcagcgcaaaagatg

SEQ ID NO: 146260 - DNA, 103 bp, Artificial Sequence
  Synthetic Polynucleotide
taatacgactcactatagggacttcgtccaaccaccgagcctgttgtagcaacagaggagagctacaatgggctcggtgaacctggcggcagcgcaaaagatg

SEQ ID NO: 146261 - DNA, 103 bp, Artificial Sequence
  Synthetic Polynucleotide
taatacgactcactatagggggtcagtcttacttcgtccaaccaccgagcaacagaggagagctcggatgttggacgaaaacctggcggcagcgcaaaagatg

SEQ ID NO: 146262 - DNA, 103 bp, Artificial Sequence
  Synthetic Polynucleotide
taatacgactcactataggggatctgataaggtcagtcttacttcgtccaaacagaggagatggacgatgtaagactgaaacctggcggcagcgcaaaagatg

SEQ ID NO: 146263 - DNA, 103 bp, Artificial Sequence
  Synthetic Polynucleotide
taatacgactcactatagggacttgttgcggatctgataaggtcagtcttaacagaggagaaagactatgcttatcagaaacctggcggcagcgcaaaagatg

SEQ ID NO: 146264 - DNA, 103 bp, Artificial Sequence
  Synthetic Polynucleotide
taatacgactcactatagggatccaaagtgacttgttgcggatctgataaaacagaggagattatcaatgccgcaacaaaacctggcggcagcgcaaaagatg

SEQ ID NO: 146265 - DNA, 103 bp, Artificial Sequence
  Synthetic Polynucleotide
taatacgactcactatagggtcttcatgacatccaaagtgacttgttgcgaacagaggagacgcaacatgtcactttggaacctggcggcagcgcaaaagatg

SEQ ID NO: 146266 - DNA, 103 bp, Artificial Sequence
  Synthetic Polynucleotide
taatacgactcactatagggtctatcagcttcttcatgacatccaaagtgaacagaggagacactttatgtgtcatgaaaacctggcggcagcgcaaaagatg

SEQ ID NO: 146267 - DNA, 103 bp, Artificial Sequence
  Synthetic Polynucleotide
taatacgactcactatagggtaccccagagtctatcagcttcttcatgacaacagaggagagtcatgatgaagctgataaacctggcggcagcgcaaaagatg

SEQ ID NO: 146268 - DNA, 103 bp, Artificial Sequence
  Synthetic Polynucleotide
taatacgactcactataggggtgccaaccctaccccagagtctatcagctaacagaggagaagctgaatgactctggggaacctggcggcagcgcaaaagatg

SEQ ID NO: 146269 - DNA, 103 bp, Artificial Sequence
  Synthetic Polynucleotide
taatacgactcactataggggcatggtggggtgccaaccctaccccagagaacagaggagactctggatgagggttggcaacctggcggcagcgcaaaagatg

SEQ ID NO: 146270 - DNA, 103 bp, Artificial Sequence
  Synthetic Polynucleotide
taatacgactcactatagggaagttcccaaaattttgctagttgatccaaaacagaggagattggatatgctagcaaaaaacctggcggcagcgcaaaagatg

SEQ ID NO: 146271 - DNA, 103 bp, Artificial Sequence
  Synthetic Polynucleotide
taatacgactcactatagggtttctccacagcatggtggggtgccaacccaacagaggagagggttgatgccccaccataacctggcggcagcgcaaaagatg

SEQ ID NO: 146272 - DNA, 103 bp, Artificial Sequence
  Synthetic Polynucleotide
taatacgactcactatagggcagccattgctttctccacagcatggtgggaacagaggagacccaccatgctgtggagaaacctggcggcagcgcaaaagatg

SEQ ID NO: 146273 - DNA, 103 bp, Artificial Sequence
  Synthetic Polynucleotide
taatacgactcactatagggtcctgtagttcagccattgctttctccacaaacagaggagatgtggaatgagcaatggcaacctggcggcagcgcaaaagatg

SEQ ID NO: 146274 - DNA, 103 bp, Artificial Sequence
  Synthetic Polynucleotide
taatacgactcactatagggtgtaaggagctcctgtagttcagccattgcaacagaggagagcaatgatggaactacagaacctggcggcagcgcaaaagatg

SEQ ID NO: 146275 - DNA, 103 bp, Artificial Sequence
  Synthetic Polynucleotide
taatacgactcactataggggttcagagactgtaaggagctcctgtagttaacagaggagaaactacatgagctccttaaacctggcggcagcgcaaaagatg

SEQ ID NO: 146276 - DNA, 103 bp, Artificial Sequence
  Synthetic Polynucleotide
taatacgactcactatagggtcttcccatcgttcagagactgtaaggagcaacagaggagagctcctatgagtctctgaaacctggcggcagcgcaaaagatg

SEQ ID NO: 146277 - DNA, 103 bp, Artificial Sequence
  Synthetic Polynucleotide
taatacgactcactatagggcttagccttttcttcccatcgttcagagacaacagaggagagtctctatgcgatgggaaaacctggcggcagcgcaaaagatg

SEQ ID NO: 146278 - DNA, 103 bp, Artificial Sequence
  Synthetic Polynucleotide
taatacgactcactataggggtaggcagaccttagccttttcttcccatcaacagaggagagatgggatgaaaaggctaaacctggcggcagcgcaaaagatg

SEQ ID NO: 146279 - DNA, 103 bp, Artificial Sequence
  Synthetic Polynucleotide
taatacgactcactatagggggtcttgcctgtaggcagaccttagcctttaacagaggagaaaaggcatgggtctgcctaacctggcggcagcgcaaaagatg

SEQ ID NO: 146280 - DNA, 103 bp, Artificial Sequence
  Synthetic Polynucleotide
taatacgactcactatagggactgtgcctcggtcttgcctgtaggcagacaacagaggagagtctgcatgcaggcaagaaacctggcggcagcgcaaaagatg

SEQ ID NO: 146281 - DNA, 103 bp, Artificial Sequence
  Synthetic Polynucleotide
taatacgactcactatagggtagatccttgaagttcccaaaattttgctaaacagaggagatagcaaatgtttgggaacaacctggcggcagcgcaaaagatg

SEQ ID NO: 146282 - DNA, 103 bp, Artificial Sequence
  Synthetic Polynucleotide
taatacgactcactatagggaacttgccacactgtgcctcggtcttgcctaacagaggagaaggcaaatgcgaggcacaaacctggcggcagcgcaaaagatg

SEQ ID NO: 146283 - DNA, 103 bp, Artificial Sequence
  Synthetic Polynucleotide
taatacgactcactatagggatgctttctaaacttgccacactgtgcctcaacagaggagagaggcaatgtgtggcaagaacctggcggcagcgcaaaagatg

SEQ ID NO: 146284 - DNA, 103 bp, Artificial Sequence
  Synthetic Polynucleotide
taatacgactcactatagggttcattcacaatgctttctaaacttgccacaacagaggagagtggcaatgttagaaagcaacctggcggcagcgcaaaagatg

SEQ ID NO: 146285 - DNA, 103 bp, Artificial Sequence
  Synthetic Polynucleotide
taatacgactcactatagggtgttcttggcttcattcacaatgctttctaaacagaggagatagaaaatgttgtgaatgaacctggcggcagcgcaaaagatg

SEQ ID NO: 146286 - DNA, 103 bp, Artificial Sequence
  Synthetic Polynucleotide
taatacgactcactatagggaaggctggaatgttcttggcttcattcacaaacagaggagatgtgaaatgagccaagaaaacctggcggcagcgcaaaagatg

SEQ ID NO: 146287 - DNA, 103 bp, Artificial Sequence
  Synthetic Polynucleotide
taatacgactcactatagggattgggtagaaaggctggaatgttcttggcaacagaggagagccaagatgattccagccaacctggcggcagcgcaaaagatg

SEQ ID NO: 146288 - DNA, 103 bp, Artificial Sequence
  Synthetic Polynucleotide
taatacgactcactatagggaggacaacacattgggtagaaaggctggaaaacagaggagattccagatgttctacccaaacctggcggcagcgcaaaagatg

SEQ ID NO: 146289 - DNA, 103 bp, Artificial Sequence
  Synthetic Polynucleotide
taatacgactcactataggggcttctttcaaggacaacacattgggtagaaacagaggagatctaccatgtgtgttgtcaacctggcggcagcgcaaaagatg

SEQ ID NO: 146290 - DNA, 103 bp, Artificial Sequence
  Synthetic Polynucleotide
taatacgactcactatagggcttttgtaaggcttctttcaaggacaacacaacagaggagagtgttgatgttgaaagaaaacctggcggcagcgcaaaagatg

SEQ ID NO: 146291 - DNA, 103 bp, Artificial Sequence
  Synthetic Polynucleotide
taatacgactcactatagggattctcgagccttttgtaaggcttctttcaaacagaggagatgaaagatgccttacaaaaacctggcggcagcgcaaaagatg

SEQ ID NO: 146292 - DNA, 103 bp, Artificial Sequence
  Synthetic Polynucleotide
taatacgactcactatagggggcggtggcacgaactccgccgcgtagcccaacagaggagagggctaatgggcggagttaacctggcggcagcgcaaaagatg

SEQ ID NO: 146293 - DNA, 103 bp, Artificial Sequence
  Synthetic Polynucleotide
taatacgactcactatagggatcttcagagtagatccttgaagttcccaaaacagaggagattgggaatgtcaaggatcaacctggcggcagcgcaaaagatg

SEQ ID NO: 146294 - DNA, 103 bp, Artificial Sequence
  Synthetic Polynucleotide
taatacgactcactatagggttagcggtccattctcgagccttttgtaagaacagaggagacttacaatgggctcgagaaacctggcggcagcgcaaaagatg

SEQ ID NO: 146295 - DNA, 103 bp, Artificial Sequence
  Synthetic Polynucleotide
taatacgactcactatagggagcttccactttagcggtccattctcgagcaacagaggagagctcgaatgtggaccgctaacctggcggcagcgcaaaagatg

SEQ ID NO: 146296 - DNA, 103 bp, Artificial Sequence
  Synthetic Polynucleotide
taatacgactcactatagggcactctgaatagcttccactttagcggtccaacagaggagaggaccgatgaagtggaagaacctggcggcagcgcaaaagatg

SEQ ID NO: 146297 - DNA, 103 bp, Artificial Sequence
  Synthetic Polynucleotide
taatacgactcactatagggtaattgctgccactctgaatagcttccactaacagaggagaagtggaatgtattcagagaacctggcggcagcgcaaaagatg

SEQ ID NO: 146298 - DNA, 103 bp, Artificial Sequence
  Synthetic Polynucleotide
taatacgactcactatagggcaaataagcgtaattgctgccactctgaataacagaggagaattcagatgggcagcaataacctggcggcagcgcaaaagatg

SEQ ID NO: 146299 - DNA, 103 bp, Artificial Sequence
  Synthetic Polynucleotide
taatacgactcactatagggcaagctgctccaaataagcgtaattgctgcaacagaggagagcagcaatgacgcttattaacctggcggcagcgcaaaagatg

SEQ ID NO: 146300 - DNA, 103 bp, Artificial Sequence
  Synthetic Polynucleotide
taatacgactcactataggggacaagctctcaagctgctccaaataagcgaacagaggagacgcttaatgggagcagctaacctggcggcagcgcaaaagatg

SEQ ID NO: 146301 - DNA, 103 bp, Artificial Sequence
  Synthetic Polynucleotide
taatacgactcactatagggtcctttcgcagacaagctctcaagctgctcaacagaggagagagcagatggagagcttgaacctggcggcagcgcaaaagatg

SEQ ID NO: 146302 - DNA, 103 bp, Artificial Sequence
  Synthetic Polynucleotide
taatacgactcactataggggaatagggcgtcctttcgcagacaagctctaacagaggagaagagctatgctgcgaaagaacctggcggcagcgcaaaagatg

SEQ ID NO: 146303 - DNA, 103 bp, Artificial Sequence
  Synthetic Polynucleotide
taatacgactcactatagggagacgcacaggaatagggcgtcctttcgcaaacagaggagatgcgaaatgacgccctataacctggcggcagcgcaaaagatg

SEQ ID NO: 146304 - DNA, 103 bp, Artificial Sequence
  Synthetic Polynucleotide
taatacgactcactatagggtaccacagggatcttcagagtagatccttgaacagaggagacaaggaatgactctgaagaacctggcggcagcgcaaaagatg

SEQ ID NO: 146305 - DNA, 103 bp, Artificial Sequence
  Synthetic Polynucleotide
taatacgactcactatagggcagtgcttcaagacgcacaggaatagggcgaacagaggagacgccctatgcctgtgcgtaacctggcggcagcgcaaaagatg

SEQ ID NO: 146306 - DNA, 103 bp, Artificial Sequence
  Synthetic Polynucleotide
taatacgactcactatagggccacttgcggcagtgcttcaagacgcacagaacagaggagactgtgcatgttgaagcacaacctggcggcagcgcaaaagatg

SEQ ID NO: 146307 - DNA, 103 bp, Artificial Sequence
  Synthetic Polynucleotide
taatacgactcactatagggacctgtgattccacttgcggcagtgcttcaaacagaggagatgaagcatggccgcaagtaacctggcggcagcgcaaaagatg

SEQ ID NO: 146308 - DNA, 103 bp, Artificial Sequence
  Synthetic Polynucleotide
taatacgactcactatagggtgctgctgctacctgtgattccacttgcggaacagaggagaccgcaaatggaatcacagaacctggcggcagcgcaaaagatg

SEQ ID NO: 146309 - DNA, 103 bp, Artificial Sequence
  Synthetic Polynucleotide
taatacgactcactatagggtccatgcccgtgctgctgctacctgtgattaacagaggagaaatcacatgtagcagcagaacctggcggcagcgcaaaagatg

SEQ ID NO: 146310 - DNA, 103 bp, Artificial Sequence
  Synthetic Polynucleotide
taatacgactcactataggggtccgttctctccatgcccgtgctgctgctaacagaggagaagcagcatgacgggcatgaacctggcggcagcgcaaaagatg

SEQ ID NO: 146311 - DNA, 103 bp, Artificial Sequence
  Synthetic Polynucleotide
taatacgactcactatagggcgtccgcccagtccgttctctccatgcccgaacagaggagacgggcaatgagagaacggaacctggcggcagcgcaaaagatg

SEQ ID NO: 146312 - DNA, 103 bp, Artificial Sequence
  Synthetic Polynucleotide
taatacgactcactatagggtcttaagaaacgtccgcccagtccgttctcaacagaggagagagaacatgctgggcggaaacctggcggcagcgcaaaagatg

SEQ ID NO: 146313 - DNA, 103 bp, Artificial Sequence
  Synthetic Polynucleotide
taatacgactcactatagggctagaattcttcttaagaaacgtccgcccaaacagaggagatgggcgatggtttcttaaaacctggcggcagcgcaaaagatg

SEQ ID NO: 146314 - DNA, 103 bp, Artificial Sequence
  Synthetic Polynucleotide
taatacgactcactatagggcaatgtatggctagaattcttcttaagaaaaacagaggagatttcttatgaagaattctaacctggcggcagcgcaaaagatg

SEQ ID NO: 146315 - DNA, 103 bp, Artificial Sequence
  Synthetic Polynucleotide
taatacgactcactatagggtttttctctctaccacagggatcttcagagaacagaggagactctgaatgtccctgtggaacctggcggcagcgcaaaagatg

SEQ ID NO: 146316 - DNA, 103 bp, Artificial Sequence
  Synthetic Polynucleotide
taatacgactcactataggggcacctgtaacaatgtatggctagaattctaacagaggagaagaattatggccatacataacctggcggcagcgcaaaagatg

SEQ ID NO: 146317 - DNA, 103 bp, Artificial Sequence
  Synthetic Polynucleotide
taatacgactcactatagggcgggggctcagcacctgtaacaatgtatggaacagaggagaccatacatggttacaggtaacctggcggcagcgcaaaagatg

SEQ ID NO: 146318 - DNA, 103 bp, Artificial Sequence
  Synthetic Polynucleotide
taatacgactcactatagggaatgtcggtccgggggctcagcacctgtaaaacagaggagattacagatgctgagccccaacctggcggcagcgcaaaagatg

SEQ ID NO: 146319 - DNA, 103 bp, Artificial Sequence
  Synthetic Polynucleotide
taatacgactcactatagggcatatacaccaatgtcggtccgggggctcaaacagaggagatgagccatgggaccgacaaacctggcggcagcgcaaaagatg

SEQ ID NO: 146320 - DNA, 103 bp, Artificial Sequence
  Synthetic Polynucleotide
taatacgactcactatagggttgccactcccatatacaccaatgtcggtcaacagaggagagaccgaatgtggtgtataaacctggcggcagcgcaaaagatg

SEQ ID NO: 146321 - DNA, 103 bp, Artificial Sequence
  Synthetic Polynucleotide
taatacgactcactatagggcctcctatttttgccactcccatatacaccaacagaggagaggtgtaatggggagtggcaacctggcggcagcgcaaaagatg

SEQ ID NO: 146322 - DNA, 103 bp, Artificial Sequence
  Synthetic Polynucleotide
taatacgactcactatagggttacttttttcctcctatttttgccactccaacagaggagaggagtgatgaaaataggaaacctggcggcagcgcaaaagatg

SEQ ID NO: 146323 - DNA, 103 bp, Artificial Sequence
  Synthetic Polynucleotide
taatacgactcactatagggattagttcttttacttttttcctcctatttaacagaggagaaaatagatggaaaaaagtaacctggcggcagcgcaaaagatg

SEQ ID NO: 146324 - DNA, 103 bp, Artificial Sequence
  Synthetic Polynucleotide
taatacgactcactatagggttctttttctattagttcttttacttttttaacagaggagaaaaaaaatgaaagaactaaacctggcggcagcgcaaaagatg

SEQ ID NO: 146325 - DNA, 103 bp, Artificial Sequence
  Synthetic Polynucleotide
taatacgactcactatagggccttttctttttctttttctattagttcttaacagaggagaaagaacatgtagaaaaagaacctggcggcagcgcaaaagatg

SEQ ID NO: 146326 - DNA, 103 bp, Artificial Sequence
  Synthetic Polynucleotide
taatacgactcactatagggagatccaggatttttctctctaccacagggaacagaggagaccctgtatgagagagaaaaacctggcggcagcgcaaaagatg

SEQ ID NO: 146327 - DNA, 103 bp, Artificial Sequence
  Synthetic Polynucleotide
taatacgactcactatagggaggtccagatccttttctttttctttttctaacagaggagaagaaaaatgaaaagaaaaaacctggcggcagcgcaaaagatg

SEQ ID NO: 146328 - DNA, 103 bp, Artificial Sequence
  Synthetic Polynucleotide
taatacgactcactatagggcagaggctccaggtccagatccttttctttaacagaggagaaaagaaatggatctggacaacctggcggcagcgcaaaagatg

SEQ ID NO: 146329 - DNA, 103 bp, Artificial Sequence
  Synthetic Polynucleotide
taatacgactcactatagggccagatcactcagaggctccaggtccagataacagaggagaatctggatgtggagcctcaacctggcggcagcgcaaaagatg

SEQ ID NO: 146330 - DNA, 103 bp, Artificial Sequence
  Synthetic Polynucleotide
taatacgactcactatagggaatccttcctccagatcactcagaggctccaacagaggagaggagccatggagtgatctaacctggcggcagcgcaaaagatg

SEQ ID NO: 146331 - DNA, 103 bp, Artificial Sequence
  Synthetic Polynucleotide
taatacgactcactatagggggtttcctccaatccttcctccagatcactaacagaggagaagtgatatggaggaaggaaacctggcggcagcgcaaaagatg

SEQ ID NO: 146332 - DNA, 103 bp, Artificial Sequence
  Synthetic Polynucleotide
taatacgactcactatagggctgtatctctggtttcctccaatccttcctaacagaggagaaggaagatgtggaggaaaaacctggcggcagcgcaaaagatg

SEQ ID NO: 146333 - DNA, 103 bp, Artificial Sequence
  Synthetic Polynucleotide
taatacgactcactatagggaccaccatggctgtatctctggtttcctccaacagaggagaggaggaatgcagagatacaacctggcggcagcgcaaaagatg

SEQ ID NO: 146334 - DNA, 103 bp, Artificial Sequence
  Synthetic Polynucleotide
taatacgactcactataggggaaaactgccaccaccatggctgtatctctaacagaggagaagagatatggccatggtgaacctggcggcagcgcaaaagatg

SEQ ID NO: 146335 - DNA, 103 bp, Artificial Sequence
  Synthetic Polynucleotide
taatacgactcactatagggcccgttctttgaaaactgccaccaccatggaacagaggagaccatggatgtggcagtttaacctggcggcagcgcaaaagatg

SEQ ID NO: 146336 - DNA, 103 bp, Artificial Sequence
  Synthetic Polynucleotide
taatacgactcactatagggtctttttgctcccgttctttgaaaactgccaacagaggagaggcagtatgcaaagaacgaacctggcggcagcgcaaaagatg

SEQ ID NO: 146337 - DNA, 103 bp, Artificial Sequence
  Synthetic Polynucleotide
taatacgactcactatagggcaaagcatacagatccaggatttttctctcaacagaggagagagagaatgatcctggataacctggcggcagcgcaaaagatg

SEQ ID NO: 146338 - DNA, 103 bp, Artificial Sequence
  Synthetic Polynucleotide
taatacgactcactatagggggcttcaatctctttttgctcccgttctttaacagaggagaaaagaaatggagcaaaaaaacctggcggcagcgcaaaagatg

SEQ ID NO: 146339 - DNA, 103 bp, Artificial Sequence
  Synthetic Polynucleotide
taatacgactcactataggggagaatgcatggcttcaatctctttttgctaacagaggagaagcaaaatgagattgaagaacctggcggcagcgcaaaagatg

SEQ ID NO: 146340 - DNA, 103 bp, Artificial Sequence
  Synthetic Polynucleotide
taatacgactcactataggggctgctctgagagaatgcatggcttcaatcaacagaggagagattgaatgcatgcattcaacctggcggcagcgcaaaagatg

SEQ ID NO: 146341 - DNA, 103 bp, Artificial Sequence
  Synthetic Polynucleotide
taatacgactcactatagggggctaggttggctgctctgagagaatgcataacagaggagaatgcatatgctcagagcaaacctggcggcagcgcaaaagatg

SEQ ID NO: 146342 - DNA, 103 bp, Artificial Sequence
  Synthetic Polynucleotide
taatacgactcactatagggttgtcatcttggctaggttggctgctctgaaacagaggagatcagagatgccaacctagaacctggcggcagcgcaaaagatg

SEQ ID NO: 146343 - DNA, 103 bp, Artificial Sequence
  Synthetic Polynucleotide
taatacgactcactatagggcggtccaccattgtcatcttggctaggttgaacagaggagacaacctatgcaagatgacaacctggcggcagcgcaaaagatg

SEQ ID NO: 146344 - DNA, 103 bp, Artificial Sequence
  Synthetic Polynucleotide
taatacgactcactatagggttcttctatgcggtccaccattgtcatcttaacagaggagaaagatgatgatggtggacaacctggcggcagcgcaaaagatg

SEQ ID NO: 146345 - DNA, 103 bp, Artificial Sequence
  Synthetic Polynucleotide
taatacgactcactatagggaaaattttacttcttctatgcggtccaccaaacagaggagatggtggatggcatagaagaacctggcggcagcgcaaaagatg

SEQ ID NO: 146346 - DNA, 103 bp, Artificial Sequence
  Synthetic Polynucleotide
taatacgactcactatagggcggcaaatgcaaaattttacttcttctatgaacagaggagacatagaatgagtaaaattaacctggcggcagcgcaaaagatg

SEQ ID NO: 146347 - DNA, 103 bp, Artificial Sequence
  Synthetic Polynucleotide
taatacgactcactatagggggctgtcttgcggcaaatgcaaaattttacaacagaggagagtaaaaatgtgcatttgcaacctggcggcagcgcaaaagatg

SEQ ID NO: 146348 - DNA, 103 bp, Artificial Sequence
  Synthetic Polynucleotide
taatacgactcactatagggcaatcttgctcaaagcatacagatccaggaaacagaggagatcctggatgtgtatgcttaacctggcggcagcgcaaaagatg

SEQ ID NO: 146349 - DNA, 103 bp, Artificial Sequence
  Synthetic Polynucleotide
taatacgactcactatagggtaaacccactggctgtcttgcggcaaatgcaacagaggagagcatttatggcaagacagaacctggcggcagcgcaaaagatg

SEQ ID NO: 146350 - DNA, 103 bp, Artificial Sequence
  Synthetic Polynucleotide
taatacgactcactatagggcactgtagcataaacccactggctgtcttgaacagaggagacaagacatgcagtgggttaacctggcggcagcgcaaaagatg

SEQ ID NO: 146351 - DNA, 103 bp, Artificial Sequence
  Synthetic Polynucleotide
taatacgactcactataggggcagagctcacactgtagcataaacccactaacagaggagaagtgggatgatgctacagaacctggcggcagcgcaaaagatg

SEQ ID NO: 146352 - DNA, 103 bp, Artificial Sequence
  Synthetic Polynucleotide
taatacgactcactatagggaccagtctttgcagagctcacactgtagcaaacagaggagatgctacatggtgagctctaacctggcggcagcgcaaaagatg

SEQ ID NO: 146353 - DNA, 103 bp, Artificial Sequence
  Synthetic Polynucleotide
taatacgactcactatagggctgttatggaaccagtctttgcagagctcaaacagaggagatgagctatgcaaagactgaacctggcggcagcgcaaaagatg

SEQ ID NO: 146354 - DNA, 103 bp, Artificial Sequence
  Synthetic Polynucleotide
taatacgactcactatagggaggaacacagctgttatggaaccagtctttaacagaggagaaaagacatgttccataacaacctggcggcagcgcaaaagatg

SEQ ID NO: 146355 - DNA, 103 bp, Artificial Sequence
  Synthetic Polynucleotide
taatacgactcactatagggatttaggaagaggaacacagctgttatggaaacagaggagatccataatggctgtgttcaacctggcggcagcgcaaaagatg

SEQ ID NO: 146356 - DNA, 103 bp, Artificial Sequence
  Synthetic Polynucleotide
taatacgactcactatagggtgggaacttgatttaggaagaggaacacagaacagaggagactgtgtatgtcttcctaaaacctggcggcagcgcaaaagatg

SEQ ID NO: 146357 - DNA, 103 bp, Artificial Sequence
  Synthetic Polynucleotide
taatacgactcactatagggtccttttttttgggaacttgatttaggaagaacagaggagacttcctatgtcaagttccaacctggcggcagcgcaaaagatg

SEQ ID NO: 146358 - DNA, 103 bp, Artificial Sequence
  Synthetic Polynucleotide
taatacgactcactataggggccagctggatccttttttttgggaacttgaacagaggagacaagttatgaaaaaaaagaacctggcggcagcgcaaaagatg

SEQ ID NO: 146359 - DNA, 103 bp, Artificial Sequence
  Synthetic Polynucleotide
taatacgactcactatagggttgctggcaacaatcttgctcaaagcatacaacagaggagagtatgcatggagcaagataacctggcggcagcgcaaaagatg

SEQ ID NO: 146360 - DNA, 103 bp, Artificial Sequence
  Synthetic Polynucleotide
taatacgactcactatagggtctttagcttgccagctggatcctttttttaacagaggagaaaaaaaatgatccagctgaacctggcggcagcgcaaaagatg

SEQ ID NO: 146361 - DNA, 103 bp, Artificial Sequence
  Synthetic Polynucleotide
taatacgactcactataggggaattttacttctttagcttgccagctggaaacagaggagatccagcatgcaagctaaaaacctggcggcagcgcaaaagatg

SEQ ID NO: 146362 - DNA, 103 bp, Artificial Sequence
  Synthetic Polynucleotide
taatacgactcactataggggagggcaaaggaattttacttctttagcttaacagaggagaaagctaatgaagtaaaataacctggcggcagcgcaaaagatg

SEQ ID NO: 146363 - DNA, 103 bp, Artificial Sequence
  Synthetic Polynucleotide
taatacgactcactatagggcgcatacaaagagggcaaaggaattttactaacagaggagaagtaaaatgcctttgcccaacctggcggcagcgcaaaagatg

SEQ ID NO: 146364 - DNA, 103 bp, Artificial Sequence
  Synthetic Polynucleotide
taatacgactcactatagggccttcgagaccgcatacaaagagggcaaagaacagaggagactttgcatgctttgtatgaacctggcggcagcgcaaaagatg

SEQ ID NO: 146365 - DNA, 103 bp, Artificial Sequence
  Synthetic Polynucleotide
taatacgactcactatagggctagcctgggccttcgagaccgcatacaaaaacagaggagatttgtaatgggtctcgaaaacctggcggcagcgcaaaagatg

SEQ ID NO: 146366 - DNA, 103 bp, Artificial Sequence
  Synthetic Polynucleotide
taatacgactcactatagggagaatagtctctagcctgggccttcgagacaacagaggagagtctcgatggcccaggctaacctggcggcagcgcaaaagatg

SEQ ID NO: 146367 - DNA, 103 bp, Artificial Sequence
  Synthetic Polynucleotide
taatacgactcactatagggcaggagtgacagaatagtctctagcctgggaacagaggagacccaggatggagactattaacctggcggcagcgcaaaagatg

SEQ ID NO: 146368 - DNA, 103 bp, Artificial Sequence
  Synthetic Polynucleotide
taatacgactcactataggggaagggataccaggagtgacagaatagtctaacagaggagaagactaatgtgtcactccaacctggcggcagcgcaaaagatg

SEQ ID NO: 146369 - DNA, 103 bp, Artificial Sequence
  Synthetic Polynucleotide
taatacgactcactatagggggcaacttctgaagggataccaggagtgacaacagaggagagtcactatgggtatccctaacctggcggcagcgcaaaagatg

SEQ ID NO: 146370 - DNA, 103 bp, Artificial Sequence
  Synthetic Polynucleotide
taatacgactcactatagggaaaacctcctttgctggcaacaatcttgctaacagaggagaagcaagatggttgccagcaacctggcggcagcgcaaaagatg

SEQ ID NO: 146371 - DNA, 103 bp, Artificial Sequence
  Synthetic Polynucleotide
taatacgactcactatagggcaaccgtacgggcaacttctgaagggatacaacagaggagagtatccatgcagaagttgaacctggcggcagcgcaaaagatg

SEQ ID NO: 146372 - DNA, 103 bp, Artificial Sequence
  Synthetic Polynucleotide
taatacgactcactatagggctccttcaggcaaccgtacgggcaacttctaacagaggagaagaagtatgccgtacggtaacctggcggcagcgcaaaagatg

SEQ ID NO: 146373 - DNA, 103 bp, Artificial Sequence
  Synthetic Polynucleotide
taatacgactcactatagggtgcagggcctctccttcaggcaaccgtacgaacagaggagacgtacgatggcctgaaggaacctggcggcagcgcaaaagatg

SEQ ID NO: 146374 - DNA, 103 bp, Artificial Sequence
  Synthetic Polynucleotide
taatacgactcactatagggtgtcaaacactgcagggcctctccttcaggaacagaggagacctgaaatggaggccctgaacctggcggcagcgcaaaagatg

SEQ ID NO: 146375 - DNA, 103 bp, Artificial Sequence
  Synthetic Polynucleotide
taatacgactcactatagggtagcacgttctgtcaaacactgcagggcctaacagaggagaaggcccatgagtgtttgaaacctggcggcagcgcaaaagatg

SEQ ID NO: 146376 - DNA, 103 bp, Artificial Sequence
  Synthetic Polynucleotide
taatacgactcactatagggtgccaactcatagcacgttctgtcaaacacaacagaggagagtgtttatgagaacgtgcaacctggcggcagcgcaaaagatg

SEQ ID NO: 146377 - DNA, 103 bp, Artificial Sequence
  Synthetic Polynucleotide
taatacgactcactatagggcgctctatcttgccaactcatagcacgttcaacagaggagagaacgtatgatgagttggaacctggcggcagcgcaaaagatg

SEQ ID NO: 146378 - DNA, 103 bp, Artificial Sequence
  Synthetic Polynucleotide
taatacgactcactataggggagcctgccgcgctctatcttgccaactcaaacagaggagatgagttatgaagatagagaacctggcggcagcgcaaaagatg

SEQ ID NO: 146379 - DNA, 103 bp, Artificial Sequence
  Synthetic Polynucleotide
taatacgactcactatagggtctgtggctagagcctgccgcgctctatctaacagaggagaagatagatggcggcaggcaacctggcggcagcgcaaaagatg

SEQ ID NO: 146380 - DNA, 103 bp, Artificial Sequence
  Synthetic Polynucleotide
taatacgactcactatagggggatagttcatctgtggctagagcctgccgaacagaggagacggcagatgctagccacaaacctggcggcagcgcaaaagatg

SEQ ID NO: 146381 - DNA, 103 bp, Artificial Sequence
  Synthetic Polynucleotide
taatacgactcactatagggtgaccatttcaaaacctcctttgctggcaaaacagaggagattgccaatgaaggaggttaacctggcggcagcgcaaaagatg

SEQ ID NO: 146382 - DNA, 103 bp, Artificial Sequence
  Synthetic Polynucleotide
taatacgactcactatagggccagggcagaggatagttcatctgtggctaaacagaggagatagccaatgatgaactataacctggcggcagcgcaaaagatg

SEQ ID NO: 146383 - DNA, 103 bp, Artificial Sequence
  Synthetic Polynucleotide
taatacgactcactataggggatagtttggccagggcagaggatagttcaaacagaggagatgaactatgctctgccctaacctggcggcagcgcaaaagatg

SEQ ID NO: 146384 - DNA, 103 bp, Artificial Sequence
  Synthetic Polynucleotide
taatacgactcactataggggctcaacacagatagtttggccagggcagaaacagaggagatctgccatggccaaactaaacctggcggcagcgcaaaagatg

SEQ ID NO: 146385 - DNA, 103 bp, Artificial Sequence
  Synthetic Polynucleotide
taatacgactcactatagggccatacgctggctcaacacagatagtttggaacagaggagaccaaacatgctgtgttgaaacctggcggcagcgcaaaagatg

SEQ ID NO: 146386 - DNA, 103 bp, Artificial Sequence
  Synthetic Polynucleotide
taatacgactcactataggggcctgttccaccatacgctggctcaacacaaacagaggagatgtgttatgccagcgtataacctggcggcagcgcaaaagatg

SEQ ID NO: 146387 - DNA, 103 bp, Artificial Sequence
  Synthetic Polynucleotide
taatacgactcactatagggttctcgagccgcctgttccaccatacgctgaacagaggagacagcgtatggtggaacagaacctggcggcagcgcaaaagatg

SEQ ID NO: 146388 - DNA, 103 bp, Artificial Sequence
  Synthetic Polynucleotide
taatacgactcactatagggtttcagttttttctcgagccgcctgttccaaacagaggagatggaacatgcggctcgagaacctggcggcagcgcaaaagatg

SEQ ID NO: 146389 - DNA, 103 bp, Artificial Sequence
  Synthetic Polynucleotide
taatacgactcactatagggctgatgatcttttcagttttttctcgagccaacagaggagaggctcgatgaaaaactgaaacctggcggcagcgcaaaagatg

SEQ ID NO: 146390 - DNA, 103 bp, Artificial Sequence
  Synthetic Polynucleotide
taatacgactcactataggggagttctgcactgatgatcttttcagttttaacagaggagaaaaactatgaagatcatcaacctggcggcagcgcaaaagatg

SEQ ID NO: 146391 - DNA, 103 bp, Artificial Sequence
  Synthetic Polynucleotide
taatacgactcactatagggctgctttttggagttctgcactgatgatctaacagaggagaagatcaatggtgcagaacaacctggcggcagcgcaaaagatg

SEQ ID NO: 146392 - DNA, 103 bp, Artificial Sequence
  Synthetic Polynucleotide
taatacgactcactatagggttctctttggtgaccatttcaaaacctcctaacagaggagaaggaggatgtgaaatggtaacctggcggcagcgcaaaagatg

SEQ ID NO: 146393 - DNA, 103 bp, Artificial Sequence
  Synthetic Polynucleotide
taatacgactcactatagggggattggcagctgctttttggagttctgcaaacagaggagatgcagaatgccaaaaagcaacctggcggcagcgcaaaagatg

SEQ ID NO: 146394 - DNA, 103 bp, Artificial Sequence
  Synthetic Polynucleotide
taatacgactcactatagggctgtaagtctggattggcagctgctttttgaacagaggagacaaaaaatggctgccaataacctggcggcagcgcaaaagatg

SEQ ID NO: 146395 - DNA, 103 bp, Artificial Sequence
  Synthetic Polynucleotide
taatacgactcactataggggtaagtgtccctgtaagtctggattggcagaacagaggagactgccaatgcagacttacaacctggcggcagcgcaaaagatg

SEQ ID NO: 146396 - DNA, 103 bp, Artificial Sequence
  Synthetic Polynucleotide
taatacgactcactatagggtggaaactaggtaagtgtccctgtaagtctaacagaggagaagacttatggggacacttaacctggcggcagcgcaaaagatg

SEQ ID NO: 146397 - DNA, 103 bp, Artificial Sequence
  Synthetic Polynucleotide
taatacgactcactatagggagcagactgctggaaactaggtaagtgtccaacagaggagaggacacatgcctagtttcaacctggcggcagcgcaaaagatg

SEQ ID NO: 146398 - DNA, 103 bp, Artificial Sequence
  Synthetic Polynucleotide
taatacgactcactatagggcccggttaaaagcagactgctggaaactagaacagaggagactagttatgagcagtctgaacctggcggcagcgcaaaagatg

SEQ ID NO: 146399 - DNA, 103 bp, Artificial Sequence
  Synthetic Polynucleotide
taatacgactcactatagggctgctcaccacccggttaaaagcagactgcaacagaggagagcagtcatgttttaaccgaacctggcggcagcgcaaaagatg

SEQ ID NO: 146400 - DNA, 103 bp, Artificial Sequence
  Synthetic Polynucleotide
taatacgactcactatagggagatgacacactgctcaccacccggttaaaaacagaggagatttaacatggtggtgagcaacctggcggcagcgcaaaagatg

SEQ ID NO: 146401 - DNA, 103 bp, Artificial Sequence
  Synthetic Polynucleotide
taatacgactcactataggggtcgaggagaagatgacacactgctcaccaaacagaggagatggtgaatggtgtgtcataacctggcggcagcgcaaaagatg

SEQ ID NO: 146402 - DNA, 103 bp, Artificial Sequence
  Synthetic Polynucleotide
taatacgactcactatagggtccattgtttgtcgaggagaagatgacacaaacagaggagatgtgtcatgttctcctcgaacctggcggcagcgcaaaagatg

SEQ ID NO: 146403 - DNA, 103 bp, Artificial Sequence
  Synthetic Polynucleotide
taatacgactcactatagggggggcactctggcggtggcacgaactccgcaacagaggagagcggagatggtgccaccgaacctggcggcagcgcaaaagatg

SEQ ID NO: 146404 - DNA, 103 bp, Artificial Sequence
  Synthetic Polynucleotide
taatacgactcactatagggagaccatttcttctctttggtgaccatttcaacagaggagagaaatgatgaccaaagagaacctggcggcagcgcaaaagatg

SEQ ID NO: 146405 - DNA, 103 bp, Artificial Sequence
  Synthetic Polynucleotide
taatacgactcactatagggatcatcatagtccattgtttgtcgaggagaaacagaggagatctcctatgcaaacaatgaacctggcggcagcgcaaaagatg

SEQ ID NO: 146406 - DNA, 103 bp, Artificial Sequence
  Synthetic Polynucleotide
taatacgactcactatagggctgtttcttcatcatcatagtccattgtttaacagaggagaaaacaaatgactatgatgaacctggcggcagcgcaaaagatg

SEQ ID NO: 146407 - DNA, 103 bp, Artificial Sequence
  Synthetic Polynucleotide
taatacgactcactatagggtcatcagagtctgtttcttcatcatcatagaacagaggagactatgaatgtgaagaaacaacctggcggcagcgcaaaagatg

SEQ ID NO: 146408 - DNA, 103 bp, Artificial Sequence
  Synthetic Polynucleotide
taatacgactcactatagggtcgaatgtcttcatcagagtctgtttcttcaacagaggagagaagaaatggactctgataacctggcggcagcgcaaaagatg

SEQ ID NO: 146409 - DNA, 103 bp, Artificial Sequence
  Synthetic Polynucleotide
taatacgactcactatagggcatatgtctctcgaatgtcttcatcagagtaacagaggagaactctgatgaagacattcaacctggcggcagcgcaaaagatg

SEQ ID NO: 146410 - DNA, 103 bp, Artificial Sequence
  Synthetic Polynucleotide
taatacgactcactatagggatgtcgtagccatatgtctctcgaatgtctaacagaggagaagacatatgagagacataaacctggcggcagcgcaaaagatg

SEQ ID NO: 146411 - DNA, 103 bp, Artificial Sequence
  Synthetic Polynucleotide
taatacgactcactatagggtgtgtccttcatgtcgtagccatatgtctcaacagaggagagagacaatgggctacgacaacctggcggcagcgcaaaagatg

SEQ ID NO: 146412 - DNA, 103 bp, Artificial Sequence
  Synthetic Polynucleotide
taatacgactcactatagggtcacactggctgtgtccttcatgtcgtagcaacagaggagagctacgatgtgaaggacaaacctggcggcagcgcaaaagatg

SEQ ID NO: 146413 - DNA, 103 bp, Artificial Sequence
  Synthetic Polynucleotide
taatacgactcactatagggctagaggacttcacactggctgtgtccttcaacagaggagagaaggaatgagccagtgtaacctggcggcagcgcaaaagatg

SEQ ID NO: 146414 - DNA, 103 bp, Artificial Sequence
  Synthetic Polynucleotide
taatacgactcactatagggttcaagactactagaggacttcacactggcaacagaggagagccagtatgaagtcctctaacctggcggcagcgcaaaagatg

SEQ ID NO: 146415 - DNA, 103 bp, Artificial Sequence
  Synthetic Polynucleotide
taatacgactcactatagggtacccactttagaccatttcttctctttggaacagaggagaccaaagatgagaaatggtaacctggcggcagcgcaaaagatg

SEQ ID NO: 146416 - DNA, 103 bp, Artificial Sequence
  Synthetic Polynucleotide
taatacgactcactatagggaaagattgggttcaagactactagaggactaacagaggagaagtcctatggtagtcttgaacctggcggcagcgcaaaagatg

SEQ ID NO: 146417 - DNA, 103 bp, Artificial Sequence
  Synthetic Polynucleotide
taatacgactcactatagggtcatcacaaaaaagattgggttcaagactaaacagaggagatagtctatgacccaatctaacctggcggcagcgcaaaagatg

SEQ ID NO: 146418 - DNA, 103 bp, Artificial Sequence
  Synthetic Polynucleotide
taatacgactcactataggggggaatctcttcatcacaaaaaagattgggaacagaggagacccaatatgttttgtgataacctggcggcagcgcaaaagatg

SEQ ID NO: 146419 - DNA, 103 bp, Artificial Sequence
  Synthetic Polynucleotide
taatacgactcactatagggcggatttgatgggaatctcttcatcacaaaaacagaggagatttgtgatgaagagattcaacctggcggcagcgcaaaagatg

SEQ ID NO: 146420 - DNA, 103 bp, Artificial Sequence
  Synthetic Polynucleotide
taatacgactcactatagggaccacctcctcggatttgatgggaatctctaacagaggagaagagatatgcatcaaatcaacctggcggcagcgcaaaagatg

SEQ ID NO: 146421 - DNA, 103 bp, Artificial Sequence
  Synthetic Polynucleotide
taatacgactcactatagggcatgtgggtcaccacctcctcggatttgataacagaggagaatcaaaatggaggaggtgaacctggcggcagcgcaaaagatg

SEQ ID NO: 146422 - DNA, 103 bp, Artificial Sequence
  Synthetic Polynucleotide
taatacgactcactataggggtgctgtccacatgtgggtcaccacctcctaacagaggagaaggaggatgtgacccacaaacctggcggcagcgcaaaagatg

SEQ ID NO: 146423 - DNA, 103 bp, Artificial Sequence
  Synthetic Polynucleotide
taatacgactcactatagggcaaaatgaaggtgctgtccacatgtgggtcaacagaggagagacccaatggtggacagcaacctggcggcagcgcaaaagatg

SEQ ID NO: 146424 - DNA, 103 bp, Artificial Sequence
  Synthetic Polynucleotide
taatacgactcactatagggatgctctgcacaaaatgaaggtgctgtccaaacagaggagatggacaatgccttcatttaacctggcggcagcgcaaaagatg

SEQ ID NO: 146425 - DNA, 103 bp, Artificial Sequence
  Synthetic Polynucleotide
taatacgactcactatagggaagaataagcatgctctgcacaaaatgaagaacagaggagacttcatatggtgcagagcaacctggcggcagcgcaaaagatg

SEQ ID NO: 146426 - DNA, 103 bp, Artificial Sequence
  Synthetic Polynucleotide
taatacgactcactatagggcccaagcgactacccactttagaccatttcaacagaggagagaaatgatgtaaagtgggaacctggcggcagcgcaaaagatg

SEQ ID NO: 146427 - DNA, 103 bp, Artificial Sequence
  Synthetic Polynucleotide
taatacgactcactatagggttagaagcagaagaataagcatgctctgcaaacagaggagatgcagaatgtgcttattcaacctggcggcagcgcaaaagatg

SEQ ID NO: 146428 - DNA, 103 bp, Artificial Sequence
  Synthetic Polynucleotide
taatacgactcactatagggagaacaactcttagaagcagaagaataagcaacagaggagagcttatatgtctgcttctaacctggcggcagcgcaaaagatg

SEQ ID NO: 146429 - DNA, 103 bp, Artificial Sequence
  Synthetic Polynucleotide
taatacgactcactatagggtagaaccttgagaacaactcttagaagcagaacagaggagactgcttatgagagttgttaacctggcggcagcgcaaaagatg

SEQ ID NO: 146430 - DNA, 103 bp, Artificial Sequence
  Synthetic Polynucleotide
taatacgactcactatagggcttggggtgctagaaccttgagaacaactcaacagaggagagagttgatgtcaaggttcaacctggcggcagcgcaaaagatg

SEQ ID NO: 146431 - DNA, 103 bp, Artificial Sequence
  Synthetic Polynucleotide
taatacgactcactatagggaggttgtttccttggggtgctagaaccttgaacagaggagacaaggtatgagcaccccaaacctggcggcagcgcaaaagatg

SEQ ID NO: 146432 - DNA, 103 bp, Artificial Sequence
  Synthetic Polynucleotide
taatacgactcactatagggggctcttccgaggttgtttccttggggtgcaacagaggagagcacccatgggaaacaacaacctggcggcagcgcaaaagatg

SEQ ID NO: 146433 - DNA, 103 bp, Artificial Sequence
  Synthetic Polynucleotide
taatacgactcactatagggggcaccaaagggctcttccgaggttgtttcaacagaggagagaaacaatgtcggaagagaacctggcggcagcgcaaaagatg

SEQ ID NO: 146434 - DNA, 103 bp, Artificial Sequence
  Synthetic Polynucleotide
taatacgactcactatagggcaaacttcggggcaccaaagggctcttccgaacagaggagacggaagatgcctttggtgaacctggcggcagcgcaaaagatg

SEQ ID NO: 146435 - DNA, 103 bp, Artificial Sequence
  Synthetic Polynucleotide
taatacgactcactatagggctggaggttccaaacttcggggcaccaaagaacagaggagactttggatgcccgaagttaacctggcggcagcgcaaaagatg

SEQ ID NO: 146436 - DNA, 103 bp, Artificial Sequence
  Synthetic Polynucleotide
taatacgactcactatagggaactccagcactggaggttccaaacttcggaacagaggagaccgaagatgggaacctccaacctggcggcagcgcaaaagatg

SEQ ID NO: 146437 - DNA, 103 bp, Artificial Sequence
  Synthetic Polynucleotide
taatacgactcactatagggtggcagatatcccaagcgactacccactttaacagaggagaaaagtgatgagtcgcttgaacctggcggcagcgcaaaagatg

SEQ ID NO: 146438 - DNA, 103 bp, Artificial Sequence
  Synthetic Polynucleotide
taatacgactcactatagggtccaggtgacaactccagcactggaggttcaacagaggagagaacctatggtgctggagaacctggcggcagcgcaaaagatg

SEQ ID NO: 146439 - DNA, 103 bp, Artificial Sequence
  Synthetic Polynucleotide
taatacgactcactataggggtgccttagctccaggtgacaactccagcaaacagaggagatgctggatgtgtcacctgaacctggcggcagcgcaaaagatg

SEQ ID NO: 146440 - DNA, 103 bp, Artificial Sequence
  Synthetic Polynucleotide
taatacgactcactatagggtcttccagttgtgccttagctccaggtgacaacagaggagagtcaccatgagctaaggcaacctggcggcagcgcaaaagatg

SEQ ID NO: 146441 - DNA, 103 bp, Artificial Sequence
  Synthetic Polynucleotide
taatacgactcactatagggcatcataagttcttccagttgtgccttagcaacagaggagagctaagatgcaactggaaaacctggcggcagcgcaaaagatg

SEQ ID NO: 146442 - DNA, 103 bp, Artificial Sequence
  Synthetic Polynucleotide
taatacgactcactataggggatctccaaccatcataagttcttccagttaacagaggagaaactggatgaacttatgaaacctggcggcagcgcaaaagatg

SEQ ID NO: 146443 - DNA, 103 bp, Artificial Sequence
  Synthetic Polynucleotide
taatacgactcactatagggacttccaggagatctccaaccatcataagtaacagaggagaacttatatgggttggagaaacctggcggcagcgcaaaagatg

SEQ ID NO: 146444 - DNA, 103 bp, Artificial Sequence
  Synthetic Polynucleotide
taatacgactcactataggggtccagagatacttccaggagatctccaacaacagaggagagttggaatgctcctggaaaacctggcggcagcgcaaaagatg

SEQ ID NO: 146445 - DNA, 103 bp, Artificial Sequence
  Synthetic Polynucleotide
taatacgactcactataggggttgagtctcgtccagagatacttccaggaaacagaggagatcctggatgtatctctggaacctggcggcagcgcaaaagatg

SEQ ID NO: 146446 - DNA, 103 bp, Artificial Sequence
  Synthetic Polynucleotide
taatacgactcactatagggcgccatatgtgttgagtctcgtccagagataacagaggagaatctctatgcgagactcaaacctggcggcagcgcaaaagatg

SEQ ID NO: 146447 - DNA, 103 bp, Artificial Sequence
  Synthetic Polynucleotide
taatacgactcactatagggctgcaaaatccgccatatgtgttgagtctcaacagaggagagagactatgcacatatggaacctggcggcagcgcaaaagatg

SEQ ID NO: 146448 - DNA, 103 bp, Artificial Sequence
  Synthetic Polynucleotide
taatacgactcactatagggttccttttcctggcagatatcccaagcgacaacagaggagagtcgctatggatatctgcaacctggcggcagcgcaaaagatg

SEQ ID NO: 146449 - DNA, 103 bp, Artificial Sequence
  Synthetic Polynucleotide
taatacgactcactatagggggtgtgtggcctgcaaaatccgccatatgtaacagaggagaacatatatgggattttgcaacctggcggcagcgcaaaagatg

SEQ ID NO: 146450 - DNA, 103 bp, Artificial Sequence
  Synthetic Polynucleotide
taatacgactcactatagggtcagagggtgggtgtgtggcctgcaaaatcaacagaggagagattttatgggccacacaaacctggcggcagcgcaaaagatg

SEQ ID NO: 146451 - DNA, 103 bp, Artificial Sequence
  Synthetic Polynucleotide
taatacgactcactataggggaatctgtcttcagagggtgggtgtgtggcaacagaggagagccacaatgccaccctctaacctggcggcagcgcaaaagatg

SEQ ID NO: 146452 - DNA, 103 bp, Artificial Sequence
  Synthetic Polynucleotide
taatacgactcactatagggtgatatgcaagaatctgtcttcagagggtgaacagaggagacaccctatgaagacagataacctggcggcagcgcaaaagatg

SEQ ID NO: 146453 - DNA, 103 bp, Artificial Sequence
  Synthetic Polynucleotide
taatacgactcactatagggtcatcctccatgatatgcaagaatctgtctaacagaggagaagacagatgcttgcatataacctggcggcagcgcaaaagatg

SEQ ID NO: 146454 - DNA, 103 bp, Artificial Sequence
  Synthetic Polynucleotide
taatacgactcactatagggttccatgctgtcatcctccatgatatgcaaaacagaggagattgcatatgatggaggataacctggcggcagcgcaaaagatg

SEQ ID NO: 146455 - DNA, 103 bp, Artificial Sequence
  Synthetic Polynucleotide
taatacgactcactataggggtggtttctcttccatgctgtcatcctccaaacagaggagatggaggatgacagcatggaacctggcggcagcgcaaaagatg

SEQ ID NO: 146456 - DNA, 103 bp, Artificial Sequence
  Synthetic Polynucleotide
taatacgactcactatagggttcacttttagtggtttctcttccatgctgaacagaggagacagcatatgagagaaaccaacctggcggcagcgcaaaagatg

SEQ ID NO: 146457 - DNA, 103 bp, Artificial Sequence
  Synthetic Polynucleotide
taatacgactcactataggggtcctttcctttcacttttagtggtttctcaacagaggagagagaaaatgctaaaagtgaacctggcggcagcgcaaaagatg

SEQ ID NO: 146458 - DNA, 103 bp, Artificial Sequence
  Synthetic Polynucleotide
taatacgactcactatagggtctctgaagagtcctttcctttcacttttaaacagaggagataaaagatgaaggaaaggaacctggcggcagcgcaaaagatg

SEQ ID NO: 146459 - DNA, 103 bp, Artificial Sequence
  Synthetic Polynucleotide
taatacgactcactatagggagagacccagttccttttcctggcagatataacagaggagaatatctatgaggaaaaggaacctggcggcagcgcaaaagatg

SEQ ID NO: 146460 - DNA, 103 bp, Artificial Sequence
  Synthetic Polynucleotide
taatacgactcactatagggttccgtttcttctctgaagagtcctttcctaacagaggagaaggaaaatgctcttcagaaacctggcggcagcgcaaaagatg

SEQ ID NO: 146461 - DNA, 103 bp, Artificial Sequence
  Synthetic Polynucleotide
taatacgactcactatagggtagcttccgtttccgtttcttctctgaagaaacagaggagatcttcaatgaagaaacggaacctggcggcagcgcaaaagatg

SEQ ID NO: 146462 - DNA, 103 bp, Artificial Sequence
  Synthetic Polynucleotide
taatacgactcactatagggctaccttttctagcttccgtttccgtttctaacagaggagaagaaacatgaacggaagcaacctggcggcagcgcaaaagatg

SEQ ID NO: 146463 - DNA, 103 bp, Artificial Sequence
  Synthetic Polynucleotide
taatacgactcactatagggaaaagttgctctaccttttctagcttccgtaacagaggagaacggaaatgagaaaaggtaacctggcggcagcgcaaaagatg

SEQ ID NO: 146464 - DNA, 103 bp, Artificial Sequence
  Synthetic Polynucleotide
taatacgactcactatagggtccttctccaaaaagttgctctaccttttcaacagaggagagaaaagatggagcaacttaacctggcggcagcgcaaaagatg

SEQ ID NO: 146465 - DNA, 103 bp, Artificial Sequence
  Synthetic Polynucleotide
taatacgactcactatagggacttctgttttccttctccaaaaagttgctaacagaggagaagcaacatgttggagaagaacctggcggcagcgcaaaagatg

SEQ ID NO: 146466 - DNA, 103 bp, Artificial Sequence
  Synthetic Polynucleotide
taatacgactcactatagggaactccttggacttctgttttccttctccaaacagaggagatggagaatgaaaacagaaaacctggcggcagcgcaaaagatg

SEQ ID NO: 146467 - DNA, 103 bp, Artificial Sequence
  Synthetic Polynucleotide
taatacgactcactatagggcattttctttaactccttggacttctgtttaacagaggagaaaacagatgtccaaggagaacctggcggcagcgcaaaagatg

SEQ ID NO: 146468 - DNA, 103 bp, Artificial Sequence
  Synthetic Polynucleotide
taatacgactcactatagggtaggtttgtccattttctttaactccttggaacagaggagaccaaggatgtaaagaaaaaacctggcggcagcgcaaaagatg

SEQ ID NO: 146469 - DNA, 103 bp, Artificial Sequence
  Synthetic Polynucleotide
taatacgactcactatagggttcttctttctaggtttgtccattttctttaacagaggagaaaagaaatgggacaaaccaacctggcggcagcgcaaaagatg

SEQ ID NO: 146470 - DNA, 103 bp, Artificial Sequence
  Synthetic Polynucleotide
taatacgactcactatagggtgacttcaaaagagacccagttccttttccaacagaggagaggaaaaatgactgggtctaacctggcggcagcgcaaaagatg

SEQ ID NO: 146471 - DNA, 103 bp, Artificial Sequence
  Synthetic Polynucleotide
taatacgactcactatagggtaattttaatttcttctttctaggtttgtcaacagaggagagacaaaatgagaaagaagaacctggcggcagcgcaaaagatg

SEQ ID NO: 146472 - DNA, 103 bp, Artificial Sequence
  Synthetic Polynucleotide
taatacgactcactatagggtgtctgcacctaattttaatttcttctttcaacagaggagagaaagaatgaattaaaataacctggcggcagcgcaaaagatg

SEQ ID NO: 146473 - DNA, 103 bp, Artificial Sequence
  Synthetic Polynucleotide
taatacgactcactatagggtcctttgatttgtctgcacctaattttaataacagaggagaattaaaatgaggtgcagaaacctggcggcagcgcaaaagatg

SEQ ID NO: 146474 - DNA, 103 bp, Artificial Sequence
  Synthetic Polynucleotide
taatacgactcactatagggtttattcagctcctttgatttgtctgcaccaacagaggagaggtgcaatgaaatcaaagaacctggcggcagcgcaaaagatg

SEQ ID NO: 146475 - DNA, 103 bp, Artificial Sequence
  Synthetic Polynucleotide
taatacgactcactatagggtcttggccagtttattcagctcctttgattaacagaggagaaatcaaatgagctgaataaacctggcggcagcgcaaaagatg

SEQ ID NO: 146476 - DNA, 103 bp, Artificial Sequence
  Synthetic Polynucleotide
taatacgactcactatagggtttgctagtttcttggccagtttattcagcaacagaggagagctgaaatgactggccaaaacctggcggcagcgcaaaagatg

SEQ ID NO: 146477 - DNA, 103 bp, Artificial Sequence
  Synthetic Polynucleotide
taatacgactcactatagggctcttcttcttttgctagtttcttggccagaacagaggagactggccatgaaactagcaaacctggcggcagcgcaaaagatg

SEQ ID NO: 146478 - DNA, 103 bp, Artificial Sequence
  Synthetic Polynucleotide
taatacgactcactatagggttttctttctctcttcttcttttgctagttaacagaggagaaactagatgaagaagaagaacctggcggcagcgcaaaagatg

SEQ ID NO: 146479 - DNA, 103 bp, Artificial Sequence
  Synthetic Polynucleotide
taatacgactcactatagggttctccttctttttctttctctcttcttctaacagaggagaagaagaatggagaaagaaaacctggcggcagcgcaaaagatg

SEQ ID NO: 146480 - DNA, 103 bp, Artificial Sequence
  Synthetic Polynucleotide
taatacgactcactatagggtgcagcagccttctccttctttttctttctaacagaggagaagaaagatgaagaaggagaacctggcggcagcgcaaaagatg

SEQ ID NO: 146481 - DNA, 103 bp, Artificial Sequence
  Synthetic Polynucleotide
taatacgactcactatagggtttcataatgtgacttcaaaagagacccagaacagaggagactgggtatgttttgaagtaacctggcggcagcgcaaaagatg

SEQ ID NO: 146482 - DNA, 103 bp, Artificial Sequence
  Synthetic Polynucleotide
taatacgactcactatagggcaactttggctgcagcagccttctccttctaacagaggagaagaaggatgaggctgctgaacctggcggcagcgcaaaagatg

SEQ ID NO: 146483 - DNA, 103 bp, Artificial Sequence
  Synthetic Polynucleotide
taatacgactcactatagggttcacaagttcaactttggctgcagcagccaacagaggagaggctgcatgagccaaagtaacctggcggcagcgcaaaagatg

SEQ ID NO: 146484 - DNA, 103 bp, Artificial Sequence
  Synthetic Polynucleotide
taatacgactcactatagggagtgctctctttcacaagttcaactttggcaacagaggagagccaaaatggaacttgtgaacctggcggcagcgcaaaagatg

SEQ ID NO: 146485 - DNA, 103 bp, Artificial Sequence
  Synthetic Polynucleotide
taatacgactcactatagggttttcttttcagtgctctctttcacaagttaacagaggagaaacttgatgaagagagcaaacctggcggcagcgcaaaagatg

SEQ ID NO: 146486 - DNA, 103 bp, Artificial Sequence
  Synthetic Polynucleotide
taatacgactcactatagggtttttctctcttttcttttcagtgctctctaacagaggagaagagagatgtgaaaagaaaacctggcggcagcgcaaaagatg

SEQ ID NO: 146487 - DNA, 103 bp, Artificial Sequence
  Synthetic Polynucleotide
taatacgactcactataggggtccagcacctttttctctcttttcttttcaacagaggagagaaaagatgagagagaaaaacctggcggcagcgcaaaagatg

SEQ ID NO: 146488 - DNA, 103 bp, Artificial Sequence
  Synthetic Polynucleotide
taatacgactcactatagggttgaggggatgtccagcacctttttctctcaacagaggagagagagaatgaggtgctggaacctggcggcagcgcaaaagatg

SEQ ID NO: 146489 - DNA, 103 bp, Artificial Sequence
  Synthetic Polynucleotide
taatacgactcactatagggcagtcatactttgaggggatgtccagcaccaacagaggagaggtgctatgcatcccctcaacctggcggcagcgcaaaagatg

SEQ ID NO: 146490 - DNA, 103 bp, Artificial Sequence
  Synthetic Polynucleotide
taatacgactcactatagggtgctcctgaccagtcatactttgaggggataacagaggagaatccccatgaagtatgacaacctggcggcagcgcaaaagatg

SEQ ID NO: 146491 - DNA, 103 bp, Artificial Sequence
  Synthetic Polynucleotide
taatacgactcactatagggcagactcctctgctcctgaccagtcatactaacagaggagaagtatgatgggtcaggagaacctggcggcagcgcaaaagatg

SEQ ID NO: 146492 - DNA, 103 bp, Artificial Sequence
  Synthetic Polynucleotide
taatacgactcactatagggtagagaattctttcataatgtgacttcaaaaacagaggagatttgaaatgacattatgaaacctggcggcagcgcaaaagatg

SEQ ID NO: 146493 - DNA, 103 bp, Artificial Sequence
  Synthetic Polynucleotide
taatacgactcactatagggttctcatcatcagactcctctgctcctgacaacagaggagagtcaggatgagaggagtcaacctggcggcagcgcaaaagatg

SEQ ID NO: 146494 - DNA, 103 bp, Artificial Sequence
  Synthetic Polynucleotide
taatacgactcactataggggcacacagcattctcatcatcagactcctcaacagaggagagaggagatggatgatgagaacctggcggcagcgcaaaagatg

SEQ ID NO: 146495 - DNA, 103 bp, Artificial Sequence
  Synthetic Polynucleotide
taatacgactcactatagggtctgtgctgcgcacacagcattctcatcataacagaggagaatgatgatgatgctgtgtaacctggcggcagcgcaaaagatg

SEQ ID NO: 146496 - DNA, 103 bp, Artificial Sequence
  Synthetic Polynucleotide
taatacgactcactatagggctttggcagttctgtgctgcgcacacagcaaacagaggagatgctgtatgcgcagcacaaacctggcggcagcgcaaaagatg

SEQ ID NO: 146497 - DNA, 103 bp, Artificial Sequence
  Synthetic Polynucleotide
taatacgactcactatagggcttgcagggcctttggcagttctgtgctgcaacagaggagagcagcaatgaactgccaaaacctggcggcagcgcaaaagatg

SEQ ID NO: 146498 - DNA, 103 bp, Artificial Sequence
  Synthetic Polynucleotide
taatacgactcactatagggctaccttgtccttgcagggcctttggcagtaacagaggagaactgccatgggccctgcaaacctggcggcagcgcaaaagatg

SEQ ID NO: 146499 - DNA, 103 bp, Artificial Sequence
  Synthetic Polynucleotide
taatacgactcactatagggtgtacccagtctaccttgtccttgcagggcaacagaggagagccctgatgggacaaggtaacctggcggcagcgcaaaagatg

SEQ ID NO: 146500 - DNA, 103 bp, Artificial Sequence
  Synthetic Polynucleotide
taatacgactcactatagggaccatcacattgtacccagtctaccttgtcaacagaggagagacaagatggactgggtaaacctggcggcagcgcaaaagatg

SEQ ID NO: 146501 - DNA, 103 bp, Artificial Sequence
  Synthetic Polynucleotide
taatacgactcactatagggcatcacagccaccatcacattgtacccagtaacagaggagaactgggatgaatgtgatgaacctggcggcagcgcaaaagatg

SEQ ID NO: 146502 - DNA, 103 bp, Artificial Sequence
  Synthetic Polynucleotide
taatacgactcactatagggtgaaaccactcatcacagccaccatcacataacagaggagaatgtgaatgtggctgtgaaacctggcggcagcgcaaaagatg

SEQ ID NO: 146503 - DNA, 103 bp, Artificial Sequence
  Synthetic Polynucleotide
taatacgactcactatagggctcatatgggtagagaattctttcataatgaacagaggagacattatatgagaattctcaacctggcggcagcgcaaaagatg

SEQ ID NO: 146504 - DNA, 103 bp, Artificial Sequence
  Synthetic Polynucleotide
taatacgactcactatagggacaaacttgatgaaaccactcatcacagccaacagaggagaggctgtatggagtggtttaacctggcggcagcgcaaaagatg

SEQ ID NO: 146505 - DNA, 103 bp, Artificial Sequence
  Synthetic Polynucleotide
taatacgactcactatagggatacacccacacaaacttgatgaaaccactaacagaggagaagtggtatgatcaagtttaacctggcggcagcgcaaaagatg

SEQ ID NO: 146506 - DNA, 103 bp, Artificial Sequence
  Synthetic Polynucleotide
taatacgactcactatagggatttctggagatacacccacacaaacttgaaacagaggagatcaagtatgtgtgggtgtaacctggcggcagcgcaaaagatg

SEQ ID NO: 146507 - DNA, 103 bp, Artificial Sequence
  Synthetic Polynucleotide
taatacgactcactatagggattttcagccatttctggagatacacccacaacagaggagagtgggtatgtctccagaaaacctggcggcagcgcaaaagatg

SEQ ID NO: 146508 - DNA, 103 bp, Artificial Sequence
  Synthetic Polynucleotide
taatacgactcactatagggtgtaatcttcattttcagccatttctggagaacagaggagactccagatgtggctgaaaaacctggcggcagcgcaaaagatg

SEQ ID NO: 146509 - DNA, 103 bp, Artificial Sequence
  Synthetic Polynucleotide
taatacgactcactatagggtttatacagatgtaatcttcattttcagccaacagaggagaggctgaatgtgaagattaaacctggcggcagcgcaaaagatg

SEQ ID NO: 146510 - DNA, 103 bp, Artificial Sequence
  Synthetic Polynucleotide
taatacgactcactatagggctttgcacagtttatacagatgtaatcttcaacagaggagagaagatatgatctgtataaacctggcggcagcgcaaaagatg

SEQ ID NO: 146511 - DNA, 103 bp, Artificial Sequence
  Synthetic Polynucleotide
taatacgactcactataggggcccctgcttctttgcacagtttatacagaaacagaggagatctgtaatgactgtgcaaaacctggcggcagcgcaaaagatg

SEQ ID NO: 146512 - DNA, 103 bp, Artificial Sequence
  Synthetic Polynucleotide
taatacgactcactataggggggctaactggcccctgcttctttgcacagaacagaggagactgtgcatggaagcagggaacctggcggcagcgcaaaagatg

SEQ ID NO: 146513 - DNA, 103 bp, Artificial Sequence
  Synthetic Polynucleotide
taatacgactcactatagggtgctggacctgggctaactggcccctgcttaacagaggagaaagcagatgccagttagcaacctggcggcagcgcaaaagatg

SEQ ID NO: 146514 - DNA, 103 bp, Artificial Sequence
  Synthetic Polynucleotide
taatacgactcactataggggctcaaagacggggcactctggcggtggcaaacagaggagatgccacatgcagagtgccaacctggcggcagcgcaaaagatg

SEQ ID NO: 146515 - DNA, 103 bp, Artificial Sequence
  Synthetic Polynucleotide
taatacgactcactatagggactggaaaagctcatatgggtagagaattcaacagaggagagaattcatgacccatatgaacctggcggcagcgcaaaagatg

SEQ ID NO: 146516 - DNA, 103 bp, Artificial Sequence
  Synthetic Polynucleotide
taatacgactcactatagggaaggaggtggtgctggacctgggctaactgaacagaggagacagttaatgcaggtccagaacctggcggcagcgcaaaagatg

SEQ ID NO: 146517 - DNA, 103 bp, Artificial Sequence
  Synthetic Polynucleotide
taatacgactcactatagggattatgaaggaaggaggtggtgctggacctaacagaggagaaggtccatgaccacctccaacctggcggcagcgcaaaagatg

SEQ ID NO: 146518 - DNA, 103 bp, Artificial Sequence
  Synthetic Polynucleotide
taatacgactcactatagggtttgtagctcattatgaaggaaggaggtggaacagaggagaccacctatgtccttcataaacctggcggcagcgcaaaagatg

SEQ ID NO: 146519 - DNA, 103 bp, Artificial Sequence
  Synthetic Polynucleotide
taatacgactcactatagggccattggtagtttgtagctcattatgaaggaacagaggagaccttcaatgtgagctacaaacctggcggcagcgcaaaagatg

SEQ ID NO: 146520 - DNA, 103 bp, Artificial Sequence
  Synthetic Polynucleotide
taatacgactcactatagggttaagatcctccattggtagtttgtagctcaacagaggagagagctaatgactaccaataacctggcggcagcgcaaaagatg

SEQ ID NO: 146521 - DNA, 103 bp, Artificial Sequence
  Synthetic Polynucleotide
taatacgactcactatagggactggtctctttaagatcctccattggtagaacagaggagactaccaatggaggatcttaacctggcggcagcgcaaaagatg

SEQ ID NO: 146522 - DNA, 103 bp, Artificial Sequence
  Synthetic Polynucleotide
taatacgactcactatagggctcacaccagactggaaaagctcatatgggaacagaggagacccataatggcttttccaaacctggcggcagcgcaaaagatg

SEQ ID NO: 146523 - DNA, 103 bp, Artificial Sequence
  Synthetic Polynucleotide
taatacgactcactatagggacccataaggctcacaccagactggaaaagaacagaggagacttttcatgtctggtgtgaacctggcggcagcgcaaaagatg

SEQ ID NO: 146524 - DNA, 103 bp, Artificial Sequence
  Synthetic Polynucleotide
taatacgactcactataggggcatctgcacacccataaggctcacaccagaacagaggagactggtgatggccttatggaacctggcggcagcgcaaaagatg

SEQ ID NO: 146525 - DNA, 103 bp, Artificial Sequence
  Synthetic Polynucleotide
taatacgactcactatagggtctaaattaggcatctgcacacccataaggaacagaggagaccttatatgtgtgcagataacctggcggcagcgcaaaagatg

SEQ ID NO: 146526 - DNA, 103 bp, Artificial Sequence
  Synthetic Polynucleotide
taatacgactcactatagggttctttaagatctaaattaggcatctgcacaacagaggagagtgcagatgcctaatttaaacctggcggcagcgcaaaagatg

SEQ ID NO: 146527 - DNA, 103 bp, Artificial Sequence
  Synthetic Polynucleotide
taatacgactcactataggggctccactttttctttaagatctaaattagaacagaggagactaattatgatcttaaagaacctggcggcagcgcaaaagatg

SEQ ID NO: 146528 - DNA, 103 bp, Artificial Sequence
  Synthetic Polynucleotide
taatacgactcactatagggagaacctcaggctccactttttctttaagaaacagaggagatcttaaatgaaaagtggaaacctggcggcagcgcaaaagatg

SEQ ID NO: 146529 - DNA, 103 bp, Artificial Sequence
  Synthetic Polynucleotide
taatacgactcactatagggatcagtgctgagaacctcaggctccactttaacagaggagaaaagtgatgcctgaggttaacctggcggcagcgcaaaagatg

SEQ ID NO: 146530 - DNA, 103 bp, Artificial Sequence
  Synthetic Polynucleotide
taatacgactcactatagggaagtttgggtatcagtgctgagaacctcagaacagaggagactgaggatgtcagcactgaacctggcggcagcgcaaaagatg

SEQ ID NO: 146531 - DNA, 103 bp, Artificial Sequence
  Synthetic Polynucleotide
taatacgactcactatagggtcccaactcggctcaaagacggggcactctaacagaggagaagagtgatgcgtctttgaaacctggcggcagcgcaaaagatg

SEQ ID NO: 146532 - DNA, 103 bp, Artificial Sequence
  Synthetic Polynucleotide
taatacgactcactatagggggctctggggaagtttgggtatcagtgctgaacagaggagacagcacatgtacccaaacaacctggcggcagcgcaaaagatg

SEQ ID NO: 146533 - DNA, 103 bp, Artificial Sequence
  Synthetic Polynucleotide
taatacgactcactatagggccttgtgcctggctctggggaagtttgggtaacagaggagaacccaaatgtccccagagaacctggcggcagcgcaaaagatg

SEQ ID NO: 146534 - DNA, 103 bp, Artificial Sequence
  Synthetic Polynucleotide
taatacgactcactataggggaatgttcatccttgtgcctggctctggggaacagaggagaccccagatgcaggcacaaaacctggcggcagcgcaaaagatg

SEQ ID NO: 146535 - DNA, 103 bp, Artificial Sequence
  Synthetic Polynucleotide
taatacgactcactatagggctcttcggcagaatgttcatccttgtgcctaacagaggagaaggcacatggatgaacataacctggcggcagcgcaaaagatg

SEQ ID NO: 146536 - DNA, 103 bp, Artificial Sequence
  Synthetic Polynucleotide
taatacgactcactatagggacgtcttgttctcttcggcagaatgttcataacagaggagaatgaacatgctgccgaagaacctggcggcagcgcaaaagatg

SEQ ID NO: 146537 - DNA, 103 bp, Artificial Sequence
  Synthetic Polynucleotide
taatacgactcactataggggagtcttcacacgtcttgttctcttcggcaaacagaggagatgccgaatggaacaagacaacctggcggcagcgcaaaagatg

SEQ ID NO: 146538 - DNA, 103 bp, Artificial Sequence
  Synthetic Polynucleotide
taatacgactcactataggggattctgactgagtcttcacacgtcttgttaacagaggagaaacaagatgtgtgaagacaacctggcggcagcgcaaaagatg

SEQ ID NO: 146539 - DNA, 103 bp, Artificial Sequence
  Synthetic Polynucleotide
taatacgactcactatagggcacatctccagattctgactgagtcttcacaacagaggagagtgaagatgcagtcagaaaacctggcggcagcgcaaaagatg

SEQ ID NO: 146540 - DNA, 103 bp, Artificial Sequence
  Synthetic Polynucleotide
taatacgactcactatagggtgtttctactcacatctccagattctgactaacagaggagaagtcagatgctggagatgaacctggcggcagcgcaaaagatg

SEQ ID NO: 146541 - DNA, 103 bp, Artificial Sequence
  Synthetic Polynucleotide
taatacgactcactatagggttcagttccgtgtttctactcacatctccaaacagaggagatggagaatggagtagaaaaacctggcggcagcgcaaaagatg

SEQ ID NO: 146542 - DNA, 103 bp, Artificial Sequence
  Synthetic Polynucleotide
taatacgactcactatagggtgtgaactcctcccaactcggctcaaagacaacagaggagagtctttatgccgagttggaacctggcggcagcgcaaaagatg

SEQ ID NO: 146543 - DNA, 103 bp, Artificial Sequence
  Synthetic Polynucleotide
taatacgactcactatagggctgaagtttcttcagttccgtgtttctactaacagaggagaagtagaatgacggaactgaacctggcggcagcgcaaaagatg

SEQ ID NO: 146544 - DNA, 103 bp, Artificial Sequence
  Synthetic Polynucleotide
taatacgactcactatagggccccaaaaatctgaagtttcttcagttccgaacagaggagacggaacatgagaaacttcaacctggcggcagcgcaaaagatg

SEQ ID NO: 146545 - DNA, 103 bp, Artificial Sequence
  Synthetic Polynucleotide
taatacgactcactatagggttgggcccagccccaaaaatctgaagtttcaacagaggagagaaactatggatttttggaacctggcggcagcgcaaaagatg

SEQ ID NO: 146546 - DNA, 103 bp, Artificial Sequence
  Synthetic Polynucleotide
taatacgactcactataggggcccacaaccttgggcccagccccaaaaataacagaggagaatttttatggctgggcccaacctggcggcagcgcaaaagatg

SEQ ID NO: 146547 - DNA, 103 bp, Artificial Sequence
  Synthetic Polynucleotide
taatacgactcactatagggccattgccaagcccacaaccttgggcccagaacagaggagactgggcatgaggttgtggaacctggcggcagcgcaaaagatg

SEQ ID NO: 146548 - DNA, 103 bp, Artificial Sequence
  Synthetic Polynucleotide
taatacgactcactatagggtcttttgttcccattgccaagcccacaaccaacagaggagaggttgtatgcttggcaataacctggcggcagcgcaaaagatg

SEQ ID NO: 146549 - DNA, 103 bp, Artificial Sequence
  Synthetic Polynucleotide
taatacgactcactatagggatcttctttatcttttgttcccattgccaaaacagaggagattggcaatgggaacaaaaaacctggcggcagcgcaaaagatg

SEQ ID NO: 146550 - DNA, 103 bp, Artificial Sequence
  Synthetic Polynucleotide
taatacgactcactataggggggtgacctcatcttctttatcttttgttcaacagaggagagaacaaatgataaagaagaacctggcggcagcgcaaaagatg

SEQ ID NO: 146551 - DNA, 103 bp, Artificial Sequence
  Synthetic Polynucleotide
taatacgactcactatagggtttcgtcttcgggtgacctcatcttctttaaacagaggagataaagaatgtgaggtcacaacctggcggcagcgcaaaagatg

SEQ ID NO: 146552 - DNA, 103 bp, Artificial Sequence
  Synthetic Polynucleotide
taatacgactcactataggggttggtaacttttcgtcttcgggtgacctcaacagaggagagaggtcatgcgaagacgaaacctggcggcagcgcaaaagatg

SEQ ID NO: 146553 - DNA, 103 bp, Artificial Sequence
  Synthetic Polynucleotide
taatacgactcactatagggtgagcggatctgtgaactcctcccaactcgaacagaggagacgagttatgaggagttcaaacctggcggcagcgcaaaagatg

SEQ ID NO: 146554 - DNA, 103 bp, Artificial Sequence
  Synthetic Polynucleotide
taatacgactcactatagggcgtctgacctgttggtaacttttcgtcttcaacagaggagagaagacatgaagttaccaaacctggcggcagcgcaaaagatg

SEQ ID NO: 146555 - DNA, 103 bp, Artificial Sequence
  Synthetic Polynucleotide
taatacgactcactatagggatgttaaatgcgtctgacctgttggtaactaacagaggagaagttacatgcaggtcagaaacctggcggcagcgcaaaagatg

SEQ ID NO: 146556 - DNA, 103 bp, Artificial Sequence
  Synthetic Polynucleotide
taatacgactcactatagggtctcatttgcatgttaaatgcgtctgacctaacagaggagaaggtcaatggcatttaacaacctggcggcagcgcaaaagatg

SEQ ID NO: 146557 - DNA, 103 bp, Artificial Sequence
  Synthetic Polynucleotide
taatacgactcactatagggctttccgttgtctcatttgcatgttaaatgaacagaggagacatttaatgtgcaaatgaaacctggcggcagcgcaaaagatg

SEQ ID NO: 146558 - DNA, 103 bp, Artificial Sequence
  Synthetic Polynucleotide
taatacgactcactataggggagagagtgcctttccgttgtctcatttgcaacagaggagagcaaatatgacaacggaaaacctggcggcagcgcaaaagatg

SEQ ID NO: 146559 - DNA, 103 bp, Artificial Sequence
  Synthetic Polynucleotide
taatacgactcactatagggaaagttaacagagagagtgcctttccgttgaacagaggagacaacggatgggcactctcaacctggcggcagcgcaaaagatg

SEQ ID NO: 146560 - DNA, 103 bp, Artificial Sequence
  Synthetic Polynucleotide
taatacgactcactatagggagagatcaacaaagttaacagagagagtgcaacagaggagagcactcatgctgttaactaacctggcggcagcgcaaaagatg

SEQ ID NO: 146561 - DNA, 103 bp, Artificial Sequence
  Synthetic Polynucleotide
taatacgactcactatagggatacaaacatagagatcaacaaagttaacaaacagaggagatgttaaatgtgttgatctaacctggcggcagcgcaaaagatg

SEQ ID NO: 146562 - DNA, 103 bp, Artificial Sequence
  Synthetic Polynucleotide
taatacgactcactatagggaccacaaaacatacaaacatagagatcaacaacagaggagagttgatatgtatgtttgtaacctggcggcagcgcaaaagatg

SEQ ID NO: 146563 - DNA, 103 bp, Artificial Sequence
  Synthetic Polynucleotide
taatacgactcactatagggtgtttccccgaccacaaaacatacaaacataacagaggagaatgtttatgtgttttgtgaacctggcggcagcgcaaaagatg

SEQ ID NO: 146564 - DNA, 103 bp, Artificial Sequence
  Synthetic Polynucleotide
taatacgactcactatagggccgataaagctgagcggatctgtgaactccaacagaggagaggagttatgagatccgctaacctggcggcagcgcaaaagatg

SEQ ID NO: 146565 - DNA, 103 bp, Artificial Sequence
  Synthetic Polynucleotide
taatacgactcactatagggttatcttcattgtttccccgaccacaaaacaacagaggagagttttgatgtcggggaaaaacctggcggcagcgcaaaagatg

SEQ ID NO: 146566 - DNA, 103 bp, Artificial Sequence
  Synthetic Polynucleotide
taatacgactcactatagggcaaaagcaatttatcttcattgtttccccgaacagaggagacggggaatgaatgaagataacctggcggcagcgcaaaagatg

SEQ ID NO: 146567 - DNA, 103 bp, Artificial Sequence
  Synthetic Polynucleotide
taatacgactcactatagggatccatcacacaaaagcaatttatcttcataacagaggagaatgaagatgaattgctttaacctggcggcagcgcaaaagatg

SEQ ID NO: 146568 - DNA, 103 bp, Artificial Sequence
  Synthetic Polynucleotide
taatacgactcactatagggctgtcatcacatccatcacacaaaagcaataacagaggagaattgctatggtgtgatggaacctggcggcagcgcaaaagatg

SEQ ID NO: 146569 - DNA, 103 bp, Artificial Sequence
  Synthetic Polynucleotide
taatacgactcactatagggtgtatgatagctgtcatcacatccatcacaaacagaggagatgtgatatgtgtgatgacaacctggcggcagcgcaaaagatg

SEQ ID NO: 146570 - DNA, 103 bp, Artificial Sequence
  Synthetic Polynucleotide
taatacgactcactatagggttagacaaaatgtatgatagctgtcatcacaacagaggagagtgatgatggctatcataaacctggcggcagcgcaaaagatg

SEQ ID NO: 146571 - DNA, 103 bp, Artificial Sequence
  Synthetic Polynucleotide
taatacgactcactatagggagtggaggaattagacaaaatgtatgatagaacagaggagactatcaatgattttgtctaacctggcggcagcgcaaaagatg

SEQ ID NO: 146572 - DNA, 103 bp, Artificial Sequence
  Synthetic Polynucleotide
taatacgactcactatagggcacatcaggtagtggaggaattagacaaaaaacagaggagattttgtatgattcctccaaacctggcggcagcgcaaaagatg

SEQ ID NO: 146573 - DNA, 103 bp, Artificial Sequence
  Synthetic Polynucleotide
taatacgactcactatagggctcctttgggcacatcaggtagtggaggaaaacagaggagattcctcatgtacctgatgaacctggcggcagcgcaaaagatg

SEQ ID NO: 146574 - DNA, 103 bp, Artificial Sequence
  Synthetic Polynucleotide
taatacgactcactatagggcacctccagtctcctttgggcacatcaggtaacagaggagaacctgaatggcccaaaggaacctggcggcagcgcaaaagatg

SEQ ID NO: 146575 - DNA, 103 bp, Artificial Sequence
  Synthetic Polynucleotide
taatacgactcactatagggggtagcgagcgacactccgcaggatttcataacagaggagaatgaaaatgtgcggagtgaacctggcggcagcgcaaaagatg

SEQ ID NO: 146576 - DNA, 103 bp, Artificial Sequence
  Synthetic Polynucleotide
taatacgactcactataggggctgggggacgcctcctcgctctcgccgctaacagaggagaagcggcatgagcgaggagaacctggcggcagcgcaaaagatg

SEQ ID NO: 146577 - DNA, 103 bp, Artificial Sequence
  Synthetic Polynucleotide
taatacgactcactatagggggcctgtaaagcatccatgggctgattttgaacagaggagacaaaatatgcccatggataacctggcggcagcgcaaaagatg

SEQ ID NO: 146578 - DNA, 103 bp, Artificial Sequence
  Synthetic Polynucleotide
taatacgactcactatagggcacaaatataggcctgtaaagcatccatggaacagaggagaccatggatgctttacaggaacctggcggcagcgcaaaagatg

SEQ ID NO: 146579 - DNA, 103 bp, Artificial Sequence
  Synthetic Polynucleotide
taatacgactcactatagggaattgtacagcacaaatataggcctgtaaaaacagaggagatttacaatgctatatttgaacctggcggcagcgcaaaagatg

SEQ ID NO: 146580 - DNA, 103 bp, Artificial Sequence
  Synthetic Polynucleotide
taatacgactcactataggggccatggtccaattgtacagcacaaatataaacagaggagatatattatggctgtacaaaacctggcggcagcgcaaaagatg

SEQ ID NO: 146581 - DNA, 103 bp, Artificial Sequence
  Synthetic Polynucleotide
taatacgactcactatagggctgcagcatggccatggtccaattgtacagaacagaggagactgtacatgtggaccatgaacctggcggcagcgcaaaagatg

SEQ ID NO: 146582 - DNA, 103 bp, Artificial Sequence
  Synthetic Polynucleotide
taatacgactcactatagggtccatccaggctgcagcatggccatggtccaacagaggagaggaccaatgccatgctgcaacctggcggcagcgcaaaagatg

SEQ ID NO: 146583 - DNA, 103 bp, Artificial Sequence
  Synthetic Polynucleotide
taatacgactcactatagggagtgcctaggtccatccaggctgcagcatgaacagaggagacatgctatggcctggatgaacctggcggcagcgcaaaagatg

SEQ ID NO: 146584 - DNA, 103 bp, Artificial Sequence
  Synthetic Polynucleotide
taatacgactcactatagggattcatagagagtgcctaggtccatccaggaacagaggagacctggaatgacctaggcaaacctggcggcagcgcaaaagatg

SEQ ID NO: 146585 - DNA, 103 bp, Artificial Sequence
  Synthetic Polynucleotide
taatacgactcactatagggtggttgcaggattcatagagagtgcctaggaacagaggagacctaggatgtctctatgaaacctggcggcagcgcaaaagatg

SEQ ID NO: 146586 - DNA, 103 bp, Artificial Sequence
  Synthetic Polynucleotide
taatacgactcactatagggatcctgaggctggttgcaggattcatagagaacagaggagactctatatgtcctgcaacaacctggcggcagcgcaaaagatg

SEQ ID NO: 146587 - DNA, 103 bp, Artificial Sequence
  Synthetic Polynucleotide
taatacgactcactatagggcggctgtcaggctgggggacgcctcctcgcaacagaggagagcgaggatgcgtcccccaaacctggcggcagcgcaaaagatg

SEQ ID NO: 146588 - DNA, 103 bp, Artificial Sequence
  Synthetic Polynucleotide
taatacgactcactatagggatttaatggcatcctgaggctggttgcaggaacagaggagacctgcaatgagcctcaggaacctggcggcagcgcaaaagatg

SEQ ID NO: 146589 - DNA, 103 bp, Artificial Sequence
  Synthetic Polynucleotide
taatacgactcactatagggtttaagtagcatttaatggcatcctgaggcaacagaggagagcctcaatgtgccattaaaacctggcggcagcgcaaaagatg

SEQ ID NO: 146590 - DNA, 103 bp, Artificial Sequence
  Synthetic Polynucleotide
taatacgactcactatagggtctagttgcatttaagtagcatttaatggcaacagaggagagccattatgtgctacttaaacctggcggcagcgcaaaagatg

SEQ ID NO: 146591 - DNA, 103 bp, Artificial Sequence
  Synthetic Polynucleotide
taatacgactcactatagggaacttttgcttctagttgcatttaagtagcaacagaggagagctactatgatgcaactaaacctggcggcagcgcaaaagatg

SEQ ID NO: 146592 - DNA, 103 bp, Artificial Sequence
  Synthetic Polynucleotide
taatacgactcactataggggtattactacaacttttgcttctagttgcaaacagaggagatgcaacatgaagcaaaagaacctggcggcagcgcaaaagatg

SEQ ID NO: 146593 - DNA, 103 bp, Artificial Sequence
  Synthetic Polynucleotide
taatacgactcactatagggaagtgcagaggtattactacaacttttgctaacagaggagaagcaaaatgtgtagtaataacctggcggcagcgcaaaagatg

SEQ ID NO: 146594 - DNA, 103 bp, Artificial Sequence
  Synthetic Polynucleotide
taatacgactcactatagggttcgtgctgcaagtgcagaggtattactacaacagaggagagtagtaatgcctctgcacaacctggcggcagcgcaaaagatg

SEQ ID NO: 146595 - DNA, 103 bp, Artificial Sequence
  Synthetic Polynucleotide
taatacgactcactatagggaaatacttaattcgtgctgcaagtgcagagaacagaggagactctgcatgtgcagcacgaacctggcggcagcgcaaaagatg

SEQ ID NO: 146596 - DNA, 103 bp, Artificial Sequence
  Synthetic Polynucleotide
taatacgactcactatagggctgagcctgtaaatacttaattcgtgctgcaacagaggagagcagcaatgattaagtataacctggcggcagcgcaaaagatg

SEQ ID NO: 146597 - DNA, 103 bp, Artificial Sequence
  Synthetic Polynucleotide
taatacgactcactatagggggttacacaactgagcctgtaaatacttaaaacagaggagattaagtatgtacaggctcaacctggcggcagcgcaaaagatg

SEQ ID NO: 146598 - DNA, 103 bp, Artificial Sequence
  Synthetic Polynucleotide
taatacgactcactatagggtccctctcctcggctgtcaggctgggggacaacagaggagagtccccatgcctgacagcaacctggcggcagcgcaaaagatg

SEQ ID NO: 146599 - DNA, 103 bp, Artificial Sequence
  Synthetic Polynucleotide
taatacgactcactatagggccttgtggaaggttacacaactgagcctgtaacagaggagaacaggcatggttgtgtaaaacctggcggcagcgcaaaagatg

SEQ ID NO: 146600 - DNA, 103 bp, Artificial Sequence
  Synthetic Polynucleotide
taatacgactcactatagggctgtagactaccttgtggaaggttacacaaaacagaggagattgtgtatgcttccacaaaacctggcggcagcgcaaaagatg

SEQ ID NO: 146601 - DNA, 103 bp, Artificial Sequence
  Synthetic Polynucleotide
taatacgactcactatagggtagttttattctgtagactaccttgtggaaaacagaggagattccacatggtagtctacaacctggcggcagcgcaaaagatg

SEQ ID NO: 146602 - DNA, 103 bp, Artificial Sequence
  Synthetic Polynucleotide
taatacgactcactatagggggaagtaatttagttttattctgtagactaaacagaggagatagtctatggaataaaacaacctggcggcagcgcaaaagatg

SEQ ID NO: 146603 - DNA, 103 bp, Artificial Sequence
  Synthetic Polynucleotide
taatacgactcactatagggctcaatactaggaagtaatttagttttattaacagaggagaaataaaatgaaattacttaacctggcggcagcgcaaaagatg

SEQ ID NO: 146604 - DNA, 103 bp, Artificial Sequence
  Synthetic Polynucleotide
taatacgactcactatagggtccacgcctcctcaatactaggaagtaattaacagaggagaaattacatgctagtattgaacctggcggcagcgcaaaagatg

SEQ ID NO: 146605 - DNA, 103 bp, Artificial Sequence
  Synthetic Polynucleotide
taatacgactcactatagggattggtaggctccacgcctcctcaatactaaacagaggagatagtatatgggaggcgtgaacctggcggcagcgcaaaagatg

SEQ ID NO: 146606 - DNA, 103 bp, Artificial Sequence
  Synthetic Polynucleotide
taatacgactcactatagggctctgcgggaattggtaggctccacgcctcaacagaggagagaggcgatgagcctaccaaacctggcggcagcgcaaaagatg

SEQ ID NO: 146607 - DNA, 103 bp, Artificial Sequence
  Synthetic Polynucleotide
taatacgactcactatagggtggaggtaagctctgcgggaattggtaggcaacagaggagagcctacatgttcccgcagaacctggcggcagcgcaaaagatg

SEQ ID NO: 146608 - DNA, 103 bp, Artificial Sequence
  Synthetic Polynucleotide
taatacgactcactataggggcaccctgcctggaggtaagctctgcgggaaacagaggagatcccgcatggcttacctcaacctggcggcagcgcaaaagatg

SEQ ID NO: 146609 - DNA, 103 bp, Artificial Sequence
  Synthetic Polynucleotide
taatacgactcactataggggccgagcgcctccctctcctcggctgtcagaacagaggagactgacaatggaggagaggaacctggcggcagcgcaaaagatg

SEQ ID NO: 146610 - DNA, 103 bp, Artificial Sequence
  Synthetic Polynucleotide
taatacgactcactatagggtgtgttcatggcaccctgcctggaggtaagaacagaggagacttaccatgaggcagggtaacctggcggcagcgcaaaagatg

SEQ ID NO: 146611 - DNA, 103 bp, Artificial Sequence
  Synthetic Polynucleotide
taatacgactcactatagggtctgctgtgctgtgttcatggcaccctgccaacagaggagaggcaggatgccatgaacaaacctggcggcagcgcaaaagatg

SEQ ID NO: 146612 - DNA, 103 bp, Artificial Sequence
  Synthetic Polynucleotide
taatacgactcactatagggtcagaagtattctgctgtgctgtgttcatgaacagaggagacatgaaatgagcacagcaaacctggcggcagcgcaaaagatg

SEQ ID NO: 146613 - DNA, 103 bp, Artificial Sequence
  Synthetic Polynucleotide
taatacgactcactatagggactccaattgtcagaagtattctgctgtgcaacagaggagagcacagatgaatacttctaacctggcggcagcgcaaaagatg

SEQ ID NO: 146614 - DNA, 103 bp, Artificial Sequence
  Synthetic Polynucleotide
taatacgactcactatagggcatgtccaccactccaattgtcagaagtataacagaggagaatacttatgacaattggaaacctggcggcagcgcaaaagatg

SEQ ID NO: 146615 - DNA, 103 bp, Artificial Sequence
  Synthetic Polynucleotide
taatacgactcactatagggtgtgacacagcatgtccaccactccaattgaacagaggagacaattgatgtggtggacaaacctggcggcagcgcaaaagatg

SEQ ID NO: 146616 - DNA, 103 bp, Artificial Sequence
  Synthetic Polynucleotide
taatacgactcactatagggtactggaggatgtgacacagcatgtccaccaacagaggagaggtggaatggctgtgtcaaacctggcggcagcgcaaaagatg

SEQ ID NO: 146617 - DNA, 103 bp, Artificial Sequence
  Synthetic Polynucleotide
taatacgactcactatagggcttgttgctgtactggaggatgtgacacagaacagaggagactgtgtatgatcctccagaacctggcggcagcgcaaaagatg

SEQ ID NO: 146618 - DNA, 103 bp, Artificial Sequence
  Synthetic Polynucleotide
taatacgactcactatagggcatgaatgagcttgttgctgtactggaggaaacagaggagatcctccatgacagcaacaaacctggcggcagcgcaaaagatg

SEQ ID NO: 146619 - DNA, 103 bp, Artificial Sequence
  Synthetic Polynucleotide
taatacgactcactatagggtgtcaaacaccatgaatgagcttgttgctgaacagaggagacagcaaatggctcattcaaacctggcggcagcgcaaaagatg

SEQ ID NO: 146620 - DNA, 103 bp, Artificial Sequence
  Synthetic Polynucleotide
taatacgactcactatagggtgtccagtccgccgagcgcctccctctcctaacagaggagaaggagaatgaggcgctcgaacctggcggcagcgcaaaagatg

SEQ ID NO: 146621 - DNA, 103 bp, Artificial Sequence
  Synthetic Polynucleotide
taatacgactcactatagggatttctgtggtgtcaaacaccatgaatgagaacagaggagactcattatgggtgtttgaaacctggcggcagcgcaaaagatg

SEQ ID NO: 146622 - DNA, 103 bp, Artificial Sequence
  Synthetic Polynucleotide
taatacgactcactatagggaaatgctgtaatttctgtggtgtcaaacacaacagaggagagtgtttatgaccacagaaaacctggcggcagcgcaaaagatg

SEQ ID NO: 146623 - DNA, 103 bp, Artificial Sequence
  Synthetic Polynucleotide
taatacgactcactataggggagctgttccaaatgctgtaatttctgtggaacagaggagaccacagatgttacagcataacctggcggcagcgcaaaagatg

SEQ ID NO: 146624 - DNA, 103 bp, Artificial Sequence
  Synthetic Polynucleotide
taatacgactcactatagggtatttgcgcggagctgttccaaatgctgtaaacagaggagatacagcatgtggaacagcaacctggcggcagcgcaaaagatg

SEQ ID NO: 146625 - DNA, 103 bp, Artificial Sequence
  Synthetic Polynucleotide
taatacgactcactatagggaaattatttctatttgcgcggagctgttccaacagaggagaggaacaatgccgcgcaaaaacctggcggcagcgcaaaagatg

SEQ ID NO: 146626 - DNA, 103 bp, Artificial Sequence
  Synthetic Polynucleotide
taatacgactcactatagggtgctggatttaaattatttctatttgcgcgaacagaggagacgcgcaatgagaaataataacctggcggcagcgcaaaagatg

SEQ ID NO: 146627 - DNA, 103 bp, Artificial Sequence
  Synthetic Polynucleotide
taatacgactcactatagggtcagtttctgtgctggatttaaattatttcaacagaggagagaaataatgtaaatccagaacctggcggcagcgcaaaagatg

SEQ ID NO: 146628 - DNA, 103 bp, Artificial Sequence
  Synthetic Polynucleotide
taatacgactcactatagggtgttccagcatcagtttctgtgctggatttaacagaggagaaaatccatgacagaaactaacctggcggcagcgcaaaagatg

SEQ ID NO: 146629 - DNA, 103 bp, Artificial Sequence
  Synthetic Polynucleotide
taatacgactcactatagggactttccagctgttccagcatcagtttctgaacagaggagacagaaaatgatgctggaaaacctggcggcagcgcaaaagatg

SEQ ID NO: 146630 - DNA, 103 bp, Artificial Sequence
  Synthetic Polynucleotide
taatacgactcactatagggagacaaactgactttccagctgttccagcaaacagaggagatgctggatgagctggaaaaacctggcggcagcgcaaaagatg

SEQ ID NO: 146631 - DNA, 103 bp, Artificial Sequence
  Synthetic Polynucleotide
taatacgactcactatagggaagaggcggctgtccagtccgccgagcgccaacagaggagaggcgctatgcggactggaaacctggcggcagcgcaaaagatg

SEQ ID NO: 146632 - DNA, 103 bp, Artificial Sequence
  Synthetic Polynucleotide
taatacgactcactatagggtgttgcattaagacaaactgactttccagcaacagaggagagctggaatgtcagtttgtaacctggcggcagcgcaaaagatg

SEQ ID NO: 146633 - DNA, 103 bp, Artificial Sequence
  Synthetic Polynucleotide
taatacgactcactatagggcatttggtgttgttgcattaagacaaactgaacagaggagacagtttatgttaatgcaaaacctggcggcagcgcaaaagatg

SEQ ID NO: 146634 - DNA, 103 bp, Artificial Sequence
  Synthetic Polynucleotide
taatacgactcactatagggctgttggtctcatttggtgttgttgcattaaacagaggagataatgcatgaacaccaaaaacctggcggcagcgcaaaagatg

SEQ ID NO: 146635 - DNA, 103 bp, Artificial Sequence
  Synthetic Polynucleotide
taatacgactcactatagggtgtgcaactcctgttggtctcatttggtgtaacagaggagaacaccaatggagaccaacaacctggcggcagcgcaaaagatg

SEQ ID NO: 146636 - DNA, 103 bp, Artificial Sequence
  Synthetic Polynucleotide
taatacgactcactatagggagatcgtacctgtgcaactcctgttggtctaacagaggagaagaccaatgggagttgcaaacctggcggcagcgcaaaagatg

SEQ ID NO: 146637 - DNA, 103 bp, Artificial Sequence
  Synthetic Polynucleotide
taatacgactcactataggggaattccagtagatcgtacctgtgcaactcaacagaggagagagttgatgaggtacgataacctggcggcagcgcaaaagatg

SEQ ID NO: 146638 - DNA, 103 bp, Artificial Sequence
  Synthetic Polynucleotide
taatacgactcactatagggggcccattaggaattccagtagatcgtaccaacagaggagaggtacgatgtactggaataacctggcggcagcgcaaaagatg

SEQ ID NO: 146639 - DNA, 103 bp, Artificial Sequence
  Synthetic Polynucleotide
taatacgactcactataggggtcagctgttggcccattaggaattccagtaacagaggagaactggaatgcctaatgggaacctggcggcagcgcaaaagatg

SEQ ID NO: 146640 - DNA, 103 bp, Artificial Sequence
  Synthetic Polynucleotide
taatacgactcactataggggcagtgatgagtcagctgttggcccattagaacagaggagactaatgatgcaacagctgaacctggcggcagcgcaaaagatg

SEQ ID NO: 146641 - DNA, 103 bp, Artificial Sequence
  Synthetic Polynucleotide
taatacgactcactataggggagtttgtaggcagtgatgagtcagctgttaacagaggagaaacagcatgctcatcactaacctggcggcagcgcaaaagatg

SEQ ID NO: 146642 - DNA, 103 bp, Artificial Sequence
  Synthetic Polynucleotide
taatacgactcactatagggcacgaacccaaagaggcggctgtccagtccaacagaggagaggactgatgagccgcctcaacctggcggcagcgcaaaagatg

SEQ ID NO: 146643 - DNA, 103 bp, Artificial Sequence
  Synthetic Polynucleotide
taatacgactcactataggggccagagactgagtttgtaggcagtgatgaaacagaggagatcatcaatgcctacaaacaacctggcggcagcgcaaaagatg

SEQ ID NO: 146644 - DNA, 103 bp, Artificial Sequence
  Synthetic Polynucleotide
taatacgactcactataggggtggctgctggccagagactgagtttgtagaacagaggagactacaaatgcagtctctgaacctggcggcagcgcaaaagatg

SEQ ID NO: 146645 - DNA, 103 bp, Artificial Sequence
  Synthetic Polynucleotide
taatacgactcactatagggagagcaagctgtggctgctggccagagactaacagaggagaagtctcatgccagcagccaacctggcggcagcgcaaaagatg

SEQ ID NO: 146646 - DNA, 103 bp, Artificial Sequence
  Synthetic Polynucleotide
taatacgactcactatagggcactctggtcagagcaagctgtggctgctgaacagaggagacagcagatgcagcttgctaacctggcggcagcgcaaaagatg

SEQ ID NO: 146647 - DNA, 103 bp, Artificial Sequence
  Synthetic Polynucleotide
taatacgactcactatagggagacgctaggcactctggtcagagcaagctaacagaggagaagcttgatgtgaccagagaacctggcggcagcgcaaaagatg

SEQ ID NO: 146648 - DNA, 103 bp, Artificial Sequence
  Synthetic Polynucleotide
taatacgactcactatagggccaggctgagagacgctaggcactctggtcaacagaggagagaccagatggcctagcgtaacctggcggcagcgcaaaagatg

SEQ ID NO: 146649 - DNA, 103 bp, Artificial Sequence
  Synthetic Polynucleotide
taatacgactcactatagggaggacggactccaggctgagagacgctaggaacagaggagacctagcatgtctcagcctaacctggcggcagcgcaaaagatg

SEQ ID NO: 146650 - DNA, 103 bp, Artificial Sequence
  Synthetic Polynucleotide
taatacgactcactatagggcagggcaggcaggacggactccaggctgagaacagaggagactcagcatggagtccgtcaacctggcggcagcgcaaaagatg

SEQ ID NO: 146651 - DNA, 103 bp, Artificial Sequence
  Synthetic Polynucleotide
taatacgactcactatagggaaaggctgcccagggcaggcaggacggactaacagaggagaagtccgatgtgcctgcccaacctggcggcagcgcaaaagatg

SEQ ID NO: 146652 - DNA, 103 bp, Artificial Sequence
  Synthetic Polynucleotide
taatacgactcactatagggtccattggccaaaggctgcccagggcaggcaacagaggagagcctgcatggggcagcctaacctggcggcagcgcaaaagatg

SEQ ID NO: 146653 - DNA, 103 bp, Artificial Sequence
  Synthetic Polynucleotide
taatacgactcactatagggcatgaaatctcacgaacccaaagaggcggcaacagaggagagccgccatgttgggttcgaacctggcggcagcgcaaaagatg

SEQ ID NO: 146654 - DNA, 103 bp, Artificial Sequence
  Synthetic Polynucleotide
taatacgactcactatagggcagaaaagggtccattggccaaaggctgccaacagaggagaggcagcatgtggccaatgaacctggcggcagcgcaaaagatg

SEQ ID NO: 146655 - DNA, 103 bp, Artificial Sequence
  Synthetic Polynucleotide
taatacgactcactatagggacatggcctgcagaaaagggtccattggccaacagaggagaggccaaatgacccttttcaacctggcggcagcgcaaaagatg

SEQ ID NO: 146656 - DNA, 103 bp, Artificial Sequence
  Synthetic Polynucleotide
taatacgactcactataggggctacagggaacatggcctgcagaaaagggaacagaggagaccctttatggcaggccataacctggcggcagcgcaaaagatg

SEQ ID NO: 146657 - DNA, 103 bp, Artificial Sequence
  Synthetic Polynucleotide
taatacgactcactatagggttcttgatgtgctacagggaacatggcctgaacagaggagacaggccatgttccctgtaaacctggcggcagcgcaaaagatg

SEQ ID NO: 146658 - DNA, 103 bp, Artificial Sequence
  Synthetic Polynucleotide
taatacgactcactatagggcttcccagcgttcttgatgtgctacagggaaacagaggagatccctgatgcacatcaagaacctggcggcagcgcaaaagatg

SEQ ID NO: 146659 - DNA, 103 bp, Artificial Sequence
  Synthetic Polynucleotide
taatacgactcactatagggagtgtctgtacttcccagcgttcttgatgtaacagaggagaacatcaatgacgctgggaaacctggcggcagcgcaaaagatg

SEQ ID NO: 146660 - DNA, 103 bp, Artificial Sequence
  Synthetic Polynucleotide
taatacgactcactatagggctatcaaaatagtgtctgtacttcccagcgaacagaggagacgctggatggtacagacaaacctggcggcagcgcaaaagatg

SEQ ID NO: 146661 - DNA, 103 bp, Artificial Sequence
  Synthetic Polynucleotide
taatacgactcactatagggtgattattgcctatcaaaatagtgtctgtaaacagaggagatacagaatgtattttgataacctggcggcagcgcaaaagatg

SEQ ID NO: 146662 - DNA, 103 bp, Artificial Sequence
  Synthetic Polynucleotide
taatacgactcactatagggtcctgttatatgattattgcctatcaaaataacagaggagaattttgatgggcaataataacctggcggcagcgcaaaagatg

SEQ ID NO: 146663 - DNA, 103 bp, Artificial Sequence
  Synthetic Polynucleotide
taatacgactcactatagggtacttccacttcctgttatatgattattgcaacagaggagagcaataatgatataacagaacctggcggcagcgcaaaagatg

SEQ ID NO: 146664 - DNA, 103 bp, Artificial Sequence
  Synthetic Polynucleotide
taatacgactcactataggggcgccatcttcatgaaatctcacgaacccaaacagaggagatgggttatggagatttcaaacctggcggcagcgcaaaagatg

SEQ ID NO: 146665 - DNA, 103 bp, Artificial Sequence
  Synthetic Polynucleotide
taatacgactcactatagggacgtttccattacttccacttcctgttataaacagaggagatataacatgaagtggaagaacctggcggcagcgcaaaagatg

SEQ ID NO: 146666 - DNA, 103 bp, Artificial Sequence
  Synthetic Polynucleotide
taatacgactcactatagggcaggtaaggcacgtttccattacttccactaacagaggagaagtggaatgaatggaaacaacctggcggcagcgcaaaagatg

SEQ ID NO: 146667 - DNA, 103 bp, Artificial Sequence
  Synthetic Polynucleotide
taatacgactcactatagggcgtttcgctgcaggtaaggcacgtttccataacagaggagaatggaaatgtgccttaccaacctggcggcagcgcaaaagatg

SEQ ID NO: 146668 - DNA, 103 bp, Artificial Sequence
  Synthetic Polynucleotide
taatacgactcactatagggagagtgagtgcgtttcgctgcaggtaaggcaacagaggagagccttaatggcagcgaaaaacctggcggcagcgcaaaagatg

SEQ ID NO: 146669 - DNA, 103 bp, Artificial Sequence
  Synthetic Polynucleotide
taatacgactcactataggggttatgaggtagagtgagtgcgtttcgctgaacagaggagacagcgaatggcactcactaacctggcggcagcgcaaaagatg

SEQ ID NO: 146670 - DNA, 103 bp, Artificial Sequence
  Synthetic Polynucleotide
taatacgactcactatagggggtttgtgcggttatgaggtagagtgagtgaacagaggagacactcaatgtacctcataaacctggcggcagcgcaaaagatg

SEQ ID NO: 146671 - DNA, 103 bp, Artificial Sequence
  Synthetic Polynucleotide
taatacgactcactatagggctgctggtcaggtttgtgcggttatgaggtaacagaggagaacctcaatgccgcacaaaaacctggcggcagcgcaaaagatg

SEQ ID NO: 146672 - DNA, 103 bp, Artificial Sequence
  Synthetic Polynucleotide
taatacgactcactatagggctcctctgcgctgctggtcaggtttgtgcgaacagaggagacgcacaatgctgaccagcaacctggcggcagcgcaaaagatg

SEQ ID NO: 146673 - DNA, 103 bp, Artificial Sequence
  Synthetic Polynucleotide
taatacgactcactatagggttttccacggctcctctgcgctgctggtcaaacagaggagatgaccaatggcgcagaggaacctggcggcagcgcaaaagatg

SEQ ID NO: 146674 - DNA, 103 bp, Artificial Sequence
  Synthetic Polynucleotide
taatacgactcactataggggatagttggtttttccacggctcctctgcgaacagaggagacgcagaatggccgtggaaaacctggcggcagcgcaaaagatg

SEQ ID NO: 146675 - DNA, 103 bp, Artificial Sequence
  Synthetic Polynucleotide
taatacgactcactatagggcttcgtcctggcgccatcttcatgaaatctaacagaggagaagatttatggaagatggcaacctggcggcagcgcaaaagatg

SEQ ID NO: 146676 - DNA, 103 bp, Artificial Sequence
  Synthetic Polynucleotide
taatacgactcactatagggagtggagttagatagttggtttttccacggaacagaggagaccgtggatgaaccaactaaacctggcggcagcgcaaaagatg

SEQ ID NO: 146677 - DNA, 103 bp, Artificial Sequence
  Synthetic Polynucleotide
taatacgactcactataggggaagcccctgagtggagttagatagttggtaacagaggagaaccaacatgctaactccaaacctggcggcagcgcaaaagatg

SEQ ID NO: 146678 - DNA, 103 bp, Artificial Sequence
  Synthetic Polynucleotide
taatacgactcactatagggtgacctttgtgaagcccctgagtggagttaaacagaggagataactcatgtcaggggctaacctggcggcagcgcaaaagatg

SEQ ID NO: 146679 - DNA, 103 bp, Artificial Sequence
  Synthetic Polynucleotide
taatacgactcactatagggatgtgaactctgacctttgtgaagcccctgaacagaggagacaggggatgcacaaaggtaacctggcggcagcgcaaaagatg

SEQ ID NO: 146680 - DNA, 103 bp, Artificial Sequence
  Synthetic Polynucleotide
taatacgactcactataggggacctgccgaatgtgaactctgacctttgtaacagaggagaacaaagatgagagttcacaacctggcggcagcgcaaaagatg

SEQ ID NO: 146681 - DNA, 103 bp, Artificial Sequence
  Synthetic Polynucleotide
taatacgactcactatagggtcaccattaggacctgccgaatgtgaactcaacagaggagagagttcatgttcggcaggaacctggcggcagcgcaaaagatg

SEQ ID NO: 146682 - DNA, 103 bp, Artificial Sequence
  Synthetic Polynucleotide
taatacgactcactataggggagaggtcgttcaccattaggacctgccgaaacagaggagatcggcaatgcctaatggtaacctggcggcagcgcaaaagatg

SEQ ID NO: 146683 - DNA, 103 bp, Artificial Sequence
  Synthetic Polynucleotide
taatacgactcactatagggcagtggaagagagaggtcgttcaccattagaacagaggagactaatgatgaacgacctcaacctggcggcagcgcaaaagatg

SEQ ID NO: 146684 - DNA, 103 bp, Artificial Sequence
  Synthetic Polynucleotide
taatacgactcactatagggtgggaaggcccagtggaagagagaggtcgtaacagaggagaacgaccatgctcttccacaacctggcggcagcgcaaaagatg

SEQ ID NO: 146685 - DNA, 103 bp, Artificial Sequence
  Synthetic Polynucleotide
taatacgactcactatagggctggagatgctgggaaggcccagtggaagaaacagaggagatcttccatggggccttccaacctggcggcagcgcaaaagatg

SEQ ID NO: 146686 - DNA, 103 bp, Artificial Sequence
  Synthetic Polynucleotide
taatacgactcactatagggcagcggcggcggtagcgagcgacactccgcaacagaggagagcggagatgcgctcgctaaacctggcggcagcgcaaaagatg

SEQ ID NO: 146687 - DNA, 103 bp, Artificial Sequence
  Synthetic Polynucleotide
taatacgactcactatagggccagtagggccttcgtcctggcgccatcttaacagaggagaaagatgatgccaggacgaaacctggcggcagcgcaaaagatg

SEQ ID NO: 146688 - DNA, 103 bp, Artificial Sequence
  Synthetic Polynucleotide
taatacgactcactatagggagccagctgcctggagatgctgggaaggccaacagaggagaggccttatgagcatctccaacctggcggcagcgcaaaagatg

SEQ ID NO: 146689 - DNA, 103 bp, Artificial Sequence
  Synthetic Polynucleotide
taatacgactcactatagggtgaataccagagccagctgcctggagatgcaacagaggagagcatctatgggcagctggaacctggcggcagcgcaaaagatg

SEQ ID NO: 146690 - DNA, 103 bp, Artificial Sequence
  Synthetic Polynucleotide
taatacgactcactataggggttctgattctgaataccagagccagctgcaacagaggagagcagctatgtctggtattaacctggcggcagcgcaaaagatg

SEQ ID NO: 146691 - DNA, 103 bp, Artificial Sequence
  Synthetic Polynucleotide
taatacgactcactatagggtgggatgtccgttctgattctgaataccagaacagaggagactggtaatgagaatcagaaacctggcggcagcgcaaaagatg

SEQ ID NO: 146692 - DNA, 103 bp, Artificial Sequence
  Synthetic Polynucleotide
taatacgactcactatagggctaggcagggtgggatgtccgttctgattcaacagaggagagaatcaatgcggacatccaacctggcggcagcgcaaaagatg

SEQ ID NO: 146693 - DNA, 103 bp, Artificial Sequence
  Synthetic Polynucleotide
taatacgactcactatagggtactgaattgctaggcagggtgggatgtccaacagaggagaggacatatgaccctgcctaacctggcggcagcgcaaaagatg

SEQ ID NO: 146694 - DNA, 103 bp, Artificial Sequence
  Synthetic Polynucleotide
taatacgactcactatagggccccctgtgttactgaattgctaggcagggaacagaggagaccctgcatggcaattcagaacctggcggcagcgcaaaagatg

SEQ ID NO: 146695 - DNA, 103 bp, Artificial Sequence
  Synthetic Polynucleotide
taatacgactcactatagggttgagagcagccccctgtgttactgaattgaacagaggagacaattcatgaacacagggaacctggcggcagcgcaaaagatg

SEQ ID NO: 146696 - DNA, 103 bp, Artificial Sequence
  Synthetic Polynucleotide
taatacgactcactatagggggagaggtgattgagagcagccccctgtgtaacagaggagaacacagatggctgctctcaacctggcggcagcgcaaaagatg

SEQ ID NO: 146697 - DNA, 103 bp, Artificial Sequence
  Synthetic Polynucleotide
taatacgactcactatagggcagtgtgagaggagaggtgattgagagcagaacagaggagactgctcatgatcacctctaacctggcggcagcgcaaaagatg

SEQ ID NO: 146698 - DNA, 103 bp, Artificial Sequence
  Synthetic Polynucleotide
taatacgactcactatagggacagccttgcccagtagggccttcgtcctgaacagaggagacaggacatgggccctactaacctggcggcagcgcaaaagatg

SEQ ID NO: 146699 - DNA, 103 bp, Artificial Sequence
  Synthetic Polynucleotide
taatacgactcactatagggcctgaggtagcagtgtgagaggagaggtgaaacagaggagatcacctatgctctcacacaacctggcggcagcgcaaaagatg

SEQ ID NO: 146700 - DNA, 103 bp, Artificial Sequence
  Synthetic Polynucleotide
taatacgactcactatagggttgttgtccacctgaggtagcagtgtgagaaacagaggagatctcacatggctacctcaaacctggcggcagcgcaaaagatg

SEQ ID NO: 146701 - DNA, 103 bp, Artificial Sequence
  Synthetic Polynucleotide
taatacgactcactatagggaggtaatgccttgttgtccacctgaggtagaacagaggagactacctatggtggacaacaacctggcggcagcgcaaaagatg

SEQ ID NO: 146702 - DNA, 103 bp, Artificial Sequence
  Synthetic Polynucleotide
taatacgactcactatagggtctttggttaaggtaatgccttgttgtccaaacagaggagatggacaatgaggcattacaacctggcggcagcgcaaaagatg

SEQ ID NO: 146703 - DNA, 103 bp, Artificial Sequence
  Synthetic Polynucleotide
taatacgactcactatagggaggcttgctctctttggttaaggtaatgccaacagaggagaggcattatgttaaccaaaaacctggcggcagcgcaaaagatg

SEQ ID NO: 146704 - DNA, 103 bp, Artificial Sequence
  Synthetic Polynucleotide
taatacgactcactatagggtgtttcctgaaggcttgctctctttggttaaacagaggagataaccaatgagagcaagcaacctggcggcagcgcaaaagatg

SEQ ID NO: 146705 - DNA, 103 bp, Artificial Sequence
  Synthetic Polynucleotide
taatacgactcactatagggaccgtcaatatgtttcctgaaggcttgctcaacagaggagagagcaaatgttcaggaaaaacctggcggcagcgcaaaagatg

SEQ ID NO: 146706 - DNA, 103 bp, Artificial Sequence
  Synthetic Polynucleotide
taatacgactcactatagggtgtttcaggcaccgtcaatatgtttcctgaaacagaggagatcaggaatgatattgacgaacctggcggcagcgcaaaagatg

SEQ ID NO: 146707 - DNA, 103 bp, Artificial Sequence
  Synthetic Polynucleotide
taatacgactcactatagggtgtgcctgcttgtttcaggcaccgtcaataaacagaggagatattgaatgtgcctgaaaaacctggcggcagcgcaaaagatg

SEQ ID NO: 146708 - DNA, 103 bp, Artificial Sequence
  Synthetic Polynucleotide
taatacgactcactataggggtctctccagtgtgcctgcttgtttcaggcaacagaggagagcctgaatgaagcaggcaaacctggcggcagcgcaaaagatg

SEQ ID NO: 146709 - DNA, 103 bp, Artificial Sequence
  Synthetic Polynucleotide
taatacgactcactatagggatagcagcgaacagccttgcccagtagggcaacagaggagagccctaatgggcaaggctaacctggcggcagcgcaaaagatg

SEQ ID NO: 146710 - DNA, 103 bp, Artificial Sequence
  Synthetic Polynucleotide
taatacgactcactataggggctgttaggtgtctctccagtgtgcctgctaacagaggagaagcaggatgactggagagaacctggcggcagcgcaaaagatg

SEQ ID NO: 146711 - DNA, 103 bp, Artificial Sequence
  Synthetic Polynucleotide
taatacgactcactatagggcactggcagtgctgttaggtgtctctccagaacagaggagactggagatgcacctaacaaacctggcggcagcgcaaaagatg

SEQ ID NO: 146712 - DNA, 103 bp, Artificial Sequence
  Synthetic Polynucleotide
taatacgactcactatagggagtccctcgacactggcagtgctgttaggtaacagaggagaacctaaatgcactgccagaacctggcggcagcgcaaaagatg

SEQ ID NO: 146713 - DNA, 103 bp, Artificial Sequence
  Synthetic Polynucleotide
taatacgactcactatagggatgattaggaagtccctcgacactggcagtaacagaggagaactgccatggtcgagggaaacctggcggcagcgcaaaagatg

SEQ ID NO: 146714 - DNA, 103 bp, Artificial Sequence
  Synthetic Polynucleotide
taatacgactcactatagggtctgatggacatgattaggaagtccctcgaaacagaggagatcgaggatgttcctaatcaacctggcggcagcgcaaaagatg

SEQ ID NO: 146715 - DNA, 103 bp, Artificial Sequence
  Synthetic Polynucleotide
taatacgactcactatagggtctgccgtcatctgatggacatgattaggaaacagaggagatcctaaatgtgtccatcaaacctggcggcagcgcaaaagatg

SEQ ID NO: 146716 - DNA, 103 bp, Artificial Sequence
  Synthetic Polynucleotide
taatacgactcactataggggcaaacagcatctgccgtcatctgatggacaacagaggagagtccatatgatgacggcaaacctggcggcagcgcaaaagatg

SEQ ID NO: 146717 - DNA, 103 bp, Artificial Sequence
  Synthetic Polynucleotide
taatacgactcactatagggggctaggactgcaaacagcatctgccgtcaaacagaggagatgacggatgatgctgtttaacctggcggcagcgcaaaagatg

SEQ ID NO: 146718 - DNA, 103 bp, Artificial Sequence
  Synthetic Polynucleotide
taatacgactcactataggggaatctccatggctaggactgcaaacagcaaacagaggagatgctgtatgcagtcctagaacctggcggcagcgcaaaagatg

SEQ ID NO: 146719 - DNA, 103 bp, Artificial Sequence
  Synthetic Polynucleotide
taatacgactcactatagggtggtgacttagaatctccatggctaggactaacagaggagaagtcctatgcatggagataacctggcggcagcgcaaaagatg

SEQ ID NO: 146720 - DNA, 103 bp, Artificial Sequence
  Synthetic Polynucleotide
taatacgactcactatagggttagagattcatagcagcgaacagccttgcaacagaggagagcaaggatgttcgctgctaacctggcggcagcgcaaaagatg

SEQ ID NO: 146721 - DNA, 103 bp, Artificial Sequence
  Synthetic Polynucleotide
taatacgactcactatagggttagtaaacctggtgacttagaatctccataacagaggagaatggagatgctaagtcacaacctggcggcagcgcaaaagatg

SEQ ID NO: 146722 - DNA, 103 bp, Artificial Sequence
  Synthetic Polynucleotide
taatacgactcactatagggttgtctgaacttagtaaacctggtgacttaaacagaggagataagtcatgaggtttactaacctggcggcagcgcaaaagatg

SEQ ID NO: 146723 - DNA, 103 bp, Artificial Sequence
  Synthetic Polynucleotide
taatacgactcactataggggagctgaggattgtctgaacttagtaaaccaacagaggagaggtttaatgagttcagacaacctggcggcagcgcaaaagatg

SEQ ID NO: 146724 - DNA, 103 bp, Artificial Sequence
  Synthetic Polynucleotide
taatacgactcactatagggacaaggcagagagctgaggattgtctgaacaacagaggagagttcagatgatcctcagcaacctggcggcagcgcaaaagatg

SEQ ID NO: 146725 - DNA, 103 bp, Artificial Sequence
  Synthetic Polynucleotide
taatacgactcactatagggtttcccatcaacaaggcagagagctgaggaaacagaggagatcctcaatgctctgccttaacctggcggcagcgcaaaagatg

SEQ ID NO: 146726 - DNA, 103 bp, Artificial Sequence
  Synthetic Polynucleotide
taatacgactcactataggggttattggcttttcccatcaacaaggcagaaacagaggagatctgccatgttgatgggaaacctggcggcagcgcaaaagatg

SEQ ID NO: 146727 - DNA, 103 bp, Artificial Sequence
  Synthetic Polynucleotide
taatacgactcactatagggtacccacattgttattggcttttcccatcaaacagaggagatgatggatgaagccaataaacctggcggcagcgcaaaagatg

SEQ ID NO: 146728 - DNA, 103 bp, Artificial Sequence
  Synthetic Polynucleotide
taatacgactcactatagggcaggttccagtacccacattgttattggctaacagaggagaagccaaatgcaatgtgggaacctggcggcagcgcaaaagatg

SEQ ID NO: 146729 - DNA, 103 bp, Artificial Sequence
  Synthetic Polynucleotide
taatacgactcactataggggactttgtcacaggttccagtacccacattaacagaggagaaatgtgatgactggaaccaacctggcggcagcgcaaaagatg

SEQ ID NO: 146730 - DNA, 103 bp, Artificial Sequence
  Synthetic Polynucleotide
taatacgactcactatagggggatgttattgactttgtcacaggttccagaacagaggagactggaaatggtgacaaagaacctggcggcagcgcaaaagatg

SEQ ID NO: 146731 - DNA, 103 bp, Artificial Sequence
  Synthetic Polynucleotide
taatacgactcactataggggcttttaagattagagattcatagcagcgaaacagaggagatcgctgatgtgaatctctaacctggcggcagcgcaaaagatg

SEQ ID NO: 146732 - DNA, 103 bp, Artificial Sequence
  Synthetic Polynucleotide
taatacgactcactatagggacagctgggtggatgttattgactttgtcaaacagaggagatgacaaatgcaataacataacctggcggcagcgcaaaagatg

SEQ ID NO: 146733 - DNA, 103 bp, Artificial Sequence
  Synthetic Polynucleotide
taatacgactcactatagggctttgtatgaacagctgggtggatgttattaacagaggagaaataacatgcacccagctaacctggcggcagcgcaaaagatg

SEQ ID NO: 146734 - DNA, 103 bp, Artificial Sequence
  Synthetic Polynucleotide
taatacgactcactatagggagttatcagtctttgtatgaacagctgggtaacagaggagaacccagatgttcatacaaaacctggcggcagcgcaaaagatg

SEQ ID NO: 146735 - DNA, 103 bp, Artificial Sequence
  Synthetic Polynucleotide
taatacgactcactataggggaggcaacagagttatcagtctttgtatgaaacagaggagatcatacatggactgataaaacctggcggcagcgcaaaagatg

SEQ ID NO: 146736 - DNA, 103 bp, Artificial Sequence
  Synthetic Polynucleotide
taatacgactcactatagggagatggtgaagaggcaacagagttatcagtaacagaggagaactgatatgtctgttgccaacctggcggcagcgcaaaagatg

SEQ ID NO: 146737 - DNA, 103 bp, Artificial Sequence
  Synthetic Polynucleotide
taatacgactcactatagggaaatggctgaagatggtgaagaggcaacagaacagaggagactgttgatgcttcaccataacctggcggcagcgcaaaagatg

SEQ ID NO: 146738 - DNA, 103 bp, Artificial Sequence
  Synthetic Polynucleotide
taatacgactcactataggggttgctgttgaaatggctgaagatggtgaaaacagaggagattcaccatgttcagccataacctggcggcagcgcaaaagatg

SEQ ID NO: 146739 - DNA, 103 bp, Artificial Sequence
  Synthetic Polynucleotide
taatacgactcactatagggtggagaaggtgttgctgttgaaatggctgaaacagaggagatcagccatgtcaacagcaaacctggcggcagcgcaaaagatg

SEQ ID NO: 146740 - DNA, 103 bp, Artificial Sequence
  Synthetic Polynucleotide
taatacgactcactatagggcagtggattttggagaaggtgttgctgttgaacagaggagacaacagatgcaccttctcaacctggcggcagcgcaaaagatg

SEQ ID NO: 146741 - DNA, 103 bp, Artificial Sequence
  Synthetic Polynucleotide
taatacgactcactataggggttgtctgctcagtggattttggagaaggtaacagaggagaaccttcatgaaaatccacaacctggcggcagcgcaaaagatg

SEQ ID NO: 146742 - DNA, 103 bp, Artificial Sequence
  Synthetic Polynucleotide
taatacgactcactatagggttttccttcagcttttaagattagagattcaacagaggagagaatctatgatcttaaaaaacctggcggcagcgcaaaagatg

SEQ ID NO: 146743 - DNA, 103 bp, Artificial Sequence
  Synthetic Polynucleotide
taatacgactcactatagggactgtttgtggttgtctgctcagtggatttaacagaggagaaaatccatggagcagacaaacctggcggcagcgcaaaagatg

SEQ ID NO: 146744 - DNA, 103 bp, Artificial Sequence
  Synthetic Polynucleotide
taatacgactcactatagggggctggtaacactgtttgtggttgtctgctaacagaggagaagcagaatgccacaaacaaacctggcggcagcgcaaaagatg

SEQ ID NO: 146745 - DNA, 103 bp, Artificial Sequence
  Synthetic Polynucleotide
taatacgactcactataggggggctgttaaggctggtaacactgtttgtgaacagaggagacacaaaatgtgttaccagaacctggcggcagcgcaaaagatg

SEQ ID NO: 146746 - DNA, 103 bp, Artificial Sequence
  Synthetic Polynucleotide
taatacgactcactatagggcccactgtgagggctgttaaggctggtaacaacagaggagagttaccatgcttaacagcaacctggcggcagcgcaaaagatg

SEQ ID NO: 146747 - DNA, 103 bp, Artificial Sequence
  Synthetic Polynucleotide
taatacgactcactatagggttgtgtgtagcccactgtgagggctgttaaaacagaggagattaacaatgctcacagtgaacctggcggcagcgcaaaagatg

SEQ ID NO: 146748 - DNA, 103 bp, Artificial Sequence
  Synthetic Polynucleotide
taatacgactcactatagggtctccattaattgtgtgtagcccactgtgaaacagaggagatcacagatggctacacacaacctggcggcagcgcaaaagatg

SEQ ID NO: 146749 - DNA, 103 bp, Artificial Sequence
  Synthetic Polynucleotide
taatacgactcactatagggttccatcccttctccattaattgtgtgtagaacagaggagactacacatgattaatggaaacctggcggcagcgcaaaagatg

SEQ ID NO: 146750 - DNA, 103 bp, Artificial Sequence
  Synthetic Polynucleotide
taatacgactcactatagggtctgagattcttccatcccttctccattaaaacagaggagattaatgatgaagggatggaacctggcggcagcgcaaaagatg

SEQ ID NO: 146751 - DNA, 103 bp, Artificial Sequence
  Synthetic Polynucleotide
taatacgactcactatagggttcatggggctctgagattcttccatccctaacagaggagaagggatatgagaatctcaaacctggcggcagcgcaaaagatg

SEQ ID NO: 146752 - DNA, 103 bp, Artificial Sequence
  Synthetic Polynucleotide
taatacgactcactatagggcagatctgttttcatggggctctgagattcaacagaggagagaatctatgagccccatgaacctggcggcagcgcaaaagatg

SEQ ID NO: 146753 - DNA, 103 bp, Artificial Sequence
  Synthetic Polynucleotide
taatacgactcactatagggcagactccacttttccttcagcttttaagaaacagaggagatcttaaatgctgaaggaaaacctggcggcagcgcaaaagatg

SEQ ID NO: 146754 - DNA, 103 bp, Artificial Sequence
  Synthetic Polynucleotide
taatacgactcactatagggtaaccagaagcagatctgttttcatggggcaacagaggagagccccaatgaaacagatcaacctggcggcagcgcaaaagatg

SEQ ID NO: 146755 - DNA, 103 bp, Artificial Sequence
  Synthetic Polynucleotide
taatacgactcactatagggggtttgtggttaaccagaagcagatctgttaacagaggagaaacagaatggcttctggtaacctggcggcagcgcaaaagatg

SEQ ID NO: 146756 - DNA, 103 bp, Artificial Sequence
  Synthetic Polynucleotide
taatacgactcactatagggctgtggactaggtttgtggttaaccagaagaacagaggagacttctgatgaaccacaaaaacctggcggcagcgcaaaagatg

SEQ ID NO: 146757 - DNA, 103 bp, Artificial Sequence
  Synthetic Polynucleotide
taatacgactcactatagggatggtatgatctgtggactaggtttgtggtaacagaggagaaccacaatgctagtccacaacctggcggcagcgcaaaagatg

SEQ ID NO: 146758 - DNA, 103 bp, Artificial Sequence
  Synthetic Polynucleotide
taatacgactcactatagggacagacattgatggtatgatctgtggactaaacagaggagatagtccatggatcataccaacctggcggcagcgcaaaagatg

SEQ ID NO: 146759 - DNA, 103 bp, Artificial Sequence
  Synthetic Polynucleotide
taatacgactcactataggggtatatggacacagacattgatggtatgataacagaggagaatcataatgtcaatgtctaacctggcggcagcgcaaaagatg

SEQ ID NO: 146760 - DNA, 103 bp, Artificial Sequence
  Synthetic Polynucleotide
taatacgactcactatagggctgagctggggtatatggacacagacattgaacagaggagacaatgtatgtgtccatataacctggcggcagcgcaaaagatg

SEQ ID NO: 146761 - DNA, 103 bp, Artificial Sequence
  Synthetic Polynucleotide
taatacgactcactatagggagaacttctgctgagctggggtatatggacaacagaggagagtccatatgccccagctcaacctggcggcagcgcaaaagatg

SEQ ID NO: 146762 - DNA, 103 bp, Artificial Sequence
  Synthetic Polynucleotide
taatacgactcactataggggcatgccttcagaacttctgctgagctgggaacagaggagacccagcatggcagaagttaacctggcggcagcgcaaaagatg

SEQ ID NO: 146763 - DNA, 103 bp, Artificial Sequence
  Synthetic Polynucleotide
taatacgactcactatagggctagattcctgcatgccttcagaacttctgaacagaggagacagaagatgtgaaggcataacctggcggcagcgcaaaagatg

SEQ ID NO: 146764 - DNA, 103 bp, Artificial Sequence
  Synthetic Polynucleotide
taatacgactcactatagggcaaaagaaatcagactccacttttccttcaaacagaggagatgaaggatgagtggagtcaacctggcggcagcgcaaaagatg

SEQ ID NO: 146765 - DNA, 103 bp, Artificial Sequence
  Synthetic Polynucleotide
taatacgactcactatagggccatttttacctagattcctgcatgccttcaacagaggagagaaggcatgcaggaatctaacctggcggcagcgcaaaagatg

SEQ ID NO: 146766 - DNA, 103 bp, Artificial Sequence
  Synthetic Polynucleotide
taatacgactcactataggggttagataagccatttttacctagattcctaacagaggagaaggaatatgggtaaaaataacctggcggcagcgcaaaagatg

SEQ ID NO: 146767 - DNA, 103 bp, Artificial Sequence
  Synthetic Polynucleotide
taatacgactcactatagggaaatgctactgttagataagccatttttacaacagaggagagtaaaaatggcttatctaaacctggcggcagcgcaaaagatg

SEQ ID NO: 146768 - DNA, 103 bp, Artificial Sequence
  Synthetic Polynucleotide
taatacgactcactatagggttatccaacaaaatgctactgttagataagaacagaggagacttatcatgcagtagcataacctggcggcagcgcaaaagatg

SEQ ID NO: 146769 - DNA, 103 bp, Artificial Sequence
  Synthetic Polynucleotide
taatacgactcactatagggaggtggacatttatccaacaaaatgctactaacagaggagaagtagcatgttgttggataacctggcggcagcgcaaaagatg

SEQ ID NO: 146770 - DNA, 103 bp, Artificial Sequence
  Synthetic Polynucleotide
taatacgactcactataggggtggtcttggaggtggacatttatccaacaaacagaggagatgttggatgaatgtccacaacctggcggcagcgcaaaagatg

SEQ ID NO: 146771 - DNA, 103 bp, Artificial Sequence
  Synthetic Polynucleotide
taatacgactcactatagggggtgaagatggtggtcttggaggtggacataacagaggagaatgtccatgtccaagaccaacctggcggcagcgcaaaagatg

SEQ ID NO: 146772 - DNA, 103 bp, Artificial Sequence
  Synthetic Polynucleotide
taatacgactcactataggggggagggtatggtgaagatggtggtcttggaacagaggagaccaagaatgccatcttcaaacctggcggcagcgcaaaagatg

SEQ ID NO: 146773 - DNA, 103 bp, Artificial Sequence
  Synthetic Polynucleotide
taatacgactcactatagggcctttggcaagggagggtatggtgaagatgaacagaggagacatcttatgcataccctcaacctggcggcagcgcaaaagatg

SEQ ID NO: 146774 - DNA, 103 bp, Artificial Sequence
  Synthetic Polynucleotide
taatacgactcactatagggttcaacttgtcctttggcaagggagggtataacagaggagaatacccatgcttgccaaaaacctggcggcagcgcaaaagatg

SEQ ID NO: 146775 - DNA, 103 bp, Artificial Sequence
  Synthetic Polynucleotide
taatacgactcactatagggacctaattgacaaaagaaatcagactccacaacagaggagagtggagatggatttctttaacctggcggcagcgcaaaagatg

SEQ ID NO: 146776 - DNA, 103 bp, Artificial Sequence
  Synthetic Polynucleotide
taatacgactcactatagggtgtaggtggattcaacttgtcctttggcaaaacagaggagattgccaatggacaagttgaacctggcggcagcgcaaaagatg

SEQ ID NO: 146777 - DNA, 103 bp, Artificial Sequence
  Synthetic Polynucleotide
taatacgactcactatagggaaatactaggtgtaggtggattcaacttgtaacagaggagaacaagtatgatccacctaaacctggcggcagcgcaaaagatg

SEQ ID NO: 146778 - DNA, 103 bp, Artificial Sequence
  Synthetic Polynucleotide
taatacgactcactatagggttttccaagtaaatactaggtgtaggtggaaacagaggagatccaccatgacctagtataacctggcggcagcgcaaaagatg

SEQ ID NO: 146779 - DNA, 103 bp, Artificial Sequence
  Synthetic Polynucleotide
taatacgactcactatagggatcacgtttattttccaagtaaatactaggaacagaggagacctagtatgtacttggaaaacctggcggcagcgcaaaagatg

SEQ ID NO: 146780 - DNA, 103 bp, Artificial Sequence
  Synthetic Polynucleotide
taatacgactcactataggggaaagaaagcatcacgtttattttccaagtaacagaggagaacttggatgataaacgtgaacctggcggcagcgcaaaagatg

SEQ ID NO: 146781 - DNA, 103 bp, Artificial Sequence
  Synthetic Polynucleotide
taatacgactcactatagggtgtaatggaggaaagaaagcatcacgtttaaacagaggagataaacgatgtgctttcttaacctggcggcagcgcaaaagatg

SEQ ID NO: 146782 - DNA, 103 bp, Artificial Sequence
  Synthetic Polynucleotide
taatacgactcactatagggacaaaattgatgtaatggaggaaagaaagcaacagaggagagctttcatgcctccattaaacctggcggcagcgcaaaagatg

SEQ ID NO: 146783 - DNA, 103 bp, Artificial Sequence
  Synthetic Polynucleotide
taatacgactcactatagggtcggatttgtacaaaattgatgtaatggagaacagaggagactccatatgatcaattttaacctggcggcagcgcaaaagatg

SEQ ID NO: 146784 - DNA, 103 bp, Artificial Sequence
  Synthetic Polynucleotide
taatacgactcactatagggacagggttgttcggatttgtacaaaattgaaacagaggagatcaattatgtacaaatccaacctggcggcagcgcaaaagatg

SEQ ID NO: 146785 - DNA, 103 bp, Artificial Sequence
  Synthetic Polynucleotide
taatacgactcactatagggtattactgtaacagggttgttcggatttgtaacagaggagaacaaatatgaacaaccctaacctggcggcagcgcaaaagatg

SEQ ID NO: 146786 - DNA, 103 bp, Artificial Sequence
  Synthetic Polynucleotide
taatacgactcactatagggggttgaagtgacctaattgacaaaagaaataacagaggagaatttctatggtcaattagaacctggcggcagcgcaaaagatg

SEQ ID NO: 146787 - DNA, 103 bp, Artificial Sequence
  Synthetic Polynucleotide
taatacgactcactatagggcaaggccacgtattactgtaacagggttgtaacagaggagaacaaccatgttacagtaaaacctggcggcagcgcaaaagatg

SEQ ID NO: 146788 - DNA, 103 bp, Artificial Sequence
  Synthetic Polynucleotide
taatacgactcactatagggagagctccagcaaggccacgtattactgtaaacagaggagatacagtatgacgtggcctaacctggcggcagcgcaaaagatg

SEQ ID NO: 146789 - DNA, 103 bp, Artificial Sequence
  Synthetic Polynucleotide
taatacgactcactataggggtctaacttaagagctccagcaaggccacgaacagaggagacgtggcatggctggagctaacctggcggcagcgcaaaagatg

SEQ ID NO: 146790 - DNA, 103 bp, Artificial Sequence
  Synthetic Polynucleotide
taatacgactcactatagggaaagtcccaggtctaacttaagagctccagaacagaggagactggagatgttaagttagaacctggcggcagcgcaaaagatg

SEQ ID NO: 146791 - DNA, 103 bp, Artificial Sequence
  Synthetic Polynucleotide
taatacgactcactatagggttagtagagaaaagtcccaggtctaacttaaacagaggagataagttatgcctgggactaacctggcggcagcgcaaaagatg

SEQ ID NO: 146792 - DNA, 103 bp, Artificial Sequence
  Synthetic Polynucleotide
taatacgactcactatagggcaccaaagttttagtagagaaaagtcccagaacagaggagactgggaatgttctctactaacctggcggcagcgcaaaagatg

SEQ ID NO: 146793 - DNA, 103 bp, Artificial Sequence
  Synthetic Polynucleotide
taatacgactcactatagggtgttagcttccaccaaagttttagtagagaaacagaggagatctctaatgaaactttggaacctggcggcagcgcaaaagatg

SEQ ID NO: 146794 - DNA, 103 bp, Artificial Sequence
  Synthetic Polynucleotide
taatacgactcactatagggatatgttcattgttagcttccaccaaagttaacagaggagaaactttatgggaagctaaaacctggcggcagcgcaaaagatg

SEQ ID NO: 146795 - DNA, 103 bp, Artificial Sequence
  Synthetic Polynucleotide
taatacgactcactatagggcacttctaccatatgttcattgttagcttcaacagaggagagaagctatgaatgaacataacctggcggcagcgcaaaagatg

SEQ ID NO: 146796 - DNA, 103 bp, Artificial Sequence
  Synthetic Polynucleotide
taatacgactcactatagggactgtgtcctcacttctaccatatgttcataacagaggagaatgaacatgtggtagaagaacctggcggcagcgcaaaagatg

SEQ ID NO: 146797 - DNA, 103 bp, Artificial Sequence
  Synthetic Polynucleotide
taatacgactcactataggggcggcggcggcagcggcggcggtagcgagcaacagaggagagctcgcatgcgccgccgcaacctggcggcagcgcaaaagatg

SEQ ID NO: 146798 - DNA, 103 bp, Artificial Sequence
  Synthetic Polynucleotide
taatacgactcactatagggtccaataagaggttgaagtgacctaattgaaacagaggagatcaattatgtcacttcaaaacctggcggcagcgcaaaagatg

SEQ ID NO: 146799 - DNA, 103 bp, Artificial Sequence
  Synthetic Polynucleotide
taatacgactcactatagggggctgcaacaactgtgtcctcacttctaccaacagaggagaggtagaatggaggacacaaacctggcggcagcgcaaaagatg

SEQ ID NO: 146800 - DNA, 103 bp, Artificial Sequence
  Synthetic Polynucleotide
taatacgactcactatagggttcatctgctggctgcaacaactgtgtcctaacagaggagaaggacaatgttgttgcagaacctggcggcagcgcaaaagatg

SEQ ID NO: 146801 - DNA, 103 bp, Artificial Sequence
  Synthetic Polynucleotide
taatacgactcactataggggatcccagttttcatctgctggctgcaacaaacagaggagatgttgcatgcagcagatgaacctggcggcagcgcaaaagatg

SEQ ID NO: 146802 - DNA, 103 bp, Artificial Sequence
  Synthetic Polynucleotide
taatacgactcactataggggttccagtgggatcccagttttcatctgctaacagaggagaagcagaatgaaactgggaaacctggcggcagcgcaaaagatg

SEQ ID NO: 146803 - DNA, 103 bp, Artificial Sequence
  Synthetic Polynucleotide
taatacgactcactataggggattttctttgttccagtgggatcccagttaacagaggagaaactggatgcccactggaaacctggcggcagcgcaaaagatg

SEQ ID NO: 146804 - DNA, 103 bp, Artificial Sequence
  Synthetic Polynucleotide
taatacgactcactatagggcacaatgccagattttctttgttccagtggaacagaggagaccactgatgcaaagaaaaaacctggcggcagcgcaaaagatg

SEQ ID NO: 146805 - DNA, 103 bp, Artificial Sequence
  Synthetic Polynucleotide
taatacgactcactatagggctattactttcacaatgccagattttctttaacagaggagaaaagaaatgctggcattgaacctggcggcagcgcaaaagatg

SEQ ID NO: 146806 - DNA, 103 bp, Artificial Sequence
  Synthetic Polynucleotide
taatacgactcactatagggagtatgagatctattactttcacaatgccaaacagaggagatggcatatggaaagtaataacctggcggcagcgcaaaagatg

SEQ ID NO: 146807 - DNA, 103 bp, Artificial Sequence
  Synthetic Polynucleotide
taatacgactcactatagggtagcaattgtagtatgagatctattactttaacagaggagaaaagtaatggatctcataaacctggcggcagcgcaaaagatg

SEQ ID NO: 146808 - DNA, 103 bp, Artificial Sequence
  Synthetic Polynucleotide
taatacgactcactatagggtgtgcatatttagcaattgtagtatgagataacagaggagaatctcaatgtacaattgcaacctggcggcagcgcaaaagatg

SEQ ID NO: 146809 - DNA, 103 bp, Artificial Sequence
  Synthetic Polynucleotide
taatacgactcactatagggtggataatcttccaataagaggttgaagtgaacagaggagacacttcatgctcttattgaacctggcggcagcgcaaaagatg

SEQ ID NO: 146810 - DNA, 103 bp, Artificial Sequence
  Synthetic Polynucleotide
taatacgactcactatagggggcctggtactgtgcatatttagcaattgtaacagaggagaacaattatgaaatatgcaaacctggcggcagcgcaaaagatg

SEQ ID NO: 146811 - DNA, 103 bp, Artificial Sequence
  Synthetic Polynucleotide
taatacgactcactatagggggaatgaggaggcctggtactgtgcatattaacagaggagaaatatgatgagtaccaggaacctggcggcagcgcaaaagatg

SEQ ID NO: 146812 - DNA, 103 bp, Artificial Sequence
  Synthetic Polynucleotide
taatacgactcactatagggaatgattcctggaatgaggaggcctggtacaacagaggagagtaccaatgctcctcattaacctggcggcagcgcaaaagatg

SEQ ID NO: 146813 - DNA, 103 bp, Artificial Sequence
  Synthetic Polynucleotide
taatacgactcactatagggttcttctctcaatgattcctggaatgaggaaacagaggagatcctcaatgcaggaatcaaacctggcggcagcgcaaaagatg

SEQ ID NO: 146814 - DNA, 103 bp, Artificial Sequence
  Synthetic Polynucleotide
taatacgactcactatagggttttttcattttcttctctcaatgattcctaacagaggagaaggaatatgtgagagaagaacctggcggcagcgcaaaagatg

SEQ ID NO: 146815 - DNA, 103 bp, Artificial Sequence
  Synthetic Polynucleotide
taatacgactcactatagggtgatgacttcttttttcattttcttctctcaacagaggagagagagaatgaaatgaaaaaacctggcggcagcgcaaaagatg

SEQ ID NO: 146816 - DNA, 103 bp, Artificial Sequence
  Synthetic Polynucleotide
taatacgactcactataggggtggtctttatgatgacttcttttttcattaacagaggagaaatgaaatgagaagtcataacctggcggcagcgcaaaagatg

SEQ ID NO: 146817 - DNA, 103 bp, Artificial Sequence
  Synthetic Polynucleotide
taatacgactcactatagggcactatctgagtggtctttatgatgacttcaacagaggagagaagtcatgataaagaccaacctggcggcagcgcaaaagatg

SEQ ID NO: 146818 - DNA, 103 bp, Artificial Sequence
  Synthetic Polynucleotide
taatacgactcactataggggatgtagattcactatctgagtggtctttaaacagaggagataaagaatgctcagatagaacctggcggcagcgcaaaagatg

SEQ ID NO: 146819 - DNA, 103 bp, Artificial Sequence
  Synthetic Polynucleotide
taatacgactcactatagggattatctgacgatgtagattcactatctgaaacagaggagatcagatatggaatctacaaacctggcggcagcgcaaaagatg

SEQ ID NO: 146820 - DNA, 103 bp, Artificial Sequence
  Synthetic Polynucleotide
taatacgactcactatagggataatgcttttggataatcttccaataagaaacagaggagatcttatatgaagattatcaacctggcggcagcgcaaaagatg

SEQ ID NO: 146821 - DNA, 103 bp, Artificial Sequence
  Synthetic Polynucleotide
taatacgactcactatagggtcctcccagaattatctgacgatgtagattaacagaggagaaatctaatgcgtcagataaacctggcggcagcgcaaaagatg

SEQ ID NO: 146822 - DNA, 103 bp, Artificial Sequence
  Synthetic Polynucleotide
taatacgactcactatagggcctttcctcctcctcccagaattatctgacaacagaggagagtcagaatgttctgggagaacctggcggcagcgcaaaagatg

SEQ ID NO: 146823 - DNA, 103 bp, Artificial Sequence
  Synthetic Polynucleotide
taatacgactcactatagggtttaaagggtcctttcctcctcctcccagaaacagaggagatctgggatgaggaggaaaaacctggcggcagcgcaaaagatg

SEQ ID NO: 146824 - DNA, 103 bp, Artificial Sequence
  Synthetic Polynucleotide
taatacgactcactatagggactttatggttttaaagggtcctttcctccaacagaggagaggaggaatggaccctttaaacctggcggcagcgcaaaagatg

SEQ ID NO: 146825 - DNA, 103 bp, Artificial Sequence
  Synthetic Polynucleotide
taatacgactcactatagggttggtcccaaactttatggttttaaagggtaacagaggagaacccttatgaaccataaaaacctggcggcagcgcaaaagatg

SEQ ID NO: 146826 - DNA, 103 bp, Artificial Sequence
  Synthetic Polynucleotide
taatacgactcactatagggtaggtcaatattggtcccaaactttatggtaacagaggagaaccataatgtttgggaccaacctggcggcagcgcaaaagatg

SEQ ID NO: 146827 - DNA, 103 bp, Artificial Sequence
  Synthetic Polynucleotide
taatacgactcactatagggtgtcatcagataggtcaatattggtcccaaaacagaggagattgggaatgatattgaccaacctggcggcagcgcaaaagatg

SEQ ID NO: 146828 - DNA, 103 bp, Artificial Sequence
  Synthetic Polynucleotide
taatacgactcactatagggttccactttttgtcatcagataggtcaataaacagaggagatattgaatgatctgatgaaacctggcggcagcgcaaaagatg

SEQ ID NO: 146829 - DNA, 103 bp, Artificial Sequence
  Synthetic Polynucleotide
taatacgactcactatagggtagctgcaacttccactttttgtcatcagaaacagaggagatctgatatgaaaaagtggaacctggcggcagcgcaaaagatg

SEQ ID NO: 146830 - DNA, 103 bp, Artificial Sequence
  Synthetic Polynucleotide
taatacgactcactatagggtcagctcatgtagctgcaacttccacttttaacagaggagaaaaagtatgagttgcagcaacctggcggcagcgcaaaagatg

SEQ ID NO: 146831 - DNA, 103 bp, Artificial Sequence
  Synthetic Polynucleotide
taatacgactcactatagggtggtatgcagataatgcttttggataatctaacagaggagaagattaatgaaaagcattaacctggcggcagcgcaaaagatg

SEQ ID NO: 146832 - DNA, 103 bp, Artificial Sequence
  Synthetic Polynucleotide
taatacgactcactatagggggaagtttagtcagctcatgtagctgcaacaacagaggagagttgcaatgacatgagctaacctggcggcagcgcaaaagatg

SEQ ID NO: 146833 - DNA, 103 bp, Artificial Sequence
  Synthetic Polynucleotide
taatacgactcactatagggcacaaaagcaggaagtttagtcagctcatgaacagaggagacatgagatgactaaacttaacctggcggcagcgcaaaagatg

SEQ ID NO: 146834 - DNA, 103 bp, Artificial Sequence
  Synthetic Polynucleotide
taatacgactcactatagggatacgacacgcacaaaagcaggaagtttagaacagaggagactaaacatgctgcttttgaacctggcggcagcgcaaaagatg

SEQ ID NO: 146835 - DNA, 103 bp, Artificial Sequence
  Synthetic Polynucleotide
taatacgactcactatagggtttcctgctgatacgacacgcacaaaagcaaacagaggagatgctttatggcgtgtcgtaacctggcggcagcgcaaaagatg

SEQ ID NO: 146836 - DNA, 103 bp, Artificial Sequence
  Synthetic Polynucleotide
taatacgactcactataggggcttagaagatttcctgctgatacgacacgaacagaggagacgtgtcatgtcagcaggaaacctggcggcagcgcaaaagatg

SEQ ID NO: 146837 - DNA, 103 bp, Artificial Sequence
  Synthetic Polynucleotide
taatacgactcactataggggaccaacatggcttagaagatttcctgctgaacagaggagacagcagatgatcttctaaaacctggcggcagcgcaaaagatg

SEQ ID NO: 146838 - DNA, 103 bp, Artificial Sequence
  Synthetic Polynucleotide
taatacgactcactatagggaatatggtatgaccaacatggcttagaagaaacagaggagatcttctatgccatgttggaacctggcggcagcgcaaaagatg

SEQ ID NO: 146839 - DNA, 103 bp, Artificial Sequence
  Synthetic Polynucleotide
taatacgactcactataggggttcatgcccaatatggtatgaccaacatgaacagaggagacatgttatgcataccataaacctggcggcagcgcaaaagatg

SEQ ID NO: 146840 - DNA, 103 bp, Artificial Sequence
  Synthetic Polynucleotide
taatacgactcactataggggttgaactgtgttcatgcccaatatggtataacagaggagaataccaatgtgggcatgaaacctggcggcagcgcaaaagatg

SEQ ID NO: 146841 - DNA, 103 bp, Artificial Sequence
  Synthetic Polynucleotide
taatacgactcactatagggttcatgtatagttgaactgtgttcatgcccaacagaggagagggcatatgcacagttcaaacctggcggcagcgcaaaagatg

SEQ ID NO: 146842 - DNA, 103 bp, Artificial Sequence
  Synthetic Polynucleotide
taatacgactcactataggggtagtacctctggtatgcagataatgctttaacagaggagaaaagcaatgtctgcatacaacctggcggcagcgcaaaagatg

SEQ ID NO: 146843 - DNA, 103 bp, Artificial Sequence
  Synthetic Polynucleotide
taatacgactcactatagggccctggaactttcatgtatagttgaactgtaacagaggagaacagttatgctatacatgaacctggcggcagcgcaaaagatg

SEQ ID NO: 146844 - DNA, 103 bp, Artificial Sequence
  Synthetic Polynucleotide
taatacgactcactataggggtgttctgctccctggaactttcatgtataaacagaggagatatacaatgaagttccagaacctggcggcagcgcaaaagatg

SEQ ID NO: 146845 - DNA, 103 bp, Artificial Sequence
  Synthetic Polynucleotide
taatacgactcactatagggtgatgacctggtgttctgctccctggaactaacagaggagaagttccatggagcagaacaacctggcggcagcgcaaaagatg

SEQ ID NO: 146846 - DNA, 103 bp, Artificial Sequence
  Synthetic Polynucleotide
taatacgactcactataggggttattttcctgatgacctggtgttctgctaacagaggagaagcagaatgccaggtcataacctggcggcagcgcaaaagatg

SEQ ID NO: 146847 - DNA, 103 bp, Artificial Sequence
  Synthetic Polynucleotide
taatacgactcactatagggaacagaagttgttattttcctgatgacctgaacagaggagacaggtcatgaggaaaataaacctggcggcagcgcaaaagatg

SEQ ID NO: 146848 - DNA, 103 bp, Artificial Sequence
  Synthetic Polynucleotide
taatacgactcactatagggatgttaactgaacagaagttgttattttccaacagaggagaggaaaaatgcaacttctgaacctggcggcagcgcaaaagatg

SEQ ID NO: 146849 - DNA, 103 bp, Artificial Sequence
  Synthetic Polynucleotide
taatacgactcactataggggccaatatttatgttaactgaacagaagttaacagaggagaaacttcatgtcagttaacaacctggcggcagcgcaaaagatg

SEQ ID NO: 146850 - DNA, 103 bp, Artificial Sequence
  Synthetic Polynucleotide
taatacgactcactatagggagtcacctgggccaatatttatgttaactgaacagaggagacagttaatgtaaatattgaacctggcggcagcgcaaaagatg

SEQ ID NO: 146851 - DNA, 103 bp, Artificial Sequence
  Synthetic Polynucleotide
taatacgactcactatagggaaccattcacagtcacctgggccaatatttaacagaggagaaaatatatgcccaggtgaaacctggcggcagcgcaaaagatg

SEQ ID NO: 146852 - DNA, 103 bp, Artificial Sequence
  Synthetic Polynucleotide
taatacgactcactatagggaggaacaacaaaccattcacagtcacctggaacagaggagaccaggtatgtgtgaatggaacctggcggcagcgcaaaagatg

SEQ ID NO: 146853 - DNA, 103 bp, Artificial Sequence
  Synthetic Polynucleotide
taatacgactcactatagggactgtaaactgtagtacctctggtatgcagaacagaggagactgcatatgagaggtactaacctggcggcagcgcaaaagatg

SEQ ID NO: 146854 - DNA, 103 bp, Artificial Sequence
  Synthetic Polynucleotide
taatacgactcactatagggagtaaccttcaggaacaacaaaccattcacaacagaggagagtgaatatgttgttgttcaacctggcggcagcgcaaaagatg

SEQ ID NO: 146855 - DNA, 103 bp, Artificial Sequence
  Synthetic Polynucleotide
taatacgactcactatagggagaacaccccagtaaccttcaggaacaacaaacagaggagatgttgtatgtgaaggttaaacctggcggcagcgcaaaagatg

SEQ ID NO: 146856 - DNA, 103 bp, Artificial Sequence
  Synthetic Polynucleotide
taatacgactcactataggggaagtcattcagaacaccccagtaaccttcaacagaggagagaaggtatgtggggtgttaacctggcggcagcgcaaaagatg

SEQ ID NO: 146857 - DNA, 103 bp, Artificial Sequence
  Synthetic Polynucleotide
taatacgactcactatagggttttttcacagaagtcattcagaacaccccaacagaggagaggggtgatgtgaatgactaacctggcggcagcgcaaaagatg

SEQ ID NO: 146858 - DNA, 103 bp, Artificial Sequence
  Synthetic Polynucleotide
taatacgactcactatagggttcaaattatttttttcacagaagtcattcaacagaggagagaatgaatgctgtgaaaaaacctggcggcagcgcaaaagatg

SEQ ID NO: 146859 - DNA, 103 bp, Artificial Sequence
  Synthetic Polynucleotide
taatacgactcactatagggcattaggaaattcaaattatttttttcacaaacagaggagatgtgaaatgaataatttgaacctggcggcagcgcaaaagatg

SEQ ID NO: 146860 - DNA, 103 bp, Artificial Sequence
  Synthetic Polynucleotide
taatacgactcactatagggaccaagaacccattaggaaattcaaattataacagaggagaataattatgatttcctaaaacctggcggcagcgcaaaagatg

SEQ ID NO: 146861 - DNA, 103 bp, Artificial Sequence
  Synthetic Polynucleotide
taatacgactcactatagggagattgggccaccaagaacccattaggaaaaacagaggagatttcctatggggttcttgaacctggcggcagcgcaaaagatg

SEQ ID NO: 146862 - DNA, 103 bp, Artificial Sequence
  Synthetic Polynucleotide
taatacgactcactatagggaagatcttcaagattgggccaccaagaaccaacagaggagaggttctatgtggcccaataacctggcggcagcgcaaaagatg

SEQ ID NO: 146863 - DNA, 103 bp, Artificial Sequence
  Synthetic Polynucleotide
taatacgactcactatagggttgcttcataaagatcttcaagattgggccaacagaggagaggcccaatgttgaagatcaacctggcggcagcgcaaaagatg

SEQ ID NO: 146864 - DNA, 103 bp, Artificial Sequence
  Synthetic Polynucleotide
taatacgactcactatagggcagtagtcagactgtaaactgtagtacctcaacagaggagagaggtaatgcagtttacaaacctggcggcagcgcaaaagatg

SEQ ID NO: 146865 - DNA, 103 bp, Artificial Sequence
  Synthetic Polynucleotide
taatacgactcactatagggactggaacatttgcttcataaagatcttcaaacagaggagatgaagaatgttatgaagcaacctggcggcagcgcaaaagatg

SEQ ID NO: 146866 - DNA, 103 bp, Artificial Sequence
  Synthetic Polynucleotide
taatacgactcactatagggaaacctatacactggaacatttgcttcataaacagaggagatatgaaatgaatgttccaaacctggcggcagcgcaaaagatg

SEQ ID NO: 146867 - DNA, 103 bp, Artificial Sequence
  Synthetic Polynucleotide
taatacgactcactataggggtcgctgaataaacctatacactggaacataacagaggagaatgttcatgtgtataggtaacctggcggcagcgcaaaagatg

SEQ ID NO: 146868 - DNA, 103 bp, Artificial Sequence
  Synthetic Polynucleotide
taatacgactcactatagggaaatctccaggtcgctgaataaacctatacaacagaggagagtatagatgtattcagcgaacctggcggcagcgcaaaagatg

SEQ ID NO: 146869 - DNA, 103 bp, Artificial Sequence
  Synthetic Polynucleotide
taatacgactcactatagggtatccagaccaaatctccaggtcgctgaataacagaggagaattcagatgcctggagataacctggcggcagcgcaaaagatg

SEQ ID NO: 146870 - DNA, 103 bp, Artificial Sequence
  Synthetic Polynucleotide
taatacgactcactatagggtgcctgcatttatccagaccaaatctccagaacagaggagactggagatgtggtctggaaacctggcggcagcgcaaaagatg

SEQ ID NO: 146871 - DNA, 103 bp, Artificial Sequence
  Synthetic Polynucleotide
taatacgactcactatagggcaatgaacagtgcctgcatttatccagaccaacagaggagaggtctgatgaaatgcaggaacctggcggcagcgcaaaagatg

SEQ ID NO: 146872 - DNA, 103 bp, Artificial Sequence
  Synthetic Polynucleotide
taatacgactcactatagggagcctgaacccaatgaacagtgcctgcattaacagaggagaaatgcaatgactgttcataacctggcggcagcgcaaaagatg

SEQ ID NO: 146873 - DNA, 103 bp, Artificial Sequence
  Synthetic Polynucleotide
taatacgactcactatagggaccagccaatagcctgaacccaatgaacagaacagaggagactgttcatggggttcaggaacctggcggcagcgcaaaagatg

SEQ ID NO: 146874 - DNA, 103 bp, Artificial Sequence
  Synthetic Polynucleotide
taatacgactcactatagggatgttgttgcaccagccaatagcctgaaccaacagaggagaggttcaatgtattggctgaacctggcggcagcgcaaaagatg

SEQ ID NO: 146875 - DNA, 103 bp, Artificial Sequence
  Synthetic Polynucleotide
taatacgactcactatagggagcattcttccagtagtcagactgtaaactaacagaggagaagtttaatgtctgactacaacctggcggcagcgcaaaagatg

SEQ ID NO: 146876 - DNA, 103 bp, Artificial Sequence
  Synthetic Polynucleotide
taatacgactcactatagggattccaagcaatgttgttgcaccagccaataacagaggagaattggcatgtgcaacaacaacctggcggcagcgcaaaagatg

SEQ ID NO: 146877 - DNA, 103 bp, Artificial Sequence
  Synthetic Polynucleotide
taatacgactcactataggggtggaccaacattccaagcaatgttgttgcaacagaggagagcaacaatgttgcttggaaacctggcggcagcgcaaaagatg

SEQ ID NO: 146878 - DNA, 103 bp, Artificial Sequence
  Synthetic Polynucleotide
taatacgactcactatagggcaggctgtaagtggaccaacattccaagcaaacagaggagatgcttgatgtgttggtccaacctggcggcagcgcaaaagatg

SEQ ID NO: 146879 - DNA, 103 bp, Artificial Sequence
  Synthetic Polynucleotide
taatacgactcactatagggtttatactggcaggctgtaagtggaccaacaacagaggagagttggtatgcttacagccaacctggcggcagcgcaaaagatg

SEQ ID NO: 146880 - DNA, 103 bp, Artificial Sequence
  Synthetic Polynucleotide
taatacgactcactatagggccactgccaatttatactggcaggctgtaaaacagaggagattacagatggccagtataaacctggcggcagcgcaaaagatg

SEQ ID NO: 146881 - DNA, 103 bp, Artificial Sequence
  Synthetic Polynucleotide
taatacgactcactatagggtcgtaccgttccactgccaatttatactggaacagaggagaccagtaatgattggcagtaacctggcggcagcgcaaaagatg

SEQ ID NO: 146882 - DNA, 103 bp, Artificial Sequence
  Synthetic Polynucleotide
taatacgactcactatagggtttgttccattcgtaccgttccactgccaaaacagaggagattggcaatggaacggtacaacctggcggcagcgcaaaagatg

SEQ ID NO: 146883 - DNA, 103 bp, Artificial Sequence
  Synthetic Polynucleotide
taatacgactcactatagggcactttgcaatttgttccattcgtaccgttaacagaggagaaacggtatgaatggaacaaacctggcggcagcgcaaaagatg

SEQ ID NO: 146884 - DNA, 103 bp, Artificial Sequence
  Synthetic Polynucleotide
taatacgactcactatagggattgacttcacactttgcaatttgttccataacagaggagaatggaaatgattgcaaagaacctggcggcagcgcaaaagatg

SEQ ID NO: 146885 - DNA, 103 bp, Artificial Sequence
  Synthetic Polynucleotide
taatacgactcactatagggcatgggtactattgacttcacactttgcaaaacagaggagattgcaaatggtgaagtcaaacctggcggcagcgcaaaagatg

SEQ ID NO: 146886 - DNA, 103 bp, Artificial Sequence
  Synthetic Polynucleotide
taatacgactcactatagggataaaaaggcagcattcttccagtagtcagaacagaggagactgactatgggaagaatgaacctggcggcagcgcaaaagatg

SEQ ID NO: 146887 - DNA, 103 bp, Artificial Sequence
  Synthetic Polynucleotide
taatacgactcactatagggaaagatgaaccatgggtactattgacttcaaacagaggagatgaagtatgtagtacccaaacctggcggcagcgcaaaagatg

SEQ ID NO: 146888 - DNA, 103 bp, Artificial Sequence
  Synthetic Polynucleotide
taatacgactcactatagggatattccaggaaagatgaaccatgggtactaacagaggagaagtaccatgggttcatctaacctggcggcagcgcaaaagatg

SEQ ID NO: 146889 - DNA, 103 bp, Artificial Sequence
  Synthetic Polynucleotide
taatacgactcactatagggatttcgtgccatattccaggaaagatgaacaacagaggagagttcatatgtcctggaataacctggcggcagcgcaaaagatg

SEQ ID NO: 146890 - DNA, 103 bp, Artificial Sequence
  Synthetic Polynucleotide
taatacgactcactatagggagaccttgatatttcgtgccatattccaggaacagaggagacctggaatgtggcacgaaaacctggcggcagcgcaaaagatg

SEQ ID NO: 146891 - DNA, 103 bp, Artificial Sequence
  Synthetic Polynucleotide
taatacgactcactatagggtttggatctgagaccttgatatttcgtgccaacagaggagaggcacgatgtatcaaggtaacctggcggcagcgcaaaagatg

SEQ ID NO: 146892 - DNA, 103 bp, Artificial Sequence
  Synthetic Polynucleotide
taatacgactcactatagggttcaaaaagctttggatctgagaccttgataacagaggagaatcaagatgtcagatccaaacctggcggcagcgcaaaagatg

SEQ ID NO: 146893 - DNA, 103 bp, Artificial Sequence
  Synthetic Polynucleotide
taatacgactcactatagggacttaatcatttcaaaaagctttggatctgaacagaggagacagatcatgagctttttgaacctggcggcagcgcaaaagatg

SEQ ID NO: 146894 - DNA, 103 bp, Artificial Sequence
  Synthetic Polynucleotide
taatacgactcactatagggagaagacaatacttaatcatttcaaaaagcaacagaggagagcttttatgaatgattaaaacctggcggcagcgcaaaagatg

SEQ ID NO: 146895 - DNA, 103 bp, Artificial Sequence
  Synthetic Polynucleotide
taatacgactcactatagggcagagttcttagaagacaatacttaatcataacagaggagaatgattatgtattgtcttaacctggcggcagcgcaaaagatg

SEQ ID NO: 146896 - DNA, 103 bp, Artificial Sequence
  Synthetic Polynucleotide
taatacgactcactataggggacattgcttcagagttcttagaagacaataacagaggagaattgtcatgtaagaactcaacctggcggcagcgcaaaagatg

SEQ ID NO: 146897 - DNA, 103 bp, Artificial Sequence
  Synthetic Polynucleotide
taatacgactcactatagggccaagaccatataaaaaggcagcattcttcaacagaggagagaagaaatgtgcctttttaacctggcggcagcgcaaaagatg

SEQ ID NO: 146898 - DNA, 103 bp, Artificial Sequence
  Synthetic Polynucleotide
taatacgactcactatagggctcaatgtctgacattgcttcagagttcttaacagaggagaaagaacatggaagcaatgaacctggcggcagcgcaaaagatg

SEQ ID NO: 146899 - DNA, 103 bp, Artificial Sequence
  Synthetic Polynucleotide
taatacgactcactataggggagagcttccctcaatgtctgacattgcttaacagaggagaaagcaaatgcagacattgaacctggcggcagcgcaaaagatg

SEQ ID NO: 146900 - DNA, 103 bp, Artificial Sequence
  Synthetic Polynucleotide
taatacgactcactatagggctgcagcaatgagagcttccctcaatgtctaacagaggagaagacatatggggaagctcaacctggcggcagcgcaaaagatg

SEQ ID NO: 146901 - DNA, 103 bp, Artificial Sequence
  Synthetic Polynucleotide
taatacgactcactatagggatctcttttcctgcagcaatgagagcttccaacagaggagaggaagcatgcattgctgcaacctggcggcagcgcaaaagatg

SEQ ID NO: 146902 - DNA, 103 bp, Artificial Sequence
  Synthetic Polynucleotide
taatacgactcactatagggatgccatataatctcttttcctgcagcaataacagaggagaattgctatgggaaaagagaacctggcggcagcgcaaaagatg

SEQ ID NO: 146903 - DNA, 103 bp, Artificial Sequence
  Synthetic Polynucleotide
taatacgactcactatagggttgtccgcccatgccatataatctcttttcaacagaggagagaaaagatgttatatggcaacctggcggcagcgcaaaagatg

SEQ ID NO: 146904 - DNA, 103 bp, Artificial Sequence
  Synthetic Polynucleotide
taatacgactcactatagggggttcttcttttgtccgcccatgccatataaacagaggagatatatgatgtgggcggacaacctggcggcagcgcaaaagatg

SEQ ID NO: 146905 - DNA, 103 bp, Artificial Sequence
  Synthetic Polynucleotide
taatacgactcactataggggtaatgagctggttcttcttttgtccgcccaacagaggagagggcggatgaaagaagaaaacctggcggcagcgcaaaagatg

SEQ ID NO: 146906 - DNA, 103 bp, Artificial Sequence
  Synthetic Polynucleotide
taatacgactcactatagggaaatgctacagtaatgagctggttcttcttaacagaggagaaagaagatgcagctcattaacctggcggcagcgcaaaagatg

SEQ ID NO: 146907 - DNA, 103 bp, Artificial Sequence
  Synthetic Polynucleotide
taatacgactcactatagggtccacttcacaaatgctacagtaatgagctaacagaggagaagctcaatgctgtagcataacctggcggcagcgcaaaagatg

SEQ ID NO: 146908 - DNA, 103 bp, Artificial Sequence
  Synthetic Polynucleotide
taatacgactcactatagggatcaccgaaagcggcggcggcagcggcggcaacagaggagagccgccatggccgccgccaacctggcggcagcgcaaaagatg

SEQ ID NO: 146909 - DNA, 103 bp, Artificial Sequence
  Synthetic Polynucleotide
taatacgactcactataggggtagaccaaaccaagaccatataaaaaggcaacagaggagagcctttatgtatggtcttaacctggcggcagcgcaaaagatg

SEQ ID NO: 146910 - DNA, 103 bp, Artificial Sequence
  Synthetic Polynucleotide
taatacgactcactatagggatcaaaaacctccacttcacaaatgctacaaacagaggagatgtagcatgtgtgaagtgaacctggcggcagcgcaaaagatg

SEQ ID NO: 146911 - DNA, 103 bp, Artificial Sequence
  Synthetic Polynucleotide
taatacgactcactatagggcaaaaagcagatcaaaaacctccacttcacaacagaggagagtgaagatgaggtttttgaacctggcggcagcgcaaaagatg

SEQ ID NO: 146912 - DNA, 103 bp, Artificial Sequence
  Synthetic Polynucleotide
taatacgactcactatagggtcattagtgacaaaaagcagatcaaaaaccaacagaggagaggttttatgtctgcttttaacctggcggcagcgcaaaagatg

SEQ ID NO: 146913 - DNA, 103 bp, Artificial Sequence
  Synthetic Polynucleotide
taatacgactcactatagggtgaattactctcattagtgacaaaaagcagaacagaggagactgcttatggtcactaataacctggcggcagcgcaaaagatg

SEQ ID NO: 146914 - DNA, 103 bp, Artificial Sequence
  Synthetic Polynucleotide
taatacgactcactatagggaggtctttcgtgaattactctcattagtgaaacagaggagatcactaatgagagtaattaacctggcggcagcgcaaaagatg

SEQ ID NO: 146915 - DNA, 103 bp, Artificial Sequence
  Synthetic Polynucleotide
taatacgactcactatagggtgtactatgtaggtctttcgtgaattactcaacagaggagagagtaaatgacgaaagacaacctggcggcagcgcaaaagatg

SEQ ID NO: 146916 - DNA, 103 bp, Artificial Sequence
  Synthetic Polynucleotide
taatacgactcactatagggatcttggcaatgtactatgtaggtctttcgaacagaggagacgaaagatgtacatagtaaacctggcggcagcgcaaaagatg

SEQ ID NO: 146917 - DNA, 103 bp, Artificial Sequence
  Synthetic Polynucleotide
taatacgactcactatagggttcgtgcacaatcttggcaatgtactatgtaacagaggagaacatagatgattgccaagaacctggcggcagcgcaaaagatg

SEQ ID NO: 146918 - DNA, 103 bp, Artificial Sequence
  Synthetic Polynucleotide
taatacgactcactatagggccgcttgtttttcgtgcacaatcttggcaaaacagaggagattgccaatgttgtgcacgaacctggcggcagcgcaaaagatg

SEQ ID NO: 146919 - DNA, 103 bp, Artificial Sequence
  Synthetic Polynucleotide
taatacgactcactatagggttccaagtttccgcttgtttttcgtgcacaaacagaggagatgtgcaatgaaaacaagcaacctggcggcagcgcaaaagatg

SEQ ID NO: 146920 - DNA, 103 bp, Artificial Sequence
  Synthetic Polynucleotide
taatacgactcactatagggtataatggaagtagaccaaaccaagaccataacagaggagaatggtcatggtttggtctaacctggcggcagcgcaaaagatg

SEQ ID NO: 146921 - DNA, 103 bp, Artificial Sequence
  Synthetic Polynucleotide
taatacgactcactatagggccacaaagttttccaagtttccgcttgtttaacagaggagaaaacaaatggaaacttggaacctggcggcagcgcaaaagatg

SEQ ID NO: 146922 - DNA, 103 bp, Artificial Sequence
  Synthetic Polynucleotide
taatacgactcactatagggtgttctagcaccacaaagttttccaagtttaacagaggagaaaacttatgaaactttgtaacctggcggcagcgcaaaagatg

SEQ ID NO: 146923 - DNA, 103 bp, Artificial Sequence
  Synthetic Polynucleotide
taatacgactcactatagggcattttgtactgttctagcaccacaaagttaacagaggagaaactttatggtgctagaaaacctggcggcagcgcaaaagatg

SEQ ID NO: 146924 - DNA, 103 bp, Artificial Sequence
  Synthetic Polynucleotide
taatacgactcactatagggtcaggtcctccattttgtactgttctagcaaacagaggagatgctagatgagtacaaaaaacctggcggcagcgcaaaagatg

SEQ ID NO: 146925 - DNA, 103 bp, Artificial Sequence
  Synthetic Polynucleotide
taatacgactcactatagggtagacttgcatcaggtcctccattttgtacaacagaggagagtacaaatgggaggacctaacctggcggcagcgcaaaagatg

SEQ ID NO: 146926 - DNA, 103 bp, Artificial Sequence
  Synthetic Polynucleotide
taatacgactcactatagggaaattggtcatagacttgcatcaggtcctcaacagaggagagaggacatgatgcaagtcaacctggcggcagcgcaaaagatg

SEQ ID NO: 146927 - DNA, 103 bp, Artificial Sequence
  Synthetic Polynucleotide
taatacgactcactataggggagctaatgtaaattggtcatagacttgcaaacagaggagatgcaagatgatgaccaataacctggcggcagcgcaaaagatg

SEQ ID NO: 146928 - DNA, 103 bp, Artificial Sequence
  Synthetic Polynucleotide
taatacgactcactatagggggtaatggaggagctaatgtaaattggtcaaacagaggagatgaccaatgtacattagcaacctggcggcagcgcaaaagatg

SEQ ID NO: 146929 - DNA, 103 bp, Artificial Sequence
  Synthetic Polynucleotide
taatacgactcactatagggtgaggcggatggtaatggaggagctaatgtaacagaggagaacattaatgcctccattaaacctggcggcagcgcaaaagatg

SEQ ID NO: 146930 - DNA, 103 bp, Artificial Sequence
  Synthetic Polynucleotide
taatacgactcactatagggtgaaatgcattataatggaagtagaccaaaaacagaggagatttggtatgcttccattaaacctggcggcagcgcaaaagatg

SEQ ID NO: 146931 - DNA, 103 bp, Artificial Sequence
  Synthetic Polynucleotide
taatacgactcactatagggaattgcccactgaaatgcattataatggaaaacagaggagattccatatgaatgcatttaacctggcggcagcgcaaaagatg

SEQ ID NO: 146932 - DNA, 103 bp, Artificial Sequence
  Synthetic Polynucleotide
taatacgactcactataggggaaatgctttaattgcccactgaaatgcataacagaggagaatgcatatgagtgggcaaaacctggcggcagcgcaaaagatg

SEQ ID NO: 146933 - DNA, 103 bp, Artificial Sequence
  Synthetic Polynucleotide
taatacgactcactatagggagcacctcctgaaatgctttaattgcccacaacagaggagagtgggcatgtaaagcattaacctggcggcagcgcaaaagatg

SEQ ID NO: 146934 - DNA, 103 bp, Artificial Sequence
  Synthetic Polynucleotide
taatacgactcactatagggatcaacataaagcacctcctgaaatgctttaacagaggagaaaagcaatgcaggaggtgaacctggcggcagcgcaaaagatg

SEQ ID NO: 146935 - DNA, 103 bp, Artificial Sequence
  Synthetic Polynucleotide
taatacgactcactatagggaaaagctgggatcaacataaagcacctcctaacagaggagaaggaggatgtttatgttgaacctggcggcagcgcaaaagatg

SEQ ID NO: 146936 - DNA, 103 bp, Artificial Sequence
  Synthetic Polynucleotide
taatacgactcactatagggttggctcgacaaaagctgggatcaacataaaacagaggagattatgtatgtcccagcttaacctggcggcagcgcaaaagatg

SEQ ID NO: 146937 - DNA, 103 bp, Artificial Sequence
  Synthetic Polynucleotide
taatacgactcactatagggatgaatttccttggctcgacaaaagctgggaacagaggagacccagcatgtgtcgagccaacctggcggcagcgcaaaagatg

SEQ ID NO: 146938 - DNA, 103 bp, Artificial Sequence
  Synthetic Polynucleotide
taatacgactcactatagggtcttttcctcatcaccgaaagcggcggcggaacagaggagaccgccgatgctttcggtgaacctggcggcagcgcaaaagatg

SEQ ID NO: 146939 - DNA, 103 bp, Artificial Sequence
  Synthetic Polynucleotide
taatacgactcactatagggcaagtcgtaaatgaatttccttggctcgacaacagaggagagtcgagatgaggaaattcaacctggcggcagcgcaaaagatg

SEQ ID NO: 146940 - DNA, 103 bp, Artificial Sequence
  Synthetic Polynucleotide
taatacgactcactatagggaacataagcccaagtcgtaaatgaatttccaacagaggagaggaaatatgtttacgactaacctggcggcagcgcaaaagatg

SEQ ID NO: 146941 - DNA, 103 bp, Artificial Sequence
  Synthetic Polynucleotide
taatacgactcactataggggttcactttgaacataagcccaagtcgtaaaacagaggagattacgaatggggcttatgaacctggcggcagcgcaaaagatg

SEQ ID NO: 146942 - DNA, 103 bp, Artificial Sequence
  Synthetic Polynucleotide
taatacgactcactatagggcatagtctgtgttcactttgaacataagccaacagaggagaggcttaatgtcaaagtgaaacctggcggcagcgcaaaagatg

SEQ ID NO: 146943 - DNA, 103 bp, Artificial Sequence
  Synthetic Polynucleotide
taatacgactcactatagggaaactagactcatagtctgtgttcactttgaacagaggagacaaagtatgcacagactaaacctggcggcagcgcaaaagatg

SEQ ID NO: 146944 - DNA, 103 bp, Artificial Sequence
  Synthetic Polynucleotide
taatacgactcactatagggaaaatgctttaaactagactcatagtctgtaacagaggagaacagacatggagtctagtaacctggcggcagcgcaaaagatg

SEQ ID NO: 146945 - DNA, 103 bp, Artificial Sequence
  Synthetic Polynucleotide
taatacgactcactatagggaagctaactgaaaatgctttaaactagactaacagaggagaagtctaatgtaaagcattaacctggcggcagcgcaaaagatg

SEQ ID NO: 146946 - DNA, 103 bp, Artificial Sequence
  Synthetic Polynucleotide
taatacgactcactatagggcagtcaaccaaagctaactgaaaatgctttaacagaggagaaaagcaatgtcagttagcaacctggcggcagcgcaaaagatg

SEQ ID NO: 146947 - DNA, 103 bp, Artificial Sequence
  Synthetic Polynucleotide
taatacgactcactataggggcagggattacagtcaaccaaagctaactgaacagaggagacagttaatgttggttgacaacctggcggcagcgcaaaagatg

SEQ ID NO: 146948 - DNA, 103 bp, Artificial Sequence
  Synthetic Polynucleotide
taatacgactcactatagggtggacaaagtgcagggattacagtcaaccaaacagaggagatggttgatggtaatccctaacctggcggcagcgcaaaagatg

SEQ ID NO: 146949 - DNA, 103 bp, Artificial Sequence
  Synthetic Polynucleotide
taatacgactcactataggggccgccattttcttttcctcatcaccgaaaaacagaggagatttcggatgtgaggaaaaaacctggcggcagcgcaaaagatg

SEQ ID NO: 146950 - DNA, 103 bp, Artificial Sequence
  Synthetic Polynucleotide
taatacgactcactatagggatttcagcattggacaaagtgcagggattaaacagaggagataatccatgcactttgtcaacctggcggcagcgcaaaagatg

SEQ ID NO: 146951 - DNA, 103 bp, Artificial Sequence
  Synthetic Polynucleotide
taatacgactcactataggggtgaaattgaatttcagcattggacaaagtaacagaggagaactttgatgaatgctgaaaacctggcggcagcgcaaaagatg

SEQ ID NO: 146952 - DNA, 103 bp, Artificial Sequence
  Synthetic Polynucleotide
taatacgactcactatagggagtgggcaatgtgaaattgaatttcagcataacagaggagaatgctgatgttcaatttcaacctggcggcagcgcaaaagatg

SEQ ID NO: 146953 - DNA, 103 bp, Artificial Sequence
  Synthetic Polynucleotide
taatacgactcactataggggtttcatataagtgggcaatgtgaaattgaaacagaggagatcaattatgcattgcccaaacctggcggcagcgcaaaagatg

SEQ ID NO: 146954 - DNA, 103 bp, Artificial Sequence
  Synthetic Polynucleotide
taatacgactcactatagggtttcctctgggtttcatataagtgggcaataacagaggagaattgccatgttatatgaaaacctggcggcagcgcaaaagatg

SEQ ID NO: 146955 - DNA, 103 bp, Artificial Sequence
  Synthetic Polynucleotide
taatacgactcactatagggcagaatgatatttcctctgggtttcatataaacagaggagatatatgatgcccagaggaaacctggcggcagcgcaaaagatg

SEQ ID NO: 146956 - DNA, 103 bp, Artificial Sequence
  Synthetic Polynucleotide
taatacgactcactataggggcttcttttgcagaatgatatttcctctggaacagaggagaccagagatgatatcattcaacctggcggcagcgcaaaagatg

SEQ ID NO: 146957 - DNA, 103 bp, Artificial Sequence
  Synthetic Polynucleotide
taatacgactcactatagggttgttcataagcttcttttgcagaatgataaacagaggagatatcatatggcaaaagaaaacctggcggcagcgcaaaagatg

SEQ ID NO: 146958 - DNA, 103 bp, Artificial Sequence
  Synthetic Polynucleotide
taatacgactcactatagggtctgcaaaagttgttcataagcttcttttgaacagaggagacaaaagatgcttatgaacaacctggcggcagcgcaaaagatg

SEQ ID NO: 146959 - DNA, 103 bp, Artificial Sequence
  Synthetic Polynucleotide
taatacgactcactatagggagattctctgtctgcaaaagttgttcataaaacagaggagattatgaatgacttttgcaaacctggcggcagcgcaaaagatg

SEQ ID NO: 146960 - DNA, 103 bp, Artificial Sequence
  Synthetic Polynucleotide
taatacgactcactatagggcgcttttcccgccgccattttcttttcctcaacagaggagagaggaaatgaaaatggcgaacctggcggcagcgcaaaagatg

SEQ ID NO: 146961 - DNA, 103 bp, Artificial Sequence
  Synthetic Polynucleotide
taatacgactcactatagggttgtgcagaaagattctctgtctgcaaaagaacagaggagacttttgatgacagagaataacctggcggcagcgcaaaagatg

SEQ ID NO: 146962 - DNA, 103 bp, Artificial Sequence
  Synthetic Polynucleotide
taatacgactcactatagggttgcttttacttgtgcagaaagattctctgaacagaggagacagagaatgtttctgcacaacctggcggcagcgcaaaagatg

SEQ ID NO: 146963 - DNA, 103 bp, Artificial Sequence
  Synthetic Polynucleotide
taatacgactcactatagggtgtaagacagttgcttttacttgtgcagaaaacagaggagattctgcatgagtaaaagcaacctggcggcagcgcaaaagatg

SEQ ID NO: 146964 - DNA, 103 bp, Artificial Sequence
  Synthetic Polynucleotide
taatacgactcactatagggacctaactgttgtaagacagttgcttttacaacagaggagagtaaaaatgactgtcttaaacctggcggcagcgcaaaagatg

SEQ ID NO: 146965 - DNA, 103 bp, Artificial Sequence
  Synthetic Polynucleotide
taatacgactcactataggggatgcatccaacctaactgttgtaagacagaacagaggagactgtctatgaacagttagaacctggcggcagcgcaaaagatg

SEQ ID NO: 146966 - DNA, 103 bp, Artificial Sequence
  Synthetic Polynucleotide
taatacgactcactatagggtctacagtgtgatgcatccaacctaactgtaacagaggagaacagttatgttggatgcaaacctggcggcagcgcaaaagatg

SEQ ID NO: 146967 - DNA, 103 bp, Artificial Sequence
  Synthetic Polynucleotide
taatacgactcactatagggtcccaggagatctacagtgtgatgcatccaaacagaggagatggatgatgcacactgtaaacctggcggcagcgcaaaagatg

SEQ ID NO: 146968 - DNA, 103 bp, Artificial Sequence
  Synthetic Polynucleotide
taatacgactcactatagggtggctttatctcccaggagatctacagtgtaacagaggagaacactgatgatctcctggaacctggcggcagcgcaaaagatg

SEQ ID NO: 146969 - DNA, 103 bp, Artificial Sequence
  Synthetic Polynucleotide
taatacgactcactatagggctttccttggtggctttatctcccaggagaaacagaggagatctcctatgagataaagcaacctggcggcagcgcaaaagatg

SEQ ID NO: 146970 - DNA, 103 bp, Artificial Sequence
  Synthetic Polynucleotide
taatacgactcactatagggaatagcatagctttccttggtggctttatcaacagaggagagataaaatgaccaaggaaaacctggcggcagcgcaaaagatg

SEQ ID NO: 146971 - DNA, 103 bp, Artificial Sequence
  Synthetic Polynucleotide
taatacgactcactatagggtctcgccgctcgcttttcccgccgccatttaacagaggagaaaatggatgcgggaaaagaacctggcggcagcgcaaaagatg

SEQ ID NO: 146972 - DNA, 103 bp, Artificial Sequence
  Synthetic Polynucleotide
taatacgactcactatagggggagatactgaatagcatagctttccttggaacagaggagaccaaggatggctatgctaaacctggcggcagcgcaaaagatg

SEQ ID NO: 146973 - DNA, 103 bp, Artificial Sequence
  Synthetic Polynucleotide
taatacgactcactatagggaaggacttttggagatactgaatagcatagaacagaggagactatgcatgtcagtatctaacctggcggcagcgcaaaagatg

SEQ ID NO: 146974 - DNA, 103 bp, Artificial Sequence
  Synthetic Polynucleotide
taatacgactcactatagggatctgcttccaaggacttttggagatactgaacagaggagacagtatatgcaaaagtccaacctggcggcagcgcaaaagatg

SEQ ID NO: 146975 - DNA, 103 bp, Artificial Sequence
  Synthetic Polynucleotide
taatacgactcactatagggcagaattaggatctgcttccaaggacttttaacagaggagaaaaagtatgtggaagcagaacctggcggcagcgcaaaagatg

SEQ ID NO: 146976 - DNA, 103 bp, Artificial Sequence
  Synthetic Polynucleotide
taatacgactcactatagggcaggactggccagaattaggatctgcttccaacagaggagaggaagcatgtcctaattcaacctggcggcagcgcaaaagatg

SEQ ID NO: 146977 - DNA, 103 bp, Artificial Sequence
  Synthetic Polynucleotide
taatacgactcactataggggaggaaataccaggactggccagaattaggaacagaggagacctaatatgggccagtccaacctggcggcagcgcaaaagatg

SEQ ID NO: 146978 - DNA, 103 bp, Artificial Sequence
  Synthetic Polynucleotide
taatacgactcactatagggagcaccttccgaggaaataccaggactggcaacagaggagagccagtatgggtatttccaacctggcggcagcgcaaaagatg

SEQ ID NO: 146979 - DNA, 103 bp, Artificial Sequence
  Synthetic Polynucleotide
taatacgactcactatagggatacttgaatagcaccttccgaggaaatacaacagaggagagtatttatgcggaaggtgaacctggcggcagcgcaaaagatg

SEQ ID NO: 146980 - DNA, 103 bp, Artificial Sequence
  Synthetic Polynucleotide
taatacgactcactatagggaactttcccaatacttgaatagcaccttccaacagaggagaggaaggatgtattcaagtaacctggcggcagcgcaaaagatg

SEQ ID NO: 146981 - DNA, 103 bp, Artificial Sequence
  Synthetic Polynucleotide
taatacgactcactatagggaggcatcctgaactttcccaatacttgaataacagaggagaattcaaatgttgggaaagaacctggcggcagcgcaaaagatg

SEQ ID NO: 146982 - DNA, 103 bp, Artificial Sequence
  Synthetic Polynucleotide
taatacgactcactataggggcctcctcgctctcgccgctcgcttttcccaacagaggagagggaaaatggagcggcgaaacctggcggcagcgcaaaagatg

SEQ ID NO: 146983 - DNA, 103 bp, Artificial Sequence
  Synthetic Polynucleotide
taatacgactcactatagggtaagatataaaggcatcctgaactttcccaaacagaggagatgggaaatgtcaggatgcaacctggcggcagcgcaaaagatg

SEQ ID NO: 146984 - DNA, 103 bp, Artificial Sequence
  Synthetic Polynucleotide
taatacgactcactatagggagactgcctgtaagatataaaggcatcctgaacagaggagacaggatatgtttatatctaacctggcggcagcgcaaaagatg

SEQ ID NO: 146985 - DNA, 103 bp, Artificial Sequence
  Synthetic Polynucleotide
taatacgactcactatagggatttatcaatagactgcctgtaagatataaaacagaggagattatatatgacaggcagtaacctggcggcagcgcaaaagatg

SEQ ID NO: 146986 - DNA, 103 bp, Artificial Sequence
  Synthetic Polynucleotide
taatacgactcactatagggcttgcttctgatttatcaatagactgcctgaacagaggagacaggcaatgtattgataaaacctggcggcagcgcaaaagatg

SEQ ID NO: 146987 - DNA, 103 bp, Artificial Sequence
  Synthetic Polynucleotide
taatacgactcactatagggtgtatctgcacttgcttctgatttatcaataacagaggagaattgatatgtcagaagcaaacctggcggcagcgcaaaagatg

SEQ ID NO: 146988 - DNA, 103 bp, Artificial Sequence
  Synthetic Polynucleotide
taatacgactcactatagggttgaacaccatgtatctgcacttgcttctgaacagaggagacagaagatggtgcagataaacctggcggcagcgcaaaagatg

SEQ ID NO: 146989 - DNA, 103 bp, Artificial Sequence
  Synthetic Polynucleotide
taatacgactcactatagggagcacacctattgaacaccatgtatctgcaaacagaggagatgcagaatgatggtgttcaacctggcggcagcgcaaaagatg

SEQ ID NO: 146990 - DNA, 103 bp, Artificial Sequence
  Synthetic Polynucleotide
taatacgactcactatagggctgctgatatagcacacctattgaacaccaaacagaggagatggtgtatgataggtgtgaacctggcggcagcgcaaaagatg

SEQ ID NO: 146991 - DNA, 103 bp, Artificial Sequence
  Synthetic Polynucleotide
taatacgactcactataggggctgattttgctgctgatatagcacacctaaacagaggagataggtgatgtatatcagcaacctggcggcagcgcaaaagatg

SEQ ID NO: 146992 - DNA, 103 bp, Artificial Sequence
  Synthetic Polynucleotide
taatacgactcactataggggcatccatgggctgattttgctgctgatataacagaggagaatatcaatggcaaaatcaaacctggcggcagcgcaaaagatg

SEQ ID NO: 146993 - DNA, 103 bp, Artificial Sequence
  Synthetic Polynucleotide
taatacgactcactatagggggcccctggagggtccactgcccgatgcataacagaggagaatgcatatggcagtggacaacctggcggcagcgcaaaagatg

SEQ ID NO: 146994 - DNA, 103 bp, Artificial Sequence
  Synthetic Polynucleotide
taatacgactcactatagggtgcgctacgaggagggggatgaggcgggcaaacagaggagatgcccgatgcatccccctaacctggcggcagcgcaaaagatg

SEQ ID NO: 146995 - DNA, 103 bp, Artificial Sequence
  Synthetic Polynucleotide
taatacgactcactataggggcgggggcctgggcctgggggagcagccggaacagaggagaccggctatgcccccaggcaacctggcggcagcgcaaaagatg

SEQ ID NO: 146996 - DNA, 103 bp, Artificial Sequence
  Synthetic Polynucleotide
taatacgactcactatagggctcctggggggcgggggcctgggcctggggaacagaggagaccccagatgcaggcccccaacctggcggcagcgcaaaagatg

SEQ ID NO: 146997 - DNA, 103 bp, Artificial Sequence
  Synthetic Polynucleotide
taatacgactcactatagggtggctctctgctcctggggggcgggggcctaacagaggagaaggcccatgccccccaggaacctggcggcagcgcaaaagatg

SEQ ID NO: 146998 - DNA, 103 bp, Artificial Sequence
  Synthetic Polynucleotide
taatacgactcactatagggcaggcagccatggctctctgctcctgggggaacagaggagacccccaatggcagagagcaacctggcggcagcgcaaaagatg

SEQ ID NO: 146999 - DNA, 103 bp, Artificial Sequence
  Synthetic Polynucleotide
taatacgactcactataggggggtggcaggcaggcagccatggctctctgaacagaggagacagagaatgatggctgccaacctggcggcagcgcaaaagatg

SEQ ID NO: 147000 - DNA, 103 bp, Artificial Sequence
  Synthetic Polynucleotide
taatacgactcactatagggccggggggacgggtggcaggcaggcagccaaacagaggagatggctgatggcctgccacaacctggcggcagcgcaaaagatg

SEQ ID NO: 147001 - DNA, 103 bp, Artificial Sequence
  Synthetic Polynucleotide
taatacgactcactatagggaaggtcacttccggggggacgggtggcaggaacagaggagacctgccatgcgtccccccaacctggcggcagcgcaaaagatg

SEQ ID NO: 147002 - DNA, 103 bp, Artificial Sequence
  Synthetic Polynucleotide
taatacgactcactatagggtgctctctctaaggtcacttccggggggacaacagaggagagtccccatggaagtgaccaacctggcggcagcgcaaaagatg

SEQ ID NO: 147003 - DNA, 103 bp, Artificial Sequence
  Synthetic Polynucleotide
taatacgactcactatagggctctgaactctgctctctctaaggtcacttaacagaggagaaagtgaatgtagagagagaacctggcggcagcgcaaaagatg

SEQ ID NO: 147004 - DNA, 103 bp, Artificial Sequence
  Synthetic Polynucleotide
taatacgactcactatagggcatccgcgacctctgaactctgctctctctaacagaggagaagagagatgagagttcagaacctggcggcagcgcaaaagatg

SEQ ID NO: 147005 - DNA, 103 bp, Artificial Sequence
  Synthetic Polynucleotide
taatacgactcactatagggcaggcagccatgcgctacgaggagggggataacagaggagaatccccatgctcgtagcgaacctggcggcagcgcaaaagatg

SEQ ID NO: 147006 - DNA, 103 bp, Artificial Sequence
  Synthetic Polynucleotide
taatacgactcactatagggcgctggagtccatccgcgacctctgaactcaacagaggagagagttcatgggtcgcggaaacctggcggcagcgcaaaagatg

SEQ ID NO: 147007 - DNA, 103 bp, Artificial Sequence
  Synthetic Polynucleotide
taatacgactcactataggggctggtgaaacgctggagtccatccgcgacaacagaggagagtcgcgatgggactccagaacctggcggcagcgcaaaagatg

SEQ ID NO: 147008 - DNA, 103 bp, Artificial Sequence
  Synthetic Polynucleotide
taatacgactcactatagggggtggttgctgctggtgaaacgctggagtcaacagaggagagactccatggtttcaccaaacctggcggcagcgcaaaagatg

SEQ ID NO: 147009 - DNA, 103 bp, Artificial Sequence
  Synthetic Polynucleotide
taatacgactcactataggggcacgcaggcggtggttgctgctggtgaaaaacagaggagatttcacatgcagcaaccaaacctggcggcagcgcaaaagatg

SEQ ID NO: 147010 - DNA, 103 bp, Artificial Sequence
  Synthetic Polynucleotide
taatacgactcactatagggggggcgtaaggcacgcaggcggtggttgctaacagaggagaagcaacatgcgcctgcgtaacctggcggcagcgcaaaagatg

SEQ ID NO: 147011 - DNA, 103 bp, Artificial Sequence
  Synthetic Polynucleotide
taatacgactcactataggggggccgggaaggggcgtaaggcacgcaggcaacagaggagagcctgcatgccttacgccaacctggcggcagcgcaaaagatg

SEQ ID NO: 147012 - DNA, 103 bp, Artificial Sequence
  Synthetic Polynucleotide
taatacgactcactatagggggaggccagggggccgggaaggggcgtaagaacagaggagacttacgatgcttcccggcaacctggcggcagcgcaaaagatg

SEQ ID NO: 147013 - DNA, 103 bp, Artificial Sequence
  Synthetic Polynucleotide
taatacgactcactataggggtggtgccggggaggccagggggccgggaaaacagaggagattcccgatgccctggcctaacctggcggcagcgcaaaagatg

SEQ ID NO: 147014 - DNA, 103 bp, Artificial Sequence
  Synthetic Polynucleotide
taatacgactcactataggggctgctggtggtggtgccggggaggccaggaacagaggagacctggcatgcccggcaccaacctggcggcagcgcaaaagatg

SEQ ID NO: 147015 - DNA, 103 bp, Artificial Sequence
  Synthetic Polynucleotide
taatacgactcactatagggtgctactgctgctgctggtggtggtgccggaacagaggagaccggcaatgccaccagcaaacctggcggcagcgcaaaagatg

SEQ ID NO: 147016 - DNA, 103 bp, Artificial Sequence
  Synthetic Polynucleotide
taatacgactcactatagggcatctgcctccaggcagccatgcgctacgaaacagaggagatcgtagatgatggctgccaacctggcggcagcgcaaaagatg

SEQ ID NO: 147017 - DNA, 103 bp, Artificial Sequence
  Synthetic Polynucleotide
taatacgactcactatagggttgctgctgctgctactgctgctgctggtgaacagaggagacaccagatgcagcagtagaacctggcggcagcgcaaaagatg

SEQ ID NO: 147018 - DNA, 103 bp, Artificial Sequence
  Synthetic Polynucleotide
taatacgactcactataggggagaccagtgttgctgctgctgctactgctaacagaggagaagcagtatgagcagcagcaacctggcggcagcgcaaaagatg

SEQ ID NO: 147019 - DNA, 103 bp, Artificial Sequence
  Synthetic Polynucleotide
taatacgactcactatagggccacgccccggagaccagtgttgctgctgcaacagaggagagcagcaatgacactggtcaacctggcggcagcgcaaaagatg

SEQ ID NO: 147020 - DNA, 103 bp, Artificial Sequence
  Synthetic Polynucleotide
taatacgactcactataggggggttcggctccacgccccggagaccagtgaacagaggagacactggatgccggggcgtaacctggcggcagcgcaaaagatg

SEQ ID NO: 147021 - DNA, 103 bp, Artificial Sequence
  Synthetic Polynucleotide
taatacgactcactataggggggaatgcctgggttcggctccacgccccgaacagaggagacggggcatggagccgaacaacctggcggcagcgcaaaagatg

SEQ ID NO: 147022 - DNA, 103 bp, Artificial Sequence
  Synthetic Polynucleotide
taatacgactcactatagggggtcagcgccgggaatgcctgggttcggctaacagaggagaagccgaatgcaggcattcaacctggcggcagcgcaaaagatg

SEQ ID NO: 147023 - DNA, 103 bp, Artificial Sequence
  Synthetic Polynucleotide
taatacgactcactataggggtttggtaatggtcagcgccgggaatgcctaacagaggagaaggcatatgcggcgctgaaacctggcggcagcgcaaaagatg

SEQ ID NO: 147024 - DNA, 103 bp, Artificial Sequence
  Synthetic Polynucleotide
taatacgactcactatagggcagcgcgggagtttggtaatggtcagcgccaacagaggagaggcgctatgcattaccaaaacctggcggcagcgcaaaagatg

SEQ ID NO: 147025 - DNA, 103 bp, Artificial Sequence
  Synthetic Polynucleotide
taatacgactcactataggggagagacctccagcgcgggagtttggtaataacagaggagaattaccatgctcccgcgcaacctggcggcagcgcaaaagatg

SEQ ID NO: 147026 - DNA, 103 bp, Artificial Sequence
  Synthetic Polynucleotide
taatacgactcactatagggcggccatggtgagagacctccagcgcgggaaacagaggagatcccgcatgggaggtctcaacctggcggcagcgcaaaagatg

SEQ ID NO: 147027 - DNA, 103 bp, Artificial Sequence
  Synthetic Polynucleotide
taatacgactcactataggggctggctgagcatctgcctccaggcagccaaacagaggagatggctgatgggaggcagaaacctggcggcagcgcaaaagatg

SEQ ID NO: 147028 - DNA, 103 bp, Artificial Sequence
  Synthetic Polynucleotide
taatacgactcactataggggggccccaggcggccatggtgagagacctcaacagaggagagaggtcatgcaccatggcaacctggcggcagcgcaaaagatg

SEQ ID NO: 147029 - DNA, 103 bp, Artificial Sequence
  Synthetic Polynucleotide
taatacgactcactatagggtgtgtgccgagggccccaggcggccatggtaacagaggagaaccatgatggcctggggcaacctggcggcagcgcaaaagatg

SEQ ID NO: 147030 - DNA, 103 bp, Artificial Sequence
  Synthetic Polynucleotide
taatacgactcactatagggttccgactgctgtgtgccgagggccccaggaacagaggagacctgggatgctcggcacaaacctggcggcagcgcaaaagatg

SEQ ID NO: 147031 - DNA, 103 bp, Artificial Sequence
  Synthetic Polynucleotide
taatacgactcactatagggcaagaacggtttccgactgctgtgtgccgaaacagaggagatcggcaatgagcagtcggaacctggcggcagcgcaaaagatg

SEQ ID NO: 147032 - DNA, 103 bp, Artificial Sequence
  Synthetic Polynucleotide
taatacgactcactatagggcgggagcccccaagaacggtttccgactgcaacagaggagagcagtcatgaaccgttctaacctggcggcagcgcaaaagatg

SEQ ID NO: 147033 - DNA, 103 bp, Artificial Sequence
  Synthetic Polynucleotide
taatacgactcactatagggggagtggcagcgggagcccccaagaacggtaacagaggagaaccgttatggggggctccaacctggcggcagcgcaaaagatg

SEQ ID NO: 147034 - DNA, 103 bp, Artificial Sequence
  Synthetic Polynucleotide
taatacgactcactatagggggataggtggggagtggcagcgggagccccaacagaggagaggggctatggctgccactaacctggcggcagcgcaaaagatg

SEQ ID NO: 147035 - DNA, 103 bp, Artificial Sequence
  Synthetic Polynucleotide
taatacgactcactatagggcaggtggcagggataggtggggagtggcagaacagaggagactgccaatgcccacctataacctggcggcagcgcaaaagatg

SEQ ID NO: 147036 - DNA, 103 bp, Artificial Sequence
  Synthetic Polynucleotide
taatacgactcactataggggaggaaggtccaggtggcagggataggtggaacagaggagaccacctatgcctgccaccaacctggcggcagcgcaaaagatg

SEQ ID NO: 147037 - DNA, 103 bp, Artificial Sequence
  Synthetic Polynucleotide
taatacgactcactatagggtggagggggtgaggaaggtccaggtggcagaacagaggagactgccaatgggaccttccaacctggcggcagcgcaaaagatg

SEQ ID NO: 147038 - DNA, 103 bp, Artificial Sequence
  Synthetic Polynucleotide
taatacgactcactataggggctgcccaatgctggctgagcatctgcctcaacagaggagagaggcaatggctcagccaaacctggcggcagcgcaaaagatg

SEQ ID NO: 147039 - DNA, 103 bp, Artificial Sequence
  Synthetic Polynucleotide
taatacgactcactataggggacaggggggtggagggggtgaggaaggtcaacagaggagagaccttatgcaccccctcaacctggcggcagcgcaaaagatg

SEQ ID NO: 147040 - DNA, 103 bp, Artificial Sequence
  Synthetic Polynucleotide
taatacgactcactatagggaagaggcggggacaggggggtggagggggtaacagaggagaacccccatgacccccctgaacctggcggcagcgcaaaagatg

SEQ ID NO: 147041 - DNA, 103 bp, Artificial Sequence
  Synthetic Polynucleotide
taatacgactcactatagggtggggggcgtaagaggcggggacaggggggaacagaggagaccccccatgccccgcctcaacctggcggcagcgcaaaagatg

SEQ ID NO: 147042 - DNA, 103 bp, Artificial Sequence
  Synthetic Polynucleotide
taatacgactcactatagggcagggggtggtggggggcgtaagaggcgggaacagaggagacccgccatgtacgcccccaacctggcggcagcgcaaaagatg

SEQ ID NO: 147043 - DNA, 103 bp, Artificial Sequence
  Synthetic Polynucleotide
taatacgactcactatagggttcaaccaggcagggggtggtggggggcgtaacagaggagaacgcccatgaccacccccaacctggcggcagcgcaaaagatg

SEQ ID NO: 147044 - DNA, 103 bp, Artificial Sequence
  Synthetic Polynucleotide
taatacgactcactatagggggccggacccttcaaccaggcagggggtggaacagaggagaccacccatggcctggttgaacctggcggcagcgcaaaagatg

SEQ ID NO: 147045 - DNA, 103 bp, Artificial Sequence
  Synthetic Polynucleotide
taatacgactcactatagggctgcccggcaggccggacccttcaaccaggaacagaggagacctggtatgagggtccggaacctggcggcagcgcaaaagatg

SEQ ID NO: 147046 - DNA, 103 bp, Artificial Sequence
  Synthetic Polynucleotide
taatacgactcactatagggtcctctcgggctgcccggcaggccggacccaacagaggagagggtccatgctgccgggcaacctggcggcagcgcaaaagatg

SEQ ID NO: 147047 - DNA, 103 bp, Artificial Sequence
  Synthetic Polynucleotide
taatacgactcactataggggatctctccatcctctcgggctgcccggcaaacagaggagatgccggatggcccgagagaacctggcggcagcgcaaaagatg

SEQ ID NO: 147048 - DNA, 103 bp, Artificial Sequence
  Synthetic Polynucleotide
taatacgactcactataggggctcttctaagatctctccatcctctcgggaacagaggagacccgagatgatggagagaaacctggcggcagcgcaaaagatg

SEQ ID NO: 147049 - DNA, 103 bp, Artificial Sequence
  Synthetic Polynucleotide
taatacgactcactatagggggaagcgggggctgcccaatgctggctgagaacagaggagactcagcatgcattgggcaaacctggcggcagcgcaaaagatg

SEQ ID NO: 147050 - DNA, 103 bp, Artificial Sequence
  Synthetic Polynucleotide
taatacgactcactatagggccaaagaagagctcttctaagatctctccaaacagaggagatggagaatgcttagaagaaacctggcggcagcgcaaaagatg

SEQ ID NO: 147051 - DNA, 103 bp, Artificial Sequence
  Synthetic Polynucleotide
taatacgactcactatagggtccctcagtcccaaagaagagctcttctaaaacagaggagattagaaatgctcttctttaacctggcggcagcgcaaaagatg

SEQ ID NO: 147052 - DNA, 103 bp, Artificial Sequence
  Synthetic Polynucleotide
taatacgactcactatagggggcgggggggtccctcagtcccaaagaagaaacagaggagatcttctatgggactgaggaacctggcggcagcgcaaaagatg

SEQ ID NO: 147053 - DNA, 103 bp, Artificial Sequence
  Synthetic Polynucleotide
taatacgactcactatagggggtggggcagggcgggggggtccctcagtcaacagaggagagactgaatgacccccccgaacctggcggcagcgcaaaagatg

SEQ ID NO: 147054 - DNA, 103 bp, Artificial Sequence
  Synthetic Polynucleotide
taatacgactcactatagggggggaggggtggtggggcagggcgggggggaacagaggagaccccccatgcctgccccaaacctggcggcagcgcaaaagatg

SEQ ID NO: 147055 - DNA, 103 bp, Artificial Sequence
  Synthetic Polynucleotide
taatacgactcactatagggcctcgcgatgggggaggggtggtggggcagaacagaggagactgcccatgcacccctccaacctggcggcagcgcaaaagatg

SEQ ID NO: 147056 - DNA, 103 bp, Artificial Sequence
  Synthetic Polynucleotide
taatacgactcactatagggcccaagaagccctcgcgatgggggaggggtaacagaggagaacccctatgccatcgcgaaacctggcggcagcgcaaaagatg

SEQ ID NO: 147057 - DNA, 103 bp, Artificial Sequence
  Synthetic Polynucleotide
taatacgactcactatagggggccggaggccccaagaagccctcgcgatgaacagaggagacatcgcatgggcttcttgaacctggcggcagcgcaaaagatg

SEQ ID NO: 147058 - DNA, 103 bp, Artificial Sequence
  Synthetic Polynucleotide
taatacgactcactatagggaaaagcgggaggccggaggccccaagaagcaacagaggagagcttctatgggcctccggaacctggcggcagcgcaaaagatg

SEQ ID NO: 147059 - DNA, 103 bp, Artificial Sequence
  Synthetic Polynucleotide
taatacgactcactataggggtgcccacagaaaagcgggaggccggaggcaacagaggagagcctccatgctcccgcttaacctggcggcagcgcaaaagatg

SEQ ID NO: 147060 - DNA, 103 bp, Artificial Sequence
  Synthetic Polynucleotide
taatacgactcactatagggtaggggagcaggaagcgggggctgcccaataacagaggagaattgggatgcccccgcttaacctggcggcagcgcaaaagatg

SEQ ID NO: 147061 - DNA, 103 bp, Artificial Sequence
  Synthetic Polynucleotide
taatacgactcactatagggagaatcctgagtgcccacagaaaagcgggaaacagaggagatcccgcatgtctgtgggcaacctggcggcagcgcaaaagatg

SEQ ID NO: 147062 - DNA, 103 bp, Artificial Sequence
  Synthetic Polynucleotide
taatacgactcactataggggaggggtgtgagaatcctgagtgcccacagaacagaggagactgtggatgctcaggattaacctggcggcagcgcaaaagatg

SEQ ID NO: 147063 - DNA, 103 bp, Artificial Sequence
  Synthetic Polynucleotide
taatacgactcactataggggggggagtgggaggggtgtgagaatcctgaaacagaggagatcaggaatgtcacaccccaacctggcggcagcgcaaaagatg

SEQ ID NO: 147064 - DNA, 103 bp, Artificial Sequence
  Synthetic Polynucleotide
taatacgactcactatagggggttggggttgggggagtgggaggggtgtgaacagaggagacacaccatgcccactcccaacctggcggcagcgcaaaagatg

SEQ ID NO: 147065 - DNA, 103 bp, Artificial Sequence
  Synthetic Polynucleotide
taatacgactcactatagggtactgctggtggttggggttgggggagtggaacagaggagaccactcatgcaaccccaaaacctggcggcagcgcaaaagatg

SEQ ID NO: 147066 - DNA, 103 bp, Artificial Sequence
  Synthetic Polynucleotide
taatacgactcactatagggttgctgttgctactgctggtggttggggttaacagaggagaaaccccatgcaccagcagaacctggcggcagcgcaaaagatg

SEQ ID NO: 147067 - DNA, 103 bp, Artificial Sequence
  Synthetic Polynucleotide
taatacgactcactataggggctgccactgttgctgttgctactgctggtaacagaggagaaccagcatgagcaacagcaacctggcggcagcgcaaaagatg

SEQ ID NO: 147068 - DNA, 103 bp, Artificial Sequence
  Synthetic Polynucleotide
taatacgactcactatagggtgctgctgtggctgccactgttgctgttgcaacagaggagagcaacaatgacagtggcaaacctggcggcagcgcaaaagatg

SEQ ID NO: 147069 - DNA, 103 bp, Artificial Sequence
  Synthetic Polynucleotide
taatacgactcactatagggccagcagggctgctgctgtggctgccactgaacagaggagacagtggatgccacagcagaacctggcggcagcgcaaaagatg

SEQ ID NO: 147070 - DNA, 103 bp, Artificial Sequence
  Synthetic Polynucleotide
taatacgactcactatagggggacacaggcccagcagggctgctgctgtgaacagaggagacacagcatgagccctgctaacctggcggcagcgcaaaagatg

SEQ ID NO: 147071 - DNA, 103 bp, Artificial Sequence
  Synthetic Polynucleotide
taatacgactcactataggggtgaagggggtaggggagcaggaagcggggaacagaggagaccccgcatgctgctccccaacctggcggcagcgcaaaagatg

SEQ ID NO: 147072 - DNA, 103 bp, Artificial Sequence
  Synthetic Polynucleotide
taatacgactcactataggggtgggggaaaggacacaggcccagcagggcaacagaggagagccctgatgggcctgtgtaacctggcggcagcgcaaaagatg

SEQ ID NO: 147073 - DNA, 103 bp, Artificial Sequence
  Synthetic Polynucleotide
taatacgactcactatagggagatagggtggtgggggaaaggacacaggcaacagaggagagcctgtatgctttcccccaacctggcggcagcgcaaaagatg

SEQ ID NO: 147074 - DNA, 103 bp, Artificial Sequence
  Synthetic Polynucleotide
taatacgactcactatagggacttctggccagatagggtggtgggggaaaaacagaggagatttcccatgccaccctataacctggcggcagcgcaaaagatg

SEQ ID NO: 147075 - DNA, 103 bp, Artificial Sequence
  Synthetic Polynucleotide
taatacgactcactataggggggggtctatacttctggccagatagggtgaacagaggagacaccctatgtggccagaaaacctggcggcagcgcaaaagatg

SEQ ID NO: 147076 - DNA, 103 bp, Artificial Sequence
  Synthetic Polynucleotide
taatacgactcactatagggggccggggaagggggtctatacttctggccaacagaggagaggccagatgtatagacccaacctggcggcagcgcaaaagatg

SEQ ID NO: 147077 - DNA, 103 bp, Artificial Sequence
  Synthetic Polynucleotide
taatacgactcactatagggtgggctgggaggccggggaagggggtctataacagaggagaatagacatgcttccccggaacctggcggcagcgcaaaagatg

SEQ ID NO: 147078 - DNA, 103 bp, Artificial Sequence
  Synthetic Polynucleotide
taatacgactcactatagggggttctgtgctgggctgggaggccggggaaaacagaggagattccccatgctcccagccaacctggcggcagcgcaaaagatg

SEQ ID NO: 147079 - DNA, 103 bp, Artificial Sequence
  Synthetic Polynucleotide
taatacgactcactataggggggtcctgggggttctgtgctgggctgggaaacagaggagatcccagatgagcacagaaaacctggcggcagcgcaaaagatg

SEQ ID NO: 147080 - DNA, 103 bp, Artificial Sequence
  Synthetic Polynucleotide
taatacgactcactatagggtacaagaggtgggtcctgggggttctgtgcaacagaggagagcacagatgccccaggacaacctggcggcagcgcaaaagatg

SEQ ID NO: 147081 - DNA, 103 bp, Artificial Sequence
  Synthetic Polynucleotide
taatacgactcactataggggagtcaggggtacaagaggtgggtcctgggaacagaggagacccaggatgcacctcttgaacctggcggcagcgcaaaagatg

SEQ ID NO: 147082 - DNA, 103 bp, Artificial Sequence
  Synthetic Polynucleotide
taatacgactcactatagggctactgccatgtgaagggggtaggggagcaaacagaggagatgctccatgacccccttcaacctggcggcagcgcaaaagatg

SEQ ID NO: 147083 - DNA, 103 bp, Artificial Sequence
  Synthetic Polynucleotide
taatacgactcactatagggggcagggcaagagtcaggggtacaagaggtaacagaggagaacctctatgacccctgacaacctggcggcagcgcaaaagatg

SEQ ID NO: 147084 - DNA, 103 bp, Artificial Sequence
  Synthetic Polynucleotide
taatacgactcactatagggaggggctggaggcagggcaagagtcaggggaacagaggagacccctgatgcttgccctgaacctggcggcagcgcaaaagatg

SEQ ID NO: 147085 - DNA, 103 bp, Artificial Sequence
  Synthetic Polynucleotide
taatacgactcactatagggaggaggaaggaggggctggaggcagggcaaaacagaggagattgcccatgctccagcccaacctggcggcagcgcaaaagatg

SEQ ID NO: 147086 - DNA, 103 bp, Artificial Sequence
  Synthetic Polynucleotide
taatacgactcactatagggttttggtggcaggaggaaggaggggctggaaacagaggagatccagcatgtccttcctcaacctggcggcagcgcaaaagatg

SEQ ID NO: 147087 - DNA, 103 bp, Artificial Sequence
  Synthetic Polynucleotide
taatacgactcactatagggtcctgaggtattttggtggcaggaggaaggaacagaggagaccttccatgtgccaccaaaacctggcggcagcgcaaaagatg

SEQ ID NO: 147088 - DNA, 103 bp, Artificial Sequence
  Synthetic Polynucleotide
taatacgactcactataggggcctgaagcttcctgaggtattttggtggcaacagaggagagccaccatgatacctcagaacctggcggcagcgcaaaagatg

SEQ ID NO: 147089 - DNA, 103 bp, Artificial Sequence
  Synthetic Polynucleotide
taatacgactcactatagggctctccgggcgcctgaagcttcctgaggtaaacagaggagatacctcatgaagcttcagaacctggcggcagcgcaaaagatg

SEQ ID NO: 147090 - DNA, 103 bp, Artificial Sequence
  Synthetic Polynucleotide
taatacgactcactataggggggccgggggctctccgggcgcctgaagctaacagaggagaagcttcatgcgcccggagaacctggcggcagcgcaaaagatg

SEQ ID NO: 147091 - DNA, 103 bp, Artificial Sequence
  Synthetic Polynucleotide
taatacgactcactatagggaggagaccctgggccgggggctctccgggcaacagaggagagcccggatggcccccggcaacctggcggcagcgcaaaagatg

SEQ ID NO: 147092 - DNA, 103 bp, Artificial Sequence
  Synthetic Polynucleotide
taatacgactcactataggggtctttgggaaggagaccctgggccgggggaacagaggagacccccgatgcagggtctcaacctggcggcagcgcaaaagatg

SEQ ID NO: 147093 - DNA, 103 bp, Artificial Sequence
  Synthetic Polynucleotide
taatacgactcactataggggtgcccagaactactgccatgtgaagggggaacagaggagaccccctatgcatggcagtaacctggcggcagcgcaaaagatg

SEQ ID NO: 147094 - DNA, 103 bp, Artificial Sequence
  Synthetic Polynucleotide
taatacgactcactatagggcacctcgggggtctttgggaaggagaccctaacagaggagaagggtcatgttcccaaagaacctggcggcagcgcaaaagatg

SEQ ID NO: 147095 - DNA, 103 bp, Artificial Sequence
  Synthetic Polynucleotide
taatacgactcactataggggccccggccccacctcgggggtctttgggaaacagaggagatcccaaatgcccccgaggaacctggcggcagcgcaaaagatg

SEQ ID NO: 147096 - DNA, 103 bp, Artificial Sequence
  Synthetic Polynucleotide
taatacgactcactatagggcctgggggtggccccggccccacctcggggaacagaggagaccccgaatgggggccgggaacctggcggcagcgcaaaagatg

SEQ ID NO: 147097 - DNA, 103 bp, Artificial Sequence
  Synthetic Polynucleotide
taatacgactcactatagggactcagggggcctgggggtggccccggcccaacagaggagagggccgatgccacccccaaacctggcggcagcgcaaaagatg

SEQ ID NO: 147098 - DNA, 103 bp, Artificial Sequence
  Synthetic Polynucleotide
taatacgactcactatagggggggggctttactcagggggcctgggggtgaacagaggagacaccccatggccccctgaaacctggcggcagcgcaaaagatg

SEQ ID NO: 147099 - DNA, 103 bp, Artificial Sequence
  Synthetic Polynucleotide
taatacgactcactatagggggcacaggctggggggctttactcagggggaacagaggagaccccctatgtaaagccccaacctggcggcagcgcaaaagatg

SEQ ID NO: 147100 - DNA, 103 bp, Artificial Sequence
  Synthetic Polynucleotide
taatacgactcactatagggaaccccgggcggcacaggctggggggctttaacagaggagaaaagccatgcagcctgtgaacctggcggcagcgcaaaagatg

SEQ ID NO: 147101 - DNA, 103 bp, Artificial Sequence
  Synthetic Polynucleotide
taatacgactcactataggggcagctccccaaccccgggcggcacaggctaacagaggagaagcctgatgcgcccggggaacctggcggcagcgcaaaagatg

SEQ ID NO: 147102 - DNA, 103 bp, Artificial Sequence
  Synthetic Polynucleotide
taatacgactcactatagggcctcgggcaggcagctccccaaccccgggcaacagaggagagcccggatgtggggagctaacctggcggcagcgcaaaagatg

SEQ ID NO: 147103 - DNA, 103 bp, Artificial Sequence
  Synthetic Polynucleotide
taatacgactcactataggggagtcgagggcctcgggcaggcagctccccaacagaggagaggggagatgcctgcccgaaacctggcggcagcgcaaaagatg

SEQ ID NO: 147104 - DNA, 103 bp, Artificial Sequence
  Synthetic Polynucleotide
taatacgactcactataggggtgcagcgcgggcccctggagggtccactgaacagaggagacagtggatgctccaggggaacctggcggcagcgcaaaagatg

SEQ ID NO: 147105 - DNA, 103 bp, Artificial Sequence
  Synthetic Polynucleotide
taatacgactcactataggggtttgctggggtgcccagaactactgccataacagaggagaatggcaatggttctgggcaacctggcggcagcgcaaaagatg

SEQ ID NO: 147106 - DNA, 103 bp, Artificial Sequence
  Synthetic Polynucleotide
taatacgactcactataggggaaaatcaaagagtcgagggcctcgggcagaacagaggagactgcccatggccctcgacaacctggcggcagcgcaaaagatg

SEQ ID NO: 147107 - DNA, 103 bp, Artificial Sequence
  Synthetic Polynucleotide
taatacgactcactatagggggagtggggggaaaatcaaagagtcgagggaacagaggagaccctcgatgctttgatttaacctggcggcagcgcaaaagatg

SEQ ID NO: 147108 - DNA, 103 bp, Artificial Sequence
  Synthetic Polynucleotide
taatacgactcactataggggtcctccagcggagtggggggaaaatcaaaaacagaggagatttgatatgccccccactaacctggcggcagcgcaaaagatg

SEQ ID NO: 147109 - DNA, 103 bp, Artificial Sequence
  Synthetic Polynucleotide
taatacgactcactatagggcctcaaactggtcctccagcggagtgggggaacagaggagacccccaatgcgctggaggaacctggcggcagcgcaaaagatg

SEQ ID NO: 147110 - DNA, 103 bp, Artificial Sequence
  Synthetic Polynucleotide
taatacgactcactatagggtcggctggctcctcaaactggtcctccagcaacagaggagagctggaatgccagtttgaaacctggcggcagcgcaaaagatg

SEQ ID NO: 147111 - DNA, 103 bp, Artificial Sequence
  Synthetic Polynucleotide
taatacgactcactataggggatcttgaattcggctggctcctcaaactgaacagaggagacagtttatggagccagccaacctggcggcagcgcaaaagatg

SEQ ID NO: 147112 - DNA, 103 bp, Artificial Sequence
  Synthetic Polynucleotide
taatacgactcactatagggcatcaggtaggatcttgaattcggctggctaacagaggagaagccagatgaattcaagaaacctggcggcagcgcaaaagatg

SEQ ID NO: 147113 - DNA, 103 bp, Artificial Sequence
  Synthetic Polynucleotide
taatacgactcactatagggttggccagcccatcaggtaggatcttgaataacagaggagaattcaaatgcctacctgaaacctggcggcagcgcaaaagatg

SEQ ID NO: 147114 - DNA, 103 bp, Artificial Sequence
  Synthetic Polynucleotide
taatacgactcactatagggcttcatgatgttggccagcccatcaggtagaacagaggagactacctatggggctggccaacctggcggcagcgcaaaagatg

SEQ ID NO: 147115 - DNA, 103 bp, Artificial Sequence
  Synthetic Polynucleotide
taatacgactcactatagggcgtccagcatcttcatgatgttggccagccaacagaggagaggctggatgacatcatgaaacctggcggcagcgcaaaagatg

SEQ ID NO: 147116 - DNA, 103 bp, Artificial Sequence
  Synthetic Polynucleotide
taatacgactcactataggggcataatatggtttgctggggtgcccagaaaacagaggagattctggatgccccagcaaaacctggcggcagcgcaaaagatg

SEQ ID NO: 147117 - DNA, 103 bp, Artificial Sequence
  Synthetic Polynucleotide
taatacgactcactatagggcgaatggattcgtccagcatcttcatgatgaacagaggagacatcatatggatgctggaaacctggcggcagcgcaaaagatg

SEQ ID NO: 147118 - DNA, 103 bp, Artificial Sequence
  Synthetic Polynucleotide
taatacgactcactatagggctcttccttgcgaatggattcgtccagcataacagaggagaatgctgatggaatccattaacctggcggcagcgcaaaagatg

SEQ ID NO: 147119 - DNA, 103 bp, Artificial Sequence
  Synthetic Polynucleotide
taatacgactcactataggggttgctgttcctcttccttgcgaatggattaacagaggagaaatccaatggcaaggaagaacctggcggcagcgcaaaagatg

SEQ ID NO: 147120 - DNA, 103 bp, Artificial Sequence
  Synthetic Polynucleotide
taatacgactcactataggggcttcgtgttgttgctgttcctcttccttgaacagaggagacaaggaatgggaacagcaaacctggcggcagcgcaaaagatg

SEQ ID NO: 147121 - DNA, 103 bp, Artificial Sequence
  Synthetic Polynucleotide
taatacgactcactatagggggccacgcctgcttcgtgttgttgctgttcaacagaggagagaacagatgcaacacgaaaacctggcggcagcgcaaaagatg

SEQ ID NO: 147122 - DNA, 103 bp, Artificial Sequence
  Synthetic Polynucleotide
taatacgactcactatagggggggttggggggccacgcctgcttcgtgttaacagaggagaaacacgatgcaggcgtggaacctggcggcagcgcaaaagatg

SEQ ID NO: 147123 - DNA, 103 bp, Artificial Sequence
  Synthetic Polynucleotide
taatacgactcactatagggtccttcagcgggggttggggggccacgcctaacagaggagaaggcgtatgcccccaaccaacctggcggcagcgcaaaagatg

SEQ ID NO: 147124 - DNA, 103 bp, Artificial Sequence
  Synthetic Polynucleotide
taatacgactcactatagggtgcaaagggctccttcagcgggggttggggaacagaggagaccccaaatgccgctgaagaacctggcggcagcgcaaaagatg

SEQ ID NO: 147125 - DNA, 103 bp, Artificial Sequence
  Synthetic Polynucleotide
taatacgactcactatagggactgcagagatgcaaagggctccttcagcgaacagaggagacgctgaatgagccctttgaacctggcggcagcgcaaaagatg

SEQ ID NO: 147126 - DNA, 103 bp, Artificial Sequence
  Synthetic Polynucleotide
taatacgactcactataggggggaaaggagactgcagagatgcaaagggcaacagaggagagcccttatgatctctgcaaacctggcggcagcgcaaaagatg

SEQ ID NO: 147127 - DNA, 103 bp, Artificial Sequence
  Synthetic Polynucleotide
taatacgactcactatagggcgcccctggagcataatatggtttgctgggaacagaggagacccagcatgccatattataacctggcggcagcgcaaaagatg

SEQ ID NO: 147128 - DNA, 103 bp, Artificial Sequence
  Synthetic Polynucleotide
taatacgactcactatagggtgtgtcggtggggaaaggagactgcagagaaacagaggagatctctgatgtctcctttcaacctggcggcagcgcaaaagatg

SEQ ID NO: 147129 - DNA, 103 bp, Artificial Sequence
  Synthetic Polynucleotide
taatacgactcactatagggtggtgggggctgtgtcggtggggaaaggagaacagaggagactccttatgccaccgacaaacctggcggcagcgcaaaagatg

SEQ ID NO: 147130 - DNA, 103 bp, Artificial Sequence
  Synthetic Polynucleotide
taatacgactcactatagggggagcagtagtggtgggggctgtgtcggtgaacagaggagacaccgaatgagcccccacaacctggcggcagcgcaaaagatg

SEQ ID NO: 147131 - DNA, 103 bp, Artificial Sequence
  Synthetic Polynucleotide
taatacgactcactatagggggcgacagcaggagcagtagtggtgggggcaacagaggagagcccccatgactactgctaacctggcggcagcgcaaaagatg

SEQ ID NO: 147132 - DNA, 103 bp, Artificial Sequence
  Synthetic Polynucleotide
taatacgactcactatagggtggtggtgacggcgacagcaggagcagtagaacagaggagactactgatgctgctgtcgaacctggcggcagcgcaaaagatg

SEQ ID NO: 147133 - DNA, 103 bp, Artificial Sequence
  Synthetic Polynucleotide
taatacgactcactataggggtggtggtggtggtggtgacggcgacagcaaacagaggagatgctgtatgcgtcaccacaacctggcggcagcgcaaaagatg

SEQ ID NO: 147134 - DNA, 103 bp, Artificial Sequence
  Synthetic Polynucleotide
taatacgactcactatagggggtggtggtggtggtggtggtggtggtgacaacagaggagagtcaccatgaccaccaccaacctggcggcagcgcaaaagatg

SEQ ID NO: 147135 - DNA, 103 bp, Artificial Sequence
  Synthetic Polynucleotide
taatacgactcactatagggtggccgtggtggtggtggtggtggtggtggaacagaggagaccaccaatgccaccaccaaacctggcggcagcgcaaaagatg

SEQ ID NO: 147136 - DNA, 103 bp, Artificial Sequence
  Synthetic Polynucleotide
taatacgactcactatagggtcttcctgggtggccgtggtggtggtggtgaacagaggagacaccacatgcaccacggcaacctggcggcagcgcaaaagatg

SEQ ID NO: 147137 - DNA, 103 bp, Artificial Sequence
  Synthetic Polynucleotide
taatacgactcactatagggcttcttctcctcttcctgggtggccgtggtaacagaggagaaccacgatgacccaggaaaacctggcggcagcgcaaaagatg

SEQ ID NO: 147138 - DNA, 103 bp, Artificial Sequence
  Synthetic Polynucleotide
taatacgactcactatagggttggagtgggcgcccctggagcataatatgaacagaggagacatattatgctccaggggaacctggcggcagcgcaaaagatg

SEQ ID NO: 147139 - DNA, 103 bp, Artificial Sequence
  Synthetic Polynucleotide
taatacgactcactatagggctggtggtggcttcttctcctcttcctgggaacagaggagacccaggatgaggagaagaaacctggcggcagcgcaaaagatg

SEQ ID NO: 147140 - DNA, 103 bp, Artificial Sequence
  Synthetic Polynucleotide
taatacgactcactatagggggtggtagggctggtggtggcttcttctccaacagaggagaggagaaatggccaccaccaacctggcggcagcgcaaaagatg

SEQ ID NO: 147141 - DNA, 103 bp, Artificial Sequence
  Synthetic Polynucleotide
taatacgactcactatagggaggcggtggtggtggtagggctggtggtggaacagaggagaccaccaatggccctaccaaacctggcggcagcgcaaaagatg

SEQ ID NO: 147142 - DNA, 103 bp, Artificial Sequence
  Synthetic Polynucleotide
taatacgactcactatagggacttggctagaggcggtggtggtggtagggaacagaggagaccctacatgcaccaccgcaacctggcggcagcgcaaaagatg

SEQ ID NO: 147143 - DNA, 103 bp, Artificial Sequence
  Synthetic Polynucleotide
taatacgactcactatagggggtggagggaacttggctagaggcggtggtaacagaggagaaccaccatgtctagccaaaacctggcggcagcgcaaaagatg

SEQ ID NO: 147144 - DNA, 103 bp, Artificial Sequence
  Synthetic Polynucleotide
taatacgactcactatagggtggctgagagggtggagggaacttggctagaacagaggagactagccatgttccctccaaacctggcggcagcgcaaaagatg

SEQ ID NO: 147145 - DNA, 103 bp, Artificial Sequence
  Synthetic Polynucleotide
taatacgactcactataggggtggtggctgtggctgagagggtggagggaaacagaggagatccctcatgcctctcagcaacctggcggcagcgcaaaagatg

SEQ ID NO: 147146 - DNA, 103 bp, Artificial Sequence
  Synthetic Polynucleotide
taatacgactcactatagggggtgggggtggtggtggctgtggctgagagaacagaggagactctcaatgacagccaccaacctggcggcagcgcaaaagatg

SEQ ID NO: 147147 - DNA, 103 bp, Artificial Sequence
  Synthetic Polynucleotide
taatacgactcactatagggcgggctggggggtgggggtggtggtggctgaacagaggagacagccaatgccacccccaaacctggcggcagcgcaaaagatg

SEQ ID NO: 147148 - DNA, 103 bp, Artificial Sequence
  Synthetic Polynucleotide
taatacgactcactataggggcaggctggccgggctggggggtgggggtgaacagaggagacaccccatgcccccagccaacctggcggcagcgcaaaagatg

SEQ ID NO: 147149 - DNA, 103 bp, Artificial Sequence
  Synthetic Polynucleotide
taatacgactcactatagggtggaggggtcttggagtgggcgcccctggaaacagaggagatccaggatggcccactccaacctggcggcagcgcaaaagatg

SEQ ID NO: 147150 - DNA, 103 bp, Artificial Sequence
  Synthetic Polynucleotide
taatacgactcactatagggaaggatttgagcaggctggccgggctggggaacagaggagaccccagatgggccagcctaacctggcggcagcgcaaaagatg

SEQ ID NO: 147151 - DNA, 103 bp, Artificial Sequence
  Synthetic Polynucleotide
taatacgactcactatagggcacggaggccaaggatttgagcaggctggcaacagaggagagccagcatgctcaaatccaacctggcggcagcgcaaaagatg

SEQ ID NO: 147152 - DNA, 103 bp, Artificial Sequence
  Synthetic Polynucleotide
taatacgactcactataggggtccctccagcacggaggccaaggatttgaaacagaggagatcaaatatgtggcctccgaacctggcggcagcgcaaaagatg

SEQ ID NO: 147153 - DNA, 103 bp, Artificial Sequence
  Synthetic Polynucleotide
taatacgactcactatagggcagtacttttgtccctccagcacggaggccaacagaggagaggcctcatggctggagggaacctggcggcagcgcaaaagatg

SEQ ID NO: 147154 - DNA, 103 bp, Artificial Sequence
  Synthetic Polynucleotide
taatacgactcactatagggcccccgataacagtacttttgtccctccagaacagaggagactggagatgcaaaagtacaacctggcggcagcgcaaaagatg

SEQ ID NO: 147155 - DNA, 103 bp, Artificial Sequence
  Synthetic Polynucleotide
taatacgactcactatagggctgctccagtcccccgataacagtacttttaacagaggagaaaaagtatggttatcgggaacctggcggcagcgcaaaagatg

SEQ ID NO: 147156 - DNA, 103 bp, Artificial Sequence
  Synthetic Polynucleotide
taatacgactcactataggggtggaaacagctgctccagtcccccgataaaacagaggagattatcgatggactggagcaacctggcggcagcgcaaaagatg

SEQ ID NO: 147157 - DNA, 103 bp, Artificial Sequence
  Synthetic Polynucleotide
taatacgactcactatagggcccaggccgggtggaaacagctgctccagtaacagaggagaactggaatggctgtttccaacctggcggcagcgcaaaagatg

SEQ ID NO: 147158 - DNA, 103 bp, Artificial Sequence
  Synthetic Polynucleotide
taatacgactcactatagggtgggcaagggcccaggccgggtggaaacagaacagaggagactgtttatgcccggcctgaacctggcggcagcgcaaaagatg

SEQ ID NO: 147159 - DNA, 103 bp, Artificial Sequence
  Synthetic Polynucleotide
taatacgactcactatagggtactgagtggtgggcaagggcccaggccggaacagaggagaccggccatggcccttgccaacctggcggcagcgcaaaagatg

SEQ ID NO: 147160 - DNA, 103 bp, Artificial Sequence
  Synthetic Polynucleotide
taatacgactcactatagggcagcttcccatggaggggtcttggagtgggaacagaggagacccactatgagacccctcaacctggcggcagcgcaaaagatg

SEQ ID NO: 147161 - DNA, 103 bp, Artificial Sequence
  Synthetic Polynucleotide
taatacgactcactataggggccaggggaatactgagtggtgggcaagggaacagaggagacccttgatgaccactcagaacctggcggcagcgcaaaagatg

SEQ ID NO: 147162 - DNA, 103 bp, Artificial Sequence
  Synthetic Polynucleotide
taatacgactcactatagggctgatggggggccaggggaatactgagtggaacagaggagaccactcatgattcccctgaacctggcggcagcgcaaaagatg

SEQ ID NO: 147163 - DNA, 103 bp, Artificial Sequence
  Synthetic Polynucleotide
taatacgactcactataggggcggtagcacctgatggggggccaggggaaaacagaggagattccccatgccccccatcaacctggcggcagcgcaaaagatg

SEQ ID NO: 147164 - DNA, 103 bp, Artificial Sequence
  Synthetic Polynucleotide
taatacgactcactataggggggcggcagggcggtagcacctgatgggggaacagaggagacccccaatgggtgctaccaacctggcggcagcgcaaaagatg

SEQ ID NO: 147165 - DNA, 103 bp, Artificial Sequence
  Synthetic Polynucleotide
taatacgactcactatagggccgctgaggtgggcggcagggcggtagcacaacagaggagagtgctaatgccctgccgcaacctggcggcagcgcaaaagatg

SEQ ID NO: 147166 - DNA, 103 bp, Artificial Sequence
  Synthetic Polynucleotide
taatacgactcactataggggcgctaggggccgctgaggtgggcggcaggaacagaggagacctgccatgcacctcagcaacctggcggcagcgcaaaagatg

SEQ ID NO: 147167 - DNA, 103 bp, Artificial Sequence
  Synthetic Polynucleotide
taatacgactcactatagggggagccctgggcgctaggggccgctgaggtaacagaggagaacctcaatggcccctagcaacctggcggcagcgcaaaagatg

SEQ ID NO: 147168 - DNA, 103 bp, Artificial Sequence
  Synthetic Polynucleotide
taatacgactcactatagggagggctgtggggagccctgggcgctaggggaacagaggagacccctaatgcccagggctaacctggcggcagcgcaaaagatg

SEQ ID NO: 147169 - DNA, 103 bp, Artificial Sequence
  Synthetic Polynucleotide
taatacgactcactataggggaggaagcagagggctgtggggagccctggaacagaggagaccagggatgcccacagccaacctggcggcagcgcaaaagatg

SEQ ID NO: 147170 - DNA, 103 bp, Artificial Sequence
  Synthetic Polynucleotide
taatacgactcactatagggctgagatgacgaggaagcagagggctgtggaacagaggagaccacagatgtctgcttccaacctggcggcagcgcaaaagatg

SEQ ID NO: 147171 - DNA, 103 bp, Artificial Sequence
  Synthetic Polynucleotide
taatacgactcactataggggcagggattccagcttcccatggaggggtcaacagaggagagaccccatgatgggaagcaacctggcggcagcgcaaaagatg

SEQ ID NO: 147172 - DNA, 103 bp, Artificial Sequence
  Synthetic Polynucleotide
taatacgactcactatagggaggtagagaactgagatgacgaggaagcagaacagaggagactgcttatgcgtcatctcaacctggcggcagcgcaaaagatg

SEQ ID NO: 147173 - DNA, 103 bp, Artificial Sequence
  Synthetic Polynucleotide
taatacgactcactatagggggcccgcctgaggtagagaactgagatgacaacagaggagagtcatcatggttctctacaacctggcggcagcgcaaaagatg

SEQ ID NO: 147174 - DNA, 103 bp, Artificial Sequence
  Synthetic Polynucleotide
taatacgactcactatagggccgggcccagggcccgcctgaggtagagaaaacagaggagattctctatgtcaggcgggaacctggcggcagcgcaaaagatg

SEQ ID NO: 147175 - DNA, 103 bp, Artificial Sequence
  Synthetic Polynucleotide
taatacgactcactatagggccctgcgctcccgggcccagggcccgcctgaacagaggagacaggcgatgcctgggcccaacctggcggcagcgcaaaagatg

SEQ ID NO: 147176 - DNA, 103 bp, Artificial Sequence
  Synthetic Polynucleotide
taatacgactcactatagggtcttcgcccgccctgcgctcccgggcccagaacagaggagactgggcatgggagcgcagaacctggcggcagcgcaaaagatg

SEQ ID NO: 147177 - DNA, 103 bp, Artificial Sequence
  Synthetic Polynucleotide
taatacgactcactatagggcgggactggctcttcgcccgccctgcgctcaacagaggagagagcgcatggcgggcgaaaacctggcggcagcgcaaaagatg

SEQ ID NO: 147178 - DNA, 103 bp, Artificial Sequence
  Synthetic Polynucleotide
taatacgactcactatagggtcatggggcccgggactggctcttcgcccgaacagaggagacgggcgatgagccagtccaacctggcggcagcgcaaaagatg

SEQ ID NO: 147179 - DNA, 103 bp, Artificial Sequence
  Synthetic Polynucleotide
taatacgactcactatagggtgggtgggggtcatggggcccgggactggcaacagaggagagccagtatggggccccataacctggcggcagcgcaaaagatg

SEQ ID NO: 147180 - DNA, 103 bp, Artificial Sequence
  Synthetic Polynucleotide
taatacgactcactatagggtgggggcggttgggtgggggtcatggggccaacagaggagaggccccatgacccccaccaacctggcggcagcgcaaaagatg

SEQ ID NO: 147181 - DNA, 103 bp, Artificial Sequence
  Synthetic Polynucleotide
taatacgactcactataggggagataggggtgggggcggttgggtgggggaacagaggagacccccaatgaaccgccccaacctggcggcagcgcaaaagatg

SEQ ID NO: 147182 - DNA, 103 bp, Artificial Sequence
  Synthetic Polynucleotide
taatacgactcactatagggacacagccatgcagggattccagcttcccaaacagaggagatgggaaatgggaatccctaacctggcggcagcgcaaaagatg

SEQ ID NO: 147183 - DNA, 103 bp, Artificial Sequence
  Synthetic Polynucleotide
taatacgactcactataggggcagggggcagagataggggtgggggcggtaacagaggagaaccgccatgacccctatcaacctggcggcagcgcaaaagatg

SEQ ID NO: 147184 - DNA, 103 bp, Artificial Sequence
  Synthetic Polynucleotide
taatacgactcactatagggctcagagcgagcagggggcagagataggggaacagaggagacccctaatgctgccccctaacctggcggcagcgcaaaagatg

SEQ ID NO: 147185 - DNA, 103 bp, Artificial Sequence
  Synthetic Polynucleotide
taatacgactcactataggggcacctcagactcagagcgagcagggggcaaacagaggagatgccccatgctcgctctgaacctggcggcagcgcaaaagatg

SEQ ID NO: 147186 - DNA, 103 bp, Artificial Sequence
  Synthetic Polynucleotide
taatacgactcactatagggatctcttctagcacctcagactcagagcgaaacagaggagatcgctcatggtctgaggtaacctggcggcagcgcaaaagatg

SEQ ID NO: 147187 - DNA, 103 bp, Artificial Sequence
  Synthetic Polynucleotide
taatacgactcactatagggagcccggctgatctcttctagcacctcagaaacagaggagatctgagatgctagaagagaacctggcggcagcgcaaaagatg

SEQ ID NO: 147188 - DNA, 103 bp, Artificial Sequence
  Synthetic Polynucleotide
taatacgactcactataggggggtctcgcaagcccggctgatctcttctaaacagaggagatagaagatgtcagccgggaacctggcggcagcgcaaaagatg

SEQ ID NO: 147189 - DNA, 103 bp, Artificial Sequence
  Synthetic Polynucleotide
taatacgactcactatagggcgctccacaagggtctcgcaagcccggctgaacagaggagacagccgatgttgcgagacaacctggcggcagcgcaaaagatg

SEQ ID NO: 147190 - DNA, 103 bp, Artificial Sequence
  Synthetic Polynucleotide
taatacgactcactatagggccggcccacccgctccacaagggtctcgcaaacagaggagatgcgagatgcttgtggagaacctggcggcagcgcaaaagatg

SEQ ID NO: 147191 - DNA, 103 bp, Artificial Sequence
  Synthetic Polynucleotide
taatacgactcactatagggcagtggcactccggcccacccgctccacaaaacagaggagattgtggatggggtgggccaacctggcggcagcgcaaaagatg

SEQ ID NO: 147192 - DNA, 103 bp, Artificial Sequence
  Synthetic Polynucleotide
taatacgactcactatagggtcggctgggtcagtggcactccggcccaccaacagaggagaggtgggatggagtgccacaacctggcggcagcgcaaaagatg

SEQ ID NO: 147193 - DNA, 103 bp, Artificial Sequence
  Synthetic Polynucleotide
taatacgactcactatagggcaatgcctgcacacagccatgcagggattcaacagaggagagaatccatgcatggctgtaacctggcggcagcgcaaaagatg

SEQ ID NO: 147194 - DNA, 103 bp, Artificial Sequence
  Synthetic Polynucleotide
taatacgactcactataggggtccactgggtcggctgggtcagtggcactaacagaggagaagtgccatggacccagccaacctggcggcagcgcaaaagatg

SEQ ID NO: 147195 - DNA, 103 bp, Artificial Sequence
  Synthetic Polynucleotide
taatacgactcactataggggctctgctgtgtccactgggtcggctgggtaacagaggagaacccagatgacccagtggaacctggcggcagcgcaaaagatg

SEQ ID NO: 147196 - DNA, 103 bp, Artificial Sequence
  Synthetic Polynucleotide
taatacgactcactatagggctgtccgctggctctgctgtgtccactgggaacagaggagacccagtatgcacagcagaaacctggcggcagcgcaaaagatg

SEQ ID NO: 147197 - DNA, 103 bp, Artificial Sequence
  Synthetic Polynucleotide
taatacgactcactatagggctcagtcccactgtccgctggctctgctgtaacagaggagaacagcaatgccagcggacaacctggcggcagcgcaaaagatg

SEQ ID NO: 147198 - DNA, 103 bp, Artificial Sequence
  Synthetic Polynucleotide
taatacgactcactataggggcagcagtcgctcagtcccactgtccgctgaacagaggagacagcggatggtgggactgaacctggcggcagcgcaaaagatg

SEQ ID NO: 147199 - DNA, 103 bp, Artificial Sequence
  Synthetic Polynucleotide
taatacgactcactatagggtgtgcggggggcagcagtcgctcagtcccaaacagaggagatgggacatggcgactgctaacctggcggcagcgcaaaagatg

SEQ ID NO: 147200 - DNA, 103 bp, Artificial Sequence
  Synthetic Polynucleotide
taatacgactcactatagggctccttggcctgtgcggggggcagcagtcgaacagaggagacgactgatgccccccgcaaacctggcggcagcgcaaaagatg

SEQ ID NO: 147201 - DNA, 103 bp, Artificial Sequence
  Synthetic Polynucleotide
taatacgactcactatagggcgccagcctcctccttggcctgtgcgggggaacagaggagacccccgatgaggccaaggaacctggcggcagcgcaaaagatg

SEQ ID NO: 147202 - DNA, 103 bp, Artificial Sequence
  Synthetic Polynucleotide
taatacgactcactataggggccgccaccccgccagcctcctccttggccaacagaggagaggccaaatgggaggctggaacctggcggcagcgcaaaagatg

SEQ ID NO: 147203 - DNA, 103 bp, Artificial Sequence
  Synthetic Polynucleotide
taatacgactcactataggggcctgacactgccgccaccccgccagcctcaacagaggagagaggctatgggggtggcgaacctggcggcagcgcaaaagatg

SEQ ID NO: 147204 - DNA, 103 bp, Artificial Sequence
  Synthetic Polynucleotide
taatacgactcactataggggctcccggagcaatgcctgcacacagccataacagaggagaatggctatgtgcaggcataacctggcggcagcgcaaaagatg

SEQ ID NO: 147205 - DNA, 103 bp, Artificial Sequence
  Synthetic Polynucleotide
taatacgactcactataggggcttacagctgcctgacactgccgccacccaacagaggagagggtggatgcagtgtcagaacctggcggcagcgcaaaagatg

SEQ ID NO: 147206 - DNA, 103 bp, Artificial Sequence
  Synthetic Polynucleotide
taatacgactcactatagggttctgtcgccgcttacagctgcctgacactaacagaggagaagtgtcatgcagctgtaaaacctggcggcagcgcaaaagatg

SEQ ID NO: 147207 - DNA, 103 bp, Artificial Sequence
  Synthetic Polynucleotide
taatacgactcactatagggctgatgctccttctgtcgccgcttacagctaacagaggagaagctgtatgcggcgacagaacctggcggcagcgcaaaagatg

SEQ ID NO: 147208 - DNA, 103 bp, Artificial Sequence
  Synthetic Polynucleotide
taatacgactcactataggggatgctccttctgatgctccttctgtcgccaacagaggagaggcgacatgaggagcatcaacctggcggcagcgcaaaagatg

SEQ ID NO: 147209 - DNA, 103 bp, Artificial Sequence
  Synthetic Polynucleotide
taatacgactcactatagggctgtgccgccgatgctccttctgatgctccaacagaggagaggagcaatggaaggagcaaacctggcggcagcgcaaaagatg

SEQ ID NO: 147210 - DNA, 103 bp, Artificial Sequence
  Synthetic Polynucleotide
taatacgactcactatagggacaggcccgcctgtgccgccgatgctccttaacagaggagaaaggagatgcggcggcacaacctggcggcagcgcaaaagatg

SEQ ID NO: 147211 - DNA, 103 bp, Artificial Sequence
  Synthetic Polynucleotide
taatacgactcactatagggcactgtccttacaggcccgcctgtgccgccaacagaggagaggcggcatgggcgggcctaacctggcggcagcgcaaaagatg

SEQ ID NO: 147212 - DNA, 103 bp, Artificial Sequence
  Synthetic Polynucleotide
taatacgactcactatagggcgacgacccacactgtccttacaggcccgcaacagaggagagcgggcatgtaaggacagaacctggcggcagcgcaaaagatg

SEQ ID NO: 147213 - DNA, 103 bp, Artificial Sequence
  Synthetic Polynucleotide
taatacgactcactatagggctcacggggccgacgacccacactgtccttaacagaggagaaaggacatggtgggtcgtaacctggcggcagcgcaaaagatg

SEQ ID NO: 147214 - DNA, 103 bp, Artificial Sequence
  Synthetic Polynucleotide
taatacgactcactatagggttgccctgccctcacggggccgacgacccaaacagaggagatgggtcatgggccccgtgaacctggcggcagcgcaaaagatg

SEQ ID NO: 147215 - DNA, 103 bp, Artificial Sequence
  Synthetic Polynucleotide
taatacgactcactatagggaaggcttcccgtgcagcgcgggcccctggaaacagaggagatccaggatgccgcgctgcaacctggcggcagcgcaaaagatg

SEQ ID NO: 147216 - DNA, 103 bp, Artificial Sequence
  Synthetic Polynucleotide
taatacgactcactatagggggctgggctggctcccggagcaatgcctgcaacagaggagagcaggcatggctccgggaaacctggcggcagcgcaaaagatg

SEQ ID NO: 147217 - DNA, 103 bp, Artificial Sequence
  Synthetic Polynucleotide
taatacgactcactataggggccttggcctttgccctgccctcacggggcaacagaggagagccccgatggggcagggcaacctggcggcagcgcaaaagatg

SEQ ID NO: 147218 - DNA, 103 bp, Artificial Sequence
  Synthetic Polynucleotide
taatacgactcactatagggggggaccttggccttggcctttgccctgccaacagaggagaggcaggatgaaggccaagaacctggcggcagcgcaaaagatg

SEQ ID NO: 147219 - DNA, 103 bp, Artificial Sequence
  Synthetic Polynucleotide
taatacgactcactatagggtcttttctttggggaccttggccttggcctaacagaggagaaggccaatgccaaggtccaacctggcggcagcgcaaaagatg

SEQ ID NO: 147220 - DNA, 103 bp, Artificial Sequence
  Synthetic Polynucleotide
taatacgactcactatagggacccggcggctcttttctttggggaccttgaacagaggagacaaggtatgcaaagaaaaaacctggcggcagcgcaaaagatg

SEQ ID NO: 147221 - DNA, 103 bp, Artificial Sequence
  Synthetic Polynucleotide
taatacgactcactataggggttccccagcacccggcggctcttttctttaacagaggagaaaagaaatgagccgccggaacctggcggcagcgcaaaagatg

SEQ ID NO: 147222 - DNA, 103 bp, Artificial Sequence
  Synthetic Polynucleotide
taatacgactcactataggggcaggtccaggttccccagcacccggcggcaacagaggagagccgccatgtgctggggaaacctggcggcagcgcaaaagatg

SEQ ID NO: 147223 - DNA, 103 bp, Artificial Sequence
  Synthetic Polynucleotide
taatacgactcactatagggtcctcgctctgcaggtccaggttccccagcaacagaggagagctgggatgcctggacctaacctggcggcagcgcaaaagatg

SEQ ID NO: 147224 - DNA, 103 bp, Artificial Sequence
  Synthetic Polynucleotide
taatacgactcactatagggaccctggatctcctcgctctgcaggtccagaacagaggagactggacatgcagagcgagaacctggcggcagcgcaaaagatg

SEQ ID NO: 147225 - DNA, 103 bp, Artificial Sequence
  Synthetic Polynucleotide
taatacgactcactatagggacttctcacgaccctggatctcctcgctctaacagaggagaagagcgatgagatccaggaacctggcggcagcgcaaaagatg

SEQ ID NO: 147226 - DNA, 103 bp, Artificial Sequence
  Synthetic Polynucleotide
taatacgactcactatagggtcgggccgggacttctcacgaccctggatcaacagaggagagatccaatgtcgtgagaaaacctggcggcagcgcaaaagatg

SEQ ID NO: 147227 - DNA, 103 bp, Artificial Sequence
  Synthetic Polynucleotide
taatacgactcactatagggccaaagccctggctgggctggctcccggagaacagaggagactccggatgccagcccagaacctggcggcagcgcaaaagatg

SEQ ID NO: 147228 - DNA, 103 bp, Artificial Sequence
  Synthetic Polynucleotide
taatacgactcactatagggcccgccaagatcgggccgggacttctcacgaacagaggagacgtgagatgtcccggcccaacctggcggcagcgcaaaagatg

SEQ ID NO: 147229 - DNA, 103 bp, Artificial Sequence
  Synthetic Polynucleotide
taatacgactcactatagggccttggaggccccgccaagatcgggccgggaacagaggagacccggcatgatcttggcgaacctggcggcagcgcaaaagatg

SEQ ID NO: 147230 - DNA, 103 bp, Artificial Sequence
  Synthetic Polynucleotide
taatacgactcactatagggggtggcttggccttggaggccccgccaagaaacagaggagatcttggatgggcctccaaaacctggcggcagcgcaaaagatg

SEQ ID NO: 147231 - DNA, 103 bp, Artificial Sequence
  Synthetic Polynucleotide
taatacgactcactatagggtggagctgtgggtggcttggccttggaggcaacagaggagagcctccatggccaagccaaacctggcggcagcgcaaaagatg

SEQ ID NO: 147232 - DNA, 103 bp, Artificial Sequence
  Synthetic Polynucleotide
taatacgactcactatagggatggaggggctggagctgtgggtggcttggaacagaggagaccaagcatgccacagctcaacctggcggcagcgcaaaagatg

SEQ ID NO: 147233 - DNA, 103 bp, Artificial Sequence
  Synthetic Polynucleotide
taatacgactcactataggggcaggagctgatggaggggctggagctgtgaacagaggagacacagcatgagcccctccaacctggcggcagcgcaaaagatg

SEQ ID NO: 147234 - DNA, 103 bp, Artificial Sequence
  Synthetic Polynucleotide
taatacgactcactatagggggcagaaggtgcaggagctgatggaggggcaacagaggagagcccctatgtcagctcctaacctggcggcagcgcaaaagatg

SEQ ID NO: 147235 - DNA, 103 bp, Artificial Sequence
  Synthetic Polynucleotide
taatacgactcactataggggtgtgggctgggcagaaggtgcaggagctgaacagaggagacagctcatgcaccttctgaacctggcggcagcgcaaaagatg

SEQ ID NO: 147236 - DNA, 103 bp, Artificial Sequence
  Synthetic Polynucleotide
taatacgactcactataggggctgacgggggtgtgggctgggcagaaggtaacagaggagaaccttcatgccagcccacaacctggcggcagcgcaaaagatg

SEQ ID NO: 147237 - DNA, 103 bp, Artificial Sequence
  Synthetic Polynucleotide
taatacgactcactatagggagggacagaggctgacgggggtgtgggctgaacagaggagacagcccatgcccccgtcaaacctggcggcagcgcaaaagatg

SEQ ID NO: 147238 - DNA, 103 bp, Artificial Sequence
  Synthetic Polynucleotide
taatacgactcactatagggcaagctgttcccaaagccctggctgggctgaacagaggagacagcccatgcagggctttaacctggcggcagcgcaaaagatg

SEQ ID NO: 147239 - DNA, 103 bp, Artificial Sequence
  Synthetic Polynucleotide
taatacgactcactatagggccttctttccagggacagaggctgacggggaacagaggagaccccgtatgcctctgtccaacctggcggcagcgcaaaagatg

SEQ ID NO: 147240 - DNA, 103 bp, Artificial Sequence
  Synthetic Polynucleotide
taatacgactcactatagggtcctcccgagccttctttccagggacagagaacagaggagactctgtatgtggaaagaaaacctggcggcagcgcaaaagatg

SEQ ID NO: 147241 - DNA, 103 bp, Artificial Sequence
  Synthetic Polynucleotide
taatacgactcactatagggccctggggcttcctcccgagccttctttccaacagaggagaggaaagatggctcgggagaacctggcggcagcgcaaaagatg

SEQ ID NO: 147242 - DNA, 103 bp, Artificial Sequence
  Synthetic Polynucleotide
taatacgactcactatagggcacccggtggccctggggcttcctcccgagaacagaggagactcgggatgaagccccagaacctggcggcagcgcaaaagatg

SEQ ID NO: 147243 - DNA, 103 bp, Artificial Sequence
  Synthetic Polynucleotide
taatacgactcactataggggcccggctgacacccggtggccctggggctaacagaggagaagccccatggccaccgggaacctggcggcagcgcaaaagatg

SEQ ID NO: 147244 - DNA, 103 bp, Artificial Sequence
  Synthetic Polynucleotide
taatacgactcactatagggcagcatgtcggcccggctgacacccggtggaacagaggagaccaccgatggtcagccggaacctggcggcagcgcaaaagatg

SEQ ID NO: 147245 - DNA, 103 bp, Artificial Sequence
  Synthetic Polynucleotide
taatacgactcactatagggagcgcagcttcagcatgtcggcccggctgaaacagaggagatcagccatgccgacatgcaacctggcggcagcgcaaaagatg

SEQ ID NO: 147246 - DNA, 103 bp, Artificial Sequence
  Synthetic Polynucleotide
taatacgactcactatagggtcactaagtgagcgcagcttcagcatgtcgaacagaggagacgacatatggaagctgcgaacctggcggcagcgcaaaagatg

SEQ ID NO: 147247 - DNA, 103 bp, Artificial Sequence
  Synthetic Polynucleotide
taatacgactcactatagggggggggcccctcactaagtgagcgcagcttaacagaggagaaagctgatgtcacttagtaacctggcggcagcgcaaaagatg

SEQ ID NO: 147248 - DNA, 103 bp, Artificial Sequence
  Synthetic Polynucleotide
taatacgactcactatagggtcagctccttggggggcccctcactaagtgaacagaggagacacttaatgaggggccccaacctggcggcagcgcaaaagatg

SEQ ID NO: 147249 - DNA, 103 bp, Artificial Sequence
  Synthetic Polynucleotide
taatacgactcactatagggtacagttgcccaagctgttcccaaagccctaacagaggagaagggctatgggaacagctaacctggcggcagcgcaaaagatg

SEQ ID NO: 147250 - DNA, 103 bp, Artificial Sequence
  Synthetic Polynucleotide
taatacgactcactatagggagccggatcttcagctccttggggggccccaacagaggagaggggccatgcaaggagctaacctggcggcagcgcaaaagatg

SEQ ID NO: 147251 - DNA, 103 bp, Artificial Sequence
  Synthetic Polynucleotide
taatacgactcactatagggtaccttgatgagccggatcttcagctccttaacagaggagaaaggagatgaagatccggaacctggcggcagcgcaaaagatg

SEQ ID NO: 147252 - DNA, 103 bp, Artificial Sequence
  Synthetic Polynucleotide
taatacgactcactatagggcaccactctctaccttgatgagccggatctaacagaggagaagatccatgtcatcaaggaacctggcggcagcgcaaaagatg

SEQ ID NO: 147253 - DNA, 103 bp, Artificial Sequence
  Synthetic Polynucleotide
taatacgactcactataggggtctccttgtcaccactctctaccttgatgaacagaggagacatcaaatgagagagtggaacctggcggcagcgcaaaagatg

SEQ ID NO: 147254 - DNA, 103 bp, Artificial Sequence
  Synthetic Polynucleotide
taatacgactcactatagggggcgataaaggtctccttgtcaccactctcaacagaggagagagagtatggacaaggagaacctggcggcagcgcaaaagatg

SEQ ID NO: 147255 - DNA, 103 bp, Artificial Sequence
  Synthetic Polynucleotide
taatacgactcactatagggccacctcagaggcgataaaggtctccttgtaacagaggagaacaaggatgcctttatcgaacctggcggcagcgcaaaagatg

SEQ ID NO: 147256 - DNA, 103 bp, Artificial Sequence
  Synthetic Polynucleotide
taatacgactcactatagggcgccgctcttccacctcagaggcgataaagaacagaggagactttatatgctctgaggtaacctggcggcagcgcaaaagatg

SEQ ID NO: 147257 - DNA, 103 bp, Artificial Sequence
  Synthetic Polynucleotide
taatacgactcactatagggcatgcgcagccgccgctcttccacctcagaaacagaggagatctgagatggaagagcggaacctggcggcagcgcaaaagatg

SEQ ID NO: 147258 - DNA, 103 bp, Artificial Sequence
  Synthetic Polynucleotide
taatacgactcactatagggtgaggtctgccatgcgcagccgccgctcttaacagaggagaaagagcatgggctgcgcaaacctggcggcagcgcaaaagatg

SEQ ID NO: 147259 - DNA, 103 bp, Artificial Sequence
  Synthetic Polynucleotide
taatacgactcactatagggtggctgatggtgaggtctgccatgcgcagcaacagaggagagctgcgatgggcagacctaacctggcggcagcgcaaaagatg

SEQ ID NO: 147260 - DNA, 103 bp, Artificial Sequence
  Synthetic Polynucleotide
taatacgactcactatagggctctgactcgtacagttgcccaagctgttcaacagaggagagaacagatggggcaactgaacctggcggcagcgcaaaagatg

SEQ ID NO: 147261 - DNA, 103 bp, Artificial Sequence
  Synthetic Polynucleotide
taatacgactcactatagggagcagcacagtggctgatggtgaggtctgcaacagaggagagcagacatgaccatcagcaacctggcggcagcgcaaaagatg

SEQ ID NO: 147262 - DNA, 103 bp, Artificial Sequence
  Synthetic Polynucleotide
taatacgactcactataggggcacgacgtcagcagcacagtggctgatggaacagaggagaccatcaatgactgtgctgaacctggcggcagcgcaaaagatg

SEQ ID NO: 147263 - DNA, 103 bp, Artificial Sequence
  Synthetic Polynucleotide
taatacgactcactatagggctgctggcgcgcacgacgtcagcagcacagaacagaggagactgtgcatgtgacgtcgtaacctggcggcagcgcaaaagatg

SEQ ID NO: 147264 - DNA, 103 bp, Artificial Sequence
  Synthetic Polynucleotide
taatacgactcactatagggcttggcattcctgctggcgcgcacgacgtcaacagaggagagacgtcatgcgcgccagcaacctggcggcagcgcaaaagatg

SEQ ID NO: 147265 - DNA, 103 bp, Artificial Sequence
  Synthetic Polynucleotide
taatacgactcactatagggtccctttcaccttggcattcctgctggcgcaacagaggagagcgccaatgggaatgccaaacctggcggcagcgcaaaagatg

SEQ ID NO: 147266 - DNA, 103 bp, Artificial Sequence
  Synthetic Polynucleotide
taatacgactcactatagggtctcgaaacttccctttcaccttggcattcaacagaggagagaatgcatgggtgaaaggaacctggcggcagcgcaaaagatg

SEQ ID NO: 147267 - DNA, 103 bp, Artificial Sequence
  Synthetic Polynucleotide
taatacgactcactatagggaaggtaggactctcgaaacttccctttcacaacagaggagagtgaaaatgaagtttcgaaacctggcggcagcgcaaaagatg

SEQ ID NO: 147268 - DNA, 103 bp, Artificial Sequence
  Synthetic Polynucleotide
taatacgactcactataggggggcaggggaaaggtaggactctcgaaactaacagaggagaagtttcatgagtcctaccaacctggcggcagcgcaaaagatg

SEQ ID NO: 147269 - DNA, 103 bp, Artificial Sequence
  Synthetic Polynucleotide
taatacgactcactatagggttcacagactgggcaggggaaaggtaggacaacagaggagagtcctaatgttcccctgcaacctggcggcagcgcaaaagatg

SEQ ID NO: 147270 - DNA, 103 bp, Artificial Sequence
  Synthetic Polynucleotide
taatacgactcactataggggatcttcggtttcacagactgggcaggggaaacagaggagatcccctatgcagtctgtgaacctggcggcagcgcaaaagatg

SEQ ID NO: 147271 - DNA, 103 bp, Artificial Sequence
  Synthetic Polynucleotide
taatacgactcactatagggcactatcgtgctctgactcgtacagttgccaacagaggagaggcaacatgacgagtcagaacctggcggcagcgcaaaagatg

SEQ ID NO: 147272 - DNA, 103 bp, Artificial Sequence
  Synthetic Polynucleotide
taatacgactcactatagggcctcagtgttgatcttcggtttcacagactaacagaggagaagtctgatgaaccgaagaaacctggcggcagcgcaaaagatg

SEQ ID NO: 147273 - DNA, 103 bp, Artificial Sequence
  Synthetic Polynucleotide
taatacgactcactatagggggcagcttctcctcagtgttgatcttcggtaacagaggagaaccgaaatgcaacactgaaacctggcggcagcgcaaaagatg

SEQ ID NO: 147274 - DNA, 103 bp, Artificial Sequence
  Synthetic Polynucleotide
taatacgactcactatagggtttttcccggggcagcttctcctcagtgttaacagaggagaaacactatggagaagctgaacctggcggcagcgcaaaagatg

SEQ ID NO: 147275 - DNA, 103 bp, Artificial Sequence
  Synthetic Polynucleotide
taatacgactcactataggggggggttgagtttttcccggggcagcttctaacagaggagaagaagcatgcccgggaaaaacctggcggcagcgcaaaagatg

SEQ ID NO: 147276 - DNA, 103 bp, Artificial Sequence
  Synthetic Polynucleotide
taatacgactcactatagggctgggtgtaggggggttgagtttttcccggaacagaggagaccgggaatgactcaacccaacctggcggcagcgcaaaagatg

SEQ ID NO: 147277 - DNA, 103 bp, Artificial Sequence
  Synthetic Polynucleotide
taatacgactcactatagggcagatagatgctgggtgtaggggggttgagaacagaggagactcaacatgcctacacccaacctggcggcagcgcaaaagatg

SEQ ID NO: 147278 - DNA, 103 bp, Artificial Sequence
  Synthetic Polynucleotide
taatacgactcactataggggtttgctctccagatagatgctgggtgtagaacagaggagactacacatggcatctatcaacctggcggcagcgcaaaagatg

SEQ ID NO: 147279 - DNA, 103 bp, Artificial Sequence
  Synthetic Polynucleotide
taatacgactcactatagggaaggcatcccgtttgctctccagatagatgaacagaggagacatctaatgggagagcaaaacctggcggcagcgcaaaagatg

SEQ ID NO: 147280 - DNA, 103 bp, Artificial Sequence
  Synthetic Polynucleotide
taatacgactcactataggggacaggtgagaaggcatcccgtttgctctcaacagaggagagagagcatgcgggatgccaacctggcggcagcgcaaaagatg

SEQ ID NO: 147281 - DNA, 103 bp, Artificial Sequence
  Synthetic Polynucleotide
taatacgactcactatagggactgcagcaggacaggtgagaaggcatcccaacagaggagagggatgatgtctcacctgaacctggcggcagcgcaaaagatg

SEQ ID NO: 147282 - DNA, 103 bp, Artificial Sequence
  Synthetic Polynucleotide
taatacgactcactataggggtggcctcctcactatcgtgctctgactcgaacagaggagacgagtcatggcacgatagaacctggcggcagcgcaaaagatg

SEQ ID NO: 147283 - DNA, 103 bp, Artificial Sequence
  Synthetic Polynucleotide
taatacgactcactatagggtctgtacagaactgcagcaggacaggtgagaacagaggagactcaccatgcctgctgcaaacctggcggcagcgcaaaagatg

SEQ ID NO: 147284 - DNA, 103 bp, Artificial Sequence
  Synthetic Polynucleotide
taatacgactcactatagggatttcgagggtctgtacagaactgcagcagaacagaggagactgctgatgttctgtacaaacctggcggcagcgcaaaagatg

SEQ ID NO: 147285 - DNA, 103 bp, Artificial Sequence
  Synthetic Polynucleotide
taatacgactcactatagggctgtgatgggatttcgagggtctgtacagaaacagaggagatctgtaatgaccctcgaaaacctggcggcagcgcaaaagatg

SEQ ID NO: 147286 - DNA, 103 bp, Artificial Sequence
  Synthetic Polynucleotide
taatacgactcactatagggccccggatcactgtgatgggatttcgagggaacagaggagaccctcgatgtcccatcacaacctggcggcagcgcaaaagatg

SEQ ID NO: 147287 - DNA, 103 bp, Artificial Sequence
  Synthetic Polynucleotide
taatacgactcactataggggcccgccaggccccggatcactgtgatgggaacagaggagacccatcatggtgatccggaacctggcggcagcgcaaaagatg

SEQ ID NO: 147288 - DNA, 103 bp, Artificial Sequence
  Synthetic Polynucleotide
taatacgactcactataggggccgcagggagcccgccaggccccggatcaaacagaggagatgatccatggcctggcggaacctggcggcagcgcaaaagatg

SEQ ID NO: 147289 - DNA, 103 bp, Artificial Sequence
  Synthetic Polynucleotide
taatacgactcactatagggcccaagttgagccgcagggagcccgccaggaacagaggagacctggcatgctccctgcgaacctggcggcagcgcaaaagatg

SEQ ID NO: 147290 - DNA, 103 bp, Artificial Sequence
  Synthetic Polynucleotide
taatacgactcactatagggggagaagaggcccaagttgagccgcagggaaacagaggagatccctgatgctcaacttgaacctggcggcagcgcaaaagatg

SEQ ID NO: 147291 - DNA, 103 bp, Artificial Sequence
  Synthetic Polynucleotide
taatacgactcactataggggggtcttggtggagaagaggcccaagttgaaacagaggagatcaactatggcctcttctaacctggcggcagcgcaaaagatg

SEQ ID NO: 147292 - DNA, 103 bp, Artificial Sequence
  Synthetic Polynucleotide
taatacgactcactataggggcttccaccagggtcttggtggagaagaggaacagaggagacctcttatgcaccaagacaacctggcggcagcgcaaaagatg

SEQ ID NO: 147293 - DNA, 103 bp, Artificial Sequence
  Synthetic Polynucleotide
taatacgactcactataggggtagcagcgtgtggcctcctcactatcgtgaacagaggagacacgatatggaggaggccaacctggcggcagcgcaaaagatg

SEQ ID NO: 147294 - DNA, 103 bp, Artificial Sequence
  Synthetic Polynucleotide
taatacgactcactatagggttcgccactcgcttccaccagggtcttggtaacagaggagaaccaagatgctggtggaaaacctggcggcagcgcaaaagatg

SEQ ID NO: 147295 - DNA, 103 bp, Artificial Sequence
  Synthetic Polynucleotide
taatacgactcactatagggccacggtgtgttcgccactcgcttccaccaaacagaggagatggtggatgcgagtggcgaacctggcggcagcgcaaaagatg

SEQ ID NO: 147296 - DNA, 103 bp, Artificial Sequence
  Synthetic Polynucleotide
taatacgactcactataggggtgcgaacttccacggtgtgttcgccactcaacagaggagagagtggatgacacaccgtaacctggcggcagcgcaaaagatg

SEQ ID NO: 147297 - DNA, 103 bp, Artificial Sequence
  Synthetic Polynucleotide
taatacgactcactatagggctgcacctgggtgcgaacttccacggtgtgaacagaggagacacaccatggaagttcgcaacctggcggcagcgcaaaagatg

SEQ ID NO: 147298 - DNA, 103 bp, Artificial Sequence
  Synthetic Polynucleotide
taatacgactcactatagggctgagggctgctgcacctgggtgcgaacttaacagaggagaaagttcatgcccaggtgcaacctggcggcagcgcaaaagatg

SEQ ID NO: 147299 - DNA, 103 bp, Artificial Sequence
  Synthetic Polynucleotide
taatacgactcactatagggcagttctcatctgagggctgctgcacctggaacagaggagaccaggtatggcagccctcaacctggcggcagcgcaaaagatg

SEQ ID NO: 147300 - DNA, 103 bp, Artificial Sequence
  Synthetic Polynucleotide
taatacgactcactatagggtgtcagatcccagttctcatctgagggctgaacagaggagacagcccatggatgagaacaacctggcggcagcgcaaaagatg

SEQ ID NO: 147301 - DNA, 103 bp, Artificial Sequence
  Synthetic Polynucleotide
taatacgactcactataggggccgagtgcctgtcagatcccagttctcataacagaggagaatgagaatggggatctgaaacctggcggcagcgcaaaagatg

SEQ ID NO: 147302 - DNA, 103 bp, Artificial Sequence
  Synthetic Polynucleotide
taatacgactcactatagggggccagatctgccgagtgcctgtcagatccaacagaggagaggatctatgaggcactcgaacctggcggcagcgcaaaagatg

SEQ ID NO: 147303 - DNA, 103 bp, Artificial Sequence
  Synthetic Polynucleotide
taatacgactcactataggggctctcacaaggccagatctgccgagtgccaacagaggagaggcactatgcagatctggaacctggcggcagcgcaaaagatg

SEQ ID NO: 147304 - DNA, 103 bp, Artificial Sequence
  Synthetic Polynucleotide
taatacgactcactataggggggcgctgtggtagcagcgtgtggcctcctaacagaggagaaggaggatgcacgctgctaacctggcggcagcgcaaaagatg

SEQ ID NO: 147305 - DNA, 103 bp, Artificial Sequence
  Synthetic Polynucleotide
taatacgactcactataggggggaacgggagctctcacaaggccagatctaacagaggagaagatctatgcttgtgagaaacctggcggcagcgcaaaagatg

SEQ ID NO: 147306 - DNA, 103 bp, Artificial Sequence
  Synthetic Polynucleotide
taatacgactcactatagggatggtggtgtgggaacgggagctctcacaaaacagaggagattgtgaatgctcccgttcaacctggcggcagcgcaaaagatg

SEQ ID NO: 147307 - DNA, 103 bp, Artificial Sequence
  Synthetic Polynucleotide
taatacgactcactataggggtacttggcaatggtggtgtgggaacgggaaacagaggagatcccgtatgcacaccaccaacctggcggcagcgcaaaagatg

SEQ ID NO: 147308 - DNA, 103 bp, Artificial Sequence
  Synthetic Polynucleotide
taatacgactcactatagggggtactgtgcgtacttggcaatggtggtgtaacagaggagaacaccaatgttgccaagtaacctggcggcagcgcaaaagatg

SEQ ID NO: 147309 - DNA, 103 bp, Artificial Sequence
  Synthetic Polynucleotide
taatacgactcactataggggatgaggcctggtactgtgcgtacttggcaaacagaggagatgccaaatgcgcacagtaaacctggcggcagcgcaaaagatg

SEQ ID NO: 147310 - DNA, 103 bp, Artificial Sequence
  Synthetic Polynucleotide
taatacgactcactatagggctcctggaaggatgaggcctggtactgtgcaacagaggagagcacagatgcaggcctcaaacctggcggcagcgcaaaagatg

SEQ ID NO: 147311 - DNA, 103 bp, Artificial Sequence
  Synthetic Polynucleotide
taatacgactcactatagggcctgcagagactcctggaaggatgaggcctaacagaggagaaggcctatgccttccaggaacctggcggcagcgcaaaagatg

SEQ ID NO: 147312 - DNA, 103 bp, Artificial Sequence
  Synthetic Polynucleotide
taatacgactcactatagggtccttctcctcctgcagagactcctggaagaacagaggagacttccaatggtctctgcaaacctggcggcagcgcaaaagatg

SEQ ID NO: 147313 - DNA, 103 bp, Artificial Sequence
  Synthetic Polynucleotide
taatacgactcactatagggatcctcactctccttctcctcctgcagagaaacagaggagatctctgatggaggagaagaacctggcggcagcgcaaaagatg

SEQ ID NO: 147314 - DNA, 103 bp, Artificial Sequence
  Synthetic Polynucleotide
taatacgactcactatagggctgactcctcatcctcactctccttctcctaacagaggagaaggagaatgagagtgaggaacctggcggcagcgcaaaagatg

SEQ ID NO: 147315 - DNA, 103 bp, Artificial Sequence
  Synthetic Polynucleotide
taatacgactcactatagggccgtatcgaagggcgctgtggtagcagcgtaacagaggagaacgctgatgccacagcgcaacctggcggcagcgcaaaagatg

SEQ ID NO: 147316 - DNA, 103 bp, Artificial Sequence
  Synthetic Polynucleotide
taatacgactcactatagggtctggctcctctgactcctcatcctcactcaacagaggagagagtgaatgtgaggagtcaacctggcggcagcgcaaaagatg

SEQ ID NO: 147317 - DNA, 103 bp, Artificial Sequence
  Synthetic Polynucleotide
taatacgactcactatagggagtggtgctgtctggctcctctgactcctcaacagaggagagaggagatggaggagccaaacctggcggcagcgcaaaagatg

SEQ ID NO: 147318 - DNA, 103 bp, Artificial Sequence
  Synthetic Polynucleotide
taatacgactcactataggggaggggttccagtggtgctgtctggctcctaacagaggagaaggagcatgacagcaccaaacctggcggcagcgcaaaagatg

SEQ ID NO: 147319 - DNA, 103 bp, Artificial Sequence
  Synthetic Polynucleotide
taatacgactcactataggggcgctgctaggaggggttccagtggtgctgaacagaggagacagcacatgtggaaccccaacctggcggcagcgcaaaagatg

SEQ ID NO: 147320 - DNA, 103 bp, Artificial Sequence
  Synthetic Polynucleotide
taatacgactcactatagggcgggtctggtgcgctgctaggaggggttccaacagaggagaggaaccatgcctagcagcaacctggcggcagcgcaaaagatg

SEQ ID NO: 147321 - DNA, 103 bp, Artificial Sequence
  Synthetic Polynucleotide
taatacgactcactataggggatggttcttcgggtctggtgcgctgctagaacagaggagactagcaatgcaccagaccaacctggcggcagcgcaaaagatg

SEQ ID NO: 147322 - DNA, 103 bp, Artificial Sequence
  Synthetic Polynucleotide
taatacgactcactatagggttgatgatgtgatggttcttcgggtctggtaacagaggagaaccagaatggaagaaccaaacctggcggcagcgcaaaagatg

SEQ ID NO: 147323 - DNA, 103 bp, Artificial Sequence
  Synthetic Polynucleotide
taatacgactcactatagggggtgccaaacttgatgatgtgatggttcttaacagaggagaaagaacatgcacatcatcaacctggcggcagcgcaaaagatg

SEQ ID NO: 147324 - DNA, 103 bp, Artificial Sequence
  Synthetic Polynucleotide
taatacgactcactatagggagtcgatgttggtgccaaacttgatgatgtaacagaggagaacatcaatgagtttggcaaacctggcggcagcgcaaaagatg

SEQ ID NO: 147325 - DNA, 103 bp, Artificial Sequence
  Synthetic Polynucleotide
taatacgactcactataggggcatcagacaagtcgatgttggtgccaaacaacagaggagagtttggatgcaacatcgaaacctggcggcagcgcaaaagatg

SEQ ID NO: 147326 - DNA, 103 bp, Artificial Sequence
  Synthetic Polynucleotide
taatacgactcactatagggcccaagggcaaaggcttcccgtgcagcgcgaacagaggagacgcgctatgcgggaagccaacctggcggcagcgcaaaagatg

SEQ ID NO: 147327 - DNA, 103 bp, Artificial Sequence
  Synthetic Polynucleotide
taatacgactcactataggggaagcttcctccgtatcgaagggcgctgtgaacagaggagacacagcatgcttcgatacaacctggcggcagcgcaaaagatg

SEQ ID NO: 147328 - DNA, 103 bp, Artificial Sequence
  Synthetic Polynucleotide
taatacgactcactatagggccaccgcttagcatcagacaagtcgatgttaacagaggagaaacatcatgttgtctgataacctggcggcagcgcaaaagatg

SEQ ID NO: 147329 - DNA, 103 bp, Artificial Sequence
  Synthetic Polynucleotide
taatacgactcactataggggctggggcttccaccgcttagcatcagacaaacagaggagatgtctgatgctaagcggtaacctggcggcagcgcaaaagatg

SEQ ID NO: 147330 - DNA, 103 bp, Artificial Sequence
  Synthetic Polynucleotide
taatacgactcactatagggagctcctgcagctggggcttccaccgcttaaacagaggagataagcgatggaagccccaaacctggcggcagcgcaaaagatg

SEQ ID NO: 147331 - DNA, 103 bp, Artificial Sequence
  Synthetic Polynucleotide
taatacgactcactatagggcagcttcagcagctcctgcagctggggcttaacagaggagaaagcccatgctgcaggagaacctggcggcagcgcaaaagatg

SEQ ID NO: 147332 - DNA, 103 bp, Artificial Sequence
  Synthetic Polynucleotide
taatacgactcactatagggtgaaggcgggcagcttcagcagctcctgcaaacagaggagatgcaggatgtgctgaagcaacctggcggcagcgcaaaagatg

SEQ ID NO: 147333 - DNA, 103 bp, Artificial Sequence
  Synthetic Polynucleotide
taatacgactcactataggggttacccgcatgaaggcgggcagcttcagcaacagaggagagctgaaatggcccgccttaacctggcggcagcgcaaaagatg

SEQ ID NO: 147334 - DNA, 103 bp, Artificial Sequence
  Synthetic Polynucleotide
taatacgactcactataggggcccgtggatgttacccgcatgaaggcgggaacagaggagacccgccatgatgcgggtaaacctggcggcagcgcaaaagatg

SEQ ID NO: 147335 - DNA, 103 bp, Artificial Sequence
  Synthetic Polynucleotide
taatacgactcactatagggtcagcatgttgcccgtggatgttacccgcaaacagaggagatgcgggatgcatccacggaacctggcggcagcgcaaaagatg

SEQ ID NO: 147336 - DNA, 103 bp, Artificial Sequence
  Synthetic Polynucleotide
taatacgactcactatagggcccacgtggctcagcatgttgcccgtggataacagaggagaatccacatgcaacatgctaacctggcggcagcgcaaaagatg

SEQ ID NO: 147337 - DNA, 103 bp, Artificial Sequence
  Synthetic Polynucleotide
taatacgactcactataggggatggtgtggcccacgtggctcagcatgttaacagaggagaaacatgatgagccacgtgaacctggcggcagcgcaaaagatg

SEQ ID NO: 147338 - DNA, 103 bp, Artificial Sequence
  Synthetic Polynucleotide
taatacgactcactatagggccagctcagcgaagcttcctccgtatcgaaaacagaggagattcgatatggaggaagctaacctggcggcagcgcaaaagatg

SEQ ID NO: 147339 - DNA, 103 bp, Artificial Sequence
  Synthetic Polynucleotide
taatacgactcactatagggtcatgcccaggatggtgtggcccacgtggcaacagaggagagccacgatggccacaccaaacctggcggcagcgcaaaagatg

SEQ ID NO: 147340 - DNA, 103 bp, Artificial Sequence
  Synthetic Polynucleotide
taatacgactcactatagggtgcaccgtgttcatgcccaggatggtgtggaacagaggagaccacacatgcctgggcataacctggcggcagcgcaaaagatg

SEQ ID NO: 147341 - DNA, 103 bp, Artificial Sequence
  Synthetic Polynucleotide
taatacgactcactatagggcatgtacagctgcaccgtgttcatgcccagaacagaggagactgggcatgaacacggtgaacctggcggcagcgcaaaagatg

SEQ ID NO: 147342 - DNA, 103 bp, Artificial Sequence
  Synthetic Polynucleotide
taatacgactcactatagggcgggcaccttcatgtacagctgcaccgtgtaacagaggagaacacggatgagctgtacaaacctggcggcagcgcaaaagatg

SEQ ID NO: 147343 - DNA, 103 bp, Artificial Sequence
  Synthetic Polynucleotide
taatacgactcactataggggttcggctgccgggcaccttcatgtacagcaacagaggagagctgtaatggaaggtgccaacctggcggcagcgcaaaagatg

SEQ ID NO: 147344 - DNA, 103 bp, Artificial Sequence
  Synthetic Polynucleotide
taatacgactcactataggggtggcctggcgttcggctgccgggcaccttaacagaggagaaaggtgatgggcagccgaaacctggcggcagcgcaaaagatg

SEQ ID NO: 147345 - DNA, 103 bp, Artificial Sequence
  Synthetic Polynucleotide
taatacgactcactatagggtattctcctggtggcctggcgttcggctgcaacagaggagagcagccatgcgccaggccaacctggcggcagcgcaaaagatg

SEQ ID NO: 147346 - DNA, 103 bp, Artificial Sequence
  Synthetic Polynucleotide
taatacgactcactatagggcagaagttgttattctcctggtggcctggcaacagaggagagccaggatgccaggagaaaacctggcggcagcgcaaaagatg

SEQ ID NO: 147347 - DNA, 103 bp, Artificial Sequence
  Synthetic Polynucleotide
taatacgactcactataggggttgacggagcagaagttgttattctcctgaacagaggagacaggagatgaacaacttcaacctggcggcagcgcaaaagatg

SEQ ID NO: 147348 - DNA, 103 bp, Artificial Sequence
  Synthetic Polynucleotide
taatacgactcactatagggcaatgttgatgttgacggagcagaagttgtaacagaggagaacaactatggctccgtcaaacctggcggcagcgcaaaagatg

SEQ ID NO: 147349 - DNA, 103 bp, Artificial Sequence
  Synthetic Polynucleotide
taatacgactcactatagggatgcggggccccagctcagcgaagcttcctaacagaggagaaggaagatgcgctgagctaacctggcggcagcgcaaaagatg

SEQ ID NO: 147350 - DNA, 103 bp, Artificial Sequence
  Synthetic Polynucleotide
taatacgactcactatagggtcgcctgggccaatgttgatgttgacggagaacagaggagactccgtatgcatcaacataacctggcggcagcgcaaaagatg

SEQ ID NO: 147351 - DNA, 103 bp, Artificial Sequence
  Synthetic Polynucleotide
taatacgactcactatagggccactcgcagtcgcctgggccaatgttgataacagaggagaatcaacatgggcccaggcaacctggcggcagcgcaaaagatg

SEQ ID NO: 147352 - DNA, 103 bp, Artificial Sequence
  Synthetic Polynucleotide
taatacgactcactataggggcaccgcgaaccactcgcagtcgcctgggcaacagaggagagcccagatgactgcgagtaacctggcggcagcgcaaaagatg

SEQ ID NO: 147353 - DNA, 103 bp, Artificial Sequence
  Synthetic Polynucleotide
taatacgactcactatagggtagtgctcgtgcaccgcgaaccactcgcagaacagaggagactgcgaatggttcgcggtaacctggcggcagcgcaaaagatg

SEQ ID NO: 147354 - DNA, 103 bp, Artificial Sequence
  Synthetic Polynucleotide
taatacgactcactatagggggtctcccagtagtgctcgtgcaccgcgaaaacagaggagattcgcgatgcacgagcacaacctggcggcagcgcaaaagatg

SEQ ID NO: 147355 - DNA, 103 bp, Artificial Sequence
  Synthetic Polynucleotide
taatacgactcactatagggaagcgctgatggtctcccagtagtgctcgtaacagaggagaacgagcatgactgggagaaacctggcggcagcgcaaaagatg

SEQ ID NO: 147356 - DNA, 103 bp, Artificial Sequence
  Synthetic Polynucleotide
taatacgactcactatagggcgatcacagaaagcgctgatggtctcccagaacagaggagactgggaatgcatcagcgcaacctggcggcagcgcaaaagatg

SEQ ID NO: 147357 - DNA, 103 bp, Artificial Sequence
  Synthetic Polynucleotide
taatacgactcactatagggcacgccgtgccgatcacagaaagcgctgataacagaggagaatcagcatgttctgtgataacctggcggcagcgcaaaagatg

SEQ ID NO: 147358 - DNA, 103 bp, Artificial Sequence
  Synthetic Polynucleotide
taatacgactcactatagggtcaagtagtccacgccgtgccgatcacagaaacagaggagatctgtgatgggcacggcgaacctggcggcagcgcaaaagatg

SEQ ID NO: 147359 - DNA, 103 bp, Artificial Sequence
  Synthetic Polynucleotide
taatacgactcactatagggcaggaacccgtcaagtagtccacgccgtgcaacagaggagagcacggatgggactacttaacctggcggcagcgcaaaagatg

SEQ ID NO: 147360 - DNA, 103 bp, Artificial Sequence
  Synthetic Polynucleotide
taatacgactcactatagggcagtcggccaatgcggggccccagctcagcaacagaggagagctgagatggggccccgcaacctggcggcagcgcaaaagatg

SEQ ID NO: 147361 - DNA, 103 bp, Artificial Sequence
  Synthetic Polynucleotide
taatacgactcactataggggattggccaccaggaacccgtcaagtagtcaacagaggagagactacatgacgggttccaacctggcggcagcgcaaaagatg

SEQ ID NO: 147362 - DNA, 103 bp, Artificial Sequence
  Synthetic Polynucleotide
taatacgactcactataggggatcatccaggattggccaccaggaacccgaacagaggagacgggttatgggtggccaaaacctggcggcagcgcaaaagatg

SEQ ID NO: 147363 - DNA, 103 bp, Artificial Sequence
  Synthetic Polynucleotide
taatacgactcactataggggatgcatagagatcatccaggattggccacaacagaggagagtggccatgcctggatgaaacctggcggcagcgcaaaagatg

SEQ ID NO: 147364 - DNA, 103 bp, Artificial Sequence
  Synthetic Polynucleotide
taatacgactcactatagggaggaatattggatgcatagagatcatccagaacagaggagactggatatgctctatgcaaacctggcggcagcgcaaaagatg

SEQ ID NO: 147365 - DNA, 103 bp, Artificial Sequence
  Synthetic Polynucleotide
taatacgactcactatagggagcggtacacaggaatattggatgcatagaaacagaggagatctatgatgccaatattcaacctggcggcagcgcaaaagatg

SEQ ID NO: 147366 - DNA, 103 bp, Artificial Sequence
  Synthetic Polynucleotide
taatacgactcactatagggcgctgcacgaagcggtacacaggaatattgaacagaggagacaatatatgtgtgtaccgaacctggcggcagcgcaaaagatg

SEQ ID NO: 147367 - DNA, 103 bp, Artificial Sequence
  Synthetic Polynucleotide
taatacgactcactataggggtctccgggtcgctgcacgaagcggtacacaacagaggagagtgtacatgttcgtgcagaacctggcggcagcgcaaaagatg

SEQ ID NO: 147368 - DNA, 103 bp, Artificial Sequence
  Synthetic Polynucleotide
taatacgactcactatagggtccacacgaggtctccgggtcgctgcacgaaacagaggagatcgtgcatggacccggagaacctggcggcagcgcaaaagatg

SEQ ID NO: 147369 - DNA, 103 bp, Artificial Sequence
  Synthetic Polynucleotide
taatacgactcactatagggcccgcattaatccacacgaggtctccgggtaacagaggagaacccggatgcctcgtgtgaacctggcggcagcgcaaaagatg

SEQ ID NO: 147370 - DNA, 103 bp, Artificial Sequence
  Synthetic Polynucleotide
taatacgactcactataggggtgcacagtccccgcattaatccacacgagaacagaggagactcgtgatgattaatgcgaacctggcggcagcgcaaaagatg

SEQ ID NO: 147371 - DNA, 103 bp, Artificial Sequence
  Synthetic Polynucleotide
taatacgactcactataggggggcctgctgcagtcggccaatgcggggccaacagaggagaggccccatgttggccgacaacctggcggcagcgcaaaagatg

SEQ ID NO: 147372 - DNA, 103 bp, Artificial Sequence
  Synthetic Polynucleotide
taatacgactcactatagggcctgcacccagtgcacagtccccgcattaaaacagaggagattaatgatgggactgtgcaacctggcggcagcgcaaaagatg

SEQ ID NO: 147373 - DNA, 103 bp, Artificial Sequence
  Synthetic Polynucleotide
taatacgactcactatagggcagccggtggcctgcacccagtgcacagtcaacagaggagagactgtatgctgggtgcaaacctggcggcagcgcaaaagatg

SEQ ID NO: 147374 - DNA, 103 bp, Artificial Sequence
  Synthetic Polynucleotide
taatacgactcactataggggttgttgcaccagccggtggcctgcacccaaacagaggagatgggtgatggccaccggcaacctggcggcagcgcaaaagatg

SEQ ID NO: 147375 - DNA, 103 bp, Artificial Sequence
  Synthetic Polynucleotide
taatacgactcactatagggtccaggcaatgttgttgcaccagccggtggaacagaggagaccaccgatgggtgcaacaaacctggcggcagcgcaaaagatg

SEQ ID NO: 147376 - DNA, 103 bp, Artificial Sequence
  Synthetic Polynucleotide
taatacgactcactatagggggccccacgttccaggcaatgttgttgcacaacagaggagagtgcaaatgcattgcctgaacctggcggcagcgcaaaagatg

SEQ ID NO: 147377 - DNA, 103 bp, Artificial Sequence
  Synthetic Polynucleotide
taatacgactcactatagggggcggtgaggggccccacgttccaggcaataacagaggagaattgccatgaacgtggggaacctggcggcagcgcaaaagatg

SEQ ID NO: 147378 - DNA, 103 bp, Artificial Sequence
  Synthetic Polynucleotide
taatacgactcactatagggggtactgataggcggtgaggggccccacgtaacagaggagaacgtggatgccctcaccgaacctggcggcagcgcaaaagatg

SEQ ID NO: 147379 - DNA, 103 bp, Artificial Sequence
  Synthetic Polynucleotide
taatacgactcactatagggagggccagctggtactgataggcggtgaggaacagaggagacctcacatgctatcagtaaacctggcggcagcgcaaaagatg

SEQ ID NO: 147380 - DNA, 103 bp, Artificial Sequence
  Synthetic Polynucleotide
taatacgactcactataggggtatcgttccagggccagctggtactgataaacagaggagatatcagatgcagctggccaacctggcggcagcgcaaaagatg

SEQ ID NO: 147381 - DNA, 103 bp, Artificial Sequence
  Synthetic Polynucleotide
taatacgactcactatagggcattccactcgtatcgttccagggccagctaacagaggagaagctggatgtggaacgataacctggcggcagcgcaaaagatg

SEQ ID NO: 147382 - DNA, 103 bp, Artificial Sequence
  Synthetic Polynucleotide
taatacgactcactatagggttccagagctgggcctgctgcagtcggccaaacagaggagatggccgatggcagcaggcaacctggcggcagcgcaaaagatg

SEQ ID NO: 147383 - DNA, 103 bp, Artificial Sequence
  Synthetic Polynucleotide
taatacgactcactatagggttcttcacctcattccactcgtatcgttccaacagaggagaggaacgatgcgagtggaaaacctggcggcagcgcaaaagatg

SEQ ID NO: 147384 - DNA, 103 bp, Artificial Sequence
  Synthetic Polynucleotide
taatacgactcactatagggggatttgacgttcttcacctcattccactcaacagaggagagagtggatggaggtgaagaacctggcggcagcgcaaaagatg

SEQ ID NO: 147385 - DNA, 103 bp, Artificial Sequence
  Synthetic Polynucleotide
taatacgactcactatagggtgggcacgatggatttgacgttcttcacctaacagaggagaaggtgaatgacgtcaaataacctggcggcagcgcaaaagatg

SEQ ID NO: 147386 - DNA, 103 bp, Artificial Sequence
  Synthetic Polynucleotide
taatacgactcactatagggacgtgaatcatgggcacgatggatttgacgaacagaggagacgtcaaatgcatcgtgccaacctggcggcagcgcaaaagatg

SEQ ID NO: 147387 - DNA, 103 bp, Artificial Sequence
  Synthetic Polynucleotide
taatacgactcactataggggttccatgacacgtgaatcatgggcacgataacagaggagaatcgtgatgatgattcacaacctggcggcagcgcaaaagatg

SEQ ID NO: 147388 - DNA, 103 bp, Artificial Sequence
  Synthetic Polynucleotide
taatacgactcactatagggtgcgagccacgttccatgacacgtgaatcaaacagaggagatgattcatgtgtcatggaaacctggcggcagcgcaaaagatg

SEQ ID NO: 147389 - DNA, 103 bp, Artificial Sequence
  Synthetic Polynucleotide
taatacgactcactatagggattttgaccgtgcgagccacgttccatgacaacagaggagagtcatgatgcgtggctcgaacctggcggcagcgcaaaagatg

SEQ ID NO: 147390 - DNA, 103 bp, Artificial Sequence
  Synthetic Polynucleotide
taatacgactcactatagggggggtcgctgattttgaccgtgcgagccacaacagaggagagtggctatgacggtcaaaaacctggcggcagcgcaaaagatg

SEQ ID NO: 147391 - DNA, 103 bp, Artificial Sequence
  Synthetic Polynucleotide
taatacgactcactatagggtgaacaagtcggggtcgctgattttgaccgaacagaggagacggtcaatgtcagcgaccaacctggcggcagcgcaaaagatg

SEQ ID NO: 147392 - DNA, 103 bp, Artificial Sequence
  Synthetic Polynucleotide
taatacgactcactatagggttgatcatcttgaacaagtcggggtcgctgaacagaggagacagcgaatgcgacttgttaacctggcggcagcgcaaaagatg

SEQ ID NO: 147393 - DNA, 103 bp, Artificial Sequence
  Synthetic Polynucleotide
taatacgactcactatagggagtatgaaagttccagagctgggcctgctgaacagaggagacagcagatgcagctctggaacctggcggcagcgcaaaagatg

SEQ ID NO: 147394 - DNA, 103 bp, Artificial Sequence
  Synthetic Polynucleotide
taatacgactcactatagggcaggcagaacttgatcatcttgaacaagtcaacagaggagagacttgatgaagatgatcaacctggcggcagcgcaaaagatg

SEQ ID NO: 147395 - DNA, 103 bp, Artificial Sequence
  Synthetic Polynucleotide
taatacgactcactatagggtggactgcagcaggcagaacttgatcatctaacagaggagaagatgaatgagttctgccaacctggcggcagcgcaaaagatg

SEQ ID NO: 147396 - DNA, 103 bp, Artificial Sequence
  Synthetic Polynucleotide
taatacgactcactatagggcagtgcttcatggactgcagcaggcagaacaacagaggagagttctgatggctgcagtcaacctggcggcagcgcaaaagatg

SEQ ID NO: 147397 - DNA, 103 bp, Artificial Sequence
  Synthetic Polynucleotide
taatacgactcactatagggttgcacctggcagtgcttcatggactgcagaacagaggagactgcagatgatgaagcacaacctggcggcagcgcaaaagatg

SEQ ID NO: 147398 - DNA, 103 bp, Artificial Sequence
  Synthetic Polynucleotide
taatacgactcactatagggggctctcgcgttgcacctggcagtgcttcaaacagaggagatgaagcatggccaggtgcaacctggcggcagcgcaaaagatg

SEQ ID NO: 147399 - DNA, 103 bp, Artificial Sequence
  Synthetic Polynucleotide
taatacgactcactataggggcccgcaccaggctctcgcgttgcacctggaacagaggagaccaggtatgacgcgagagaacctggcggcagcgcaaaagatg

SEQ ID NO: 147400 - DNA, 103 bp, Artificial Sequence
  Synthetic Polynucleotide
taatacgactcactatagggtttcttccctgcccgcaccaggctctcgcgaacagaggagacgcgagatgctggtgcggaacctggcggcagcgcaaaagatg

SEQ ID NO: 147401 - DNA, 103 bp, Artificial Sequence
  Synthetic Polynucleotide
taatacgactcactatagggggtaagcgattttcttccctgcccgcaccaaacagaggagatggtgcatgcagggaagaaacctggcggcagcgcaaaagatg

SEQ ID NO: 147402 - DNA, 103 bp, Artificial Sequence
  Synthetic Polynucleotide
taatacgactcactatagggacacggccctggtaagcgattttcttccctaacagaggagaagggaaatgaatcgcttaaacctggcggcagcgcaaaagatg

SEQ ID NO: 147403 - DNA, 103 bp, Artificial Sequence
  Synthetic Polynucleotide
taatacgactcactatagggctcgtccttgacacggccctggtaagcgataacagaggagaatcgctatgcagggccgtaacctggcggcagcgcaaaagatg

SEQ ID NO: 147404 - DNA, 103 bp, Artificial Sequence
  Synthetic Polynucleotide
taatacgactcactatagggggcaggagccagtatgaaagttccagagctaacagaggagaagctctatgactttcataaacctggcggcagcgcaaaagatg

SEQ ID NO: 147405 - DNA, 103 bp, Artificial Sequence
  Synthetic Polynucleotide
taatacgactcactatagggagtaggctggctcgtccttgacacggccctaacagaggagaagggccatgtcaaggacgaacctggcggcagcgcaaaagatg

SEQ ID NO: 147406 - DNA, 103 bp, Artificial Sequence
  Synthetic Polynucleotide
taatacgactcactatagggtcgttgcagtagtaggctggctcgtccttgaacagaggagacaaggaatggccagcctaaacctggcggcagcgcaaaagatg

SEQ ID NO: 147407 - DNA, 103 bp, Artificial Sequence
  Synthetic Polynucleotide
taatacgactcactatagggcacatcgcactcgttgcagtagtaggctggaacagaggagaccagccatgtactgcaacaacctggcggcagcgcaaaagatg

SEQ ID NO: 147408 - DNA, 103 bp, Artificial Sequence
  Synthetic Polynucleotide
taatacgactcactatagggtaaacacctccacatcgcactcgttgcagtaacagaggagaactgcaatgagtgcgatgaacctggcggcagcgcaaaagatg

SEQ ID NO: 147409 - DNA, 103 bp, Artificial Sequence
  Synthetic Polynucleotide
taatacgactcactatagggaacaggatgttaaacacctccacatcgcacaacagaggagagtgcgaatgggaggtgttaacctggcggcagcgcaaaagatg

SEQ ID NO: 147410 - DNA, 103 bp, Artificial Sequence
  Synthetic Polynucleotide
taatacgactcactatagggacttgtcacgaacaggatgttaaacacctcaacagaggagagaggtgatgaacatcctgaacctggcggcagcgcaaaagatg

SEQ ID NO: 147411 - DNA, 103 bp, Artificial Sequence
  Synthetic Polynucleotide
taatacgactcactatagggtgccattctcacttgtcacgaacaggatgtaacagaggagaacatccatgtcgtgacaaaacctggcggcagcgcaaaagatg

SEQ ID NO: 147412 - DNA, 103 bp, Artificial Sequence
  Synthetic Polynucleotide
taatacgactcactataggggtgttgcggctgccattctcacttgtcacgaacagaggagacgtgacatgtgagaatggaacctggcggcagcgcaaaagatg

SEQ ID NO: 147413 - DNA, 103 bp, Artificial Sequence
  Synthetic Polynucleotide
taatacgactcactatagggtaccaggtacgtgttgcggctgccattctcaacagaggagagagaatatgagccgcaacaacctggcggcagcgcaaaagatg

SEQ ID NO: 147414 - DNA, 103 bp, Artificial Sequence
  Synthetic Polynucleotide
taatacgactcactatagggcctcgcagtgtaccaggtacgtgttgcggcaacagaggagagccgcaatgcgtacctggaacctggcggcagcgcaaaagatg

SEQ ID NO: 147415 - DNA, 103 bp, Artificial Sequence
  Synthetic Polynucleotide
taatacgactcactataggggctcggtgctggcaggagccagtatgaaagaacagaggagactttcaatgtggctcctgaacctggcggcagcgcaaaagatg

SEQ ID NO: 147416 - DNA, 103 bp, Artificial Sequence
  Synthetic Polynucleotide
taatacgactcactatagggcgggcacagccctcgcagtgtaccaggtacaacagaggagagtacctatgacactgcgaaacctggcggcagcgcaaaagatg

SEQ ID NO: 147417 - DNA, 103 bp, Artificial Sequence
  Synthetic Polynucleotide
taatacgactcactataggggctgcggcgccgggcacagccctcgcagtgaacagaggagacactgcatgggctgtgccaacctggcggcagcgcaaaagatg

SEQ ID NO: 147418 - DNA, 103 bp, Artificial Sequence
  Synthetic Polynucleotide
taatacgactcactataggggcaggcctgcgctgcggcgccgggcacagcaacagaggagagctgtgatgggcgccgcaaacctggcggcagcgcaaaagatg

SEQ ID NO: 147419 - DNA, 103 bp, Artificial Sequence
  Synthetic Polynucleotide
taatacgactcactatagggaccacgccctgcaggcctgcgctgcggcgcaacagaggagagcgccgatgcgcaggcctaacctggcggcagcgcaaaagatg

SEQ ID NO: 147420 - DNA, 103 bp, Artificial Sequence
  Synthetic Polynucleotide
taatacgactcactatagggctccagcaccaccacgccctgcaggcctgcaacagaggagagcaggcatgcagggcgtgaacctggcggcagcgcaaaagatg

SEQ ID NO: 147421 - DNA, 103 bp, Artificial Sequence
  Synthetic Polynucleotide
taatacgactcactatagggtgcggtactgctccagcaccaccacgccctaacagaggagaagggcgatgtggtgctggaacctggcggcagcgcaaaagatg

SEQ ID NO: 147422 - DNA, 103 bp, Artificial Sequence
  Synthetic Polynucleotide
taatacgactcactatagggagctcctcagtgcggtactgctccagcaccaacagaggagaggtgctatggcagtaccgaacctggcggcagcgcaaaagatg

SEQ ID NO: 147423 - DNA, 103 bp, Artificial Sequence
  Synthetic Polynucleotide
taatacgactcactatagggggcctgagccagctcctcagtgcggtactgaacagaggagacagtacatgactgaggagaacctggcggcagcgcaaaagatg

SEQ ID NO: 147424 - DNA, 103 bp, Artificial Sequence
  Synthetic Polynucleotide
taatacgactcactatagggaggcgtcgtaggcctgagccagctcctcagaacagaggagactgaggatgtggctcaggaacctggcggcagcgcaaaagatg

SEQ ID NO: 147425 - DNA, 103 bp, Artificial Sequence
  Synthetic Polynucleotide
taatacgactcactatagggaccagcgtgaaggcgtcgtaggcctgagccaacagaggagaggctcaatgctacgacgcaacctggcggcagcgcaaaagatg

SEQ ID NO: 147426 - DNA, 103 bp, Artificial Sequence
  Synthetic Polynucleotide
taatacgactcactatagggcaggaccttggctcggtgctggcaggagccaacagaggagaggctccatgcagcaccgaaacctggcggcagcgcaaaagatg

SEQ ID NO: 147427 - DNA, 103 bp, Artificial Sequence
  Synthetic Polynucleotide
taatacgactcactatagggccgggccctcaccagcgtgaaggcgtcgtaaacagaggagatacgacatgttcacgctgaacctggcggcagcgcaaaagatg

SEQ ID NO: 147428 - DNA, 103 bp, Artificial Sequence
  Synthetic Polynucleotide
taatacgactcactatagggcgcgcgcccgccgggccctcaccagcgtgaaacagaggagatcacgcatgtgagggcccaacctggcggcagcgcaaaagatg

SEQ ID NO: 147429 - DNA, 103 bp, Artificial Sequence
  Synthetic Polynucleotide
taatacgactcactatagggctccgctgcccgcgcgcccgccgggccctcaacagaggagagagggcatggcgggcgcgaacctggcggcagcgcaaaagatg

SEQ ID NO: 147430 - DNA, 103 bp, Artificial Sequence
  Synthetic Polynucleotide
taatacgactcactatagggcagtgccctcctccgctgcccgcgcgcccgaacagaggagacgggcgatggggcagcggaacctggcggcagcgcaaaagatg

SEQ ID NO: 147431 - DNA, 103 bp, Artificial Sequence
  Synthetic Polynucleotide
taatacgactcactatagggcagcctgccccagtgccctcctccgctgccaacagaggagaggcagcatgggagggcacaacctggcggcagcgcaaaagatg

SEQ ID NO: 147432 - DNA, 103 bp, Artificial Sequence
  Synthetic Polynucleotide
taatacgactcactatagggcccgtccctgcagcctgccccagtgccctcaacagaggagagagggcatgggggcaggcaacctggcggcagcgcaaaagatg

SEQ ID NO: 147433 - DNA, 103 bp, Artificial Sequence
  Synthetic Polynucleotide
taatacgactcactataggggctcccgaagcccgtccctgcagcctgcccaacagaggagagggcagatggcagggacgaacctggcggcagcgcaaaagatg

SEQ ID NO: 147434 - DNA, 103 bp, Artificial Sequence
  Synthetic Polynucleotide
taatacgactcactataggggcgcggccgggctcccgaagcccgtccctgaacagaggagacagggaatggcttcgggaaacctggcggcagcgcaaaagatg

SEQ ID NO: 147435 - DNA, 103 bp, Artificial Sequence
  Synthetic Polynucleotide
taatacgactcactatagggtcagggaaaggcgcggccgggctcccgaagaacagaggagacttcggatgcccggccgcaacctggcggcagcgcaaaagatg

SEQ ID NO: 147436 - DNA, 103 bp, Artificial Sequence
  Synthetic Polynucleotide
taatacgactcactatagggcggcgggggctcagggaaaggcgcggccggaacagaggagaccggccatgcctttccctaacctggcggcagcgcaaaagatg

SEQ ID NO: 147437 - DNA, 103 bp, Artificial Sequence
  Synthetic Polynucleotide
taatacgactcactatagggagctcaggcccccaagggcaaaggcttcccaacagaggagagggaagatgttgcccttgaacctggcggcagcgcaaaagatg

SEQ ID NO: 147438 - DNA, 103 bp, Artificial Sequence
  Synthetic Polynucleotide
taatacgactcactatagggccagtgggggcaggaccttggctcggtgctaacagaggagaagcaccatgccaaggtccaacctggcggcagcgcaaaagatg

SEQ ID NO: 147439 - DNA, 103 bp, Artificial Sequence
  Synthetic Polynucleotide
taatacgactcactataggggggagaaagccggcgggggctcagggaaagaacagaggagactttccatgagcccccgcaacctggcggcagcgcaaaagatg

SEQ ID NO: 147440 - DNA, 103 bp, Artificial Sequence
  Synthetic Polynucleotide
taatacgactcactatagggggggcctggggggagaaagccggcgggggcaacagaggagagcccccatgggctttctcaacctggcggcagcgcaaaagatg

SEQ ID NO: 147441 - DNA, 103 bp, Artificial Sequence
  Synthetic Polynucleotide
taatacgactcactatagggcgtgctggctggggcctggggggagaaagcaacagaggagagctttcatgccccaggccaacctggcggcagcgcaaaagatg

SEQ ID NO: 147442 - DNA, 103 bp, Artificial Sequence
  Synthetic Polynucleotide
taatacgactcactatagggcacacttgctccagtgggggcaggaccttgaacagaggagacaaggtatggcccccactaacctggcggcagcgcaaaagatg

SEQ ID NO: 147443 - DNA, 103 bp, Artificial Sequence
  Synthetic Polynucleotide
taatacgactcactatagggtagcaagttccacacttgctccagtgggggaacagaggagacccccaatggagcaagtgaacctggcggcagcgcaaaagatg

SEQ ID NO: 147444 - DNA, 103 bp, Artificial Sequence
  Synthetic Polynucleotide
taatacgactcactataggggctcaaggtgtagcaagttccacacttgctaacagaggagaagcaagatgggaacttgcaacctggcggcagcgcaaaagatg

SEQ ID NO: 147445 - DNA, 103 bp, Artificial Sequence
  Synthetic Polynucleotide
taatacgactcactatagggttccgtttgtgctcaaggtgtagcaagttcaacagaggagagaacttatgacaccttgaaacctggcggcagcgcaaaagatg

SEQ ID NO: 147446 - DNA, 103 bp, Artificial Sequence
  Synthetic Polynucleotide
taatacgactcactatagggggctccatagttccgtttgtgctcaaggtgaacagaggagacaccttatgcacaaacggaacctggcggcagcgcaaaagatg

SEQ ID NO: 147447 - DNA, 103 bp, Artificial Sequence
  Synthetic Polynucleotide
taatacgactcactatagggctccccgcttggctccatagttccgtttgtaacagaggagaacaaacatgactatggagaacctggcggcagcgcaaaagatg

SEQ ID NO: 147448 - DNA, 103 bp, Artificial Sequence
  Synthetic Polynucleotide
taatacgactcactatagggaccgggggacctccccgcttggctccatagaacagaggagactatggatgcaagcggggaacctggcggcagcgcaaaagatg

SEQ ID NO: 147449 - DNA, 103 bp, Artificial Sequence
  Synthetic Polynucleotide
taatacgactcactatagggagctcgcttcaccgggggacctccccgcttaacagaggagaaagcggatgggtcccccgaacctggcggcagcgcaaaagatg

SEQ ID NO: 147450 - DNA, 103 bp, Artificial Sequence
  Synthetic Polynucleotide
taatacgactcactatagggggggttcagcagctcgcttcaccgggggacaacagaggagagtccccatgtgaagcgagaacctggcggcagcgcaaaagatg

SEQ ID NO: 147451 - DNA, 103 bp, Artificial Sequence
  Synthetic Polynucleotide
taatacgactcactataggggccccagcacagctcaggcccccaagggcaaacagaggagatgccctatggggcctgagaacctggcggcagcgcaaaagatg

SEQ ID NO: 147452 - DNA, 103 bp, Artificial Sequence
  Synthetic Polynucleotide
taatacgactcactatagggtgcaccactgggggttcagcagctcgcttcaacagaggagagaagcgatgtgctgaaccaacctggcggcagcgcaaaagatg

SEQ ID NO: 147453 - DNA, 103 bp, Artificial Sequence
  Synthetic Polynucleotide
taatacgactcactatagggaggcacaggctgcaccactgggggttcagcaacagaggagagctgaaatgccagtggtgaacctggcggcagcgcaaaagatg

SEQ ID NO: 147454 - DNA, 103 bp, Artificial Sequence
  Synthetic Polynucleotide
taatacgactcactataggggtgctgcaggaggcacaggctgcaccactgaacagaggagacagtggatgagcctgtgcaacctggcggcagcgcaaaagatg

SEQ ID NO: 147455 - DNA, 103 bp, Artificial Sequence
  Synthetic Polynucleotide
taatacgactcactataggggggcctgagagtgctgcaggaggcacaggcaacagaggagagcctgtatgtcctgcagcaacctggcggcagcgcaaaagatg

SEQ ID NO: 147456 - DNA, 103 bp, Artificial Sequence
  Synthetic Polynucleotide
taatacgactcactatagggctcccctgaggggcctgagagtgctgcaggaacagaggagacctgcaatgctctcaggcaacctggcggcagcgcaaaagatg

SEQ ID NO: 147457 - DNA, 103 bp, Artificial Sequence
  Synthetic Polynucleotide
taatacgactcactatagggtgaggccctcctcccctgaggggcctgagaaacagaggagatctcagatgcctcaggggaacctggcggcagcgcaaaagatg

SEQ ID NO: 147458 - DNA, 103 bp, Artificial Sequence
  Synthetic Polynucleotide
taatacgactcactatagggcctccagggctgaggccctcctcccctgagaacagaggagactcaggatgggagggcctaacctggcggcagcgcaaaagatg

SEQ ID NO: 147459 - DNA, 103 bp, Artificial Sequence
  Synthetic Polynucleotide
taatacgactcactatagggccttcgcttgcctccagggctgaggccctcaacagaggagagagggcatgagccctggaaacctggcggcagcgcaaaagatg

SEQ ID NO: 147460 - DNA, 103 bp, Artificial Sequence
  Synthetic Polynucleotide
taatacgactcactatagggtgcagcctctccttcgcttgcctccagggcaacagaggagagccctgatggcaagcgaaaacctggcggcagcgcaaaagatg

SEQ ID NO: 147461 - DNA, 103 bp, Artificial Sequence
  Synthetic Polynucleotide
taatacgactcactatagggtgttcagagttgcagcctctccttcgcttgaacagaggagacaagcgatggagaggctgaacctggcggcagcgcaaaagatg

SEQ ID NO: 147462 - DNA, 103 bp, Artificial Sequence
  Synthetic Polynucleotide
taatacgactcactatagggggagctccaggccccagcacagctcaggccaacagaggagaggcctgatgtgtgctgggaacctggcggcagcgcaaaagatg

SEQ ID NO: 147463 - DNA, 103 bp, Artificial Sequence
  Synthetic Polynucleotide
taatacgactcactatagggaaggccagtctgttcagagttgcagcctctaacagaggagaagaggcatgaactctgaaaacctggcggcagcgcaaaagatg

SEQ ID NO: 147464 - DNA, 103 bp, Artificial Sequence
  Synthetic Polynucleotide
taatacgactcactataggggccctgggggaaggccagtctgttcagagtaacagaggagaactctgatgagactggccaacctggcggcagcgcaaaagatg

SEQ ID NO: 147465 - DNA, 103 bp, Artificial Sequence
  Synthetic Polynucleotide
taatacgactcactatagggggcagtggcagccctgggggaaggccagtcaacagaggagagactggatgtcccccaggaacctggcggcagcgcaaaagatg

SEQ ID NO: 147466 - DNA, 103 bp, Artificial Sequence
  Synthetic Polynucleotide
taatacgactcactatagggtggtggtggaggcagtggcagccctgggggaacagaggagacccccaatgctgccactgaacctggcggcagcgcaaaagatg

SEQ ID NO: 147467 - DNA, 103 bp, Artificial Sequence
  Synthetic Polynucleotide
taatacgactcactataggggtggtggtaatggtggtggaggcagtggcaaacagaggagatgccacatgctccaccacaacctggcggcagcgcaaaagatg

SEQ ID NO: 147468 - DNA, 103 bp, Artificial Sequence
  Synthetic Polynucleotide
taatacgactcactatagggggtggtggtggtggtggtaatggtggtggaaacagaggagatccaccatgattaccaccaacctggcggcagcgcaaaagatg

SEQ ID NO: 147469 - DNA, 103 bp, Artificial Sequence
  Synthetic Polynucleotide
taatacgactcactatagggtggtggtggtggtggtggtggtggtggtaaaacagaggagattaccaatgccaccaccaaacctggcggcagcgcaaaagatg

SEQ ID NO: 147470 - DNA, 103 bp, Artificial Sequence; identical to SEQ ID NO: 98481
  Synthetic Polynucleotide

SEQ ID NO: 147471 - DNA, 103 bp, Artificial Sequence
  Synthetic Polynucleotide
taatacgactcactatagggccaggcaggggtggtggtggtggtggtggtaacagaggagaaccaccatgaccaccaccaacctggcggcagcgcaaaagatg

SEQ ID NO: 147472 - DNA, 103 bp, Artificial Sequence
  Synthetic Polynucleotide
taatacgactcactatagggggtagccaggccaggcaggggtggtggtggaacagaggagaccaccaatgcccctgcctaacctggcggcagcgcaaaagatg

SEQ ID NO: 147473 - DNA, 103 bp, Artificial Sequence
  Synthetic Polynucleotide
taatacgactcactataggggaggcgggcaggagctccaggccccagcacaacagaggagagtgctgatgcctggagctaacctggcggcagcgcaaaagatg

SEQ ID NO: 147474 - DNA, 103 bp, Artificial Sequence
  Synthetic Polynucleotide
taatacgactcactatagggatggggggctggtagccaggccaggcagggaacagaggagaccctgcatggcctggctaaacctggcggcagcgcaaaagatg

SEQ ID NO: 147475 - DNA, 103 bp, Artificial Sequence
  Synthetic Polynucleotide
taatacgactcactataggggttagctgaaatggggggctggtagccaggaacagaggagacctggcatgcagccccccaacctggcggcagcgcaaaagatg

SEQ ID NO: 147476 - DNA, 103 bp, Artificial Sequence
  Synthetic Polynucleotide
taatacgactcactatagggccctggcttggttagctgaaatggggggctaacagaggagaagccccatgtttcagctaaacctggcggcagcgcaaaagatg

SEQ ID NO: 147477 - DNA, 103 bp, Artificial Sequence
  Synthetic Polynucleotide
taatacgactcactatagggtactccacagccctggcttggttagctgaaaacagaggagattcagcatgccaagccagaacctggcggcagcgcaaaagatg

SEQ ID NO: 147478 - DNA, 103 bp, Artificial Sequence
  Synthetic Polynucleotide
taatacgactcactatagggccatgcagggtactccacagccctggcttgaacagaggagacaagccatggctgtggagaacctggcggcagcgcaaaagatg

SEQ ID NO: 147479 - DNA, 103 bp, Artificial Sequence
  Synthetic Polynucleotide
taatacgactcactatagggccaggcatctccatgcagggtactccacagaacagaggagactgtggatgaccctgcataacctggcggcagcgcaaaagatg

SEQ ID NO: 147480 - DNA, 103 bp, Artificial Sequence
  Synthetic Polynucleotide
taatacgactcactataggggctctgggccccaggcatctccatgcagggaacagaggagaccctgcatggagatgcctaacctggcggcagcgcaaaagatg

SEQ ID NO: 147481 - DNA, 103 bp, Artificial Sequence
  Synthetic Polynucleotide
taatacgactcactataggggaacccttgcgctctgggccccaggcatctaacagaggagaagatgcatggggcccagaaacctggcggcagcgcaaaagatg

SEQ ID NO: 147482 - DNA, 103 bp, Artificial Sequence
  Synthetic Polynucleotide
taatacgactcactatagggtgggggtgctgaacccttgcgctctgggccaacagaggagaggcccaatgcgcaagggtaacctggcggcagcgcaaaagatg

SEQ ID NO: 147483 - DNA, 103 bp, Artificial Sequence
  Synthetic Polynucleotide
taatacgactcactatagggcctggcgctctgggggtgctgaacccttgcaacagaggagagcaaggatgcagcaccccaacctggcggcagcgcaaaagatg

SEQ ID NO: 147484 - DNA, 103 bp, Artificial Sequence
  Synthetic Polynucleotide
taatacgactcactatagggggagggggatgaggcgggcaggagctccagaacagaggagactggagatgctgcccgccaacctggcggcagcgcaaaagatg

SEQ ID NO: 147485 - DNA, 103 bp, Artificial Sequence
  Synthetic Polynucleotide
taatacgactcactatagggtgccgctgctcctggcgctctgggggtgctaacagaggagaagcaccatgagagcgccaaacctggcggcagcgcaaaagatg

SEQ ID NO: 147486 - DNA, 103 bp, Artificial Sequence
  Synthetic Polynucleotide
taatacgactcactatagggaggcagcgagtgccgctgctcctggcgctcaacagaggagagagcgcatggagcagcggaacctggcggcagcgcaaaagatg

SEQ ID NO: 147487 - DNA, 103 bp, Artificial Sequence
  Synthetic Polynucleotide
taatacgactcactataggggatatgggtgaggcagcgagtgccgctgctaacagaggagaagcagcatgactcgctgcaacctggcggcagcgcaaaagatg

SEQ ID NO: 147488 - DNA, 103 bp, Artificial Sequence
  Synthetic Polynucleotide
taatacgactcactataggggctgggtatggatatgggtgaggcagcgagaacagaggagactcgctatgtcacccataaacctggcggcagcgcaaaagatg

SEQ ID NO: 147489 - DNA, 103 bp, Artificial Sequence
  Synthetic Polynucleotide
taatacgactcactataggggtacgctggagctgggtatggatatgggtgaacagaggagacacccaatgccatacccaaacctggcggcagcgcaaaagatg

SEQ ID NO: 147490 - DNA, 103 bp, Artificial Sequence
  Synthetic Polynucleotide
taatacgactcactatagggggtgcgcggtgtacgctggagctgggtatgaacagaggagacataccatgctccagcgtaacctggcggcagcgcaaaagatg

SEQ ID NO: 147491 - DNA, 103 bp, Artificial Sequence
  Synthetic Polynucleotide
taatacgactcactatagggtggccaggggggtgcgcggtgtacgctggaaacagaggagatccagcatgcaccgcgcaaacctggcggcagcgcaaaagatg

SEQ ID NO: 147492 - DNA, 103 bp, Artificial Sequence
  Synthetic Polynucleotide
taatacgactcactataggggaccagccggtggccaggggggtgcgcggtaacagaggagaaccgcgatgccccctggcaacctggcggcagcgcaaaagatg

SEQ ID NO: 147493 - DNA, 103 bp, Artificial Sequence
  Synthetic Polynucleotide
taatacgactcactataggggagcagccgggaccagccggtggccaggggaacagaggagacccctgatgaccggctggaacctggcggcagcgcaaaagatg

SEQ ID NO: 147494 - DNA, 103 bp, Artificial Sequence
  Synthetic Polynucleotide
taatacgactcactataggggggcctgggggagcagccgggaccagccggaacagaggagaccggctatgcccggctgcaacctggcggcagcgcaaaagatg

SEQ ID NO: 147495 - DNA, 103 bp, Artificial Sequence
  Synthetic Polynucleotide
taatacgactcactatagggggagggcaaggcggtctcggctgtggccataacagaggagaatggccatggccgagaccaacctggcggcagcgcaaaagatg

SEQ ID NO: 147496 - DNA, 103 bp, Artificial Sequence
  Synthetic Polynucleotide
taatacgactcactataggggcccatgtcctgcgcctcttcggagcgccaaacagaggagatggcgcatggaagaggcgaacctggcggcagcgcaaaagatg

SEQ ID NO: 147497 - DNA, 103 bp, Artificial Sequence
  Synthetic Polynucleotide
taatacgactcactataggggcggaaggggcgctgccccgtgtgtttccgaacagaggagacggaaaatgacggggcagaacctggcggcagcgcaaaagatg

SEQ ID NO: 147498 - DNA, 103 bp, Artificial Sequence
  Synthetic Polynucleotide
taatacgactcactatagggagagctggcagcggaaggggcgctgccccgaacagaggagacggggcatggccccttccaacctggcggcagcgcaaaagatg

SEQ ID NO: 147499 - DNA, 103 bp, Artificial Sequence
  Synthetic Polynucleotide
taatacgactcactataggggcacgtgggcagagctggcagcggaaggggaacagaggagaccccttatgctgccagctaacctggcggcagcgcaaaagatg

SEQ ID NO: 147500 - DNA, 103 bp, Artificial Sequence
  Synthetic Polynucleotide
taatacgactcactataggggcgcgaaaaagcacgtgggcagagctggcaaacagaggagatgccagatgtgcccacgtaacctggcggcagcgcaaaagatg

SEQ ID NO: 147501 - DNA, 103 bp, Artificial Sequence
  Synthetic Polynucleotide
taatacgactcactatagggggtggtcagagcgcgaaaaagcacgtgggcaacagaggagagcccacatgctttttcgcaacctggcggcagcgcaaaagatg

SEQ ID NO: 147502 - DNA, 103 bp, Artificial Sequence
  Synthetic Polynucleotide
taatacgactcactatagggtgcaaggccaggtggtcagagcgcgaaaaaaacagaggagatttttcatgctctgaccaaacctggcggcagcgcaaaagatg

SEQ ID NO: 147503 - DNA, 103 bp, Artificial Sequence
  Synthetic Polynucleotide
taatacgactcactataggggcgcttcatgtgcaaggccaggtggtcagaaacagaggagatctgacatgctggccttgaacctggcggcagcgcaaaagatg

SEQ ID NO: 147504 - DNA, 103 bp, Artificial Sequence
  Synthetic Polynucleotide
taatacgactcactataggggaggacccgggcccatgtcctgcgcctcttaacagaggagaaagaggatgaggacatggaacctggcggcagcgcaaaagatg

SEQ ID NO: 147505 - DNA, 103 bp, Artificial Sequence
  Synthetic Polynucleotide
taatacgactcactataggggtggggtcaggaggacccgggcccatgtccaacagaggagaggacatatgcccgggtccaacctggcggcagcgcaaaagatg

SEQ ID NO: 147506 - DNA, 103 bp, Artificial Sequence
  Synthetic Polynucleotide
taatacgactcactataggggggcggctccgtggggtcaggaggacccggaacagaggagaccgggtatgcctgaccccaacctggcggcagcgcaaaagatg

SEQ ID NO: 147507 - DNA, 103 bp, Artificial Sequence
  Synthetic Polynucleotide
taatacgactcactatagggtcacgtggaggggcggctccgtggggtcagaacagaggagactgaccatgcggagccgcaacctggcggcagcgcaaaagatg

SEQ ID NO: 147508 - DNA, 103 bp, Artificial Sequence
  Synthetic Polynucleotide
taatacgactcactatagggtcctcagacttcacgtggaggggcggctccaacagaggagaggagccatgcctccacgtaacctggcggcagcgcaaaagatg

SEQ ID NO: 147509 - DNA, 103 bp, Artificial Sequence
  Synthetic Polynucleotide
taatacgactcactatagggcccgggctggtcctcagacttcacgtggagaacagaggagactccacatgaagtctgagaacctggcggcagcgcaaaagatg

SEQ ID NO: 147510 - DNA, 103 bp, Artificial Sequence
  Synthetic Polynucleotide
taatacgactcactatagggcctcttcctccccgggctggtcctcagactaacagaggagaagtctgatgaccagcccgaacctggcggcagcgcaaaagatg

SEQ ID NO: 147511 - DNA, 103 bp, Artificial Sequence
  Synthetic Polynucleotide
taatacgactcactatagggctctcatcgtcctcttcctccccgggctggaacagaggagaccagccatgggaggaagaaacctggcggcagcgcaaaagatg

SEQ ID NO: 147512 - DNA, 103 bp, Artificial Sequence
  Synthetic Polynucleotide
taatacgactcactataggggtccgcgcccctctcatcgtcctcttcctcaacagaggagagaggaaatggacgatgagaacctggcggcagcgcaaaagatg

SEQ ID NO: 147513 - DNA, 103 bp, Artificial Sequence
  Synthetic Polynucleotide
taatacgactcactataggggtgtgctgatggagggcaaggcggtctcggaacagaggagaccgagaatgccttgccctaacctggcggcagcgcaaaagatg

SEQ ID NO: 147514 - DNA, 103 bp, Artificial Sequence
  Synthetic Polynucleotide
taatacgactcactatagggcccaggtggcgtccgcgcccctctcatcgtaacagaggagaacgatgatgggggcgcggaacctggcggcagcgcaaaagatg

SEQ ID NO: 147515 - DNA, 103 bp, Artificial Sequence
  Synthetic Polynucleotide
taatacgactcactatagggagatccaggtcccaggtggcgtccgcgcccaacagaggagagggcgcatgcgccacctgaacctggcggcagcgcaaaagatg

SEQ ID NO: 147516 - DNA, 103 bp, Artificial Sequence
  Synthetic Polynucleotide
taatacgactcactatagggggtgaggaggagatccaggtcccaggtggcaacagaggagagccaccatggacctggataacctggcggcagcgcaaaagatg

SEQ ID NO: 147517 - DNA, 103 bp, Artificial Sequence
  Synthetic Polynucleotide
taatacgactcactatagggccgagaagttggtgaggaggagatccaggtaacagaggagaacctggatgtcctcctcaaacctggcggcagcgcaaaagatg

SEQ ID NO: 147518 - DNA, 103 bp, Artificial Sequence
  Synthetic Polynucleotide
taatacgactcactatagggggctccgggcccgagaagttggtgaggaggaacagaggagacctcctatgcaacttctcaacctggcggcagcgcaaaagatg

SEQ ID NO: 147519 - DNA, 103 bp, Artificial Sequence
  Synthetic Polynucleotide
taatacgactcactatagggcgcgccaccgggctccgggcccgagaagttaacagaggagaaacttcatgggcccggagaacctggcggcagcgcaaaagatg

SEQ ID NO: 147520 - DNA, 103 bp, Artificial Sequence
  Synthetic Polynucleotide
taatacgactcactatagggaggtctggggcgcgccaccgggctccgggcaacagaggagagcccggatgccggtggcgaacctggcggcagcgcaaaagatg

SEQ ID NO: 147521 - DNA, 103 bp, Artificial Sequence
  Synthetic Polynucleotide
taatacgactcactataggggccagagcgcaggtctggggcgcgccaccgaacagaggagacggtggatggccccagacaacctggcggcagcgcaaaagatg

SEQ ID NO: 147522 - DNA, 103 bp, Artificial Sequence
  Synthetic Polynucleotide
taatacgactcactatagggctcgctgggcgccagagcgcaggtctggggaacagaggagaccccagatgtgcgctctgaacctggcggcagcgcaaaagatg

SEQ ID NO: 147523 - DNA, 103 bp, Artificial Sequence
  Synthetic Polynucleotide
taatacgactcactatagggccccggaggcctcgctgggcgccagagcgcaacagaggagagcgctcatgcgcccagcgaacctggcggcagcgcaaaagatg

SEQ ID NO: 147524 - DNA, 103 bp, Artificial Sequence
  Synthetic Polynucleotide
taatacgactcactatagggagggcggtcagtgtgctgatggagggcaagaacagaggagacttgccatgcatcagcacaacctggcggcagcgcaaaagatg

SEQ ID NO: 147525 - DNA, 103 bp, Artificial Sequence
  Synthetic Polynucleotide
taatacgactcactatagggggatattgcgccccggaggcctcgctgggcaacagaggagagcccagatgggcctccggaacctggcggcagcgcaaaagatg

SEQ ID NO: 147526 - DNA, 103 bp, Artificial Sequence
  Synthetic Polynucleotide
taatacgactcactataggggggcggcggcggatattgcgccccggaggcaacagaggagagcctccatggcgcaatataacctggcggcagcgcaaaagatg

SEQ ID NO: 147527 - DNA, 103 bp, Artificial Sequence
  Synthetic Polynucleotide
taatacgactcactatagggccagagtctcgggcggcggcggatattgcgaacagaggagacgcaatatgcgccgccgcaacctggcggcagcgcaaaagatg

SEQ ID NO: 147528 - DNA, 103 bp, Artificial Sequence
  Synthetic Polynucleotide
taatacgactcactataggggcatatgcgcccagagtctcgggcggcggcaacagaggagagccgccatgcgagactctaacctggcggcagcgcaaaagatg

SEQ ID NO: 147529 - DNA, 103 bp, Artificial Sequence
  Synthetic Polynucleotide
taatacgactcactatagggcgggccgccagcatatgcgcccagagtctcaacagaggagagagactatgggcgcatataacctggcggcagcgcaaaagatg

SEQ ID NO: 147530 - DNA, 103 bp, Artificial Sequence
  Synthetic Polynucleotide
taatacgactcactatagggccaccagccccgggccgccagcatatgcgcaacagaggagagcgcatatgctggcggccaacctggcggcagcgcaaaagatg

SEQ ID NO: 147531 - DNA, 103 bp, Artificial Sequence
  Synthetic Polynucleotide
taatacgactcactatagggaaaagcccagccaccagccccgggccgccaaacagaggagatggcggatgggggctggtaacctggcggcagcgcaaaagatg

SEQ ID NO: 147532 - DNA, 103 bp, Artificial Sequence
  Synthetic Polynucleotide
taatacgactcactatagggctccgaacccaaaagcccagccaccagcccaacagaggagagggctgatggctgggcttaacctggcggcagcgcaaaagatg

SEQ ID NO: 147533 - DNA, 103 bp, Artificial Sequence
  Synthetic Polynucleotide
taatacgactcactatagggccgagtgatcctccgaacccaaaagcccagaacagaggagactgggcatgtgggttcggaacctggcggcagcgcaaaagatg

SEQ ID NO: 147534 - DNA, 103 bp, Artificial Sequence
  Synthetic Polynucleotide
taatacgactcactatagggcgcacccaacccgagtgatcctccgaacccaacagaggagagggttcatgggatcactcaacctggcggcagcgcaaaagatg

SEQ ID NO: 147535 - DNA, 103 bp, Artificial Sequence
  Synthetic Polynucleotide
taatacgactcactataggggaaggggcccagggcggtcagtgtgctgataacagaggagaatcagcatgctgaccgccaacctggcggcagcgcaaaagatg

SEQ ID NO: 147536 - DNA, 103 bp, Artificial Sequence
  Synthetic Polynucleotide
taatacgactcactatagggcagggcagggcgcacccaacccgagtgatcaacagaggagagatcacatgggttgggtgaacctggcggcagcgcaaaagatg

SEQ ID NO: 147537 - DNA, 103 bp, Artificial Sequence
  Synthetic Polynucleotide
taatacgactcactatagggcccgggctcgcagggcagggcgcacccaacaacagaggagagttgggatggccctgcccaacctggcggcagcgcaaaagatg

SEQ ID NO: 147538 - DNA, 103 bp, Artificial Sequence
  Synthetic Polynucleotide
taatacgactcactataggggcgtcgggagcccgggctcgcagggcagggaacagaggagaccctgcatggcgagcccgaacctggcggcagcgcaaaagatg

SEQ ID NO: 147539 - DNA, 103 bp, Artificial Sequence
  Synthetic Polynucleotide
taatacgactcactataggggcccacgaaggcgtcgggagcccgggctcgaacagaggagacgagccatggctcccgacaacctggcggcagcgcaaaagatg

SEQ ID NO: 147540 - DNA, 103 bp, Artificial Sequence
  Synthetic Polynucleotide
taatacgactcactatagggccagggctgggcccacgaaggcgtcgggagaacagaggagactcccgatgccttcgtggaacctggcggcagcgcaaaagatg

SEQ ID NO: 147541 - DNA, 103 bp, Artificial Sequence
  Synthetic Polynucleotide
taatacgactcactatagggggggctggagccagggctgggcccacgaagaacagaggagacttcgtatgcccagccctaacctggcggcagcgcaaaagatg

SEQ ID NO: 147542 - DNA, 103 bp, Artificial Sequence
  Synthetic Polynucleotide
taatacgactcactatagggctcgggggccggggctggagccagggctggaacagaggagaccagccatggctccagccaacctggcggcagcgcaaaagatg

SEQ ID NO: 147543 - DNA, 103 bp, Artificial Sequence
  Synthetic Polynucleotide
taatacgactcactataggggcgccttgggctcgggggccggggctggagaacagaggagactccagatgcggcccccgaacctggcggcagcgcaaaagatg

SEQ ID NO: 147544 - DNA, 103 bp, Artificial Sequence
  Synthetic Polynucleotide
taatacgactcactatagggtgcagcgccagcgccttgggctcgggggccaacagaggagaggccccatggcccaaggcaacctggcggcagcgcaaaagatg

SEQ ID NO: 147545 - DNA, 103 bp, Artificial Sequence
  Synthetic Polynucleotide
taatacgactcactataggggtacaccggttgcagcgccagcgccttgggaacagaggagacccaagatgctggcgctgaacctggcggcagcgcaaaagatg

SEQ ID NO: 147546 - DNA, 103 bp, Artificial Sequence
  Synthetic Polynucleotide
taatacgactcactataggggtgtgtccgggaaggggcccagggcggtcaaacagaggagatgaccgatgtgggcccctaacctggcggcagcgcaaaagatg

SEQ ID NO: 147547 - DNA, 103 bp, Artificial Sequence
  Synthetic Polynucleotide
taatacgactcactatagggcgggccccgggtacaccggttgcagcgccaaacagaggagatggcgcatgaaccggtgtaacctggcggcagcgcaaaagatg

SEQ ID NO: 147548 - DNA, 103 bp, Artificial Sequence
  Synthetic Polynucleotide
taatacgactcactataggggagccggcgccgggccccgggtacaccggtaacagaggagaaccggtatgcccggggccaacctggcggcagcgcaaaagatg

SEQ ID NO: 147549 - DNA, 103 bp, Artificial Sequence
  Synthetic Polynucleotide
taatacgactcactataggggccacccgaggagccggcgccgggccccggaacagaggagaccggggatgggcgccggcaacctggcggcagcgcaaaagatg

SEQ ID NO: 147550 - DNA, 103 bp, Artificial Sequence
  Synthetic Polynucleotide
taatacgactcactataggggcgggaagtagccacccgaggagccggcgcaacagaggagagcgccgatgcctcgggtgaacctggcggcagcgcaaaagatg

SEQ ID NO: 147551 - DNA, 103 bp, Artificial Sequence
  Synthetic Polynucleotide
taatacgactcactatagggagcccggtccgcgggaagtagccacccgagaacagaggagactcgggatgctacttcccaacctggcggcagcgcaaaagatg

SEQ ID NO: 147552 - DNA, 103 bp, Artificial Sequence
  Synthetic Polynucleotide
taatacgactcactatagggaggcactgaaagcccggtccgcgggaagtaaacagaggagatacttcatgcggaccgggaacctggcggcagcgcaaaagatg

SEQ ID NO: 147553 - DNA, 103 bp, Artificial Sequence
  Synthetic Polynucleotide
taatacgactcactatagggccgacgccgcaggcactgaaagcccggtccaacagaggagaggaccgatgtttcagtgcaacctggcggcagcgcaaaagatg

SEQ ID NO: 147554 - DNA, 103 bp, Artificial Sequence
  Synthetic Polynucleotide
taatacgactcactatagggtagggggcgcccgacgccgcaggcactgaaaacagaggagattcagtatgtgcggcgtcaacctggcggcagcgcaaaagatg

SEQ ID NO: 147555 - DNA, 103 bp, Artificial Sequence
  Synthetic Polynucleotide
taatacgactcactatagggcagtagcccgtagggggcgcccgacgccgcaacagaggagagcggcgatgggcgcccccaacctggcggcagcgcaaaagatg

SEQ ID NO: 147556 - DNA, 103 bp, Artificial Sequence
  Synthetic Polynucleotide
taatacgactcactatagggggtacccggacagtagcccgtagggggcgcaacagaggagagcgcccatgacgggctacaacctggcggcagcgcaaaagatg

SEQ ID NO: 147557 - DNA, 103 bp, Artificial Sequence
  Synthetic Polynucleotide
taatacgactcactatagggaagtcatcctgtgtgtccgggaaggggcccaacagaggagagggcccatgcccggacacaacctggcggcagcgcaaaagatg

SEQ ID NO: 147558 - DNA, 103 bp, Artificial Sequence
  Synthetic Polynucleotide
taatacgactcactatagggtacatcgcggggtacccggacagtagcccgaacagaggagacgggctatggtccgggtaaacctggcggcagcgcaaaagatg

SEQ ID NO: 147559 - DNA, 103 bp, Artificial Sequence
  Synthetic Polynucleotide
taatacgactcactatagggaggcgccgggtacatcgcggggtacccggaaacagaggagatccgggatgcccgcgatgaacctggcggcagcgcaaaagatg

SEQ ID NO: 147560 - DNA, 103 bp, Artificial Sequence
  Synthetic Polynucleotide
taatacgactcactatagggcttggtactgaggcgccgggtacatcgcggaacagaggagaccgcgaatgacccggcgcaacctggcggcagcgcaaaagatg

SEQ ID NO: 147561 - DNA, 103 bp, Artificial Sequence
  Synthetic Polynucleotide
taatacgactcactatagggtggaagtgcccttggtactgaggcgccgggaacagaggagacccggcatgtcagtaccaaacctggcggcagcgcaaaagatg

SEQ ID NO: 147562 - DNA, 103 bp, Artificial Sequence
  Synthetic Polynucleotide
taatacgactcactataggggcggaagagctggaagtgcccttggtactgaacagaggagacagtacatggggcacttcaacctggcggcagcgcaaaagatg

SEQ ID NO: 147563 - DNA, 103 bp, Artificial Sequence
  Synthetic Polynucleotide
taatacgactcactatagggcctggagcccgcggaagagctggaagtgccaacagaggagaggcactatgagctcttccaacctggcggcagcgcaaaagatg

SEQ ID NO: 147564 - DNA, 103 bp, Artificial Sequence
  Synthetic Polynucleotide
taatacgactcactatagggggcgcgggtccctggagcccgcggaagagcaacagaggagagctcttatgcgggctccaaacctggcggcagcgcaaaagatg

SEQ ID NO: 147565 - DNA, 103 bp, Artificial Sequence
  Synthetic Polynucleotide
taatacgactcactatagggggcgggaccgggcgcgggtccctggagcccaacagaggagagggctcatgggacccgcgaacctggcggcagcgcaaaagatg

SEQ ID NO: 147566 - DNA, 103 bp, Artificial Sequence
  Synthetic Polynucleotide
taatacgactcactatagggagggggacgtggcgggaccgggcgcgggtcaacagaggagagacccgatgccggtcccgaacctggcggcagcgcaaaagatg

SEQ ID NO: 147567 - DNA, 103 bp, Artificial Sequence
  Synthetic Polynucleotide
taatacgactcactatagggctcaggaaggagggggacgtggcgggaccgaacagaggagacggtccatgcacgtccccaacctggcggcagcgcaaaagatg

SEQ ID NO: 147568 - DNA, 103 bp, Artificial Sequence
  Synthetic Polynucleotide
taatacgactcactatagggccacttgaggaagtcatcctgtgtgtccggaacagaggagaccggacatgcaggatgacaacctggcggcagcgcaaaagatg

SEQ ID NO: 147569 - DNA, 103 bp, Artificial Sequence
  Synthetic Polynucleotide
taatacgactcactatagggtcccaaacaactcaggaaggagggggacgtaacagaggagaacgtccatgtccttcctgaacctggcggcagcgcaaaagatg

SEQ ID NO: 147570 - DNA, 103 bp, Artificial Sequence
  Synthetic Polynucleotide
taatacgactcactatagggccgtcccgggtcccaaacaactcaggaaggaacagaggagaccttccatggttgtttggaacctggcggcagcgcaaaagatg

SEQ ID NO: 147571 - DNA, 103 bp, Artificial Sequence
  Synthetic Polynucleotide
taatacgactcactatagggccagtgcccaccgtcccgggtcccaaacaaaacagaggagattgtttatgacccgggacaacctggcggcagcgcaaaagatg

SEQ ID NO: 147572 - DNA, 103 bp, Artificial Sequence
  Synthetic Polynucleotide
taatacgactcactatagggccccccgagtccagtgcccaccgtcccgggaacagaggagacccgggatggtgggcactaacctggcggcagcgcaaaagatg

SEQ ID NO: 147573 - DNA, 103 bp, Artificial Sequence
  Synthetic Polynucleotide
taatacgactcactatagggcctctgcagtccccccgagtccagtgcccaaacagaggagatgggcaatggactcggggaacctggcggcagcgcaaaagatg

SEQ ID NO: 147574 - DNA, 103 bp, Artificial Sequence
  Synthetic Polynucleotide
taatacgactcactatagggacacctggatcctctgcagtccccccgagtaacagaggagaactcggatggactgcagaaacctggcggcagcgcaaaagatg

SEQ ID NO: 147575 - DNA, 103 bp, Artificial Sequence
  Synthetic Polynucleotide
taatacgactcactatagggctcggctatcacacctggatcctctgcagtaacagaggagaactgcaatggatccaggtaacctggcggcagcgcaaaagatg

SEQ ID NO: 147576 - DNA, 103 bp, Artificial Sequence
  Synthetic Polynucleotide
taatacgactcactatagggatggcgcggtctcggctatcacacctggataacagaggagaatccagatgtgatagccgaacctggcggcagcgcaaaagatg

SEQ ID NO: 147577 - DNA, 103 bp, Artificial Sequence
  Synthetic Polynucleotide
taatacgactcactatagggcctcgcttggatggcgcggtctcggctatcaacagaggagagatagcatggaccgcgccaacctggcggcagcgcaaaagatg

SEQ ID NO: 147578 - DNA, 103 bp, Artificial Sequence
  Synthetic Polynucleotide
taatacgactcactatagggcgaacgtcggcctcgcttggatggcgcggtaacagaggagaaccgcgatgtccaagcgaaacctggcggcagcgcaaaagatg

SEQ ID NO: 147579 - DNA, 103 bp, Artificial Sequence
  Synthetic Polynucleotide
taatacgactcactatagggcggagcgccaccacttgaggaagtcatcctaacagaggagaaggatgatgtcctcaagtaacctggcggcagcgcaaaagatg

SEQ ID NO: 147580 - DNA, 103 bp, Artificial Sequence
  Synthetic Polynucleotide
taatacgactcactatagggtgcgcgcccacgaacgtcggcctcgcttggaacagaggagaccaagcatggccgacgttaacctggcggcagcgcaaaagatg

SEQ ID NO: 147581 - DNA, 103 bp, Artificial Sequence
  Synthetic Polynucleotide
taatacgactcactataggggcctgcctcttgcgcgcccacgaacgtcggaacagaggagaccgacgatggtgggcgcgaacctggcggcagcgcaaaagatg

SEQ ID NO: 147582 - DNA, 103 bp, Artificial Sequence
  Synthetic Polynucleotide
taatacgactcactatagggcgtgtgcgctgcctgcctcttgcgcgcccaaacagaggagatgggcgatgaagaggcagaacctggcggcagcgcaaaagatg

SEQ ID NO: 147583 - DNA, 103 bp, Artificial Sequence
  Synthetic Polynucleotide
taatacgactcactatagggggtgcgcgcacgtgtgcgctgcctgcctctaacagaggagaagaggcatgcagcgcacaaacctggcggcagcgcaaaagatg

SEQ ID NO: 147584 - DNA, 103 bp, Artificial Sequence
  Synthetic Polynucleotide
taatacgactcactatagggccgcaacccgggtgcgcgcacgtgtgcgctaacagaggagaagcgcaatggtgcgcgcaaacctggcggcagcgcaaaagatg

SEQ ID NO: 147585 - DNA, 103 bp, Artificial Sequence
  Synthetic Polynucleotide
taatacgactcactataggggtagctcttgccgcaacccgggtgcgcgcaaacagaggagatgcgcgatgccgggttgcaacctggcggcagcgcaaaagatg

SEQ ID NO: 147586 - DNA, 103 bp, Artificial Sequence
  Synthetic Polynucleotide
taatacgactcactatagggagctcttggtgtagctcttgccgcaacccgaacagaggagacgggttatggcaagagctaacctggcggcagcgcaaaagatg

SEQ ID NO: 147587 - DNA, 103 bp, Artificial Sequence
  Synthetic Polynucleotide
taatacgactcactatagggttcaggtgggagctcttggtgtagctcttgaacagaggagacaagagatgcaccaagagaacctggcggcagcgcaaaagatg

SEQ ID NO: 147588 - DNA, 103 bp, Artificial Sequence
  Synthetic Polynucleotide
taatacgactcactatagggcagatgcgccttcaggtgggagctcttggtaacagaggagaaccaagatgtcccacctgaacctggcggcagcgcaaaagatg

SEQ ID NO: 147589 - DNA, 103 bp, Artificial Sequence
  Synthetic Polynucleotide
taatacgactcactatagggtgtgcgtgcgcagatgcgccttcaggtgggaacagaggagacccaccatgaggcgcatcaacctggcggcagcgcaaaagatg

SEQ ID NO: 147590 - DNA, 103 bp, Artificial Sequence
  Synthetic Polynucleotide
taatacgactcactatagggtgcgcctcttcggagcgccaccacttgaggaacagaggagacctcaaatggtggcgctcaacctggcggcagcgcaaaagatg

SEQ ID NO: 147591 - DNA, 103 bp, Artificial Sequence
  Synthetic Polynucleotide
taatacgactcactatagggttctcccctgtgtgcgtgcgcagatgcgccaacagaggagaggcgcaatggcgcacgcaaacctggcggcagcgcaaaagatg

SEQ ID NO: 147592 - DNA, 103 bp, Artificial Sequence
  Synthetic Polynucleotide
taatacgactcactatagggggcgtatggcttctcccctgtgtgcgtgcgaacagaggagacgcacgatgacaggggagaacctggcggcagcgcaaaagatg

SEQ ID NO: 147593 - DNA, 103 bp, Artificial Sequence
  Synthetic Polynucleotide
taatacgactcactatagggcccacgtgcaggcgtatggcttctcccctgaacagaggagacaggggatgagccatacgaacctggcggcagcgcaaaagatg

SEQ ID NO: 147594 - DNA, 103 bp, Artificial Sequence
  Synthetic Polynucleotide
taatacgactcactatagggccgcagccttcccacgtgcaggcgtatggcaacagaggagagccataatgctgcacgtgaacctggcggcagcgcaaaagatg

SEQ ID NO: 147595 - DNA, 103 bp, Artificial Sequence
  Synthetic Polynucleotide
taatacgactcactataggggaatctccagccgcagccttcccacgtgcaaacagaggagatgcacgatggaaggctgcaacctggcggcagcgcaaaagatg

SEQ ID NO: 147596 - DNA, 103 bp, Artificial Sequence
  Synthetic Polynucleotide
taatacgactcactatagggccgagcgcgcgaatctccagccgcagccttaacagaggagaaaggctatggctggagataacctggcggcagcgcaaaagatg

SEQ ID NO: 147597 - DNA, 103 bp, Artificial Sequence
  Synthetic Polynucleotide
taatacgactcactataggggtcagctcgtccgagcgcgcgaatctccagaacagaggagactggagatgcgcgcgctcaacctggcggcagcgcaaaagatg

SEQ ID NO: 147598 - DNA, 103 bp, Artificial Sequence
  Synthetic Polynucleotide
taatacgactcactataggggtagtggcgggtcagctcgtccgagcgcgcaacagaggagagcgcgcatggacgagctgaacctggcggcagcgcaaaagatg

SEQ ID NO: 147599 - DNA, 103 bp, Artificial Sequence
  Synthetic Polynucleotide
taatacgactcactatagggtgtgtttccggtagtggcgggtcagctcgtaacagaggagaacgagcatgcccgccactaacctggcggcagcgcaaaagatg

SEQ ID NO: 147600 - DNA, 103 bp, Artificial Sequence
  Synthetic Polynucleotide
taatacgactcactatagggcgctgccccgtgtgtttccggtagtggcggaacagaggagaccgccaatgccggaaacaaacctggcggcagcgcaaaagatg

SEQ ID NO: 147601 - DNA, 103 bp, Artificial Sequence
  Synthetic Polynucleotide
taatacgactcactatagggctgctggagagaggcaccgaagttgagcataacagaggagaatgctcatgttcggtgccaacctggcggcagcgcaaaagatg

SEQ ID NO: 147602 - DNA, 103 bp, Artificial Sequence
  Synthetic Polynucleotide
taatacgactcactatagggttcaaaatcacttttctctgcagttttgttaacagaggagaaacaaaatggcagagaaaaacctggcggcagcgcaaaagatg

SEQ ID NO: 147603 - DNA, 103 bp, Artificial Sequence
  Synthetic Polynucleotide
taatacgactcactatagggtctggtgccattcgggctcaccaccggaggaacagaggagacctccgatggtgagcccgaacctggcggcagcgcaaaagatg

SEQ ID NO: 147604 - DNA, 103 bp, Artificial Sequence
  Synthetic Polynucleotide
taatacgactcactatagggtgggagagagtctggtgccattcgggctcaaacagaggagatgagccatgatggcaccaaacctggcggcagcgcaaaagatg

SEQ ID NO: 147605 - DNA, 103 bp, Artificial Sequence
  Synthetic Polynucleotide
taatacgactcactataggggcaggggcaatgggagagagtctggtgccaaacagaggagatggcacatgactctctccaacctggcggcagcgcaaaagatg

SEQ ID NO: 147606 - DNA, 103 bp, Artificial Sequence
  Synthetic Polynucleotide
taatacgactcactatagggaaacccaggagcaggggcaatgggagagagaacagaggagactctctatgattgcccctaacctggcggcagcgcaaaagatg

SEQ ID NO: 147607 - DNA, 103 bp, Artificial Sequence
  Synthetic Polynucleotide
taatacgactcactatagggctgaaggggaaaacccaggagcaggggcaaaacagaggagattgcccatgctcctgggtaacctggcggcagcgcaaaagatg

SEQ ID NO: 147608 - DNA, 103 bp, Artificial Sequence
  Synthetic Polynucleotide
taatacgactcactatagggacttttgctgctgaaggggaaaacccaggaaacagaggagatcctggatgttccccttcaacctggcggcagcgcaaaagatg

SEQ ID NO: 147609 - DNA, 103 bp, Artificial Sequence
  Synthetic Polynucleotide
taatacgactcactatagggctgaggagtgacttttgctgctgaaggggaaacagaggagatcccctatggcagcaaaaaacctggcggcagcgcaaaagatg

SEQ ID NO: 147610 - DNA, 103 bp, Artificial Sequence
  Synthetic Polynucleotide
taatacgactcactatagggatgaatcaatctgaggagtgacttttgctgaacagaggagacagcaaatgtcactcctcaacctggcggcagcgcaaaagatg

SEQ ID NO: 147611 - DNA, 103 bp, Artificial Sequence
  Synthetic Polynucleotide
taatacgactcactatagggcttatccttgatgaatcaatctgaggagtgaacagaggagacactccatggattgattcaacctggcggcagcgcaaaagatg

SEQ ID NO: 147612 - DNA, 103 bp, Artificial Sequence
  Synthetic Polynucleotide
taatacgactcactataggggatgtgactccttatccttgatgaatcaataacagaggagaattgatatgtcaaggataaacctggcggcagcgcaaaagatg

SEQ ID NO: 147613 - DNA, 103 bp, Artificial Sequence
  Synthetic Polynucleotide
taatacgactcactatagggcttctacagcttcaaaatcacttttctctgaacagaggagacagagaatggtgattttgaacctggcggcagcgcaaaagatg

SEQ ID NO: 147614 - DNA, 103 bp, Artificial Sequence
  Synthetic Polynucleotide
taatacgactcactatagggggtggctacagatgtgactccttatccttgaacagaggagacaaggaatgggagtcacaaacctggcggcagcgcaaaagatg

SEQ ID NO: 147615 - DNA, 103 bp, Artificial Sequence
  Synthetic Polynucleotide
taatacgactcactatagggccacatcctgggtggctacagatgtgactcaacagaggagagagtcaatgctgtagccaaacctggcggcagcgcaaaagatg

SEQ ID NO: 147616 - DNA, 103 bp, Artificial Sequence
  Synthetic Polynucleotide
taatacgactcactataggggtatgtcttgccacatcctgggtggctacaaacagaggagatgtagcatgccaggatgtaacctggcggcagcgcaaaagatg

SEQ ID NO: 147617 - DNA, 103 bp, Artificial Sequence
  Synthetic Polynucleotide
taatacgactcactatagggaacttttaaagtatgtcttgccacatcctgaacagaggagacaggatatggcaagacataacctggcggcagcgcaaaagatg

SEQ ID NO: 147618 - DNA, 103 bp, Artificial Sequence
  Synthetic Polynucleotide
taatacgactcactatagggttcagatgggaacttttaaagtatgtcttgaacagaggagacaagacatgctttaaaagaacctggcggcagcgcaaaagatg

SEQ ID NO: 147619 - DNA, 103 bp, Artificial Sequence
  Synthetic Polynucleotide
taatacgactcactatagggcgtgtgggccttcagatgggaacttttaaaaacagaggagatttaaaatgtcccatctgaacctggcggcagcgcaaaagatg

SEQ ID NO: 147620 - DNA, 103 bp, Artificial Sequence
  Synthetic Polynucleotide
taatacgactcactatagggtgtgcgtcctcgtgtgggccttcagatgggaacagaggagacccatcatgaggcccacaaacctggcggcagcgcaaaagatg

SEQ ID NO: 147621 - DNA, 103 bp, Artificial Sequence
  Synthetic Polynucleotide
taatacgactcactatagggttttctcctgtgtgcgtcctcgtgtgggccaacagaggagaggcccaatggaggacgcaaacctggcggcagcgcaaaagatg

SEQ ID NO: 147622 - DNA, 103 bp, Artificial Sequence
  Synthetic Polynucleotide
taatacgactcactataggggctgaaaggcttttctcctgtgtgcgtcctaacagaggagaaggacgatgacaggagaaaacctggcggcagcgcaaaagatg

SEQ ID NO: 147623 - DNA, 103 bp, Artificial Sequence
  Synthetic Polynucleotide
taatacgactcactatagggtccagctacagctgaaaggcttttctcctgaacagaggagacaggagatgagcctttcaaacctggcggcagcgcaaaagatg

SEQ ID NO: 147624 - DNA, 103 bp, Artificial Sequence
  Synthetic Polynucleotide
taatacgactcactataggggacataagtgcttctacagcttcaaaatcaaacagaggagatgatttatgagctgtagaaacctggcggcagcgcaaaagatg

SEQ ID NO: 147625 - DNA, 103 bp, Artificial Sequence
  Synthetic Polynucleotide
taatacgactcactatagggtcacaacctttccagctacagctgaaaggcaacagaggagagcctttatgctgtagctgaacctggcggcagcgcaaaagatg

SEQ ID NO: 147626 - DNA, 103 bp, Artificial Sequence
  Synthetic Polynucleotide
taatacgactcactatagggaaacctcctttcacaacctttccagctacaaacagaggagatgtagcatgaaaggttgtaacctggcggcagcgcaaaagatg

SEQ ID NO: 147627 - DNA, 103 bp, Artificial Sequence
  Synthetic Polynucleotide
taatacgactcactatagggcagaacgggcaaacctcctttcacaaccttaacagaggagaaaggttatgaaaggaggtaacctggcggcagcgcaaaagatg

SEQ ID NO: 147628 - DNA, 103 bp, Artificial Sequence
  Synthetic Polynucleotide
taatacgactcactataggggacagttcatcagaacgggcaaacctccttaacagaggagaaaggagatgtgcccgttcaacctggcggcagcgcaaaagatg

SEQ ID NO: 147629 - DNA, 103 bp, Artificial Sequence
  Synthetic Polynucleotide
taatacgactcactatagggcctgtgtctggacagttcatcagaacgggcaacagaggagagcccgtatggatgaactgaacctggcggcagcgcaaaagatg

SEQ ID NO: 147630 - DNA, 103 bp, Artificial Sequence
  Synthetic Polynucleotide
taatacgactcactatagggtgtgggttcgcctgtgtctggacagttcataacagaggagaatgaacatgccagacacaaacctggcggcagcgcaaaagatg

SEQ ID NO: 147631 - DNA, 103 bp, Artificial Sequence
  Synthetic Polynucleotide
taatacgactcactatagggttctcacccgtgtgggttcgcctgtgtctgaacagaggagacagacaatggcgaacccaaacctggcggcagcgcaaaagatg

SEQ ID NO: 147632 - DNA, 103 bp, Artificial Sequence
  Synthetic Polynucleotide
taatacgactcactatagggcgcaaatttcttctcacccgtgtgggttcgaacagaggagacgaaccatgacgggtgagaacctggcggcagcgcaaaagatg

SEQ ID NO: 147633 - DNA, 103 bp, Artificial Sequence
  Synthetic Polynucleotide
taatacgactcactatagggacatggggcacgcaaatttcttctcacccgaacagaggagacgggtgatgagaaatttgaacctggcggcagcgcaaaagatg

SEQ ID NO: 147634 - DNA, 103 bp, Artificial Sequence
  Synthetic Polynucleotide
taatacgactcactatagggcgccggtcacacatggggcacgcaaatttcaacagaggagagaaattatggtgccccataacctggcggcagcgcaaaagatg

SEQ ID NO: 147635 - DNA, 103 bp, Artificial Sequence
  Synthetic Polynucleotide
taatacgactcactataggggcagctcattgacataagtgcttctacagcaacagaggagagctgtaatggcacttatgaacctggcggcagcgcaaaagatg

SEQ ID NO: 147636 - DNA, 103 bp, Artificial Sequence
  Synthetic Polynucleotide
taatacgactcactatagggcctcatgaaccgccggtcacacatggggcaaacagaggagatgccccatgtgtgaccggaacctggcggcagcgcaaaagatg

SEQ ID NO: 147637 - DNA, 103 bp, Artificial Sequence
  Synthetic Polynucleotide
taatacgactcactatagggaatggtcactcctcatgaaccgccggtcacaacagaggagagtgaccatgggttcatgaaacctggcggcagcgcaaaagatg

SEQ ID NO: 147638 - DNA, 103 bp, Artificial Sequence
  Synthetic Polynucleotide
taatacgactcactatagggtgcttggtcaaatggtcactcctcatgaacaacagaggagagttcatatggagtgaccaaacctggcggcagcgcaaaagatg

SEQ ID NO: 147639 - DNA, 103 bp, Artificial Sequence
  Synthetic Polynucleotide
taatacgactcactataggggcgccgggcatgcttggtcaaatggtcactaacagaggagaagtgacatgttgaccaagaacctggcggcagcgcaaaagatg

SEQ ID NO: 147640 - DNA, 103 bp, Artificial Sequence
  Synthetic Polynucleotide
taatacgactcactatagggctgatagatggcgccgggcatgcttggtcaaacagaggagatgaccaatgatgcccggcaacctggcggcagcgcaaaagatg

SEQ ID NO: 147641 - DNA, 103 bp, Artificial Sequence
  Synthetic Polynucleotide
taatacgactcactatagggagcttcttggctgatagatggcgccgggcaaacagaggagatgcccgatgccatctatcaacctggcggcagcgcaaaagatg

SEQ ID NO: 147642 - DNA, 103 bp, Artificial Sequence
  Synthetic Polynucleotide
taatacgactcactatagggccagtttggtagcttcttggctgatagatgaacagaggagacatctaatggccaagaagaacctggcggcagcgcaaaagatg

SEQ ID NO: 147643 - DNA, 103 bp, Artificial Sequence
  Synthetic Polynucleotide
taatacgactcactatagggcttccatctgccagtttggtagcttcttggaacagaggagaccaagaatgtaccaaactaacctggcggcagcgcaaaagatg

SEQ ID NO: 147644 - DNA, 103 bp, Artificial Sequence
  Synthetic Polynucleotide
taatacgactcactatagggagcttgctcacttccatctgccagtttggtaacagaggagaaccaaaatggcagatggaaacctggcggcagcgcaaaagatg

SEQ ID NO: 147645 - DNA, 103 bp, Artificial Sequence
  Synthetic Polynucleotide
taatacgactcactatagggaatgtcatttagcttgctcacttccatctgaacagaggagacagatgatggtgagcaagaacctggcggcagcgcaaaagatg

SEQ ID NO: 147646 - DNA, 103 bp, Artificial Sequence
  Synthetic Polynucleotide
taatacgactcactatagggacttccaactgcagctcattgacataagtgaacagaggagacacttaatgcaatgagctaacctggcggcagcgcaaaagatg

SEQ ID NO: 147647 - DNA, 103 bp, Artificial Sequence
  Synthetic Polynucleotide
taatacgactcactataggggaggtagagcaatgtcatttagcttgctcaaacagaggagatgagcaatgtaaatgacaaacctggcggcagcgcaaaagatg

SEQ ID NO: 147648 - DNA, 103 bp, Artificial Sequence
  Synthetic Polynucleotide
taatacgactcactataggggcaggggttggaggtagagcaatgtcatttaacagaggagaaaatgaatgtgctctaccaacctggcggcagcgcaaaagatg

SEQ ID NO: 147649 - DNA, 103 bp, Artificial Sequence
  Synthetic Polynucleotide
taatacgactcactatagggctgtgtgggagcaggggttggaggtagagcaacagaggagagctctaatgccaacccctaacctggcggcagcgcaaaagatg

SEQ ID NO: 147650 - DNA, 103 bp, Artificial Sequence
  Synthetic Polynucleotide
taatacgactcactatagggttaaaatcagacttccaactgcagctcattaacagaggagaaatgagatgcagttggaaaacctggcggcagcgcaaaagatg

SEQ ID NO: 147651 - DNA, 103 bp, Artificial Sequence
  Synthetic Polynucleotide
taatacgactcactatagggaacgtatttcttaaaatcagacttccaactaacagaggagaagttggatgtctgattttaacctggcggcagcgcaaaagatg

SEQ ID NO: 147652 - DNA, 103 bp, Artificial Sequence
  Synthetic Polynucleotide
taatacgactcactataggggtctgttttcaacgtatttcttaaaatcagaacagaggagactgattatgagaaatacgaacctggcggcagcgcaaaagatg

SEQ ID NO: 147653 - DNA, 103 bp, Artificial Sequence
  Synthetic Polynucleotide
taatacgactcactatagggggtgtaacaggtctgttttcaacgtatttcaacagaggagagaaataatgtgaaaacagaacctggcggcagcgcaaaagatg

SEQ ID NO: 147654 - DNA, 103 bp, Artificial Sequence
  Synthetic Polynucleotide
taatacgactcactatagggatcagatactggtgtaacaggtctgttttcaacagaggagagaaaacatgcctgttacaaacctggcggcagcgcaaaagatg

SEQ ID NO: 147655 - DNA, 103 bp, Artificial Sequence
  Synthetic Polynucleotide
taatacgactcactatagggcctccgcagtctgctggagagaggcaccgaaacagaggagatcggtgatgctctccagcaacctggcggcagcgcaaaagatg

SEQ ID NO: 147656 - DNA, 103 bp, Artificial Sequence
  Synthetic Polynucleotide
taatacgactcactatagggcctctgacaaatcagatactggtgtaacagaacagaggagactgttaatgcagtatctgaacctggcggcagcgcaaaagatg

SEQ ID NO: 147657 - DNA, 103 bp, Artificial Sequence
  Synthetic Polynucleotide
taatacgactcactatagggagattctcttcctctgacaaatcagatactaacagaggagaagtatcatgtttgtcagaaacctggcggcagcgcaaaagatg

SEQ ID NO: 147658 - DNA, 103 bp, Artificial Sequence
  Synthetic Polynucleotide
taatacgactcactatagggtcccggaagcagattctcttcctctgacaaaacagaggagattgtcaatggaagagaataacctggcggcagcgcaaaagatg

SEQ ID NO: 147659 - DNA, 103 bp, Artificial Sequence
  Synthetic Polynucleotide
taatacgactcactatagggaatcaggtgttcccggaagcagattctcttaacagaggagaaagagaatgtgcttccggaacctggcggcagcgcaaaagatg

SEQ ID NO: 147660 - DNA, 103 bp, Artificial Sequence
  Synthetic Polynucleotide
taatacgactcactatagggattgtatgaaaatcaggtgttcccggaagcaacagaggagagcttccatgaacacctgaaacctggcggcagcgcaaaagatg

SEQ ID NO: 147661 - DNA, 103 bp, Artificial Sequence
  Synthetic Polynucleotide
taatacgactcactatagggaaatgctgggattgtatgaaaatcaggtgtaacagaggagaacacctatgtttcatacaaacctggcggcagcgcaaaagatg

SEQ ID NO: 147662 - DNA, 103 bp, Artificial Sequence
  Synthetic Polynucleotide
taatacgactcactataggggagtcaaacaaaatgctgggattgtatgaaaacagaggagattcataatgtcccagcataacctggcggcagcgcaaaagatg

SEQ ID NO: 147663 - DNA, 103 bp, Artificial Sequence
  Synthetic Polynucleotide
taatacgactcactatagggctgtaaggtggagtcaaacaaaatgctgggaacagaggagacccagcatgttgtttgacaacctggcggcagcgcaaaagatg

SEQ ID NO: 147664 - DNA, 103 bp, Artificial Sequence
  Synthetic Polynucleotide
taatacgactcactataggggtcagaaggactgtaaggtggagtcaaacaaacagaggagatgtttgatgccaccttacaacctggcggcagcgcaaaagatg

SEQ ID NO: 147665 - DNA, 103 bp, Artificial Sequence
  Synthetic Polynucleotide
taatacgactcactatagggagggttcaaagtcagaaggactgtaaggtgaacagaggagacaccttatggtccttctgaacctggcggcagcgcaaaagatg

SEQ ID NO: 147666 - DNA, 103 bp, Artificial Sequence
  Synthetic Polynucleotide
taatacgactcactatagggtccattctttcctccgcagtctgctggagaaacagaggagatctccaatggactgcggaaacctggcggcagcgcaaaagatg

SEQ ID NO: 147667 - DNA, 103 bp, Artificial Sequence
  Synthetic Polynucleotide
taatacgactcactataggggacacttgagagggttcaaagtcagaaggaaacagaggagatccttcatgctttgaaccaacctggcggcagcgcaaaagatg

SEQ ID NO: 147668 - DNA, 103 bp, Artificial Sequence
  Synthetic Polynucleotide
taatacgactcactatagggcatcagatttgacacttgagagggttcaaaaacagaggagatttgaaatgtctcaagtgaacctggcggcagcgcaaaagatg

SEQ ID NO: 147669 - DNA, 103 bp, Artificial Sequence
  Synthetic Polynucleotide
taatacgactcactataggggcgctggtgccatcagatttgacacttgagaacagaggagactcaagatgcaaatctgaaacctggcggcagcgcaaaagatg

SEQ ID NO: 147670 - DNA, 103 bp, Artificial Sequence
  Synthetic Polynucleotide
taatacgactcactatagggacagtagatggcgctggtgccatcagatttaacagaggagaaaatctatgggcaccagcaacctggcggcagcgcaaaagatg

SEQ ID NO: 147671 - DNA, 103 bp, Artificial Sequence
  Synthetic Polynucleotide
taatacgactcactatagggcttgaagtgtacagtagatggcgctggtgcaacagaggagagcaccaatgccatctactaacctggcggcagcgcaaaagatg

SEQ ID NO: 147672 - DNA, 103 bp, Artificial Sequence
  Synthetic Polynucleotide
taatacgactcactatagggctgagagtgacttgaagtgtacagtagatgaacagaggagacatctaatgtacacttcaaacctggcggcagcgcaaaagatg

SEQ ID NO: 147673 - DNA, 103 bp, Artificial Sequence
  Synthetic Polynucleotide
taatacgactcactatagggttggcagtatctgagagtgacttgaagtgtaacagaggagaacacttatggtcactctcaacctggcggcagcgcaaaagatg

SEQ ID NO: 147674 - DNA, 103 bp, Artificial Sequence
  Synthetic Polynucleotide
taatacgactcactatagggaatgtgaggtttggcagtatctgagagtgaaacagaggagatcactcatggatactgccaacctggcggcagcgcaaaagatg

SEQ ID NO: 147675 - DNA, 103 bp, Artificial Sequence
  Synthetic Polynucleotide
taatacgactcactatagggaaggtgcggcaatgtgaggtttggcagtataacagaggagaatactgatgaacctcacaaacctggcggcagcgcaaaagatg

SEQ ID NO: 147676 - DNA, 103 bp, Artificial Sequence
  Synthetic Polynucleotide
taatacgactcactatagggtcctctttgaaaggtgcggcaatgtgaggtaacagaggagaacctcaatgtgccgcaccaacctggcggcagcgcaaaagatg

SEQ ID NO: 147677 - DNA, 103 bp, Artificial Sequence
  Synthetic Polynucleotide
taatacgactcactatagggagaaatcatttccattctttcctccgcagtaacagaggagaactgcgatggaaagaatgaacctggcggcagcgcaaaagatg

SEQ ID NO: 147678 - DNA, 103 bp, Artificial Sequence
  Synthetic Polynucleotide
taatacgactcactataggggctcttttcttcctctttgaaaggtgcggcaacagaggagagccgcaatgttcaaagagaacctggcggcagcgcaaaagatg

SEQ ID NO: 147679 - DNA, 103 bp, Artificial Sequence
  Synthetic Polynucleotide
taatacgactcactatagggcagatactgggctcttttcttcctctttgaaacagaggagatcaaagatgaagaaaagaaacctggcggcagcgcaaaagatg

SEQ ID NO: 147680 - DNA, 103 bp, Artificial Sequence
  Synthetic Polynucleotide
taatacgactcactatagggagtttgggggcagatactgggctcttttctaacagaggagaagaaaaatgcccagtatcaacctggcggcagcgcaaaagatg

SEQ ID NO: 147681 - DNA, 103 bp, Artificial Sequence
  Synthetic Polynucleotide
taatacgactcactatagggagctttggggagtttgggggcagatactggaacagaggagaccagtaatggcccccaaaaacctggcggcagcgcaaaagatg

SEQ ID NO: 147682 - DNA, 103 bp, Artificial Sequence
  Synthetic Polynucleotide
taatacgactcactatagggttgttgcctgagctttggggagtttgggggaacagaggagacccccaatgtccccaaagaacctggcggcagcgcaaaagatg

SEQ ID NO: 147683 - DNA, 103 bp, Artificial Sequence
  Synthetic Polynucleotide
taatacgactcactatagggcgaatcacacttgttgcctgagctttggggaacagaggagaccccaaatgtcaggcaacaacctggcggcagcgcaaaagatg

SEQ ID NO: 147684 - DNA, 103 bp, Artificial Sequence
  Synthetic Polynucleotide
taatacgactcactatagggagctgtatgacgaatcacacttgttgcctgaacagaggagacaggcaatgagtgtgattaacctggcggcagcgcaaaagatg

SEQ ID NO: 147685 - DNA, 103 bp, Artificial Sequence
  Synthetic Polynucleotide
taatacgactcactataggggctgggcatcagctgtatgacgaatcacacaacagaggagagtgtgaatggtcatacagaacctggcggcagcgcaaaagatg

SEQ ID NO: 147686 - DNA, 103 bp, Artificial Sequence
  Synthetic Polynucleotide
taatacgactcactatagggtggttacatagctgggcatcagctgtatgaaacagaggagatcatacatgtgatgcccaaacctggcggcagcgcaaaagatg

SEQ ID NO: 147687 - DNA, 103 bp, Artificial Sequence
  Synthetic Polynucleotide
taatacgactcactataggggcaggtctggtggttacatagctgggcatcaacagaggagagatgccatgctatgtaacaacctggcggcagcgcaaaagatg

SEQ ID NO: 147688 - DNA, 103 bp, Artificial Sequence
  Synthetic Polynucleotide
taatacgactcactatagggttggcctttcagaaatcatttccattctttaacagaggagaaaagaaatgaaatgatttaacctggcggcagcgcaaaagatg

SEQ ID NO: 147689 - DNA, 103 bp, Artificial Sequence
  Synthetic Polynucleotide
taatacgactcactatagggctttcattgggcaggtctggtggttacataaacagaggagatatgtaatgaccagacctaacctggcggcagcgcaaaagatg

SEQ ID NO: 147690 - DNA, 103 bp, Artificial Sequence
  Synthetic Polynucleotide
taatacgactcactatagggatgctggctgctttcattgggcaggtctggaacagaggagaccagacatgcccaatgaaaacctggcggcagcgcaaaagatg

SEQ ID NO: 147691 - DNA, 103 bp, Artificial Sequence
  Synthetic Polynucleotide
taatacgactcactatagggatagttgaggatgctggctgctttcattggaacagaggagaccaatgatggcagccagcaacctggcggcagcgcaaaagatg

SEQ ID NO: 147692 - DNA, 103 bp, Artificial Sequence
  Synthetic Polynucleotide
taatacgactcactatagggaattgttctgatagttgaggatgctggctgaacagaggagacagccaatgtcctcaactaacctggcggcagcgcaaaagatg

SEQ ID NO: 147693 - DNA, 103 bp, Artificial Sequence
  Synthetic Polynucleotide
taatacgactcactatagggcttctaaaagaattgttctgatagttgaggaacagaggagacctcaaatgtcagaacaaaacctggcggcagcgcaaaagatg

SEQ ID NO: 147694 - DNA, 103 bp, Artificial Sequence
  Synthetic Polynucleotide
taatacgactcactataggggtgggttcttcttctaaaagaattgttctgaacagaggagacagaacatgtcttttagaaacctggcggcagcgcaaaagatg

SEQ ID NO: 147695 - DNA, 103 bp, Artificial Sequence
  Synthetic Polynucleotide
taatacgactcactatagggcaacatttaggtgggttcttcttctaaaagaacagaggagacttttaatggaagaacccaacctggcggcagcgcaaaagatg

SEQ ID NO: 147696 - DNA, 103 bp, Artificial Sequence
  Synthetic Polynucleotide
taatacgactcactatagggcttgcagcctcaacatttaggtgggttcttaacagaggagaaagaacatgcctaaatgtaacctggcggcagcgcaaaagatg

SEQ ID NO: 147697 - DNA, 103 bp, Artificial Sequence
  Synthetic Polynucleotide
taatacgactcactatagggtatgttctttcttgcagcctcaacatttagaacagaggagactaaatatggaggctgcaaacctggcggcagcgcaaaagatg

SEQ ID NO: 147698 - DNA, 103 bp, Artificial Sequence
  Synthetic Polynucleotide
taatacgactcactatagggcggcacatggtatgttctttcttgcagcctaacagaggagaaggctgatggaaagaacaaacctggcggcagcgcaaaagatg

SEQ ID NO: 147699 - DNA, 103 bp, Artificial Sequence
  Synthetic Polynucleotide
taatacgactcactatagggatactctcttttggcctttcagaaatcattaacagaggagaaatgatatgtgaaaggccaacctggcggcagcgcaaaagatg

SEQ ID NO: 147700 - DNA, 103 bp, Artificial Sequence
  Synthetic Polynucleotide
taatacgactcactatagggggtgacacagcggcacatggtatgttctttaacagaggagaaaagaaatgaccatgtgcaacctggcggcagcgcaaaagatg

SEQ ID NO: 147701 - DNA, 103 bp, Artificial Sequence
  Synthetic Polynucleotide
taatacgactcactatagggggatctgtttggtgacacagcggcacatggaacagaggagaccatgtatggctgtgtcaaacctggcggcagcgcaaaagatg

SEQ ID NO: 147702 - DNA, 103 bp, Artificial Sequence
  Synthetic Polynucleotide
taatacgactcactatagggtctcacatttggatctgtttggtgacacagaacagaggagactgtgtatgcaaacagataacctggcggcagcgcaaaagatg

SEQ ID NO: 147703 - DNA, 103 bp, Artificial Sequence
  Synthetic Polynucleotide
taatacgactcactatagggactgtgtttctctcacatttggatctgtttaacagaggagaaaacagatgcaaatgtgaaacctggcggcagcgcaaaagatg

SEQ ID NO: 147704 - DNA, 103 bp, Artificial Sequence
  Synthetic Polynucleotide
taatacgactcactatagggaacatctgccactgtgtttctctcacatttaacagaggagaaaatgtatgagaaacacaaacctggcggcagcgcaaaagatg

SEQ ID NO: 147705 - DNA, 103 bp, Artificial Sequence
  Synthetic Polynucleotide
taatacgactcactatagggctttctcatcaacatctgccactgtgtttcaacagaggagagaaacaatgtggcagatgaacctggcggcagcgcaaaagatg

SEQ ID NO: 147706 - DNA, 103 bp, Artificial Sequence
  Synthetic Polynucleotide
taatacgactcactataggggcagcacttgctttctcatcaacatctgccaacagaggagaggcagaatgtgatgagaaaacctggcggcagcgcaaaagatg

SEQ ID NO: 147707 - DNA, 103 bp, Artificial Sequence
  Synthetic Polynucleotide
taatacgactcactataggggtcataaagtgcagcacttgctttctcatcaacagaggagagatgagatggcaagtgctaacctggcggcagcgcaaaagatg

SEQ ID NO: 147708 - DNA, 103 bp, Artificial Sequence
  Synthetic Polynucleotide
taatacgactcactataggggcacagaaaagtcataaagtgcagcacttgaacagaggagacaagtgatgcactttatgaacctggcggcagcgcaaaagatg

SEQ ID NO: 147709 - DNA, 103 bp, Artificial Sequence
  Synthetic Polynucleotide
taatacgactcactatagggtctgaggaaggcacagaaaagtcataaagtaacagaggagaactttaatgcttttctgtaacctggcggcagcgcaaaagatg

SEQ ID NO: 147710 - DNA, 103 bp, Artificial Sequence
  Synthetic Polynucleotide
taatacgactcactatagggccaggaatacatactctcttttggcctttcaacagaggagagaaaggatgaaagagagtaacctggcggcagcgcaaaagatg

SEQ ID NO: 147711 - DNA, 103 bp, Artificial Sequence
  Synthetic Polynucleotide
taatacgactcactataggggatgaccgtctctgaggaaggcacagaaaaaacagaggagattttctatgccttcctcaaacctggcggcagcgcaaaagatg

SEQ ID NO: 147712 - DNA, 103 bp, Artificial Sequence
  Synthetic Polynucleotide
taatacgactcactataggggagacctgcagatgaccgtctctgaggaagaacagaggagacttcctatgagacggtcaaacctggcggcagcgcaaaagatg

SEQ ID NO: 147713 - DNA, 103 bp, Artificial Sequence
  Synthetic Polynucleotide
taatacgactcactatagggggggctggctgagacctgcagatgaccgtcaacagaggagagacggtatgctgcaggtcaacctggcggcagcgcaaaagatg

SEQ ID NO: 147714 - DNA, 103 bp, Artificial Sequence
  Synthetic Polynucleotide
taatacgactcactatagggtggggacacaggggctggctgagacctgcaaacagaggagatgcaggatgcagccagccaacctggcggcagcgcaaaagatg

SEQ ID NO: 147715 - DNA, 103 bp, Artificial Sequence
  Synthetic Polynucleotide
taatacgactcactatagggacttctgttgtggggacacaggggctggctaacagaggagaagccagatgctgtgtcccaacctggcggcagcgcaaaagatg

SEQ ID NO: 147716 - DNA, 103 bp, Artificial Sequence
  Synthetic Polynucleotide
taatacgactcactatagggaccaacactgacttctgttgtggggacacaaacagaggagatgtgtcatgacaacagaaaacctggcggcagcgcaaaagatg

SEQ ID NO: 147717 - DNA, 103 bp, Artificial Sequence
  Synthetic Polynucleotide
taatacgactcactatagggaggtggagagaccaacactgacttctgttgaacagaggagacaacagatgtcagtgttgaacctggcggcagcgcaaaagatg

SEQ ID NO: 147718 - DNA, 103 bp, Artificial Sequence
  Synthetic Polynucleotide
taatacgactcactatagggcagatactgcaggtggagagaccaacactgaacagaggagacagtgtatgtctctccacaacctggcggcagcgcaaaagatg

SEQ ID NO: 147719 - DNA, 103 bp, Artificial Sequence
  Synthetic Polynucleotide
taatacgactcactatagggactccccctgcagatactgcaggtggagagaacagaggagactctccatgtgcagtatcaacctggcggcagcgcaaaagatg

SEQ ID NO: 147720 - DNA, 103 bp, Artificial Sequence
  Synthetic Polynucleotide
taatacgactcactatagggcataggtggcactccccctgcagatactgcaacagaggagagcagtaatggcagggggaaacctggcggcagcgcaaaagatg

SEQ ID NO: 147721 - DNA, 103 bp, Artificial Sequence
  Synthetic Polynucleotide
taatacgactcactatagggcagttttgttccaggaatacatactctcttaacagaggagaaagagaatgtgtattcctaacctggcggcagcgcaaaagatg

SEQ ID NO: 147722 - DNA, 103 bp, Artificial Sequence
  Synthetic Polynucleotide
taatacgactcactatagggagatgaccggcataggtggcactccccctgaacagaggagacaggggatgtgccacctaaacctggcggcagcgcaaaagatg

SEQ ID NO: 147723 - DNA, 103 bp, Artificial Sequence
  Synthetic Polynucleotide
taatacgactcactatagggaccatctggcagatgaccggcataggtggcaacagaggagagccaccatggccggtcataacctggcggcagcgcaaaagatg

SEQ ID NO: 147724 - DNA, 103 bp, Artificial Sequence
  Synthetic Polynucleotide
taatacgactcactatagggaggaaggggaaccatctggcagatgaccggaacagaggagaccggtcatgtgccagatgaacctggcggcagcgcaaaagatg

SEQ ID NO: 147725 - DNA, 103 bp, Artificial Sequence
  Synthetic Polynucleotide
taatacgactcactatagggggttgttggcaggaaggggaaccatctggcaacagaggagagccagaatgttccccttcaacctggcggcagcgcaaaagatg

SEQ ID NO: 147726 - DNA, 103 bp, Artificial Sequence
  Synthetic Polynucleotide
taatacgactcactataggggtcacaacagggttgttggcaggaaggggaaacagaggagatcccctatgtgccaacaaaacctggcggcagcgcaaaagatg

SEQ ID NO: 147727 - DNA, 103 bp, Artificial Sequence
  Synthetic Polynucleotide
taatacgactcactatagggaacgactgttgtcacaacagggttgttggcaacagaggagagccaacatgcctgttgtgaacctggcggcagcgcaaaagatg

SEQ ID NO: 147728 - DNA, 103 bp, Artificial Sequence
  Synthetic Polynucleotide
taatacgactcactataggggagtgctgggaacgactgttgtcacaacagaacagaggagactgttgatgcaacagtcgaacctggcggcagcgcaaaagatg

SEQ ID NO: 147729 - DNA, 103 bp, Artificial Sequence
  Synthetic Polynucleotide
taatacgactcactatagggtggctgggaggagtgctgggaacgactgttaacagaggagaaacagtatgtcccagcacaacctggcggcagcgcaaaagatg

SEQ ID NO: 147730 - DNA, 103 bp, Artificial Sequence
  Synthetic Polynucleotide
taatacgactcactatagggggctggtggctggctgggaggagtgctgggaacagaggagacccagcatgcctcccagcaacctggcggcagcgcaaaagatg

SEQ ID NO: 147731 - DNA, 103 bp, Artificial Sequence
  Synthetic Polynucleotide
taatacgactcactataggggggggcaaacggctggtggctggctgggagaacagaggagactcccaatgagccaccagaacctggcggcagcgcaaaagatg

SEQ ID NO: 147732 - DNA, 103 bp, Artificial Sequence
  Synthetic Polynucleotide
taatacgactcactatagggcttttctctgcagttttgttccaggaatacaacagaggagagtattcatggaacaaaacaacctggcggcagcgcaaaagatg

SEQ ID NO: 147733 - DNA, 103 bp, Artificial Sequence
  Synthetic Polynucleotide
taatacgactcactatagggaacacaacaggggggcaaacggctggtggcaacagaggagagccaccatgcgtttgcccaacctggcggcagcgcaaaagatg

SEQ ID NO: 147734 - DNA, 103 bp, Artificial Sequence
  Synthetic Polynucleotide
taatacgactcactatagggtgtgcccatgaacacaacaggggggcaaacaacagaggagagtttgcatgcctgttgtgaacctggcggcagcgcaaaagatg

SEQ ID NO: 147735 - DNA, 103 bp, Artificial Sequence
  Synthetic Polynucleotide
taatacgactcactatagggtggggacttgtgtgcccatgaacacaacagaacagaggagactgttgatgtcatgggcaaacctggcggcagcgcaaaagatg

SEQ ID NO: 147736 - DNA, 103 bp, Artificial Sequence
  Synthetic Polynucleotide
taatacgactcactatagggacagcgcctttggggacttgtgtgcccatgaacagaggagacatgggatgacaagtcccaacctggcggcagcgcaaaagatg

SEQ ID NO: 147737 - DNA, 103 bp, Artificial Sequence
  Synthetic Polynucleotide
taatacgactcactatagggcacaaacatgacagcgcctttggggacttgaacagaggagacaagtcatgaaaggcgctaacctggcggcagcgcaaaagatg

SEQ ID NO: 147738 - DNA, 103 bp, Artificial Sequence
  Synthetic Polynucleotide
taatacgactcactataggggctggggtaccacaaacatgacagcgccttaacagaggagaaaggcgatgtcatgtttgaacctggcggcagcgcaaaagatg

SEQ ID NO: 147739 - DNA, 103 bp, Artificial Sequence
  Synthetic Polynucleotide
taatacgactcactatagggtgcacaacgggctggggtaccacaaacatgaacagaggagacatgttatgggtaccccaaacctggcggcagcgcaaaagatg

SEQ ID NO: 147740 - DNA, 103 bp, Artificial Sequence
  Synthetic Polynucleotide
taatacgactcactatagggctttgaactctgcacaacgggctggggtacaacagaggagagtacccatgcccgttgtgaacctggcggcagcgcaaaagatg

SEQ ID NO: 147741 - DNA, 103 bp, Artificial Sequence
  Synthetic Polynucleotide
taatacgactcactatagggccaccggaggctttgaactctgcacaacggaacagaggagaccgttgatgagagttcaaaacctggcggcagcgcaaaagatg

SEQ ID NO: 147742 - DNA, 103 bp, Artificial Sequence
  Synthetic Polynucleotide
taatacgactcactatagggttcgggctcaccaccggaggctttgaactcaacagaggagagagttcatggcctccggtaacctggcggcagcgcaaaagatg

SEQ ID NO: 147743 - DNA, 103 bp, Artificial Sequence
  Synthetic Polynucleotide
taatacgactcactataggggtctgggcctgcgaagtccggcgtgtgcataacagaggagaatgcacatgccggacttcaacctggcggcagcgcaaaagatg

SEQ ID NO: 147744 - DNA, 103 bp, Artificial Sequence
  Synthetic Polynucleotide
taatacgactcactatagggcaagatgctgcaagtagacctttcgctgtcaacagaggagagacagcatgaggtctactaacctggcggcagcgcaaaagatg

SEQ ID NO: 147745 - DNA, 103 bp, Artificial Sequence
  Synthetic Polynucleotide
taatacgactcactatagggcatcacagctccctgaggcacagcaggtccaacagaggagaggacctatggtgcctcagaacctggcggcagcgcaaaagatg

SEQ ID NO: 147746 - DNA, 103 bp, Artificial Sequence
  Synthetic Polynucleotide
taatacgactcactataggggcaggaccaacatcacagctccctgaggcaaacagaggagatgcctcatggagctgtgaaacctggcggcagcgcaaaagatg

SEQ ID NO: 147747 - DNA, 103 bp, Artificial Sequence
  Synthetic Polynucleotide
taatacgactcactataggggctccctggggcaggaccaacatcacagctaacagaggagaagctgtatggttggtcctaacctggcggcagcgcaaaagatg

SEQ ID NO: 147748 - DNA, 103 bp, Artificial Sequence
  Synthetic Polynucleotide
taatacgactcactatagggcggagggagggctccctggggcaggaccaaaacagaggagattggtcatgccccagggaaacctggcggcagcgcaaaagatg

SEQ ID NO: 147749 - DNA, 103 bp, Artificial Sequence
  Synthetic Polynucleotide
taatacgactcactatagggagggggcaggcggagggagggctccctgggaacagaggagacccaggatgccctccctcaacctggcggcagcgcaaaagatg

SEQ ID NO: 147750 - DNA, 103 bp, Artificial Sequence
  Synthetic Polynucleotide
taatacgactcactatagggttggctgcacagggggcaggcggagggaggaacagaggagacctcccatggcctgccccaacctggcggcagcgcaaaagatg

SEQ ID NO: 147751 - DNA, 103 bp, Artificial Sequence
  Synthetic Polynucleotide
taatacgactcactatagggagccatgacattggctgcacagggggcaggaacagaggagacctgccatgtgtgcagccaacctggcggcagcgcaaaagatg

SEQ ID NO: 147752 - DNA, 103 bp, Artificial Sequence
  Synthetic Polynucleotide
taatacgactcactatagggtattcccggcagccatgacattggctgcacaacagaggagagtgcagatgatgtcatggaacctggcggcagcgcaaaagatg

SEQ ID NO: 147753 - DNA, 103 bp, Artificial Sequence
  Synthetic Polynucleotide
taatacgactcactatagggaacaacttggtattcccggcagccatgacaaacagaggagatgtcatatgtgccgggaaaacctggcggcagcgcaaaagatg

SEQ ID NO: 147754 - DNA, 103 bp, Artificial Sequence
  Synthetic Polynucleotide
taatacgactcactatagggggcaaggggcaacaacttggtattcccggcaacagaggagagccgggatgaccaagttgaacctggcggcagcgcaaaagatg

SEQ ID NO: 147755 - DNA, 103 bp, Artificial Sequence
  Synthetic Polynucleotide
taatacgactcactatagggctgtctgctccaagatgctgcaagtagaccaacagaggagaggtctaatggcagcatctaacctggcggcagcgcaaaagatg

SEQ ID NO: 147756 - DNA, 103 bp, Artificial Sequence
  Synthetic Polynucleotide
taatacgactcactatagggctggagcaggggcaaggggcaacaacttggaacagaggagaccaagtatgtgccccttgaacctggcggcagcgcaaaagatg

SEQ ID NO: 147757 - DNA, 103 bp, Artificial Sequence
  Synthetic Polynucleotide
taatacgactcactataggggtgatgaacactggagcaggggcaaggggcaacagaggagagcccctatgccctgctccaacctggcggcagcgcaaaagatg

SEQ ID NO: 147758 - DNA, 103 bp, Artificial Sequence
  Synthetic Polynucleotide
taatacgactcactatagggttggctagaggtgatgaacactggagcaggaacagaggagacctgctatggtgttcatcaacctggcggcagcgcaaaagatg

SEQ ID NO: 147759 - DNA, 103 bp, Artificial Sequence
  Synthetic Polynucleotide
taatacgactcactatagggggacacagttttggctagaggtgatgaacaaacagaggagatgttcaatgcctctagccaacctggcggcagcgcaaaagatg

SEQ ID NO: 147760 - DNA, 103 bp, Artificial Sequence
  Synthetic Polynucleotide
taatacgactcactatagggtctacctgagggacacagttttggctagagaacagaggagactctagatgaaactgtgtaacctggcggcagcgcaaaagatg

SEQ ID NO: 147761 - DNA, 103 bp, Artificial Sequence
  Synthetic Polynucleotide
taatacgactcactatagggtcgggaaaagtctacctgagggacacagttaacagaggagaaactgtatgcctcaggtaaacctggcggcagcgcaaaagatg

SEQ ID NO: 147762 - DNA, 103 bp, Artificial Sequence
  Synthetic Polynucleotide
taatacgactcactatagggagttcctccttcgggaaaagtctacctgagaacagaggagactcaggatgacttttcccaacctggcggcagcgcaaaagatg

SEQ ID NO: 147763 - DNA, 103 bp, Artificial Sequence
  Synthetic Polynucleotide
taatacgactcactatagggctgcatacatagttcctccttcgggaaaagaacagaggagacttttcatgaaggaggaaaacctggcggcagcgcaaaagatg

SEQ ID NO: 147764 - DNA, 103 bp, Artificial Sequence
  Synthetic Polynucleotide
taatacgactcactatagggacctgggaagctgcatacatagttcctcctaacagaggagaaggaggatgtatgtatgcaacctggcggcagcgcaaaagatg

SEQ ID NO: 147765 - DNA, 103 bp, Artificial Sequence
  Synthetic Polynucleotide
taatacgactcactatagggtcttccggcaacctgggaagctgcatacataacagaggagaatgtatatggcttcccagaacctggcggcagcgcaaaagatg

SEQ ID NO: 147766 - DNA, 103 bp, Artificial Sequence
  Synthetic Polynucleotide
taatacgactcactataggggcttccatgtctgtctgctccaagatgctgaacagaggagacagcatatgggagcagacaacctggcggcagcgcaaaagatg

SEQ ID NO: 147767 - DNA, 103 bp, Artificial Sequence
  Synthetic Polynucleotide
taatacgactcactatagggttgaagtaggtcttccggcaacctgggaagaacagaggagacttcccatgttgccggaaaacctggcggcagcgcaaaagatg

SEQ ID NO: 147768 - DNA, 103 bp, Artificial Sequence
  Synthetic Polynucleotide
taatacgactcactataggggtgggaacttttgaagtaggtcttccggcaaacagaggagatgccggatgacctacttcaacctggcggcagcgcaaaagatg

SEQ ID NO: 147769 - DNA, 103 bp, Artificial Sequence
  Synthetic Polynucleotide
taatacgactcactataggggggccttaaggtgggaacttttgaagtaggaacagaggagacctactatgaaagttcccaacctggcggcagcgcaaaagatg

SEQ ID NO: 147770 - DNA, 103 bp, Artificial Sequence
  Synthetic Polynucleotide
taatacgactcactataggggtgcgaagatgggccttaaggtgggaacttaacagaggagaaagttcatgccttaaggcaacctggcggcagcgcaaaagatg

SEQ ID NO: 147771 - DNA, 103 bp, Artificial Sequence
  Synthetic Polynucleotide
taatacgactcactatagggccctgtgtgagtgcgaagatgggccttaagaacagaggagacttaagatgcatcttcgcaacctggcggcagcgcaaaagatg

SEQ ID NO: 147772 - DNA, 103 bp, Artificial Sequence
  Synthetic Polynucleotide
taatacgactcactatagggaaggcttctcccctgtgtgagtgcgaagataacagaggagaatcttcatgctcacacagaacctggcggcagcgcaaaagatg

SEQ ID NO: 147773 - DNA, 103 bp, Artificial Sequence
  Synthetic Polynucleotide
taatacgactcactatagggctgcagttgaaaggcttctcccctgtgtgaaacagaggagatcacacatgggagaagccaacctggcggcagcgcaaaagatg

SEQ ID NO: 147774 - DNA, 103 bp, Artificial Sequence
  Synthetic Polynucleotide
taatacgactcactataggggccatcccagctgcagttgaaaggcttctcaacagaggagagagaagatgttcaactgcaacctggcggcagcgcaaaagatg

SEQ ID NO: 147775 - DNA, 103 bp, Artificial Sequence
  Synthetic Polynucleotide
taatacgactcactatagggttttatcacagccatcccagctgcagttgaaacagaggagatcaactatggctgggatgaacctggcggcagcgcaaaagatg

SEQ ID NO: 147776 - DNA, 103 bp, Artificial Sequence
  Synthetic Polynucleotide
taatacgactcactatagggcgagcaaactttttatcacagccatcccagaacagaggagactgggaatgctgtgataaaacctggcggcagcgcaaaagatg

SEQ ID NO: 147777 - DNA, 103 bp, Artificial Sequence
  Synthetic Polynucleotide
taatacgactcactatagggagcctcgacagcttccatgtctgtctgctcaacagaggagagagcagatggacatggaaaacctggcggcagcgcaaaagatg

SEQ ID NO: 147778 - DNA, 103 bp, Artificial Sequence
  Synthetic Polynucleotide
taatacgactcactatagggctcatccgaacgagcaaactttttatcacaaacagaggagatgtgatatgaagtttgctaacctggcggcagcgcaaaagatg

SEQ ID NO: 147779 - DNA, 103 bp, Artificial Sequence
  Synthetic Polynucleotide
taatacgactcactatagggggcgtgacagctcatccgaacgagcaaactaacagaggagaagtttgatggttcggatgaacctggcggcagcgcaaaagatg

SEQ ID NO: 147780 - DNA, 103 bp, Artificial Sequence
  Synthetic Polynucleotide
taatacgactcactataggggttctgcggtggcgtgacagctcatccgaaaacagaggagattcggaatggctgtcacgaacctggcggcagcgcaaaagatg

SEQ ID NO: 147781 - DNA, 103 bp, Artificial Sequence
  Synthetic Polynucleotide
taatacgactcactatagggccctgtgtgagttctgcggtggcgtgacagaacagaggagactgtcaatgcaccgcagaaacctggcggcagcgcaaaagatg

SEQ ID NO: 147782 - DNA, 103 bp, Artificial Sequence
  Synthetic Polynucleotide
taatacgactcactatagggacttcttctcccctgtgtgagttctgcggtaacagaggagaaccgcaatgctcacacagaacctggcggcagcgcaaaagatg

SEQ ID NO: 147783 - DNA, 103 bp, Artificial Sequence
  Synthetic Polynucleotide
taatacgactcactataggggggcacacaaacttcttctcccctgtgtgaaacagaggagatcacacatgggagaagaaaacctggcggcagcgcaaaagatg

SEQ ID NO: 147784 - DNA, 103 bp, Artificial Sequence
  Synthetic Polynucleotide
taatacgactcactataggggtcacacaccgggcacacaaacttcttctcaacagaggagagagaagatgtttgtgtgcaacctggcggcagcgcaaaagatg

SEQ ID NO: 147785 - DNA, 103 bp, Artificial Sequence
  Synthetic Polynucleotide
taatacgactcactatagggtgaaacgtcggtcacacaccgggcacacaaaacagaggagattgtgtatgcggtgtgtgaacctggcggcagcgcaaaagatg

SEQ ID NO: 147786 - DNA, 103 bp, Artificial Sequence
  Synthetic Polynucleotide
taatacgactcactatagggtcactgcgcatgaaacgtcggtcacacaccaacagaggagaggtgtgatgccgacgtttaacctggcggcagcgcaaaagatg

SEQ ID NO: 147787 - DNA, 103 bp, Artificial Sequence
  Synthetic Polynucleotide
taatacgactcactatagggcgtcaggtggtcactgcgcatgaaacgtcgaacagaggagacgacgtatgatgcgcagtaacctggcggcagcgcaaaagatg

SEQ ID NO: 147788 - DNA, 103 bp, Artificial Sequence
  Synthetic Polynucleotide
taatacgactcactatagggtacaaacaagagcctcgacagcttccatgtaacagaggagaacatggatgctgtcgaggaacctggcggcagcgcaaaagatg

SEQ ID NO: 147789 - DNA, 103 bp, Artificial Sequence
  Synthetic Polynucleotide
taatacgactcactataggggggcatgcttcgtcaggtggtcactgcgcaaacagaggagatgcgcaatgaccacctgaaacctggcggcagcgcaaaagatg

SEQ ID NO: 147790 - DNA, 103 bp, Artificial Sequence
  Synthetic Polynucleotide
taatacgactcactatagggatgtggcgccgggcatgcttcgtcaggtggaacagaggagaccacctatggaagcatgcaacctggcggcagcgcaaaagatg

SEQ ID NO: 147791 - DNA, 103 bp, Artificial Sequence
  Synthetic Polynucleotide
taatacgactcactatagggcttggtcgtcatgtggcgccgggcatgcttaacagaggagaaagcatatgcggcgccacaacctggcggcagcgcaaaagatg

SEQ ID NO: 147792 - DNA, 103 bp, Artificial Sequence
  Synthetic Polynucleotide
taatacgactcactatagggctgggatcttcttggtcgtcatgtggcgccaacagaggagaggcgccatgtgacgaccaaacctggcggcagcgcaaaagatg

SEQ ID NO: 147793 - DNA, 103 bp, Artificial Sequence
  Synthetic Polynucleotide
taatacgactcactataggggcctgccagcctgggatcttcttggtcgtcaacagaggagagacgacatggaagatcccaacctggcggcagcgcaaaagatg

SEQ ID NO: 147794 - DNA, 103 bp, Artificial Sequence
  Synthetic Polynucleotide
taatacgactcactataggggccaacctctgcctgccagcctgggatcttaacagaggagaaagatcatgggctggcagaacctggcggcagcgcaaaagatg

SEQ ID NO: 147795 - DNA, 103 bp, Artificial Sequence
  Synthetic Polynucleotide
taatacgactcactatagggtgttcagcttgccaacctctgcctgccagcaacagaggagagctggcatgcagaggttgaacctggcggcagcgcaaaagatg

SEQ ID NO: 147796 - DNA, 103 bp, Artificial Sequence
  Synthetic Polynucleotide
taatacgactcactataggggaggcgattctgttcagcttgccaacctctaacagaggagaagaggtatgcaagctgaaaacctggcggcagcgcaaaagatg

SEQ ID NO: 147797 - DNA, 103 bp, Artificial Sequence
  Synthetic Polynucleotide
taatacgactcactataggggctctctgcagaggcgattctgttcagcttaacagaggagaaagctgatgagaatcgccaacctggcggcagcgcaaaagatg

SEQ ID NO: 147798 - DNA, 103 bp, Artificial Sequence
  Synthetic Polynucleotide
taatacgactcactatagggggctccccgggctctctgcagaggcgattcaacagaggagagaatcgatgctgcagagaaacctggcggcagcgcaaaagatg

SEQ ID NO: 147799 - DNA, 103 bp, Artificial Sequence
  Synthetic Polynucleotide
taatacgactcactatagggcaggagctcatacaaacaagagcctcgacaaacagaggagatgtcgaatgtcttgtttgaacctggcggcagcgcaaaagatg

SEQ ID NO: 147800 - DNA, 103 bp, Artificial Sequence
  Synthetic Polynucleotide
taatacgactcactatagggctcaccagtgggctccccgggctctctgcaaacagaggagatgcagaatgcccggggagaacctggcggcagcgcaaaagatg

SEQ ID NO: 147801 - DNA, 103 bp, Artificial Sequence
  Synthetic Polynucleotide
taatacgactcactatagggggctggcatgctcaccagtgggctccccggaacagaggagaccggggatgccactggtgaacctggcggcagcgcaaaagatg

SEQ ID NO: 147802 - DNA, 103 bp, Artificial Sequence
  Synthetic Polynucleotide
taatacgactcactatagggtctttgaccccaggagctcatacaaacaagaacagaggagacttgttatgatgagctccaacctggcggcagcgcaaaagatg

SEQ ID NO: 147803 - DNA, 103 bp, Artificial Sequence
  Synthetic Polynucleotide
taatacgactcactatagggctttctgggatctttgaccccaggagctcaaacagaggagatgagctatgggggtcaaaaacctggcggcagcgcaaaagatg

SEQ ID NO: 147804 - DNA, 103 bp, Artificial Sequence
  Synthetic Polynucleotide
taatacgactcactatagggaacaggtcacctttctgggatctttgacccaacagaggagagggtcaatgatcccagaaaacctggcggcagcgcaaaagatg

SEQ ID NO: 147805 - DNA, 103 bp, Artificial Sequence
  Synthetic Polynucleotide
taatacgactcactatagggtcttatccgcaacaggtcacctttctgggaaacagaggagatcccagatgggtgacctgaacctggcggcagcgcaaaagatg

SEQ ID NO: 147806 - DNA, 103 bp, Artificial Sequence
  Synthetic Polynucleotide
taatacgactcactatagggcgcgcgcgtcgtctgggcctgcgaagtccgaacagaggagacggactatgcaggcccagaacctggcggcagcgcaaaagatg

SEQ ID NO: 147807 - DNA, 103 bp, Artificial Sequence
  Synthetic Polynucleotide
taatacgactcactataggggcgtgaggggtcttatccgcaacaggtcacaacagaggagagtgaccatgtgcggataaaacctggcggcagcgcaaaagatg

SEQ ID NO: 147808 - DNA, 103 bp, Artificial Sequence
  Synthetic Polynucleotide
taatacgactcactatagggtcagagacaggcgtgaggggtcttatccgcaacagaggagagcggatatgacccctcacaacctggcggcagcgcaaaagatg

SEQ ID NO: 147809 - DNA, 103 bp, Artificial Sequence
  Synthetic Polynucleotide
taatacgactcactatagggatccccagagtcagagacaggcgtgaggggaacagaggagacccctcatgcctgtctctaacctggcggcagcgcaaaagatg

SEQ ID NO: 147810 - DNA, 103 bp, Artificial Sequence
  Synthetic Polynucleotide
taatacgactcactatagggtggtggtgacatccccagagtcagagacagaacagaggagactgtctatgactctggggaacctggcggcagcgcaaaagatg

SEQ ID NO: 147811 - DNA, 103 bp, Artificial Sequence
  Synthetic Polynucleotide
taatacgactcactatagggatatgcacagtggtggtgacatccccagagaacagaggagactctggatgtgtcaccacaacctggcggcagcgcaaaagatg

SEQ ID NO: 147812 - DNA, 103 bp, Artificial Sequence
  Synthetic Polynucleotide
taatacgactcactatagggggctgcatccatatgcacagtggtggtgacaacagaggagagtcaccatgactgtgcataacctggcggcagcgcaaaagatg

SEQ ID NO: 147813 - DNA, 103 bp, Artificial Sequence
  Synthetic Polynucleotide
taatacgactcactataggggttcaggtgtggctgcatccatatgcacagaacagaggagactgtgcatgtggatgcagaacctggcggcagcgcaaaagatg

SEQ ID NO: 147814 - DNA, 103 bp, Artificial Sequence
  Synthetic Polynucleotide
taatacgactcactatagggtcttttggtagttcaggtgtggctgcatccaacagaggagaggatgcatgcacacctgaaacctggcggcagcgcaaaagatg

SEQ ID NO: 147815 - DNA, 103 bp, Artificial Sequence
  Synthetic Polynucleotide
taatacgactcactatagggagaatggaagtcttttggtagttcaggtgtaacagaggagaacacctatgctaccaaaaaacctggcggcagcgcaaaagatg

SEQ ID NO: 147816 - DNA, 103 bp, Artificial Sequence
  Synthetic Polynucleotide
taatacgactcactataggggagtcgataaagaatggaagtcttttggtaaacagaggagataccaaatgacttccattaacctggcggcagcgcaaaagatg

SEQ ID NO: 147817 - DNA, 103 bp, Artificial Sequence
  Synthetic Polynucleotide
taatacgactcactatagggatgtcaactgcgcgcgcgtcgtctgggcctaacagaggagaaggcccatgcgacgcgcgaacctggcggcagcgcaaaagatg

SEQ ID NO: 147818 - DNA, 103 bp, Artificial Sequence
  Synthetic Polynucleotide
taatacgactcactataggggttatgcacagagtcgataaagaatggaagaacagaggagacttccaatgtttatcgacaacctggcggcagcgcaaaagatg

SEQ ID NO: 147819 - DNA, 103 bp, Artificial Sequence
  Synthetic Polynucleotide
taatacgactcactatagggctgaggaggagttatgcacagagtcgataaaacagaggagattatcgatgctgtgcataaacctggcggcagcgcaaaagatg

SEQ ID NO: 147820 - DNA, 103 bp, Artificial Sequence
  Synthetic Polynucleotide
taatacgactcactataggggatcagggctctgaggaggagttatgcacaaacagaggagatgtgcaatgctcctcctcaacctggcggcagcgcaaaagatg

SEQ ID NO: 147821 - DNA, 103 bp, Artificial Sequence
  Synthetic Polynucleotide
taatacgactcactatagggggctccacgagatcagggctctgaggaggaaacagaggagatcctccatggagccctgaaacctggcggcagcgcaaaagatg

SEQ ID NO: 147822 - DNA, 103 bp, Artificial Sequence
  Synthetic Polynucleotide
taatacgactcactatagggccttgtcgatggctccacgagatcagggctaacagaggagaagccctatgctcgtggagaacctggcggcagcgcaaaagatg

SEQ ID NO: 147823 - DNA, 103 bp, Artificial Sequence
  Synthetic Polynucleotide
taatacgactcactatagggaaacaggtgtccttgtcgatggctccacgaaacagaggagatcgtggatgcatcgacaaaacctggcggcagcgcaaaagatg

SEQ ID NO: 147824 - DNA, 103 bp, Artificial Sequence
  Synthetic Polynucleotide
taatacgactcactatagggacttggggagaaacaggtgtccttgtcgataacagaggagaatcgacatggacacctgtaacctggcggcagcgcaaaagatg

SEQ ID NO: 147825 - DNA, 103 bp, Artificial Sequence
  Synthetic Polynucleotide
taatacgactcactatagggggaatctgttacttggggagaaacaggtgtaacagaggagaacacctatgtctccccaaaacctggcggcagcgcaaaagatg

SEQ ID NO: 147826 - DNA, 103 bp, Artificial Sequence
  Synthetic Polynucleotide
taatacgactcactatagggtacatgctttggaatctgttacttggggagaacagaggagactccccatgtaacagattaacctggcggcagcgcaaaagatg

SEQ ID NO: 147827 - DNA, 103 bp, Artificial Sequence
  Synthetic Polynucleotide
taatacgactcactatagggtccgtggctgtacatgctttggaatctgttaacagaggagaaacagaatgcaaagcatgaacctggcggcagcgcaaaagatg

SEQ ID NO: 147828 - DNA, 103 bp, Artificial Sequence
  Synthetic Polynucleotide
taatacgactcactatagggtatgtccatgatgtcaactgcgcgcgcgtcaacagaggagagacgcgatggcagttgacaacctggcggcagcgcaaaagatg

SEQ ID NO: 147829 - DNA, 103 bp, Artificial Sequence
  Synthetic Polynucleotide
taatacgactcactatagggctggagaacatccgtggctgtacatgctttaacagaggagaaaagcaatgacagccacgaacctggcggcagcgcaaaagatg

SEQ ID NO: 147830 - DNA, 103 bp, Artificial Sequence
  Synthetic Polynucleotide
taatacgactcactatagggcggcagaggactggagaacatccgtggctgaacagaggagacagccaatgatgttctccaacctggcggcagcgcaaaagatg

SEQ ID NO: 147831 - DNA, 103 bp, Artificial Sequence
  Synthetic Polynucleotide
taatacgactcactatagggctggccactacggcagaggactggagaacaaacagaggagatgttctatggtcctctgcaacctggcggcagcgcaaaagatg

SEQ ID NO: 147832 - DNA, 103 bp, Artificial Sequence
  Synthetic Polynucleotide
taatacgactcactataggggctcagagctctggccactacggcagaggaaacagaggagatcctctatggtagtggccaacctggcggcagcgcaaaagatg

SEQ ID NO: 147833 - DNA, 103 bp, Artificial Sequence
  Synthetic Polynucleotide
taatacgactcactatagggccgcgcccccgctcagagctctggccactaaacagaggagatagtggatggagctctgaaacctggcggcagcgcaaaagatg

SEQ ID NO: 147834 - DNA, 103 bp, Artificial Sequence
  Synthetic Polynucleotide
taatacgactcactatagggaagcccctctccgcgcccccgctcagagctaacagaggagaagctctatgcgggggcgcaacctggcggcagcgcaaaagatg

SEQ ID NO: 147835 - DNA, 103 bp, Artificial Sequence
  Synthetic Polynucleotide
taatacgactcactatagggcaaacccagcaagcccctctccgcgcccccaacagaggagagggggcatggagaggggcaacctggcggcagcgcaaaagatg

SEQ ID NO: 147836 - DNA, 103 bp, Artificial Sequence
  Synthetic Polynucleotide
taatacgactcactataggggcactggctccaaacccagcaagcccctctaacagaggagaagagggatgtgctgggttaacctggcggcagcgcaaaagatg

SEQ ID NO: 147837 - DNA, 103 bp, Artificial Sequence
  Synthetic Polynucleotide
taatacgactcactatagggggagagctgggcactggctccaaacccagcaacagaggagagctgggatgggagccagtaacctggcggcagcgcaaaagatg

SEQ ID NO: 147838 - DNA, 103 bp, Artificial Sequence
  Synthetic Polynucleotide
taatacgactcactatagggggccctgcagggagagctgggcactggctcaacagaggagagagccaatgcccagctctaacctggcggcagcgcaaaagatg

SEQ ID NO: 147839 - DNA, 103 bp, Artificial Sequence
  Synthetic Polynucleotide
taatacgactcactatagggtggactcacatatgtccatgatgtcaactgaacagaggagacagttgatgtcatggacaaacctggcggcagcgcaaaagatg

SEQ ID NO: 147840 - DNA, 103 bp, Artificial Sequence
  Synthetic Polynucleotide
taatacgactcactatagggtagtccccttggccctgcagggagagctggaacagaggagaccagctatgcctgcagggaacctggcggcagcgcaaaagatg

SEQ ID NO: 147841 - DNA, 103 bp, Artificial Sequence
  Synthetic Polynucleotide
taatacgactcactatagggcggatcacgctagtccccttggccctgcagaacagaggagactgcagatgcaaggggacaacctggcggcagcgcaaaagatg

SEQ ID NO: 147842 - DNA, 103 bp, Artificial Sequence
  Synthetic Polynucleotide
taatacgactcactatagggcccagtgtgtcggatcacgctagtccccttaacagaggagaaaggggatgagcgtgatcaacctggcggcagcgcaaaagatg

SEQ ID NO: 147843 - DNA, 103 bp, Artificial Sequence
  Synthetic Polynucleotide
taatacgactcactatagggcagggctctccccagtgtgtcggatcacgcaacagaggagagcgtgaatggacacactgaacctggcggcagcgcaaaagatg

SEQ ID NO: 147844 - DNA, 103 bp, Artificial Sequence
  Synthetic Polynucleotide
taatacgactcactatagggaagcaggcagcagggctctccccagtgtgtaacagaggagaacacacatgggagagcccaacctggcggcagcgcaaaagatg

SEQ ID NO: 147845 - DNA, 103 bp, Artificial Sequence
  Synthetic Polynucleotide
taatacgactcactataggggatggtgggaaagcaggcagcagggctctcaacagaggagagagagcatggctgcctgcaacctggcggcagcgcaaaagatg

SEQ ID NO: 147846 - DNA, 103 bp, Artificial Sequence
  Synthetic Polynucleotide
taatacgactcactatagggctggagtctggatggtgggaaagcaggcagaacagaggagactgcctatgttcccaccaaacctggcggcagcgcaaaagatg

SEQ ID NO: 147847 - DNA, 103 bp, Artificial Sequence
  Synthetic Polynucleotide
taatacgactcactatagggagccggcaatctggagtctggatggtgggaaacagaggagatcccacatgccagactccaacctggcggcagcgcaaaagatg

SEQ ID NO: 147848 - DNA, 103 bp, Artificial Sequence
  Synthetic Polynucleotide
taatacgactcactataggggctgtcagaaagccggcaatctggagtctgaacagaggagacagactatggattgccggaacctggcggcagcgcaaaagatg

SEQ ID NO: 147849 - DNA, 103 bp, Artificial Sequence
  Synthetic Polynucleotide
taatacgactcactatagggctccttctctgctgtcagaaagccggcaataacagaggagaattgccatgtttctgacaaacctggcggcagcgcaaaagatg

SEQ ID NO: 147850 - DNA, 103 bp, Artificial Sequence
  Synthetic Polynucleotide
taatacgactcactatagggctctccaggatggactcacatatgtccatgaacagaggagacatggaatgatgtgagtcaacctggcggcagcgcaaaagatg

SEQ ID NO: 147851 - DNA, 103 bp, Artificial Sequence
  Synthetic Polynucleotide
taatacgactcactatagggagctgctcttctccttctctgctgtcagaaaacagaggagattctgaatgcagagaaggaacctggcggcagcgcaaaagatg

SEQ ID NO: 147852 - DNA, 103 bp, Artificial Sequence
  Synthetic Polynucleotide
taatacgactcactataggggtgtcccagaagctgctcttctccttctctaacagaggagaagagaaatggaagagcagaacctggcggcagcgcaaaagatg

SEQ ID NO: 147853 - DNA, 103 bp, Artificial Sequence
  Synthetic Polynucleotide
taatacgactcactatagggaagtttcaaagtgtcccagaagctgctcttaacagaggagaaagagcatgttctgggacaacctggcggcagcgcaaaagatg

SEQ ID NO: 147854 - DNA, 103 bp, Artificial Sequence
  Synthetic Polynucleotide
taatacgactcactataggggtgtcctgcaaagtttcaaagtgtcccagaaacagaggagatctgggatgctttgaaacaacctggcggcagcgcaaaagatg

SEQ ID NO: 147855 - DNA, 103 bp, Artificial Sequence
  Synthetic Polynucleotide
taatacgactcactatagggcgtgaggtgtgtgtcctgcaaagtttcaaaaacagaggagatttgaaatgttgcaggacaacctggcggcagcgcaaaagatg

SEQ ID NO: 147856 - DNA, 103 bp, Artificial Sequence
  Synthetic Polynucleotide
taatacgactcactataggggtaaactgtccgtgaggtgtgtgtcctgcaaacagaggagatgcaggatgcacacctcaaacctggcggcagcgcaaaagatg

SEQ ID NO: 147857 - DNA, 103 bp, Artificial Sequence
  Synthetic Polynucleotide
taatacgactcactatagggttagtgctgagtaaactgtccgtgaggtgtaacagaggagaacacctatgggacagtttaacctggcggcagcgcaaaagatg

SEQ ID NO: 147858 - DNA, 103 bp, Artificial Sequence
  Synthetic Polynucleotide
taatacgactcactatagggggacaccaagttagtgctgagtaaactgtcaacagaggagagacagtatgctcagcactaacctggcggcagcgcaaaagatg

SEQ ID NO: 147859 - DNA, 103 bp, Artificial Sequence
  Synthetic Polynucleotide
taatacgactcactatagggagggctgacaggacaccaagttagtgctgaaacagaggagatcagcaatgacttggtgtaacctggcggcagcgcaaaagatg

SEQ ID NO: 147860 - DNA, 103 bp, Artificial Sequence
  Synthetic Polynucleotide
taatacgactcactatagggttgtgcaagcagggctgacaggacaccaagaacagaggagacttggtatgctgtcagccaacctggcggcagcgcaaaagatg

SEQ ID NO: 147861 - DNA, 103 bp, Artificial Sequence
  Synthetic Polynucleotide
taatacgactcactatagggatgccgcttcctctccaggatggactcacaaacagaggagatgtgagatgatcctggagaacctggcggcagcgcaaaagatg

SEQ ID NO: 147862 - DNA, 103 bp, Artificial Sequence
  Synthetic Polynucleotide
taatacgactcactataggggccaccagacttgtgcaagcagggctgacaaacagaggagatgtcagatgtgcttgcacaacctggcggcagcgcaaaagatg

SEQ ID NO: 147863 - DNA, 103 bp, Artificial Sequence
  Synthetic Polynucleotide
taatacgactcactatagggtgagcagcaggccaccagacttgtgcaagcaacagaggagagcttgcatgagtctggtgaacctggcggcagcgcaaaagatg

SEQ ID NO: 147864 - DNA, 103 bp, Artificial Sequence
  Synthetic Polynucleotide
taatacgactcactatagggcctttgtcagtgagcagcaggccaccagacaacagaggagagtctggatgcctgctgctaacctggcggcagcgcaaaagatg

SEQ ID NO: 147865 - DNA, 103 bp, Artificial Sequence
  Synthetic Polynucleotide
taatacgactcactatagggtgcctgctggcctttgtcagtgagcagcagaacagaggagactgctgatgactgacaaaaacctggcggcagcgcaaaagatg

SEQ ID NO: 147866 - DNA, 103 bp, Artificial Sequence
  Synthetic Polynucleotide
taatacgactcactatagggcaggccaccctgcctgctggcctttgtcagaacagaggagactgacaatggccagcaggaacctggcggcagcgcaaaagatg

SEQ ID NO: 147867 - DNA, 103 bp, Artificial Sequence
  Synthetic Polynucleotide
taatacgactcactatagggtgaactgcaccaggccaccctgcctgctggaacagaggagaccagcaatgagggtggccaacctggcggcagcgcaaaagatg

SEQ ID NO: 147868 - DNA, 103 bp, Artificial Sequence
  Synthetic Polynucleotide
taatacgactcactatagggtgagcaagtctgaactgcaccaggccacccaacagaggagagggtggatgggtgcagttaacctggcggcagcgcaaaagatg

SEQ ID NO: 147869 - DNA, 103 bp, Artificial Sequence
  Synthetic Polynucleotide
taatacgactcactatagggaattctttggtgagcaagtctgaactgcacaacagaggagagtgcagatgagacttgctaacctggcggcagcgcaaaagatg

SEQ ID NO: 147870 - DNA, 103 bp, Artificial Sequence
  Synthetic Polynucleotide
taatacgactcactatagggtcattttcataattctttggtgagcaagtcaacagaggagagacttgatgaccaaagaaaacctggcggcagcgcaaaagatg

SEQ ID NO: 147871 - DNA, 103 bp, Artificial Sequence
  Synthetic Polynucleotide
taatacgactcactatagggcctgggcaggtcattttcataattctttggaacagaggagaccaaagatgtatgaaaataacctggcggcagcgcaaaagatg

SEQ ID NO: 147872 - DNA, 103 bp, Artificial Sequence
  Synthetic Polynucleotide
taatacgactcactatagggtttcgctgtcatgccgcttcctctccaggaaacagaggagatcctggatgggaagcggcaacctggcggcagcgcaaaagatg

SEQ ID NO: 147873 - DNA, 103 bp, Artificial Sequence
  Synthetic Polynucleotide
taatacgactcactataggggggtggttttcctgggcaggtcattttcataacagaggagaatgaaaatgacctgcccaaacctggcggcagcgcaaaagatg

SEQ ID NO: 147874 - DNA, 103 bp, Artificial Sequence
  Synthetic Polynucleotide
taatacgactcactataggggaaatcagaggggtggttttcctgggcaggaacagaggagacctgccatggaaaaccacaacctggcggcagcgcaaaagatg

SEQ ID NO: 147875 - DNA, 103 bp, Artificial Sequence
  Synthetic Polynucleotide
taatacgactcactataggggacagagacagaaatcagaggggtggttttaacagaggagaaaaaccatgcctctgattaacctggcggcagcgcaaaagatg

SEQ ID NO: 147876 - DNA, 103 bp, Artificial Sequence
  Synthetic Polynucleotide
taatacgactcactatagggggggagcagggacagagacagaaatcagagaacagaggagactctgaatgctgtctctgaacctggcggcagcgcaaaagatg

SEQ ID NO: 147877 - DNA, 103 bp, Artificial Sequence
  Synthetic Polynucleotide
taatacgactcactatagggcaaaggacagggggagcagggacagagacaaacagaggagatgtctcatgccctgctccaacctggcggcagcgcaaaagatg

SEQ ID NO: 147878 - DNA, 103 bp, Artificial Sequence
  Synthetic Polynucleotide
taatacgactcactataggggatcatctggcaaaggacagggggagcaggaacagaggagacctgctatgcctgtccttaacctggcggcagcgcaaaagatg

SEQ ID NO: 147879 - DNA, 103 bp, Artificial Sequence
  Synthetic Polynucleotide
taatacgactcactatagggcagtcacagggatcatctggcaaaggacagaacagaggagactgtccatggccagatgaaacctggcggcagcgcaaaagatg

SEQ ID NO: 147880 - DNA, 103 bp, Artificial Sequence
  Synthetic Polynucleotide
taatacgactcactatagggctactttgtccagtcacagggatcatctggaacagaggagaccagatatgccctgtgacaacctggcggcagcgcaaaagatg

SEQ ID NO: 147881 - DNA, 103 bp, Artificial Sequence
  Synthetic Polynucleotide
taatacgactcactatagggtggtaacatgctactttgtccagtcacaggaacagaggagacctgtgatgggacaaagtaacctggcggcagcgcaaaagatg

SEQ ID NO: 147882 - DNA, 103 bp, Artificial Sequence
  Synthetic Polynucleotide
taatacgactcactatagggtcaaaaaagctggtaacatgctactttgtcaacagaggagagacaaaatggcatgttacaacctggcggcagcgcaaaagatg

SEQ ID NO: 147883 - DNA, 103 bp, Artificial Sequence
  Synthetic Polynucleotide
taatacgactcactatagggcaagtagacctttcgctgtcatgccgcttcaacagaggagagaagcgatgtgacagcgaaacctggcggcagcgcaaaagatg

SEQ ID NO: 147884 - DNA, 103 bp, Artificial Sequence
  Synthetic Polynucleotide
taatacgactcactatagggggagggggcttcaaaaaagctggtaacatgaacagaggagacatgttatgagcttttttaacctggcggcagcgcaaaagatg

SEQ ID NO: 147885 - DNA, 103 bp, Artificial Sequence
  Synthetic Polynucleotide
taatacgactcactatagggagacaactggggagggggcttcaaaaaagcaacagaggagagcttttatgaagccccctaacctggcggcagcgcaaaagatg

SEQ ID NO: 147886 - DNA, 103 bp, Artificial Sequence
  Synthetic Polynucleotide
taatacgactcactatagggcagtccccacagacaactggggagggggctaacagaggagaagccccatgcccagttgtaacctggcggcagcgcaaaagatg

SEQ ID NO: 147887 - DNA, 103 bp, Artificial Sequence
  Synthetic Polynucleotide
taatacgactcactatagggatgggtctcacagtccccacagacaactggaacagaggagaccagttatgtgtggggacaacctggcggcagcgcaaaagatg

SEQ ID NO: 147888 - DNA, 103 bp, Artificial Sequence
  Synthetic Polynucleotide
taatacgactcactatagggctgagctaggatgggtctcacagtccccacaacagaggagagtggggatggtgagacccaacctggcggcagcgcaaaagatg

SEQ ID NO: 147889 - DNA, 103 bp, Artificial Sequence
  Synthetic Polynucleotide
taatacgactcactatagggctggagcagcctgagctaggatgggtctcaaacagaggagatgagacatgtcctagctcaacctggcggcagcgcaaaagatg

SEQ ID NO: 147890 - DNA, 103 bp, Artificial Sequence
  Synthetic Polynucleotide
taatacgactcactatagggggttgaggcgctggagcagcctgagctaggaacagaggagacctagcatgggctgctccaacctggcggcagcgcaaaagatg

SEQ ID NO: 147891 - DNA, 103 bp, Artificial Sequence
  Synthetic Polynucleotide
taatacgactcactatagggcacgaacacaggttgaggcgctggagcagcaacagaggagagctgctatggcgcctcaaaacctggcggcagcgcaaaagatg

SEQ ID NO: 147892 - DNA, 103 bp, Artificial Sequence
  Synthetic Polynucleotide
taatacgactcactatagggcagcaggtcccacgaacacaggttgaggcgaacagaggagacgcctcatgctgtgttcgaacctggcggcagcgcaaaagatg

SEQ ID NO: 147893 - DNA, 103 bp, Artificial Sequence
  Synthetic Polynucleotide
taatacgactcactatagggccctgaggcacagcaggtcccacgaacacaaacagaggagatgtgttatggggacctgcaacctggcggcagcgcaaaagatg

SEQ ID NO: 147894 - DNA, 103 bp, Artificial Sequence
  Synthetic Polynucleotide
taatacgactcactatagggtattgtttttctcttcatatggatattcataacagaggagaatgaatatgcatatgaagaacctggcggcagcgcaaaagatg

SEQ ID NO: 147895 - DNA, 103 bp, Artificial Sequence
  Synthetic Polynucleotide
taatacgactcactatagggttgttcagattccaaaagctctgttttgacaacagaggagagtcaaaatggagcttttgaacctggcggcagcgcaaaagatg

SEQ ID NO: 147896 - DNA, 103 bp, Artificial Sequence
  Synthetic Polynucleotide
taatacgactcactatagggtgtcctccggtgagccttcaggtgagaactaacagaggagaagttctatgctgaaggctaacctggcggcagcgcaaaagatg

SEQ ID NO: 147897 - DNA, 103 bp, Artificial Sequence
  Synthetic Polynucleotide
taatacgactcactatagggctcctgtatgtgtcctccggtgagccttcaaacagaggagatgaaggatgaccggaggaaacctggcggcagcgcaaaagatg

SEQ ID NO: 147898 - DNA, 103 bp, Artificial Sequence
  Synthetic Polynucleotide
taatacgactcactatagggtaaggtttctctcctgtatgtgtcctccggaacagaggagaccggagatgacatacaggaacctggcggcagcgcaaaagatg

SEQ ID NO: 147899 - DNA, 103 bp, Artificial Sequence
  Synthetic Polynucleotide
taatacgactcactatagggggtacacttgtaaggtttctctcctgtatgaacagaggagacatacaatggagaaacctaacctggcggcagcgcaaaagatg

SEQ ID NO: 147900 - DNA, 103 bp, Artificial Sequence
  Synthetic Polynucleotide
taatacgactcactatagggagccttcccaggtacacttgtaaggtttctaacagaggagaagaaacatgacaagtgtaaacctggcggcagcgcaaaagatg

SEQ ID NO: 147901 - DNA, 103 bp, Artificial Sequence
  Synthetic Polynucleotide
taatacgactcactatagggttccaggtgcagccttcccaggtacacttgaacagaggagacaagtgatgctgggaaggaacctggcggcagcgcaaaagatg

SEQ ID NO: 147902 - DNA, 103 bp, Artificial Sequence
  Synthetic Polynucleotide
taatacgactcactatagggacgagcgaacttccaggtgcagccttcccaaacagaggagatgggaaatgtgcacctggaacctggcggcagcgcaaaagatg

SEQ ID NO: 147903 - DNA, 103 bp, Artificial Sequence
  Synthetic Polynucleotide
taatacgactcactataggggttcatctgaacgagcgaacttccaggtgcaacagaggagagcacctatgagttcgctcaacctggcggcagcgcaaaagatg

SEQ ID NO: 147904 - DNA, 103 bp, Artificial Sequence
  Synthetic Polynucleotide
taatacgactcactatagggtgcctcgtcagttcatctgaacgagcgaacaacagaggagagttcgcatgttcagatgaaacctggcggcagcgcaaaagatg

SEQ ID NO: 147905 - DNA, 103 bp, Artificial Sequence
  Synthetic Polynucleotide
taatacgactcactatagggtttgcggtaatgcctcgtcagttcatctgaaacagaggagatcagatatgctgacgaggaacctggcggcagcgcaaaagatg

SEQ ID NO: 147906 - DNA, 103 bp, Artificial Sequence
  Synthetic Polynucleotide
taatacgactcactatagggttggagacccttgttcagattccaaaagctaacagaggagaagctttatgaatctgaacaacctggcggcagcgcaaaagatg

SEQ ID NO: 147907 - DNA, 103 bp, Artificial Sequence
  Synthetic Polynucleotide
taatacgactcactatagggctcccgtatgtttgcggtaatgcctcgtcaaacagaggagatgacgaatgattaccgcaaacctggcggcagcgcaaaagatg

SEQ ID NO: 147908 - DNA, 103 bp, Artificial Sequence
  Synthetic Polynucleotide
taatacgactcactatagggaatggcttcactcccgtatgtttgcggtaaaacagaggagattaccgatgacatacgggaacctggcggcagcgcaaaagatg

SEQ ID NO: 147909 - DNA, 103 bp, Artificial Sequence
  Synthetic Polynucleotide
taatacgactcactatagggcgcgcacttgaatggcttcactcccgtatgaacagaggagacatacgatggtgaagccaaacctggcggcagcgcaaaagatg

SEQ ID NO: 147910 - DNA, 103 bp, Artificial Sequence
  Synthetic Polynucleotide
taatacgactcactataggggatcacagtccgcgcacttgaatggcttcaaacagaggagatgaagcatgtcaagtgcgaacctggcggcagcgcaaaagatg

SEQ ID NO: 147911 - DNA, 103 bp, Artificial Sequence
  Synthetic Polynucleotide
taatacgactcactataggggaaaagctgcgatcacagtccgcgcacttgaacagaggagacaagtgatgggactgtgaaacctggcggcagcgcaaaagatg

SEQ ID NO: 147912 - DNA, 103 bp, Artificial Sequence
  Synthetic Polynucleotide
taatacgactcactatagggatctgaccgggaaaagctgcgatcacagtcaacagaggagagactgtatgcgcagctttaacctggcggcagcgcaaaagatg

SEQ ID NO: 147913 - DNA, 103 bp, Artificial Sequence
  Synthetic Polynucleotide
taatacgactcactataggggggccaaatgatctgaccgggaaaagctgcaacagaggagagcagctatgcccggtcagaacctggcggcagcgcaaaagatg

SEQ ID NO: 147914 - DNA, 103 bp, Artificial Sequence
  Synthetic Polynucleotide
taatacgactcactatagggcggcggtgcagggccaaatgatctgaccggaacagaggagaccggtcatgtcatttggcaacctggcggcagcgcaaaagatg

SEQ ID NO: 147915 - DNA, 103 bp, Artificial Sequence
  Synthetic Polynucleotide
taatacgactcactatagggcatatgcctccggcggtgcagggccaaatgaacagaggagacatttgatgctgcaccgcaacctggcggcagcgcaaaagatg

SEQ ID NO: 147916 - DNA, 103 bp, Artificial Sequence
  Synthetic Polynucleotide
taatacgactcactatagggttgtggacgtttggagacccttgttcagataacagaggagaatctgaatgagggtctccaacctggcggcagcgcaaaagatg

SEQ ID NO: 147917 - DNA, 103 bp, Artificial Sequence
  Synthetic Polynucleotide
taatacgactcactatagggatcgggatagttgtggacgtttggagacccaacagaggagagggtctatgaacgtccacaacctggcggcagcgcaaaagatg

SEQ ID NO: 147918 - DNA, 103 bp, Artificial Sequence
  Synthetic Polynucleotide
taatacgactcactatagggcggcttccatatcgggatagttgtggacgtaacagaggagaacgtccatgactatcccgaacctggcggcagcgcaaaagatg

SEQ ID NO: 147919 - DNA, 103 bp, Artificial Sequence
  Synthetic Polynucleotide
taatacgactcactatagggaacaggggaacggcttccatatcgggatagaacagaggagactatccatgtatggaagcaacctggcggcagcgcaaaagatg

SEQ ID NO: 147920 - DNA, 103 bp, Artificial Sequence
  Synthetic Polynucleotide
taatacgactcactatagggattatttagcaacaggggaacggcttccataacagaggagaatggaaatggttcccctgaacctggcggcagcgcaaaagatg

SEQ ID NO: 147921 - DNA, 103 bp, Artificial Sequence
  Synthetic Polynucleotide
taatacgactcactatagggcccctttcacattatttagcaacaggggaaaacagaggagattccccatgtgctaaataaacctggcggcagcgcaaaagatg

SEQ ID NO: 147922 - DNA, 103 bp, Artificial Sequence
  Synthetic Polynucleotide
taatacgactcactatagggtccgggggctcccctttcacattatttagcaacagaggagagctaaaatgtgtgaaaggaacctggcggcagcgcaaaagatg

SEQ ID NO: 147923 - DNA, 103 bp, Artificial Sequence
  Synthetic Polynucleotide
taatacgactcactatagggtaacgagtcctccgggggctcccctttcacaacagaggagagtgaaaatggagcccccgaacctggcggcagcgcaaaagatg

SEQ ID NO: 147924 - DNA, 103 bp, Artificial Sequence
  Synthetic Polynucleotide
taatacgactcactatagggtgatattctttattgtttttctcttcatataacagaggagaatatgaatggaaaaacaaaacctggcggcagcgcaaaagatg

SEQ ID NO: 147925 - DNA, 103 bp, Artificial Sequence
  Synthetic Polynucleotide
taatacgactcactataggggatctacagataacgagtcctccgggggctaacagaggagaagccccatgaggactcgtaacctggcggcagcgcaaaagatg

SEQ ID NO: 147926 - DNA, 103 bp, Artificial Sequence
  Synthetic Polynucleotide
taatacgactcactataggggtttggaagtgatctacagataacgagtccaacagaggagaggactcatgatctgtagaaacctggcggcagcgcaaaagatg

SEQ ID NO: 147927 - DNA, 103 bp, Artificial Sequence
  Synthetic Polynucleotide
taatacgactcactatagggctcagtttgtgtttggaagtgatctacagaaacagaggagatctgtaatgcacttccaaaacctggcggcagcgcaaaagatg

SEQ ID NO: 147928 - DNA, 103 bp, Artificial Sequence
  Synthetic Polynucleotide
taatacgactcactatagggagtccactggctcagtttgtgtttggaagtaacagaggagaacttccatgcacaaactgaacctggcggcagcgcaaaagatg

SEQ ID NO: 147929 - DNA, 103 bp, Artificial Sequence
  Synthetic Polynucleotide
taatacgactcactatagggtttattgacaagtccactggctcagtttgtaacagaggagaacaaacatggccagtggaaacctggcggcagcgcaaaagatg

SEQ ID NO: 147930 - DNA, 103 bp, Artificial Sequence
  Synthetic Polynucleotide
taatacgactcactatagggcctggctttgtttattgacaagtccactggaacagaggagaccagtgatgttgtcaataaacctggcggcagcgcaaaagatg

SEQ ID NO: 147931 - DNA, 103 bp, Artificial Sequence
  Synthetic Polynucleotide
taatacgactcactatagggtaggggacgtcctggctttgtttattgacaaacagaggagatgtcaaatgacaaagccaaacctggcggcagcgcaaaagatg

SEQ ID NO: 147932 - DNA, 103 bp, Artificial Sequence
  Synthetic Polynucleotide
taatacgactcactataggggaaacggcagtaggggacgtcctggctttgaacagaggagacaaagcatggacgtccccaacctggcggcagcgcaaaagatg

SEQ ID NO: 147933 - DNA, 103 bp, Artificial Sequence
  Synthetic Polynucleotide
taatacgactcactatagggtggggaggatgaaacggcagtaggggacgtaacagaggagaacgtccatgactgccgttaacctggcggcagcgcaaaagatg

SEQ ID NO: 147934 - DNA, 103 bp, Artificial Sequence
  Synthetic Polynucleotide
taatacgactcactatagggtcatggaaactggggaggatgaaacggcagaacagaggagactgccgatgcatcctcccaacctggcggcagcgcaaaagatg

SEQ ID NO: 147935 - DNA, 103 bp, Artificial Sequence
  Synthetic Polynucleotide
taatacgactcactatagggtcaaaggtgttgatattctttattgtttttaacagaggagaaaaaacatgaaagaatataacctggcggcagcgcaaaagatg

SEQ ID NO: 147936 - DNA, 103 bp, Artificial Sequence
  Synthetic Polynucleotide
taatacgactcactataggggcagatgctgtcatggaaactggggaggataacagaggagaatcctcatgagtttccataacctggcggcagcgcaaaagatg

SEQ ID NO: 147937 - DNA, 103 bp, Artificial Sequence
  Synthetic Polynucleotide
taatacgactcactatagggaggtgaggaggcagatgctgtcatggaaacaacagaggagagtttccatgacagcatctaacctggcggcagcgcaaaagatg

SEQ ID NO: 147938 - DNA, 103 bp, Artificial Sequence
  Synthetic Polynucleotide
taatacgactcactatagggaagttgaagaaggtgaggaggcagatgctgaacagaggagacagcatatgcctcctcacaacctggcggcagcgcaaaagatg

SEQ ID NO: 147939 - DNA, 103 bp, Artificial Sequence
  Synthetic Polynucleotide
taatacgactcactataggggaagaggttgaagttgaagaaggtgaggagaacagaggagactcctcatgttcttcaacaacctggcggcagcgcaaaagatg

SEQ ID NO: 147940 - DNA, 103 bp, Artificial Sequence
  Synthetic Polynucleotide
taatacgactcactatagggagaagacgatgaagaggttgaagttgaagaaacagaggagatcttcaatgtcaacctctaacctggcggcagcgcaaaagatg

SEQ ID NO: 147941 - DNA, 103 bp, Artificial Sequence
  Synthetic Polynucleotide
taatacgactcactatagggctagacgactagaagacgatgaagaggttgaacagaggagacaacctatgcatcgtcttaacctggcggcagcgcaaaagatg

SEQ ID NO: 147942 - DNA, 103 bp, Artificial Sequence
  Synthetic Polynucleotide
taatacgactcactatagggggggatgaggctagacgactagaagacgataacagaggagaatcgtcatgtagtcgtctaacctggcggcagcgcaaaagatg

SEQ ID NO: 147943 - DNA, 103 bp, Artificial Sequence
  Synthetic Polynucleotide
taatacgactcactataggggataacagttggggatgaggctagacgactaacagaggagaagtcgtatggcctcatccaacctggcggcagcgcaaaagatg

SEQ ID NO: 147944 - DNA, 103 bp, Artificial Sequence
  Synthetic Polynucleotide
taatacgactcactatagggatactgatgtgataacagttggggatgaggaacagaggagacctcatatgcaactgttaaacctggcggcagcgcaaaagatg

SEQ ID NO: 147945 - DNA, 103 bp, Artificial Sequence
  Synthetic Polynucleotide
taatacgactcactataggggacgctgaagatactgatgtgataacagttaacagaggagaaactgtatgcacatcagtaacctggcggcagcgcaaaagatg

SEQ ID NO: 147946 - DNA, 103 bp, Artificial Sequence
  Synthetic Polynucleotide
taatacgactcactatagggcattctgttctcaaaggtgttgatattcttaacagaggagaaagaatatgaacacctttaacctggcggcagcgcaaaagatg

SEQ ID NO: 147947 - DNA, 103 bp, Artificial Sequence
  Synthetic Polynucleotide
taatacgactcactatagggtgacgaagatgacgctgaagatactgatgtaacagaggagaacatcaatgtcttcagcgaacctggcggcagcgcaaaagatg

SEQ ID NO: 147948 - DNA, 103 bp, Artificial Sequence
  Synthetic Polynucleotide
taatacgactcactatagggttaatactgttgacgaagatgacgctgaagaacagaggagacttcagatgcatcttcgtaacctggcggcagcgcaaaagatg

SEQ ID NO: 147949 - DNA, 103 bp, Artificial Sequence
  Synthetic Polynucleotide
taatacgactcactatagggggccctggagttaatactgttgacgaagataacagaggagaatcttcatgaacagtattaacctggcggcagcgcaaaagatg

SEQ ID NO: 147950 - DNA, 103 bp, Artificial Sequence
  Synthetic Polynucleotide
taatacgactcactatagggggccacaaggggccctggagttaatactgtaacagaggagaacagtaatgactccagggaacctggcggcagcgcaaaagatg

SEQ ID NO: 147951 - DNA, 103 bp, Artificial Sequence
  Synthetic Polynucleotide
taatacgactcactatagggcagatgcagaggccacaaggggccctggagaacagaggagactccagatgcccttgtggaacctggcggcagcgcaaaagatg

SEQ ID NO: 147952 - DNA, 103 bp, Artificial Sequence
  Synthetic Polynucleotide
taatacgactcactatagggcctccaacaccagatgcagaggccacaaggaacagaggagaccttgtatgctctgcatcaacctggcggcagcgcaaaagatg

SEQ ID NO: 147953 - DNA, 103 bp, Artificial Sequence
  Synthetic Polynucleotide
taatacgactcactatagggaaactgctggcctccaacaccagatgcagaaacagaggagatctgcaatgggtgttggaaacctggcggcagcgcaaaagatg

SEQ ID NO: 147954 - DNA, 103 bp, Artificial Sequence
  Synthetic Polynucleotide
taatacgactcactatagggtaatgtgcaaaaactgctggcctccaacacaacagaggagagtgttgatggccagcagtaacctggcggcagcgcaaaagatg

SEQ ID NO: 147955 - DNA, 103 bp, Artificial Sequence
  Synthetic Polynucleotide
taatacgactcactatagggacgggatggataatgtgcaaaaactgctggaacagaggagaccagcaatgtttgcacataacctggcggcagcgcaaaagatg

SEQ ID NO: 147956 - DNA, 103 bp, Artificial Sequence
  Synthetic Polynucleotide
taatacgactcactatagggtgaaggcggtacgggatggataatgtgcaaaacagaggagattgcacatgatccatcccaacctggcggcagcgcaaaagatg

SEQ ID NO: 147957 - DNA, 103 bp, Artificial Sequence
  Synthetic Polynucleotide
taatacgactcactatagggcaagcattaacattctgttctcaaaggtgtaacagaggagaacacctatgagaacagaaaacctggcggcagcgcaaaagatg

SEQ ID NO: 147958 - DNA, 103 bp, Artificial Sequence
  Synthetic Polynucleotide
taatacgactcactatagggtcatgggacttgaaggcggtacgggatggaaacagaggagatccatcatgtaccgccttaacctggcggcagcgcaaaagatg

SEQ ID NO: 147959 - DNA, 103 bp, Artificial Sequence
  Synthetic Polynucleotide
taatacgactcactataggggactgtaaattcatgggacttgaaggcggtaacagaggagaaccgccatgaagtcccataacctggcggcagcgcaaaagatg

SEQ ID NO: 147960 - DNA, 103 bp, Artificial Sequence
  Synthetic Polynucleotide
taatacgactcactatagggcagtttgttagactgtaaattcatgggactaacagaggagaagtcccatgaatttacagaacctggcggcagcgcaaaagatg

SEQ ID NO: 147961 - DNA, 103 bp, Artificial Sequence
  Synthetic Polynucleotide
taatacgactcactataggggaacatgactcagtttgttagactgtaaataacagaggagaatttacatgctaacaaacaacctggcggcagcgcaaaagatg

SEQ ID NO: 147962 - DNA, 103 bp, Artificial Sequence
  Synthetic Polynucleotide
taatacgactcactataggggggatgcggtgaacatgactcagtttgttaaacagaggagataacaaatggagtcatgtaacctggcggcagcgcaaaagatg

SEQ ID NO: 147963 - DNA, 103 bp, Artificial Sequence
  Synthetic Polynucleotide
taatacgactcactatagggtaccaccacggggatgcggtgaacatgactaacagaggagaagtcatatgcaccgcatcaacctggcggcagcgcaaaagatg

SEQ ID NO: 147964 - DNA, 103 bp, Artificial Sequence
  Synthetic Polynucleotide
taatacgactcactataggggcaccgactgtaccaccacggggatgcggtaacagaggagaaccgcaatgccgtggtggaacctggcggcagcgcaaaagatg

SEQ ID NO: 147965 - DNA, 103 bp, Artificial Sequence
  Synthetic Polynucleotide
taatacgactcactatagggtagacaacaggcaccgactgtaccaccacgaacagaggagacgtggtatgacagtcggtaacctggcggcagcgcaaaagatg

SEQ ID NO: 147966 - DNA, 103 bp, Artificial Sequence
  Synthetic Polynucleotide
taatacgactcactatagggtacagctgtgtagacaacaggcaccgactgaacagaggagacagtcgatgcctgttgtcaacctggcggcagcgcaaaagatg

SEQ ID NO: 147967 - DNA, 103 bp, Artificial Sequence
  Synthetic Polynucleotide
taatacgactcactatagggcaggtgaccttacagctgtgtagacaacagaacagaggagactgttgatgacacagctgaacctggcggcagcgcaaaagatg

SEQ ID NO: 147968 - DNA, 103 bp, Artificial Sequence
  Synthetic Polynucleotide
taatacgactcactatagggggcatcccatcaagcattaacattctgttcaacagaggagagaacagatggttaatgctaacctggcggcagcgcaaaagatg

SEQ ID NO: 147969 - DNA, 103 bp, Artificial Sequence
  Synthetic Polynucleotide
taatacgactcactatagggttcacatttccaggtgaccttacagctgtgaacagaggagacacagcatgaaggtcaccaacctggcggcagcgcaaaagatg

SEQ ID NO: 147970 - DNA, 103 bp, Artificial Sequence
  Synthetic Polynucleotide
taatacgactcactatagggaatagtgttgttcacatttccaggtgacctaacagaggagaaggtcaatgggaaatgtgaacctggcggcagcgcaaaagatg

SEQ ID NO: 147971 - DNA, 103 bp, Artificial Sequence
  Synthetic Polynucleotide
taatacgactcactataggggcggcacgacaatagtgttgttcacatttcaacagaggagagaaatgatgacaacactaaacctggcggcagcgcaaaagatg

SEQ ID NO: 147972 - DNA, 103 bp, Artificial Sequence
  Synthetic Polynucleotide
taatacgactcactatagggtcctccaaaagcggcacgacaatagtgttgaacagaggagacaacacatgtgtcgtgccaacctggcggcagcgcaaaagatg

SEQ ID NO: 147973 - DNA, 103 bp, Artificial Sequence
  Synthetic Polynucleotide
taatacgactcactataggggcctctcccatcctccaaaagcggcacgacaacagaggagagtcgtgatgcttttggagaacctggcggcagcgcaaaagatg

SEQ ID NO: 147974 - DNA, 103 bp, Artificial Sequence
  Synthetic Polynucleotide
taatacgactcactatagggctttgccatggcctctcccatcctccaaaaaacagaggagattttggatgatgggagagaacctggcggcagcgcaaaagatg

SEQ ID NO: 147975 - DNA, 103 bp, Artificial Sequence
  Synthetic Polynucleotide
taatacgactcactatagggtccatttgtgctttgccatggcctctcccaaacagaggagatgggagatgccatggcaaaacctggcggcagcgcaaaagatg

SEQ ID NO: 147976 - DNA, 103 bp, Artificial Sequence
  Synthetic Polynucleotide
taatacgactcactataggggcctcgggggtccatttgtgctttgccatgaacagaggagacatggcatggcacaaatgaacctggcggcagcgcaaaagatg

SEQ ID NO: 147977 - DNA, 103 bp, Artificial Sequence
  Synthetic Polynucleotide
taatacgactcactatagggtgggagataggcctcgggggtccatttgtgaacagaggagacacaaaatgacccccgagaacctggcggcagcgcaaaagatg

SEQ ID NO: 147978 - DNA, 103 bp, Artificial Sequence
  Synthetic Polynucleotide
taatacgactcactatagggttactttgtctgggagataggcctcgggggaacagaggagacccccgatgcctatctccaacctggcggcagcgcaaaagatg

SEQ ID NO: 147979 - DNA, 103 bp, Artificial Sequence
  Synthetic Polynucleotide
taatacgactcactatagggtctgactgccggcatcccatcaagcattaaaacagaggagattaatgatggatgggatgaacctggcggcagcgcaaaagatg

SEQ ID NO: 147980 - DNA, 103 bp, Artificial Sequence
  Synthetic Polynucleotide
taatacgactcactatagggactgtcacttttactttgtctgggagatagaacagaggagactatctatgagacaaagtaacctggcggcagcgcaaaagatg

SEQ ID NO: 147981 - DNA, 103 bp, Artificial Sequence
  Synthetic Polynucleotide
taatacgactcactatagggcatcatcatcactgtcacttttactttgtcaacagaggagagacaaaatgaaagtgacaaacctggcggcagcgcaaaagatg

SEQ ID NO: 147982 - DNA, 103 bp, Artificial Sequence
  Synthetic Polynucleotide
taatacgactcactatagggtttggcaggtcatcatcatcactgtcacttaacagaggagaaagtgaatgtgatgatgaaacctggcggcagcgcaaaagatg

SEQ ID NO: 147983 - DNA, 103 bp, Artificial Sequence
  Synthetic Polynucleotide
taatacgactcactatagggtaaggtcacatttggcaggtcatcatcatcaacagaggagagatgatatggacctgccaaacctggcggcagcgcaaaagatg

SEQ ID NO: 147984 - DNA, 103 bp, Artificial Sequence
  Synthetic Polynucleotide
taatacgactcactatagggtaacgctatctaaggtcacatttggcaggtaacagaggagaacctgcatgatgtgacctaacctggcggcagcgcaaaagatg

SEQ ID NO: 147985 - DNA, 103 bp, Artificial Sequence
  Synthetic Polynucleotide
taatacgactcactatagggccagtttcattaacgctatctaaggtcacaaacagaggagatgtgacatgagatagcgtaacctggcggcagcgcaaaagatg

SEQ ID NO: 147986 - DNA, 103 bp, Artificial Sequence
  Synthetic Polynucleotide
taatacgactcactatagggggccgtagatccagtttcattaacgctatcaacagaggagagatagcatgaatgaaactaacctggcggcagcgcaaaagatg

SEQ ID NO: 147987 - DNA, 103 bp, Artificial Sequence
  Synthetic Polynucleotide
taatacgactcactatagggctatggaaagggccgtagatccagtttcataacagaggagaatgaaaatggatctacggaacctggcggcagcgcaaaagatg

SEQ ID NO: 147988 - DNA, 103 bp, Artificial Sequence
  Synthetic Polynucleotide
taatacgactcactatagggactgctctggctatggaaagggccgtagataacagaggagaatctacatgcctttccataacctggcggcagcgcaaaagatg

SEQ ID NO: 147989 - DNA, 103 bp, Artificial Sequence
  Synthetic Polynucleotide
taatacgactcactatagggtacctcttgtactgctctggctatggaaagaacagaggagactttccatggccagagcaaacctggcggcagcgcaaaagatg

SEQ ID NO: 147990 - DNA, 103 bp, Artificial Sequence
  Synthetic Polynucleotide
taatacgactcactatagggctgttttgactctgactgccggcatcccataacagaggagaatgggaatgcggcagtcaaacctggcggcagcgcaaaagatg

SEQ ID NO: 147991 - DNA, 103 bp, Artificial Sequence
  Synthetic Polynucleotide
taatacgactcactataggggggacggatgtacctcttgtactgctctggaacagaggagaccagagatgtacaagaggaacctggcggcagcgcaaaagatg

SEQ ID NO: 147992 - DNA, 103 bp, Artificial Sequence
  Synthetic Polynucleotide
taatacgactcactatagggcttgatactggggacggatgtacctcttgtaacagaggagaacaagaatgacatccgtcaacctggcggcagcgcaaaagatg

SEQ ID NO: 147993 - DNA, 103 bp, Artificial Sequence
  Synthetic Polynucleotide
taatacgactcactataggggccccggacccttgatactggggacggatgaacagaggagacatccgatgccagtatcaaacctggcggcagcgcaaaagatg

SEQ ID NO: 147994 - DNA, 103 bp, Artificial Sequence
  Synthetic Polynucleotide
taatacgactcactatagggtcattcgattgccccggacccttgatactgaacagaggagacagtatatggggtccgggaacctggcggcagcgcaaaagatg

SEQ ID NO: 147995 - DNA, 103 bp, Artificial Sequence
  Synthetic Polynucleotide
taatacgactcactatagggttttgattattcattcgattgccccggaccaacagaggagaggtccgatgcaatcgaataacctggcggcagcgcaaaagatg

SEQ ID NO: 147996 - DNA, 103 bp, Artificial Sequence
  Synthetic Polynucleotide
taatacgactcactatagggacaaggaaacttttgattattcattcgattaacagaggagaaatcgaatgaataatcaaaacctggcggcagcgcaaaagatg

SEQ ID NO: 147997 - DNA, 103 bp, Artificial Sequence
  Synthetic Polynucleotide
taatacgactcactataggggtgaaattgaacaaggaaacttttgattataacagaggagaataatcatgagtttccttaacctggcggcagcgcaaaagatg

SEQ ID NO: 147998 - DNA, 103 bp, Artificial Sequence
  Synthetic Polynucleotide
taatacgactcactatagggatactaaatggtgaaattgaacaaggaaacaacagaggagagtttccatgttcaatttcaacctggcggcagcgcaaaagatg

SEQ ID NO: 147999 - DNA, 103 bp, Artificial Sequence
  Synthetic Polynucleotide
taatacgactcactatagggtgtgctctcaatactaaatggtgaaattgaaacagaggagatcaattatgccatttagtaacctggcggcagcgcaaaagatg

SEQ ID NO: 148000 - DNA, 103 bp, Artificial Sequence
  Synthetic Polynucleotide
taatacgactcactatagggtctggcgtcttgtgctctcaatactaaatgaacagaggagacatttaatgttgagagcaaacctggcggcagcgcaaaagatg

SEQ ID NO: 148001 - DNA, 103 bp, Artificial Sequence
  Synthetic Polynucleotide
taatacgactcactatagggtccaaaagctctgttttgactctgactgccaacagaggagaggcagtatgagtcaaaacaacctggcggcagcgcaaaagatg

SEQ ID NO: 148002 - DNA, 103 bp, Artificial Sequence
  Synthetic Polynucleotide
taatacgactcactatagggtcagaccgtctctggcgtcttgtgctctcaaacagaggagatgagagatgaagacgccaaacctggcggcagcgcaaaagatg

SEQ ID NO: 148003 - DNA, 103 bp, Artificial Sequence
  Synthetic Polynucleotide
taatacgactcactataggggtctggggattcagaccgtctctggcgtctaacagaggagaagacgcatgagacggtctaacctggcggcagcgcaaaagatg

SEQ ID NO: 148004 - DNA, 103 bp, Artificial Sequence
  Synthetic Polynucleotide
taatacgactcactataggggttttctggagtctggggattcagaccgtcaacagaggagagacggtatgaatccccagaacctggcggcagcgcaaaagatg

SEQ ID NO: 148005 - DNA, 103 bp, Artificial Sequence
  Synthetic Polynucleotide
taatacgactcactatagggtggatacgccgttttctggagtctggggataacagaggagaatccccatgctccagaaaaacctggcggcagcgcaaaagatg

SEQ ID NO: 148006 - DNA, 103 bp, Artificial Sequence
  Synthetic Polynucleotide
taatacgactcactatagggatcacatctgtggatacgccgttttctggaaacagaggagatccagaatgcggcgtatcaacctggcggcagcgcaaaagatg

SEQ ID NO: 148007 - DNA, 103 bp, Artificial Sequence
  Synthetic Polynucleotide
taatacgactcactatagggatccctcaaaatcacatctgtggatacgccaacagaggagaggcgtaatgacagatgtgaacctggcggcagcgcaaaagatg

SEQ ID NO: 148008 - DNA, 103 bp, Artificial Sequence
  Synthetic Polynucleotide
taatacgactcactatagggactttgttgcatccctcaaaatcacatctgaacagaggagacagatgatgttttgagggaacctggcggcagcgcaaaagatg

SEQ ID NO: 148009 - DNA, 103 bp, Artificial Sequence
  Synthetic Polynucleotide
taatacgactcactatagggttttgtgtacactttgttgcatccctcaaaaacagaggagatttgagatgtgcaacaaaaacctggcggcagcgcaaaagatg

SEQ ID NO: 148010 - DNA, 103 bp, Artificial Sequence
  Synthetic Polynucleotide
taatacgactcactatagggggtgagaactttttgtgtacactttgttgcaacagaggagagcaacaatgtgtacacaaaacctggcggcagcgcaaaagatg

SEQ ID NO: 148011 - DNA, 103 bp, Artificial Sequence
  Synthetic Polynucleotide
taatacgactcactatagggtgagccttcaggtgagaactttttgtgtacaacagaggagagtacacatgaagttctcaaacctggcggcagcgcaaaagatg

SEQ ID NO: 148012 - DNA, 103 bp, Artificial Sequence
  Synthetic Polynucleotide
taatacgactcactataggggaagtggtccacataggcggcggctgccataacagaggagaatggcaatggccgcctataacctggcggcagcgcaaaagatg

SEQ ID NO: 148013 - DNA, 103 bp, Artificial Sequence
  Synthetic Polynucleotide
taatacgactcactatagggcacggccgcgccctcgggccgggactccggaacagaggagaccggagatgcggcccgagaacctggcggcagcgcaaaagatg

SEQ ID NO: 148014 - DNA, 103 bp, Artificial Sequence
  Synthetic Polynucleotide
taatacgactcactataggggggtggcggccacggccgcgccctcgggccaacagaggagaggcccgatggcgcggccgaacctggcggcagcgcaaaagatg

SEQ ID NO: 148015 - DNA, 103 bp, Artificial Sequence
  Synthetic Polynucleotide
taatacgactcactatagggggcagcgtgggggtggcggccacggccgcgaacagaggagacgcggcatgggccgccacaacctggcggcagcgcaaaagatg

SEQ ID NO: 148016 - DNA, 103 bp, Artificial Sequence
  Synthetic Polynucleotide
taatacgactcactatagggctcgacgcggggcagcgtgggggtggcggcaacagaggagagccgccatgcccacgctgaacctggcggcagcgcaaaagatg

SEQ ID NO: 148017 - DNA, 103 bp, Artificial Sequence
  Synthetic Polynucleotide
taatacgactcactatagggcgcggcgctcctcgacgcggggcagcgtggaacagaggagaccacgcatgcccgcgtcgaacctggcggcagcgcaaaagatg

SEQ ID NO: 148018 - DNA, 103 bp, Artificial Sequence
  Synthetic Polynucleotide
taatacgactcactatagggtccttaccgtcgcggcgctcctcgacgcggaacagaggagaccgcgtatgggagcgccgaacctggcggcagcgcaaaagatg

SEQ ID NO: 148019 - DNA, 103 bp, Artificial Sequence
  Synthetic Polynucleotide
taatacgactcactatagggcgaggcgctgtccttaccgtcgcggcgctcaacagaggagagagcgcatggacggtaagaacctggcggcagcgcaaaagatg

SEQ ID NO: 148020 - DNA, 103 bp, Artificial Sequence
  Synthetic Polynucleotide
taatacgactcactatagggccacgaagagcgaggcgctgtccttaccgtaacagaggagaacggtaatgacagcgcctaacctggcggcagcgcaaaagatg

SEQ ID NO: 148021 - DNA, 103 bp, Artificial Sequence
  Synthetic Polynucleotide
taatacgactcactatagggatccgcgccaccacgaagagcgaggcgctgaacagaggagacagcgcatggctcttcgtaacctggcggcagcgcaaaagatg

SEQ ID NO: 148022 - DNA, 103 bp, Artificial Sequence
  Synthetic Polynucleotide
taatacgactcactataggggtccgctaggatccgcgccaccacgaagagaacagaggagactcttcatggtggcgcggaacctggcggcagcgcaaaagatg

SEQ ID NO: 148023 - DNA, 103 bp, Artificial Sequence
  Synthetic Polynucleotide
taatacgactcactatagggactcggcggcgaagtggtccacataggcggaacagaggagaccgcctatgtggaccactaacctggcggcagcgcaaaagatg

SEQ ID NO: 148024 - DNA, 103 bp, Artificial Sequence
  Synthetic Polynucleotide
taatacgactcactataggggctggttgaggtccgctaggatccgcgccaaacagaggagatggcgcatgtcctagcggaacctggcggcagcgcaaaagatg

SEQ ID NO: 148025 - DNA, 103 bp, Artificial Sequence
  Synthetic Polynucleotide
taatacgactcactataggggccggcgcttgctggttgaggtccgctaggaacagaggagacctagcatgcctcaaccaaacctggcggcagcgcaaaagatg

SEQ ID NO: 148026 - DNA, 103 bp, Artificial Sequence
  Synthetic Polynucleotide
taatacgactcactatagggcggggcgggcgccggcgcttgctggttgagaacagaggagactcaacatgcaagcgccgaacctggcggcagcgcaaaagatg

SEQ ID NO: 148027 - DNA, 103 bp, Artificial Sequence
  Synthetic Polynucleotide
taatacgactcactatagggtgcgctccgccggggcgggcgccggcgcttaacagaggagaaagcgcatgcgcccgcccaacctggcggcagcgcaaaagatg

SEQ ID NO: 148028 - DNA, 103 bp, Artificial Sequence
  Synthetic Polynucleotide
taatacgactcactataggggcgccctccctgcgctccgccggggcgggcaacagaggagagcccgcatgggcggagcgaacctggcggcagcgcaaaagatg

SEQ ID NO: 148029 - DNA, 103 bp, Artificial Sequence
  Synthetic Polynucleotide
taatacgactcactatagggccgggccgcggcgccctccctgcgctccgcaacagaggagagcggagatgagggagggcaacctggcggcagcgcaaaagatg

SEQ ID NO: 148030 - DNA, 103 bp, Artificial Sequence
  Synthetic Polynucleotide
taatacgactcactatagggtcctcgccttccgggccgcggcgccctcccaacagaggagagggaggatgccgcggcccaacctggcggcagcgcaaaagatg

SEQ ID NO: 148031 - DNA, 103 bp, Artificial Sequence
  Synthetic Polynucleotide
taatacgactcactatagggcggcagggggtcctcgccttccgggccgcgaacagaggagacgcggcatggaaggcgagaacctggcggcagcgcaaaagatg

SEQ ID NO: 148032 - DNA, 103 bp, Artificial Sequence
  Synthetic Polynucleotide
taatacgactcactatagggcggcggcaggcggcagggggtcctcgccttaacagaggagaaaggcgatgaccccctgcaacctggcggcagcgcaaaagatg

SEQ ID NO: 148033 - DNA, 103 bp, Artificial Sequence
  Synthetic Polynucleotide
taatacgactcactatagggcgggggcgggcggcggcaggcggcagggggaacagaggagaccccctatggcctgccgcaacctggcggcagcgcaaaagatg

SEQ ID NO: 148034 - DNA, 103 bp, Artificial Sequence
  Synthetic Polynucleotide
taatacgactcactataggggacacgaggcactcggcggcgaagtggtccaacagaggagaggaccaatgcgccgccgaaacctggcggcagcgcaaaagatg

SEQ ID NO: 148035 - DNA, 103 bp, Artificial Sequence
  Synthetic Polynucleotide
taatacgactcactataggggaggtgggctcgggggcgggcggcggcaggaacagaggagacctgccatggcccgccccaacctggcggcagcgcaaaagatg

SEQ ID NO: 148036 - DNA, 103 bp, Artificial Sequence
  Synthetic Polynucleotide
taatacgactcactatagggggcgccgggggaggtgggctcgggggcgggaacagaggagacccgccatggagcccaccaacctggcggcagcgcaaaagatg

SEQ ID NO: 148037 - DNA, 103 bp, Artificial Sequence
  Synthetic Polynucleotide
taatacgactcactatagggccgcgccttcggcgccgggggaggtgggctaacagaggagaagcccaatgcccccggcgaacctggcggcagcgcaaaagatg

SEQ ID NO: 148038 - DNA, 103 bp, Artificial Sequence
  Synthetic Polynucleotide
taatacgactcactatagggggcgcggccgccgcgccttcggcgccggggaacagaggagaccccggatgcgaaggcgcaacctggcggcagcgcaaaagatg

SEQ ID NO: 148039 - DNA, 103 bp, Artificial Sequence
  Synthetic Polynucleotide
taatacgactcactatagggcgggctggggggcgcggccgccgcgccttcaacagaggagagaaggcatggcggccgcgaacctggcggcagcgcaaaagatg

SEQ ID NO: 148040 - DNA, 103 bp, Artificial Sequence
  Synthetic Polynucleotide
taatacgactcactatagggcgctccacgccgggctggggggcgcggccgaacagaggagacggccgatgcccccagccaacctggcggcagcgcaaaagatg

SEQ ID NO: 148041 - DNA, 103 bp, Artificial Sequence
  Synthetic Polynucleotide
taatacgactcactatagggggctccggctcgctccacgccgggctggggaacagaggagaccccagatgggcgtggagaacctggcggcagcgcaaaagatg

SEQ ID NO: 148042 - DNA, 103 bp, Artificial Sequence
  Synthetic Polynucleotide
taatacgactcactatagggccccgcctcgggctccggctcgctccacgcaacagaggagagcgtggatggagccggagaacctggcggcagcgcaaaagatg

SEQ ID NO: 148043 - DNA, 103 bp, Artificial Sequence
  Synthetic Polynucleotide
taatacgactcactatagggcgggctccagccccgcctcgggctccggctaacagaggagaagccggatgccgaggcggaacctggcggcagcgcaaaagatg

SEQ ID NO: 148044 - DNA, 103 bp, Artificial Sequence
  Synthetic Polynucleotide
taatacgactcactatagggggctcccgctcgggctccagccccgcctcgaacagaggagacgaggcatggctggagccaacctggcggcagcgcaaaagatg

SEQ ID NO: 148045 - DNA, 103 bp, Artificial Sequence
  Synthetic Polynucleotide
taatacgactcactataggggctcgacatggacacgaggcactcggcggcaacagaggagagccgccatgtgcctcgtgaacctggcggcagcgcaaaagatg

SEQ ID NO: 148046 - DNA, 103 bp, Artificial Sequence
  Synthetic Polynucleotide
taatacgactcactatagggcgcgggccccggctcccgctcgggctccagaacagaggagactggagatggagcgggagaacctggcggcagcgcaaaagatg

SEQ ID NO: 148047 - DNA, 103 bp, Artificial Sequence
  Synthetic Polynucleotide
taatacgactcactatagggcgccgctccccgcgggccccggctcccgctaacagaggagaagcgggatgcggggcccgaacctggcggcagcgcaaaagatg

SEQ ID NO: 148048 - DNA, 103 bp, Artificial Sequence
  Synthetic Polynucleotide
taatacgactcactatagggaggccgggctcgccgctccccgcgggccccaacagaggagaggggccatgggggagcggaacctggcggcagcgcaaaagatg

SEQ ID NO: 148049 - DNA, 103 bp, Artificial Sequence
  Synthetic Polynucleotide
taatacgactcactatagggcctttgtctgaggccgggctcgccgctcccaacagaggagagggagcatggagcccggcaacctggcggcagcgcaaaagatg

SEQ ID NO: 148050 - DNA, 103 bp, Artificial Sequence
  Synthetic Polynucleotide
taatacgactcactatagggcccgccggaccctttgtctgaggccgggctaacagaggagaagcccgatgtcagacaaaaacctggcggcagcgcaaaagatg

SEQ ID NO: 148051 - DNA, 103 bp, Artificial Sequence
  Synthetic Polynucleotide
taatacgactcactatagggcgacttcggccccgccggaccctttgtctgaacagaggagacagacaatgggtccggcgaacctggcggcagcgcaaaagatg

SEQ ID NO: 148052 - DNA, 103 bp, Artificial Sequence
  Synthetic Polynucleotide
taatacgactcactataggggaggtcggcgcgacttcggccccgccggacaacagaggagagtccggatgggccgaagtaacctggcggcagcgcaaaagatg

SEQ ID NO: 148053 - DNA, 103 bp, Artificial Sequence
  Synthetic Polynucleotide
taatacgactcactataggggcggggactcgaggtcggcgcgacttcggcaacagaggagagccgaaatggcgccgaccaacctggcggcagcgcaaaagatg

SEQ ID NO: 148054 - DNA, 103 bp, Artificial Sequence
  Synthetic Polynucleotide
taatacgactcactatagggtgcttcctctgcggggactcgaggtcggcgaacagaggagacgccgaatgcgagtccccaacctggcggcagcgcaaaagatg

SEQ ID NO: 148055 - DNA, 103 bp, Artificial Sequence
  Synthetic Polynucleotide
taatacgactcactataggggtggcacttgtgcttcctctgcggggactcaacagaggagagagtccatgcagaggaagaacctggcggcagcgcaaaagatg

SEQ ID NO: 148056 - DNA, 103 bp, Artificial Sequence
  Synthetic Polynucleotide
taatacgactcactatagggcgaccgcgcggctcgacatggacacgaggcaacagaggagagcctcgatgccatgtcgaaacctggcggcagcgcaaaagatg

SEQ ID NO: 148057 - DNA, 103 bp, Artificial Sequence
  Synthetic Polynucleotide
taatacgactcactatagggagcccgcgtagtggcacttgtgcttcctctaacagaggagaagaggaatgacaagtgccaacctggcggcagcgcaaaagatg

SEQ ID NO: 148058 - DNA, 103 bp, Artificial Sequence
  Synthetic Polynucleotide
taatacgactcactatagggactttctcgcagcccgcgtagtggcacttgaacagaggagacaagtgatgctacgcgggaacctggcggcagcgcaaaagatg

SEQ ID NO: 148059 - DNA, 103 bp, Artificial Sequence
  Synthetic Polynucleotide
taatacgactcactatagggtttcccgtaaactttctcgcagcccgcgtaaacagaggagatacgcgatgtgcgagaaaaacctggcggcagcgcaaaagatg

SEQ ID NO: 148060 - DNA, 103 bp, Artificial Sequence
  Synthetic Polynucleotide
taatacgactcactatagggggtgcgaagatttcccgtaaactttctcgcaacagaggagagcgagaatgtttacgggaaacctggcggcagcgcaaaagatg

SEQ ID NO: 148061 - DNA, 103 bp, Artificial Sequence
  Synthetic Polynucleotide
taatacgactcactatagggtgcgccttgaggtgcgaagatttcccgtaaaacagaggagattacggatgatcttcgcaaacctggcggcagcgcaaaagatg

SEQ ID NO: 148062 - DNA, 103 bp, Artificial Sequence
  Synthetic Polynucleotide
taatacgactcactatagggagttctcaggtgcgccttgaggtgcgaagaaacagaggagatcttcgatgctcaaggcgaacctggcggcagcgcaaaagatg

SEQ ID NO: 148063 - DNA, 103 bp, Artificial Sequence
  Synthetic Polynucleotide
taatacgactcactatagggcacctgtgtgagttctcaggtgcgccttgaaacagaggagatcaaggatgacctgagaaaacctggcggcagcgcaaaagatg

SEQ ID NO: 148064 - DNA, 103 bp, Artificial Sequence
  Synthetic Polynucleotide
taatacgactcactatagggaagggcctctcacctgtgtgagttctcaggaacagaggagacctgagatgtcacacaggaacctggcggcagcgcaaaagatg

SEQ ID NO: 148065 - DNA, 103 bp, Artificial Sequence
  Synthetic Polynucleotide
taatacgactcactataggggctgcaggcgaagggcctctcacctgtgtgaacagaggagacacacaatggagaggcccaacctggcggcagcgcaaaagatg

SEQ ID NO: 148066 - DNA, 103 bp, Artificial Sequence
  Synthetic Polynucleotide
taatacgactcactatagggagtcctgccagctgcaggcgaagggcctctaacagaggagaagaggcatgtcgcctgcaaacctggcggcagcgcaaaagatg

SEQ ID NO: 148067 - DNA, 103 bp, Artificial Sequence
  Synthetic Polynucleotide
taatacgactcactatagggggcccgtgcacgaccgcgcggctcgacatgaacagaggagacatgtcatgccgcgcggtaacctggcggcagcgcaaaagatg

SEQ ID NO: 148068 - DNA, 103 bp, Artificial Sequence
  Synthetic Polynucleotide
taatacgactcactatagggttcttgttgcagtcctgccagctgcaggcgaacagaggagacgcctgatgctggcaggaaacctggcggcagcgcaaaagatg

SEQ ID NO: 148069 - DNA, 103 bp, Artificial Sequence
  Synthetic Polynucleotide
taatacgactcactataggggcgcgcgaacttcttgttgcagtcctgccaaacagaggagatggcagatgtgcaacaagaacctggcggcagcgcaaaagatg

SEQ ID NO: 148070 - DNA, 103 bp, Artificial Sequence
  Synthetic Polynucleotide
taatacgactcactataggggctcgtcggagcgcgcgaacttcttgttgcaacagaggagagcaacaatgagttcgcgcaacctggcggcagcgcaaaagatg

SEQ ID NO: 148071 - DNA, 103 bp, Artificial Sequence
  Synthetic Polynucleotide
taatacgactcactatagggtgccgcgccagctcgtcggagcgcgcgaacaacagaggagagttcgcatgctccgacgaaacctggcggcagcgcaaaagatg

SEQ ID NO: 148072 - DNA, 103 bp, Artificial Sequence
  Synthetic Polynucleotide
taatacgactcactatagggtgtgcggtagtgccgcgccagctcgtcggaaacagaggagatccgacatgctggcgcggaacctggcggcagcgcaaaagatg

SEQ ID NO: 148073 - DNA, 103 bp, Artificial Sequence
  Synthetic Polynucleotide
taatacgactcactatagggcgcccgtgtgtgtgcggtagtgccgcgccaaacagaggagatggcgcatgactaccgcaaacctggcggcagcgcaaaagatg

SEQ ID NO: 148074 - DNA, 103 bp, Artificial Sequence
  Synthetic Polynucleotide
taatacgactcactatagggaacttcttctcgcccgtgtgtgtgcggtagaacagaggagactaccgatgacacacgggaacctggcggcagcgcaaaagatg

SEQ ID NO: 148075 - DNA, 103 bp, Artificial Sequence
  Synthetic Polynucleotide
taatacgactcactatagggggggcagctgaacttcttctcgcccgtgtgaacagaggagacacacgatggagaagaagaacctggcggcagcgcaaaagatg

SEQ ID NO: 148076 - DNA, 103 bp, Artificial Sequence
  Synthetic Polynucleotide
taatacgactcactatagggtctcgcagatggggcagctgaacttcttctaacagaggagaagaagaatgtcagctgccaacctggcggcagcgcaaaagatg

SEQ ID NO: 148077 - DNA, 103 bp, Artificial Sequence
  Synthetic Polynucleotide
taatacgactcactatagggatgaagcgcttctcgcagatggggcagctgaacagaggagacagctgatgcatctgcgaaacctggcggcagcgcaaaagatg

SEQ ID NO: 148078 - DNA, 103 bp, Artificial Sequence
  Synthetic Polynucleotide
taatacgactcactatagggcccctcccgcggcccgtgcacgaccgcgcgaacagaggagacgcgcgatggtgcacgggaacctggcggcagcgcaaaagatg

SEQ ID NO: 148079 - DNA, 103 bp, Artificial Sequence
  Synthetic Polynucleotide
taatacgactcactataggggtcgctgcgcatgaagcgcttctcgcagataacagaggagaatctgcatgaagcgcttcaacctggcggcagcgcaaaagatg

SEQ ID NO: 148080 - DNA, 103 bp, Artificial Sequence
  Synthetic Polynucleotide
taatacgactcactatagggtggtcaggtggtcgctgcgcatgaagcgctaacagaggagaagcgctatgtgcgcagcgaacctggcggcagcgcaaaagatg

SEQ ID NO: 148081 - DNA, 103 bp, Artificial Sequence
  Synthetic Polynucleotide
taatacgactcactatagggcgcgcgtgcttggtcaggtggtcgctgcgcaacagaggagagcgcagatgccacctgacaacctggcggcagcgcaaaagatg

SEQ ID NO: 148082 - DNA, 103 bp, Artificial Sequence
  Synthetic Polynucleotide
taatacgactcactatagggggcgtggcggcgcgcgtgcttggtcaggtgaacagaggagacacctgatgaagcacgcgaacctggcggcagcgcaaaagatg

SEQ ID NO: 148083 - DNA, 103 bp, Artificial Sequence
  Synthetic Polynucleotide
taatacgactcactatagggggtggaagttggcgtggcggcgcgcgtgctaacagaggagaagcacgatggccgccacgaacctggcggcagcgcaaaagatg

SEQ ID NO: 148084 - DNA, 103 bp, Artificial Sequence
  Synthetic Polynucleotide
taatacgactcactatagggagcattcccgggtggaagttggcgtggcggaacagaggagaccgccaatgcaacttccaaacctggcggcagcgcaaaagatg

SEQ ID NO: 148085 - DNA, 103 bp, Artificial Sequence
  Synthetic Polynucleotide
taatacgactcactataggggcgccgctgcagcattcccgggtggaagttaacagaggagaaacttcatgccgggaatgaacctggcggcagcgcaaaagatg

SEQ ID NO: 148086 - DNA, 103 bp, Artificial Sequence
  Synthetic Polynucleotide
taatacgactcactatagggagcccccgccgcgccgctgcagcattcccgaacagaggagacgggaaatgtgcagcggcaacctggcggcagcgcaaaagatg

SEQ ID NO: 148087 - DNA, 103 bp, Artificial Sequence
  Synthetic Polynucleotide
taatacgactcactatagggccggtccgcgagcccccgccgcgccgctgcaacagaggagagcagcgatgcggcgggggaacctggcggcagcgcaaaagatg

SEQ ID NO: 148088 - DNA, 103 bp, Artificial Sequence
  Synthetic Polynucleotide
taatacgactcactataggggctgagggagccggtccgcgagcccccgccaacagaggagaggcgggatgtcgcggaccaacctggcggcagcgcaaaagatg

SEQ ID NO: 148089 - DNA, 103 bp, Artificial Sequence
  Synthetic Polynucleotide
taatacgactcactataggggggactccggcccctcccgcggcccgtgcaaacagaggagatgcacgatgcgcgggaggaacctggcggcagcgcaaaagatg

SEQ ID NO: 148090 - DNA, 103 bp, Artificial Sequence
  Synthetic Polynucleotide
taatacgactcactatagggggctgtagtcgctgagggagccggtccgcgaacagaggagacgcggaatggctccctcaaacctggcggcagcgcaaaagatg

SEQ ID NO: 148091 - DNA, 103 bp, Artificial Sequence
  Synthetic Polynucleotide
taatacgactcactataggggcgtcggagcggctgtagtcgctgagggagaacagaggagactccctatgcgactacagaacctggcggcagcgcaaaagatg

SEQ ID NO: 148092 - DNA, 103 bp, Artificial Sequence
  Synthetic Polynucleotide
taatacgactcactatagggggggctgctggcgtcggagcggctgtagtcaacagaggagagactacatgcgctccgacaacctggcggcagcgcaaaagatg

SEQ ID NO: 148093 - DNA, 103 bp, Artificial Sequence
  Synthetic Polynucleotide
taatacgactcactatagggggctgatggtggggctgctggcgtcggagcaacagaggagagctccgatgccagcagccaacctggcggcagcgcaaaagatg

SEQ ID NO: 148094 - DNA, 103 bp, Artificial Sequence
  Synthetic Polynucleotide
taatacgactcactataggggagctggccgggctgatggtggggctgctgaacagaggagacagcagatgcaccatcagaacctggcggcagcgcaaaagatg

SEQ ID NO: 148095 - DNA, 103 bp, Artificial Sequence
  Synthetic Polynucleotide
taatacgactcactatagggccctcgggccgggactccggcccctcccgcaacagaggagagcgggaatggccggagtcaacctggcggcagcgcaaaagatg

SEQ ID NO: 148096 - DNA, 103 bp, Artificial Sequence
  Synthetic Polynucleotide
taatacgactcactatagggctcgtccactggaagtaagtggtccaccataacagaggagaatggtgatgcacttacttaacctggcggcagcgcaaaagatg

SEQ ID NO: 148097 - DNA, 103 bp, Artificial Sequence
  Synthetic Polynucleotide
taatacgactcactatagggagagacgggtgagggcagcatgtgatatgcaacagaggagagcatatatgatgctgcccaacctggcggcagcgcaaaagatg

SEQ ID NO: 148098 - DNA, 103 bp, Artificial Sequence
  Synthetic Polynucleotide
taatacgactcactatagggggccttgaggtggctgcttttggtgtacataacagaggagaatgtacatgaaaagcagcaacctggcggcagcgcaaaagatg

SEQ ID NO: 148099 - DNA, 103 bp, Artificial Sequence
  Synthetic Polynucleotide
taatacgactcactatagggggcgcaggtgggccttgaggtggctgctttaacagaggagaaaagcaatgacctcaaggaacctggcggcagcgcaaaagatg

SEQ ID NO: 148100 - DNA, 103 bp, Artificial Sequence
  Synthetic Polynucleotide
taatacgactcactatagggcccgtgtgccggcgcaggtgggccttgaggaacagaggagacctcaaatgccacctgcgaacctggcggcagcgcaaaagatg

SEQ ID NO: 148101 - DNA, 103 bp, Artificial Sequence
  Synthetic Polynucleotide
taatacgactcactataggggggcttctcacccgtgtgccggcgcaggtgaacagaggagacacctgatgcggcacacgaacctggcggcagcgcaaaagatg

SEQ ID NO: 148102 - DNA, 103 bp, Artificial Sequence
  Synthetic Polynucleotide
taatacgactcactatagggtgcaggcgaagggcttctcacccgtgtgccaacagaggagaggcacaatggtgagaagcaacctggcggcagcgcaaaagatg

SEQ ID NO: 148103 - DNA, 103 bp, Artificial Sequence
  Synthetic Polynucleotide
taatacgactcactatagggcctggccaggtgcaggcgaagggcttctcaaacagaggagatgagaaatgcttcgcctgaacctggcggcagcgcaaaagatg

SEQ ID NO: 148104 - DNA, 103 bp, Artificial Sequence
  Synthetic Polynucleotide
taatacgactcactatagggccagccgcagcctggccaggtgcaggcgaaaacagaggagattcgccatgacctggccaaacctggcggcagcgcaaaagatg

SEQ ID NO: 148105 - DNA, 103 bp, Artificial Sequence
  Synthetic Polynucleotide
taatacgactcactataggggcgagaacctccagccgcagcctggccaggaacagaggagacctggcatggctgcggctaacctggcggcagcgcaaaagatg

SEQ ID NO: 148106 - DNA, 103 bp, Artificial Sequence
  Synthetic Polynucleotide
taatacgactcactatagggtcgtcagagcgcgagaacctccagccgcagaacagaggagactgcggatggaggttctcaacctggcggcagcgcaaaagatg

SEQ ID NO: 148107 - DNA, 103 bp, Artificial Sequence
  Synthetic Polynucleotide
taatacgactcactatagggccgcgacagctcgtcagagcgcgagaacctaacagaggagaaggttcatgcgctctgacaacctggcggcagcgcaaaagatg

SEQ ID NO: 148108 - DNA, 103 bp, Artificial Sequence
  Synthetic Polynucleotide
taatacgactcactatagggtgtcatcttcagagacgggtgagggcagcaaacagaggagatgctgcatgcacccgtctaacctggcggcagcgcaaaagatg

SEQ ID NO: 148109 - DNA, 103 bp, Artificial Sequence
  Synthetic Polynucleotide
taatacgactcactatagggagcgcctgtgccgcgacagctcgtcagagcaacagaggagagctctgatgagctgtcgcaacctggcggcagcgcaaaagatg

SEQ ID NO: 148110 - DNA, 103 bp, Artificial Sequence
  Synthetic Polynucleotide
taatacgactcactatagggcctgagtgcgagcgcctgtgccgcgacagcaacagaggagagctgtcatggcacaggcgaacctggcggcagcgcaaaagatg

SEQ ID NO: 148111 - DNA, 103 bp, Artificial Sequence
  Synthetic Polynucleotide
taatacgactcactatagggcggcttcacacctgagtgcgagcgcctgtgaacagaggagacacaggatgtcgcactcaaacctggcggcagcgcaaaagatg

SEQ ID NO: 148112 - DNA, 103 bp, Artificial Sequence
  Synthetic Polynucleotide
taatacgactcactataggggacactggtacggcttcacacctgagtgcgaacagaggagacgcactatggtgtgaagcaacctggcggcagcgcaaaagatg

SEQ ID NO: 148113 - DNA, 103 bp, Artificial Sequence
  Synthetic Polynucleotide
taatacgactcactatagggtcgcacacaggacactggtacggcttcacaaacagaggagatgtgaaatggtaccagtgaacctggcggcagcgcaaaagatg

SEQ ID NO: 148114 - DNA, 103 bp, Artificial Sequence
  Synthetic Polynucleotide
taatacgactcactataggggaacttcttctcgcacacaggacactggtaaacagaggagataccagatgcctgtgtgcaacctggcggcagcgcaaaagatg

SEQ ID NO: 148115 - DNA, 103 bp, Artificial Sequence
  Synthetic Polynucleotide
taatacgactcactatagggcgctccgcgcgaacttcttctcgcacacagaacagaggagactgtgtatgagaagaagtaacctggcggcagcgcaaaagatg

SEQ ID NO: 148116 - DNA, 103 bp, Artificial Sequence
  Synthetic Polynucleotide
taatacgactcactataggggagaggtggtcgctccgcgcgaacttcttcaacagaggagagaagaaatgcgcgcggagaacctggcggcagcgcaaaagatg

SEQ ID NO: 148117 - DNA, 103 bp, Artificial Sequence
  Synthetic Polynucleotide
taatacgactcactataggggatgtgcttggagaggtggtcgctccgcgcaacagaggagagcgcggatggaccacctcaacctggcggcagcgcaaaagatg

SEQ ID NO: 148118 - DNA, 103 bp, Artificial Sequence
  Synthetic Polynucleotide
taatacgactcactatagggggtgcaccttgatgtgcttggagaggtggtaacagaggagaaccaccatgccaagcacaaacctggcggcagcgcaaaagatg

SEQ ID NO: 148119 - DNA, 103 bp, Artificial Sequence
  Synthetic Polynucleotide
taatacgactcactataggggaggcatcgctgtcatcttcagagacgggtaacagaggagaacccgtatgtgaagatgaaacctggcggcagcgcaaaagatg

SEQ ID NO: 148120 - DNA, 103 bp, Artificial Sequence
  Synthetic Polynucleotide
taatacgactcactatagggcgcgggaagcggtgcaccttgatgtgcttgaacagaggagacaagcaatgcaaggtgcaaacctggcggcagcgcaaaagatg

SEQ ID NO: 148121 - DNA, 103 bp, Artificial Sequence
  Synthetic Polynucleotide
taatacgactcactataggggcggctgctccgcgggaagcggtgcaccttaacagaggagaaaggtgatgcgcttcccgaacctggcggcagcgcaaaagatg

SEQ ID NO: 148122 - DNA, 103 bp, Artificial Sequence
  Synthetic Polynucleotide
taatacgactcactatagggagcgcacggagcggctgctccgcgggaagcaacagaggagagcttccatgggagcagccaacctggcggcagcgcaaaagatg

SEQ ID NO: 148123 - DNA, 103 bp, Artificial Sequence
  Synthetic Polynucleotide
taatacgactcactatagggcagttcacggagcgcacggagcggctgctcaacagaggagagagcagatgctccgtgcgaacctggcggcagcgcaaaagatg

SEQ ID NO: 148124 - DNA, 103 bp, Artificial Sequence
  Synthetic Polynucleotide
taatacgactcactataggggcaggggctggaggcatcgctgtcatcttcaacagaggagagaagatatgagcgatgccaacctggcggcagcgcaaaagatg

SEQ ID NO: 148125 - DNA, 103 bp, Artificial Sequence
  Synthetic Polynucleotide
taatacgactcactatagggtggaacaggagcaggggctggaggcatcgcaacagaggagagcgatgatgccagcccctaacctggcggcagcgcaaaagatg

SEQ ID NO: 148126 - DNA, 103 bp, Artificial Sequence
  Synthetic Polynucleotide
taatacgactcactataggggagtcgggactggaacaggagcaggggctgaacagaggagacagcccatgctcctgttcaacctggcggcagcgcaaaagatg

SEQ ID NO: 148127 - DNA, 103 bp, Artificial Sequence
  Synthetic Polynucleotide
taatacgactcactataggggagggcttgagagtcgggactggaacaggaaacagaggagatcctgtatgagtcccgacaacctggcggcagcgcaaaagatg

SEQ ID NO: 148128 - DNA, 103 bp, Artificial Sequence
  Synthetic Polynucleotide
taatacgactcactatagggagcaggagcagagggcttgagagtcgggacaacagaggagagtcccgatgctcaagcccaacctggcggcagcgcaaaagatg

SEQ ID NO: 148129 - DNA, 103 bp, Artificial Sequence
  Synthetic Polynucleotide
taatacgactcactatagggcctccaccatagcaggagcagagggcttgaaacagaggagatcaagcatgctgctcctgaacctggcggcagcgcaaaagatg

SEQ ID NO: 148130 - DNA, 103 bp, Artificial Sequence
  Synthetic Polynucleotide
taatacgactcactatagggggtgcccaggcctccaccatagcaggagcaaacagaggagatgctccatgtatggtggaaacctggcggcagcgcaaaagatg

SEQ ID NO: 148131 - DNA, 103 bp, Artificial Sequence
  Synthetic Polynucleotide
taatacgactcactatagggacgagaagttctcgtccactggaagtaagtaacagaggagaacttacatgcagtggacgaacctggcggcagcgcaaaagatg

SEQ ID NO: 148132 - DNA, 103 bp, Artificial Sequence
  Synthetic Polynucleotide
taatacgactcactatagggcctggctctcggtgcccaggcctccaccataacagaggagaatggtgatggcctgggcaaacctggcggcagcgcaaaagatg

SEQ ID NO: 148133 - DNA, 103 bp, Artificial Sequence
  Synthetic Polynucleotide
taatacgactcactatagggaagatgctgtcctggctctcggtgcccaggaacagaggagacctgggatgcgagagccaaacctggcggcagcgcaaaagatg

SEQ ID NO: 148134 - DNA, 103 bp, Artificial Sequence
  Synthetic Polynucleotide
taatacgactcactatagggtaggaagtccaagatgctgtcctggctctcaacagaggagagagagcatggacagcatcaacctggcggcagcgcaaaagatg

SEQ ID NO: 148135 - DNA, 103 bp, Artificial Sequence
  Synthetic Polynucleotide
taatacgactcactatagggcctgggacaataggaagtccaagatgctgtaacagaggagaacagcaatgtggacttccaacctggcggcagcgcaaaagatg

SEQ ID NO: 148136 - DNA, 103 bp, Artificial Sequence
  Synthetic Polynucleotide
taatacgactcactatagggcccagcgtggcctgggacaataggaagtccaacagaggagaggacttatgattgtcccaaacctggcggcagcgcaaaagatg

SEQ ID NO: 148137 - DNA, 103 bp, Artificial Sequence
  Synthetic Polynucleotide
taatacgactcactatagggcccgccactgcccagcgtggcctgggacaaaacagaggagattgtccatggccacgctgaacctggcggcagcgcaaaagatg

SEQ ID NO: 148138 - DNA, 103 bp, Artificial Sequence
  Synthetic Polynucleotide
taatacgactcactatagggtgccgctgcccccgccactgcccagcgtggaacagaggagaccacgcatggcagtggcgaacctggcggcagcgcaaaagatg

SEQ ID NO: 148139 - DNA, 103 bp, Artificial Sequence
  Synthetic Polynucleotide
taatacgactcactatagggccaatgctactgccgctgcccccgccactgaacagaggagacagtggatggggcagcggaacctggcggcagcgcaaaagatg

SEQ ID NO: 148140 - DNA, 103 bp, Artificial Sequence
  Synthetic Polynucleotide
taatacgactcactatagggactgctggccccaatgctactgccgctgccaacagaggagaggcagcatgagtagcattaacctggcggcagcgcaaaagatg

SEQ ID NO: 148141 - DNA, 103 bp, Artificial Sequence
  Synthetic Polynucleotide
taatacgactcactatagggccacggggccactgctggccccaatgctacaacagaggagagtagcaatggggccagcaaacctggcggcagcgcaaaagatg

SEQ ID NO: 148142 - DNA, 103 bp, Artificial Sequence
  Synthetic Polynucleotide
taatacgactcactatagggcattttggcgacgagaagttctcgtccactaacagaggagaagtggaatggaacttctcaacctggcggcagcgcaaaagatg

SEQ ID NO: 148143 - DNA, 103 bp, Artificial Sequence
  Synthetic Polynucleotide
taatacgactcactatagggggcccccaggccacggggccactgctggccaacagaggagaggccagatgtggccccgtaacctggcggcagcgcaaaagatg

SEQ ID NO: 148144 - DNA, 103 bp, Artificial Sequence
  Synthetic Polynucleotide
taatacgactcactatagggccttcgccagggcccccaggccacggggccaacagaggagaggccccatggcctgggggaacctggcggcagcgcaaaagatg

SEQ ID NO: 148145 - DNA, 103 bp, Artificial Sequence
  Synthetic Polynucleotide
taatacgactcactataggggggccgctgcccttcgccagggcccccaggaacagaggagacctgggatgcctggcgaaaacctggcggcagcgcaaaagatg

SEQ ID NO: 148146 - DNA, 103 bp, Artificial Sequence
  Synthetic Polynucleotide
taatacgactcactatagggcccttcacaggggccgctgcccttcgccagaacagaggagactggcgatgggcagcggcaacctggcggcagcgcaaaagatg

SEQ ID NO: 148147 - DNA, 103 bp, Artificial Sequence
  Synthetic Polynucleotide
taatacgactcactataggggaaatgctcccccttcacaggggccgctgcaacagaggagagcagcgatgcctgtgaagaacctggcggcagcgcaaaagatg

SEQ ID NO: 148148 - DNA, 103 bp, Artificial Sequence
  Synthetic Polynucleotide
taatacgactcactatagggcgggcaagcagaaatgctcccccttcacagaacagaggagactgtgaatggggagcattaacctggcggcagcgcaaaagatg

SEQ ID NO: 148149 - DNA, 103 bp, Artificial Sequence
  Synthetic Polynucleotide
taatacgactcactatagggaaaggaaactcgggcaagcagaaatgctccaacagaggagaggagcaatgctgcttgccaacctggcggcagcgcaaaagatg

SEQ ID NO: 148150 - DNA, 103 bp, Artificial Sequence
  Synthetic Polynucleotide
taatacgactcactatagggaggatcacccaaaggaaactcgggcaagcaaacagaggagatgcttgatggagtttcctaacctggcggcagcgcaaaagatg

SEQ ID NO: 148151 - DNA, 103 bp, Artificial Sequence
  Synthetic Polynucleotide
taatacgactcactatagggggacgtcatcaggatcacccaaaggaaactaacagaggagaagtttcatgtgggtgatcaacctggcggcagcgcaaaagatg

SEQ ID NO: 148152 - DNA, 103 bp, Artificial Sequence
  Synthetic Polynucleotide
taatacgactcactatagggaagggccgtgggacgtcatcaggatcacccaacagaggagagggtgaatgtgatgacgtaacctggcggcagcgcaaaagatg

SEQ ID NO: 148153 - DNA, 103 bp, Artificial Sequence
  Synthetic Polynucleotide
taatacgactcactatagggcccaactgggcattttggcgacgagaagttaacagaggagaaacttcatgtcgccaaaaaacctggcggcagcgcaaaagatg

SEQ ID NO: 148154 - DNA, 103 bp, Artificial Sequence
  Synthetic Polynucleotide
taatacgactcactatagggggtaggctggaagggccgtgggacgtcatcaacagaggagagatgacatgccacggcccaacctggcggcagcgcaaaagatg

SEQ ID NO: 148155 - DNA, 103 bp, Artificial Sequence
  Synthetic Polynucleotide
taatacgactcactatagggtctcctccagggtaggctggaagggccgtgaacagaggagacacggcatgtccagcctaaacctggcggcagcgcaaaagatg

SEQ ID NO: 148156 - DNA, 103 bp, Artificial Sequence
  Synthetic Polynucleotide
taatacgactcactatagggaactcttcaatctcctccagggtaggctggaacagaggagaccagccatgcctggaggaaacctggcggcagcgcaaaagatg

SEQ ID NO: 148157 - DNA, 103 bp, Artificial Sequence
  Synthetic Polynucleotide
taatacgactcactatagggctcctccagaaactcttcaatctcctccagaacagaggagactggagatgattgaagagaacctggcggcagcgcaaaagatg

SEQ ID NO: 148158 - DNA, 103 bp, Artificial Sequence
  Synthetic Polynucleotide
taatacgactcactataggggctccatgttctcctccagaaactcttcaaaacagaggagattgaagatgttctggaggaacctggcggcagcgcaaaagatg

SEQ ID NO: 148159 - DNA, 103 bp, Artificial Sequence
  Synthetic Polynucleotide
taatacgactcactatagggttgactccaggctccatgttctcctccagaaacagaggagatctggaatggaacatggaaacctggcggcagcgcaaaagatg

SEQ ID NO: 148160 - DNA, 103 bp, Artificial Sequence
  Synthetic Polynucleotide
taatacgactcactatagggagggacctccttgactccaggctccatgttaacagaggagaaacatgatgcctggagtcaacctggcggcagcgcaaaagatg

SEQ ID NO: 148161 - DNA, 103 bp, Artificial Sequence
  Synthetic Polynucleotide
taatacgactcactatagggtgttgccctcagggacctccttgactccagaacagaggagactggagatgaggaggtccaacctggcggcagcgcaaaagatg

SEQ ID NO: 148162 - DNA, 103 bp, Artificial Sequence
  Synthetic Polynucleotide
taatacgactcactatagggaagtccttgctgttgccctcagggacctccaacagaggagaggaggtatgtgagggcaaaacctggcggcagcgcaaaagatg

SEQ ID NO: 148163 - DNA, 103 bp, Artificial Sequence
  Synthetic Polynucleotide
taatacgactcactataggggcaggcatccaagtccttgctgttgccctcaacagaggagagagggcatgagcaaggacaacctggcggcagcgcaaaagatg

SEQ ID NO: 148164 - DNA, 103 bp, Artificial Sequence
  Synthetic Polynucleotide
taatacgactcactatagggcacccagatacccaactgggcattttggcgaacagaggagacgccaaatggcccagttgaacctggcggcagcgcaaaagatg

SEQ ID NO: 148165 - DNA, 103 bp, Artificial Sequence
  Synthetic Polynucleotide
taatacgactcactatagggagagctggctgcaggcatccaagtccttgcaacagaggagagcaaggatgtggatgcctaacctggcggcagcgcaaaagatg

SEQ ID NO: 148166 - DNA, 103 bp, Artificial Sequence
  Synthetic Polynucleotide
taatacgactcactatagggggcccagctgagagctggctgcaggcatccaacagaggagaggatgcatgcagccagctaacctggcggcagcgcaaaagatg

SEQ ID NO: 148167 - DNA, 103 bp, Artificial Sequence
  Synthetic Polynucleotide
taatacgactcactataggggctcttgtgtggcccagctgagagctggctaacagaggagaagccagatgtcagctgggaacctggcggcagcgcaaaagatg

SEQ ID NO: 148168 - DNA, 103 bp, Artificial Sequence
  Synthetic Polynucleotide
taatacgactcactataggggatggaggtggctcttgtgtggcccagctgaacagaggagacagctgatgcacacaagaaacctggcggcagcgcaaaagatg

SEQ ID NO: 148169 - DNA, 103 bp, Artificial Sequence
  Synthetic Polynucleotide
taatacgactcactatagggctggacccaggatggaggtggctcttgtgtaacagaggagaacacaaatgccacctccaaacctggcggcagcgcaaaagatg

SEQ ID NO: 148170 - DNA, 103 bp, Artificial Sequence
  Synthetic Polynucleotide
taatacgactcactatagggctctctcccgctggacccaggatggaggtgaacagaggagacacctcatgcctgggtccaacctggcggcagcgcaaaagatg

SEQ ID NO: 148171 - DNA, 103 bp, Artificial Sequence
  Synthetic Polynucleotide
taatacgactcactataggggggaacagcgctctctcccgctggacccagaacagaggagactgggtatggcgggagagaacctggcggcagcgcaaaagatg

SEQ ID NO: 148172 - DNA, 103 bp, Artificial Sequence
  Synthetic Polynucleotide
taatacgactcactatagggcctggtggaggggaacagcgctctctcccgaacagaggagacgggagatggcgctgttcaacctggcggcagcgcaaaagatg

SEQ ID NO: 148173 - DNA, 103 bp, Artificial Sequence
  Synthetic Polynucleotide
taatacgactcactatagggactggcaccacctggtggaggggaacagcgaacagaggagacgctgtatgcctccaccaaacctggcggcagcgcaaaagatg

SEQ ID NO: 148174 - DNA, 103 bp, Artificial Sequence
  Synthetic Polynucleotide
taatacgactcactatagggcacctcctgcactggcaccacctggtggagaacagaggagactccacatggtggtgccaaacctggcggcagcgcaaaagatg

SEQ ID NO: 148175 - DNA, 103 bp, Artificial Sequence
  Synthetic Polynucleotide
taatacgactcactatagggaccagcctatcacccagatacccaactgggaacagaggagacccagtatggtatctgggaacctggcggcagcgcaaaagatg

SEQ ID NO: 148176 - DNA, 103 bp, Artificial Sequence
  Synthetic Polynucleotide
taatacgactcactataggggggccctgggcacctcctgcactggcaccaaacagaggagatggtgcatgtgcaggaggaacctggcggcagcgcaaaagatg

SEQ ID NO: 148177 - DNA, 103 bp, Artificial Sequence
  Synthetic Polynucleotide
taatacgactcactataggggcccccacctgggccctgggcacctcctgcaacagaggagagcaggaatggcccagggcaacctggcggcagcgcaaaagatg

SEQ ID NO: 148178 - DNA, 103 bp, Artificial Sequence
  Synthetic Polynucleotide
taatacgactcactatagggcaggcgtggggcccccacctgggccctgggaacagaggagacccaggatgcaggtggggaacctggcggcagcgcaaaagatg

SEQ ID NO: 148179 - DNA, 103 bp, Artificial Sequence
  Synthetic Polynucleotide
taatacgactcactatagggatggggccatcaggcgtggggcccccacctaacagaggagaaggtggatgccccacgccaacctggcggcagcgcaaaagatg

SEQ ID NO: 148180 - DNA, 103 bp, Artificial Sequence
  Synthetic Polynucleotide
taatacgactcactatagggcaacactgggatggggccatcaggcgtgggaacagaggagacccacgatggatggccccaacctggcggcagcgcaaaagatg

SEQ ID NO: 148181 - DNA, 103 bp, Artificial Sequence
  Synthetic Polynucleotide
taatacgactcactatagggggatctgcagcaacactgggatggggccataacagaggagaatggccatgtcccagtgtaacctggcggcagcgcaaaagatg

SEQ ID NO: 148182 - DNA, 103 bp, Artificial Sequence
  Synthetic Polynucleotide
taatacgactcactatagggggcacgggctggatctgcagcaacactgggaacagaggagacccagtatggctgcagataacctggcggcagcgcaaaagatg

SEQ ID NO: 148183 - DNA, 103 bp, Artificial Sequence
  Synthetic Polynucleotide
taatacgactcactatagggctgcttcacaggcacgggctggatctgcagaacagaggagactgcagatgcagcccgtgaacctggcggcagcgcaaaagatg

SEQ ID NO: 148184 - DNA, 103 bp, Artificial Sequence
  Synthetic Polynucleotide
taatacgactcactatagggtgcccgattcctgcttcacaggcacgggctaacagaggagaagcccgatgctgtgaagcaacctggcggcagcgcaaaagatg

SEQ ID NO: 148185 - DNA, 103 bp, Artificial Sequence
  Synthetic Polynucleotide
taatacgactcactataggggcaggccctgtgcccgattcctgcttcacaaacagaggagatgtgaaatgggaatcgggaacctggcggcagcgcaaaagatg

SEQ ID NO: 148186 - DNA, 103 bp, Artificial Sequence
  Synthetic Polynucleotide
taatacgactcactatagggccgccggccaaccagcctatcacccagataaacagaggagatatctgatggataggctgaacctggcggcagcgcaaaagatg

SEQ ID NO: 148187 - DNA, 103 bp, Artificial Sequence
  Synthetic Polynucleotide
taatacgactcactatagggcccaggggaggcaggccctgtgcccgattcaacagaggagagaatcgatgacagggcctaacctggcggcagcgcaaaagatg

SEQ ID NO: 148188 - DNA, 103 bp, Artificial Sequence
  Synthetic Polynucleotide
taatacgactcactatagggctggggcttgcccaggggaggcaggccctgaacagaggagacagggcatgcctcccctgaacctggcggcagcgcaaaagatg

SEQ ID NO: 148189 - DNA, 103 bp, Artificial Sequence
  Synthetic Polynucleotide
taatacgactcactatagggttgacattctctggggcttgcccaggggagaacagaggagactccccatggcaagccccaacctggcggcagcgcaaaagatg

SEQ ID NO: 148190 - DNA, 103 bp, Artificial Sequence
  Synthetic Polynucleotide
taatacgactcactatagggctgggcaaccttgacattctctggggcttgaacagaggagacaagccatggagaatgtcaacctggcggcagcgcaaaagatg

SEQ ID NO: 148191 - DNA, 103 bp, Artificial Sequence
  Synthetic Polynucleotide
taatacgactcactatagggtgaccaggagctgggcaaccttgacattctaacagaggagaagaatgatgaggttgcccaacctggcggcagcgcaaaagatg

SEQ ID NO: 148192 - DNA, 103 bp, Artificial Sequence
  Synthetic Polynucleotide
taatacgactcactatagggccctggatgttgaccaggagctgggcaaccaacagaggagaggttgcatggctcctggtaacctggcggcagcgcaaaagatg

SEQ ID NO: 148193 - DNA, 103 bp, Artificial Sequence
  Synthetic Polynucleotide
taatacgactcactataggggaaggtctgcccctggatgttgaccaggagaacagaggagactcctgatgaacatccagaacctggcggcagcgcaaaagatg

SEQ ID NO: 148194 - DNA, 103 bp, Artificial Sequence
  Synthetic Polynucleotide
taatacgactcactataggggcacgagtgcgaaggtctgcccctggatgtaacagaggagaacatccatgggcagacctaacctggcggcagcgcaaaagatg

SEQ ID NO: 148195 - DNA, 103 bp, Artificial Sequence
  Synthetic Polynucleotide
taatacgactcactatagggaccacctggggcacgagtgcgaaggtctgcaacagaggagagcagacatgcgcactcgtaacctggcggcagcgcaaaagatg

SEQ ID NO: 148196 - DNA, 103 bp, Artificial Sequence
  Synthetic Polynucleotide
taatacgactcactatagggggaggagggtaccacctggggcacgagtgcaacagaggagagcactcatgccccaggtgaacctggcggcagcgcaaaagatg

SEQ ID NO: 148197 - DNA, 103 bp, Artificial Sequence
  Synthetic Polynucleotide
taatacgactcactatagggtgtgatatgcccgccggccaaccagcctataacagaggagaataggcatgttggccggcaacctggcggcagcgcaaaagatg

SEQ ID NO: 148198 - DNA, 103 bp, Artificial Sequence
  Synthetic Polynucleotide
taatacgactcactatagggggttcaagttggaggagggtaccacctgggaacagaggagacccaggatgtaccctcctaacctggcggcagcgcaaaagatg

SEQ ID NO: 148199 - DNA, 103 bp, Artificial Sequence
  Synthetic Polynucleotide
taatacgactcactatagggttggagggcaggttcaagttggaggagggtaacagaggagaaccctcatgcaacttgaaaacctggcggcagcgcaaaagatg

SEQ ID NO: 148200 - DNA, 103 bp, Artificial Sequence
  Synthetic Polynucleotide
taatacgactcactataggggcgcacaaacttggagggcaggttcaagttaacagaggagaaacttgatgctgccctccaacctggcggcagcgcaaaagatg

SEQ ID NO: 148201 - DNA, 103 bp, Artificial Sequence
  Synthetic Polynucleotide
taatacgactcactatagggcaggggcaatgcgcacaaacttggagggcaaacagaggagatgccctatgagtttgtgcaacctggcggcagcgcaaaagatg

SEQ ID NO: 148202 - DNA, 103 bp, Artificial Sequence
  Synthetic Polynucleotide
taatacgactcactataggggcaatgggcacaggggcaatgcgcacaaacaacagaggagagtttgtatgcattgccccaacctggcggcagcgcaaaagatg

SEQ ID NO: 148203 - DNA, 103 bp, Artificial Sequence
  Synthetic Polynucleotide
taatacgactcactatagggaggcttggcggcaatgggcacaggggcaataacagaggagaattgccatggtgcccattaacctggcggcagcgcaaaagatg

SEQ ID NO: 148204 - DNA, 103 bp, Artificial Sequence
  Synthetic Polynucleotide
taatacgactcactatagggccgatccaacaggcttggcggcaatgggcaaacagaggagatgcccaatgccgccaagcaacctggcggcagcgcaaaagatg

SEQ ID NO: 148205 - DNA, 103 bp, Artificial Sequence
  Synthetic Polynucleotide
taatacgactcactatagggcccaggggtcccgatccaacaggcttggcgaacagaggagacgccaaatgtgttggatcaacctggcggcagcgcaaaagatg

SEQ ID NO: 148206 - DNA, 103 bp, Artificial Sequence
  Synthetic Polynucleotide
taatacgactcactatagggagggccaggccccaggggtcccgatccaacaacagaggagagttggaatgggacccctgaacctggcggcagcgcaaaagatg

SEQ ID NO: 148207 - DNA, 103 bp, Artificial Sequence
  Synthetic Polynucleotide
taatacgactcactatagggggagaccggcagggccaggccccaggggtcaacagaggagagaccccatgggcctggccaacctggcggcagcgcaaaagatg

SEQ ID NO: 148208 - DNA, 103 bp, Artificial Sequence
  Synthetic Polynucleotide
taatacgactcactataggggagggcagcatgtgatatgcccgccggccaaacagaggagatggccgatgggcatatcaaacctggcggcagcgcaaaagatg

SEQ ID NO: 148209 - DNA, 103 bp, Artificial Sequence
  Synthetic Polynucleotide
taatacgactcactatagggtggcccatgaggagaccggcagggccaggcaacagaggagagcctggatgtgccggtctaacctggcggcagcgcaaaagatg

SEQ ID NO: 148210 - DNA, 103 bp, Artificial Sequence
  Synthetic Polynucleotide
taatacgactcactatagggggggaacttctggcccatgaggagaccggcaacagaggagagccggtatgctcatgggcaacctggcggcagcgcaaaagatg

SEQ ID NO: 148211 - DNA, 103 bp, Artificial Sequence
  Synthetic Polynucleotide
taatacgactcactatagggctgggttcttggggaacttctggcccatgaaacagaggagatcatggatgagaagttccaacctggcggcagcgcaaaagatg

SEQ ID NO: 148212 - DNA, 103 bp, Artificial Sequence
  Synthetic Polynucleotide
taatacgactcactatagggagttctgcggctgggttcttggggaacttcaacagaggagagaagttatgcaagaacccaacctggcggcagcgcaaaagatg

SEQ ID NO: 148213 - DNA, 103 bp, Artificial Sequence
  Synthetic Polynucleotide
taatacgactcactatagggcattttgatgagttctgcggctgggttcttaacagaggagaaagaacatggccgcagaaaacctggcggcagcgcaaaagatg

SEQ ID NO: 148214 - DNA, 103 bp, Artificial Sequence
  Synthetic Polynucleotide
taatacgactcactatagggtacatttgtgcattttgatgagttctgcggaacagaggagaccgcagatgtcatcaaaaaacctggcggcagcgcaaaagatg

SEQ ID NO: 148215 - DNA, 103 bp, Artificial Sequence
  Synthetic Polynucleotide
taatacgactcactatagggccagggaaagtacatttgtgcattttgatgaacagaggagacatcaaatggcacaaatgaacctggcggcagcgcaaaagatg

SEQ ID NO: 148216 - DNA, 103 bp, Artificial Sequence
  Synthetic Polynucleotide
taatacgactcactatagggcttgctgcagccagggaaagtacatttgtgaacagaggagacacaaaatgactttccctaacctggcggcagcgcaaaagatg

SEQ ID NO: 148217 - DNA, 103 bp, Artificial Sequence
  Synthetic Polynucleotide
taatacgactcactatagggtggtgtacatcttgctgcagccagggaaagaacagaggagactttccatggctgcagcaaacctggcggcagcgcaaaagatg

SEQ ID NO: 148218 - DNA, 103 bp, Artificial Sequence
  Synthetic Polynucleotide
taatacgactcactatagggtggctgcttttggtgtacatcttgctgcagaacagaggagactgcagatggatgtacacaacctggcggcagcgcaaaagatg

SEQ ID NO: 148219 - DNA, 103 bp, Artificial Sequence
  Synthetic Polynucleotide
taatacgactcactataggggtaatccacgcacgccacggccgccgacataacagaggagaatgtcgatggccgtggcgaacctggcggcagcgcaaaagatg

SEQ ID NO: 148220 - DNA, 103 bp, Artificial Sequence
  Synthetic Polynucleotide
taatacgactcactataggggccggcggcggggcccgcgccctcggggccaacagaggagaggccccatgggcgcgggcaacctggcggcagcgcaaaagatg

SEQ ID NO: 148221 - DNA, 103 bp, Artificial Sequence
  Synthetic Polynucleotide
taatacgactcactataggggcacatccaggccggcggcggggcccgcgcaacagaggagagcgcggatgccgccgccgaacctggcggcagcgcaaaagatg

SEQ ID NO: 148222 - DNA, 103 bp, Artificial Sequence
  Synthetic Polynucleotide
taatacgactcactatagggcgcgccgcgcgcacatccaggccggcggcgaacagaggagacgccgcatgcctggatgtaacctggcggcagcgcaaaagatg

SEQ ID NO: 148223 - DNA, 103 bp, Artificial Sequence
  Synthetic Polynucleotide
taatacgactcactatagggggcctcgcggcgcgccgcgcgcacatccagaacagaggagactggatatgcgcgcggcgaacctggcggcagcgcaaaagatg

SEQ ID NO: 148224 - DNA, 103 bp, Artificial Sequence
  Synthetic Polynucleotide
taatacgactcactatagggcgggtgaggcggcctcgcggcgcgccgcgcaacagaggagagcgcggatggccgcgaggaacctggcggcagcgcaaaagatg

SEQ ID NO: 148225 - DNA, 103 bp, Artificial Sequence
  Synthetic Polynucleotide
taatacgactcactatagggcccggggtcccgggtgaggcggcctcgcggaacagaggagaccgcgaatgcgcctcaccaacctggcggcagcgcaaaagatg

SEQ ID NO: 148226 - DNA, 103 bp, Artificial Sequence
  Synthetic Polynucleotide
taatacgactcactatagggcgggggtggccccggggtcccgggtgaggcaacagaggagagcctcaatggggaccccgaacctggcggcagcgcaaaagatg

SEQ ID NO: 148227 - DNA, 103 bp, Artificial Sequence
  Synthetic Polynucleotide
taatacgactcactatagggcggggggcggcgggggtggccccggggtccaacagaggagaggacccatgggccaccccaacctggcggcagcgcaaaagatg

SEQ ID NO: 148228 - DNA, 103 bp, Artificial Sequence
  Synthetic Polynucleotide
taatacgactcactatagggccagaagcggcggggggcggcgggggtggcaacagaggagagccaccatggccgcccccaacctggcggcagcgcaaaagatg

SEQ ID NO: 148229 - DNA, 103 bp, Artificial Sequence
  Synthetic Polynucleotide
taatacgactcactatagggggggcccgggccagaagcggcggggggcggaacagaggagaccgcccatggccgcttctaacctggcggcagcgcaaaagatg

SEQ ID NO: 148230 - DNA, 103 bp, Artificial Sequence
  Synthetic Polynucleotide
taatacgactcactatagggcggcggcgaagtaatccacgcacgccacggaacagaggagaccgtggatggcgtggattaacctggcggcagcgcaaaagatg

SEQ ID NO: 148231 - DNA, 103 bp, Artificial Sequence
  Synthetic Polynucleotide
taatacgactcactatagggcggcggcgccggggcccgggccagaagcggaacagaggagaccgcttatggcccgggccaacctggcggcagcgcaaaagatg

SEQ ID NO: 148232 - DNA, 103 bp, Artificial Sequence
  Synthetic Polynucleotide
taatacgactcactatagggtggggcgccgcggcggcgccggggcccgggaacagaggagacccgggatgcggcgccgcaacctggcggcagcgcaaaagatg

SEQ ID NO: 148233 - DNA, 103 bp, Artificial Sequence
  Synthetic Polynucleotide
taatacgactcactatagggggccagcaggtggggcgccgcggcggcgccaacagaggagaggcgccatggcggcgcccaacctggcggcagcgcaaaagatg

SEQ ID NO: 148234 - DNA, 103 bp, Artificial Sequence
  Synthetic Polynucleotide
taatacgactcactatagggggatgctggcggccagcaggtggggcgccgaacagaggagacggcgcatgacctgctggaacctggcggcagcgcaaaagatg

SEQ ID NO: 148235 - DNA, 103 bp, Artificial Sequence
  Synthetic Polynucleotide
taatacgactcactatagggaggtcggccaggatgctggcggccagcaggaacagaggagacctgctatgcgccagcataacctggcggcagcgcaaaagatg

SEQ ID NO: 148236 - DNA, 103 bp, Artificial Sequence
  Synthetic Polynucleotide
taatacgactcactatagggtccgccgcgcaggtcggccaggatgctggcaacagaggagagccagcatgctggccgacaacctggcggcagcgcaaaagatg

SEQ ID NO: 148237 - DNA, 103 bp, Artificial Sequence
  Synthetic Polynucleotide
taatacgactcactatagggcggctccgggtccgccgcgcaggtcggccaaacagaggagatggccgatgtgcgcggcgaacctggcggcagcgcaaaagatg

SEQ ID NO: 148238 - DNA, 103 bp, Artificial Sequence
  Synthetic Polynucleotide
taatacgactcactatagggccccccggggcggctccgggtccgccgcgcaacagaggagagcgcggatgacccggagcaacctggcggcagcgcaaaagatg

SEQ ID NO: 148239 - DNA, 103 bp, Artificial Sequence
  Synthetic Polynucleotide
taatacgactcactataggggggcgaggcgccccccggggcggctccgggaacagaggagacccggaatggccccggggaacctggcggcagcgcaaaagatg

SEQ ID NO: 148240 - DNA, 103 bp, Artificial Sequence
  Synthetic Polynucleotide
taatacgactcactatagggaggaggaggcgggcgaggcgccccccggggaacagaggagaccccggatggcgcctcgcaacctggcggcagcgcaaaagatg

SEQ ID NO: 148241 - DNA, 103 bp, Artificial Sequence
  Synthetic Polynucleotide
taatacgactcactatagggatgagcacgtcggcggcgaagtaatccacgaacagaggagacgtggaatgcttcgccgcaacctggcggcagcgcaaaagatg

SEQ ID NO: 148242 - DNA, 103 bp, Artificial Sequence
  Synthetic Polynucleotide
taatacgactcactataggggcggctgaggaggaggaggcgggcgaggcgaacagaggagacgcctcatgcgcctcctcaacctggcggcagcgcaaaagatg

SEQ ID NO: 148243 - DNA, 103 bp, Artificial Sequence
  Synthetic Polynucleotide
taatacgactcactatagggcggggacgaggcggctgaggaggaggaggcaacagaggagagcctccatgtcctcagccaacctggcggcagcgcaaaagatg

SEQ ID NO: 148244 - DNA, 103 bp, Artificial Sequence
  Synthetic Polynucleotide
taatacgactcactatagggggcccgaggacggggacgaggcggctgaggaacagaggagacctcagatgcctcgtcccaacctggcggcagcgcaaaagatg

SEQ ID NO: 148245 - DNA, 103 bp, Artificial Sequence
  Synthetic Polynucleotide
taatacgactcactatagggccgggggcgcggcccgaggacggggacgagaacagaggagactcgtcatggtcctcgggaacctggcggcagcgcaaaagatg

SEQ ID NO: 148246 - DNA, 103 bp, Artificial Sequence
  Synthetic Polynucleotide
taatacgactcactataggggggcgcggcgccgggggcgcggcccgaggaaacagaggagatcctcgatgcgcgcccccaacctggcggcagcgcaaaagatg

SEQ ID NO: 148247 - DNA, 103 bp, Artificial Sequence
  Synthetic Polynucleotide
taatacgactcactatagggcggcggcggagggcgcggcgccgggggcgcaacagaggagagcgcccatggcgccgcgcaacctggcggcagcgcaaaagatg

SEQ ID NO: 148248 - DNA, 103 bp, Artificial Sequence
  Synthetic Polynucleotide
taatacgactcactatagggtggctcttggcggcggcggagggcgcggcgaacagaggagacgccgcatgctccgccgcaacctggcggcagcgcaaaagatg

SEQ ID NO: 148249 - DNA, 103 bp, Artificial Sequence
  Synthetic Polynucleotide
taatacgactcactataggggggacagcggtggctcttggcggcggcggaaacagaggagatccgccatggccaagagcaacctggcggcagcgcaaaagatg

SEQ ID NO: 148250 - DNA, 103 bp, Artificial Sequence
  Synthetic Polynucleotide
taatacgactcactatagggagtccgggaagggacagcggtggctcttggaacagaggagaccaagaatgaccgctgtcaacctggcggcagcgcaaaagatg

SEQ ID NO: 148251 - DNA, 103 bp, Artificial Sequence
  Synthetic Polynucleotide
taatacgactcactataggggctttggcgcagtccgggaagggacagcggaacagaggagaccgctgatgcttcccggaaacctggcggcagcgcaaaagatg

SEQ ID NO: 148252 - DNA, 103 bp, Artificial Sequence
  Synthetic Polynucleotide
taatacgactcactatagggagagatggccatgagcacgtcggcggcgaaaacagaggagattcgccatggacgtgctcaacctggcggcagcgcaaaagatg

SEQ ID NO: 148253 - DNA, 103 bp, Artificial Sequence
  Synthetic Polynucleotide
taatacgactcactatagggcttgtagtaggctttggcgcagtccgggaaaacagaggagattcccgatgtgcgccaaaaacctggcggcagcgcaaaagatg

SEQ ID NO: 148254 - DNA, 103 bp, Artificial Sequence
  Synthetic Polynucleotide
taatacgactcactatagggggtgcgaggacttgtagtaggctttggcgcaacagaggagagcgccaatgcctactacaaacctggcggcagcgcaaaagatg

SEQ ID NO: 148255 - DNA, 103 bp, Artificial Sequence
  Synthetic Polynucleotide
taatacgactcactatagggtgcgactttaggtgcgaggacttgtagtagaacagaggagactactaatggtcctcgcaaacctggcggcagcgcaaaagatg

SEQ ID NO: 148256 - DNA, 103 bp, Artificial Sequence
  Synthetic Polynucleotide
taatacgactcactatagggcgtccgcaggtgcgactttaggtgcgaggaaacagaggagatcctcgatgctaaagtcgaacctggcggcagcgcaaaagatg

SEQ ID NO: 148257 - DNA, 103 bp, Artificial Sequence
  Synthetic Polynucleotide
taatacgactcactatagggcccctgtgtgcgtccgcaggtgcgactttaaacagaggagataaagtatgacctgcggaaacctggcggcagcgcaaaagatg

SEQ ID NO: 148258 - DNA, 103 bp, Artificial Sequence
  Synthetic Polynucleotide
taatacgactcactatagggaaagggcgttcccctgtgtgcgtccgcaggaacagaggagacctgcgatggcacacaggaacctggcggcagcgcaaaagatg

SEQ ID NO: 148259 - DNA, 103 bp, Artificial Sequence
  Synthetic Polynucleotide
taatacgactcactataggggtcacaagcaaaagggcgttcccctgtgtgaacagaggagacacacaatggaacgccctaacctggcggcagcgcaaaagatg

SEQ ID NO: 148260 - DNA, 103 bp, Artificial Sequence
  Synthetic Polynucleotide
taatacgactcactatagggagccctgccagtcacaagcaaaagggcgttaacagaggagaaacgccatgttgcttgtgaacctggcggcagcgcaaaagatg

SEQ ID NO: 148261 - DNA, 103 bp, Artificial Sequence
  Synthetic Polynucleotide
taatacgactcactatagggttcttgtcgcagccctgccagtcacaagcaaacagaggagatgcttgatgctggcagggaacctggcggcagcgcaaaagatg

SEQ ID NO: 148262 - DNA, 103 bp, Artificial Sequence
  Synthetic Polynucleotide
taatacgactcactataggggcgggcgaacttcttgtcgcagccctgccaaacagaggagatggcagatgtgcgacaagaacctggcggcagcgcaaaagatg

SEQ ID NO: 148263 - DNA, 103 bp, Artificial Sequence
  Synthetic Polynucleotide
taatacgactcactatagggcggcgcccgaagagatggccatgagcacgtaacagaggagaacgtgcatgtggccatctaacctggcggcagcgcaaaagatg

SEQ ID NO: 148264 - DNA, 103 bp, Artificial Sequence
  Synthetic Polynucleotide
taatacgactcactataggggctcgtcggagcgggcgaacttcttgtcgcaacagaggagagcgacaatgagttcgcccaacctggcggcagcgcaaaagatg

SEQ ID NO: 148265 - DNA, 103 bp, Artificial Sequence
  Synthetic Polynucleotide
taatacgactcactatagggtggcgggccagctcgtcggagcgggcgaacaacagaggagagttcgcatgctccgacgaaacctggcggcagcgcaaaagatg

SEQ ID NO: 148266 - DNA, 103 bp, Artificial Sequence
  Synthetic Polynucleotide
taatacgactcactatagggcgtccggtggtggcgggccagctcgtcggaaacagaggagatccgacatgctggcccgcaacctggcggcagcgcaaaagatg

SEQ ID NO: 148267 - DNA, 103 bp, Artificial Sequence
  Synthetic Polynucleotide
taatacgactcactatagggcgcccgtgtgcgtccggtggtggcgggccaaacagaggagatggcccatgaccaccggaaacctggcggcagcgcaaaagatg

SEQ ID NO: 148268 - DNA, 103 bp, Artificial Sequence
  Synthetic Polynucleotide
taatacgactcactatagggaagcgcttctcgcccgtgtgcgtccggtggaacagaggagaccaccgatggcacacgggaacctggcggcagcgcaaaagatg

SEQ ID NO: 148269 - DNA, 103 bp, Artificial Sequence
  Synthetic Polynucleotide
taatacgactcactatagggagggcaggagaagcgcttctcgcccgtgtgaacagaggagacacacgatggagaagcgcaacctggcggcagcgcaaaagatg

SEQ ID NO: 148270 - DNA, 103 bp, Artificial Sequence
  Synthetic Polynucleotide
taatacgactcactatagggtggagcacagagggcaggagaagcgcttctaacagaggagaagaagcatgtctcctgccaacctggcggcagcgcaaaagatg

SEQ ID NO: 148271 - DNA, 103 bp, Artificial Sequence
  Synthetic Polynucleotide
taatacgactcactataggggtgaagcgcttggagcacagagggcaggagaacagaggagactcctgatgtctgtgctcaacctggcggcagcgcaaaagatg

SEQ ID NO: 148272 - DNA, 103 bp, Artificial Sequence
  Synthetic Polynucleotide
taatacgactcactataggggtcactgcgggtgaagcgcttggagcacagaacagaggagactgtgcatgaagcgcttcaacctggcggcagcgcaaaagatg

SEQ ID NO: 148273 - DNA, 103 bp, Artificial Sequence
  Synthetic Polynucleotide
taatacgactcactatagggtggccaggtggtcactgcgggtgaagcgctaacagaggagaagcgctatgcccgcagtgaacctggcggcagcgcaaaagatg

SEQ ID NO: 148274 - DNA, 103 bp, Artificial Sequence
  Synthetic Polynucleotide
taatacgactcactatagggcggtgcaccacggcgcccgaagagatggccaacagaggagaggccatatgttcgggcgcaacctggcggcagcgcaaaagatg

SEQ ID NO: 148275 - DNA, 103 bp, Artificial Sequence
  Synthetic Polynucleotide
taatacgactcactatagggcgggcgtgcttggccaggtggtcactgcggaacagaggagaccgcagatgccacctggcaacctggcggcagcgcaaaagatg

SEQ ID NO: 148276 - DNA, 103 bp, Artificial Sequence
  Synthetic Polynucleotide
taatacgactcactatagggggggtggcggcgggcgtgcttggccaggtgaacagaggagacacctgatgaagcacgccaacctggcggcagcgcaaaagatg

SEQ ID NO: 148277 - DNA, 103 bp, Artificial Sequence
  Synthetic Polynucleotide
taatacgactcactatagggggtggaagccggggtggcggcgggcgtgctaacagaggagaagcacgatggccgccaccaacctggcggcagcgcaaaagatg

SEQ ID NO: 148278 - DNA, 103 bp, Artificial Sequence
  Synthetic Polynucleotide
taatacgactcactatagggagcaggtccgggtggaagccggggtggcggaacagaggagaccgccaatgcggcttccaaacctggcggcagcgcaaaagatg

SEQ ID NO: 148279 - DNA, 103 bp, Artificial Sequence
  Synthetic Polynucleotide
taatacgactcactatagggagggcgccggagcaggtccgggtggaagccaacagaggagaggcttcatgccggacctgaacctggcggcagcgcaaaagatg

SEQ ID NO: 148280 - DNA, 103 bp, Artificial Sequence
  Synthetic Polynucleotide
taatacgactcactatagggtgcgggcaccagggcgccggagcaggtccgaacagaggagacggaccatgtccggcgccaacctggcggcagcgcaaaagatg

SEQ ID NO: 148281 - DNA, 103 bp, Artificial Sequence
  Synthetic Polynucleotide
taatacgactcactatagggggggaggtactgcgggcaccagggcgccggaacagaggagaccggcgatgtggtgcccgaacctggcggcagcgcaaaagatg

SEQ ID NO: 148282 - DNA, 103 bp, Artificial Sequence
  Synthetic Polynucleotide
taatacgactcactatagggcgagtcgctgggggaggtactgcgggcaccaacagaggagaggtgccatgagtacctccaacctggcggcagcgcaaaagatg

SEQ ID NO: 148283 - DNA, 103 bp, Artificial Sequence
  Synthetic Polynucleotide
taatacgactcactatagggtgcagggcagcgagtcgctgggggaggtacaacagaggagagtacctatgccagcgactaacctggcggcagcgcaaaagatg

SEQ ID NO: 148284 - DNA, 103 bp, Artificial Sequence
  Synthetic Polynucleotide
taatacgactcactatagggccggccaggctgcagggcagcgagtcgctgaacagaggagacagcgaatggctgccctgaacctggcggcagcgcaaaagatg

SEQ ID NO: 148285 - DNA, 103 bp, Artificial Sequence
  Synthetic Polynucleotide
taatacgactcactataggggggccgcccgcggtgcaccacggcgcccgaaacagaggagatcgggcatggtggtgcacaacctggcggcagcgcaaaagatg

SEQ ID NO: 148286 - DNA, 103 bp, Artificial Sequence
  Synthetic Polynucleotide
taatacgactcactatagggcgcagggctcccggccaggctgcagggcagaacagaggagactgcccatgagcctggccaacctggcggcagcgcaaaagatg

SEQ ID NO: 148287 - DNA, 103 bp, Artificial Sequence
  Synthetic Polynucleotide
taatacgactcactatagggcggggctgggcgcagggctcccggccaggcaacagaggagagcctggatgggagccctgaacctggcggcagcgcaaaagatg

SEQ ID NO: 148288 - DNA, 103 bp, Artificial Sequence
  Synthetic Polynucleotide
taatacgactcactataggggggctgggcgcggggctgggcgcagggctcaacagaggagagagcccatggcccagcccaacctggcggcagcgcaaaagatg

SEQ ID NO: 148289 - DNA, 103 bp, Artificial Sequence
  Synthetic Polynucleotide
taatacgactcactatagggtgcgggggctgggctgggcgcggggctgggaacagaggagacccagcatggcgcccagcaacctggcggcagcgcaaaagatg

SEQ ID NO: 148290 - DNA, 103 bp, Artificial Sequence
  Synthetic Polynucleotide
taatacgactcactatagggcctcggggccgggccgcccgcggtgcaccaaacagaggagatggtgcatggcgggcggcaacctggcggcagcgcaaaagatg

SEQ ID NO: 148291 - DNA, 103 bp, Artificial Sequence
  Synthetic Polynucleotide
taatacgactcactataggggggcccgcgccctcggggccgggccgcccgaacagaggagacgggcgatgcggccccgaaacctggcggcagcgcaaaagatg

SEQ ID NO: 148292 - DNA, 103 bp, Artificial Sequence
  Synthetic Polynucleotide
taatacgactcactatagggttccatctcagcctgcggtcggccgtacataacagaggagaatgtacatgcgaccgcagaacctggcggcagcgcaaaagatg

SEQ ID NO: 148293 - DNA, 103 bp, Artificial Sequence
  Synthetic Polynucleotide
taatacgactcactatagggtgaagacatgttcaagatgggcgctgagttaacagaggagaaactcaatgcccatcttgaacctggcggcagcgcaaaagatg

SEQ ID NO: 148294 - DNA, 103 bp, Artificial Sequence
  Synthetic Polynucleotide
taatacgactcactatagggatatctggtgtgtacccgcatatgtcgtctaacagaggagaagacgaatgatgcgggtaaacctggcggcagcgcaaaagatg

SEQ ID NO: 148295 - DNA, 103 bp, Artificial Sequence
  Synthetic Polynucleotide
taatacgactcactatagggtatatggtcgatatctggtgtgtacccgcaaacagaggagatgcgggatgacaccagataacctggcggcagcgcaaaagatg

SEQ ID NO: 148296 - DNA, 103 bp, Artificial Sequence
  Synthetic Polynucleotide
taatacgactcactatagggtgatcacatttatatggtcgatatctggtgaacagaggagacaccagatgtcgaccataaacctggcggcagcgcaaaagatg

SEQ ID NO: 148297 - DNA, 103 bp, Artificial Sequence
  Synthetic Polynucleotide
taatacgactcactatagggccggctgcactgatcacatttatatggtcgaacagaggagacgaccaatgaaatgtgataacctggcggcagcgcaaaagatg

SEQ ID NO: 148298 - DNA, 103 bp, Artificial Sequence
  Synthetic Polynucleotide
taatacgactcactatagggtcatgaactcccggctgcactgatcacattaacagaggagaaatgtgatgagtgcagccaacctggcggcagcgcaaaagatg

SEQ ID NO: 148299 - DNA, 103 bp, Artificial Sequence
  Synthetic Polynucleotide
taatacgactcactatagggtggtcagacctcatgaactcccggctgcacaacagaggagagtgcagatgggagttcataacctggcggcagcgcaaaagatg

SEQ ID NO: 148300 - DNA, 103 bp, Artificial Sequence
  Synthetic Polynucleotide
taatacgactcactatagggttgcttgagatggtcagacctcatgaactcaacagaggagagagttcatgaggtctgacaacctggcggcagcgcaaaagatg

SEQ ID NO: 148301 - DNA, 103 bp, Artificial Sequence
  Synthetic Polynucleotide
taatacgactcactatagggtcttctggtgttgcttgagatggtcagaccaacagaggagaggtctgatgatctcaagcaacctggcggcagcgcaaaagatg

SEQ ID NO: 148302 - DNA, 103 bp, Artificial Sequence
  Synthetic Polynucleotide
taatacgactcactatagggggccgatgagtcttctggtgttgcttgagaaacagaggagatctcaaatgacaccagaaaacctggcggcagcgcaaaagatg

SEQ ID NO: 148303 - DNA, 103 bp, Artificial Sequence
  Synthetic Polynucleotide
taatacgactcactatagggtgagggtcccggccgatgagtcttctggtgaacagaggagacaccagatgactcatcggaacctggcggcagcgcaaaagatg

SEQ ID NO: 148304 - DNA, 103 bp, Artificial Sequence
  Synthetic Polynucleotide
taatacgactcactatagggttccagaagatgaagacatgttcaagatggaacagaggagaccatctatgacatgtcttaacctggcggcagcgcaaaagatg

SEQ ID NO: 148305 - DNA, 103 bp, Artificial Sequence
  Synthetic Polynucleotide
taatacgactcactatagggcctgtgggtctgagggtcccggccgatgagaacagaggagactcatcatgcgggaccctaacctggcggcagcgcaaaagatg

SEQ ID NO: 148306 - DNA, 103 bp, Artificial Sequence
  Synthetic Polynucleotide
taatacgactcactatagggttgttgttggcctgtgggtctgagggtcccaacagaggagagggaccatgagacccacaaacctggcggcagcgcaaaagatg

SEQ ID NO: 148307 - DNA, 103 bp, Artificial Sequence
  Synthetic Polynucleotide
taatacgactcactatagggctctccattgttgttgttggcctgtgggtcaacagaggagagacccaatggccaacaacaacctggcggcagcgcaaaagatg

SEQ ID NO: 148308 - DNA, 103 bp, Artificial Sequence
  Synthetic Polynucleotide
taatacgactcactataggggactgtcctgctctccattgttgttgttggaacagaggagaccaacaatgacaatggagaacctggcggcagcgcaaaagatg

SEQ ID NO: 148309 - DNA, 103 bp, Artificial Sequence
  Synthetic Polynucleotide
taatacgactcactataggggcagcaggaggactgtcctgctctccattgaacagaggagacaatggatggcaggacagaacctggcggcagcgcaaaagatg

SEQ ID NO: 148310 - DNA, 103 bp, Artificial Sequence
  Synthetic Polynucleotide
taatacgactcactatagggctaaggaccagcagcaggaggactgtcctgaacagaggagacaggacatgcctcctgctaacctggcggcagcgcaaaagatg

SEQ ID NO: 148311 - DNA, 103 bp, Artificial Sequence
  Synthetic Polynucleotide
taatacgactcactatagggactccagagcttccagaagatgaagacatgaacagaggagacatgtcatgatcttctggaacctggcggcagcgcaaaagatg

SEQ ID NO: 148312 - DNA, 103 bp, Artificial Sequence
  Synthetic Polynucleotide
taatacgactcactatagggagaggtgtgcactccagagcttccagaagaaacagaggagatcttctatgagctctggaaacctggcggcagcgcaaaagatg

SEQ ID NO: 148313 - DNA, 103 bp, Artificial Sequence
  Synthetic Polynucleotide
taatacgactcactatagggcttggttccaagaggtgtgcactccagagcaacagaggagagctctgatgtgcacacctaacctggcggcagcgcaaaagatg

SEQ ID NO: 148314 - DNA, 103 bp, Artificial Sequence
  Synthetic Polynucleotide
taatacgactcactatagggcttggtaggccttggttccaagaggtgtgcaacagaggagagcacacatgttggaaccaaacctggcggcagcgcaaaagatg

SEQ ID NO: 148315 - DNA, 103 bp, Artificial Sequence
  Synthetic Polynucleotide
taatacgactcactataggggtgctgaatgcttggtaggccttggttccaaacagaggagatggaacatgggcctaccaaacctggcggcagcgcaaaagatg

SEQ ID NO: 148316 - DNA, 103 bp, Artificial Sequence
  Synthetic Polynucleotide
taatacgactcactatagggtgtgaggaaagtgctgaatgcttggtaggcaacagaggagagcctacatggcattcagcaacctggcggcagcgcaaaagatg

SEQ ID NO: 148317 - DNA, 103 bp, Artificial Sequence
  Synthetic Polynucleotide
taatacgactcactatagggatctctgcgctgtgaggaaagtgctgaatgaacagaggagacattcaatgctttcctcaaacctggcggcagcgcaaaagatg

SEQ ID NO: 148318 - DNA, 103 bp, Artificial Sequence
  Synthetic Polynucleotide
taatacgactcactatagggggaccccagcatctctgcgctgtgaggaaaaacagaggagatttcctatgagcgcagagaacctggcggcagcgcaaaagatg

SEQ ID NO: 148319 - DNA, 103 bp, Artificial Sequence
  Synthetic Polynucleotide
taatacgactcactatagggcagcctcctgttccatctcagcctgcggtcaacagaggagagaccgcatgctgagatggaacctggcggcagcgcaaaagatg

SEQ ID NO: 148320 - DNA, 103 bp, Artificial Sequence
  Synthetic Polynucleotide
taatacgactcactatagggacaccaaaggggaccccagcatctctgcgcaacagaggagagcgcagatgtgctggggtaacctggcggcagcgcaaaagatg

SEQ ID NO: 148321 - DNA, 103 bp, Artificial Sequence
  Synthetic Polynucleotide
taatacgactcactataggggcctcaacagacaccaaaggggaccccagcaacagaggagagctgggatgccctttggtaacctggcggcagcgcaaaagatg

SEQ ID NO: 148322 - DNA, 103 bp, Artificial Sequence
  Synthetic Polynucleotide
taatacgactcactatagggctgccccggcgcctcaacagacaccaaaggaacagaggagacctttgatgtctgttgagaacctggcggcagcgcaaaagatg

SEQ ID NO: 148323 - DNA, 103 bp, Artificial Sequence
  Synthetic Polynucleotide
taatacgactcactatagggcattcacattctgccccggcgcctcaacagaacagaggagactgttgatgcgccggggcaacctggcggcagcgcaaaagatg

SEQ ID NO: 148324 - DNA, 103 bp, Artificial Sequence
  Synthetic Polynucleotide
taatacgactcactatagggggccccccttcattcacattctgccccggcaacagaggagagccgggatggaatgtgaaaacctggcggcagcgcaaaagatg

SEQ ID NO: 148325 - DNA, 103 bp, Artificial Sequence
  Synthetic Polynucleotide
taatacgactcactatagggactgaactgtggccccccttcattcacattaacagaggagaaatgtgatggaaggggggaacctggcggcagcgcaaaagatg

SEQ ID NO: 148326 - DNA, 103 bp, Artificial Sequence
  Synthetic Polynucleotide
taatacgactcactataggggcagtggcatactgaactgtggccccccttaacagaggagaaaggggatgcacagttcaaacctggcggcagcgcaaaagatg

SEQ ID NO: 148327 - DNA, 103 bp, Artificial Sequence
  Synthetic Polynucleotide
taatacgactcactatagggccacgctcaggcagtggcatactgaactgtaacagaggagaacagttatgtatgccactaacctggcggcagcgcaaaagatg

SEQ ID NO: 148328 - DNA, 103 bp, Artificial Sequence
  Synthetic Polynucleotide
taatacgactcactataggggtagctcataccacgctcaggcagtggcataacagaggagaatgccaatgcctgagcgtaacctggcggcagcgcaaaagatg

SEQ ID NO: 148329 - DNA, 103 bp, Artificial Sequence
  Synthetic Polynucleotide
taatacgactcactatagggcttgggggcagtagctcataccacgctcagaacagaggagactgagcatggtatgagctaacctggcggcagcgcaaaagatg

SEQ ID NO: 148330 - DNA, 103 bp, Artificial Sequence
  Synthetic Polynucleotide
taatacgactcactatagggctcagctccccagcctcctgttccatctcaaacagaggagatgagatatgacaggaggcaacctggcggcagcgcaaaagatg

SEQ ID NO: 148331 - DNA, 103 bp, Artificial Sequence
  Synthetic Polynucleotide
taatacgactcactataggggtgagagtcgcttgggggcagtagctcataaacagaggagatatgagatgctgcccccaaacctggcggcagcgcaaaagatg

SEQ ID NO: 148332 - DNA, 103 bp, Artificial Sequence
  Synthetic Polynucleotide
taatacgactcactatagggccgggaaggagtgagagtcgcttgggggcaaacagaggagatgccccatggcgactctcaacctggcggcagcgcaaaagatg

SEQ ID NO: 148333 - DNA, 103 bp, Artificial Sequence
  Synthetic Polynucleotide
taatacgactcactatagggagtaaatcatccgggaaggagtgagagtcgaacagaggagacgactcatgctccttcccaacctggcggcagcgcaaaagatg

SEQ ID NO: 148334 - DNA, 103 bp, Artificial Sequence
  Synthetic Polynucleotide
taatacgactcactatagggattctctgacagtaaatcatccgggaaggaaacagaggagatccttcatggatgatttaaacctggcggcagcgcaaaagatg

SEQ ID NO: 148335 - DNA, 103 bp, Artificial Sequence
  Synthetic Polynucleotide
taatacgactcactatagggagggggagacattctctgacagtaaatcataacagaggagaatgattatgtgtcagagaaacctggcggcagcgcaaaagatg

SEQ ID NO: 148336 - DNA, 103 bp, Artificial Sequence
  Synthetic Polynucleotide
taatacgactcactatagggtctcttgctgagggggagacattctctgacaacagaggagagtcagaatgtgtctccccaacctggcggcagcgcaaaagatg

SEQ ID NO: 148337 - DNA, 103 bp, Artificial Sequence
  Synthetic Polynucleotide
taatacgactcactatagggaaaatcgtcatctcttgctgagggggagacaacagaggagagtctccatgtcagcaagaaacctggcggcagcgcaaaagatg

SEQ ID NO: 148338 - DNA, 103 bp, Artificial Sequence
  Synthetic Polynucleotide
taatacgactcactataggggggcccactgaaaatcgtcatctcttgctgaacagaggagacagcaaatgatgacgattaacctggcggcagcgcaaaagatg

SEQ ID NO: 148339 - DNA, 103 bp, Artificial Sequence
  Synthetic Polynucleotide
taatacgactcactataggggcattagttggggcccactgaaaatcgtcaaacagaggagatgacgaatgtcagtgggcaacctggcggcagcgcaaaagatg

SEQ ID NO: 148340 - DNA, 103 bp, Artificial Sequence
  Synthetic Polynucleotide
taatacgactcactatagggtctcctacgggcattagttggggcccactgaacagaggagacagtggatgccaactaataacctggcggcagcgcaaaagatg

SEQ ID NO: 148341 - DNA, 103 bp, Artificial Sequence
  Synthetic Polynucleotide
taatacgactcactatagggctgccaccggctcagctccccagcctcctgaacagaggagacaggagatgggggagctgaacctggcggcagcgcaaaagatg

SEQ ID NO: 148342 - DNA, 103 bp, Artificial Sequence
  Synthetic Polynucleotide
taatacgactcactatagggaatattgggctctcctacgggcattagttgaacagaggagacaactaatgcccgtaggaaacctggcggcagcgcaaaagatg

SEQ ID NO: 148343 - DNA, 103 bp, Artificial Sequence
  Synthetic Polynucleotide
taatacgactcactatagggctacccttggaatattgggctctcctacggaacagaggagaccgtagatgagcccaataaacctggcggcagcgcaaaagatg

SEQ ID NO: 148344 - DNA, 103 bp, Artificial Sequence
  Synthetic Polynucleotide
taatacgactcactatagggaagggcctggctacccttggaatattgggcaacagaggagagcccaaatgtccaagggtaacctggcggcagcgcaaaagatg

SEQ ID NO: 148345 - DNA, 103 bp, Artificial Sequence
  Synthetic Polynucleotide
taatacgactcactatagggattcccaccgaagggcctggctacccttggaacagaggagaccaaggatggccaggcccaacctggcggcagcgcaaaagatg

SEQ ID NO: 148346 - DNA, 103 bp, Artificial Sequence
  Synthetic Polynucleotide
taatacgactcactataggggcatccttagattcccaccgaagggcctggaacagaggagaccaggcatgtcggtgggaaacctggcggcagcgcaaaagatg

SEQ ID NO: 148347 - DNA, 103 bp, Artificial Sequence
  Synthetic Polynucleotide
taatacgactcactatagggccattggggggcatccttagattcccaccgaacagaggagacggtggatgtctaaggataacctggcggcagcgcaaaagatg

SEQ ID NO: 148348 - DNA, 103 bp, Artificial Sequence
  Synthetic Polynucleotide
taatacgactcactataggggactggcagcccattggggggcatccttagaacagaggagactaaggatgccccccaataacctggcggcagcgcaaaagatg

SEQ ID NO: 148349 - DNA, 103 bp, Artificial Sequence
  Synthetic Polynucleotide
taatacgactcactatagggtggaagccgagactggcagcccattgggggaacagaggagacccccaatgggctgccagaacctggcggcagcgcaaaagatg

SEQ ID NO: 148350 - DNA, 103 bp, Artificial Sequence
  Synthetic Polynucleotide
taatacgactcactataggggggattccagtggaagccgagactggcagcaacagaggagagctgccatgctcggcttcaacctggcggcagcgcaaaagatg

SEQ ID NO: 148351 - DNA, 103 bp, Artificial Sequence
  Synthetic Polynucleotide
taatacgactcactatagggggacattattgggattccagtggaagccgaaacagaggagatcggctatgactggaatcaacctggcggcagcgcaaaagatg

SEQ ID NO: 148352 - DNA, 103 bp, Artificial Sequence
  Synthetic Polynucleotide
taatacgactcactatagggggtgcgccgcctgccaccggctcagctcccaacagaggagagggagcatggccggtggcaacctggcggcagcgcaaaagatg

SEQ ID NO: 148353 - DNA, 103 bp, Artificial Sequence
  Synthetic Polynucleotide
taatacgactcactatagggtcccagtgtgggacattattgggattccagaacagaggagactggaaatgcaataatgtaacctggcggcagcgcaaaagatg

SEQ ID NO: 148354 - DNA, 103 bp, Artificial Sequence
  Synthetic Polynucleotide
taatacgactcactatagggactggagggttcccagtgtgggacattattaacagaggagaaataatatgccacactggaacctggcggcagcgcaaaagatg

SEQ ID NO: 148355 - DNA, 103 bp, Artificial Sequence
  Synthetic Polynucleotide
taatacgactcactatagggagggtaaggcactggagggttcccagtgtgaacagaggagacacactatgaaccctccaaacctggcggcagcgcaaaagatg

SEQ ID NO: 148356 - DNA, 103 bp, Artificial Sequence
  Synthetic Polynucleotide
taatacgactcactatagggtcgagaggccagggtaaggcactggagggtaacagaggagaaccctcatgtgccttaccaacctggcggcagcgcaaaagatg

SEQ ID NO: 148357 - DNA, 103 bp, Artificial Sequence
  Synthetic Polynucleotide
taatacgactcactataggggaaggtactgtcgagaggccagggtaaggcaacagaggagagccttaatgtggcctctcaacctggcggcagcgcaaaagatg

SEQ ID NO: 148358 - DNA, 103 bp, Artificial Sequence
  Synthetic Polynucleotide
taatacgactcactatagggtgtttcgtcagaaggtactgtcgagaggccaacagaggagaggcctcatgacagtacctaacctggcggcagcgcaaaagatg

SEQ ID NO: 148359 - DNA, 103 bp, Artificial Sequence
  Synthetic Polynucleotide
taatacgactcactatagggggcccaacaatgtttcgtcagaaggtactgaacagaggagacagtacatgctgacgaaaaacctggcggcagcgcaaaagatg

SEQ ID NO: 148360 - DNA, 103 bp, Artificial Sequence
  Synthetic Polynucleotide
taatacgactcactatagggggcacagtcgggcccaacaatgtttcgtcaaacagaggagatgacgaatgattgttgggaacctggcggcagcgcaaaagatg

SEQ ID NO: 148361 - DNA, 103 bp, Artificial Sequence
  Synthetic Polynucleotide
taatacgactcactatagggctcagtggaaggcacagtcgggcccaacaaaacagaggagattgttgatgccgactgtgaacctggcggcagcgcaaaagatg

SEQ ID NO: 148362 - DNA, 103 bp, Artificial Sequence
  Synthetic Polynucleotide
taatacgactcactatagggctgcctgggcctcagtggaaggcacagtcgaacagaggagacgactgatgcttccactgaacctggcggcagcgcaaaagatg

SEQ ID NO: 148363 - DNA, 103 bp, Artificial Sequence
  Synthetic Polynucleotide
taatacgactcactatagggtgggcagcctggtgcgccgcctgccaccggaacagaggagaccggtgatgggcggcgcaaacctggcggcagcgcaaaagatg

SEQ ID NO: 148364 - DNA, 103 bp, Artificial Sequence
  Synthetic Polynucleotide
taatacgactcactataggggaggggagcactgcctgggcctcagtggaaaacagaggagattccacatgggcccaggcaacctggcggcagcgcaaaagatg

SEQ ID NO: 148365 - DNA, 103 bp, Artificial Sequence
  Synthetic Polynucleotide
taatacgactcactatagggctgagccatggaggggagcactgcctgggcaacagaggagagcccagatggtgctccccaacctggcggcagcgcaaaagatg

SEQ ID NO: 148366 - DNA, 103 bp, Artificial Sequence
  Synthetic Polynucleotide
taatacgactcactatagggggggcaacatctgagccatggaggggagcaaacagaggagatgctccatgccatggctcaacctggcggcagcgcaaaagatg

SEQ ID NO: 148367 - DNA, 103 bp, Artificial Sequence
  Synthetic Polynucleotide
taatacgactcactataggggcatcttgcgggggcaacatctgagccatgaacagaggagacatggcatggatgttgccaacctggcggcagcgcaaaagatg

SEQ ID NO: 148368 - DNA, 103 bp, Artificial Sequence
  Synthetic Polynucleotide
taatacgactcactatagggaaggtcatgggcatcttgcgggggcaacataacagaggagaatgttgatgccgcaagataacctggcggcagcgcaaaagatg

SEQ ID NO: 148369 - DNA, 103 bp, Artificial Sequence
  Synthetic Polynucleotide
taatacgactcactatagggggggcatcccaaggtcatgggcatcttgcgaacagaggagacgcaagatgcccatgaccaacctggcggcagcgcaaaagatg

SEQ ID NO: 148370 - DNA, 103 bp, Artificial Sequence
  Synthetic Polynucleotide
taatacgactcactataggggactcagctgggggcatcccaaggtcatggaacagaggagaccatgaatgtgggatgccaacctggcggcagcgcaaaagatg

SEQ ID NO: 148371 - DNA, 103 bp, Artificial Sequence
  Synthetic Polynucleotide
taatacgactcactatagggcaatgactgggactcagctgggggcatcccaacagaggagagggatgatgccagctgagaacctggcggcagcgcaaaagatg

SEQ ID NO: 148372 - DNA, 103 bp, Artificial Sequence
  Synthetic Polynucleotide
taatacgactcactatagggctaaaaccagcaatgactgggactcagctgaacagaggagacagctgatgcccagtcataacctggcggcagcgcaaaagatg

SEQ ID NO: 148373 - DNA, 103 bp, Artificial Sequence
  Synthetic Polynucleotide
taatacgactcactatagggtcctgagatcctaaaaccagcaatgactggaacagaggagaccagtcatggctggttttaacctggcggcagcgcaaaagatg

SEQ ID NO: 148374 - DNA, 103 bp, Artificial Sequence
  Synthetic Polynucleotide
taatacgactcactatagggctcgttatcctgggcagcctggtgcgccgcaacagaggagagcggcgatgcaggctgccaacctggcggcagcgcaaaagatg

SEQ ID NO: 148375 - DNA, 103 bp, Artificial Sequence
  Synthetic Polynucleotide
taatacgactcactataggggacaagagagtcctgagatcctaaaaccagaacagaggagactggttatgggatctcagaacctggcggcagcgcaaaagatg

SEQ ID NO: 148376 - DNA, 103 bp, Artificial Sequence
  Synthetic Polynucleotide
taatacgactcactatagggctggctgactgacaagagagtcctgagatcaacagaggagagatctcatgactctcttgaacctggcggcagcgcaaaagatg

SEQ ID NO: 148377 - DNA, 103 bp, Artificial Sequence
  Synthetic Polynucleotide
taatacgactcactatagggtcttgagagtctggctgactgacaagagagaacagaggagactctctatgcagtcagccaacctggcggcagcgcaaaagatg

SEQ ID NO: 148378 - DNA, 103 bp, Artificial Sequence
  Synthetic Polynucleotide
taatacgactcactatagggaaatgggccttcttgagagtctggctgactaacagaggagaagtcagatggactctcaaaacctggcggcagcgcaaaagatg

SEQ ID NO: 148379 - DNA, 103 bp, Artificial Sequence
  Synthetic Polynucleotide
taatacgactcactataggggctctggtagaaatgggccttcttgagagtaacagaggagaactctcatgaaggcccataacctggcggcagcgcaaaagatg

SEQ ID NO: 148380 - DNA, 103 bp, Artificial Sequence
  Synthetic Polynucleotide
taatacgactcactatagggggtccgggctgctctggtagaaatgggcctaacagaggagaaggcccatgtctaccagaaacctggcggcagcgcaaaagatg

SEQ ID NO: 148381 - DNA, 103 bp, Artificial Sequence
  Synthetic Polynucleotide
taatacgactcactatagggctgtggagcaggtccgggctgctctggtagaacagaggagactaccaatgcagcccggaaacctggcggcagcgcaaaagatg

SEQ ID NO: 148382 - DNA, 103 bp, Artificial Sequence
  Synthetic Polynucleotide
taatacgactcactatagggtctctactgtctgtggagcaggtccgggctaacagaggagaagcccgatgctgctccacaacctggcggcagcgcaaaagatg

SEQ ID NO: 148383 - DNA, 103 bp, Artificial Sequence
  Synthetic Polynucleotide
taatacgactcactatagggctggagttcttctctactgtctgtggagcaaacagaggagatgctccatggacagtagaaacctggcggcagcgcaaaagatg

SEQ ID NO: 148384 - DNA, 103 bp, Artificial Sequence
  Synthetic Polynucleotide
taatacgactcactatagggttcctgaggcctggagttcttctctactgtaacagaggagaacagtaatgaagaactccaacctggcggcagcgcaaaagatg

SEQ ID NO: 148385 - DNA, 103 bp, Artificial Sequence
  Synthetic Polynucleotide
taatacgactcactataggggcgctgagttctcgttatcctgggcagcctaacagaggagaaggctgatgaggataacgaacctggcggcagcgcaaaagatg

SEQ ID NO: 148386 - DNA, 103 bp, Artificial Sequence
  Synthetic Polynucleotide
taatacgactcactatagggtaccagtcccttcctgaggcctggagttctaacagaggagaagaactatgggcctcaggaacctggcggcagcgcaaaagatg

SEQ ID NO: 148387 - DNA, 103 bp, Artificial Sequence
  Synthetic Polynucleotide
taatacgactcactataggggagccccttctaccagtcccttcctgaggcaacagaggagagcctcaatgagggactggaacctggcggcagcgcaaaagatg

SEQ ID NO: 148388 - DNA, 103 bp, Artificial Sequence
  Synthetic Polynucleotide
taatacgactcactatagggtgcctctgaggagccccttctaccagtcccaacagaggagagggactatgagaaggggcaacctggcggcagcgcaaaagatg

SEQ ID NO: 148389 - DNA, 103 bp, Artificial Sequence
  Synthetic Polynucleotide
taatacgactcactatagggagtaaggccttgcctctgaggagccccttcaacagaggagagaagggatgcctcagaggaacctggcggcagcgcaaaagatg

SEQ ID NO: 148390 - DNA, 103 bp, Artificial Sequence
  Synthetic Polynucleotide
taatacgactcactatagggtagttgcagcagtaaggccttgcctctgagaacagaggagactcagaatgaaggccttaaacctggcggcagcgcaaaagatg

SEQ ID NO: 148391 - DNA, 103 bp, Artificial Sequence
  Synthetic Polynucleotide
taatacgactcactataggggcagttctcgtagttgcagcagtaaggcctaacagaggagaaggcctatgtgctgcaacaacctggcggcagcgcaaaagatg

SEQ ID NO: 148392 - DNA, 103 bp, Artificial Sequence
  Synthetic Polynucleotide
taatacgactcactatagggaagcttttccgcagttctcgtagttgcagcaacagaggagagctgcaatgacgagaactaacctggcggcagcgcaaaagatg

SEQ ID NO: 148393 - DNA, 103 bp, Artificial Sequence
  Synthetic Polynucleotide
taatacgactcactatagggcgtttggtataagcttttccgcagttctcgaacagaggagacgagaaatgcggaaaagcaacctggcggcagcgcaaaagatg

SEQ ID NO: 148394 - DNA, 103 bp, Artificial Sequence
  Synthetic Polynucleotide
taatacgactcactataggggaggtgggagcgtttggtataagcttttccaacagaggagaggaaaaatgtataccaaaaacctggcggcagcgcaaaagatg

SEQ ID NO: 148395 - DNA, 103 bp, Artificial Sequence
  Synthetic Polynucleotide
taatacgactcactatagggggtggctcacgaggtgggagcgtttggtataacagaggagaataccaatggctcccaccaacctggcggcagcgcaaaagatg

SEQ ID NO: 148396 - DNA, 103 bp, Artificial Sequence
  Synthetic Polynucleotide
taatacgactcactatagggttcaagatgggcgctgagttctcgttatccaacagaggagaggataaatggaactcagcaacctggcggcagcgcaaaagatg

SEQ ID NO: 148397 - DNA, 103 bp, Artificial Sequence
  Synthetic Polynucleotide
taatacgactcactatagggtgcttgcgctggtggctcacgaggtgggagaacagaggagactcccaatgcgtgagccaaacctggcggcagcgcaaaagatg

SEQ ID NO: 148398 - DNA, 103 bp, Artificial Sequence
  Synthetic Polynucleotide
taatacgactcactatagggctcacctgtgtgcttgcgctggtggctcacaacagaggagagtgagcatgcagcgcaagaacctggcggcagcgcaaaagatg

SEQ ID NO: 148399 - DNA, 103 bp, Artificial Sequence
  Synthetic Polynucleotide
taatacgactcactatagggaatatggcctctcacctgtgtgcttgcgctaacagaggagaagcgcaatgacacaggtgaacctggcggcagcgcaaaagatg

SEQ ID NO: 148400 - DNA, 103 bp, Artificial Sequence
  Synthetic Polynucleotide
taatacgactcactatagggcagttgcaagaatatggcctctcacctgtgaacagaggagacacaggatggaggccataaacctggcggcagcgcaaaagatg

SEQ ID NO: 148401 - DNA, 103 bp, Artificial Sequence
  Synthetic Polynucleotide
taatacgactcactatagggacaactttcccagttgcaagaatatggcctaacagaggagaaggccaatgtcttgcaacaacctggcggcagcgcaaaagatg

SEQ ID NO: 148402 - DNA, 103 bp, Artificial Sequence
  Synthetic Polynucleotide
taatacgactcactatagggaagaccatgaacaactttcccagttgcaagaacagaggagacttgcaatggggaaagttaacctggcggcagcgcaaaagatg

SEQ ID NO: 148403 - DNA, 103 bp, Artificial Sequence
  Synthetic Polynucleotide
taatacgactcactataggggaacggaagaaagaccatgaacaactttccaacagaggagaggaaagatgttcatggtcaacctggcggcagcgcaaaagatg

SEQ ID NO: 148404 - DNA, 103 bp, Artificial Sequence
  Synthetic Polynucleotide
taatacgactcactatagggaagctcatcagaacggaagaaagaccatgaaacagaggagatcatggatgttcttccgtaacctggcggcagcgcaaaagatg

SEQ ID NO: 148405 - DNA, 103 bp, Artificial Sequence
  Synthetic Polynucleotide
taatacgactcactatagggtatgtcgtctaagctcatcagaacggaagaaacagaggagatcttccatgctgatgagcaacctggcggcagcgcaaaagatg

SEQ ID NO: 148406 - DNA, 103 bp, Artificial Sequence
  Synthetic Polynucleotide
taatacgactcactatagggtgtacccgcatatgtcgtctaagctcatcaaacagaggagatgatgaatgtagacgacaaacctggcggcagcgcaaaagatg

SEQ ID NO: 148407 - DNA, 103 bp, Artificial Sequence
  Synthetic Polynucleotide
taatacgactcactatagggcttgacaggaactgggtcaaacatgagcataacagaggagaatgctcatgtttgacccaaacctggcggcagcgcaaaagatg

SEQ ID NO: 148408 - DNA, 103 bp, Artificial Sequence
  Synthetic Polynucleotide
taatacgactcactatagggtgtggagtagatgaccccatacttgttaggaacagaggagacctaacatgtatggggtcaacctggcggcagcgcaaaagatg

SEQ ID NO: 148409 - DNA, 103 bp, Artificial Sequence
  Synthetic Polynucleotide
taatacgactcactatagggtttcctatggagggcaagatggtcagaacgaacagaggagacgttctatgcatcttgccaacctggcggcagcgcaaaagatg

SEQ ID NO: 148410 - DNA, 103 bp, Artificial Sequence
  Synthetic Polynucleotide
taatacgactcactataggggcatgtggcgtttcctatggagggcaagataacagaggagaatcttgatgtccataggaaacctggcggcagcgcaaaagatg

SEQ ID NO: 148411 - DNA, 103 bp, Artificial Sequence
  Synthetic Polynucleotide
taatacgactcactatagggcaggcaatggtgtggagtagatgaccccataacagaggagaatggggatgtctactccaaacctggcggcagcgcaaaagatg

SEQ ID NO: 148412 - DNA, 103 bp, Artificial Sequence
  Synthetic Polynucleotide
taatacgactcactatagggaagaacttctcaggcaatggtgtggagtagaacagaggagactactcatgaccattgccaacctggcggcagcgcaaaagatg

SEQ ID NO: 148413 - DNA, 103 bp, Artificial Sequence
  Synthetic Polynucleotide
taatacgactcactatagggtggggtctgaaagaacttctcaggcaatggaacagaggagaccattgatggagaagttcaacctggcggcagcgcaaaagatg

SEQ ID NO: 148414 - DNA, 103 bp, Artificial Sequence
  Synthetic Polynucleotide
taatacgactcactatagggacagaccttctggggtctgaaagaacttctaacagaggagaagaagtatgttcagacccaacctggcggcagcgcaaaagatg

SEQ ID NO: 148415 - DNA, 103 bp, Artificial Sequence
  Synthetic Polynucleotide
taatacgactcactatagggattccgtgcgacagaccttctggggtctgaaacagaggagatcagacatgagaaggtctaacctggcggcagcgcaaaagatg

SEQ ID NO: 148416 - DNA, 103 bp, Artificial Sequence
  Synthetic Polynucleotide
taatacgactcactatagggctccatctgtattccgtgcgacagaccttcaacagaggagagaaggtatgtcgcacggaaacctggcggcagcgcaaaagatg

SEQ ID NO: 148417 - DNA, 103 bp, Artificial Sequence
  Synthetic Polynucleotide
taatacgactcactatagggggtccactggctccatctgtattccgtgcgaacagaggagacgcacgatgtacagatggaacctggcggcagcgcaaaagatg

SEQ ID NO: 148418 - DNA, 103 bp, Artificial Sequence
  Synthetic Polynucleotide
taatacgactcactatagggttcaccgtgaggtccactggctccatctgtaacagaggagaacagatatggccagtggaaacctggcggcagcgcaaaagatg

SEQ ID NO: 148419 - DNA, 103 bp, Artificial Sequence
  Synthetic Polynucleotide
taatacgactcactatagggactccgcttgttcaccgtgaggtccactggaacagaggagaccagtgatgctcacggtgaacctggcggcagcgcaaaagatg

SEQ ID NO: 148420 - DNA, 103 bp, Artificial Sequence
  Synthetic Polynucleotide
taatacgactcactatagggtggcctcttgcttgacaggaactgggtcaaaacagaggagattgaccatgttcctgtcaaacctggcggcagcgcaaaagatg

SEQ ID NO: 148421 - DNA, 103 bp, Artificial Sequence
  Synthetic Polynucleotide
taatacgactcactatagggaagggggtgaactccgcttgttcaccgtgaaacagaggagatcacggatgacaagcggaaacctggcggcagcgcaaaagatg

SEQ ID NO: 148422 - DNA, 103 bp, Artificial Sequence
  Synthetic Polynucleotide
taatacgactcactatagggttcccagccgaagggggtgaactccgcttgaacagaggagacaagcgatgttcacccccaacctggcggcagcgcaaaagatg

SEQ ID NO: 148423 - DNA, 103 bp, Artificial Sequence
  Synthetic Polynucleotide
taatacgactcactatagggggagggcgaattcccagccgaagggggtgaaacagaggagatcacccatgtcggctgggaacctggcggcagcgcaaaagatg

SEQ ID NO: 148424 - DNA, 103 bp, Artificial Sequence
  Synthetic Polynucleotide
taatacgactcactatagggacttcagagaggagggcgaattcccagccgaacagaggagacggctgatgattcgccctaacctggcggcagcgcaaaagatg

SEQ ID NO: 148425 - DNA, 103 bp, Artificial Sequence
  Synthetic Polynucleotide
taatacgactcactataggggaggacgggaacttcagagaggagggcgaaaacagaggagattcgccatgctctctgaaaacctggcggcagcgcaaaagatg

SEQ ID NO: 148426 - DNA, 103 bp, Artificial Sequence
  Synthetic Polynucleotide
taatacgactcactatagggtctccggtgtgaggacgggaacttcagagaaacagaggagatctctgatgttcccgtccaacctggcggcagcgcaaaagatg

SEQ ID NO: 148427 - DNA, 103 bp, Artificial Sequence
  Synthetic Polynucleotide
taatacgactcactatagggcaggcgaggctctccggtgtgaggacgggaaacagaggagatcccgtatgcacaccggaaacctggcggcagcgcaaaagatg

SEQ ID NO: 148428 - DNA, 103 bp, Artificial Sequence
  Synthetic Polynucleotide
taatacgactcactatagggatgctcaacccaggcgaggctctccggtgtaacagaggagaacaccgatgagcctcgccaacctggcggcagcgcaaaagatg

SEQ ID NO: 148429 - DNA, 103 bp, Artificial Sequence
  Synthetic Polynucleotide
taatacgactcactatagggggaagaaggcatgctcaacccaggcgaggcaacagaggagagcctcgatggggttgagcaacctggcggcagcgcaaaagatg

SEQ ID NO: 148430 - DNA, 103 bp, Artificial Sequence
  Synthetic Polynucleotide
taatacgactcactatagggtcggtgggctggaagaaggcatgctcaaccaacagaggagaggttgaatgtgccttcttaacctggcggcagcgcaaaagatg

SEQ ID NO: 148431 - DNA, 103 bp, Artificial Sequence
  Synthetic Polynucleotide
taatacgactcactatagggacagggtccatggcctcttgcttgacaggaaacagaggagatcctgtatggcaagaggcaacctggcggcagcgcaaaagatg

SEQ ID NO: 148432 - DNA, 103 bp, Artificial Sequence
  Synthetic Polynucleotide
taatacgactcactatagggtatttttttatcggtgggctggaagaaggcaacagaggagagccttcatgcagcccaccaacctggcggcagcgcaaaagatg

SEQ ID NO: 148433 - DNA, 103 bp, Artificial Sequence
  Synthetic Polynucleotide
taatacgactcactatagggagggggtgagtatttttttatcggtgggctaacagaggagaagcccaatgataaaaaaaaacctggcggcagcgcaaaagatg

SEQ ID NO: 148434 - DNA, 103 bp, Artificial Sequence
  Synthetic Polynucleotide
taatacgactcactatagggcgcctggagaagggggtgagtatttttttaaacagaggagataaaaaatgactcaccccaacctggcggcagcgcaaaagatg

SEQ ID NO: 148435 - DNA, 103 bp, Artificial Sequence
  Synthetic Polynucleotide
taatacgactcactatagggaagggctgcacgcctggagaagggggtgagaacagaggagactcaccatgttctccaggaacctggcggcagcgcaaaagatg

SEQ ID NO: 148436 - DNA, 103 bp, Artificial Sequence
  Synthetic Polynucleotide
taatacgactcactatagggcggcacgccgaagggctgcacgcctggagaaacagaggagatctccaatggtgcagcccaacctggcggcagcgcaaaagatg

SEQ ID NO: 148437 - DNA, 103 bp, Artificial Sequence
  Synthetic Polynucleotide
taatacgactcactataggggcatggacagcggcacgccgaagggctgcaaacagaggagatgcagcatgtcggcgtgcaacctggcggcagcgcaaaagatg

SEQ ID NO: 148438 - DNA, 103 bp, Artificial Sequence
  Synthetic Polynucleotide
taatacgactcactatagggatcactggtggcatggacagcggcacgccgaacagaggagacggcgtatggctgtccataacctggcggcagcgcaaaagatg

SEQ ID NO: 148439 - DNA, 103 bp, Artificial Sequence
  Synthetic Polynucleotide
taatacgactcactatagggggcagctgccatcactggtggcatggacagaacagaggagactgtccatgccaccagtgaacctggcggcagcgcaaaagatg

SEQ ID NO: 148440 - DNA, 103 bp, Artificial Sequence
  Synthetic Polynucleotide
taatacgactcactataggggccgcgagagggcagctgccatcactggtgaacagaggagacaccagatgtggcagctgaacctggcggcagcgcaaaagatg

SEQ ID NO: 148441 - DNA, 103 bp, Artificial Sequence
  Synthetic Polynucleotide
taatacgactcactatagggcgtattccatgccgcgagagggcagctgccaacagaggagaggcagcatgcctctcgcgaacctggcggcagcgcaaaagatg

SEQ ID NO: 148442 - DNA, 103 bp, Artificial Sequence
  Synthetic Polynucleotide
taatacgactcactatagggtgacactgagacagggtccatggcctcttgaacagaggagacaagagatgatggaccctaacctggcggcagcgcaaaagatg

SEQ ID NO: 148443 - DNA, 103 bp, Artificial Sequence
  Synthetic Polynucleotide
taatacgactcactatagggccccgggctccgtattccatgccgcgagagaacagaggagactctcgatgcatggaataaacctggcggcagcgcaaaagatg

SEQ ID NO: 148444 - DNA, 103 bp, Artificial Sequence
  Synthetic Polynucleotide
taatacgactcactatagggcgggcaggatccccgggctccgtattccataacagaggagaatggaaatgggagcccggaacctggcggcagcgcaaaagatg

SEQ ID NO: 148445 - DNA, 103 bp, Artificial Sequence
  Synthetic Polynucleotide
taatacgactcactatagggggctggatgacgggcaggatccccgggctcaacagaggagagagcccatggatcctgccaacctggcggcagcgcaaaagatg

SEQ ID NO: 148446 - DNA, 103 bp, Artificial Sequence
  Synthetic Polynucleotide
taatacgactcactatagggcaccaccaccggctggatgacgggcaggataacagaggagaatcctgatggtcatccagaacctggcggcagcgcaaaagatg

SEQ ID NO: 148447 - DNA, 103 bp, Artificial Sequence
  Synthetic Polynucleotide
taatacgactcactatagggggacgggctgcaccaccaccggctggatgaaacagaggagatcatccatgcggtggtggaacctggcggcagcgcaaaagatg

SEQ ID NO: 148448 - DNA, 103 bp, Artificial Sequence
  Synthetic Polynucleotide
taatacgactcactatagggtacataaaggggacgggctgcaccaccaccaacagaggagaggtggtatggcagcccgtaacctggcggcagcgcaaaagatg

SEQ ID NO: 148449 - DNA, 103 bp, Artificial Sequence
  Synthetic Polynucleotide
taatacgactcactataggggtgacttgtgtacataaaggggacgggctgaacagaggagacagcccatgccctttatgaacctggcggcagcgcaaaagatg

SEQ ID NO: 148450 - DNA, 103 bp, Artificial Sequence
  Synthetic Polynucleotide
taatacgactcactataggggctgctggaggtgacttgtgtacataaaggaacagaggagacctttaatgacacaagtcaacctggcggcagcgcaaaagatg

SEQ ID NO: 148451 - DNA, 103 bp, Artificial Sequence
  Synthetic Polynucleotide
taatacgactcactatagggaccatgagaggctgctggaggtgacttgtgaacagaggagacacaagatgcctccagcaaacctggcggcagcgcaaaagatg

SEQ ID NO: 148452 - DNA, 103 bp, Artificial Sequence
  Synthetic Polynucleotide
taatacgactcactatagggcgataaggagaccatgagaggctgctggagaacagaggagactccagatgcctctcatgaacctggcggcagcgcaaaagatg

SEQ ID NO: 148453 - DNA, 103 bp, Artificial Sequence
  Synthetic Polynucleotide
taatacgactcactatagggtagatgggtatgacactgagacagggtccaaacagaggagatggaccatgtctcagtgtaacctggcggcagcgcaaaagatg

SEQ ID NO: 148454 - DNA, 103 bp, Artificial Sequence
  Synthetic Polynucleotide
taatacgactcactatagggccatctcctccgataaggagaccatgagagaacagaggagactctcaatgtctccttataacctggcggcagcgcaaaagatg

SEQ ID NO: 148455 - DNA, 103 bp, Artificial Sequence
  Synthetic Polynucleotide
taatacgactcactatagggctggaattttccatctcctccgataaggagaacagaggagactccttatgggaggagataacctggcggcagcgcaaaagatg

SEQ ID NO: 148456 - DNA, 103 bp, Artificial Sequence
  Synthetic Polynucleotide
taatacgactcactatagggcatgctactactggaattttccatctcctcaacagaggagagaggagatggaaaattccaacctggcggcagcgcaaaagatg

SEQ ID NO: 148457 - DNA, 103 bp, Artificial Sequence
  Synthetic Polynucleotide
taatacgactcactatagggcaggtacttgcatgctactactggaattttaacagaggagaaaaattatggtagtagcaaacctggcggcagcgcaaaagatg

SEQ ID NO: 148458 - DNA, 103 bp, Artificial Sequence
  Synthetic Polynucleotide
taatacgactcactataggggattcaattacaggtacttgcatgctactaaacagaggagatagtagatggcaagtaccaacctggcggcagcgcaaaagatg

SEQ ID NO: 148459 - DNA, 103 bp, Artificial Sequence
  Synthetic Polynucleotide
taatacgactcactatagggcttctcatatgattcaattacaggtacttgaacagaggagacaagtaatggtaattgaaaacctggcggcagcgcaaaagatg

SEQ ID NO: 148460 - DNA, 103 bp, Artificial Sequence
  Synthetic Polynucleotide
taatacgactcactataggggtgatataggcttctcatatgattcaattaaacagaggagataattgatgcatatgagaaacctggcggcagcgcaaaagatg

SEQ ID NO: 148461 - DNA, 103 bp, Artificial Sequence
  Synthetic Polynucleotide
taatacgactcactatagggatttttttctgtgatataggcttctcatataacagaggagaatatgaatggcctatatcaacctggcggcagcgcaaaagatg

SEQ ID NO: 148462 - DNA, 103 bp, Artificial Sequence
  Synthetic Polynucleotide
taatacgactcactatagggttctattttaatttttttctgtgatataggaacagaggagacctataatgcagaaaaaaaacctggcggcagcgcaaaagatg

SEQ ID NO: 148463 - DNA, 103 bp, Artificial Sequence
  Synthetic Polynucleotide
taatacgactcactatagggcgatcccaggttctattttaatttttttctaacagaggagaagaaaaatgttaaaatagaacctggcggcagcgcaaaagatg

SEQ ID NO: 148464 - DNA, 103 bp, Artificial Sequence
  Synthetic Polynucleotide
taatacgactcactatagggtccatgtaattagatgggtatgacactgagaacagaggagactcagtatgatacccatcaacctggcggcagcgcaaaagatg

SEQ ID NO: 148465 - DNA, 103 bp, Artificial Sequence
  Synthetic Polynucleotide
taatacgactcactatagggctctgtggttcgatcccaggttctattttaaacagaggagataaaatatgacctgggataacctggcggcagcgcaaaagatg

SEQ ID NO: 148466 - DNA, 103 bp, Artificial Sequence
  Synthetic Polynucleotide
taatacgactcactatagggataatctgtcctctgtggttcgatcccaggaacagaggagacctgggatggaaccacagaacctggcggcagcgcaaaagatg

SEQ ID NO: 148467 - DNA, 103 bp, Artificial Sequence
  Synthetic Polynucleotide
taatacgactcactatagggcttcaggataataatctgtcctctgtggttaacagaggagaaaccacatgggacagattaacctggcggcagcgcaaaagatg

SEQ ID NO: 148468 - DNA, 103 bp, Artificial Sequence
  Synthetic Polynucleotide
taatacgactcactatagggggtgacatttcttcaggataataatctgtcaacagaggagagacagaatgttatcctgaaacctggcggcagcgcaaaagatg

SEQ ID NO: 148469 - DNA, 103 bp, Artificial Sequence
  Synthetic Polynucleotide
taatacgactcactatagggcattaaggggggtgacatttcttcaggataaacagaggagatatcctatggaaatgtcaaacctggcggcagcgcaaaagatg

SEQ ID NO: 148470 - DNA, 103 bp, Artificial Sequence
  Synthetic Polynucleotide
taatacgactcactatagggacactgagttcattaaggggggtgacatttaacagaggagaaaatgtatgcccccttaaaacctggcggcagcgcaaaagatg

SEQ ID NO: 148471 - DNA, 103 bp, Artificial Sequence
  Synthetic Polynucleotide
taatacgactcactatagggtgcgggggggacactgagttcattaaggggaacagaggagaccccttatggaactcagtaacctggcggcagcgcaaaagatg

SEQ ID NO: 148472 - DNA, 103 bp, Artificial Sequence
  Synthetic Polynucleotide
taatacgactcactatagggcaacaatgcttgcgggggggacactgagttaacagaggagaaactcaatgtcccccccgaacctggcggcagcgcaaaagatg

SEQ ID NO: 148473 - DNA, 103 bp, Artificial Sequence
  Synthetic Polynucleotide
taatacgactcactataggggattctcttgcaacaatgcttgcgggggggaacagaggagaccccccatgaagcattgtaacctggcggcagcgcaaaagatg

SEQ ID NO: 148474 - DNA, 103 bp, Artificial Sequence
  Synthetic Polynucleotide
taatacgactcactatagggaccgaagggtgattctcttgcaacaatgctaacagaggagaagcattatggcaagagaaaacctggcggcagcgcaaaagatg

SEQ ID NO: 148475 - DNA, 103 bp, Artificial Sequence
  Synthetic Polynucleotide
taatacgactcactatagggcttcatggattccatgtaattagatgggtaaacagaggagatacccaatgaattacatgaacctggcggcagcgcaaaagatg

SEQ ID NO: 148476 - DNA, 103 bp, Artificial Sequence
  Synthetic Polynucleotide
taatacgactcactatagggctgcacgatgaccgaagggtgattctcttgaacagaggagacaagagatgcacccttcgaacctggcggcagcgcaaaagatg

SEQ ID NO: 148477 - DNA, 103 bp, Artificial Sequence
  Synthetic Polynucleotide
taatacgactcactatagggtcttcccaggctgcacgatgaccgaagggtaacagaggagaacccttatgtcatcgtgcaacctggcggcagcgcaaaagatg

SEQ ID NO: 148478 - DNA, 103 bp, Artificial Sequence
  Synthetic Polynucleotide
taatacgactcactatagggggtaaaggtctcttcccaggctgcacgatgaacagaggagacatcgtatggcctgggaaaacctggcggcagcgcaaaagatg

SEQ ID NO: 148479 - DNA, 103 bp, Artificial Sequence
  Synthetic Polynucleotide
taatacgactcactatagggggattccacaggtaaaggtctcttcccaggaacagaggagacctgggatgagacctttaaacctggcggcagcgcaaaagatg

SEQ ID NO: 148480 - DNA, 103 bp, Artificial Sequence
  Synthetic Polynucleotide
taatacgactcactataggggagtatccggggattccacaggtaaaggtcaacagaggagagaccttatgctgtggaataacctggcggcagcgcaaaagatg

SEQ ID NO: 148481 - DNA, 103 bp, Artificial Sequence
  Synthetic Polynucleotide
taatacgactcactatagggcgcttcctttgagtatccggggattccacaaacagaggagatgtggaatgcccggatacaacctggcggcagcgcaaaagatg

SEQ ID NO: 148482 - DNA, 103 bp, Artificial Sequence
  Synthetic Polynucleotide
taatacgactcactataggggtgtatcctccgcttcctttgagtatccggaacagaggagaccggatatgcaaaggaagaacctggcggcagcgcaaaagatg

SEQ ID NO: 148483 - DNA, 103 bp, Artificial Sequence
  Synthetic Polynucleotide
taatacgactcactatagggaatcacatctgtgtatcctccgcttcctttaacagaggagaaaaggaatgggaggatacaacctggcggcagcgcaaaagatg

SEQ ID NO: 148484 - DNA, 103 bp, Artificial Sequence
  Synthetic Polynucleotide
taatacgactcactatagggcatccatcataatcacatctgtgtatcctcaacagaggagagaggatatgcagatgtgaaacctggcggcagcgcaaaagatg

SEQ ID NO: 148485 - DNA, 103 bp, Artificial Sequence
  Synthetic Polynucleotide
taatacgactcactatagggcactttgttgcatccatcataatcacatctaacagaggagaagatgtatgtatgatggaaacctggcggcagcgcaaaagatg

SEQ ID NO: 148486 - DNA, 103 bp, Artificial Sequence
  Synthetic Polynucleotide
taatacgactcactatagggacttgttaggcttcatggattccatgtaataacagaggagaattacaatgaatccatgaaacctggcggcagcgcaaaagatg

SEQ ID NO: 148487 - DNA, 103 bp, Artificial Sequence
  Synthetic Polynucleotide
taatacgactcactatagggttttagtgtacactttgttgcatccatcataacagaggagaatgatgatggcaacaaagaacctggcggcagcgcaaaagatg

SEQ ID NO: 148488 - DNA, 103 bp, Artificial Sequence
  Synthetic Polynucleotide
taatacgactcactatagggaagtgggagcttttagtgtacactttgttgaacagaggagacaacaaatggtacactaaaacctggcggcagcgcaaaagatg

SEQ ID NO: 148489 - DNA, 103 bp, Artificial Sequence
  Synthetic Polynucleotide
taatacgactcactataggggtgtgctttcaagtgggagcttttagtgtaaacagaggagatacactatgagctcccacaacctggcggcagcgcaaaagatg

SEQ ID NO: 148490 - DNA, 103 bp, Artificial Sequence
  Synthetic Polynucleotide
taatacgactcactataggggtgttcttctgtgtgctttcaagtgggagcaacagaggagagctcccatgtgaaagcacaacctggcggcagcgcaaaagatg

SEQ ID NO: 148491 - DNA, 103 bp, Artificial Sequence
  Synthetic Polynucleotide
taatacgactcactatagggtctcctgtgtgtgttcttctgtgtgctttcaacagaggagagaaagcatgcagaagaacaacctggcggcagcgcaaaagatg

SEQ ID NO: 148492 - DNA, 103 bp, Artificial Sequence
  Synthetic Polynucleotide
taatacgactcactataggggtagggtttttctcctgtgtgtgttcttctaacagaggagaagaagaatgcacacaggaaacctggcggcagcgcaaaagatg

SEQ ID NO: 148493 - DNA, 103 bp, Artificial Sequence
  Synthetic Polynucleotide
taatacgactcactatagggatgtacatttgtagggtttttctcctgtgtaacagaggagaacacagatgaaaaaccctaacctggcggcagcgcaaaagatg

SEQ ID NO: 148494 - DNA, 103 bp, Artificial Sequence
  Synthetic Polynucleotide
taatacgactcactatagggcacccttcccatgtacatttgtagggttttaacagaggagaaaaaccatgcaaatgtacaacctggcggcagcgcaaaagatg

SEQ ID NO: 148495 - DNA, 103 bp, Artificial Sequence
  Synthetic Polynucleotide
taatacgactcactatagggcttccatgtgcacccttcccatgtacatttaacagaggagaaaatgtatgtgggaagggaacctggcggcagcgcaaaagatg

SEQ ID NO: 148496 - DNA, 103 bp, Artificial Sequence
  Synthetic Polynucleotide
taatacgactcactatagggaccgagcaaacttccatgtgcacccttcccaacagaggagagggaagatggcacatggaaacctggcggcagcgcaaaagatg

SEQ ID NO: 148497 - DNA, 103 bp, Artificial Sequence
  Synthetic Polynucleotide
taatacgactcactatagggatgaccccatacttgttaggcttcatggataacagaggagaatccatatggcctaacaaaacctggcggcagcgcaaaagatg

SEQ ID NO: 148498 - DNA, 103 bp, Artificial Sequence
  Synthetic Polynucleotide
taatacgactcactatagggagttcatcagaccgagcaaacttccatgtgaacagaggagacacatgatggtttgctcgaacctggcggcagcgcaaaagatg

SEQ ID NO: 148499 - DNA, 103 bp, Artificial Sequence
  Synthetic Polynucleotide
taatacgactcactatagggatgtcttgttagttcatcagaccgagcaaaaacagaggagatttgctatgtctgatgaaaacctggcggcagcgcaaaagatg

SEQ ID NO: 148500 - DNA, 103 bp, Artificial Sequence
  Synthetic Polynucleotide
taatacgactcactataggggttttcggaaatgtcttgttagttcatcagaacagaggagactgatgatgtaacaagacaacctggcggcagcgcaaaagatg

SEQ ID NO: 148501 - DNA, 103 bp, Artificial Sequence
  Synthetic Polynucleotide
taatacgactcactatagggattccagtatgttttcggaaatgtcttgttaacagaggagaaacaagatgtttccgaaaaacctggcggcagcgcaaaagatg

SEQ ID NO: 148502 - DNA, 103 bp, Artificial Sequence
  Synthetic Polynucleotide
taatacgactcactataggggaaaggtttgattccagtatgttttcggaaaacagaggagattccgaatgcatactggaaacctggcggcagcgcaaaagatg

SEQ ID NO: 148503 - DNA, 103 bp, Artificial Sequence
  Synthetic Polynucleotide
taatacgactcactatagggccgggcactggaaaggtttgattccagtataacagaggagaatactgatgtcaaaccttaacctggcggcagcgcaaaagatg

SEQ ID NO: 148504 - DNA, 103 bp, Artificial Sequence
  Synthetic Polynucleotide
taatacgactcactatagggcggtcacagtccgggcactggaaaggtttgaacagaggagacaaaccatgccagtgcccaacctggcggcagcgcaaaagatg

SEQ ID NO: 148505 - DNA, 103 bp, Artificial Sequence
  Synthetic Polynucleotide
taatacgactcactatagggggagaagctgcggtcacagtccgggcactgaacagaggagacagtgcatggactgtgacaacctggcggcagcgcaaaagatg

SEQ ID NO: 148506 - DNA, 103 bp, Artificial Sequence
  Synthetic Polynucleotide
taatacgactcactatagggggtcagaacgggagaagctgcggtcacagtaacagaggagaactgtgatggcagcttctaacctggcggcagcgcaaaagatg

SEQ ID NO: 148507 - DNA, 103 bp, Artificial Sequence
  Synthetic Polynucleotide
taatacgactcactatagggagggcaagatggtcagaacgggagaagctgaacagaggagacagcttatgccgttctgaaacctggcggcagcgcaaaagatg

SEQ ID NO: 148508 - DNA, 103 bp, Artificial Sequence
  Synthetic Polynucleotide
taatacgactcactatagggcatgtcagactcgccaggtggctgcctcataacagaggagaatgaggatgccacctggcaacctggcggcagcgcaaaagatg

SEQ ID NO: 148509 - DNA, 103 bp, Artificial Sequence
  Synthetic Polynucleotide
taatacgactcactatagggcggggcacctgcttgacgcagtgtcttctcaacagaggagagagaagatgctgcgtcaaaacctggcggcagcgcaaaagatg

SEQ ID NO: 148510 - DNA, 103 bp, Artificial Sequence
  Synthetic Polynucleotide
taatacgactcactataggggaagccgggaggaagcggcagggcagggtgaacagaggagacaccctatgctgccgcttaacctggcggcagcgcaaaagatg

SEQ ID NO: 148511 - DNA, 103 bp, Artificial Sequence
  Synthetic Polynucleotide
taatacgactcactatagggggtggggatggaagccgggaggaagcggcaaacagaggagatgccgcatgctcccggctaacctggcggcagcgcaaaagatg

SEQ ID NO: 148512 - DNA, 103 bp, Artificial Sequence
  Synthetic Polynucleotide
taatacgactcactatagggttgggccccgggtggggatggaagccgggaaacagaggagatcccggatgccatccccaaacctggcggcagcgcaaaagatg

SEQ ID NO: 148513 - DNA, 103 bp, Artificial Sequence
  Synthetic Polynucleotide
taatacgactcactatagggggatgggtaattgggccccgggtggggatgaacagaggagacatcccatgccggggcccaacctggcggcagcgcaaaagatg

SEQ ID NO: 148514 - DNA, 103 bp, Artificial Sequence
  Synthetic Polynucleotide
taatacgactcactatagggcgggcaggaaggatgggtaattgggccccgaacagaggagacggggcatgattacccataacctggcggcagcgcaaaagatg

SEQ ID NO: 148515 - DNA, 103 bp, Artificial Sequence
  Synthetic Polynucleotide
taatacgactcactatagggtgcatctgatcgggcaggaaggatgggtaaaacagaggagattacccatgcttcctgccaacctggcggcagcgcaaaagatg

SEQ ID NO: 148516 - DNA, 103 bp, Artificial Sequence
  Synthetic Polynucleotide
taatacgactcactataggggacttgcggctgcatctgatcgggcaggaaaacagaggagattcctgatggatcagatgaacctggcggcagcgcaaaagatg

SEQ ID NO: 148517 - DNA, 103 bp, Artificial Sequence
  Synthetic Polynucleotide
taatacgactcactatagggggagcggcgggacttgcggctgcatctgataacagaggagaatcagaatgagccgcaagaacctggcggcagcgcaaaagatg

SEQ ID NO: 148518 - DNA, 103 bp, Artificial Sequence
  Synthetic Polynucleotide
taatacgactcactatagggtcttggtaatggagcggcgggacttgcggcaacagaggagagccgcaatgcccgccgctaacctggcggcagcgcaaaagatg

SEQ ID NO: 148519 - DNA, 103 bp, Artificial Sequence
  Synthetic Polynucleotide
taatacgactcactatagggtggcatgagctcttggtaatggagcggcggaacagaggagaccgccgatgcattaccaaaacctggcggcagcgcaaaagatg

SEQ ID NO: 148520 - DNA, 103 bp, Artificial Sequence
  Synthetic Polynucleotide
taatacgactcactatagggagcggttattcggggcacctgcttgacgcaaacagaggagatgcgtcatgcaggtgcccaacctggcggcagcgcaaaagatg

SEQ ID NO: 148521 - DNA, 103 bp, Artificial Sequence
  Synthetic Polynucleotide
taatacgactcactatagggaggaaccgggtggcatgagctcttggtaataacagaggagaattaccatgagctcatgcaacctggcggcagcgcaaaagatg

SEQ ID NO: 148522 - DNA, 103 bp, Artificial Sequence
  Synthetic Polynucleotide
taatacgactcactatagggtctggcatgcaggaaccgggtggcatgagcaacagaggagagctcatatgacccggttcaacctggcggcagcgcaaaagatg

SEQ ID NO: 148523 - DNA, 103 bp, Artificial Sequence
  Synthetic Polynucleotide
taatacgactcactatagggcttgggctcctctggcatgcaggaaccgggaacagaggagacccggtatgtgcatgccaaacctggcggcagcgcaaaagatg

SEQ ID NO: 148524 - DNA, 103 bp, Artificial Sequence
  Synthetic Polynucleotide
taatacgactcactatagggccctctttggcttgggctcctctggcatgcaacagaggagagcatgcatgaggagcccaaacctggcggcagcgcaaaagatg

SEQ ID NO: 148525 - DNA, 103 bp, Artificial Sequence
  Synthetic Polynucleotide
taatacgactcactataggggatcgtcttcccctctttggcttgggctccaacagaggagaggagccatggccaaagagaacctggcggcagcgcaaaagatg

SEQ ID NO: 148526 - DNA, 103 bp, Artificial Sequence
  Synthetic Polynucleotide
taatacgactcactatagggccggggccacgatcgtcttcccctctttggaacagaggagaccaaagatgggaagacgaaacctggcggcagcgcaaaagatg

SEQ ID NO: 148527 - DNA, 103 bp, Artificial Sequence
  Synthetic Polynucleotide
taatacgactcactatagggcggtccttttccggggccacgatcgtcttcaacagaggagagaagacatgcgtggccccaacctggcggcagcgcaaaagatg

SEQ ID NO: 148528 - DNA, 103 bp, Artificial Sequence
  Synthetic Polynucleotide
taatacgactcactataggggtgtgggtggcggtccttttccggggccacaacagaggagagtggccatggaaaaggacaacctggcggcagcgcaaaagatg

SEQ ID NO: 148529 - DNA, 103 bp, Artificial Sequence
  Synthetic Polynucleotide
taatacgactcactataggggtaatcacaagtgtgggtggcggtccttttaacagaggagaaaaaggatggccacccacaacctggcggcagcgcaaaagatg

SEQ ID NO: 148530 - DNA, 103 bp, Artificial Sequence
  Synthetic Polynucleotide
taatacgactcactatagggcgcagcccgcgtaatcacaagtgtgggtggaacagaggagaccacccatgcttgtgattaacctggcggcagcgcaaaagatg

SEQ ID NO: 148531 - DNA, 103 bp, Artificial Sequence
  Synthetic Polynucleotide
taatacgactcactatagggtcctcccgccagcggttattcggggcacctaacagaggagaaggtgcatggaataaccgaacctggcggcagcgcaaaagatg

SEQ ID NO: 148532 - DNA, 103 bp, Artificial Sequence
  Synthetic Polynucleotide
taatacgactcactatagggtaggttttgccgcagcccgcgtaatcacaaaacagaggagattgtgaatgcgcgggctgaacctggcggcagcgcaaaagatg

SEQ ID NO: 148533 - DNA, 103 bp, Artificial Sequence
  Synthetic Polynucleotide
taatacgactcactatagggactctttgtgtaggttttgccgcagcccgcaacagaggagagcgggcatgggcaaaaccaacctggcggcagcgcaaaagatg

SEQ ID NO: 148534 - DNA, 103 bp, Artificial Sequence
  Synthetic Polynucleotide
taatacgactcactatagggtgagatgggaactctttgtgtaggttttgcaacagaggagagcaaaaatgacacaaagaaacctggcggcagcgcaaaagatg

SEQ ID NO: 148535 - DNA, 103 bp, Artificial Sequence
  Synthetic Polynucleotide
taatacgactcactatagggaggtgtgccttgagatgggaactctttgtgaacagaggagacacaaaatgttcccatctaacctggcggcagcgcaaaagatg

SEQ ID NO: 148536 - DNA, 103 bp, Artificial Sequence
  Synthetic Polynucleotide
taatacgactcactataggggtgggttcgcaggtgtgccttgagatgggaaacagaggagatcccatatgaaggcacacaacctggcggcagcgcaaaagatg

SEQ ID NO: 148537 - DNA, 103 bp, Artificial Sequence
  Synthetic Polynucleotide
taatacgactcactatagggtctcacctgtgtgggttcgcaggtgtgcctaacagaggagaaggcacatgtgcgaacccaacctggcggcagcgcaaaagatg

SEQ ID NO: 148538 - DNA, 103 bp, Artificial Sequence
  Synthetic Polynucleotide
taatacgactcactatagggtggtaaggtttctcacctgtgtgggttcgcaacagaggagagcgaacatgcacaggtgaaacctggcggcagcgcaaaagatg

SEQ ID NO: 148539 - DNA, 103 bp, Artificial Sequence
  Synthetic Polynucleotide
taatacgactcactatagggccagtcacagtggtaaggtttctcacctgtaacagaggagaacaggtatgaaaccttacaacctggcggcagcgcaaaagatg

SEQ ID NO: 148540 - DNA, 103 bp, Artificial Sequence
  Synthetic Polynucleotide
taatacgactcactatagggcacagccgtcccagtcacagtggtaaggttaacagaggagaaaccttatgactgtgactaacctggcggcagcgcaaaagatg

SEQ ID NO: 148541 - DNA, 103 bp, Artificial Sequence
  Synthetic Polynucleotide
taatacgactcactatagggaatttccatccacagccgtcccagtcacagaacagaggagactgtgaatgggacggctgaacctggcggcagcgcaaaagatg

SEQ ID NO: 148542 - DNA, 103 bp, Artificial Sequence
  Synthetic Polynucleotide
taatacgactcactataggggtgggagagctcctcccgccagcggttattaacagaggagaaataacatgtggcgggagaacctggcggcagcgcaaaagatg

SEQ ID NO: 148543 - DNA, 103 bp, Artificial Sequence
  Synthetic Polynucleotide
taatacgactcactatagggtgagcgggcgaatttccatccacagccgtcaacagaggagagacggcatgggatggaaaaacctggcggcagcgcaaaagatg

SEQ ID NO: 148544 - DNA, 103 bp, Artificial Sequence
  Synthetic Polynucleotide
taatacgactcactatagggtcagttcatctgagcgggcgaatttccatcaacagaggagagatggaatgtcgcccgctaacctggcggcagcgcaaaagatg

SEQ ID NO: 148545 - DNA, 103 bp, Artificial Sequence
  Synthetic Polynucleotide
taatacgactcactatagggtagtgcctggtcagttcatctgagcgggcgaacagaggagacgcccgatgagatgaactaacctggcggcagcgcaaaagatg

SEQ ID NO: 148546 - DNA, 103 bp, Artificial Sequence
  Synthetic Polynucleotide
taatacgactcactataggggtgtttacggtagtgcctggtcagttcatcaacagaggagagatgaaatgaccaggcacaacctggcggcagcgcaaaagatg

SEQ ID NO: 148547 - DNA, 103 bp, Artificial Sequence
  Synthetic Polynucleotide
taatacgactcactatagggggtgccccgtgtgtttacggtagtgcctggaacagaggagaccaggcatgaccgtaaacaacctggcggcagcgcaaaagatg

SEQ ID NO: 148548 - DNA, 103 bp, Artificial Sequence
  Synthetic Polynucleotide
taatacgactcactatagggtggaacgggcggtgccccgtgtgtttacggaacagaggagaccgtaaatgcacggggcaaacctggcggcagcgcaaaagatg

SEQ ID NO: 148549 - DNA, 103 bp, Artificial Sequence
  Synthetic Polynucleotide
taatacgactcactatagggtttttggcactggaacgggcggtgccccgtaacagaggagaacggggatgcgcccgttcaacctggcggcagcgcaaaagatg

SEQ ID NO: 148550 - DNA, 103 bp, Artificial Sequence
  Synthetic Polynucleotide
taatacgactcactatagggctcggtcgcatttttggcactggaacgggcaacagaggagagcccgtatgagtgccaaaaacctggcggcagcgcaaaagatg

SEQ ID NO: 148551 - DNA, 103 bp, Artificial Sequence
  Synthetic Polynucleotide
taatacgactcactatagggctggaaaatgctcggtcgcatttttggcacaacagaggagagtgccaatgatgcgaccgaacctggcggcagcgcaaaagatg

SEQ ID NO: 148552 - DNA, 103 bp, Artificial Sequence
  Synthetic Polynucleotide
taatacgactcactataggggtggtccgacctggaaaatgctcggtcgcaaacagaggagatgcgacatggcattttccaacctggcggcagcgcaaaagatg

SEQ ID NO: 148553 - DNA, 103 bp, Artificial Sequence
  Synthetic Polynucleotide
taatacgactcactataggggtcgcttcatgtgggagagctcctcccgccaacagaggagaggcgggatgagctctcccaacctggcggcagcgcaaaagatg

SEQ ID NO: 148554 - DNA, 103 bp, Artificial Sequence
  Synthetic Polynucleotide
taatacgactcactataggggtaaggcgaggtggtccgacctggaaaatgaacagaggagacattttatgggtcggaccaacctggcggcagcgcaaaagatg

SEQ ID NO: 148555 - DNA, 103 bp, Artificial Sequence
  Synthetic Polynucleotide
taatacgactcactatagggctcttcatgtgtaaggcgaggtggtccgacaacagaggagagtcggaatgcctcgccttaacctggcggcagcgcaaaagatg

SEQ ID NO: 148556 - DNA, 103 bp, Artificial Sequence
  Synthetic Polynucleotide
taatacgactcactatagggttaaaaatgcctcttcatgtgtaaggcgagaacagaggagactcgccatgcacatgaagaacctggcggcagcgcaaaagatg

SEQ ID NO: 148557 - DNA, 103 bp, Artificial Sequence
  Synthetic Polynucleotide
taatacgactcactatagggactgggggaagtcgcttcatgtgggagagcaacagaggagagctctcatgcatgaagcgaacctggcggcagcgcaaaagatg

SEQ ID NO: 148558 - DNA, 103 bp, Artificial Sequence
  Synthetic Polynucleotide
taatacgactcactataggggccgggaagcactgggggaagtcgcttcataacagaggagaatgaagatgcttcccccaaacctggcggcagcgcaaaagatg

SEQ ID NO: 148559 - DNA, 103 bp, Artificial Sequence
  Synthetic Polynucleotide
taatacgactcactatagggcataggggcggccgggaagcactgggggaaaacagaggagattccccatgtgcttcccgaacctggcggcagcgcaaaagatg

SEQ ID NO: 148560 - DNA, 103 bp, Artificial Sequence
  Synthetic Polynucleotide
taatacgactcactataggggccgccaggtcataggggcggccgggaagcaacagaggagagcttccatgccgcccctaaacctggcggcagcgcaaaagatg

SEQ ID NO: 148561 - DNA, 103 bp, Artificial Sequence
  Synthetic Polynucleotide
taatacgactcactatagggcacggtcgccgccgccaggtcataggggcgaacagaggagacgccccatggacctggcgaacctggcggcagcgcaaaagatg

SEQ ID NO: 148562 - DNA, 103 bp, Artificial Sequence
  Synthetic Polynucleotide
taatacgactcactatagggcgctgacagccatgtcagactcgccaggtgaacagaggagacacctgatgagtctgacaaacctggcggcagcgcaaaagatg

SEQ ID NO: 148563 - DNA, 103 bp, Artificial Sequence
  Synthetic Polynucleotide
taatacgactcactatagggggtctgtggccacggtcgccgccgccaggtaacagaggagaacctggatgcggcgaccgaacctggcggcagcgcaaaagatg

SEQ ID NO: 148564 - DNA, 103 bp, Artificial Sequence
  Synthetic Polynucleotide
taatacgactcactatagggccgctctccaggtctgtggccacggtcgccaacagaggagaggcgacatgggccacagaaacctggcggcagcgcaaaagatg

SEQ ID NO: 148565 - DNA, 103 bp, Artificial Sequence
  Synthetic Polynucleotide
taatacgactcactatagggaccggctccgccgctctccaggtctgtggcaacagaggagagccacaatgctggagagcaacctggcggcagcgcaaaagatg

SEQ ID NO: 148566 - DNA, 103 bp, Artificial Sequence
  Synthetic Polynucleotide
taatacgactcactatagggcgcaagccgcaccggctccgccgctctccaaacagaggagatggagaatggcggagccgaacctggcggcagcgcaaaagatg

SEQ ID NO: 148567 - DNA, 103 bp, Artificial Sequence
  Synthetic Polynucleotide
taatacgactcactatagggttgctaccgccgcaagccgcaccggctccgaacagaggagacggagcatgtgcggcttgaacctggcggcagcgcaaaagatg

SEQ ID NO: 148568 - DNA, 103 bp, Artificial Sequence
  Synthetic Polynucleotide
taatacgactcactataggggggcgccaggttgctaccgccgcaagccgcaacagaggagagcggctatgggcggtagcaacctggcggcagcgcaaaagatg

SEQ ID NO: 148569 - DNA, 103 bp, Artificial Sequence
  Synthetic Polynucleotide
taatacgactcactatagggtccgaggtaggggcgccaggttgctaccgcaacagaggagagcggtaatgacctggcgcaacctggcggcagcgcaaaagatg

SEQ ID NO: 148570 - DNA, 103 bp, Artificial Sequence
  Synthetic Polynucleotide
taatacgactcactatagggtcggtctctctccgaggtaggggcgccaggaacagaggagacctggcatgcctacctcgaacctggcggcagcgcaaaagatg

SEQ ID NO: 148571 - DNA, 103 bp, Artificial Sequence
  Synthetic Polynucleotide
taatacgactcactataggggttgaactcctcggtctctctccgaggtagaacagaggagactacctatgagagagaccaacctggcggcagcgcaaaagatg

SEQ ID NO: 148572 - DNA, 103 bp, Artificial Sequence
  Synthetic Polynucleotide
taatacgactcactatagggccaggagatcgttgaactcctcggtctctcaacagaggagagagagaatgaggagttcaaacctggcggcagcgcaaaagatg

SEQ ID NO: 148573 - DNA, 103 bp, Artificial Sequence
  Synthetic Polynucleotide
taatacgactcactatagggagcagcgcgtcgctgacagccatgtcagacaacagaggagagtctgaatgggctgtcagaacctggcggcagcgcaaaagatg

SEQ ID NO: 148574 - DNA, 103 bp, Artificial Sequence
  Synthetic Polynucleotide
taatacgactcactatagggaagtccaggtccaggagatcgttgaactccaacagaggagaggagttatgcgatctcctaacctggcggcagcgcaaaagatg

SEQ ID NO: 148575 - DNA, 103 bp, Artificial Sequence
  Synthetic Polynucleotide
taatacgactcactatagggggagagaataaagtccaggtccaggagatcaacagaggagagatctcatggacctggacaacctggcggcagcgcaaaagatg

SEQ ID NO: 148576 - DNA, 103 bp, Artificial Sequence
  Synthetic Polynucleotide
taatacgactcactatagggtcagcgaattggagagaataaagtccaggtaacagaggagaacctggatgttattctctaacctggcggcagcgcaaaagatg

SEQ ID NO: 148577 - DNA, 103 bp, Artificial Sequence
  Synthetic Polynucleotide
taatacgactcactatagggggaggatgggtcagcgaattggagagaataaacagaggagatattctatgcaattcgctaacctggcggcagcgcaaaagatg

SEQ ID NO: 148578 - DNA, 103 bp, Artificial Sequence
  Synthetic Polynucleotide
taatacgactcactatagggcactgactccggaggatgggtcagcgaattaacagaggagaaattcgatgacccatcctaacctggcggcagcgcaaaagatg

SEQ ID NO: 148579 - DNA, 103 bp, Artificial Sequence
  Synthetic Polynucleotide
taatacgactcactatagggcggtggcggccactgactccggaggatgggaacagaggagacccatcatgcggagtcagaacctggcggcagcgcaaaagatg

SEQ ID NO: 148580 - DNA, 103 bp, Artificial Sequence
  Synthetic Polynucleotide
taatacgactcactataggggacgaggacacggtggcggccactgactccaacagaggagaggagtcatgggccgccacaacctggcggcagcgcaaaagatg

SEQ ID NO: 148581 - DNA, 103 bp, Artificial Sequence
  Synthetic Polynucleotide
taatacgactcactatagggggctgacgctgacgaggacacggtggcggcaacagaggagagccgccatggtgtcctcgaacctggcggcagcgcaaaagatg

SEQ ID NO: 148582 - DNA, 103 bp, Artificial Sequence
  Synthetic Polynucleotide
taatacgactcactatagggacgaagaggaggctgacgctgacgaggacaaacagaggagatgtcctatgcagcgtcagaacctggcggcagcgcaaaagatg

SEQ ID NO: 148583 - DNA, 103 bp, Artificial Sequence
  Synthetic Polynucleotide
taatacgactcactataggggacggcgacgacgaagaggaggctgacgctaacagaggagaagcgtcatgctcctcttcaacctggcggcagcgcaaaagatg

SEQ ID NO: 148584 - DNA, 103 bp, Artificial Sequence
  Synthetic Polynucleotide
taatacgactcactataggggaaagatgggagcagcgcgtcgctgacagcaacagaggagagctgtcatggacgcgctgaacctggcggcagcgcaaaagatg

SEQ ID NO: 148585 - DNA, 103 bp, Artificial Sequence
  Synthetic Polynucleotide
taatacgactcactataggggccgctgctcgacggcgacgacgaagaggaaacagaggagatcctctatgtcgtcgccgaacctggcggcagcgcaaaagatg

SEQ ID NO: 148586 - DNA, 103 bp, Artificial Sequence
  Synthetic Polynucleotide
taatacgactcactatagggcgctggcagggccgctgctcgacggcgacgaacagaggagacgtcgcatgcgagcagcgaacctggcggcagcgcaaaagatg

SEQ ID NO: 148587 - DNA, 103 bp, Artificial Sequence
  Synthetic Polynucleotide
taatacgactcactataggggtggagggcgcgctggcagggccgctgctcaacagaggagagagcagatgccctgccagaacctggcggcagcgcaaaagatg

SEQ ID NO: 148588 - DNA, 103 bp, Artificial Sequence
  Synthetic Polynucleotide
taatacgactcactataggggaagctgcaggtggagggcgcgctggcaggaacagaggagacctgccatggcgccctccaacctggcggcagcgcaaaagatg

SEQ ID NO: 148589 - DNA, 103 bp, Artificial Sequence
  Synthetic Polynucleotide
taatacgactcactatagggtcggataggtgaagctgcaggtggagggcgaacagaggagacgccctatgcctgcagctaacctggcggcagcgcaaaagatg

SEQ ID NO: 148590 - DNA, 103 bp, Artificial Sequence
  Synthetic Polynucleotide
taatacgactcactatagggccggcccggatcggataggtgaagctgcagaacagaggagactgcagatgcacctatccaacctggcggcagcgcaaaagatg

SEQ ID NO: 148591 - DNA, 103 bp, Artificial Sequence
  Synthetic Polynucleotide
taatacgactcactatagggcgggtcgttcccggcccggatcggataggtaacagaggagaacctatatgatccgggccaacctggcggcagcgcaaaagatg

SEQ ID NO: 148592 - DNA, 103 bp, Artificial Sequence
  Synthetic Polynucleotide
taatacgactcactataggggcgccacgcccgggtcgttcccggcccggaaacagaggagatccgggatgggaacgaccaacctggcggcagcgcaaaagatg

SEQ ID NO: 148593 - DNA, 103 bp, Artificial Sequence
  Synthetic Polynucleotide
taatacgactcactataggggtgccgcccggcgccacgcccgggtcgttcaacagaggagagaacgaatggggcgtggcaacctggcggcagcgcaaaagatg

SEQ ID NO: 148594 - DNA, 103 bp, Artificial Sequence
  Synthetic Polynucleotide
taatacgactcactataggggcctccgcccgtgccgcccggcgccacgccaacagaggagaggcgtgatgccgggcggcaacctggcggcagcgcaaaagatg

SEQ ID NO: 148595 - DNA, 103 bp, Artificial Sequence
  Synthetic Polynucleotide
taatacgactcactatagggcgaacgtggagaaagatgggagcagcgcgtaacagaggagaacgcgcatgtcccatcttaacctggcggcagcgcaaaagatg

SEQ ID NO: 148596 - DNA, 103 bp, Artificial Sequence
  Synthetic Polynucleotide
taatacgactcactatagggcatagaggaggcctccgcccgtgccgcccgaacagaggagacgggcgatgcgggcggagaacctggcggcagcgcaaaagatg

SEQ ID NO: 148597 - DNA, 103 bp, Artificial Sequence
  Synthetic Polynucleotide
taatacgactcactataggggactccctgccatagaggaggcctccgcccaacagaggagagggcggatgcctcctctaaacctggcggcagcgcaaaagatg

SEQ ID NO: 148598 - DNA, 103 bp, Artificial Sequence
  Synthetic Polynucleotide
taatacgactcactatagggagggggagcggactccctgccatagaggagaacagaggagactcctcatgggcagggagaacctggcggcagcgcaaaagatg

SEQ ID NO: 148599 - DNA, 103 bp, Artificial Sequence
  Synthetic Polynucleotide
taatacgactcactataggggagccgtcggagggggagcggactccctgcaacagaggagagcagggatgccgctccccaacctggcggcagcgcaaaagatg

SEQ ID NO: 148600 - DNA, 103 bp, Artificial Sequence
  Synthetic Polynucleotide
taatacgactcactatagggaggttgaagggagccgtcggagggggagcgaacagaggagacgctccatgtccgacggcaacctggcggcagcgcaaaagatg

SEQ ID NO: 148601 - DNA, 103 bp, Artificial Sequence
  Synthetic Polynucleotide
taatacgactcactataggggatgtccgccaggttgaagggagccgtcggaacagaggagaccgacgatgcccttcaacaacctggcggcagcgcaaaagatg

SEQ ID NO: 148602 - DNA, 103 bp, Artificial Sequence
  Synthetic Polynucleotide
taatacgactcactatagggtcacgtcgttgatgtccgccaggttgaaggaacagaggagaccttcaatgtggcggacaaacctggcggcagcgcaaaagatg

SEQ ID NO: 148603 - DNA, 103 bp, Artificial Sequence
  Synthetic Polynucleotide
taatacgactcactatagggcccgaggggctcacgtcgttgatgtccgccaacagaggagaggcggaatgcaacgacgtaacctggcggcagcgcaaaagatg

SEQ ID NO: 148604 - DNA, 103 bp, Artificial Sequence
  Synthetic Polynucleotide
taatacgactcactatagggcacgaagccgcccgaggggctcacgtcgttaacagaggagaaacgacatgagcccctcgaacctggcggcagcgcaaaagatg

SEQ ID NO: 148605 - DNA, 103 bp, Artificial Sequence
  Synthetic Polynucleotide
taatacgactcactatagggggagctcggccacgaagccgcccgaggggcaacagaggagagcccctatggcggcttcgaacctggcggcagcgcaaaagatg

SEQ ID NO: 148606 - DNA, 103 bp, Artificial Sequence
  Synthetic Polynucleotide
taatacgactcactataggggggccagacgcgaacgtggagaaagatgggaacagaggagacccatcatgctccacgttaacctggcggcagcgcaaaagatg

SEQ ID NO: 148607 - DNA, 103 bp, Artificial Sequence
  Synthetic Polynucleotide
taatacgactcactatagggtctggccgcaggagctcggccacgaagccgaacagaggagacggcttatgggccgagctaacctggcggcagcgcaaaagatg

SEQ ID NO: 148608 - DNA, 103 bp, Artificial Sequence
  Synthetic Polynucleotide
taatacgactcactatagggcgggtccaattctggccgcaggagctcggcaacagaggagagccgagatgctgcggccaaacctggcggcagcgcaaaagatg

SEQ ID NO: 148609 - DNA, 103 bp, Artificial Sequence
  Synthetic Polynucleotide
taatacgactcactataggggaatgtacaccgggtccaattctggccgcaaacagaggagatgcggcatgaattggaccaacctggcggcagcgcaaaagatg

SEQ ID NO: 148610 - DNA, 103 bp, Artificial Sequence
  Synthetic Polynucleotide
taatacgactcactatagggtgctgcggcggaatgtacaccgggtccaataacagaggagaattggaatgggtgtacataacctggcggcagcgcaaaagatg

SEQ ID NO: 148611 - DNA, 103 bp, Artificial Sequence
  Synthetic Polynucleotide
taatacgactcactatagggcggctgcggctgctgcggcggaatgtacacaacagaggagagtgtacatgccgccgcagaacctggcggcagcgcaaaagatg

SEQ ID NO: 148612 - DNA, 103 bp, Artificial Sequence
  Synthetic Polynucleotide
taatacgactcactatagggcgccacctggcggctgcggctgctgcggcgaacagaggagacgccgcatgagccgcagcaacctggcggcagcgcaaaagatg

SEQ ID NO: 148613 - DNA, 103 bp, Artificial Sequence
  Synthetic Polynucleotide
taatacgactcactatagggcccatcagcccgccacctggcggctgcggcaacagaggagagccgcaatggccaggtggaacctggcggcagcgcaaaagatg

SEQ ID NO: 148614 - DNA, 103 bp, Artificial Sequence
  Synthetic Polynucleotide
taatacgactcactatagggcacgaacttgcccatcagcccgccacctggaacagaggagaccaggtatggggctgatgaacctggcggcagcgcaaaagatg

SEQ ID NO: 148615 - DNA, 103 bp, Artificial Sequence
  Synthetic Polynucleotide
taatacgactcactatagggacgccttcagcacgaacttgcccatcagccaacagaggagaggctgaatggcaagttcgaacctggcggcagcgcaaaagatg

SEQ ID NO: 148616 - DNA, 103 bp, Artificial Sequence
  Synthetic Polynucleotide
taatacgactcactataggggcgctcagcgacgccttcagcacgaacttgaacagaggagacaagttatggctgaaggcaacctggcggcagcgcaaaagatg

SEQ ID NO: 148617 - DNA, 103 bp, Artificial Sequence
  Synthetic Polynucleotide
taatacgactcactatagggccttcccgccgggccagacgcgaacgtggaaacagaggagatccacgatggcgtctggcaacctggcggcagcgcaaaagatg

SEQ ID NO: 148618 - DNA, 103 bp, Artificial Sequence
  Synthetic Polynucleotide
taatacgactcactataggggctgccaggggcgctcagcgacgccttcagaacagaggagactgaagatgtcgctgagcaacctggcggcagcgcaaaagatg

SEQ ID NO: 148619 - DNA, 103 bp, Artificial Sequence
  Synthetic Polynucleotide
taatacgactcactatagggtgccgtactcgctgccaggggcgctcagcgaacagaggagacgctgaatgcccctggcaaacctggcggcagcgcaaaagatg

SEQ ID NO: 148620 - DNA, 103 bp, Artificial Sequence
  Synthetic Polynucleotide
taatacgactcactatagggaccgacgggctgccgtactcgctgccagggaacagaggagaccctggatgcgagtacggaacctggcggcagcgcaaaagatg

SEQ ID NO: 148621 - DNA, 103 bp, Artificial Sequence
  Synthetic Polynucleotide
taatacgactcactataggggacgctgatgaccgacgggctgccgtactcaacagaggagagagtacatgagcccgtcgaacctggcggcagcgcaaaagatg

SEQ ID NO: 148622 - DNA, 103 bp, Artificial Sequence
  Synthetic Polynucleotide
taatacgactcactatagggtgcctttgctgacgctgatgaccgacgggcaacagaggagagcccgtatgtcatcagcgaacctggcggcagcgcaaaagatg

SEQ ID NO: 148623 - DNA, 103 bp, Artificial Sequence
  Synthetic Polynucleotide
taatacgactcactatagggccgtcagggctgcctttgctgacgctgatgaacagaggagacatcagatgcagcaaaggaacctggcggcagcgcaaaagatg

SEQ ID NO: 148624 - DNA, 103 bp, Artificial Sequence
  Synthetic Polynucleotide
taatacgactcactatagggcgggtggctgccgtcagggctgcctttgctaacagaggagaagcaaaatgagccctgacaacctggcggcagcgcaaaagatg

SEQ ID NO: 148625 - DNA, 103 bp, Artificial Sequence
  Synthetic Polynucleotide
taatacgactcactatagggccaccaccaccgggtggctgccgtcagggcaacagaggagagccctgatggcagccaccaacctggcggcagcgcaaaagatg

SEQ ID NO: 148626 - DNA, 103 bp, Artificial Sequence
  Synthetic Polynucleotide
taatacgactcactatagggttgtagggcgccaccaccaccgggtggctgaacagaggagacagccaatgggtggtggtaacctggcggcagcgcaaaagatg

SEQ ID NO: 148627 - DNA, 103 bp, Artificial Sequence
  Synthetic Polynucleotide
taatacgactcactatagggcggcccgccgttgtagggcgccaccaccacaacagaggagagtggtgatggcgccctacaacctggcggcagcgcaaaagatg

SEQ ID NO: 148628 - DNA, 103 bp, Artificial Sequence
  Synthetic Polynucleotide
taatacgactcactataggggtgtcttctcccttcccgccgggccagacgaacagaggagacgtctgatgcggcgggaaaacctggcggcagcgcaaaagatg

SEQ ID NO: 148629 - DNA, 103 bp, Artificial Sequence
  Synthetic Polynucleotide
taatacgactcactatagggacgtgcgcggcggcccgccgttgtagggcgaacagaggagacgccctatgacggcgggcaacctggcggcagcgcaaaagatg

SEQ ID NO: 148630 - DNA, 103 bp, Artificial Sequence
  Synthetic Polynucleotide
taatacgactcactatagggatcttggggcacgtgcgcggcggcccgccgaacagaggagacggcggatggccgcgcacaacctggcggcagcgcaaaagatg

SEQ ID NO: 148631 - DNA, 103 bp, Artificial Sequence
  Synthetic Polynucleotide
taatacgactcactatagggctcctgcttgatcttggggcacgtgcgcggaacagaggagaccgcgcatgtgccccaagaacctggcggcagcgcaaaagatg

SEQ ID NO: 148632 - DNA, 103 bp, Artificial Sequence
  Synthetic Polynucleotide
taatacgactcactatagggaagagaccgcctcctgcttgatcttggggcaacagaggagagccccaatgtcaagcaggaacctggcggcagcgcaaaagatg

SEQ ID NO: 148633 - DNA, 103 bp, Artificial Sequence
  Synthetic Polynucleotide
taatacgactcactatagggtgggtgcacgaagagaccgcctcctgcttgaacagaggagacaagcaatgggcggtctcaacctggcggcagcgcaaaagatg

SEQ ID NO: 148634 - DNA, 103 bp, Artificial Sequence
  Synthetic Polynucleotide
taatacgactcactatagggagcgcccaagtgggtgcacgaagagaccgcaacagaggagagcggtcatgtcgtgcaccaacctggcggcagcgcaaaagatg

SEQ ID NO: 148635 - DNA, 103 bp, Artificial Sequence
  Synthetic Polynucleotide
taatacgactcactataggggagggggtccagcgcccaagtgggtgcacgaacagaggagacgtgcaatgacttgggcgaacctggcggcagcgcaaaagatg

SEQ ID NO: 148636 - DNA, 103 bp, Artificial Sequence
  Synthetic Polynucleotide
taatacgactcactatagggccattgctgagagggggtccagcgcccaagaacagaggagacttgggatgtggacccccaacctggcggcagcgcaaaagatg

SEQ ID NO: 148637 - DNA, 103 bp, Artificial Sequence
  Synthetic Polynucleotide
taatacgactcactatagggcggccggtggccattgctgagagggggtccaacagaggagaggacccatgctcagcaataacctggcggcagcgcaaaagatg

SEQ ID NO: 148638 - DNA, 103 bp, Artificial Sequence
  Synthetic Polynucleotide
taatacgactcactatagggcgtgtgcagccggccggtggccattgctgaaacagaggagatcagcaatggccaccggcaacctggcggcagcgcaaaagatg

SEQ ID NO: 148639 - DNA, 103 bp, Artificial Sequence
  Synthetic Polynucleotide
taatacgactcactataggggcttgacgcagtgtcttctcccttcccgccaacagaggagaggcgggatgggagaagacaacctggcggcagcgcaaaagatg

SEQ ID NO: 148640 - DNA, 103 bp, Artificial Sequence
  Synthetic Polynucleotide
taatacgactcactatagggagggggaagtcgtgtgcagccggccggtggaacagaggagaccaccgatgggctgcacaaacctggcggcagcgcaaaagatg

SEQ ID NO: 148641 - DNA, 103 bp, Artificial Sequence
  Synthetic Polynucleotide
taatacgactcactatagggctgccgccccagggggaagtcgtgtgcagcaacagaggagagctgcaatggacttccccaacctggcggcagcgcaaaagatg

SEQ ID NO: 148642 - DNA, 103 bp, Artificial Sequence
  Synthetic Polynucleotide
taatacgactcactatagggtgctggggagctgccgccccagggggaagtaacagaggagaacttccatgtggggcggcaacctggcggcagcgcaaaagatg

SEQ ID NO: 148643 - DNA, 103 bp, Artificial Sequence
  Synthetic Polynucleotide
taatacgactcactatagggggggtagtcctgctggggagctgccgccccaacagaggagaggggcgatggctccccagaacctggcggcagcgcaaaagatg

SEQ ID NO: 148644 - DNA, 103 bp, Artificial Sequence
  Synthetic Polynucleotide
taatacgactcactatagggacccagggtcggggtagtcctgctggggagaacagaggagactccccatgaggactaccaacctggcggcagcgcaaaagatg

SEQ ID NO: 148645 - DNA, 103 bp, Artificial Sequence
  Synthetic Polynucleotide
taatacgactcactatagggcttcctcaagacccagggtcggggtagtccaacagaggagaggactaatgcgaccctggaacctggcggcagcgcaaaagatg

SEQ ID NO: 148646 - DNA, 103 bp, Artificial Sequence
  Synthetic Polynucleotide
taatacgactcactatagggctgctcagcacttcctcaagacccagggtcaacagaggagagaccctatgtcttgaggaaacctggcggcagcgcaaaagatg

SEQ ID NO: 148647 - DNA, 103 bp, Artificial Sequence
  Synthetic Polynucleotide
taatacgactcactatagggacagtccctgctgctcagcacttcctcaagaacagaggagacttgagatggtgctgagcaacctggcggcagcgcaaaagatg

SEQ ID NO: 148648 - DNA, 103 bp, Artificial Sequence
  Synthetic Polynucleotide
taatacgactcactataggggggcagggtgacagtccctgctgctcagcaaacagaggagatgctgaatggcagggactaacctggcggcagcgcaaaagatg

SEQ ID NO: 148649 - DNA, 103 bp, Artificial Sequence
  Synthetic Polynucleotide
taatacgactcactatagggggaagcggcagggcagggtgacagtccctgaacagaggagacagggaatgtcaccctgcaacctggcggcagcgcaaaagatg

SEQ ID NO: 148650 - DNA, 103 bp, Artificial Sequence
  Synthetic Polynucleotide
taatacgactcactatagggggcgctcatgctcagcacccttgtagccataacagaggagaatggctatgagggtgctgaacctggcggcagcgcaaaagatg

SEQ ID NO: 148651 - DNA, 103 bp, Artificial Sequence
  Synthetic Polynucleotide
taatacgactcactatagggggccggattcgcggcgcccagcaccggcttaacagaggagaaagccgatgctgggcgccaacctggcggcagcgcaaaagatg

SEQ ID NO: 148652 - DNA, 103 bp, Artificial Sequence
  Synthetic Polynucleotide
taatacgactcactatagggattgtgaattgccagtttagaagcaattgtaacagaggagaacaattatgtctaaactgaacctggcggcagcgcaaaagatg

SEQ ID NO: 148653 - DNA, 103 bp, Artificial Sequence
  Synthetic Polynucleotide
taatacgactcactataggggtaaatttggattgtgaattgccagtttagaacagaggagactaaacatgcaattcacaaacctggcggcagcgcaaaagatg

SEQ ID NO: 148654 - DNA, 103 bp, Artificial Sequence
  Synthetic Polynucleotide
taatacgactcactatagggagggtggtgggtaaatttggattgtgaattaacagaggagaaattcaatgtccaaatttaacctggcggcagcgcaaaagatg

SEQ ID NO: 148655 - DNA, 103 bp, Artificial Sequence
  Synthetic Polynucleotide
taatacgactcactataggggttaactggcagggtggtgggtaaatttggaacagaggagaccaaatatgcccaccaccaacctggcggcagcgcaaaagatg

SEQ ID NO: 148656 - DNA, 103 bp, Artificial Sequence
  Synthetic Polynucleotide
taatacgactcactatagggtgttttgtgagttaactggcagggtggtggaacagaggagaccaccaatgtgccagttaaacctggcggcagcgcaaaagatg

SEQ ID NO: 148657 - DNA, 103 bp, Artificial Sequence
  Synthetic Polynucleotide
taatacgactcactatagggacaggttggatgttttgtgagttaactggcaacagaggagagccagtatgctcacaaaaaacctggcggcagcgcaaaagatg

SEQ ID NO: 148658 - DNA, 103 bp, Artificial Sequence
  Synthetic Polynucleotide
taatacgactcactatagggattgtatctgacaggttggatgttttgtgaaacagaggagatcacaaatgatccaacctaacctggcggcagcgcaaaagatg

SEQ ID NO: 148659 - DNA, 103 bp, Artificial Sequence
  Synthetic Polynucleotide
taatacgactcactatagggtactccttctattgtatctgacaggttggaaacagaggagatccaacatgtcagatacaaacctggcggcagcgcaaaagatg

SEQ ID NO: 148660 - DNA, 103 bp, Artificial Sequence
  Synthetic Polynucleotide
taatacgactcactatagggaaatcggggttactccttctattgtatctgaacagaggagacagataatgtagaaggagaacctggcggcagcgcaaaagatg

SEQ ID NO: 148661 - DNA, 103 bp, Artificial Sequence
  Synthetic Polynucleotide
taatacgactcactatagggtcgtttctccaaatcggggttactccttctaacagaggagaagaaggatgaaccccgataacctggcggcagcgcaaaagatg

SEQ ID NO: 148662 - DNA, 103 bp, Artificial Sequence
  Synthetic Polynucleotide
taatacgactcactatagggccgcgtcgcgggccggattcgcggcgcccaaacagaggagatgggcgatgcgaatccggaacctggcggcagcgcaaaagatg

SEQ ID NO: 148663 - DNA, 103 bp, Artificial Sequence
  Synthetic Polynucleotide
taatacgactcactatagggagtggatgcgtcgtttctccaaatcggggtaacagaggagaaccccgatgtggagaaacaacctggcggcagcgcaaaagatg

SEQ ID NO: 148664 - DNA, 103 bp, Artificial Sequence
  Synthetic Polynucleotide
taatacgactcactatagggtaatcgcagtagtggatgcgtcgtttctccaacagaggagaggagaaatgacgcatccaaacctggcggcagcgcaaaagatg

SEQ ID NO: 148665 - DNA, 103 bp, Artificial Sequence
  Synthetic Polynucleotide
taatacgactcactataggggcaaccagggtaatcgcagtagtggatgcgaacagaggagacgcatcatgtactgcgataacctggcggcagcgcaaaagatg

SEQ ID NO: 148666 - DNA, 103 bp, Artificial Sequence
  Synthetic Polynucleotide
taatacgactcactatagggaaacttttgtgcaaccagggtaatcgcagtaacagaggagaactgcgatgaccctggttaacctggcggcagcgcaaaagatg

SEQ ID NO: 148667 - DNA, 103 bp, Artificial Sequence
  Synthetic Polynucleotide
taatacgactcactataggggacttggtataaacttttgtgcaaccagggaacagaggagaccctggatgcacaaaagtaacctggcggcagcgcaaaagatg

SEQ ID NO: 148668 - DNA, 103 bp, Artificial Sequence
  Synthetic Polynucleotide
taatacgactcactatagggtaaatgagaagacttggtataaacttttgtaacagaggagaacaaaaatgtataccaagaacctggcggcagcgcaaaagatg

SEQ ID NO: 148669 - DNA, 103 bp, Artificial Sequence
  Synthetic Polynucleotide
taatacgactcactatagggggtgagcttttaaatgagaagacttggtataacagaggagaataccaatgcttctcattaacctggcggcagcgcaaaagatg

SEQ ID NO: 148670 - DNA, 103 bp, Artificial Sequence
  Synthetic Polynucleotide
taatacgactcactatagggtgagtcctcaggtgagcttttaaatgagaaaacagaggagattctcaatgaaaagctcaaacctggcggcagcgcaaaagatg

SEQ ID NO: 148671 - DNA, 103 bp, Artificial Sequence
  Synthetic Polynucleotide
taatacgactcactatagggttcaccagtgtgagtcctcaggtgagctttaacagaggagaaaagctatgctgaggactaacctggcggcagcgcaaaagatg

SEQ ID NO: 148672 - DNA, 103 bp, Artificial Sequence
  Synthetic Polynucleotide
taatacgactcactatagggtgtatggcttttcaccagtgtgagtcctcaaacagaggagatgaggaatgacactggtgaacctggcggcagcgcaaaagatg

SEQ ID NO: 148673 - DNA, 103 bp, Artificial Sequence
  Synthetic Polynucleotide
taatacgactcactataggggggaagagcgccgcgtcgcgggccggattcaacagaggagagaatccatgccgcgacgcaacctggcggcagcgcaaaagatg

SEQ ID NO: 148674 - DNA, 103 bp, Artificial Sequence
  Synthetic Polynucleotide
taatacgactcactatagggcaggtacacttgtatggcttttcaccagtgaacagaggagacactggatgaaagccataaacctggcggcagcgcaaaagatg

SEQ ID NO: 148675 - DNA, 103 bp, Artificial Sequence
  Synthetic Polynucleotide
taatacgactcactataggggcagccttcccaggtacacttgtatggcttaacagaggagaaagccaatgaagtgtaccaacctggcggcagcgcaaaagatg

SEQ ID NO: 148676 - DNA, 103 bp, Artificial Sequence
  Synthetic Polynucleotide
taatacgactcactatagggacctccagtcgcagccttcccaggtacactaacagaggagaagtgtaatggggaaggctaacctggcggcagcgcaaaagatg

SEQ ID NO: 148677 - DNA, 103 bp, Artificial Sequence
  Synthetic Polynucleotide
taatacgactcactataggggatcgcgcgaacctccagtcgcagccttccaacagaggagaggaaggatgcgactggagaacctggcggcagcgcaaaagatg

SEQ ID NO: 148678 - DNA, 103 bp, Artificial Sequence
  Synthetic Polynucleotide
taatacgactcactatagggcagctcatccgatcgcgcgaacctccagtcaacagaggagagactggatgttcgcgcgaaacctggcggcagcgcaaaagatg

SEQ ID NO: 148679 - DNA, 103 bp, Artificial Sequence
  Synthetic Polynucleotide
taatacgactcactatagggagtggcgggtcagctcatccgatcgcgcgaaacagaggagatcgcgcatgcggatgagcaacctggcggcagcgcaaaagatg

SEQ ID NO: 148680 - DNA, 103 bp, Artificial Sequence
  Synthetic Polynucleotide
taatacgactcactatagggtgcttccggtagtggcgggtcagctcatccaacagaggagaggatgaatggacccgccaaacctggcggcagcgcaaaagatg

SEQ ID NO: 148681 - DNA, 103 bp, Artificial Sequence
  Synthetic Polynucleotide
taatacgactcactatagggggcgcctgtgtgcttccggtagtggcgggtaacagaggagaacccgcatgtaccggaagaacctggcggcagcgcaaaagatg

SEQ ID NO: 148682 - DNA, 103 bp, Artificial Sequence
  Synthetic Polynucleotide
taatacgactcactatagggggaagggcttggcgcctgtgtgcttccggtaacagaggagaaccggaatgacacaggcgaacctggcggcagcgcaaaagatg

SEQ ID NO: 148683 - DNA, 103 bp, Artificial Sequence
  Synthetic Polynucleotide
taatacgactcactatagggaccccgcactggaagggcttggcgcctgtgaacagaggagacacaggatgcaagcccttaacctggcggcagcgcaaaagatg

SEQ ID NO: 148684 - DNA, 103 bp, Artificial Sequence
  Synthetic Polynucleotide
taatacgactcactatagggctcctcgccggggaagagcgccgcgtcgcgaacagaggagacgcgacatggcgctcttcaacctggcggcagcgcaaaagatg

SEQ ID NO: 148685 - DNA, 103 bp, Artificial Sequence
  Synthetic Polynucleotide
taatacgactcactataggggcggttgcacaccccgcactggaagggcttaacagaggagaaagcccatgcagtgcgggaacctggcggcagcgcaaaagatg

SEQ ID NO: 148686 - DNA, 103 bp, Artificial Sequence
  Synthetic Polynucleotide
taatacgactcactataggggcgagaagctgcggttgcacaccccgcactaacagaggagaagtgcgatgtgtgcaaccaacctggcggcagcgcaaaagatg

SEQ ID NO: 148687 - DNA, 103 bp, Artificial Sequence
  Synthetic Polynucleotide
taatacgactcactatagggtggtcagagcgcgagaagctgcggttgcacaacagaggagagtgcaaatgcagcttctcaacctggcggcagcgcaaaagatg

SEQ ID NO: 148688 - DNA, 103 bp, Artificial Sequence
  Synthetic Polynucleotide
taatacgactcactatagggcagggccaggtggtcagagcgcgagaagctaacagaggagaagcttcatgcgctctgacaacctggcggcagcgcaaaagatg

SEQ ID NO: 148689 - DNA, 103 bp, Artificial Sequence
  Synthetic Polynucleotide
taatacgactcactatagggtcttcatatgcagggccaggtggtcagagcaacagaggagagctctgatgacctggcccaacctggcggcagcgcaaaagatg

SEQ ID NO: 148690 - DNA, 103 bp, Artificial Sequence
  Synthetic Polynucleotide
taatacgactcactatagggttctggtgcctcttcatatgcagggccaggaacagaggagacctggcatggcatatgaaaacctggcggcagcgcaaaagatg

SEQ ID NO: 148691 - DNA, 103 bp, Artificial Sequence
  Synthetic Polynucleotide
taatacgactcactatagggcgtgcttcagctcctcgccggggaagagcgaacagaggagacgctctatgccggcgaggaacctggcggcagcgcaaaagatg

SEQ ID NO: 148692 - DNA, 103 bp, Artificial Sequence
  Synthetic Polynucleotide
taatacgactcactatagggcggtggtgcgcgtgcttcagctcctcgccgaacagaggagacggcgaatggctgaagcaaacctggcggcagcgcaaaagatg

SEQ ID NO: 148693 - DNA, 103 bp, Artificial Sequence
  Synthetic Polynucleotide
taatacgactcactatagggcgcctgcgggcggtggtgcgcgtgcttcagaacagaggagactgaagatggcgcaccacaacctggcggcagcgcaaaagatg

SEQ ID NO: 148694 - DNA, 103 bp, Artificial Sequence
  Synthetic Polynucleotide
taatacgactcactataggggcgcgggctgcgcctgcgggcggtggtgcgaacagaggagacgcaccatggcccgcaggaacctggcggcagcgcaaaagatg

SEQ ID NO: 148695 - DNA, 103 bp, Artificial Sequence
  Synthetic Polynucleotide
taatacgactcactataggggcctgcgcgggcgcgggctgcgcctgcgggaacagaggagacccgcaatggcagcccgcaacctggcggcagcgcaaaagatg

SEQ ID NO: 148696 - DNA, 103 bp, Artificial Sequence
  Synthetic Polynucleotide
taatacgactcactatagggcggctgcggggcctgcgcgggcgcgggctgaacagaggagacagcccatgcccgcgcagaacctggcggcagcgcaaaagatg

SEQ ID NO: 148697 - DNA, 103 bp, Artificial Sequence
  Synthetic Polynucleotide
taatacgactcactataggggtcccaggcgggcgctcatgctcagcacccaacagaggagagggtgcatggcatgagcgaacctggcggcagcgcaaaagatg

SEQ ID NO: 148698 - DNA, 103 bp, Artificial Sequence
  Synthetic Polynucleotide
taatacgactcactataggggcggctgggccggctgcggggcctgcgcggaacagaggagaccgcgcatgccccgcagcaacctggcggcagcgcaaaagatg

SEQ ID NO: 148699 - DNA, 103 bp, Artificial Sequence
  Synthetic Polynucleotide
taatacgactcactatagggccggtggcgggcggctgggccggctgcgggaacagaggagacccgcaatgggcccagccaacctggcggcagcgcaaaagatg

SEQ ID NO: 148700 - DNA, 103 bp, Artificial Sequence
  Synthetic Polynucleotide
taatacgactcactatagggcagccgcgggccggtggcgggcggctgggcaacagaggagagcccagatgcccgccaccaacctggcggcagcgcaaaagatg

SEQ ID NO: 148701 - DNA, 103 bp, Artificial Sequence
  Synthetic Polynucleotide
taatacgactcactatagggcctctggaggcagccgcgggccggtggcggaacagaggagaccgccaatggcccgcggcaacctggcggcagcgcaaaagatg

SEQ ID NO: 148702 - DNA, 103 bp, Artificial Sequence
  Synthetic Polynucleotide
taatacgactcactatagggtggaccaggtcctctggaggcagccgcgggaacagaggagacccgcgatggcctccagaaacctggcggcagcgcaaaagatg

SEQ ID NO: 148703 - DNA, 103 bp, Artificial Sequence
  Synthetic Polynucleotide
taatacgactcactatagggacatcttgtctggaccaggtcctctggaggaacagaggagacctccaatggacctggtcaacctggcggcagcgcaaaagatg

SEQ ID NO: 148704 - DNA, 103 bp, Artificial Sequence
  Synthetic Polynucleotide
taatacgactcactatagggtctccatttcacatcttgtctggaccaggtaacagaggagaacctggatgagacaagataacctggcggcagcgcaaaagatg

SEQ ID NO: 148705 - DNA, 103 bp, Artificial Sequence
  Synthetic Polynucleotide
taatacgactcactataggggtcagatacttctccatttcacatcttgtcaacagaggagagacaagatgtgaaatggaaacctggcggcagcgcaaaagatg

SEQ ID NO: 148706 - DNA, 103 bp, Artificial Sequence
  Synthetic Polynucleotide
taatacgactcactatagggaagctgaggtgtcagatacttctccatttcaacagaggagagaaatgatgaagtatctgaacctggcggcagcgcaaaagatg

SEQ ID NO: 148707 - DNA, 103 bp, Artificial Sequence
  Synthetic Polynucleotide
taatacgactcactataggggaactggaggaagctgaggtgtcagatactaacagaggagaagtatcatgcacctcagcaacctggcggcagcgcaaaagatg

SEQ ID NO: 148708 - DNA, 103 bp, Artificial Sequence
  Synthetic Polynucleotide
taatacgactcactatagggtggggcacgggtcccaggcgggcgctcatgaacagaggagacatgagatgccgcctgggaacctggcggcagcgcaaaagatg

SEQ ID NO: 148709 - DNA, 103 bp, Artificial Sequence
  Synthetic Polynucleotide
taatacgactcactatagggggaattataggaactggaggaagctgaggtaacagaggagaacctcaatgtcctccagtaacctggcggcagcgcaaaagatg

SEQ ID NO: 148710 - DNA, 103 bp, Artificial Sequence
  Synthetic Polynucleotide
taatacgactcactatagggtttatgctctggaattataggaactggaggaacagaggagacctccaatgcctataattaacctggcggcagcgcaaaagatg

SEQ ID NO: 148711 - DNA, 103 bp, Artificial Sequence
  Synthetic Polynucleotide
taatacgactcactataggggtctatactttttatgctctggaattatagaacagaggagactataaatgcagagcataaacctggcggcagcgcaaaagatg

SEQ ID NO: 148712 - DNA, 103 bp, Artificial Sequence
  Synthetic Polynucleotide
taatacgactcactataggggcactgtctcgtctatactttttatgctctaacagaggagaagagcaatgaaagtatagaacctggcggcagcgcaaaagatg

SEQ ID NO: 148713 - DNA, 103 bp, Artificial Sequence
  Synthetic Polynucleotide
taatacgactcactatagggtacgactgaggcactgtctcgtctatacttaacagaggagaaagtatatgcgagacagtaacctggcggcagcgcaaaagatg

SEQ ID NO: 148714 - DNA, 103 bp, Artificial Sequence
  Synthetic Polynucleotide
taatacgactcactatagggagaactggtctacgactgaggcactgtctcaacagaggagagagacaatgcctcagtcgaacctggcggcagcgcaaaagatg

SEQ ID NO: 148715 - DNA, 103 bp, Artificial Sequence
  Synthetic Polynucleotide
taatacgactcactataggggtgtcagtgaagaactggtctacgactgagaacagaggagactcagtatgagaccagttaacctggcggcagcgcaaaagatg

SEQ ID NO: 148716 - DNA, 103 bp, Artificial Sequence
  Synthetic Polynucleotide
taatacgactcactatagggtaacccttcagtgtcagtgaagaactggtcaacagaggagagaccagatgttcactgacaacctggcggcagcgcaaaagatg

SEQ ID NO: 148717 - DNA, 103 bp, Artificial Sequence
  Synthetic Polynucleotide
taatacgactcactatagggtactgtaaggtaacccttcagtgtcagtgaaacagaggagatcactgatgctgaagggtaacctggcggcagcgcaaaagatg

SEQ ID NO: 148718 - DNA, 103 bp, Artificial Sequence
  Synthetic Polynucleotide
taatacgactcactatagggttcatgttgatactgtaaggtaacccttcaaacagaggagatgaaggatgaccttacagaacctggcggcagcgcaaaagatg

SEQ ID NO: 148719 - DNA, 103 bp, Artificial Sequence
  Synthetic Polynucleotide
taatacgactcactatagggcgccggcggctggggcacgggtcccaggcgaacagaggagacgcctgatgcccgtgcccaacctggcggcagcgcaaaagatg

SEQ ID NO: 148720 - DNA, 103 bp, Artificial Sequence
  Synthetic Polynucleotide
taatacgactcactataggggaggaagacgttcatgttgatactgtaaggaacagaggagaccttacatgatcaacatgaacctggcggcagcgcaaaagatg

SEQ ID NO: 148721 - DNA, 103 bp, Artificial Sequence
  Synthetic Polynucleotide
taatacgactcactatagggtgatgtcagggaggaagacgttcatgttgaaacagaggagatcaacaatgacgtcttccaacctggcggcagcgcaaaagatg

SEQ ID NO: 148722 - DNA, 103 bp, Artificial Sequence
  Synthetic Polynucleotide
taatacgactcactatagggctcaggtgagtgatgtcagggaggaagacgaacagaggagacgtcttatgccctgacataacctggcggcagcgcaaaagatg

SEQ ID NO: 148723 - DNA, 103 bp, Artificial Sequence
  Synthetic Polynucleotide
taatacgactcactataggggaggccagttctcaggtgagtgatgtcaggaacagaggagacctgacatgactcacctgaacctggcggcagcgcaaaagatg

SEQ ID NO: 148724 - DNA, 103 bp, Artificial Sequence
  Synthetic Polynucleotide
taatacgactcactataggggggatttgtagaggccagttctcaggtgagaacagaggagactcaccatggaactggccaacctggcggcagcgcaaaagatg

SEQ ID NO: 148725 - DNA, 103 bp, Artificial Sequence
  Synthetic Polynucleotide
taatacgactcactatagggcacggtctctgggatttgtagaggccagttaacagaggagaaactggatgctacaaatcaacctggcggcagcgcaaaagatg

SEQ ID NO: 148726 - DNA, 103 bp, Artificial Sequence
  Synthetic Polynucleotide
taatacgactcactataggggtgtgttacgcacggtctctgggatttgtaaacagaggagatacaaaatgcagagaccgaacctggcggcagcgcaaaagatg

SEQ ID NO: 148727 - DNA, 103 bp, Artificial Sequence
  Synthetic Polynucleotide
taatacgactcactatagggctgtcttgatgtgtgttacgcacggtctctaacagaggagaagagacatggcgtaacacaacctggcggcagcgcaaaagatg

SEQ ID NO: 148728 - DNA, 103 bp, Artificial Sequence
  Synthetic Polynucleotide
taatacgactcactataggggcaacaggttctgtcttgatgtgtgttacgaacagaggagacgtaacatgcatcaagacaacctggcggcagcgcaaaagatg

SEQ ID NO: 148729 - DNA, 103 bp, Artificial Sequence
  Synthetic Polynucleotide
taatacgactcactataggggctgaaaatggcaacaggttctgtcttgataacagaggagaatcaagatggaacctgttaacctggcggcagcgcaaaagatg

SEQ ID NO: 148730 - DNA, 103 bp, Artificial Sequence
  Synthetic Polynucleotide
taatacgactcactatagggcgtcctgcggcgccggcggctggggcacggaacagaggagaccgtgcatgagccgccggaacctggcggcagcgcaaaagatg

SEQ ID NO: 148731 - DNA, 103 bp, Artificial Sequence
  Synthetic Polynucleotide
taatacgactcactatagggcactctggtggctgaaaatggcaacaggttaacagaggagaaacctgatgccattttcaaacctggcggcagcgcaaaagatg

SEQ ID NO: 148732 - DNA, 103 bp, Artificial Sequence
  Synthetic Polynucleotide
taatacgactcactataggggcagtcgtttcactctggtggctgaaaatgaacagaggagacattttatgccaccagagaacctggcggcagcgcaaaagatg

SEQ ID NO: 148733 - DNA, 103 bp, Artificial Sequence
  Synthetic Polynucleotide
taatacgactcactatagggcggaggaggggcagtcgtttcactctggtgaacagaggagacaccagatggaaacgactaacctggcggcagcgcaaaagatg

SEQ ID NO: 148734 - DNA, 103 bp, Artificial Sequence
  Synthetic Polynucleotide
taatacgactcactataggggggtcggggccggaggaggggcagtcgtttaacagaggagaaaacgaatgcccctcctcaacctggcggcagcgcaaaagatg

SEQ ID NO: 148735 - DNA, 103 bp, Artificial Sequence
  Synthetic Polynucleotide
taatacgactcactataggggggagggcctgggtcggggccggaggagggaacagaggagaccctccatgggccccgacaacctggcggcagcgcaaaagatg

SEQ ID NO: 148736 - DNA, 103 bp, Artificial Sequence
  Synthetic Polynucleotide
taatacgactcactatagggggtgaactcagggagggcctgggtcggggcaacagaggagagccccgatgcaggccctcaacctggcggcagcgcaaaagatg

SEQ ID NO: 148737 - DNA, 103 bp, Artificial Sequence
  Synthetic Polynucleotide
taatacgactcactatagggtgaatatactggtgaactcagggagggcctaacagaggagaaggcccatgctgagttcaaacctggcggcagcgcaaaagatg

SEQ ID NO: 148738 - DNA, 103 bp, Artificial Sequence
  Synthetic Polynucleotide
taatacgactcactatagggtggtgtgagctgaatatactggtgaactcaaacagaggagatgagttatgcagtatattaacctggcggcagcgcaaaagatg

SEQ ID NO: 148739 - DNA, 103 bp, Artificial Sequence
  Synthetic Polynucleotide
taatacgactcactatagggagctgcggtctggtgtgagctgaatatactaacagaggagaagtataatgagctcacacaacctggcggcagcgcaaaagatg

SEQ ID NO: 148740 - DNA, 103 bp, Artificial Sequence
  Synthetic Polynucleotide
taatacgactcactatagggtcacctctggagctgcggtctggtgtgagcaacagaggagagctcacatgagaccgcagaacctggcggcagcgcaaaagatg

SEQ ID NO: 148741 - DNA, 103 bp, Artificial Sequence
  Synthetic Polynucleotide
taatacgactcactatagggaacaccggctcgtcctgcggcgccggcggcaacagaggagagccgccatggccgcaggaaacctggcggcagcgcaaaagatg

SEQ ID NO: 148742 - DNA, 103 bp, Artificial Sequence
  Synthetic Polynucleotide
taatacgactcactatagggaaaatattgttcacctctggagctgcggtcaacagaggagagaccgcatgtccagaggtaacctggcggcagcgcaaaagatg

SEQ ID NO: 148743 - DNA, 103 bp, Artificial Sequence
  Synthetic Polynucleotide
taatacgactcactatagggttgtttgatgaaaatattgttcacctctggaacagaggagaccagagatgaacaatattaacctggcggcagcgcaaaagatg

SEQ ID NO: 148744 - DNA, 103 bp, Artificial Sequence
  Synthetic Polynucleotide
taatacgactcactatagggtaggaagttcttgtttgatgaaaatattgtaacagaggagaacaataatgtcatcaaacaacctggcggcagcgcaaaagatg

SEQ ID NO: 148745 - DNA, 103 bp, Artificial Sequence
  Synthetic Polynucleotide
taatacgactcactatagggagatctggtgtaggaagttcttgtttgatgaacagaggagacatcaaatgagaacttccaacctggcggcagcgcaaaagatg

SEQ ID NO: 148746 - DNA, 103 bp, Artificial Sequence
  Synthetic Polynucleotide
taatacgactcactatagggagaaagatgaagatctggtgtaggaagttcaacagaggagagaacttatgacaccagataacctggcggcagcgcaaaagatg

SEQ ID NO: 148747 - DNA, 103 bp, Artificial Sequence
  Synthetic Polynucleotide
taatacgactcactataggggggtagggacagaaagatgaagatctggtgaacagaggagacaccagatgttcatctttaacctggcggcagcgcaaaagatg

SEQ ID NO: 148748 - DNA, 103 bp, Artificial Sequence
  Synthetic Polynucleotide
taatacgactcactatagggtggccctgctgggtagggacagaaagatgaaacagaggagatcatctatgtgtccctacaacctggcggcagcgcaaaagatg

SEQ ID NO: 148749 - DNA, 103 bp, Artificial Sequence
  Synthetic Polynucleotide
taatacgactcactatagggctggtacaggtggccctgctgggtagggacaacagaggagagtccctatgcagcagggcaacctggcggcagcgcaaaagatg

SEQ ID NO: 148750 - DNA, 103 bp, Artificial Sequence
  Synthetic Polynucleotide
taatacgactcactatagggtattcagtagctggtacaggtggccctgctaacagaggagaagcaggatgacctgtaccaacctggcggcagcgcaaaagatg

SEQ ID NO: 148751 - DNA, 103 bp, Artificial Sequence
  Synthetic Polynucleotide
taatacgactcactatagggagatccggtgtattcagtagctggtacaggaacagaggagacctgtaatggctactgaaaacctggcggcagcgcaaaagatg

SEQ ID NO: 148752 - DNA, 103 bp, Artificial Sequence
  Synthetic Polynucleotide
taatacgactcactataggggagctgcgcgaacaccggctcgtcctgcggaacagaggagaccgcagatggagccggtgaacctggcggcagcgcaaaagatg

SEQ ID NO: 148753 - DNA, 103 bp, Artificial Sequence
  Synthetic Polynucleotide
taatacgactcactataggggggcatatctagatccggtgtattcagtagaacagaggagactactgatgacaccggataacctggcggcagcgcaaaagatg

SEQ ID NO: 148754 - DNA, 103 bp, Artificial Sequence
  Synthetic Polynucleotide
taatacgactcactatagggttgtagaactgggcatatctagatccggtgaacagaggagacaccggatgtagatatgcaacctggcggcagcgcaaaagatg

SEQ ID NO: 148755 - DNA, 103 bp, Artificial Sequence
  Synthetic Polynucleotide
taatacgactcactataggggctgtctgatttgtagaactgggcatatctaacagaggagaagatatatgcagttctacaacctggcggcagcgcaaaagatg

SEQ ID NO: 148756 - DNA, 103 bp, Artificial Sequence
  Synthetic Polynucleotide
taatacgactcactataggggtccattgctgctgtctgatttgtagaactaacagaggagaagttctatgaatcagacaaacctggcggcagcgcaaaagatg

SEQ ID NO: 148757 - DNA, 103 bp, Artificial Sequence
  Synthetic Polynucleotide
taatacgactcactatagggcattaagagtgtccattgctgctgtctgataacagaggagaatcagaatgcagcaatggaacctggcggcagcgcaaaagatg

SEQ ID NO: 148758 - DNA, 103 bp, Artificial Sequence
  Synthetic Polynucleotide
taatacgactcactataggggacatagaaacattaagagtgtccattgctaacagaggagaagcaatatgcactcttaaaacctggcggcagcgcaaaagatg

SEQ ID NO: 148759 - DNA, 103 bp, Artificial Sequence
  Synthetic Polynucleotide
taatacgactcactatagggcatggcagctgacatagaaacattaagagtaacagaggagaactcttatggtttctatgaacctggcggcagcgcaaaagatg

SEQ ID NO: 148760 - DNA, 103 bp, Artificial Sequence
  Synthetic Polynucleotide
taatacgactcactatagggtaaggcctgccatggcagctgacatagaaaaacagaggagatttctaatgcagctgccaaacctggcggcagcgcaaaagatg

SEQ ID NO: 148761 - DNA, 103 bp, Artificial Sequence
  Synthetic Polynucleotide
taatacgactcactataggggtgtgtgtgttaaggcctgccatggcagctaacagaggagaagctgcatgggcaggcctaacctggcggcagcgcaaaagatg

SEQ ID NO: 148762 - DNA, 103 bp, Artificial Sequence
  Synthetic Polynucleotide
taatacgactcactatagggaacagcagaggtgtgtgtgttaaggcctgcaacagaggagagcaggcatgaacacacacaacctggcggcagcgcaaaagatg

SEQ ID NO: 148763 - DNA, 103 bp, Artificial Sequence
  Synthetic Polynucleotide
taatacgactcactataggggcaccggcttgagctgcgcgaacaccggctaacagaggagaagccggatgtcgcgcagcaacctggcggcagcgcaaaagatg

SEQ ID NO: 148764 - DNA, 103 bp, Artificial Sequence
  Synthetic Polynucleotide
taatacgactcactatagggcagtctgcggaacagcagaggtgtgtgtgtaacagaggagaacacacatgcctctgctgaacctggcggcagcgcaaaagatg

SEQ ID NO: 148765 - DNA, 103 bp, Artificial Sequence
  Synthetic Polynucleotide
taatacgactcactatagggtgtttcactgcagtctgcggaacagcagagaacagaggagactctgcatgtccgcagacaacctggcggcagcgcaaaagatg

SEQ ID NO: 148766 - DNA, 103 bp, Artificial Sequence
  Synthetic Polynucleotide
taatacgactcactataggggccctggaattgtttcactgcagtctgcggaacagaggagaccgcagatggcagtgaaaaacctggcggcagcgcaaaagatg

SEQ ID NO: 148767 - DNA, 103 bp, Artificial Sequence
  Synthetic Polynucleotide
taatacgactcactatagggaagggggcatgccctggaattgtttcactgaacagaggagacagtgaatgaattccaggaacctggcggcagcgcaaaagatg

SEQ ID NO: 148768 - DNA, 103 bp, Artificial Sequence
  Synthetic Polynucleotide
taatacgactcactataggggtgtatgtgcaagggggcatgccctggaataacagaggagaattccaatgcatgcccccaacctggcggcagcgcaaaagatg

SEQ ID NO: 148769 - DNA, 103 bp, Artificial Sequence
  Synthetic Polynucleotide
taatacgactcactatagggacttggcattgtgtatgtgcaagggggcataacagaggagaatgcccatgtgcacatacaacctggcggcagcgcaaaagatg

SEQ ID NO: 148770 - DNA, 103 bp, Artificial Sequence
  Synthetic Polynucleotide
taatacgactcactataggggaagaaactgacttggcattgtgtatgtgcaacagaggagagcacatatgcaatgccaaaacctggcggcagcgcaaaagatg

SEQ ID NO: 148771 - DNA, 103 bp, Artificial Sequence
  Synthetic Polynucleotide
taatacgactcactataggggcctgttgtggaagaaactgacttggcattaacagaggagaaatgccatgtcagtttctaacctggcggcagcgcaaaagatg

SEQ ID NO: 148772 - DNA, 103 bp, Artificial Sequence
  Synthetic Polynucleotide
taatacgactcactatagggaaagtaagtggcctgttgtggaagaaactgaacagaggagacagtttatgccacaacagaacctggcggcagcgcaaaagatg

SEQ ID NO: 148773 - DNA, 103 bp, Artificial Sequence
  Synthetic Polynucleotide
taatacgactcactataggggtgacgggggaaagtaagtggcctgttgtgaacagaggagacacaacatgccacttactaacctggcggcagcgcaaaagatg

SEQ ID NO: 148774 - DNA, 103 bp, Artificial Sequence
  Synthetic Polynucleotide
taatacgactcactataggggcggcgcccagcaccggcttgagctgcgcgaacagaggagacgcgcaatgcaagccggtaacctggcggcagcgcaaaagatg

SEQ ID NO: 148775 - DNA, 103 bp, Artificial Sequence
  Synthetic Polynucleotide
taatacgactcactataggggagcttggtggtgacgggggaaagtaagtgaacagaggagacacttaatgtcccccgtcaacctggcggcagcgcaaaagatg

SEQ ID NO: 148776 - DNA, 103 bp, Artificial Sequence
  Synthetic Polynucleotide
taatacgactcactatagggtccaggctctgagcttggtggtgacgggggaacagaggagacccccgatgccaccaagcaacctggcggcagcgcaaaagatg

SEQ ID NO: 148777 - DNA, 103 bp, Artificial Sequence
  Synthetic Polynucleotide
taatacgactcactatagggtatctggacttccaggctctgagcttggtgaacagaggagacaccaaatgcagagcctgaacctggcggcagcgcaaaagatg

SEQ ID NO: 148778 - DNA, 103 bp, Artificial Sequence
  Synthetic Polynucleotide
taatacgactcactatagggtctgcttgtctatctggacttccaggctctaacagaggagaagagccatgaagtccagaaacctggcggcagcgcaaaagatg

SEQ ID NO: 148779 - DNA, 103 bp, Artificial Sequence
  Synthetic Polynucleotide
taatacgactcactatagggctggagcatctctgcttgtctatctggactaacagaggagaagtccaatgagacaagcaaacctggcggcagcgcaaaagatg

SEQ ID NO: 148780 - DNA, 103 bp, Artificial Sequence
  Synthetic Polynucleotide
taatacgactcactataggggggttaaattctggagcatctctgcttgtcaacagaggagagacaagatgagatgctccaacctggcggcagcgcaaaagatg

SEQ ID NO: 148781 - DNA, 103 bp, Artificial Sequence
  Synthetic Polynucleotide
taatacgactcactataggggatggaggtggggttaaattctggagcatcaacagaggagagatgctatggaatttaacaacctggcggcagcgcaaaagatg

SEQ ID NO: 148782 - DNA, 103 bp, Artificial Sequence
  Synthetic Polynucleotide
taatacgactcactatagggagcagcataggatggaggtggggttaaattaacagaggagaaatttaatgccacctccaaacctggcggcagcgcaaaagatg

SEQ ID NO: 148783 - DNA, 103 bp, Artificial Sequence
  Synthetic Polynucleotide
taatacgactcactatagggaagcaattgtagcagcataggatggaggtgaacagaggagacacctcatgcctatgctgaacctggcggcagcgcaaaagatg

SEQ ID NO: 148784 - DNA, 103 bp, Artificial Sequence
  Synthetic Polynucleotide
taatacgactcactataggggccagtttagaagcaattgtagcagcatagaacagaggagactatgcatgtacaattgcaacctggcggcagcgcaaaagatg

SEQ ID NO: 148785 - DNA, 103 bp, Artificial Sequence
  Synthetic Polynucleotide
taatacgactcactataggggaagatgctgcacatggggagcacgtccataacagaggagaatggacatgctccccatgaacctggcggcagcgcaaaagatg

SEQ ID NO: 148786 - DNA, 103 bp, Artificial Sequence
  Synthetic Polynucleotide
taatacgactcactatagggttccagctctaggcaggtctgttgccagtaaacagaggagatactggatgcagacctgcaacctggcggcagcgcaaaagatg

SEQ ID NO: 148787 - DNA, 103 bp, Artificial Sequence
  Synthetic Polynucleotide
taatacgactcactatagggggaggtaacgttccagctctaggcaggtctaacagaggagaagacctatgtagagctggaacctggcggcagcgcaaaagatg

SEQ ID NO: 148788 - DNA, 103 bp, Artificial Sequence
  Synthetic Polynucleotide
taatacgactcactatagggggctcgctctggaggtaacgttccagctctaacagaggagaagagctatgacgttacctaacctggcggcagcgcaaaagatg

SEQ ID NO: 148789 - DNA, 103 bp, Artificial Sequence
  Synthetic Polynucleotide
taatacgactcactatagggaacatagcagggctcgctctggaggtaacgaacagaggagacgttacatgcagagcgagaacctggcggcagcgcaaaagatg

SEQ ID NO: 148790 - DNA, 103 bp, Artificial Sequence
  Synthetic Polynucleotide
taatacgactcactatagggctgaggctgaaacatagcagggctcgctctaacagaggagaagagcgatgcctgctatgaacctggcggcagcgcaaaagatg

SEQ ID NO: 148791 - DNA, 103 bp, Artificial Sequence
  Synthetic Polynucleotide
taatacgactcactatagggaatttgatttctgaggctgaaacatagcagaacagaggagactgctaatgttcagcctcaacctggcggcagcgcaaaagatg

SEQ ID NO: 148792 - DNA, 103 bp, Artificial Sequence
  Synthetic Polynucleotide
taatacgactcactatagggctggctgtcaaatttgatttctgaggctgaaacagaggagatcagccatggaaatcaaaaacctggcggcagcgcaaaagatg

SEQ ID NO: 148793 - DNA, 103 bp, Artificial Sequence
  Synthetic Polynucleotide
taatacgactcactatagggacagatcttcctggctgtcaaatttgatttaacagaggagaaaatcaatgttgacagccaacctggcggcagcgcaaaagatg

SEQ ID NO: 148794 - DNA, 103 bp, Artificial Sequence
  Synthetic Polynucleotide
taatacgactcactatagggattttggtccacagatcttcctggctgtcaaacagaggagatgacagatgggaagatctaacctggcggcagcgcaaaagatg

SEQ ID NO: 148795 - DNA, 103 bp, Artificial Sequence
  Synthetic Polynucleotide
taatacgactcactatagggagccagaatgattttggtccacagatcttcaacagaggagagaagatatgtggaccaaaaacctggcggcagcgcaaaagatg

SEQ ID NO: 148796 - DNA, 103 bp, Artificial Sequence
  Synthetic Polynucleotide
taatacgactcactatagggggagctcctggaagatgctgcacatggggaaacagaggagatccccaatggcagcatctaacctggcggcagcgcaaaagatg

SEQ ID NO: 148797 - DNA, 103 bp, Artificial Sequence
  Synthetic Polynucleotide
taatacgactcactatagggttttctcccgagccagaatgattttggtccaacagaggagaggaccaatgtcattctggaacctggcggcagcgcaaaagatg

SEQ ID NO: 148798 - DNA, 103 bp, Artificial Sequence
  Synthetic Polynucleotide
taatacgactcactataggggattcctcctttttctcccgagccagaatgaacagaggagacattctatgtcgggagaaaacctggcggcagcgcaaaagatg

SEQ ID NO: 148799 - DNA, 103 bp, Artificial Sequence
  Synthetic Polynucleotide
taatacgactcactatagggcttcagttcggattcctcctttttctcccgaacagaggagacgggagatgaaggaggaaaacctggcggcagcgcaaaagatg

SEQ ID NO: 148800 - DNA, 103 bp, Artificial Sequence
  Synthetic Polynucleotide
taatacgactcactatagggtggaagatatcttcagttcggattcctcctaacagaggagaaggaggatgccgaactgaaacctggcggcagcgcaaaagatg

SEQ ID NO: 148801 - DNA, 103 bp, Artificial Sequence
  Synthetic Polynucleotide
taatacgactcactatagggtctggaggactggaagatatcttcagttcgaacagaggagacgaactatggatatcttcaacctggcggcagcgcaaaagatg

SEQ ID NO: 148802 - DNA, 103 bp, Artificial Sequence
  Synthetic Polynucleotide
taatacgactcactataggggagagtgtcctctggaggactggaagatataacagaggagaatatctatgagtcctccaaacctggcggcagcgcaaaagatg

SEQ ID NO: 148803 - DNA, 103 bp, Artificial Sequence
  Synthetic Polynucleotide
taatacgactcactatagggtcgggctgatgagagtgtcctctggaggacaacagaggagagtcctcatgaggacactcaacctggcggcagcgcaaaagatg

SEQ ID NO: 148804 - DNA, 103 bp, Artificial Sequence
  Synthetic Polynucleotide
taatacgactcactatagggtaacaaaagctcgggctgatgagagtgtccaacagaggagaggacacatgcatcagcccaacctggcggcagcgcaaaagatg

SEQ ID NO: 148805 - DNA, 103 bp, Artificial Sequence
  Synthetic Polynucleotide
taatacgactcactatagggctctaagttgtaacaaaagctcgggctgataacagaggagaatcagcatgagcttttgtaacctggcggcagcgcaaaagatg

SEQ ID NO: 148806 - DNA, 103 bp, Artificial Sequence
  Synthetic Polynucleotide
taatacgactcactatagggggctgttggtctctaagttgtaacaaaagcaacagaggagagcttttatgacaacttagaacctggcggcagcgcaaaagatg

SEQ ID NO: 148807 - DNA, 103 bp, Artificial Sequence
  Synthetic Polynucleotide
taatacgactcactatagggtgcacgatctggagctcctggaagatgctgaacagaggagacagcatatgccaggagctaacctggcggcagcgcaaaagatg

SEQ ID NO: 148808 - DNA, 103 bp, Artificial Sequence
  Synthetic Polynucleotide
taatacgactcactatagggtctgagttcaggctgttggtctctaagttgaacagaggagacaacttatggaccaacagaacctggcggcagcgcaaaagatg

SEQ ID NO: 148809 - DNA, 103 bp, Artificial Sequence
  Synthetic Polynucleotide
taatacgactcactataggggctgctgacatctgagttcaggctgttggtaacagaggagaaccaacatgctgaactcaaacctggcggcagcgcaaaagatg

SEQ ID NO: 148810 - DNA, 103 bp, Artificial Sequence
  Synthetic Polynucleotide
taatacgactcactatagggcagaggattcgctgctgacatctgagttcaaacagaggagatgaactatgatgtcagcaaacctggcggcagcgcaaaagatg

SEQ ID NO: 148811 - DNA, 103 bp, Artificial Sequence
  Synthetic Polynucleotide
taatacgactcactatagggtcggagctgtcagaggattcgctgctgacaaacagaggagatgtcagatgcgaatcctcaacctggcggcagcgcaaaagatg

SEQ ID NO: 148812 - DNA, 103 bp, Artificial Sequence
  Synthetic Polynucleotide
taatacgactcactatagggagaaagttcctcggagctgtcagaggattcaacagaggagagaatccatggacagctccaacctggcggcagcgcaaaagatg

SEQ ID NO: 148813 - DNA, 103 bp, Artificial Sequence
  Synthetic Polynucleotide
taatacgactcactatagggtggccgtgggagaaagttcctcggagctgtaacagaggagaacagctatgaggaactttaacctggcggcagcgcaaaagatg

SEQ ID NO: 148814 - DNA, 103 bp, Artificial Sequence
  Synthetic Polynucleotide
taatacgactcactataggggaggtaaacttggccgtgggagaaagttccaacagaggagaggaactatgtcccacggcaacctggcggcagcgcaaaagatg

SEQ ID NO: 148815 - DNA, 103 bp, Artificial Sequence
  Synthetic Polynucleotide
taatacgactcactatagggaatggggtcggaggtaaacttggccgtgggaacagaggagacccacgatgaagtttaccaacctggcggcagcgcaaaagatg

SEQ ID NO: 148816 - DNA, 103 bp, Artificial Sequence
  Synthetic Polynucleotide
taatacgactcactatagggaaacttcgccaatggggtcggaggtaaactaacagaggagaagtttaatgccgaccccaaacctggcggcagcgcaaaagatg

SEQ ID NO: 148817 - DNA, 103 bp, Artificial Sequence
  Synthetic Polynucleotide
taatacgactcactataggggagctgaccaaaacttcgccaatggggtcgaacagaggagacgacccatgtggcgaagtaacctggcggcagcgcaaaagatg

SEQ ID NO: 148818 - DNA, 103 bp, Artificial Sequence
  Synthetic Polynucleotide
taatacgactcactataggggccggtctcgtgcacgatctggagctcctgaacagaggagacaggagatgcagatcgtgaacctggcggcagcgcaaaagatg

SEQ ID NO: 148819 - DNA, 103 bp, Artificial Sequence
  Synthetic Polynucleotide
taatacgactcactatagggcaattttcccgagctgaccaaaacttcgccaacagaggagaggcgaaatgttggtcagcaacctggcggcagcgcaaaagatg

SEQ ID NO: 148820 - DNA, 103 bp, Artificial Sequence
  Synthetic Polynucleotide
taatacgactcactatagggcagaggagctcaattttcccgagctgaccaaacagaggagatggtcaatgcgggaaaataacctggcggcagcgcaaaagatg

SEQ ID NO: 148821 - DNA, 103 bp, Artificial Sequence
  Synthetic Polynucleotide
taatacgactcactataggggtggaggtgacagaggagctcaattttcccaacagaggagagggaaaatggagctcctcaacctggcggcagcgcaaaagatg

SEQ ID NO: 148822 - DNA, 103 bp, Artificial Sequence
  Synthetic Polynucleotide
taatacgactcactatagggagatggaggcgtggaggtgacagaggagctaacagaggagaagctccatggtcacctccaacctggcggcagcgcaaaagatg

SEQ ID NO: 148823 - DNA, 103 bp, Artificial Sequence
  Synthetic Polynucleotide
taatacgactcactataggggttccggagaagatggaggcgtggaggtgaaacagaggagatcacctatgcgcctccataacctggcggcagcgcaaaagatg

SEQ ID NO: 148824 - DNA, 103 bp, Artificial Sequence
  Synthetic Polynucleotide
taatacgactcactatagggtccctgctcagttccggagaagatggaggcaacagaggagagcctccatgttctccggaaacctggcggcagcgcaaaagatg

SEQ ID NO: 148825 - DNA, 103 bp, Artificial Sequence
  Synthetic Polynucleotide
taatacgactcactatagggttgagaaggttccctgctcagttccggagaaacagaggagatctccgatgctgagcaggaacctggcggcagcgcaaaagatg

SEQ ID NO: 148826 - DNA, 103 bp, Artificial Sequence
  Synthetic Polynucleotide
taatacgactcactatagggaaccccacagttgagaaggttccctgctcaaacagaggagatgagcaatgaaccttctcaacctggcggcagcgcaaaagatg

SEQ ID NO: 148827 - DNA, 103 bp, Artificial Sequence
  Synthetic Polynucleotide
taatacgactcactatagggccgggcacgcaaccccacagttgagaaggtaacagaggagaaccttcatgactgtggggaacctggcggcagcgcaaaagatg

SEQ ID NO: 148828 - DNA, 103 bp, Artificial Sequence
  Synthetic Polynucleotide
taatacgactcactataggggggcagctccccgggcacgcaaccccacagaacagaggagactgtggatgtgcgtgcccaacctggcggcagcgcaaaagatg

SEQ ID NO: 148829 - DNA, 103 bp, Artificial Sequence
  Synthetic Polynucleotide
taatacgactcactatagggccgagaagtagccggtctcgtgcacgatctaacagaggagaagatcgatgacgagaccgaacctggcggcagcgcaaaagatg

SEQ ID NO: 148830 - DNA, 103 bp, Artificial Sequence
  Synthetic Polynucleotide
taatacgactcactatagggtccctggcgagggcagctccccgggcacgcaacagaggagagcgtgcatggggagctgcaacctggcggcagcgcaaaagatg

SEQ ID NO: 148831 - DNA, 103 bp, Artificial Sequence
  Synthetic Polynucleotide
taatacgactcactatagggctgcgcaccttccctggcgagggcagctccaacagaggagaggagctatgctcgccaggaacctggcggcagcgcaaaagatg

SEQ ID NO: 148832 - DNA, 103 bp, Artificial Sequence
  Synthetic Polynucleotide
taatacgactcactatagggcgaagtcccgctgcgcaccttccctggcgaaacagaggagatcgccaatgaaggtgcgcaacctggcggcagcgcaaaagatg

SEQ ID NO: 148833 - DNA, 103 bp, Artificial Sequence
  Synthetic Polynucleotide
taatacgactcactatagggctggcttccccgaagtcccgctgcgcacctaacagaggagaaggtgcatggcgggacttaacctggcggcagcgcaaaagatg

SEQ ID NO: 148834 - DNA, 103 bp, Artificial Sequence
  Synthetic Polynucleotide
taatacgactcactatagggcccttgtcacctggcttccccgaagtcccgaacagaggagacgggacatgggggaagccaacctggcggcagcgcaaaagatg

SEQ ID NO: 148835 - DNA, 103 bp, Artificial Sequence
  Synthetic Polynucleotide
taatacgactcactatagggatcgccatttcccttgtcacctggcttcccaacagaggagagggaagatgggtgacaagaacctggcggcagcgcaaaagatg

SEQ ID NO: 148836 - DNA, 103 bp, Artificial Sequence
  Synthetic Polynucleotide
taatacgactcactatagggcgggggaggcatcgccatttcccttgtcacaacagaggagagtgacaatggaaatggcgaacctggcggcagcgcaaaagatg

SEQ ID NO: 148837 - DNA, 103 bp, Artificial Sequence
  Synthetic Polynucleotide
taatacgactcactatagggctcctgccgtcgggggaggcatcgccatttaacagaggagaaaatggatgtgcctccccaacctggcggcagcgcaaaagatg

SEQ ID NO: 148838 - DNA, 103 bp, Artificial Sequence
  Synthetic Polynucleotide
taatacgactcactataggggtgcaccctcctcctgccgtcgggggaggcaacagaggagagcctccatggacggcaggaacctggcggcagcgcaaaagatg

SEQ ID NO: 148839 - DNA, 103 bp, Artificial Sequence
  Synthetic Polynucleotide
taatacgactcactatagggagtggcaccggtgcaccctcctcctgccgtaacagaggagaacggcaatgggagggtgcaacctggcggcagcgcaaaagatg

SEQ ID NO: 148840 - DNA, 103 bp, Artificial Sequence
  Synthetic Polynucleotide
taatacgactcactataggggacggcagcgccgagaagtagccggtctcgaacagaggagacgagacatgctacttctcaacctggcggcagcgcaaaagatg

SEQ ID NO: 148841 - DNA, 103 bp, Artificial Sequence
  Synthetic Polynucleotide
taatacgactcactatagggcagccgttaaagtggcaccggtgcaccctcaacagaggagagagggtatgccggtgccaaacctggcggcagcgcaaaagatg

SEQ ID NO: 148842 - DNA, 103 bp, Artificial Sequence
  Synthetic Polynucleotide
taatacgactcactatagggaactttcctgcagccgttaaagtggcaccgaacagaggagacggtgcatgtttaacggcaacctggcggcagcgcaaaagatg

SEQ ID NO: 148843 - DNA, 103 bp, Artificial Sequence
  Synthetic Polynucleotide
taatacgactcactatagggttttggtgtaaactttcctgcagccgttaaaacagaggagattaacgatggcaggaaagaacctggcggcagcgcaaaagatg

SEQ ID NO: 148844 - DNA, 103 bp, Artificial Sequence
  Synthetic Polynucleotide
taatacgactcactatagggaagtgggagcttttggtgtaaactttcctgaacagaggagacaggaaatgttacaccaaaacctggcggcagcgcaaaagatg

SEQ ID NO: 148845 - DNA, 103 bp, Artificial Sequence
  Synthetic Polynucleotide
taatacgactcactataggggtgtgctttcaagtgggagcttttggtgtaaacagaggagatacaccatgagctcccacaacctggcggcagcgcaaaagatg

SEQ ID NO: 148846 - DNA, 103 bp, Artificial Sequence
  Synthetic Polynucleotide
taatacgactcactataggggcgtccgctggtgtgctttcaagtgggagcaacagaggagagctcccatgtgaaagcacaacctggcggcagcgcaaaagatg

SEQ ID NO: 148847 - DNA, 103 bp, Artificial Sequence
  Synthetic Polynucleotide
taatacgactcactatagggtgacctgtgtgcgtccgctggtgtgctttcaacagaggagagaaagcatgccagcggacaacctggcggcagcgcaaaagatg

SEQ ID NO: 148848 - DNA, 103 bp, Artificial Sequence
  Synthetic Polynucleotide
taatacgactcactataggggcgtgggcactgacctgtgtgcgtccgctgaacagaggagacagcggatgcacacaggtaacctggcggcagcgcaaaagatg

SEQ ID NO: 148849 - DNA, 103 bp, Artificial Sequence
  Synthetic Polynucleotide
taatacgactcactatagggtccggggcccgcgtgggcactgacctgtgtaacagaggagaacacagatgagtgcccacaacctggcggcagcgcaaaagatg

SEQ ID NO: 148850 - DNA, 103 bp, Artificial Sequence
  Synthetic Polynucleotide
taatacgactcactataggggcggccgccctccggggcccgcgtgggcacaacagaggagagtgcccatgcgggccccgaacctggcggcagcgcaaaagatg

SEQ ID NO: 148851 - DNA, 103 bp, Artificial Sequence
  Synthetic Polynucleotide
taatacgactcactatagggctcctccagagacggcagcgccgagaagtaaacagaggagatacttcatggcgctgccgaacctggcggcagcgcaaaagatg

SEQ ID NO: 148852 - DNA, 103 bp, Artificial Sequence
  Synthetic Polynucleotide
taatacgactcactataggggcgcccaccagcggccgccctccggggcccaacagaggagagggcccatgagggcggccaacctggcggcagcgcaaaagatg

SEQ ID NO: 148853 - DNA, 103 bp, Artificial Sequence
  Synthetic Polynucleotide
taatacgactcactatagggcaatgcagtggcgcccaccagcggccgcccaacagaggagagggcggatgctggtgggcaacctggcggcagcgcaaaagatg

SEQ ID NO: 148854 - DNA, 103 bp, Artificial Sequence
  Synthetic Polynucleotide
taatacgactcactatagggagggctggtgcaatgcagtggcgcccaccaaacagaggagatggtggatgccactgcataacctggcggcagcgcaaaagatg

SEQ ID NO: 148855 - DNA, 103 bp, Artificial Sequence
  Synthetic Polynucleotide
taatacgactcactatagggggctccctccagggctggtgcaatgcagtgaacagaggagacactgcatggcaccagccaacctggcggcagcgcaaaagatg

SEQ ID NO: 148856 - DNA, 103 bp, Artificial Sequence
  Synthetic Polynucleotide
taatacgactcactatagggagccaggcccggctccctccagggctggtgaacagaggagacaccagatgtggagggagaacctggcggcagcgcaaaagatg

SEQ ID NO: 148857 - DNA, 103 bp, Artificial Sequence
  Synthetic Polynucleotide
taatacgactcactatagggcatcctgtgcagccaggcccggctccctccaacagaggagaggagggatgcgggcctggaacctggcggcagcgcaaaagatg

SEQ ID NO: 148858 - DNA, 103 bp, Artificial Sequence
  Synthetic Polynucleotide
taatacgactcactataggggccctgaccacatcctgtgcagccaggcccaacagaggagagggcctatgtgcacaggaaacctggcggcagcgcaaaagatg

SEQ ID NO: 148859 - DNA, 103 bp, Artificial Sequence
  Synthetic Polynucleotide
taatacgactcactatagggggatttgtctgccctgaccacatcctgtgcaacagaggagagcacagatggtggtcaggaacctggcggcagcgcaaaagatg

SEQ ID NO: 148860 - DNA, 103 bp, Artificial Sequence
  Synthetic Polynucleotide
taatacgactcactataggggaggaagtgaggatttgtctgccctgaccaaacagaggagatggtcaatgcagacaaataacctggcggcagcgcaaaagatg

SEQ ID NO: 148861 - DNA, 103 bp, Artificial Sequence
  Synthetic Polynucleotide
taatacgactcactataggggaaaacatctgaggaagtgaggatttgtctaacagaggagaagacaaatgctcacttccaacctggcggcagcgcaaaagatg

SEQ ID NO: 148862 - DNA, 103 bp, Artificial Sequence
  Synthetic Polynucleotide
taatacgactcactataggggttgccagtactcctccagagacggcagcgaacagaggagacgctgcatgctctggaggaacctggcggcagcgcaaaagatg

SEQ ID NO: 148863 - DNA, 103 bp, Artificial Sequence
  Synthetic Polynucleotide
taatacgactcactatagggtgctttggtggaaaacatctgaggaagtgaaacagaggagatcacttatgcagatgtttaacctggcggcagcgcaaaagatg

SEQ ID NO: 148864 - DNA, 103 bp, Artificial Sequence
  Synthetic Polynucleotide
taatacgactcactatagggaaagacctaatgctttggtggaaaacatctaacagaggagaagatgtatgccaccaaagaacctggcggcagcgcaaaagatg

SEQ ID NO: 148865 - DNA, 103 bp, Artificial Sequence
  Synthetic Polynucleotide
taatacgactcactatagggtgaactccaaaaagacctaatgctttggtgaacagaggagacaccaaatgattaggtctaacctggcggcagcgcaaaagatg

SEQ ID NO: 148866 - DNA, 103 bp, Artificial Sequence
  Synthetic Polynucleotide
taatacgactcactatagggaggcaggtctgttgccagtactcctccagaaacagaggagatctggaatggtactggcaaacctggcggcagcgcaaaagatg

SEQ ID NO: 148867 - DNA, 103 bp, Artificial Sequence
  Synthetic Polynucleotide
taatacgactcactataggggaatatactataactagccaacacgtccataacagaggagaatggacatgttggctagtaacctggcggcagcgcaaaagatg

SEQ ID NO: 148868 - DNA, 103 bp, Artificial Sequence
  Synthetic Polynucleotide
taatacgactcactatagggttccaattcaaggcatgtctgctgccaggtaacagaggagaacctggatgcagacatgcaacctggcggcagcgcaaaagatg

SEQ ID NO: 148869 - DNA, 103 bp, Artificial Sequence
  Synthetic Polynucleotide
taatacgactcactataggggtaggtagcgttccaattcaaggcatgtctaacagaggagaagacatatgttgaattggaacctggcggcagcgcaaaagatg

SEQ ID NO: 148870 - DNA, 103 bp, Artificial Sequence
  Synthetic Polynucleotide
taatacgactcactatagggggctccgtctgtaggtagcgttccaattcaaacagaggagatgaattatgacgctacctaacctggcggcagcgcaaaagatg

SEQ ID NO: 148871 - DNA, 103 bp, Artificial Sequence
  Synthetic Polynucleotide
taatacgactcactataggggatcctccggggctccgtctgtaggtagcgaacagaggagacgctacatgcagacggagaacctggcggcagcgcaaaagatg

SEQ ID NO: 148872 - DNA, 103 bp, Artificial Sequence
  Synthetic Polynucleotide
taatacgactcactatagggaggtctctgagatcctccggggctccgtctaacagaggagaagacggatgcccggaggaaacctggcggcagcgcaaaagatg

SEQ ID NO: 148873 - DNA, 103 bp, Artificial Sequence
  Synthetic Polynucleotide
taatacgactcactatagggtcctcaccaaaggtctctgagatcctccggaacagaggagaccggagatgctcagagacaacctggcggcagcgcaaaagatg

SEQ ID NO: 148874 - DNA, 103 bp, Artificial Sequence
  Synthetic Polynucleotide
taatacgactcactatagggacagtccaagtcctcaccaaaggtctctgaaacagaggagatcagagatgtttggtgagaacctggcggcagcgcaaaagatg

SEQ ID NO: 148875 - DNA, 103 bp, Artificial Sequence
  Synthetic Polynucleotide
taatacgactcactatagggcgtggaggaaacagtccaagtcctcaccaaaacagaggagattggtgatgacttggactaacctggcggcagcgcaaaagatg

SEQ ID NO: 148876 - DNA, 103 bp, Artificial Sequence
  Synthetic Polynucleotide
taatacgactcactatagggggaggggaagcgtggaggaaacagtccaagaacagaggagacttggaatgtttcctccaaacctggcggcagcgcaaaagatg

SEQ ID NO: 148877 - DNA, 103 bp, Artificial Sequence
  Synthetic Polynucleotide
taatacgactcactatagggaatgcacgggggaggggaagcgtggaggaaaacagaggagattcctcatggcttcccctaacctggcggcagcgcaaaagatg

SEQ ID NO: 148878 - DNA, 103 bp, Artificial Sequence
  Synthetic Polynucleotide
taatacgactcactataggggtagctcctggaatatactataactagccaaacagaggagatggctaatgatagtatataacctggcggcagcgcaaaagatg

SEQ ID NO: 148879 - DNA, 103 bp, Artificial Sequence
  Synthetic Polynucleotide
taatacgactcactatagggagctttcctcaatgcacgggggaggggaagaacagaggagacttcccatgccccgtgcaaacctggcggcagcgcaaaagatg

SEQ ID NO: 148880 - DNA, 103 bp, Artificial Sequence
  Synthetic Polynucleotide
taatacgactcactatagggaagcgacggaagctttcctcaatgcacgggaacagaggagacccgtgatgtgaggaaagaacctggcggcagcgcaaaagatg

SEQ ID NO: 148881 - DNA, 103 bp, Artificial Sequence
  Synthetic Polynucleotide
taatacgactcactatagggcagggggtctaagcgacggaagctttcctcaacagaggagagaggaaatgttccgtcgcaacctggcggcagcgcaaaagatg

SEQ ID NO: 148882 - DNA, 103 bp, Artificial Sequence
  Synthetic Polynucleotide
taatacgactcactatagggcggggagcagcagggggtctaagcgacggaaacagaggagatccgtcatgtagacccccaacctggcggcagcgcaaaagatg

SEQ ID NO: 148883 - DNA, 103 bp, Artificial Sequence
  Synthetic Polynucleotide
taatacgactcactataggggccgcttccacggggagcagcagggggtctaacagaggagaagacccatggctgctcccaacctggcggcagcgcaaaagatg

SEQ ID NO: 148884 - DNA, 103 bp, Artificial Sequence
  Synthetic Polynucleotide
taatacgactcactatagggctcacagatggccgcttccacggggagcagaacagaggagactgctcatggtggaagcgaacctggcggcagcgcaaaagatg

SEQ ID NO: 148885 - DNA, 103 bp, Artificial Sequence
  Synthetic Polynucleotide
taatacgactcactatagggccgagctcttctcacagatggccgcttccaaacagaggagatggaagatgccatctgtgaacctggcggcagcgcaaaagatg

SEQ ID NO: 148886 - DNA, 103 bp, Artificial Sequence
  Synthetic Polynucleotide
taatacgactcactatagggatgtccactgccgagctcttctcacagatgaacagaggagacatctgatggaagagctcaacctggcggcagcgcaaaagatg

SEQ ID NO: 148887 - DNA, 103 bp, Artificial Sequence
  Synthetic Polynucleotide
taatacgactcactatagggagagagcaagatgtccactgccgagctcttaacagaggagaaagagcatggcagtggacaacctggcggcagcgcaaaagatg

SEQ ID NO: 148888 - DNA, 103 bp, Artificial Sequence
  Synthetic Polynucleotide
taatacgactcactatagggacttgtcccgagagagcaagatgtccactgaacagaggagacagtggatgtcttgctctaacctggcggcagcgcaaaagatg

SEQ ID NO: 148889 - DNA, 103 bp, Artificial Sequence
  Synthetic Polynucleotide
taatacgactcactatagggtggacaagttgtagctcctggaatatactaaacagaggagatagtatatgccaggagctaacctggcggcagcgcaaaagatg

SEQ ID NO: 148890 - DNA, 103 bp, Artificial Sequence
  Synthetic Polynucleotide
taatacgactcactatagggtcagatagcaacttgtcccgagagagcaagaacagaggagacttgctatgtcgggacaaaacctggcggcagcgcaaaagatg

SEQ ID NO: 148891 - DNA, 103 bp, Artificial Sequence
  Synthetic Polynucleotide
taatacgactcactataggggaggcaggtctcagatagcaacttgtcccgaacagaggagacgggacatgttgctatctaacctggcggcagcgcaaaagatg

SEQ ID NO: 148892 - DNA, 103 bp, Artificial Sequence
  Synthetic Polynucleotide
taatacgactcactataggggctggaggctgaggcaggtctcagatagcaaacagaggagatgctatatgagacctgccaacctggcggcagcgcaaaagatg

SEQ ID NO: 148893 - DNA, 103 bp, Artificial Sequence
  Synthetic Polynucleotide
taatacgactcactataggggagctggccggctggaggctgaggcaggtcaacagaggagagacctgatgcagcctccaaacctggcggcagcgcaaaagatg

SEQ ID NO: 148894 - DNA, 103 bp, Artificial Sequence
  Synthetic Polynucleotide
taatacgactcactataggggtctagagaagagctggccggctggaggctaacagaggagaagcctcatgccggccagcaacctggcggcagcgcaaaagatg

SEQ ID NO: 148895 - DNA, 103 bp, Artificial Sequence
  Synthetic Polynucleotide
taatacgactcactatagggctgtgtagctgtctagagaagagctggccgaacagaggagacggccaatgcttctctagaacctggcggcagcgcaaaagatg

SEQ ID NO: 148896 - DNA, 103 bp, Artificial Sequence
  Synthetic Polynucleotide
taatacgactcactatagggtggttgacggctgtgtagctgtctagagaaaacagaggagattctctatgcagctacacaacctggcggcagcgcaaaagatg

SEQ ID NO: 148897 - DNA, 103 bp, Artificial Sequence
  Synthetic Polynucleotide
taatacgactcactataggggagctgggcctggttgacggctgtgtagctaacagaggagaagctacatggccgtcaacaacctggcggcagcgcaaaagatg

SEQ ID NO: 148898 - DNA, 103 bp, Artificial Sequence
  Synthetic Polynucleotide
taatacgactcactatagggtcactgcgttgagctgggcctggttgacggaacagaggagaccgtcaatgaggcccagcaacctggcggcagcgcaaaagatg

SEQ ID NO: 148899 - DNA, 103 bp, Artificial Sequence
  Synthetic Polynucleotide
taatacgactcactataggggttaatgaggtcactgcgttgagctgggccaacagaggagaggcccaatgcaacgcagtaacctggcggcagcgcaaaagatg

SEQ ID NO: 148900 - DNA, 103 bp, Artificial Sequence
  Synthetic Polynucleotide
taatacgactcactataggggccggtgtcgtggacaagttgtagctcctgaacagaggagacaggagatgcaacttgtcaacctggcggcagcgcaaaagatg

SEQ ID NO: 148901 - DNA, 103 bp, Artificial Sequence
  Synthetic Polynucleotide
taatacgactcactatagggcgatgggggcgttaatgaggtcactgcgttaacagaggagaaacgcaatgacctcattaaacctggcggcagcgcaaaagatg

SEQ ID NO: 148902 - DNA, 103 bp, Artificial Sequence
  Synthetic Polynucleotide
taatacgactcactataggggctcaggggacgatgggggcgttaatgaggaacagaggagacctcatatgcgcccccataacctggcggcagcgcaaaagatg

SEQ ID NO: 148903 - DNA, 103 bp, Artificial Sequence
  Synthetic Polynucleotide
taatacgactcactatagggtggcggctgagctcaggggacgatgggggcaacagaggagagcccccatggtcccctgaaacctggcggcagcgcaaaagatg

SEQ ID NO: 148904 - DNA, 103 bp, Artificial Sequence
  Synthetic Polynucleotide
taatacgactcactatagggtttgaccagatggcggctgagctcaggggaaacagaggagatcccctatgctcagccgcaacctggcggcagcgcaaaagatg

SEQ ID NO: 148905 - DNA, 103 bp, Artificial Sequence
  Synthetic Polynucleotide
taatacgactcactatagggtttgtgaggttttgaccagatggcggctgaaacagaggagatcagccatgatctggtcaaacctggcggcagcgcaaaagatg

SEQ ID NO: 148906 - DNA, 103 bp, Artificial Sequence
  Synthetic Polynucleotide
taatacgactcactataggggcagagagagtttgtgaggttttgaccagaaacagaggagatctggtatgaacctcacaaacctggcggcagcgcaaaagatg

SEQ ID NO: 148907 - DNA, 103 bp, Artificial Sequence
  Synthetic Polynucleotide
taatacgactcactataggggccatccacggcagagagagtttgtgaggtaacagaggagaacctcaatgactctctctaacctggcggcagcgcaaaagatg

SEQ ID NO: 148908 - DNA, 103 bp, Artificial Sequence
  Synthetic Polynucleotide
taatacgactcactatagggacgtcaccgtgccatccacggcagagagagaacagaggagactctctatgccgtggatgaacctggcggcagcgcaaaagatg

SEQ ID NO: 148909 - DNA, 103 bp, Artificial Sequence
  Synthetic Polynucleotide
taatacgactcactatagggaccagtttcaacgtcaccgtgccatccacgaacagaggagacgtggaatgcacggtgacaacctggcggcagcgcaaaagatg

SEQ ID NO: 148910 - DNA, 103 bp, Artificial Sequence
  Synthetic Polynucleotide
taatacgactcactatagggcttcttggccaccagtttcaacgtcaccgtaacagaggagaacggtgatgttgaaactgaacctggcggcagcgcaaaagatg

SEQ ID NO: 148911 - DNA, 103 bp, Artificial Sequence
  Synthetic Polynucleotide
taatacgactcactatagggctgagaagtagccggtgtcgtggacaagttaacagaggagaaacttgatgacgacaccgaacctggcggcagcgcaaaagatg

SEQ ID NO: 148912 - DNA, 103 bp, Artificial Sequence
  Synthetic Polynucleotide
taatacgactcactatagggtgagagcagccttcttggccaccagtttcaaacagaggagatgaaacatgtggccaagaaacctggcggcagcgcaaaagatg

SEQ ID NO: 148913 - DNA, 103 bp, Artificial Sequence
  Synthetic Polynucleotide
taatacgactcactatagggtttacggagctgagagcagccttcttggccaacagaggagaggccaaatgggctgctctaacctggcggcagcgcaaaagatg

SEQ ID NO: 148914 - DNA, 103 bp, Artificial Sequence
  Synthetic Polynucleotide
taatacgactcactatagggccctcccacctttacggagctgagagcagcaacagaggagagctgctatgagctccgtaaacctggcggcagcgcaaaagatg

SEQ ID NO: 148915 - DNA, 103 bp, Artificial Sequence
  Synthetic Polynucleotide
taatacgactcactatagggctgttgcgacccctcccacctttacggagcaacagaggagagctccgatgaggtgggagaacctggcggcagcgcaaaagatg

SEQ ID NO: 148916 - DNA, 103 bp, Artificial Sequence
  Synthetic Polynucleotide
taatacgactcactataggggctgctgcagctgttgcgacccctcccaccaacagaggagaggtgggatgggtcgcaacaacctggcggcagcgcaaaagatg

SEQ ID NO: 148917 - DNA, 103 bp, Artificial Sequence
  Synthetic Polynucleotide
taatacgactcactatagggagccgtcacggctgctgcagctgttgcgacaacagaggagagtcgcaatggctgcagcaaacctggcggcagcgcaaaagatg

SEQ ID NO: 148918 - DNA, 103 bp, Artificial Sequence
  Synthetic Polynucleotide
taatacgactcactatagggcggcccccgcagccgtcacggctgctgcagaacagaggagactgcagatgccgtgacggaacctggcggcagcgcaaaagatg

SEQ ID NO: 148919 - DNA, 103 bp, Artificial Sequence
  Synthetic Polynucleotide
taatacgactcactatagggccactcttaacggcccccgcagccgtcacgaacagaggagacgtgacatgtgcgggggcaacctggcggcagcgcaaaagatg

SEQ ID NO: 148920 - DNA, 103 bp, Artificial Sequence
  Synthetic Polynucleotide
taatacgactcactataggggtcgctctgtccactcttaacggcccccgcaacagaggagagcggggatggttaagagtaacctggcggcagcgcaaaagatg

SEQ ID NO: 148921 - DNA, 103 bp, Artificial Sequence
  Synthetic Polynucleotide
taatacgactcactatagggcttggtcactgtcgctctgtccactcttaaaacagaggagattaagaatggacagagcgaacctggcggcagcgcaaaagatg

SEQ ID NO: 148922 - DNA, 103 bp, Artificial Sequence
  Synthetic Polynucleotide
taatacgactcactataggggatggtaaagctgagaagtagccggtgtcgaacagaggagacgacacatgctacttctcaacctggcggcagcgcaaaagatg

SEQ ID NO: 148923 - DNA, 103 bp, Artificial Sequence
  Synthetic Polynucleotide
taatacgactcactatagggcccagccctccttggtcactgtcgctctgtaacagaggagaacagagatgcagtgaccaaacctggcggcagcgcaaaagatg

SEQ ID NO: 148924 - DNA, 103 bp, Artificial Sequence
  Synthetic Polynucleotide
taatacgactcactatagggtgcttcagcccccagccctccttggtcactaacagaggagaagtgacatgggagggctgaacctggcggcagcgcaaaagatg

SEQ ID NO: 148925 - DNA, 103 bp, Artificial Sequence
  Synthetic Polynucleotide
taatacgactcactatagggtttcgggacatgcttcagcccccagccctcaacagaggagagagggcatggggctgaagaacctggcggcagcgcaaaagatg

SEQ ID NO: 148926 - DNA, 103 bp, Artificial Sequence
  Synthetic Polynucleotide
taatacgactcactatagggctcttcttgttttcgggacatgcttcagccaacagaggagaggctgaatgatgtcccgaaacctggcggcagcgcaaaagatg

SEQ ID NO: 148927 - DNA, 103 bp, Artificial Sequence
  Synthetic Polynucleotide
taatacgactcactataggggcggtgaaccctcttcttgttttcgggacaaacagaggagatgtcccatgaacaagaagaacctggcggcagcgcaaaagatg

SEQ ID NO: 148928 - DNA, 103 bp, Artificial Sequence
  Synthetic Polynucleotide
taatacgactcactatagggtaaactgacagcggtgaaccctcttcttgtaacagaggagaacaagaatggggttcaccaacctggcggcagcgcaaaagatg

SEQ ID NO: 148929 - DNA, 103 bp, Artificial Sequence
  Synthetic Polynucleotide
taatacgactcactatagggcggcacccgttaaactgacagcggtgaaccaacagaggagaggttcaatgctgtcagttaacctggcggcagcgcaaaagatg

SEQ ID NO: 148930 - DNA, 103 bp, Artificial Sequence
  Synthetic Polynucleotide
taatacgactcactatagggataaactttccggcacccgttaaactgacaaacagaggagatgtcagatgaacgggtgcaacctggcggcagcgcaaaagatg

SEQ ID NO: 148931 - DNA, 103 bp, Artificial Sequence
  Synthetic Polynucleotide
taatacgactcactatagggagctttttgtataaactttccggcacccgtaacagaggagaacgggtatgggaaagtttaacctggcggcagcgcaaaagatg

SEQ ID NO: 148932 - DNA, 103 bp, Artificial Sequence
  Synthetic Polynucleotide
taatacgactcactatagggtttaagtgggagctttttgtataaactttcaacagaggagagaaagtatgtacaaaaagaacctggcggcagcgcaaaagatg

SEQ ID NO: 148933 - DNA, 103 bp, Artificial Sequence
  Synthetic Polynucleotide
taatacgactcactatagggctcctccagggatggtaaagctgagaagtaaacagaggagatacttcatggctttaccaaacctggcggcagcgcaaaagatg

SEQ ID NO: 148934 - DNA, 103 bp, Artificial Sequence
  Synthetic Polynucleotide
taatacgactcactatagggctggtgggcctttaagtgggagctttttgtaacagaggagaacaaaaatgtcccacttaaacctggcggcagcgcaaaagatg

SEQ ID NO: 148935 - DNA, 103 bp, Artificial Sequence
  Synthetic Polynucleotide
taatacgactcactatagggtgtgagtcctctggtgggcctttaagtgggaacagaggagacccactatgaggcccaccaacctggcggcagcgcaaaagatg

SEQ ID NO: 148936 - DNA, 103 bp, Artificial Sequence
  Synthetic Polynucleotide
taatacgactcactatagggttctcacctgtgtgagtcctctggtgggccaacagaggagaggcccaatggaggactcaaacctggcggcagcgcaaaagatg

SEQ ID NO: 148937 - DNA, 103 bp, Artificial Sequence
  Synthetic Polynucleotide
taatacgactcactatagggcttataaggcttctcacctgtgtgagtcctaacagaggagaaggactatgacaggtgagaacctggcggcagcgcaaaagatg

SEQ ID NO: 148938 - DNA, 103 bp, Artificial Sequence
  Synthetic Polynucleotide
taatacgactcactatagggcccatgagcacttataaggcttctcacctgaacagaggagacaggtgatgagccttataaacctggcggcagcgcaaaagatg

SEQ ID NO: 148939 - DNA, 103 bp, Artificial Sequence
  Synthetic Polynucleotide
taatacgactcactatagggtcacatccctcccatgagcacttataaggcaacagaggagagccttaatggtgctcatgaacctggcggcagcgcaaaagatg

SEQ ID NO: 148940 - DNA, 103 bp, Artificial Sequence
  Synthetic Polynucleotide
taatacgactcactatagggaaaacgccactcacatccctcccatgagcaaacagaggagatgctcaatggagggatgtaacctggcggcagcgcaaaagatg

SEQ ID NO: 148941 - DNA, 103 bp, Artificial Sequence
  Synthetic Polynucleotide
taatacgactcactatagggcgcttcgtgcaaaacgccactcacatccctaacagaggagaagggatatgagtggcgttaacctggcggcagcgcaaaagatg

SEQ ID NO: 148942 - DNA, 103 bp, Artificial Sequence
  Synthetic Polynucleotide
taatacgactcactataggggtgagctcatcgcttcgtgcaaaacgccacaacagaggagagtggcgatgtgcacgaagaacctggcggcagcgcaaaagatg

SEQ ID NO: 148943 - DNA, 103 bp, Artificial Sequence
  Synthetic Polynucleotide
taatacgactcactataggggtagtgcctcgtgagctcatcgcttcgtgcaacagaggagagcacgaatggatgagctcaacctggcggcagcgcaaaagatg

SEQ ID NO: 148944 - DNA, 103 bp, Artificial Sequence
  Synthetic Polynucleotide
taatacgactcactataggggctgccaggtctcctccagggatggtaaagaacagaggagactttacatgccctggaggaacctggcggcagcgcaaaagatg

SEQ ID NO: 148945 - DNA, 103 bp, Artificial Sequence
  Synthetic Polynucleotide
taatacgactcactatagggtgtgtttcctgtagtgcctcgtgagctcataacagaggagaatgagcatgcgaggcactaacctggcggcagcgcaaaagatg

SEQ ID NO: 148946 - DNA, 103 bp, Artificial Sequence
  Synthetic Polynucleotide
taatacgactcactatagggtttgcacctgtgtgtttcctgtagtgcctcaacagaggagagaggcaatgcaggaaacaaacctggcggcagcgcaaaagatg

SEQ ID NO: 148947 - DNA, 103 bp, Artificial Sequence
  Synthetic Polynucleotide
taatacgactcactatagggtttgaagggctttgcacctgtgtgtttcctaacagaggagaaggaaaatgacaggtgcaaacctggcggcagcgcaaaagatg

SEQ ID NO: 148948 - DNA, 103 bp, Artificial Sequence
  Synthetic Polynucleotide
taatacgactcactatagggagtggttgcatttgaagggctttgcacctgaacagaggagacaggtgatgagcccttcaaacctggcggcagcgcaaaagatg

SEQ ID NO: 148949 - DNA, 103 bp, Artificial Sequence
  Synthetic Polynucleotide
taatacgactcactatagggcacctgtcgcagtggttgcatttgaagggcaacagaggagagcccttatgatgcaaccaaacctggcggcagcgcaaaagatg

SEQ ID NO: 148950 - DNA, 103 bp, Artificial Sequence
  Synthetic Polynucleotide
taatacgactcactatagggcctggaaaaacacctgtcgcagtggttgcaaacagaggagatgcaacatgtgcgacaggaacctggcggcagcgcaaaagatg

SEQ ID NO: 148951 - DNA, 103 bp, Artificial Sequence
  Synthetic Polynucleotide
taatacgactcactataggggatggtcagacctggaaaaacacctgtcgcaacagaggagagcgacaatggtttttccaaacctggcggcagcgcaaaagatg

SEQ ID NO: 148952 - DNA, 103 bp, Artificial Sequence
  Synthetic Polynucleotide
taatacgactcactatagggtggagggcaagatggtcagacctggaaaaaaacagaggagatttttcatggtctgaccaaacctggcggcagcgcaaaagatg

SEQ ID NO: 148953 - DNA, 103 bp, Artificial Sequence
  Synthetic Polynucleotide
taatacgactcactatagggtctcttcatgtggagggcaagatggtcagaaacagaggagatctgacatgcttgccctcaacctggcggcagcgcaaaagatg

SEQ ID NO: 148954 - DNA, 103 bp, Artificial Sequence
  Synthetic Polynucleotide
taatacgactcactatagggaggcatgtctgctgccaggtctcctccaggaacagaggagacctggaatggacctggcaaacctggcggcagcgcaaaagatg

SEQ ID NO: 148955 - DNA, 103 bp, Artificial Sequence
  Synthetic Polynucleotide
taatacgactcactataggggttgtttatgagtttatccatatcgaccataacagaggagaatggtcatgatggataaaaacctggcggcagcgcaaaagatg

SEQ ID NO: 148956 - DNA, 103 bp, Artificial Sequence
  Synthetic Polynucleotide
taatacgactcactatagggtatctcagggggatctctgttccgaacagaaacagaggagatctgttatgaacagagataacctggcggcagcgcaaaagatg

SEQ ID NO: 148957 - DNA, 103 bp, Artificial Sequence
  Synthetic Polynucleotide
taatacgactcactatagggttctgtattctatctcagggggatctctgtaacagaggagaacagagatgcccctgagaaacctggcggcagcgcaaaagatg

SEQ ID NO: 148958 - DNA, 103 bp, Artificial Sequence
  Synthetic Polynucleotide
taatacgactcactataggggtcatattacttctgtattctatctcagggaacagaggagaccctgaatgagaatacagaacctggcggcagcgcaaaagatg

SEQ ID NO: 148959 - DNA, 103 bp, Artificial Sequence
  Synthetic Polynucleotide
taatacgactcactatagggtgttggagaagtcatattacttctgtattcaacagaggagagaatacatgagtaatatgaacctggcggcagcgcaaaagatg

SEQ ID NO: 148960 - DNA, 103 bp, Artificial Sequence
  Synthetic Polynucleotide
taatacgactcactatagggcatccaggagtgttggagaagtcatattacaacagaggagagtaataatgcttctccaaaacctggcggcagcgcaaaagatg

SEQ ID NO: 148961 - DNA, 103 bp, Artificial Sequence
  Synthetic Polynucleotide
taatacgactcactatagggatggggttggcatccaggagtgttggagaaaacagaggagattctccatgactcctggaaacctggcggcagcgcaaaagatg

SEQ ID NO: 148962 - DNA, 103 bp, Artificial Sequence
  Synthetic Polynucleotide
taatacgactcactatagggtgggttctccatggggttggcatccaggagaacagaggagactcctgatggccaaccccaacctggcggcagcgcaaaagatg

SEQ ID NO: 148963 - DNA, 103 bp, Artificial Sequence
  Synthetic Polynucleotide
taatacgactcactatagggtaaacagtgctgggttctccatggggttggaacagaggagaccaaccatgtggagaaccaacctggcggcagcgcaaaagatg

SEQ ID NO: 148964 - DNA, 103 bp, Artificial Sequence
  Synthetic Polynucleotide
taatacgactcactatagggttgatgtcattaaacagtgctgggttctccaacagaggagaggagaaatgagcactgttaacctggcggcagcgcaaaagatg

SEQ ID NO: 148965 - DNA, 103 bp, Artificial Sequence
  Synthetic Polynucleotide
taatacgactcactataggggggctcaatcttgatgtcattaaacagtgcaacagaggagagcactgatgaatgacatcaacctggcggcagcgcaaaagatg

SEQ ID NO: 148966 - DNA, 103 bp, Artificial Sequence
  Synthetic Polynucleotide
taatacgactcactatagggggacctccaagttgtttatgagtttatccaaacagaggagatggataatgtcataaacaaacctggcggcagcgcaaaagatg

SEQ ID NO: 148967 - DNA, 103 bp, Artificial Sequence
  Synthetic Polynucleotide
taatacgactcactataggggttcttctgggggctcaatcttgatgtcataacagaggagaatgacaatgagattgagcaacctggcggcagcgcaaaagatg

SEQ ID NO: 148968 - DNA, 103 bp, Artificial Sequence
  Synthetic Polynucleotide
taatacgactcactatagggctagccaaaagttcttctgggggctcaatcaacagaggagagattgaatgcccagaagaaacctggcggcagcgcaaaagatg

SEQ ID NO: 148969 - DNA, 103 bp, Artificial Sequence
  Synthetic Polynucleotide
taatacgactcactataggggctgaaatcactagccaaaagttcttctggaacagaggagaccagaaatgcttttggctaacctggcggcagcgcaaaagatg

SEQ ID NO: 148970 - DNA, 103 bp, Artificial Sequence
  Synthetic Polynucleotide
taatacgactcactatagggcttggggcaggctgaaatcactagccaaaaaacagaggagattttggatggtgatttcaaacctggcggcagcgcaaaagatg

SEQ ID NO: 148971 - DNA, 103 bp, Artificial Sequence
  Synthetic Polynucleotide
taatacgactcactatagggactggttccacttggggcaggctgaaatcaaacagaggagatgatttatgcctgccccaaacctggcggcagcgcaaaagatg

SEQ ID NO: 148972 - DNA, 103 bp, Artificial Sequence
  Synthetic Polynucleotide
taatacgactcactatagggggagaggtcaactggttccacttggggcagaacagaggagactgcccatggtggaaccaaacctggcggcagcgcaaaagatg

SEQ ID NO: 148973 - DNA, 103 bp, Artificial Sequence
  Synthetic Polynucleotide
taatacgactcactataggggcttgtgaaaggagaggtcaactggttccaaacagaggagatggaacatgttgacctctaacctggcggcagcgcaaaagatg

SEQ ID NO: 148974 - DNA, 103 bp, Artificial Sequence
  Synthetic Polynucleotide
taatacgactcactatagggggagccttgggcttgtgaaaggagaggtcaaacagaggagatgacctatgctttcacaaaacctggcggcagcgcaaaagatg

SEQ ID NO: 148975 - DNA, 103 bp, Artificial Sequence
  Synthetic Polynucleotide
taatacgactcactatagggaggctggagaggagccttgggcttgtgaaaaacagaggagatttcacatgcccaaggctaacctggcggcagcgcaaaagatg

SEQ ID NO: 148976 - DNA, 103 bp, Artificial Sequence
  Synthetic Polynucleotide
taatacgactcactataggggcatgctagcaggctggagaggagccttggaacagaggagaccaaggatgctctccagcaacctggcggcagcgcaaaagatg

SEQ ID NO: 148977 - DNA, 103 bp, Artificial Sequence
  Synthetic Polynucleotide
taatacgactcactataggggaattaagttggacctccaagttgtttatgaacagaggagacataaaatgcttggaggtaacctggcggcagcgcaaaagatg

SEQ ID NO: 148978 - DNA, 103 bp, Artificial Sequence
  Synthetic Polynucleotide
taatacgactcactatagggggagcttgtagcatgctagcaggctggagaaacagaggagatctccaatgtgctagcataacctggcggcagcgcaaaagatg

SEQ ID NO: 148979 - DNA, 103 bp, Artificial Sequence
  Synthetic Polynucleotide
taatacgactcactataggggggacgtattggagcttgtagcatgctagcaacagaggagagctagcatgctacaagctaacctggcggcagcgcaaaagatg

SEQ ID NO: 148980 - DNA, 103 bp, Artificial Sequence
  Synthetic Polynucleotide
taatacgactcactataggggtggcttggggggacgtattggagcttgtaaacagaggagatacaagatgcaatacgtcaacctggcggcagcgcaaaagatg

SEQ ID NO: 148981 - DNA, 103 bp, Artificial Sequence
  Synthetic Polynucleotide
taatacgactcactatagggggagaagactgtggcttggggggacgtattaacagaggagaaatacgatgccccaagccaacctggcggcagcgcaaaagatg

SEQ ID NO: 148982 - DNA, 103 bp, Artificial Sequence
  Synthetic Polynucleotide
taatacgactcactatagggaagggtctggggagaagactgtggcttgggaacagaggagacccaagatgcagtcttctaacctggcggcagcgcaaaagatg

SEQ ID NO: 148983 - DNA, 103 bp, Artificial Sequence
  Synthetic Polynucleotide
taatacgactcactatagggtggacaccacaagggtctggggagaagactaacagaggagaagtcttatgcccagacccaacctggcggcagcgcaaaagatg

SEQ ID NO: 148984 - DNA, 103 bp, Artificial Sequence
  Synthetic Polynucleotide
taatacgactcactataggggatgttgacgtggacaccacaagggtctggaacagaggagaccagacatgtgtggtgtcaacctggcggcagcgcaaaagatg

SEQ ID NO: 148985 - DNA, 103 bp, Artificial Sequence
  Synthetic Polynucleotide
taatacgactcactataggggctcatgtcagatgttgacgtggacaccacaacagaggagagtggtgatgacgtcaacaaacctggcggcagcgcaaaagatg

SEQ ID NO: 148986 - DNA, 103 bp, Artificial Sequence
  Synthetic Polynucleotide
taatacgactcactatagggttgctgaagtgctcatgtcagatgttgacgaacagaggagacgtcaaatgctgacatgaaacctggcggcagcgcaaaagatg

SEQ ID NO: 148987 - DNA, 103 bp, Artificial Sequence
  Synthetic Polynucleotide
taatacgactcactataggggtaggaatgtttgctgaagtgctcatgtcaaacagaggagatgacatatgcacttcagcaacctggcggcagcgcaaaagatg

SEQ ID NO: 148988 - DNA, 103 bp, Artificial Sequence
  Synthetic Polynucleotide
taatacgactcactataggggccaccttctgaattaagttggacctccaaaacagaggagattggagatgcaacttaataacctggcggcagcgcaaaagatg

SEQ ID NO: 148989 - DNA, 103 bp, Artificial Sequence
  Synthetic Polynucleotide
taatacgactcactatagggggtcagaacagtaggaatgtttgctgaagtaacagaggagaacttcaatgaacattcctaacctggcggcagcgcaaaagatg

SEQ ID NO: 148990 - DNA, 103 bp, Artificial Sequence
  Synthetic Polynucleotide
taatacgactcactatagggcagagcctggggtcagaacagtaggaatgtaacagaggagaacattcatgctgttctgaaacctggcggcagcgcaaaagatg

SEQ ID NO: 148991 - DNA, 103 bp, Artificial Sequence
  Synthetic Polynucleotide
taatacgactcactataggggaggtcaggacagagcctggggtcagaacaaacagaggagatgttctatgcccaggctcaacctggcggcagcgcaaaagatg

SEQ ID NO: 148992 - DNA, 103 bp, Artificial Sequence
  Synthetic Polynucleotide
taatacgactcactataggggctctgagaggaggtcaggacagagcctggaacagaggagaccaggcatggtcctgaccaacctggcggcagcgcaaaagatg

SEQ ID NO: 148993 - DNA, 103 bp, Artificial Sequence
  Synthetic Polynucleotide
taatacgactcactatagggggctaccagtgctctgagaggaggtcaggaaacagaggagatcctgaatgcctctcagaaacctggcggcagcgcaaaagatg

SEQ ID NO: 148994 - DNA, 103 bp, Artificial Sequence
  Synthetic Polynucleotide
taatacgactcactatagggaagatctgctggctaccagtgctctgagagaacagaggagactctcaatgcactggtagaacctggcggcagcgcaaaagatg

SEQ ID NO: 148995 - DNA, 103 bp, Artificial Sequence
  Synthetic Polynucleotide
taatacgactcactatagggaatgacatgtaagatctgctggctaccagtaacagaggagaactggtatgcagcagatcaacctggcggcagcgcaaaagatg

SEQ ID NO: 148996 - DNA, 103 bp, Artificial Sequence
  Synthetic Polynucleotide
taatacgactcactatagggggatagtgtgaatgacatgtaagatctgctaacagaggagaagcagaatgtacatgtcaaacctggcggcagcgcaaaagatg

SEQ ID NO: 148997 - DNA, 103 bp, Artificial Sequence
  Synthetic Polynucleotide
taatacgactcactatagggctgactgaggggatagtgtgaatgacatgtaacagaggagaacatgtatgtcacactataacctggcggcagcgcaaaagatg

SEQ ID NO: 148998 - DNA, 103 bp, Artificial Sequence
  Synthetic Polynucleotide
taatacgactcactatagggatttggcagactgactgaggggatagtgtgaacagaggagacacactatgccctcagtcaacctggcggcagcgcaaaagatg

SEQ ID NO: 148999 - DNA, 103 bp, Artificial Sequence
  Synthetic Polynucleotide
taatacgactcactatagggcctgcattgagccaccttctgaattaagttaacagaggagaaacttaatgcagaaggtgaacctggcggcagcgcaaaagatg

SEQ ID NO: 149000 - DNA, 103 bp, Artificial Sequence
  Synthetic Polynucleotide
taatacgactcactatagggcacccatcttatttggcagactgactgaggaacagaggagacctcagatggtctgccaaaacctggcggcagcgcaaaagatg

SEQ ID NO: 149001 - DNA, 103 bp, Artificial Sequence
  Synthetic Polynucleotide
taatacgactcactataggggtcttcaggccacccatcttatttggcagaaacagaggagatctgccatgtaagatgggaacctggcggcagcgcaaaagatg

SEQ ID NO: 149002 - DNA, 103 bp, Artificial Sequence
  Synthetic Polynucleotide
taatacgactcactatagggcactgggatggtcttcaggccacccatcttaacagaggagaaagatgatgggcctgaagaacctggcggcagcgcaaaagatg

SEQ ID NO: 149003 - DNA, 103 bp, Artificial Sequence
  Synthetic Polynucleotide
taatacgactcactatagggactgcactaccactgggatggtcttcaggcaacagaggagagcctgaatgccatcccagaacctggcggcagcgcaaaagatg

SEQ ID NO: 149004 - DNA, 103 bp, Artificial Sequence
  Synthetic Polynucleotide
taatacgactcactatagggatgggcagagactgcactaccactgggatgaacagaggagacatcccatgggtagtgcaaacctggcggcagcgcaaaagatg

SEQ ID NO: 149005 - DNA, 103 bp, Artificial Sequence
  Synthetic Polynucleotide
taatacgactcactatagggagtatacaccatgggcagagactgcactacaacagaggagagtagtgatgtctctgcccaacctggcggcagcgcaaaagatg

SEQ ID NO: 149006 - DNA, 103 bp, Artificial Sequence
  Synthetic Polynucleotide
taatacgactcactatagggcaggcaaagtagtatacaccatgggcagagaacagaggagactctgcatgtggtgtataaacctggcggcagcgcaaaagatg

SEQ ID NO: 149007 - DNA, 103 bp, Artificial Sequence
  Synthetic Polynucleotide
taatacgactcactatagggcccccatctgcaggcaaagtagtatacaccaacagaggagaggtgtaatgtactttgccaacctggcggcagcgcaaaagatg

SEQ ID NO: 149008 - DNA, 103 bp, Artificial Sequence
  Synthetic Polynucleotide
taatacgactcactatagggggctgcagggcccccatctgcaggcaaagtaacagaggagaactttgatggcagatgggaacctggcggcagcgcaaaagatg

SEQ ID NO: 149009 - DNA, 103 bp, Artificial Sequence
  Synthetic Polynucleotide
taatacgactcactatagggggactgtaatggctgcagggcccccatctgaacagaggagacagatgatggccctgcagaacctggcggcagcgcaaaagatg

SEQ ID NO: 149010 - DNA, 103 bp, Artificial Sequence
  Synthetic Polynucleotide
taatacgactcactatagggtgcttgaatacctgcattgagccaccttctaacagaggagaagaaggatgctcaatgcaaacctggcggcagcgcaaaagatg

SEQ ID NO: 149011 - DNA, 103 bp, Artificial Sequence
  Synthetic Polynucleotide
taatacgactcactatagggccaatgagtgggactgtaatggctgcagggaacagaggagaccctgcatgcattacagtaacctggcggcagcgcaaaagatg

SEQ ID NO: 149012 - DNA, 103 bp, Artificial Sequence
  Synthetic Polynucleotide
taatacgactcactatagggaccatctcctccaatgagtgggactgtaataacagaggagaattacaatgccactcattaacctggcggcagcgcaaaagatg

SEQ ID NO: 149013 - DNA, 103 bp, Artificial Sequence
  Synthetic Polynucleotide
taatacgactcactatagggcagcatttttaccatctcctccaatgagtgaacagaggagacactcaatggaggagatgaacctggcggcagcgcaaaagatg

SEQ ID NO: 149014 - DNA, 103 bp, Artificial Sequence
  Synthetic Polynucleotide
taatacgactcactatagggttcactgatccagcatttttaccatctcctaacagaggagaaggagaatgtaaaaatgcaacctggcggcagcgcaaaagatg

SEQ ID NO: 149015 - DNA, 103 bp, Artificial Sequence
  Synthetic Polynucleotide
taatacgactcactatagggggggtcaactttcactgatccagcatttttaacagaggagaaaaaatatgggatcagtgaacctggcggcagcgcaaaagatg

SEQ ID NO: 149016 - DNA, 103 bp, Artificial Sequence
  Synthetic Polynucleotide
taatacgactcactatagggacatggaggtggggtcaactttcactgatcaacagaggagagatcagatgaagttgaccaacctggcggcagcgcaaaagatg

SEQ ID NO: 149017 - DNA, 103 bp, Artificial Sequence
  Synthetic Polynucleotide
taatacgactcactatagggtccagtggagacatggaggtggggtcaactaacagaggagaagttgaatgcacctccataacctggcggcagcgcaaaagatg

SEQ ID NO: 149018 - DNA, 103 bp, Artificial Sequence
  Synthetic Polynucleotide
taatacgactcactatagggacttggaatttccagtggagacatggaggtaacagaggagaacctccatgtctccactgaacctggcggcagcgcaaaagatg

SEQ ID NO: 149019 - DNA, 103 bp, Artificial Sequence
  Synthetic Polynucleotide
taatacgactcactatagggcctcactgtcacttggaatttccagtggagaacagaggagactccacatgaaattccaaaacctggcggcagcgcaaaagatg

SEQ ID NO: 149020 - DNA, 103 bp, Artificial Sequence
  Synthetic Polynucleotide
taatacgactcactatagggattgtactctcctcactgtcacttggaattaacagaggagaaattccatgtgacagtgaaacctggcggcagcgcaaaagatg

SEQ ID NO: 149021 - DNA, 103 bp, Artificial Sequence
  Synthetic Polynucleotide
taatacgactcactatagggagcagtgacctgcttgaatacctgcattgaaacagaggagatcaatgatggtattcaagaacctggcggcagcgcaaaagatg

SEQ ID NO: 149022 - DNA, 103 bp, Artificial Sequence
  Synthetic Polynucleotide
taatacgactcactatagggtccactctcaattgtactctcctcactgtcaacagaggagagacagtatggagagtacaaacctggcggcagcgcaaaagatg

SEQ ID NO: 149023 - DNA, 103 bp, Artificial Sequence
  Synthetic Polynucleotide
taatacgactcactatagggaggctgaggatccactctcaattgtactctaacagaggagaagagtaatgttgagagtgaacctggcggcagcgcaaaagatg

SEQ ID NO: 149024 - DNA, 103 bp, Artificial Sequence
  Synthetic Polynucleotide
taatacgactcactatagggagactctgcaaggctgaggatccactctcaaacagaggagatgagagatgatcctcagcaacctggcggcagcgcaaaagatg

SEQ ID NO: 149025 - DNA, 103 bp, Artificial Sequence
  Synthetic Polynucleotide
taatacgactcactatagggtagtccctgcagactctgcaaggctgaggaaacagaggagatcctcaatgttgcagagtaacctggcggcagcgcaaaagatg

SEQ ID NO: 149026 - DNA, 103 bp, Artificial Sequence
  Synthetic Polynucleotide
taatacgactcactatagggtctcttgctgtagtccctgcagactctgcaaacagaggagatgcagaatgtgcagggacaacctggcggcagcgcaaaagatg

SEQ ID NO: 149027 - DNA, 103 bp, Artificial Sequence
  Synthetic Polynucleotide
taatacgactcactatagggaaggcttctctctcttgctgtagtccctgcaacagaggagagcagggatgacagcaagaaacctggcggcagcgcaaaagatg

SEQ ID NO: 149028 - DNA, 103 bp, Artificial Sequence
  Synthetic Polynucleotide
taatacgactcactatagggtccgaacagaagcagtgacctgcttgaataaacagaggagatattcaatgaggtcactgaacctggcggcagcgcaaaagatg

SEQ ID NO: 149029 - DNA, 103 bp, Artificial Sequence
  Synthetic Polynucleotide
taatacgactcactatagggggatctctgttccgaacagaagcagtgaccaacagaggagaggtcacatgttctgttcgaacctggcggcagcgcaaaagatg

SEQ ID NO: 149030 - DNA, 103 bp, Artificial Sequence
  Synthetic Polynucleotide
taatacgactcactatagggggggaagcgccaccgacagctgtgcgccataacagaggagaatggcgatgagctgtcggaacctggcggcagcgcaaaagatg

SEQ ID NO: 149031 - DNA, 103 bp, Artificial Sequence
  Synthetic Polynucleotide
taatacgactcactatagggaagcagcagggccgggacgcgttgccgcggaacagaggagaccgcggatgcgcgtcccgaacctggcggcagcgcaaaagatg

SEQ ID NO: 149032 - DNA, 103 bp, Artificial Sequence
  Synthetic Polynucleotide
taatacgactcactatagggaagtggaggtgttccttccttgtctttccgaacagaggagacggaaaatgaaggaaggaaacctggcggcagcgcaaaagatg

SEQ ID NO: 149033 - DNA, 103 bp, Artificial Sequence
  Synthetic Polynucleotide
taatacgactcactataggggacagaggaactggatgccaagccagacacaacagaggagagtgtctatgttggcatccaacctggcggcagcgcaaaagatg

SEQ ID NO: 149034 - DNA, 103 bp, Artificial Sequence
  Synthetic Polynucleotide
taatacgactcactatagggcaacattcaagacagaggaactggatgccaaacagaggagatggcatatggttcctctgaacctggcggcagcgcaaaagatg

SEQ ID NO: 149035 - DNA, 103 bp, Artificial Sequence
  Synthetic Polynucleotide
taatacgactcactatagggtgcatggatacaacattcaagacagaggaaaacagaggagattcctcatgcttgaatgtaacctggcggcagcgcaaaagatg

SEQ ID NO: 149036 - DNA, 103 bp, Artificial Sequence
  Synthetic Polynucleotide
taatacgactcactatagggtgtggtagtttgcatggatacaacattcaaaacagaggagattgaatatggtatccatgaacctggcggcagcgcaaaagatg

SEQ ID NO: 149037 - DNA, 103 bp, Artificial Sequence
  Synthetic Polynucleotide
taatacgactcactatagggttgtaggggttgtggtagtttgcatggataaacagaggagatatccaatgaaactaccaaacctggcggcagcgcaaaagatg

SEQ ID NO: 149038 - DNA, 103 bp, Artificial Sequence
  Synthetic Polynucleotide
taatacgactcactataggggacgcactacttgtaggggttgtggtagttaacagaggagaaactacatgaacccctacaacctggcggcagcgcaaaagatg

SEQ ID NO: 149039 - DNA, 103 bp, Artificial Sequence
  Synthetic Polynucleotide
taatacgactcactatagggtcctggaactgacgcactacttgtaggggtaacagaggagaacccctatgagtagtgcgaacctggcggcagcgcaaaagatg

SEQ ID NO: 149040 - DNA, 103 bp, Artificial Sequence
  Synthetic Polynucleotide
taatacgactcactatagggaggtgacgtgtcctggaactgacgcactacaacagaggagagtagtgatgcagttccagaacctggcggcagcgcaaaagatg

SEQ ID NO: 149041 - DNA, 103 bp, Artificial Sequence
  Synthetic Polynucleotide
taatacgactcactataggggggttggttaaggtgacgtgtcctggaactaacagaggagaagttccatgacacgtcacaacctggcggcagcgcaaaagatg

SEQ ID NO: 149042 - DNA, 103 bp, Artificial Sequence
  Synthetic Polynucleotide
taatacgactcactatagggaagcaaccttgggttggttaaggtgacgtgaacagaggagacacgtcatgttaaccaacaacctggcggcagcgcaaaagatg

SEQ ID NO: 149043 - DNA, 103 bp, Artificial Sequence
  Synthetic Polynucleotide
taatacgactcactatagggcttcttttgtaagtggaggtgttccttcctaacagaggagaaggaagatgcacctccacaacctggcggcagcgcaaaagatg

SEQ ID NO: 149044 - DNA, 103 bp, Artificial Sequence
  Synthetic Polynucleotide
taatacgactcactatagggctggggtaccaagcaaccttgggttggttaaacagaggagataaccaatgcaaggttgcaacctggcggcagcgcaaaagatg

SEQ ID NO: 149045 - DNA, 103 bp, Artificial Sequence
  Synthetic Polynucleotide
taatacgactcactataggggagccaatatctggggtaccaagcaaccttaacagaggagaaaggttatgtggtaccccaacctggcggcagcgcaaaagatg

SEQ ID NO: 149046 - DNA, 103 bp, Artificial Sequence
  Synthetic Polynucleotide
taatacgactcactatagggattgcttattgagccaatatctggggtaccaacagaggagaggtaccatggatattggcaacctggcggcagcgcaaaagatg

SEQ ID NO: 149047 - DNA, 103 bp, Artificial Sequence
  Synthetic Polynucleotide
taatacgactcactatagggtgattaaaagattgcttattgagccaatataacagaggagaatattgatgcaataagcaaacctggcggcagcgcaaaagatg

SEQ ID NO: 149048 - DNA, 103 bp, Artificial Sequence
  Synthetic Polynucleotide
taatacgactcactatagggtggctagctttgattaaaagattgcttattaacagaggagaaataagatgtcttttaataacctggcggcagcgcaaaagatg

SEQ ID NO: 149049 - DNA, 103 bp, Artificial Sequence
  Synthetic Polynucleotide
taatacgactcactatagggcaggctctgctggctagctttgattaaaagaacagaggagacttttaatgaaagctagcaacctggcggcagcgcaaaagatg

SEQ ID NO: 149050 - DNA, 103 bp, Artificial Sequence
  Synthetic Polynucleotide
taatacgactcactatagggcctgaatccccaggctctgctggctagcttaacagaggagaaagctaatgagcagagccaacctggcggcagcgcaaaagatg

SEQ ID NO: 149051 - DNA, 103 bp, Artificial Sequence
  Synthetic Polynucleotide
taatacgactcactatagggacaggctggtcctgaatccccaggctctgcaacagaggagagcagagatgggggattcaaacctggcggcagcgcaaaagatg

SEQ ID NO: 149052 - DNA, 103 bp, Artificial Sequence
  Synthetic Polynucleotide
taatacgactcactatagggcggtaaagccacaggctggtcctgaatcccaacagaggagagggattatggaccagcctaacctggcggcagcgcaaaagatg

SEQ ID NO: 149053 - DNA, 103 bp, Artificial Sequence
  Synthetic Polynucleotide
taatacgactcactatagggctgaacttggcggtaaagccacaggctggtaacagaggagaaccagcatgtggctttacaacctggcggcagcgcaaaagatg

SEQ ID NO: 149054 - DNA, 103 bp, Artificial Sequence
  Synthetic Polynucleotide
taatacgactcactatagggactgtcttatcttcttttgtaagtggaggtaacagaggagaacctccatgtacaaaagaaacctggcggcagcgcaaaagatg

SEQ ID NO: 149055 - DNA, 103 bp, Artificial Sequence
  Synthetic Polynucleotide
taatacgactcactatagggggaaacattcctgaacttggcggtaaagccaacagaggagaggctttatggccaagttcaacctggcggcagcgcaaaagatg

SEQ ID NO: 149056 - DNA, 103 bp, Artificial Sequence
  Synthetic Polynucleotide
taatacgactcactatagggccccagttgtggaaacattcctgaacttggaacagaggagaccaagtatgggaatgtttaacctggcggcagcgcaaaagatg

SEQ ID NO: 149057 - DNA, 103 bp, Artificial Sequence
  Synthetic Polynucleotide
taatacgactcactatagggtctgtgatgtccccagttgtggaaacattcaacagaggagagaatgtatgcacaactggaacctggcggcagcgcaaaagatg

SEQ ID NO: 149058 - DNA, 103 bp, Artificial Sequence
  Synthetic Polynucleotide
taatacgactcactataggggtagagggggtctgtgatgtccccagttgtaacagaggagaacaactatggacatcacaaacctggcggcagcgcaaaagatg

SEQ ID NO: 149059 - DNA, 103 bp, Artificial Sequence
  Synthetic Polynucleotide
taatacgactcactatagggtattgcagcagtagagggggtctgtgatgtaacagaggagaacatcaatgaccccctctaacctggcggcagcgcaaaagatg

SEQ ID NO: 149060 - DNA, 103 bp, Artificial Sequence
  Synthetic Polynucleotide
taatacgactcactatagggatgccgctgttattgcagcagtagagggggaacagaggagaccccctatgctgctgcaaaacctggcggcagcgcaaaagatg

SEQ ID NO: 149061 - DNA, 103 bp, Artificial Sequence
  Synthetic Polynucleotide
taatacgactcactatagggcagatgctagatgccgctgttattgcagcaaacagaggagatgctgcatgaacagcggcaacctggcggcagcgcaaaagatg

SEQ ID NO: 149062 - DNA, 103 bp, Artificial Sequence
  Synthetic Polynucleotide
taatacgactcactatagggggggagcacacagatgctagatgccgctgtaacagaggagaacagcgatgtctagcatcaacctggcggcagcgcaaaagatg

SEQ ID NO: 149063 - DNA, 103 bp, Artificial Sequence
  Synthetic Polynucleotide
taatacgactcactatagggtctgagtggaggggagcacacagatgctagaacagaggagactagcaatggtgtgctccaacctggcggcagcgcaaaagatg

SEQ ID NO: 149064 - DNA, 103 bp, Artificial Sequence
  Synthetic Polynucleotide
taatacgactcactatagggatgcccgtagtctgagtggaggggagcacaaacagaggagatgtgctatgctccactcaaacctggcggcagcgcaaaagatg

SEQ ID NO: 149065 - DNA, 103 bp, Artificial Sequence
  Synthetic Polynucleotide
taatacgactcactatagggttgtctgacaactgtcttatcttcttttgtaacagaggagaacaaaaatggataagacaaacctggcggcagcgcaaaagatg

SEQ ID NO: 149066 - DNA, 103 bp, Artificial Sequence
  Synthetic Polynucleotide
taatacgactcactatagggagcggctgttatgcccgtagtctgagtggaaacagaggagatccactatgactacgggcaacctggcggcagcgcaaaagatg

SEQ ID NO: 149067 - DNA, 103 bp, Artificial Sequence
  Synthetic Polynucleotide
taatacgactcactatagggcagaaggtgaagcggctgttatgcccgtagaacagaggagactacggatgtaacagccgaacctggcggcagcgcaaaagatg

SEQ ID NO: 149068 - DNA, 103 bp, Artificial Sequence
  Synthetic Polynucleotide
taatacgactcactatagggtctgcttccccagaaggtgaagcggctgttaacagaggagaaacagcatgttcaccttcaacctggcggcagcgcaaaagatg

SEQ ID NO: 149069 - DNA, 103 bp, Artificial Sequence
  Synthetic Polynucleotide
taatacgactcactatagggatagtgttcgtctgcttccccagaaggtgaaacagaggagatcacctatgggggaagcaaacctggcggcagcgcaaaagatg

SEQ ID NO: 149070 - DNA, 103 bp, Artificial Sequence
  Synthetic Polynucleotide
taatacgactcactataggggctgaagctgatagtgttcgtctgcttcccaacagaggagagggaagatgacgaacactaacctggcggcagcgcaaaagatg

SEQ ID NO: 149071 - DNA, 103 bp, Artificial Sequence
  Synthetic Polynucleotide
taatacgactcactatagggtggttcacatgctgaagctgatagtgttcgaacagaggagacgaacaatgtcagcttcaaacctggcggcagcgcaaaagatg

SEQ ID NO: 149072 - DNA, 103 bp, Artificial Sequence
  Synthetic Polynucleotide
taatacgactcactatagggggcaaggagctggttcacatgctgaagctgaacagaggagacagcttatgcatgtgaacaacctggcggcagcgcaaaagatg

SEQ ID NO: 149073 - DNA, 103 bp, Artificial Sequence
  Synthetic Polynucleotide
taatacgactcactatagggcagttttgctggcaaggagctggttcacataacagaggagaatgtgaatgagctccttgaacctggcggcagcgcaaaagatg

SEQ ID NO: 149074 - DNA, 103 bp, Artificial Sequence
  Synthetic Polynucleotide
taatacgactcactataggggaatgaatcccagttttgctggcaaggagcaacagaggagagctcctatgcagcaaaacaacctggcggcagcgcaaaagatg

SEQ ID NO: 149075 - DNA, 103 bp, Artificial Sequence
  Synthetic Polynucleotide
taatacgactcactatagggacgctgggaagaatgaatcccagttttgctaacagaggagaagcaaaatggggattcataacctggcggcagcgcaaaagatg

SEQ ID NO: 149076 - DNA, 103 bp, Artificial Sequence
  Synthetic Polynucleotide
taatacgactcactatagggttcgagggctttgtctgacaactgtcttataacagaggagaataagaatgttgtcagacaacctggcggcagcgcaaaagatg

SEQ ID NO: 149077 - DNA, 103 bp, Artificial Sequence
  Synthetic Polynucleotide
taatacgactcactatagggaatcaagatcacgctgggaagaatgaatccaacagaggagaggattcatgcttcccagcaacctggcggcagcgcaaaagatg

SEQ ID NO: 149078 - DNA, 103 bp, Artificial Sequence
  Synthetic Polynucleotide
taatacgactcactatagggcctgaagcagaatcaagatcacgctgggaaaacagaggagattcccaatgtgatcttgaaacctggcggcagcgcaaaagatg

SEQ ID NO: 149079 - DNA, 103 bp, Artificial Sequence
  Synthetic Polynucleotide
taatacgactcactatagggtacctggggccctgaagcagaatcaagatcaacagaggagagatcttatgtctgcttcaaacctggcggcagcgcaaaagatg

SEQ ID NO: 149080 - DNA, 103 bp, Artificial Sequence
  Synthetic Polynucleotide
taatacgactcactatagggtaaagttggatacctggggccctgaagcagaacagaggagactgcttatgggccccaggaacctggcggcagcgcaaaagatg

SEQ ID NO: 149081 - DNA, 103 bp, Artificial Sequence
  Synthetic Polynucleotide
taatacgactcactatagggaccgtctgggtaaagttggatacctggggcaacagaggagagccccaatgatccaacttaacctggcggcagcgcaaaagatg

SEQ ID NO: 149082 - DNA, 103 bp, Artificial Sequence
  Synthetic Polynucleotide
taatacgactcactatagggaggagcgtctaccgtctgggtaaagttggaaacagaggagatccaacatgacccagacgaacctggcggcagcgcaaaagatg

SEQ ID NO: 149083 - DNA, 103 bp, Artificial Sequence
  Synthetic Polynucleotide
taatacgactcactatagggccatgctattaggagcgtctaccgtctgggaacagaggagacccagaatgtagacgctcaacctggcggcagcgcaaaagatg

SEQ ID NO: 149084 - DNA, 103 bp, Artificial Sequence
  Synthetic Polynucleotide
taatacgactcactatagggtgctccagtcccatgctattaggagcgtctaacagaggagaagacgcatgtaatagcataacctggcggcagcgcaaaagatg

SEQ ID NO: 149085 - DNA, 103 bp, Artificial Sequence
  Synthetic Polynucleotide
taatacgactcactatagggagccttgttctgctccagtcccatgctattaacagaggagaaatagcatgggactggagaacctggcggcagcgcaaaagatg

SEQ ID NO: 149086 - DNA, 103 bp, Artificial Sequence
  Synthetic Polynucleotide
taatacgactcactatagggctgaggataaagccttgttctgctccagtcaacagaggagagactggatgagaacaaggaacctggcggcagcgcaaaagatg

SEQ ID NO: 149087 - DNA, 103 bp, Artificial Sequence
  Synthetic Polynucleotide
taatacgactcactatagggggcttaatccttcgagggctttgtctgacaaacagaggagatgtcagatgaagccctcgaacctggcggcagcgcaaaagatg

SEQ ID NO: 149088 - DNA, 103 bp, Artificial Sequence
  Synthetic Polynucleotide
taatacgactcactataggggcttgcacagctgaggataaagccttgttcaacagaggagagaacaaatgtttatcctcaacctggcggcagcgcaaaagatg

SEQ ID NO: 149089 - DNA, 103 bp, Artificial Sequence
  Synthetic Polynucleotide
taatacgactcactatagggggtggggctggcttgcacagctgaggataaaacagaggagattatccatggctgtgcaaaacctggcggcagcgcaaaagatg

SEQ ID NO: 149090 - DNA, 103 bp, Artificial Sequence
  Synthetic Polynucleotide
taatacgactcactatagggccccaggagaggtggggctggcttgcacagaacagaggagactgtgcatgccagccccaaacctggcggcagcgcaaaagatg

SEQ ID NO: 149091 - DNA, 103 bp, Artificial Sequence
  Synthetic Polynucleotide
taatacgactcactataggggatggagaacccccaggagaggtggggctgaacagaggagacagcccatgctctcctggaacctggcggcagcgcaaaagatg

SEQ ID NO: 149092 - DNA, 103 bp, Artificial Sequence
  Synthetic Polynucleotide
taatacgactcactatagggagatggagaggatggagaacccccaggagaaacagaggagatctcctatgggttctccaaacctggcggcagcgcaaaagatg

SEQ ID NO: 149093 - DNA, 103 bp, Artificial Sequence
  Synthetic Polynucleotide
taatacgactcactataggggctgtccagaagatggagaggatggagaacaacagaggagagttctcatgcctctccataacctggcggcagcgcaaaagatg

SEQ ID NO: 149094 - DNA, 103 bp, Artificial Sequence
  Synthetic Polynucleotide
taatacgactcactatagggcttgctgaccgctgtccagaagatggagagaacagaggagactctccatgttctggacaaacctggcggcagcgcaaaagatg

SEQ ID NO: 149095 - DNA, 103 bp, Artificial Sequence
  Synthetic Polynucleotide
taatacgactcactatagggcactgaagggcttgctgaccgctgtccagaaacagaggagatctggaatgcggtcagcaaacctggcggcagcgcaaaagatg

SEQ ID NO: 149096 - DNA, 103 bp, Artificial Sequence
  Synthetic Polynucleotide
taatacgactcactatagggtgggacccggcactgaagggcttgctgaccaacagaggagaggtcagatggcccttcagaacctggcggcagcgcaaaagatg

SEQ ID NO: 149097 - DNA, 103 bp, Artificial Sequence
  Synthetic Polynucleotide
taatacgactcactatagggttgggtttagtgggacccggcactgaagggaacagaggagacccttcatggccgggtccaacctggcggcagcgcaaaagatg

SEQ ID NO: 149098 - DNA, 103 bp, Artificial Sequence
  Synthetic Polynucleotide
taatacgactcactatagggaatcctaactggcttaatccttcgagggctaacagaggagaagccctatgaggattaagaacctggcggcagcgcaaaagatg

SEQ ID NO: 149099 - DNA, 103 bp, Artificial Sequence
  Synthetic Polynucleotide
taatacgactcactatagggggtttttggtttgggtttagtgggacccggaacagaggagaccgggtatgactaaacccaacctggcggcagcgcaaaagatg

SEQ ID NO: 149100 - DNA, 103 bp, Artificial Sequence
  Synthetic Polynucleotide
taatacgactcactataggggaaaccgtttggtttttggtttgggtttagaacagaggagactaaacatgaaccaaaaaaacctggcggcagcgcaaaagatg

SEQ ID NO: 149101 - DNA, 103 bp, Artificial Sequence
  Synthetic Polynucleotide
taatacgactcactatagggagaggcagctgaaaccgtttggtttttggtaacagaggagaaccaaaatgcaaacggttaacctggcggcagcgcaaaagatg

SEQ ID NO: 149102 - DNA, 103 bp, Artificial Sequence
  Synthetic Polynucleotide
taatacgactcactatagggccctttgtctagaggcagctgaaaccgtttaacagaggagaaaacggatgcagctgcctaacctggcggcagcgcaaaagatg

SEQ ID NO: 149103 - DNA, 103 bp, Artificial Sequence
  Synthetic Polynucleotide
taatacgactcactatagggtcttgccattccctttgtctagaggcagctaacagaggagaagctgcatgtagacaaagaacctggcggcagcgcaaaagatg

SEQ ID NO: 149104 - DNA, 103 bp, Artificial Sequence
  Synthetic Polynucleotide
taatacgactcactatagggactttgtgcttcttgccattccctttgtctaacagaggagaagacaaatggaatggcaaaacctggcggcagcgcaaaagatg

SEQ ID NO: 149105 - DNA, 103 bp, Artificial Sequence
  Synthetic Polynucleotide
taatacgactcactatagggcaaatgggaaactttgtgcttcttgccattaacagaggagaaatggcatgaagcacaaaaacctggcggcagcgcaaaagatg

SEQ ID NO: 149106 - DNA, 103 bp, Artificial Sequence
  Synthetic Polynucleotide
taatacgactcactatagggaactggtccgcaaatgggaaactttgtgctaacagaggagaagcacaatgtttcccattaacctggcggcagcgcaaaagatg

SEQ ID NO: 149107 - DNA, 103 bp, Artificial Sequence
  Synthetic Polynucleotide
taatacgactcactataggggcttcagaagaactggtccgcaaatgggaaaacagaggagattcccaatggcggaccagaacctggcggcagcgcaaaagatg

SEQ ID NO: 149108 - DNA, 103 bp, Artificial Sequence
  Synthetic Polynucleotide
taatacgactcactatagggtggaatgtgtgcttcagaagaactggtccgaacagaggagacggaccatgtcttctgaaaacctggcggcagcgcaaaagatg

SEQ ID NO: 149109 - DNA, 103 bp, Artificial Sequence
  Synthetic Polynucleotide
taatacgactcactatagggaagaaggaataatcctaactggcttaatccaacagaggagaggattaatgcagttaggaaacctggcggcagcgcaaaagatg

SEQ ID NO: 149110 - DNA, 103 bp, Artificial Sequence
  Synthetic Polynucleotide
taatacgactcactatagggtttcttggtctggaatgtgtgcttcagaagaacagaggagacttctgatgcacacattcaacctggcggcagcgcaaaagatg

SEQ ID NO: 149111 - DNA, 103 bp, Artificial Sequence
  Synthetic Polynucleotide
taatacgactcactatagggagggatgtcgtttcttggtctggaatgtgtaacagaggagaacacatatgagaccaagaaacctggcggcagcgcaaaagatg

SEQ ID NO: 149112 - DNA, 103 bp, Artificial Sequence
  Synthetic Polynucleotide
taatacgactcactataggggcctgaggtcagggatgtcgtttcttggtcaacagaggagagaccaaatgacgacatccaacctggcggcagcgcaaaagatg

SEQ ID NO: 149113 - DNA, 103 bp, Artificial Sequence
  Synthetic Polynucleotide
taatacgactcactataggggagtccctgtgcctgaggtcagggatgtcgaacagaggagacgacatatgtgacctcagaacctggcggcagcgcaaaagatg

SEQ ID NO: 149114 - DNA, 103 bp, Artificial Sequence
  Synthetic Polynucleotide
taatacgactcactatagggtctgctcctggagtccctgtgcctgaggtcaacagaggagagacctcatgcacagggacaacctggcggcagcgcaaaagatg

SEQ ID NO: 149115 - DNA, 103 bp, Artificial Sequence
  Synthetic Polynucleotide
taatacgactcactatagggctgctcagcctctgctcctggagtccctgtaacagaggagaacagggatgccaggagcaaacctggcggcagcgcaaaagatg

SEQ ID NO: 149116 - DNA, 103 bp, Artificial Sequence
  Synthetic Polynucleotide
taatacgactcactatagggctgtatcctgctgctcagcctctgctcctgaacagaggagacaggagatgaggctgagcaacctggcggcagcgcaaaagatg

SEQ ID NO: 149117 - DNA, 103 bp, Artificial Sequence
  Synthetic Polynucleotide
taatacgactcactatagggtccacgctagctgtatcctgctgctcagccaacagaggagaggctgaatggcaggatacaacctggcggcagcgcaaaagatg

SEQ ID NO: 149118 - DNA, 103 bp, Artificial Sequence
  Synthetic Polynucleotide
taatacgactcactatagggggaggactgctccacgctagctgtatcctgaacagaggagacaggatatggctagcgtgaacctggcggcagcgcaaaagatg

SEQ ID NO: 149119 - DNA, 103 bp, Artificial Sequence
  Synthetic Polynucleotide
taatacgactcactatagggactccttctgggaggactgctccacgctagaacagaggagactagcgatgagcagtcctaacctggcggcagcgcaaaagatg

SEQ ID NO: 149120 - DNA, 103 bp, Artificial Sequence
  Synthetic Polynucleotide
taatacgactcactataggggtcctttttgaagaaggaataatcctaactaacagaggagaagttagatgtattccttcaacctggcggcagcgcaaaagatg

SEQ ID NO: 149121 - DNA, 103 bp, Artificial Sequence
  Synthetic Polynucleotide
taatacgactcactatagggggttgcccacactccttctgggaggactgcaacagaggagagcagtcatgccagaaggaaacctggcggcagcgcaaaagatg

SEQ ID NO: 149122 - DNA, 103 bp, Artificial Sequence
  Synthetic Polynucleotide
taatacgactcactatagggttgccctgcaggttgcccacactccttctgaacagaggagacagaagatgtgtgggcaaaacctggcggcagcgcaaaagatg

SEQ ID NO: 149123 - DNA, 103 bp, Artificial Sequence
  Synthetic Polynucleotide
taatacgactcactataggggaacagcgacttgccctgcaggttgcccacaacagaggagagtgggcatgctgcagggcaacctggcggcagcgcaaaagatg

SEQ ID NO: 149124 - DNA, 103 bp, Artificial Sequence
  Synthetic Polynucleotide
taatacgactcactatagggacttccggaagaacagcgacttgccctgcaaacagaggagatgcaggatgagtcgctgtaacctggcggcagcgcaaaagatg

SEQ ID NO: 149125 - DNA, 103 bp, Artificial Sequence
  Synthetic Polynucleotide
taatacgactcactatagggggtcacctgaacttccggaagaacagcgacaacagaggagagtcgctatgcttccggaaaacctggcggcagcgcaaaagatg

SEQ ID NO: 149126 - DNA, 103 bp, Artificial Sequence
  Synthetic Polynucleotide
taatacgactcactatagggctggattttgggtcacctgaacttccggaaaacagaggagattccggatgttcaggtgaaacctggcggcagcgcaaaagatg

SEQ ID NO: 149127 - DNA, 103 bp, Artificial Sequence
  Synthetic Polynucleotide
taatacgactcactatagggtgttcatttgctggattttgggtcacctgaaacagaggagatcaggtatgccaaaatccaacctggcggcagcgcaaaagatg

SEQ ID NO: 149128 - DNA, 103 bp, Artificial Sequence
  Synthetic Polynucleotide
taatacgactcactatagggtgcactttcttgttcatttgctggattttgaacagaggagacaaaatatggcaaatgaaaacctggcggcagcgcaaaagatg

SEQ ID NO: 149129 - DNA, 103 bp, Artificial Sequence
  Synthetic Polynucleotide
taatacgactcactatagggttttaggttctgcactttcttgttcatttgaacagaggagacaaatgatgaagaaagtgaacctggcggcagcgcaaaagatg

SEQ ID NO: 149130 - DNA, 103 bp, Artificial Sequence
  Synthetic Polynucleotide
taatacgactcactatagggtcttccactgttttaggttctgcactttctaacagaggagaagaaagatgagaacctaaaacctggcggcagcgcaaaagatg

SEQ ID NO: 149131 - DNA, 103 bp, Artificial Sequence
  Synthetic Polynucleotide
taatacgactcactatagggggttgcatctgtcctttttgaagaaggaataacagaggagaattcctatgtcaaaaaggaacctggcggcagcgcaaaagatg

SEQ ID NO: 149132 - DNA, 103 bp, Artificial Sequence
  Synthetic Polynucleotide
taatacgactcactatagggactttcctcttcttccactgttttaggttcaacagaggagagaacctatgacagtggaaaacctggcggcagcgcaaaagatg

SEQ ID NO: 149133 - DNA, 103 bp, Artificial Sequence
  Synthetic Polynucleotide
taatacgactcactatagggagctgaaattactttcctcttcttccactgaacagaggagacagtggatgaagaggaaaaacctggcggcagcgcaaaagatg

SEQ ID NO: 149134 - DNA, 103 bp, Artificial Sequence
  Synthetic Polynucleotide
taatacgactcactatagggatcagtggggagctgaaattactttcctctaacagaggagaagaggaatgtaatttcagaacctggcggcagcgcaaaagatg

SEQ ID NO: 149135 - DNA, 103 bp, Artificial Sequence
  Synthetic Polynucleotide
taatacgactcactatagggaagccaaagcatcagtggggagctgaaattaacagaggagaaatttcatgtccccactgaacctggcggcagcgcaaaagatg

SEQ ID NO: 149136 - DNA, 103 bp, Artificial Sequence
  Synthetic Polynucleotide
taatacgactcactataggggttcttgctgaagccaaagcatcagtggggaacagaggagaccccacatgtgctttggcaacctggcggcagcgcaaaagatg

SEQ ID NO: 149137 - DNA, 103 bp, Artificial Sequence
  Synthetic Polynucleotide
taatacgactcactatagggttccgcttttgttcttgctgaagccaaagcaacagaggagagctttgatgtcagcaagaaacctggcggcagcgcaaaagatg

SEQ ID NO: 149138 - DNA, 103 bp, Artificial Sequence
  Synthetic Polynucleotide
taatacgactcactatagggaatgctttccttccgcttttgttcttgctgaacagaggagacagcaaatgcaaaagcggaacctggcggcagcgcaaaagatg

SEQ ID NO: 149139 - DNA, 103 bp, Artificial Sequence
  Synthetic Polynucleotide
taatacgactcactatagggttttctcagtaatgctttccttccgcttttaacagaggagaaaaagcatgaggaaagcaaacctggcggcagcgcaaaagatg

SEQ ID NO: 149140 - DNA, 103 bp, Artificial Sequence
  Synthetic Polynucleotide
taatacgactcactatagggttcttgggttttttctcagtaatgctttccaacagaggagaggaaagatgtactgagaaaacctggcggcagcgcaaaagatg

SEQ ID NO: 149141 - DNA, 103 bp, Artificial Sequence
  Synthetic Polynucleotide
taatacgactcactatagggaacaagtcctttcttgggttttttctcagtaacagaggagaactgagatgaaacccaagaacctggcggcagcgcaaaagatg

SEQ ID NO: 149142 - DNA, 103 bp, Artificial Sequence
  Synthetic Polynucleotide
taatacgactcactataggggcccggggggaagcagcagggccgggacgcaacagaggagagcgtccatgccctgctgcaacctggcggcagcgcaaaagatg

SEQ ID NO: 149143 - DNA, 103 bp, Artificial Sequence
  Synthetic Polynucleotide
taatacgactcactataggggcttagcaatggttgcatctgtcctttttgaacagaggagacaaaaaatgcagatgcaaaacctggcggcagcgcaaaagatg

SEQ ID NO: 149144 - DNA, 103 bp, Artificial Sequence
  Synthetic Polynucleotide
taatacgactcactatagggaaatttcaaaaacaagtcctttcttgggttaacagaggagaaacccaatgaaggacttgaacctggcggcagcgcaaaagatg

SEQ ID NO: 149145 - DNA, 103 bp, Artificial Sequence
  Synthetic Polynucleotide
taatacgactcactatagggtcatcactggaaatttcaaaaacaagtcctaacagaggagaaggactatgttttgaaataacctggcggcagcgcaaaagatg

SEQ ID NO: 149146 - DNA, 103 bp, Artificial Sequence
  Synthetic Polynucleotide
taatacgactcactatagggctgaaagccatcatcactggaaatttcaaaaacagaggagatttgaaatgtccagtgataacctggcggcagcgcaaaagatg

SEQ ID NO: 149147 - DNA, 103 bp, Artificial Sequence
  Synthetic Polynucleotide
taatacgactcactatagggctgcacagatctgaaagccatcatcactggaacagaggagaccagtgatgatggctttcaacctggcggcagcgcaaaagatg

SEQ ID NO: 149148 - DNA, 103 bp, Artificial Sequence
  Synthetic Polynucleotide
taatacgactcactatagggtcaatactttctgcacagatctgaaagccaaacagaggagatggcttatggatctgtgcaacctggcggcagcgcaaaagatg

SEQ ID NO: 149149 - DNA, 103 bp, Artificial Sequence
  Synthetic Polynucleotide
taatacgactcactatagggccaggcatcttcaatactttctgcacagataacagaggagaatctgtatggaaagtattaacctggcggcagcgcaaaagatg

SEQ ID NO: 149150 - DNA, 103 bp, Artificial Sequence
  Synthetic Polynucleotide
taatacgactcactatagggtcaatgacttccaggcatcttcaatactttaacagaggagaaaagtaatgaagatgcctaacctggcggcagcgcaaaagatg

SEQ ID NO: 149151 - DNA, 103 bp, Artificial Sequence
  Synthetic Polynucleotide
taatacgactcactatagggactttatctgtcaatgacttccaggcatctaacagaggagaagatgcatggaagtcattaacctggcggcagcgcaaaagatg

SEQ ID NO: 149152 - DNA, 103 bp, Artificial Sequence
  Synthetic Polynucleotide
taatacgactcactatagggagcttcctggactttatctgtcaatgacttaacagaggagaaagtcaatgacagataaaaacctggcggcagcgcaaaagatg

SEQ ID NO: 149153 - DNA, 103 bp, Artificial Sequence
  Synthetic Polynucleotide
taatacgactcactatagggcatttgatcgagcttcctggactttatctgaacagaggagacagataatgtccaggaagaacctggcggcagcgcaaaagatg

SEQ ID NO: 149154 - DNA, 103 bp, Artificial Sequence
  Synthetic Polynucleotide
taatacgactcactatagggtgtaagagttgcttagcaatggttgcatctaacagaggagaagatgcatgcattgctaaaacctggcggcagcgcaaaagatg

SEQ ID NO: 149155 - DNA, 103 bp, Artificial Sequence
  Synthetic Polynucleotide
taatacgactcactatagggtttaggcgggcatttgatcgagcttcctggaacagaggagaccaggaatgtcgatcaaaaacctggcggcagcgcaaaagatg

SEQ ID NO: 149156 - DNA, 103 bp, Artificial Sequence
  Synthetic Polynucleotide
taatacgactcactatagggtgagagctgctttaggcgggcatttgatcgaacagaggagacgatcaatggcccgcctaaacctggcggcagcgcaaaagatg

SEQ ID NO: 149157 - DNA, 103 bp, Artificial Sequence
  Synthetic Polynucleotide
taatacgactcactatagggcacctgcaaatgagagctgctttaggcgggaacagaggagacccgccatgagcagctctaacctggcggcagcgcaaaagatg

SEQ ID NO: 149158 - DNA, 103 bp, Artificial Sequence
  Synthetic Polynucleotide
taatacgactcactatagggaaaccgttaacacctgcaaatgagagctgcaacagaggagagcagctatgatttgcaggaacctggcggcagcgcaaaagatg

SEQ ID NO: 149159 - DNA, 103 bp, Artificial Sequence
  Synthetic Polynucleotide
taatacgactcactatagggcagcatcctcaaaccgttaacacctgcaaaaacagaggagatttgcaatggttaacggtaacctggcggcagcgcaaaagatg

SEQ ID NO: 149160 - DNA, 103 bp, Artificial Sequence
  Synthetic Polynucleotide
taatacgactcactatagggggagaatccccagcatcctcaaaccgttaaaacagaggagattaacgatgtgaggatgcaacctggcggcagcgcaaaagatg

SEQ ID NO: 149161 - DNA, 103 bp, Artificial Sequence
  Synthetic Polynucleotide
taatacgactcactatagggactgcatcatggagaatccccagcatcctcaacagaggagagaggatatgggggattctaacctggcggcagcgcaaaagatg

SEQ ID NO: 149162 - DNA, 103 bp, Artificial Sequence
  Synthetic Polynucleotide
taatacgactcactataggggaggaacacaactgcatcatggagaatcccaacagaggagagggattatgcatgatgcaaacctggcggcagcgcaaaagatg

SEQ ID NO: 149163 - DNA, 103 bp, Artificial Sequence
  Synthetic Polynucleotide
taatacgactcactataggggctgctcaatgaggaacacaactgcatcataacagaggagaatgatgatgttgtgttccaacctggcggcagcgcaaaagatg

SEQ ID NO: 149164 - DNA, 103 bp, Artificial Sequence
  Synthetic Polynucleotide
taatacgactcactataggggcaccagacagctgctcaatgaggaacacaaacagaggagatgtgttatgcattgagcaaacctggcggcagcgcaaaagatg

SEQ ID NO: 149165 - DNA, 103 bp, Artificial Sequence
  Synthetic Polynucleotide
taatacgactcactatagggttttgccctctgtaagagttgcttagcaataacagaggagaattgctatgcaactcttaaacctggcggcagcgcaaaagatg

SEQ ID NO: 149166 - DNA, 103 bp, Artificial Sequence
  Synthetic Polynucleotide
taatacgactcactatagggacagtgcttggcaccagacagctgctcaataacagaggagaattgagatgctgtctggtaacctggcggcagcgcaaaagatg

SEQ ID NO: 149167 - DNA, 103 bp, Artificial Sequence
  Synthetic Polynucleotide
taatacgactcactatagggtgtaatttcgacagtgcttggcaccagacaaacagaggagatgtctgatgccaagcactaacctggcggcagcgcaaaagatg

SEQ ID NO: 149168 - DNA, 103 bp, Artificial Sequence
  Synthetic Polynucleotide
taatacgactcactatagggaaacggaatttgtaatttcgacagtgcttgaacagaggagacaagcaatgtcgaaattaaacctggcggcagcgcaaaagatg

SEQ ID NO: 149169 - DNA, 103 bp, Artificial Sequence
  Synthetic Polynucleotide
taatacgactcactatagggtggcttgtggaaacggaatttgtaatttcgaacagaggagacgaaatatgaaattccgtaacctggcggcagcgcaaaagatg

SEQ ID NO: 149170 - DNA, 103 bp, Artificial Sequence
  Synthetic Polynucleotide
taatacgactcactatagggtggcctcctctggcttgtggaaacggaattaacagaggagaaattccatgtccacaagcaacctggcggcagcgcaaaagatg

SEQ ID NO: 149171 - DNA, 103 bp, Artificial Sequence
  Synthetic Polynucleotide
taatacgactcactataggggggggttcattggcctcctctggcttgtggaacagaggagaccacaaatgagaggaggcaacctggcggcagcgcaaaagatg

SEQ ID NO: 149172 - DNA, 103 bp, Artificial Sequence
  Synthetic Polynucleotide
taatacgactcactatagggagggttcaaggggggttcattggcctcctcaacagaggagagaggagatgaatgaacccaacctggcggcagcgcaaaagatg

SEQ ID NO: 149173 - DNA, 103 bp, Artificial Sequence
  Synthetic Polynucleotide
taatacgactcactatagggctgagccgtgagggttcaaggggggttcataacagaggagaatgaacatgccttgaaccaacctggcggcagcgcaaaagatg

SEQ ID NO: 149174 - DNA, 103 bp, Artificial Sequence
  Synthetic Polynucleotide
taatacgactcactatagggtcagccctggctgagccgtgagggttcaagaacagaggagacttgaaatgtcacggctcaacctggcggcagcgcaaaagatg

SEQ ID NO: 149175 - DNA, 103 bp, Artificial Sequence
  Synthetic Polynucleotide
taatacgactcactataggggaggtggacttcagccctggctgagccgtgaacagaggagacacggcatggccagggctaacctggcggcagcgcaaaagatg

SEQ ID NO: 149176 - DNA, 103 bp, Artificial Sequence
  Synthetic Polynucleotide
taatacgactcactataggggagcccccttttttgccctctgtaagagttaacagaggagaaactctatgagagggcaaaacctggcggcagcgcaaaagatg

SEQ ID NO: 149177 - DNA, 103 bp, Artificial Sequence
  Synthetic Polynucleotide
taatacgactcactatagggctgacttcctgaggtggacttcagccctggaacagaggagaccagggatgaagtccaccaacctggcggcagcgcaaaagatg

SEQ ID NO: 149178 - DNA, 103 bp, Artificial Sequence
  Synthetic Polynucleotide
taatacgactcactatagggatgtcaaatgctgacttcctgaggtggactaacagaggagaagtccaatgcaggaagtcaacctggcggcagcgcaaaagatg

SEQ ID NO: 149179 - DNA, 103 bp, Artificial Sequence
  Synthetic Polynucleotide
taatacgactcactataggggaagttaaacatgtcaaatgctgacttcctaacagaggagaaggaagatggcatttgacaacctggcggcagcgcaaaagatg

SEQ ID NO: 149180 - DNA, 103 bp, Artificial Sequence
  Synthetic Polynucleotide
taatacgactcactatagggtagaagccaggaagttaaacatgtcaaatgaacagaggagacatttgatgtgtttaactaacctggcggcagcgcaaaagatg

SEQ ID NO: 149181 - DNA, 103 bp, Artificial Sequence
  Synthetic Polynucleotide
taatacgactcactatagggtgacgatgtttagaagccaggaagttaaacaacagaggagagtttaaatgcctggcttcaacctggcggcagcgcaaaagatg

SEQ ID NO: 149182 - DNA, 103 bp, Artificial Sequence
  Synthetic Polynucleotide
taatacgactcactatagggttcaggaggctgacgatgtttagaagccagaacagaggagactggctatgaaacatcgtaacctggcggcagcgcaaaagatg

SEQ ID NO: 149183 - DNA, 103 bp, Artificial Sequence
  Synthetic Polynucleotide
taatacgactcactatagggtggggttgtattcaggaggctgacgatgttaacagaggagaaacatcatgagcctcctgaacctggcggcagcgcaaaagatg

SEQ ID NO: 149184 - DNA, 103 bp, Artificial Sequence
  Synthetic Polynucleotide
taatacgactcactatagggtcttcatcattggggttgtattcaggaggcaacagaggagagcctccatgatacaacccaacctggcggcagcgcaaaagatg

SEQ ID NO: 149185 - DNA, 103 bp, Artificial Sequence
  Synthetic Polynucleotide
taatacgactcactatagggctcctcctcttcttcatcattggggttgtaaacagaggagatacaacatgaatgatgaaaacctggcggcagcgcaaaagatg

SEQ ID NO: 149186 - DNA, 103 bp, Artificial Sequence
  Synthetic Polynucleotide
taatacgactcactatagggtcagctgtacctcctcctcttcttcatcataacagaggagaatgatgatgaagaggaggaacctggcggcagcgcaaaagatg

SEQ ID NO: 149187 - DNA, 103 bp, Artificial Sequence
  Synthetic Polynucleotide
taatacgactcactatagggattttcttttgagcccccttttttgccctcaacagaggagagagggcatgaaagggggcaacctggcggcagcgcaaaagatg

SEQ ID NO: 149188 - DNA, 103 bp, Artificial Sequence
  Synthetic Polynucleotide
taatacgactcactatagggcgagctgacttcagctgtacctcctcctctaacagaggagaagaggaatgggtacagctaacctggcggcagcgcaaaagatg

SEQ ID NO: 149189 - DNA, 103 bp, Artificial Sequence
  Synthetic Polynucleotide
taatacgactcactatagggagttgccctccgagctgacttcagctgtacaacagaggagagtacagatgaagtcagctaacctggcggcagcgcaaaagatg

SEQ ID NO: 149190 - DNA, 103 bp, Artificial Sequence
  Synthetic Polynucleotide
taatacgactcactataggggatccatgctagttgccctccgagctgactaacagaggagaagtcagatgggagggcaaaacctggcggcagcgcaaaagatg

SEQ ID NO: 149191 - DNA, 103 bp, Artificial Sequence
  Synthetic Polynucleotide
taatacgactcactatagggggcattggcagatccatgctagttgccctcaacagaggagagagggcatgtagcatggaaacctggcggcagcgcaaaagatg

SEQ ID NO: 149192 - DNA, 103 bp, Artificial Sequence
  Synthetic Polynucleotide
taatacgactcactataggggaagcgcatgggcattggcagatccatgctaacagaggagaagcatgatgctgccaatgaacctggcggcagcgcaaaagatg

SEQ ID NO: 149193 - DNA, 103 bp, Artificial Sequence
  Synthetic Polynucleotide
taatacgactcactatagggttaagtgccggaagcgcatgggcattggcaaacagaggagatgccaaatgccatgcgctaacctggcggcagcgcaaaagatg

SEQ ID NO: 149194 - DNA, 103 bp, Artificial Sequence
  Synthetic Polynucleotide
taatacgactcactataggggaagtcttttttaagtgccggaagcgcatgaacagaggagacatgcgatgccggcacttaacctggcggcagcgcaaaagatg

SEQ ID NO: 149195 - DNA, 103 bp, Artificial Sequence
  Synthetic Polynucleotide
taatacgactcactatagggtgcctccttagaagtcttttttaagtgccgaacagaggagacggcacatgaaaaagactaacctggcggcagcgcaaaagatg

SEQ ID NO: 149196 - DNA, 103 bp, Artificial Sequence
  Synthetic Polynucleotide
taatacgactcactatagggagacaccaactgcctccttagaagtcttttaacagaggagaaaaagaatgctaaggaggaacctggcggcagcgcaaaagatg

SEQ ID NO: 149197 - DNA, 103 bp, Artificial Sequence
  Synthetic Polynucleotide
taatacgactcactatagggggagacctgtagacaccaactgcctccttaaacagaggagataaggaatgagttggtgtaacctggcggcagcgcaaaagatg

SEQ ID NO: 149198 - DNA, 103 bp, Artificial Sequence
  Synthetic Polynucleotide
taatacgactcactatagggttctttttcaattttcttttgagcccccttaacagaggagaaaggggatgcaaaagaaaaacctggcggcagcgcaaaagatg

SEQ ID NO: 149199 - DNA, 103 bp, Artificial Sequence
  Synthetic Polynucleotide
taatacgactcactataggggccatggatgggagacctgtagacaccaacaacagaggagagttggtatgtacaggtctaacctggcggcagcgcaaaagatg

SEQ ID NO: 149200 - DNA, 103 bp, Artificial Sequence
  Synthetic Polynucleotide
taatacgactcactatagggaaagaccccggccatggatgggagacctgtaacagaggagaacaggtatgccatccatgaacctggcggcagcgcaaaagatg

SEQ ID NO: 149201 - DNA, 103 bp, Artificial Sequence
  Synthetic Polynucleotide
taatacgactcactatagggctcttacagaaaagaccccggccatggatgaacagaggagacatccaatgccggggtctaacctggcggcagcgcaaaagatg

SEQ ID NO: 149202 - DNA, 103 bp, Artificial Sequence
  Synthetic Polynucleotide
taatacgactcactatagggatcaatgtttctcttacagaaaagaccccgaacagaggagacggggtatgttctgtaagaacctggcggcagcgcaaaagatg

SEQ ID NO: 149203 - DNA, 103 bp, Artificial Sequence
  Synthetic Polynucleotide
taatacgactcactatagggtctcacctgcatcaatgtttctcttacagaaacagaggagatctgtaatggaaacattgaacctggcggcagcgcaaaagatg

SEQ ID NO: 149204 - DNA, 103 bp, Artificial Sequence
  Synthetic Polynucleotide
taatacgactcactatagggtcaatcaccatctcacctgcatcaatgtttaacagaggagaaaacatatgtgcaggtgaaacctggcggcagcgcaaaagatg

SEQ ID NO: 149205 - DNA, 103 bp, Artificial Sequence
  Synthetic Polynucleotide
taatacgactcactataggggccggcatactcaatcaccatctcacctgcaacagaggagagcaggtatgatggtgattaacctggcggcagcgcaaaagatg

SEQ ID NO: 149206 - DNA, 103 bp, Artificial Sequence
  Synthetic Polynucleotide
taatacgactcactatagggggatgacgttgccggcatactcaatcaccaaacagaggagatggtgaatgagtatgccgaacctggcggcagcgcaaaagatg

SEQ ID NO: 149207 - DNA, 103 bp, Artificial Sequence
  Synthetic Polynucleotide
taatacgactcactatagggtggatggagcggatgacgttgccggcatacaacagaggagagtatgcatgcaacgtcataacctggcggcagcgcaaaagatg

SEQ ID NO: 149208 - DNA, 103 bp, Artificial Sequence
  Synthetic Polynucleotide
taatacgactcactatagggcttgtcagtctggatggagcggatgacgttaacagaggagaaacgtcatgcgctccatcaacctggcggcagcgcaaaagatg

SEQ ID NO: 149209 - DNA, 103 bp, Artificial Sequence
  Synthetic Polynucleotide
taatacgactcactataggggctgagctgcttctttttcaattttcttttaacagaggagaaaaagaatgttgaaaaagaacctggcggcagcgcaaaagatg

SEQ ID NO: 149210 - DNA, 103 bp, Artificial Sequence
  Synthetic Polynucleotide
taatacgactcactatagggacttttcccgcttgtcagtctggatggagcaacagaggagagctccaatgagactgacaaacctggcggcagcgcaaaagatg

SEQ ID NO: 149211 - DNA, 103 bp, Artificial Sequence
  Synthetic Polynucleotide
taatacgactcactatagggctgtcgtaatacttttcccgcttgtcagtcaacagaggagagactgaatggcgggaaaaaacctggcggcagcgcaaaagatg

SEQ ID NO: 149212 - DNA, 103 bp, Artificial Sequence
  Synthetic Polynucleotide
taatacgactcactatagggaatgcccttgctgtcgtaatacttttcccgaacagaggagacgggaaatgtattacgacaacctggcggcagcgcaaaagatg

SEQ ID NO: 149213 - DNA, 103 bp, Artificial Sequence
  Synthetic Polynucleotide
taatacgactcactatagggtatagcaaccaatgcccttgctgtcgtaataacagaggagaattacgatggcaagggcaaacctggcggcagcgcaaaagatg

SEQ ID NO: 149214 - DNA, 103 bp, Artificial Sequence
  Synthetic Polynucleotide
taatacgactcactatagggattcggaacatatagcaaccaatgcccttgaacagaggagacaagggatgtggttgctaaacctggcggcagcgcaaaagatg

SEQ ID NO: 149215 - DNA, 103 bp, Artificial Sequence
  Synthetic Polynucleotide
taatacgactcactatagggtgagtcatcaattcggaacatatagcaaccaacagaggagaggttgcatgatgttccgaaacctggcggcagcgcaaaagatg

SEQ ID NO: 149216 - DNA, 103 bp, Artificial Sequence
  Synthetic Polynucleotide
taatacgactcactatagggccactacctctgagtcatcaattcggaacaaacagaggagatgttccatgttgatgactaacctggcggcagcgcaaaagatg

SEQ ID NO: 149217 - DNA, 103 bp, Artificial Sequence
  Synthetic Polynucleotide
taatacgactcactatagggatggtggcatccactacctctgagtcatcaaacagaggagatgatgaatgagaggtagtaacctggcggcagcgcaaaagatg

SEQ ID NO: 149218 - DNA, 103 bp, Artificial Sequence
  Synthetic Polynucleotide
taatacgactcactatagggatttccatgcatggtggcatccactacctcaacagaggagagaggtaatggatgccaccaacctggcggcagcgcaaaagatg

SEQ ID NO: 149219 - DNA, 103 bp, Artificial Sequence
  Synthetic Polynucleotide
taatacgactcactatagggagcgtgcagcatttccatgcatggtggcataacagaggagaatgccaatgtgcatggaaaacctggcggcagcgcaaaagatg

SEQ ID NO: 149220 - DNA, 103 bp, Artificial Sequence
  Synthetic Polynucleotide
taatacgactcactatagggcttccctgcagctgagctgcttctttttcaaacagaggagatgaaaaatgagcagctcaaacctggcggcagcgcaaaagatg

SEQ ID NO: 149221 - DNA, 103 bp, Artificial Sequence
  Synthetic Polynucleotide
taatacgactcactatagggtgattgatgaagcgtgcagcatttccatgcaacagaggagagcatggatgtgctgcacgaacctggcggcagcgcaaaagatg

SEQ ID NO: 149222 - DNA, 103 bp, Artificial Sequence
  Synthetic Polynucleotide
taatacgactcactatagggctcacacgagtgattgatgaagcgtgcagcaacagaggagagctgcaatgttcatcaataacctggcggcagcgcaaaagatg

SEQ ID NO: 149223 - DNA, 103 bp, Artificial Sequence
  Synthetic Polynucleotide
taatacgactcactatagggagcagttaggctcacacgagtgattgatgaaacagaggagatcatcaatgactcgtgtgaacctggcggcagcgcaaaagatg

SEQ ID NO: 149224 - DNA, 103 bp, Artificial Sequence
  Synthetic Polynucleotide
taatacgactcactatagggacccgagaatagcagttaggctcacacgagaacagaggagactcgtgatggcctaactgaacctggcggcagcgcaaaagatg

SEQ ID NO: 149225 - DNA, 103 bp, Artificial Sequence
  Synthetic Polynucleotide
taatacgactcactatagggaatattgatgacccgagaatagcagttaggaacagaggagacctaacatgtattctcggaacctggcggcagcgcaaaagatg

SEQ ID NO: 149226 - DNA, 103 bp, Artificial Sequence
  Synthetic Polynucleotide
taatacgactcactatagggtctgcccatcaatattgatgacccgagaataacagaggagaattctcatgtcatcaataaacctggcggcagcgcaaaagatg

SEQ ID NO: 149227 - DNA, 103 bp, Artificial Sequence
  Synthetic Polynucleotide
taatacgactcactatagggacaatgtgcttctgcccatcaatattgatgaacagaggagacatcaaatgtgatgggcaaacctggcggcagcgcaaaagatg

SEQ ID NO: 149228 - DNA, 103 bp, Artificial Sequence
  Synthetic Polynucleotide
taatacgactcactatagggggcaaagatgacaatgtgcttctgcccatcaacagaggagagatgggatgaagcacattaacctggcggcagcgcaaaagatg

SEQ ID NO: 149229 - DNA, 103 bp, Artificial Sequence
  Synthetic Polynucleotide
taatacgactcactatagggtcttacgcatggcaaagatgacaatgtgctaacagaggagaagcacaatgtcatctttgaacctggcggcagcgcaaaagatg

SEQ ID NO: 149230 - DNA, 103 bp, Artificial Sequence
  Synthetic Polynucleotide
taatacgactcactatagggcctcggtagatcttacgcatggcaaagatgaacagaggagacatcttatgcatgcgtaaaacctggcggcagcgcaaaagatg

SEQ ID NO: 149231 - DNA, 103 bp, Artificial Sequence
  Synthetic Polynucleotide
taatacgactcactatagggcttcacctttcttccctgcagctgagctgcaacagaggagagcagctatgctgcagggaaacctggcggcagcgcaaaagatg

SEQ ID NO: 149232 - DNA, 103 bp, Artificial Sequence
  Synthetic Polynucleotide
taatacgactcactataggggagttcctctcctcggtagatcttacgcataacagaggagaatgcgtatgatctaccgaaacctggcggcagcgcaaaagatg

SEQ ID NO: 149233 - DNA, 103 bp, Artificial Sequence
  Synthetic Polynucleotide
taatacgactcactatagggagtcgtaagtgagttcctctcctcggtagaaacagaggagatctaccatggagaggaacaacctggcggcagcgcaaaagatg

SEQ ID NO: 149234 - DNA, 103 bp, Artificial Sequence
  Synthetic Polynucleotide
taatacgactcactataggggggaacttatagtcgtaagtgagttcctctaacagaggagaagaggaatgcacttacgaaacctggcggcagcgcaaaagatg

SEQ ID NO: 149235 - DNA, 103 bp, Artificial Sequence
  Synthetic Polynucleotide
taatacgactcactatagggatcctcaatggggaacttatagtcgtaagtaacagaggagaacttacatgtataagttcaacctggcggcagcgcaaaagatg

SEQ ID NO: 149236 - DNA, 103 bp, Artificial Sequence
  Synthetic Polynucleotide
taatacgactcactatagggtgttgctggcatcctcaatggggaacttataacagaggagaataagtatgccattgaggaacctggcggcagcgcaaaagatg

SEQ ID NO: 149237 - DNA, 103 bp, Artificial Sequence
  Synthetic Polynucleotide
taatacgactcactatagggcagggcagcttgttgctggcatcctcaatgaacagaggagacattgaatgtgccagcaaaacctggcggcagcgcaaaagatg

SEQ ID NO: 149238 - DNA, 103 bp, Artificial Sequence
  Synthetic Polynucleotide
taatacgactcactataggggccacagttgcagggcagcttgttgctggcaacagaggagagccagcatgaagctgcccaacctggcggcagcgcaaaagatg

SEQ ID NO: 149239 - DNA, 103 bp, Artificial Sequence
  Synthetic Polynucleotide
taatacgactcactatagggatttcttggcgccacagttgcagggcagctaacagaggagaagctgcatggcaactgtgaacctggcggcagcgcaaaagatg

SEQ ID NO: 149240 - DNA, 103 bp, Artificial Sequence
  Synthetic Polynucleotide
taatacgactcactatagggaacttccggcatttcttggcgccacagttgaacagaggagacaactgatgcgccaagaaaacctggcggcagcgcaaaagatg

SEQ ID NO: 149241 - DNA, 103 bp, Artificial Sequence
  Synthetic Polynucleotide
taatacgactcactatagggttagtttaggaacttccggcatttcttggcaacagaggagagccaagatgtgccggaagaacctggcggcagcgcaaaagatg

SEQ ID NO: 149242 - DNA, 103 bp, Artificial Sequence
  Synthetic Polynucleotide
taatacgactcactatagggtgacctgtgtcttcacctttcttccctgcaaacagaggagatgcaggatggaaaggtgaaacctggcggcagcgcaaaagatg

SEQ ID NO: 149243 - DNA, 103 bp, Artificial Sequence
  Synthetic Polynucleotide
taatacgactcactatagggccgaccgggggcccggggggaagcagcaggaacagaggagacctgctatgtccccccggaacctggcggcagcgcaaaagatg

SEQ ID NO: 149244 - DNA, 103 bp, Artificial Sequence
  Synthetic Polynucleotide
taatacgactcactatagggcgaatatttttgacctgtgtcttcacctttaacagaggagaaaaggtatggacacaggtaacctggcggcagcgcaaaagatg

SEQ ID NO: 149245 - DNA, 103 bp, Artificial Sequence
  Synthetic Polynucleotide
taatacgactcactataggggatgaactgtcgaatatttttgacctgtgtaacagaggagaacacagatgaaaaatattaacctggcggcagcgcaaaagatg

SEQ ID NO: 149246 - DNA, 103 bp, Artificial Sequence
  Synthetic Polynucleotide
taatacgactcactatagggcaacaggcatgatgaactgtcgaatattttaacagaggagaaaaataatggacagttcaaacctggcggcagcgcaaaagatg

SEQ ID NO: 149247 - DNA, 103 bp, Artificial Sequence
  Synthetic Polynucleotide
taatacgactcactatagggatagcactgacaacaggcatgatgaactgtaacagaggagaacagttatgcatgcctgtaacctggcggcagcgcaaaagatg

SEQ ID NO: 149248 - DNA, 103 bp, Artificial Sequence
  Synthetic Polynucleotide
taatacgactcactatagggccgcgaggagatagcactgacaacaggcataacagaggagaatgcctatggtcagtgctaacctggcggcagcgcaaaagatg

SEQ ID NO: 149249 - DNA, 103 bp, Artificial Sequence
  Synthetic Polynucleotide
taatacgactcactatagggtcttaatgatccgcgaggagatagcactgaaacagaggagatcagtgatgtctcctcgcaacctggcggcagcgcaaaagatg

SEQ ID NO: 149250 - DNA, 103 bp, Artificial Sequence
  Synthetic Polynucleotide
taatacgactcactatagggcgccgaggggtcttaatgatccgcgaggagaacagaggagactcctcatggatcattaaaacctggcggcagcgcaaaagatg

SEQ ID NO: 149251 - DNA, 103 bp, Artificial Sequence
  Synthetic Polynucleotide
taatacgactcactatagggctctataaaccgccgaggggtcttaatgataacagaggagaatcattatgacccctcggaacctggcggcagcgcaaaagatg

SEQ ID NO: 149252 - DNA, 103 bp, Artificial Sequence
  Synthetic Polynucleotide
taatacgactcactatagggaatcctcatcctctataaaccgccgaggggaacagaggagacccctcatgggtttatagaacctggcggcagcgcaaaagatg

SEQ ID NO: 149253 - DNA, 103 bp, Artificial Sequence
  Synthetic Polynucleotide
taatacgactcactatagggggagggtcataatcctcatcctctataaacaacagaggagagtttatatgggatgaggaaacctggcggcagcgcaaaagatg

SEQ ID NO: 149254 - DNA, 103 bp, Artificial Sequence
  Synthetic Polynucleotide
taatacgactcactataggggccgccaccgccgaccgggggcccggggggaacagaggagaccccccatgcccccggtcaacctggcggcagcgcaaaagatg

SEQ ID NO: 149255 - DNA, 103 bp, Artificial Sequence
  Synthetic Polynucleotide
taatacgactcactatagggaattttaattggagggtcataatcctcatcaacagaggagagatgagatgtatgaccctaacctggcggcagcgcaaaagatg

SEQ ID NO: 149256 - DNA, 103 bp, Artificial Sequence
  Synthetic Polynucleotide
taatacgactcactatagggctaatcgggcaattttaattggagggtcataacagaggagaatgaccatgcaattaaaaaacctggcggcagcgcaaaagatg

SEQ ID NO: 149257 - DNA, 103 bp, Artificial Sequence
  Synthetic Polynucleotide
taatacgactcactatagggggtgtagactctaatcgggcaattttaattaacagaggagaaattaaatgtgcccgattaacctggcggcagcgcaaaagatg

SEQ ID NO: 149258 - DNA, 103 bp, Artificial Sequence
  Synthetic Polynucleotide
taatacgactcactatagggtctactattcggtgtagactctaatcgggcaacagaggagagcccgaatggagtctacaaacctggcggcagcgcaaaagatg

SEQ ID NO: 149259 - DNA, 103 bp, Artificial Sequence
  Synthetic Polynucleotide
taatacgactcactataggggggcactgaatctactattcggtgtagactaacagaggagaagtctaatgcgaatagtaaacctggcggcagcgcaaaagatg

SEQ ID NO: 149260 - DNA, 103 bp, Artificial Sequence
  Synthetic Polynucleotide
taatacgactcactatagggccacaggacggggcactgaatctactattcaacagaggagagaatagatgattcagtgcaacctggcggcagcgcaaaagatg

SEQ ID NO: 149261 - DNA, 103 bp, Artificial Sequence
  Synthetic Polynucleotide
taatacgactcactatagggttcagaagatccacaggacggggcactgaaaacagaggagattcagtatgccgtcctgtaacctggcggcagcgcaaaagatg

SEQ ID NO: 149262 - DNA, 103 bp, Artificial Sequence
  Synthetic Polynucleotide
taatacgactcactatagggcacttgatttttcagaagatccacaggacgaacagaggagacgtcctatggatcttctgaacctggcggcagcgcaaaagatg

SEQ ID NO: 149263 - DNA, 103 bp, Artificial Sequence
  Synthetic Polynucleotide
taatacgactcactatagggtgagaagctgcacttgatttttcagaagataacagaggagaatcttcatgaaaatcaagaacctggcggcagcgcaaaagatg

SEQ ID NO: 149264 - DNA, 103 bp, Artificial Sequence
  Synthetic Polynucleotide
taatacgactcactatagggagaggagtgctgagaagctgcacttgatttaacagaggagaaaatcaatggcagcttctaacctggcggcagcgcaaaagatg

SEQ ID NO: 149265 - DNA, 103 bp, Artificial Sequence
  Synthetic Polynucleotide
taatacgactcactataggggcgccccggggccgccaccgccgaccggggaacagaggagaccccggatggcggtggcgaacctggcggcagcgcaaaagatg

SEQ ID NO: 149266 - DNA, 103 bp, Artificial Sequence
  Synthetic Polynucleotide
taatacgactcactatagggaagacatttgagaggagtgctgagaagctgaacagaggagacagcttatgagcactcctaacctggcggcagcgcaaaagatg

SEQ ID NO: 149267 - DNA, 103 bp, Artificial Sequence
  Synthetic Polynucleotide
taatacgactcactataggggaggagtctgaagacatttgagaggagtgcaacagaggagagcactcatgtcaaatgtcaacctggcggcagcgcaaaagatg

SEQ ID NO: 149268 - DNA, 103 bp, Artificial Sequence
  Synthetic Polynucleotide
taatacgactcactatagggactagatcgagaggagtctgaagacatttgaacagaggagacaaatgatgtcagactccaacctggcggcagcgcaaaagatg

SEQ ID NO: 149269 - DNA, 103 bp, Artificial Sequence
  Synthetic Polynucleotide
taatacgactcactatagggcactggggctactagatcgagaggagtctgaacagaggagacagactatgctcgatctaaacctggcggcagcgcaaaagatg

SEQ ID NO: 149270 - DNA, 103 bp, Artificial Sequence
  Synthetic Polynucleotide
taatacgactcactataggggaggtatcaacactggggctactagatcgaaacagaggagatcgatcatgtagccccagaacctggcggcagcgcaaaagatg

SEQ ID NO: 149271 - DNA, 103 bp, Artificial Sequence
  Synthetic Polynucleotide
taatacgactcactatagggagagtctgtggaggtatcaacactggggctaacagaggagaagccccatggttgataccaacctggcggcagcgcaaaagatg

SEQ ID NO: 149272 - DNA, 103 bp, Artificial Sequence
  Synthetic Polynucleotide
taatacgactcactatagggcagaagcctgagagtctgtggaggtatcaaaacagaggagattgataatgccacagactaacctggcggcagcgcaaaagatg

SEQ ID NO: 149273 - DNA, 103 bp, Artificial Sequence
  Synthetic Polynucleotide
taatacgactcactatagggtgaatctcctcagaagcctgagagtctgtgaacagaggagacacagaatgtcaggcttcaacctggcggcagcgcaaaagatg

SEQ ID NO: 149274 - DNA, 103 bp, Artificial Sequence
  Synthetic Polynucleotide
taatacgactcactatagggaggaagtacctgaatctcctcagaagcctgaacagaggagacaggctatggaggagattaacctggcggcagcgcaaaagatg

SEQ ID NO: 149275 - DNA, 103 bp, Artificial Sequence
  Synthetic Polynucleotide
taatacgactcactatagggtccgctcctcaggaagtacctgaatctcctaacagaggagaaggagaatgaggtacttcaacctggcggcagcgcaaaagatg

SEQ ID NO: 149276 - DNA, 103 bp, Artificial Sequence
  Synthetic Polynucleotide
taatacgactcactatagggggggaggggggcgccccggggccgccaccgaacagaggagacggtggatgccccggggcaacctggcggcagcgcaaaagatg

SEQ ID NO: 149277 - DNA, 103 bp, Artificial Sequence
  Synthetic Polynucleotide
taatacgactcactatagggggggtatcgctccgctcctcaggaagtaccaacagaggagaggtactatgtgaggagcgaacctggcggcagcgcaaaagatg

SEQ ID NO: 149278 - DNA, 103 bp, Artificial Sequence
  Synthetic Polynucleotide
taatacgactcactatagggatgaacttcaggggtatcgctccgctcctcaacagaggagagaggagatgagcgataccaacctggcggcagcgcaaaagatg

SEQ ID NO: 149279 - DNA, 103 bp, Artificial Sequence
  Synthetic Polynucleotide
taatacgactcactataggggcagtggaggatgaacttcaggggtatcgcaacagaggagagcgataatgctgaagttcaacctggcggcagcgcaaaagatg

SEQ ID NO: 149280 - DNA, 103 bp, Artificial Sequence
  Synthetic Polynucleotide
taatacgactcactatagggtgggaaatgggcagtggaggatgaacttcaaacagaggagatgaagtatgtcctccactaacctggcggcagcgcaaaagatg

SEQ ID NO: 149281 - DNA, 103 bp, Artificial Sequence
  Synthetic Polynucleotide
taatacgactcactatagggttctggggactgggaaatgggcagtggaggaacagaggagacctccaatgcccatttccaacctggcggcagcgcaaaagatg

SEQ ID NO: 149282 - DNA, 103 bp, Artificial Sequence
  Synthetic Polynucleotide
taatacgactcactatagggtactctcattttctggggactgggaaatggaacagaggagaccatttatgagtccccagaacctggcggcagcgcaaaagatg

SEQ ID NO: 149283 - DNA, 103 bp, Artificial Sequence
  Synthetic Polynucleotide
taatacgactcactatagggctcctatcattactctcattttctggggacaacagaggagagtccccatgaaatgagagaacctggcggcagcgcaaaagatg

SEQ ID NO: 149284 - DNA, 103 bp, Artificial Sequence
  Synthetic Polynucleotide
taatacgactcactatagggccttctgcttctcctatcattactctcattaacagaggagaaatgagatgaatgataggaacctggcggcagcgcaaaagatg

SEQ ID NO: 149285 - DNA, 103 bp, Artificial Sequence
  Synthetic Polynucleotide
taatacgactcactatagggacactgaataccttctgcttctcctatcataacagaggagaatgataatggaagcagaaaacctggcggcagcgcaaaagatg

SEQ ID NO: 149286 - DNA, 103 bp, Artificial Sequence
  Synthetic Polynucleotide
taatacgactcactatagggcttctctccgacactgaataccttctgcttaacagaggagaaagcagatggtattcagtaacctggcggcagcgcaaaagatg

SEQ ID NO: 149287 - DNA, 103 bp, Artificial Sequence
  Synthetic Polynucleotide
taatacgactcactatagggcacagccgggggggaggggggcgccccgggaacagaggagacccgggatgcccccctccaacctggcggcagcgcaaaagatg

SEQ ID NO: 149288 - DNA, 103 bp, Artificial Sequence
  Synthetic Polynucleotide
taatacgactcactatagggagatccaaaacttctctccgacactgaataaacagaggagatattcaatgtcggagagaaacctggcggcagcgcaaaagatg

SEQ ID NO: 149289 - DNA, 103 bp, Artificial Sequence
  Synthetic Polynucleotide
taatacgactcactatagggtcgtcgttctagatccaaaacttctctccgaacagaggagacggagaatggttttggataacctggcggcagcgcaaaagatg

SEQ ID NO: 149290 - DNA, 103 bp, Artificial Sequence
  Synthetic Polynucleotide
taatacgactcactataggggataattttttcgtcgttctagatccaaaaaacagaggagattttggatgtagaacgacaacctggcggcagcgcaaaagatg

SEQ ID NO: 149291 - DNA, 103 bp, Artificial Sequence
  Synthetic Polynucleotide
taatacgactcactatagggttgtagagttgataattttttcgtcgttctaacagaggagaagaacgatgaaaaaattaaacctggcggcagcgcaaaagatg

SEQ ID NO: 149292 - DNA, 103 bp, Artificial Sequence
  Synthetic Polynucleotide
taatacgactcactatagggggggggcactttgtagagttgataatttttaacagaggagaaaaaatatgcaactctacaacctggcggcagcgcaaaagatg

SEQ ID NO: 149293 - DNA, 103 bp, Artificial Sequence
  Synthetic Polynucleotide
taatacgactcactataggggtctgctgctggggggcactttgtagagttaacagaggagaaactctatgaagtgccccaacctggcggcagcgcaaaagatg

SEQ ID NO: 149294 - DNA, 103 bp, Artificial Sequence
  Synthetic Polynucleotide
taatacgactcactatagggagacgaggaggtctgctgctggggggcactaacagaggagaagtgccatgcagcagcagaacctggcggcagcgcaaaagatg

SEQ ID NO: 149295 - DNA, 103 bp, Artificial Sequence
  Synthetic Polynucleotide
taatacgactcactataggggtggaggtggagacgaggaggtctgctgctaacagaggagaagcagcatgcctcctcgtaacctggcggcagcgcaaaagatg

SEQ ID NO: 149296 - DNA, 103 bp, Artificial Sequence
  Synthetic Polynucleotide
taatacgactcactataggggtcagcagaggtggaggtggagacgaggagaacagaggagactcctcatgtccacctccaacctggcggcagcgcaaaagatg

SEQ ID NO: 149297 - DNA, 103 bp, Artificial Sequence
  Synthetic Polynucleotide
taatacgactcactatagggtggcggtggagtcagcagaggtggaggtggaacagaggagaccacctatgcctctgctgaacctggcggcagcgcaaaagatg

SEQ ID NO: 149298 - DNA, 103 bp, Artificial Sequence
  Synthetic Polynucleotide
taatacgactcactatagggccgcggccgccacagccgggggggagggggaacagaggagaccccctatgccccggctgaacctggcggcagcgcaaaagatg

SEQ ID NO: 149299 - DNA, 103 bp, Artificial Sequence
  Synthetic Polynucleotide
taatacgactcactataggggctgcagtggtggcggtggagtcagcagagaacagaggagactctgcatgctccaccgcaacctggcggcagcgcaaaagatg

SEQ ID NO: 149300 - DNA, 103 bp, Artificial Sequence
  Synthetic Polynucleotide
taatacgactcactatagggctggaggctggctgcagtggtggcggtggaaacagaggagatccaccatgaccactgcaaacctggcggcagcgcaaaagatg

SEQ ID NO: 149301 - DNA, 103 bp, Artificial Sequence
  Synthetic Polynucleotide
taatacgactcactataggggtcagagatactggaggctggctgcagtggaacagaggagaccactgatgccagcctccaacctggcggcagcgcaaaagatg

SEQ ID NO: 149302 - DNA, 103 bp, Artificial Sequence
  Synthetic Polynucleotide
taatacgactcactatagggaaggtgtgtggtcagagatactggaggctgaacagaggagacagcctatggtatctctgaacctggcggcagcgcaaaagatg

SEQ ID NO: 149303 - DNA, 103 bp, Artificial Sequence
  Synthetic Polynucleotide
taatacgactcactatagggggcataagccaaggtgtgtggtcagagataaacagaggagatatctcatgccacacaccaacctggcggcagcgcaaaagatg

SEQ ID NO: 149304 - DNA, 103 bp, Artificial Sequence
  Synthetic Polynucleotide
taatacgactcactataggggattgttggaggcataagccaaggtgtgtgaacagaggagacacacaatgtggcttatgaacctggcggcagcgcaaaagatg

SEQ ID NO: 149305 - DNA, 103 bp, Artificial Sequence
  Synthetic Polynucleotide
taatacgactcactatagggatgctaaggggattgttggaggcataagccaacagaggagaggcttaatgctccaacaaaacctggcggcagcgcaaaagatg

SEQ ID NO: 149306 - DNA, 103 bp, Artificial Sequence
  Synthetic Polynucleotide
taatacgactcactatagggaaaaatggtgatgctaaggggattgttggaaacagaggagatccaacatgccccttagcaacctggcggcagcgcaaaagatg

SEQ ID NO: 149307 - DNA, 103 bp, Artificial Sequence
  Synthetic Polynucleotide
taatacgactcactatagggggaagcaggcaaaaatggtgatgctaagggaacagaggagacccttaatgtcaccatttaacctggcggcagcgcaaaagatg

SEQ ID NO: 149308 - DNA, 103 bp, Artificial Sequence
  Synthetic Polynucleotide
taatacgactcactatagggtaggagcagtggaagcaggcaaaaatggtgaacagaggagacaccatatgtgcctgcttaacctggcggcagcgcaaaagatg

SEQ ID NO: 149309 - DNA, 103 bp, Artificial Sequence
  Synthetic Polynucleotide
taatacgactcactataggggccgccgccgccgcggccgccacagccgggaacagaggagacccggcatgggcggccgcaacctggcggcagcgcaaaagatg

SEQ ID NO: 149310 - DNA, 103 bp, Artificial Sequence
  Synthetic Polynucleotide
taatacgactcactatagggttcccttgcataggagcagtggaagcaggcaacagaggagagcctgcatgcactgctccaacctggcggcagcgcaaaagatg

SEQ ID NO: 149311 - DNA, 103 bp, Artificial Sequence
  Synthetic Polynucleotide
taatacgactcactatagggagattttcgcttcccttgcataggagcagtaacagaggagaactgctatgatgcaagggaacctggcggcagcgcaaaagatg

SEQ ID NO: 149312 - DNA, 103 bp, Artificial Sequence
  Synthetic Polynucleotide
taatacgactcactatagggctcgcaaaatagattttcgcttcccttgcaaacagaggagatgcaagatgagcgaaaataacctggcggcagcgcaaaagatg

SEQ ID NO: 149313 - DNA, 103 bp, Artificial Sequence
  Synthetic Polynucleotide
taatacgactcactatagggaatgtcggttctcgcaaaatagattttcgcaacagaggagagcgaaaatgtattttgcgaacctggcggcagcgcaaaagatg

SEQ ID NO: 149314 - DNA, 103 bp, Artificial Sequence
  Synthetic Polynucleotide
taatacgactcactatagggagtccacctaaatgtcggttctcgcaaaataacagaggagaattttgatggaaccgacaaacctggcggcagcgcaaaagatg

SEQ ID NO: 149315 - DNA, 103 bp, Artificial Sequence
  Synthetic Polynucleotide
taatacgactcactataggggctttaaagaagtccacctaaatgtcggttaacagaggagaaaccgaatgttaggtggaaacctggcggcagcgcaaaagatg

SEQ ID NO: 149316 - DNA, 103 bp, Artificial Sequence
  Synthetic Polynucleotide
taatacgactcactataggggacctagaatgctttaaagaagtccacctaaacagaggagataggtgatgttctttaaaaacctggcggcagcgcaaaagatg

SEQ ID NO: 149317 - DNA, 103 bp, Artificial Sequence
  Synthetic Polynucleotide
taatacgactcactatagggttgtggctctgacctagaatgctttaaagaaacagaggagatctttaatgcattctaggaacctggcggcagcgcaaaagatg

SEQ ID NO: 149318 - DNA, 103 bp, Artificial Sequence
  Synthetic Polynucleotide
taatacgactcactatagggaggaaaagtattgtggctctgacctagaataacagaggagaattctaatgcagagccacaacctggcggcagcgcaaaagatg

SEQ ID NO: 149319 - DNA, 103 bp, Artificial Sequence
  Synthetic Polynucleotide
taatacgactcactatagggtactttgctgaggaaaagtattgtggctctaacagaggagaagagccatgatacttttcaacctggcggcagcgcaaaagatg

SEQ ID NO: 149320 - DNA, 103 bp, Artificial Sequence
  Synthetic Polynucleotide
taatacgactcactataggggctgcttcccgccgccgccgccgcggccgcaacagaggagagcggccatggcggcggcgaacctggcggcagcgcaaaagatg

SEQ ID NO: 149321 - DNA, 103 bp, Artificial Sequence
  Synthetic Polynucleotide
taatacgactcactatagggttctttggcatactttgctgaggaaaagtaaacagaggagatactttatgtcagcaaagaacctggcggcagcgcaaaagatg

SEQ ID NO: 149322 - DNA, 103 bp, Artificial Sequence
  Synthetic Polynucleotide
taatacgactcactataggggaataagaccttctttggcatactttgctgaacagaggagacagcaaatgatgccaaagaacctggcggcagcgcaaaagatg

SEQ ID NO: 149323 - DNA, 103 bp, Artificial Sequence
  Synthetic Polynucleotide
taatacgactcactatagggattggtttgcgaataagaccttctttggcaaacagaggagatgccaaatgaggtcttataacctggcggcagcgcaaaagatg

SEQ ID NO: 149324 - DNA, 103 bp, Artificial Sequence
  Synthetic Polynucleotide
taatacgactcactatagggattatcaaatattggtttgcgaataagaccaacagaggagaggtcttatgcgcaaaccaaacctggcggcagcgcaaaagatg

SEQ ID NO: 149325 - DNA, 103 bp, Artificial Sequence
  Synthetic Polynucleotide
taatacgactcactatagggggggtcggaaattatcaaatattggtttgcaacagaggagagcaaacatgtatttgataaacctggcggcagcgcaaaagatg

SEQ ID NO: 149326 - DNA, 103 bp, Artificial Sequence
  Synthetic Polynucleotide
taatacgactcactataggggttagtggagggggtcggaaattatcaaataacagaggagaatttgaatgtttccgaccaacctggcggcagcgcaaaagatg

SEQ ID NO: 149327 - DNA, 103 bp, Artificial Sequence
  Synthetic Polynucleotide
taatacgactcactataggggtcctcgggagttagtggagggggtcggaaaacagaggagattccgaatgcctccactaaacctggcggcagcgcaaaagatg

SEQ ID NO: 149328 - DNA, 103 bp, Artificial Sequence
  Synthetic Polynucleotide
taatacgactcactatagggcaaagccaacgtcctcgggagttagtggagaacagaggagactccacatgctcccgaggaacctggcggcagcgcaaaagatg

SEQ ID NO: 149329 - DNA, 103 bp, Artificial Sequence
  Synthetic Polynucleotide
taatacgactcactatagggaaaccagatgcaaagccaacgtcctcgggaaacagaggagatcccgaatgcgttggcttaacctggcggcagcgcaaaagatg

SEQ ID NO: 149330 - DNA, 103 bp, Artificial Sequence
  Synthetic Polynucleotide
taatacgactcactatagggagatgcagaaaaaccagatgcaaagccaacaacagaggagagttggcatggcatctggtaacctggcggcagcgcaaaagatg

SEQ ID NO: 149331 - DNA, 103 bp, Artificial Sequence
  Synthetic Polynucleotide
taatacgactcactatagggcgggtcgggcggggaagcgccaccgacagcaacagaggagagctgtcatgggcgcttccaacctggcggcagcgcaaaagatg

SEQ ID NO: 149332 - DNA, 103 bp, Artificial Sequence
  Synthetic Polynucleotide
taatacgactcactatagggccccagccccgctgcttcccgccgccgccgaacagaggagacggcggatgcgggaagcaaacctggcggcagcgcaaaagatg

SEQ ID NO: 149333 - DNA, 103 bp, Artificial Sequence
  Synthetic Polynucleotide
taatacgactcactatagggcagcggtaccagatgcagaaaaaccagatgaacagaggagacatctgatgtttctgcataacctggcggcagcgcaaaagatg

SEQ ID NO: 149334 - DNA, 103 bp, Artificial Sequence
  Synthetic Polynucleotide
taatacgactcactatagggcgggctgaagcagcggtaccagatgcagaaaacagaggagattctgcatgtggtaccgcaacctggcggcagcgcaaaagatg

SEQ ID NO: 149335 - DNA, 103 bp, Artificial Sequence
  Synthetic Polynucleotide
taatacgactcactatagggcgaaaacaatcgggctgaagcagcggtaccaacagaggagaggtaccatggcttcagccaacctggcggcagcgcaaaagatg

SEQ ID NO: 149336 - DNA, 103 bp, Artificial Sequence
  Synthetic Polynucleotide
taatacgactcactatagggaatggagtggcgaaaacaatcgggctgaagaacagaggagacttcagatggattgttttaacctggcggcagcgcaaaagatg

SEQ ID NO: 149337 - DNA, 103 bp, Artificial Sequence
  Synthetic Polynucleotide
taatacgactcactatagggcttgttccagaatggagtggcgaaaacaataacagaggagaattgttatggccactccaaacctggcggcagcgcaaaagatg

SEQ ID NO: 149338 - DNA, 103 bp, Artificial Sequence
  Synthetic Polynucleotide
taatacgactcactatagggcatatcaaaccttgttccagaatggagtggaacagaggagaccactcatgtctggaacaaacctggcggcagcgcaaaagatg

SEQ ID NO: 149339 - DNA, 103 bp, Artificial Sequence
  Synthetic Polynucleotide
taatacgactcactatagggtccttttgtgcatatcaaaccttgttccagaacagaggagactggaaatgggtttgataaacctggcggcagcgcaaaagatg

SEQ ID NO: 149340 - DNA, 103 bp, Artificial Sequence
  Synthetic Polynucleotide
taatacgactcactatagggagaagagggctccttttgtgcatatcaaacaacagaggagagtttgaatggcacaaaagaacctggcggcagcgcaaaagatg

SEQ ID NO: 149341 - DNA, 103 bp, Artificial Sequence
  Synthetic Polynucleotide
taatacgactcactatagggtggagctctcagaagagggctccttttgtgaacagaggagacacaaaatgagccctcttaacctggcggcagcgcaaaagatg

SEQ ID NO: 149342 - DNA, 103 bp, Artificial Sequence
  Synthetic Polynucleotide
taatacgactcactataggggagtaaatcttggagctctcagaagagggcaacagaggagagccctcatgtgagagctcaacctggcggcagcgcaaaagatg

SEQ ID NO: 149343 - DNA, 103 bp, Artificial Sequence
  Synthetic Polynucleotide
taatacgactcactatagggccccctggaaccccagccccgctgcttcccaacagaggagagggaagatgcggggctggaacctggcggcagcgcaaaagatg

SEQ ID NO: 149344 - DNA, 103 bp, Artificial Sequence
  Synthetic Polynucleotide
taatacgactcactataggggcctcacttggagtaaatcttggagctctcaacagaggagagagagcatgaagatttacaacctggcggcagcgcaaaagatg

SEQ ID NO: 149345 - DNA, 103 bp, Artificial Sequence
  Synthetic Polynucleotide
taatacgactcactatagggtctagagtgagcctcacttggagtaaatctaacagaggagaagatttatgccaagtgagaacctggcggcagcgcaaaagatg

SEQ ID NO: 149346 - DNA, 103 bp, Artificial Sequence
  Synthetic Polynucleotide
taatacgactcactatagggactcaaatattctagagtgagcctcacttgaacagaggagacaagtgatgctcactctaaacctggcggcagcgcaaaagatg

SEQ ID NO: 149347 - DNA, 103 bp, Artificial Sequence
  Synthetic Polynucleotide
taatacgactcactatagggaaggttacagactcaaatattctagagtgaaacagaggagatcactcatgaatatttgaaacctggcggcagcgcaaaagatg

SEQ ID NO: 149348 - DNA, 103 bp, Artificial Sequence
  Synthetic Polynucleotide
taatacgactcactatagggattactaggcaaggttacagactcaaatataacagaggagaatatttatgtctgtaaccaacctggcggcagcgcaaaagatg

SEQ ID NO: 149349 - DNA, 103 bp, Artificial Sequence
  Synthetic Polynucleotide
taatacgactcactatagggcagaagttcgattactaggcaaggttacagaacagaggagactgtaaatgtgcctagtaaacctggcggcagcgcaaaagatg

SEQ ID NO: 149350 - DNA, 103 bp, Artificial Sequence
  Synthetic Polynucleotide
taatacgactcactataggggatgttccagcagaagttcgattactaggcaacagaggagagcctagatgtcgaacttcaacctggcggcagcgcaaaagatg

SEQ ID NO: 149351 - DNA, 103 bp, Artificial Sequence
  Synthetic Polynucleotide
taatacgactcactatagggtcctgaagaagatgttccagcagaagttcgaacagaggagacgaactatggctggaacaaacctggcggcagcgcaaaagatg

SEQ ID NO: 149352 - DNA, 103 bp, Artificial Sequence
  Synthetic Polynucleotide
taatacgactcactatagggtattggatactcctgaagaagatgttccagaacagaggagactggaaatgcttcttcagaacctggcggcagcgcaaaagatg

SEQ ID NO: 149353 - DNA, 103 bp, Artificial Sequence
  Synthetic Polynucleotide
taatacgactcactatagggttcctttttctattggatactcctgaagaaaacagaggagattcttcatgagtatccaaaacctggcggcagcgcaaaagatg

SEQ ID NO: 149354 - DNA, 103 bp, Artificial Sequence
  Synthetic Polynucleotide
taatacgactcactatagggggcggccgctccccctggaaccccagccccaacagaggagaggggctatggttccagggaacctggcggcagcgcaaaagatg

SEQ ID NO: 149355 - DNA, 103 bp, Artificial Sequence
  Synthetic Polynucleotide
taatacgactcactatagggcacttttcttttcctttttctattggatacaacagaggagagtatccatgagaaaaaggaacctggcggcagcgcaaaagatg

SEQ ID NO: 149356 - DNA, 103 bp, Artificial Sequence
  Synthetic Polynucleotide
taatacgactcactatagggtaggactaaacacttttcttttcctttttcaacagaggagagaaaaaatgaaagaaaagaacctggcggcagcgcaaaagatg

SEQ ID NO: 149357 - DNA, 103 bp, Artificial Sequence
  Synthetic Polynucleotide
taatacgactcactatagggtcagatcgaataggactaaacacttttcttaacagaggagaaagaaaatggtttagtccaacctggcggcagcgcaaaagatg

SEQ ID NO: 149358 - DNA, 103 bp, Artificial Sequence
  Synthetic Polynucleotide
taatacgactcactatagggagatcttggttcagatcgaataggactaaaaacagaggagatttagtatgattcgatctaacctggcggcagcgcaaaagatg

SEQ ID NO: 149359 - DNA, 103 bp, Artificial Sequence
  Synthetic Polynucleotide
taatacgactcactatagggagtgagaaggagatcttggttcagatcgaaaacagaggagattcgatatgaaccaagataacctggcggcagcgcaaaagatg

SEQ ID NO: 149360 - DNA, 103 bp, Artificial Sequence
  Synthetic Polynucleotide
taatacgactcactataggggtcctcatggagtgagaaggagatcttggtaacagaggagaaccaagatgtccttctcaaacctggcggcagcgcaaaagatg

SEQ ID NO: 149361 - DNA, 103 bp, Artificial Sequence
  Synthetic Polynucleotide
taatacgactcactatagggtccacttcttgtcctcatggagtgagaaggaacagaggagaccttctatgtccatgaggaacctggcggcagcgcaaaagatg

SEQ ID NO: 149362 - DNA, 103 bp, Artificial Sequence
  Synthetic Polynucleotide
taatacgactcactatagggtactaagccttccacttcttgtcctcatggaacagaggagaccatgaatgcaagaagtgaacctggcggcagcgcaaaagatg

SEQ ID NO: 149363 - DNA, 103 bp, Artificial Sequence
  Synthetic Polynucleotide
taatacgactcactatagggagctcagaactactaagccttccacttcttaacagaggagaaagaagatgaaggcttagaacctggcggcagcgcaaaagatg

SEQ ID NO: 149364 - DNA, 103 bp, Artificial Sequence
  Synthetic Polynucleotide
taatacgactcactataggggagaggtgagagctcagaactactaagcctaacagaggagaaggcttatgagttctgagaacctggcggcagcgcaaaagatg

SEQ ID NO: 149365 - DNA, 103 bp, Artificial Sequence
  Synthetic Polynucleotide
taatacgactcactatagggctgctgaggcggcggccgctccccctggaaaacagaggagattccagatggagcggccgaacctggcggcagcgcaaaagatg

SEQ ID NO: 149366 - DNA, 103 bp, Artificial Sequence
  Synthetic Polynucleotide
taatacgactcactatagggacgggggggtgagaggtgagagctcagaacaacagaggagagttctgatgtctcacctcaacctggcggcagcgcaaaagatg

SEQ ID NO: 149367 - DNA, 103 bp, Artificial Sequence
  Synthetic Polynucleotide
taatacgactcactataggggagacagaagacgggggggtgagaggtgagaacagaggagactcaccatgcacccccccaacctggcggcagcgcaaaagatg

SEQ ID NO: 149368 - DNA, 103 bp, Artificial Sequence
  Synthetic Polynucleotide
taatacgactcactatagggtaacgaggaagagacagaagacgggggggtaacagaggagaacccccatgtcttctgtcaacctggcggcagcgcaaaagatg

SEQ ID NO: 149369 - DNA, 103 bp, Artificial Sequence
  Synthetic Polynucleotide
taatacgactcactatagggcagaaatgcttaacgaggaagagacagaagaacagaggagacttctgatgcttcctcgtaacctggcggcagcgcaaaagatg

SEQ ID NO: 149370 - DNA, 103 bp, Artificial Sequence
  Synthetic Polynucleotide
taatacgactcactatagggagaggactaacagaaatgcttaacgaggaaaacagaggagattcctcatgaagcatttcaacctggcggcagcgcaaaagatg

SEQ ID NO: 149371 - DNA, 103 bp, Artificial Sequence
  Synthetic Polynucleotide
taatacgactcactatagggactagtggcaagaggactaacagaaatgctaacagaggagaagcattatggttagtcctaacctggcggcagcgcaaaagatg

SEQ ID NO: 149372 - DNA, 103 bp, Artificial Sequence
  Synthetic Polynucleotide
taatacgactcactatagggggtttaaggcactagtggcaagaggactaaaacagaggagattagtcatgttgccactaaacctggcggcagcgcaaaagatg

SEQ ID NO: 149373 - DNA, 103 bp, Artificial Sequence
  Synthetic Polynucleotide
taatacgactcactataggggtaaaagttgggtttaaggcactagtggcaaacagaggagatgccacatgtgccttaaaaacctggcggcagcgcaaaagatg

SEQ ID NO: 149374 - DNA, 103 bp, Artificial Sequence
  Synthetic Polynucleotide
taatacgactcactatagggagaaggaaaagtaaaagttgggtttaaggcaacagaggagagccttaatgccaacttttaacctggcggcagcgcaaaagatg

SEQ ID NO: 149375 - DNA, 103 bp, Artificial Sequence
  Synthetic Polynucleotide
taatacgactcactatagggtcagggaatgagaaggaaaagtaaaagttgaacagaggagacaacttatgcttttccttaacctggcggcagcgcaaaagatg

SEQ ID NO: 149376 - DNA, 103 bp, Artificial Sequence
  Synthetic Polynucleotide
taatacgactcactataggggacgaggaggctgctgaggcggcggccgctaacagaggagaagcggcatgcgcctcagcaacctggcggcagcgcaaaagatg

SEQ ID NO: 149377 - DNA, 103 bp, Artificial Sequence
  Synthetic Polynucleotide
taatacgactcactatagggccagactgagtcagggaatgagaaggaaaaaacagaggagattttccatgtcattccctaacctggcggcagcgcaaaagatg

SEQ ID NO: 149378 - DNA, 103 bp, Artificial Sequence
  Synthetic Polynucleotide
taatacgactcactatagggtgcagattccccagactgagtcagggaatgaacagaggagacattccatgactcagtctaacctggcggcagcgcaaaagatg

SEQ ID NO: 149379 - DNA, 103 bp, Artificial Sequence
  Synthetic Polynucleotide
taatacgactcactataggggatttttctctgcagattccccagactgagaacagaggagactcagtatggggaatctgaacctggcggcagcgcaaaagatg

SEQ ID NO: 149380 - DNA, 103 bp, Artificial Sequence
  Synthetic Polynucleotide
taatacgactcactatagggcttggtctctgatttttctctgcagattccaacagaggagaggaatcatgagagaaaaaaacctggcggcagcgcaaaagatg

SEQ ID NO: 149381 - DNA, 103 bp, Artificial Sequence
  Synthetic Polynucleotide
taatacgactcactatagggagtctgcttccttggtctctgatttttctcaacagaggagagagaaaatgcagagaccaaacctggcggcagcgcaaaagatg

SEQ ID NO: 149382 - DNA, 103 bp, Artificial Sequence
  Synthetic Polynucleotide
taatacgactcactatagggccggagcactagtctgcttccttggtctctaacagaggagaagagacatgggaagcagaaacctggcggcagcgcaaaagatg

SEQ ID NO: 149383 - DNA, 103 bp, Artificial Sequence
  Synthetic Polynucleotide
taatacgactcactatagggaatggctctgccggagcactagtctgcttcaacagaggagagaagcaatgtagtgctccaacctggcggcagcgcaaaagatg

SEQ ID NO: 149384 - DNA, 103 bp, Artificial Sequence
  Synthetic Polynucleotide
taatacgactcactatagggacttgatgaaaatggctctgccggagcactaacagaggagaagtgctatggcagagccaaacctggcggcagcgcaaaagatg

SEQ ID NO: 149385 - DNA, 103 bp, Artificial Sequence
  Synthetic Polynucleotide
taatacgactcactataggggagtaggactacttgatgaaaatggctctgaacagaggagacagagcatgtttcatcaaaacctggcggcagcgcaaaagatg

SEQ ID NO: 149386 - DNA, 103 bp, Artificial Sequence
  Synthetic Polynucleotide
taatacgactcactataggggggaagagaggagtaggactacttgatgaaaacagaggagattcatcatgtagtcctacaacctggcggcagcgcaaaagatg

SEQ ID NO: 149387 - DNA, 103 bp, Artificial Sequence
  Synthetic Polynucleotide
taatacgactcactatagggcgaggcggacgacgaggaggctgctgaggcaacagaggagagcctcaatggcctcctcgaacctggcggcagcgcaaaagatg

SEQ ID NO: 149388 - DNA, 103 bp, Artificial Sequence
  Synthetic Polynucleotide
taatacgactcactatagggggtaaaccaagggaagagaggagtaggactaacagaggagaagtcctatgcctctcttcaacctggcggcagcgcaaaagatg

SEQ ID NO: 149389 - DNA, 103 bp, Artificial Sequence
  Synthetic Polynucleotide
taatacgactcactataggggagagcctggggtaaaccaagggaagagagaacagaggagactctctatgcttggtttaaacctggcggcagcgcaaaagatg

SEQ ID NO: 149390 - DNA, 103 bp, Artificial Sequence
  Synthetic Polynucleotide
taatacgactcactatagggctttcagtctgagagcctggggtaaaccaaaacagaggagattggttatgcccaggctcaacctggcggcagcgcaaaagatg

SEQ ID NO: 149391 - DNA, 103 bp, Artificial Sequence
  Synthetic Polynucleotide
taatacgactcactatagggatttctccctctttcagtctgagagcctggaacagaggagaccaggcatgcagactgaaaacctggcggcagcgcaaaagatg

SEQ ID NO: 149392 - DNA, 103 bp, Artificial Sequence
  Synthetic Polynucleotide
taatacgactcactatagggccttgtctttatttctccctctttcagtctaacagaggagaagactgatggagggagaaaacctggcggcagcgcaaaagatg

SEQ ID NO: 149393 - DNA, 103 bp, Artificial Sequence
  Synthetic Polynucleotide
taatacgactcactatagggtcctcgggggccttgtctttatttctccctaacagaggagaagggagatgtaaagacaaaacctggcggcagcgcaaaagatg

SEQ ID NO: 149394 - DNA, 103 bp, Artificial Sequence
  Synthetic Polynucleotide
taatacgactcactatagggtttggacagctcctcgggggccttgtctttaacagaggagaaaagacatggcccccgagaacctggcggcagcgcaaaagatg

SEQ ID NO: 149395 - DNA, 103 bp, Artificial Sequence
  Synthetic Polynucleotide
taatacgactcactatagggcatctcgatctttggacagctcctcgggggaacagaggagacccccgatgagctgtccaaacctggcggcagcgcaaaagatg

SEQ ID NO: 149396 - DNA, 103 bp, Artificial Sequence
  Synthetic Polynucleotide
taatacgactcactatagggctcttgtcagcatctcgatctttggacagcaacagaggagagctgtcatgagatcgagaaacctggcggcagcgcaaaagatg

SEQ ID NO: 149397 - DNA, 103 bp, Artificial Sequence
  Synthetic Polynucleotide
taatacgactcactatagggcttctccacgctcttgtcagcatctcgatcaacagaggagagatcgaatggctgacaagaacctggcggcagcgcaaaagatg

SEQ ID NO: 149398 - DNA, 103 bp, Artificial Sequence
  Synthetic Polynucleotide
taatacgactcactatagggaagacgaagacgaggcggacgacgaggaggaacagaggagacctcctatgcgtccgcctaacctggcggcagcgcaaaagatg

SEQ ID NO: 149399 - DNA, 103 bp, Artificial Sequence
  Synthetic Polynucleotide
taatacgactcactatagggtactcttgtccttctccacgctcttgtcagaacagaggagactgacaatggcgtggagaaacctggcggcagcgcaaaagatg

SEQ ID NO: 149400 - DNA, 103 bp, Artificial Sequence
  Synthetic Polynucleotide
taatacgactcactatagggtctctctctctactcttgtccttctccacgaacagaggagacgtggaatgggacaagagaacctggcggcagcgcaaaagatg

SEQ ID NO: 149401 - DNA, 103 bp, Artificial Sequence
  Synthetic Polynucleotide
taatacgactcactatagggtctctcccggtctctctctctactcttgtcaacagaggagagacaagatgagagagagaaacctggcggcagcgcaaaagatg

SEQ ID NO: 149402 - DNA, 103 bp, Artificial Sequence
  Synthetic Polynucleotide
taatacgactcactatagggtctccttttctctctcccggtctctctctcaacagaggagagagagaatgaccgggagaaacctggcggcagcgcaaaagatg

SEQ ID NO: 149403 - DNA, 103 bp, Artificial Sequence
  Synthetic Polynucleotide
taatacgactcactatagggtcccgcttattctccttttctctctcccggaacagaggagaccgggaatgagaaaaggaaacctggcggcagcgcaaaagatg

SEQ ID NO: 149404 - DNA, 103 bp, Artificial Sequence
  Synthetic Polynucleotide
taatacgactcactatagggtttccttgactcccgcttattctccttttcaacagaggagagaaaagatgaataagcggaacctggcggcagcgcaaaagatg

SEQ ID NO: 149405 - DNA, 103 bp, Artificial Sequence
  Synthetic Polynucleotide
taatacgactcactatagggtccttttctctttccttgactcccgcttataacagaggagaataagcatgagtcaaggaaacctggcggcagcgcaaaagatg

SEQ ID NO: 149406 - DNA, 103 bp, Artificial Sequence
  Synthetic Polynucleotide
taatacgactcactataggggatccctttttccttttctctttccttgacaacagaggagagtcaagatgagagaaaagaacctggcggcagcgcaaaagatg

SEQ ID NO: 149407 - DNA, 103 bp, Artificial Sequence
  Synthetic Polynucleotide
taatacgactcactatagggctgaatttctgatccctttttccttttctcaacagaggagagagaaaatgaaaaagggaaacctggcggcagcgcaaaagatg

SEQ ID NO: 149408 - DNA, 103 bp, Artificial Sequence
  Synthetic Polynucleotide
taatacgactcactatagggcagaactactctgaatttctgatcccttttaacagaggagaaaaaggatgcagaaattcaacctggcggcagcgcaaaagatg

SEQ ID NO: 149409 - DNA, 103 bp, Artificial Sequence
  Synthetic Polynucleotide
taatacgactcactataggggacgatgacgaagacgaagacgaggcggacaacagaggagagtccgcatggtcttcgtcaacctggcggcagcgcaaaagatg

SEQ ID NO: 149410 - DNA, 103 bp, Artificial Sequence
  Synthetic Polynucleotide
taatacgactcactatagggggatacaaagcagaactactctgaatttctaacagaggagaagaaatatggagtagttcaacctggcggcagcgcaaaagatg

SEQ ID NO: 149411 - DNA, 103 bp, Artificial Sequence
  Synthetic Polynucleotide
taatacgactcactatagggcctacccacaggatacaaagcagaactactaacagaggagaagtagtatggctttgtataacctggcggcagcgcaaaagatg

SEQ ID NO: 149412 - DNA, 103 bp, Artificial Sequence
  Synthetic Polynucleotide
taatacgactcactatagggctttggaaaccctacccacaggatacaaagaacagaggagactttgtatgctgtgggtaaacctggcggcagcgcaaaagatg

SEQ ID NO: 149413 - DNA, 103 bp, Artificial Sequence
  Synthetic Polynucleotide
taatacgactcactatagggacaaccttctctttggaaaccctacccacaaacagaggagatgtgggatgggtttccaaaacctggcggcagcgcaaaagatg

SEQ ID NO: 149414 - DNA, 103 bp, Artificial Sequence
  Synthetic Polynucleotide
taatacgactcactatagggatcttcaccaacaaccttctctttggaaacaacagaggagagtttccatggagaaggttaacctggcggcagcgcaaaagatg

SEQ ID NO: 149415 - DNA, 103 bp, Artificial Sequence
  Synthetic Polynucleotide
taatacgactcactatagggaagtggcaacatcttcaccaacaaccttctaacagaggagaagaaggatgttggtgaagaacctggcggcagcgcaaaagatg

SEQ ID NO: 149416 - DNA, 103 bp, Artificial Sequence
  Synthetic Polynucleotide
taatacgactcactataggggcagaagatgaagtggcaacatcttcaccaaacagaggagatggtgaatgtgttgccacaacctggcggcagcgcaaaagatg

SEQ ID NO: 149417 - DNA, 103 bp, Artificial Sequence
  Synthetic Polynucleotide
taatacgactcactatagggtgcttttttggcagaagatgaagtggcaacaacagaggagagttgccatgtcatcttctaacctggcggcagcgcaaaagatg

SEQ ID NO: 149418 - DNA, 103 bp, Artificial Sequence
  Synthetic Polynucleotide
taatacgactcactatagggtccgccctgttgcttttttggcagaagatgaacagaggagacatcttatgccaaaaaagaacctggcggcagcgcaaaagatg

SEQ ID NO: 149419 - DNA, 103 bp, Artificial Sequence
  Synthetic Polynucleotide
taatacgactcactataggggaagacttcttccgccctgttgcttttttgaacagaggagacaaaaaatgaacagggcgaacctggcggcagcgcaaaagatg

SEQ ID NO: 149420 - DNA, 103 bp, Artificial Sequence
  Synthetic Polynucleotide
taatacgactcactatagggagaggctgaggacgatgacgaagacgaagaaacagaggagatcttcgatgtcgtcatcgaacctggcggcagcgcaaaagatg

SEQ ID NO: 149421 - DNA, 103 bp, Artificial Sequence
  Synthetic Polynucleotide
taatacgactcactatagggatcatgtgatgaagacttcttccgccctgtaacagaggagaacagggatgaagaagtctaacctggcggcagcgcaaaagatg

SEQ ID NO: 149422 - DNA, 103 bp, Artificial Sequence
  Synthetic Polynucleotide
taatacgactcactatagggcagtcccagaatcatgtgatgaagacttctaacagaggagaagaagtatgcatcacatgaacctggcggcagcgcaaaagatg

SEQ ID NO: 149423 - DNA, 103 bp, Artificial Sequence
  Synthetic Polynucleotide
taatacgactcactataggggaagtaatatcagtcccagaatcatgtgataacagaggagaatcacaatgttctgggacaacctggcggcagcgcaaaagatg

SEQ ID NO: 149424 - DNA, 103 bp, Artificial Sequence
  Synthetic Polynucleotide
taatacgactcactatagggaagagtcacagaagtaatatcagtcccagaaacagaggagatctgggatggatattactaacctggcggcagcgcaaaagatg

SEQ ID NO: 149425 - DNA, 103 bp, Artificial Sequence
  Synthetic Polynucleotide
taatacgactcactatagggttgtatccccaagagtcacagaagtaatataacagaggagaatattaatgctgtgactcaacctggcggcagcgcaaaagatg

SEQ ID NO: 149426 - DNA, 103 bp, Artificial Sequence
  Synthetic Polynucleotide
taatacgactcactatagggttgacagctgttgtatccccaagagtcacaaacagaggagatgtgacatgtggggatacaacctggcggcagcgcaaaagatg

SEQ ID NO: 149427 - DNA, 103 bp, Artificial Sequence
  Synthetic Polynucleotide
taatacgactcactatagggtattttggttttgacagctgttgtatccccaacagaggagaggggatatgacagctgtcaacctggcggcagcgcaaaagatg

SEQ ID NO: 149428 - DNA, 103 bp, Artificial Sequence
  Synthetic Polynucleotide
taatacgactcactatagggtctttataagtattttggttttgacagctgaacagaggagacagctgatgaaaccaaaaaacctggcggcagcgcaaaagatg

SEQ ID NO: 149429 - DNA, 103 bp, Artificial Sequence
  Synthetic Polynucleotide
taatacgactcactatagggcctctccctttctttataagtattttggttaacagaggagaaaccaaatgacttataaaaacctggcggcagcgcaaaagatg

SEQ ID NO: 149430 - DNA, 103 bp, Artificial Sequence
  Synthetic Polynucleotide
taatacgactcactatagggttccagatttcctctccctttctttataagaacagaggagacttataatgaaagggagaaacctggcggcagcgcaaaagatg

SEQ ID NO: 149431 - DNA, 103 bp, Artificial Sequence
  Synthetic Polynucleotide
taatacgactcactatagggccggccctgaagaggctgaggacgatgacgaacagaggagacgtcatatgcctcagcctaacctggcggcagcgcaaaagatg

SEQ ID NO: 149432 - DNA, 103 bp, Artificial Sequence
  Synthetic Polynucleotide
taatacgactcactatagggagttggttttttccagatttcctctcccttaacagaggagaaagggaatggaaatctggaacctggcggcagcgcaaaagatg

SEQ ID NO: 149433 - DNA, 103 bp, Artificial Sequence
  Synthetic Polynucleotide
taatacgactcactatagggccgaggtccaagttggttttttccagatttaacagaggagaaaatctatgaaaaaccaaaacctggcggcagcgcaaaagatg

SEQ ID NO: 149434 - DNA, 103 bp, Artificial Sequence
  Synthetic Polynucleotide
taatacgactcactatagggggcagttgggccgaggtccaagttggttttaacagaggagaaaaaccatgttggacctcaacctggcggcagcgcaaaagatg

SEQ ID NO: 149435 - DNA, 103 bp, Artificial Sequence
  Synthetic Polynucleotide
taatacgactcactatagggccagggatggggcagttgggccgaggtccaaacagaggagatggaccatggcccaactgaacctggcggcagcgcaaaagatg

SEQ ID NO: 149436 - DNA, 103 bp, Artificial Sequence
  Synthetic Polynucleotide
taatacgactcactatagggttctccttctccagggatggggcagttgggaacagaggagacccaacatgcccatccctaacctggcggcagcgcaaaagatg

SEQ ID NO: 149437 - DNA, 103 bp, Artificial Sequence
  Synthetic Polynucleotide
taatacgactcactataggggcagagggttttctccttctccagggatggaacagaggagaccatccatggagaaggagaacctggcggcagcgcaaaagatg

SEQ ID NO: 149438 - DNA, 103 bp, Artificial Sequence
  Synthetic Polynucleotide
taatacgactcactataggggagtggaaaggcagagggttttctccttctaacagaggagaagaaggatgaaaccctctaacctggcggcagcgcaaaagatg

SEQ ID NO: 149439 - DNA, 103 bp, Artificial Sequence
  Synthetic Polynucleotide
taatacgactcactatagggctagatgaaggagtggaaaggcagagggttaacagaggagaaaccctatgcctttccacaacctggcggcagcgcaaaagatg

SEQ ID NO: 149440 - DNA, 103 bp, Artificial Sequence
  Synthetic Polynucleotide
taatacgactcactatagggtttaacagtgctagatgaaggagtggaaagaacagaggagactttccatgccttcatctaacctggcggcagcgcaaaagatg

SEQ ID NO: 149441 - DNA, 103 bp, Artificial Sequence
  Synthetic Polynucleotide
taatacgactcactatagggaagtggaatgtttaacagtgctagatgaagaacagaggagacttcatatggcactgttaaacctggcggcagcgcaaaagatg

SEQ ID NO: 149442 - DNA, 103 bp, Artificial Sequence
  Synthetic Polynucleotide
taatacgactcactatagggccggtggtcccgggtcgggcggggaagcgcaacagaggagagcgcttatgcgcccgaccaacctggcggcagcgcaaaagatg

SEQ ID NO: 149443 - DNA, 103 bp, Artificial Sequence
  Synthetic Polynucleotide
taatacgactcactatagggcggagcagggccggccctgaagaggctgagaacagaggagactcagcatgttcagggccaacctggcggcagcgcaaaagatg

SEQ ID NO: 149444 - DNA, 103 bp, Artificial Sequence
  Synthetic Polynucleotide
taatacgactcactatagggcctatggaggaagtggaatgtttaacagtgaacagaggagacactgtatgacattccacaacctggcggcagcgcaaaagatg

SEQ ID NO: 149445 - DNA, 103 bp, Artificial Sequence
  Synthetic Polynucleotide
taatacgactcactatagggcaacatggagcctatggaggaagtggaatgaacagaggagacattccatgtcctccataaacctggcggcagcgcaaaagatg

SEQ ID NO: 149446 - DNA, 103 bp, Artificial Sequence
  Synthetic Polynucleotide
taatacgactcactatagggctgcctgagccaacatggagcctatggaggaacagaggagacctccaatggctccatgtaacctggcggcagcgcaaaagatg

SEQ ID NO: 149447 - DNA, 103 bp, Artificial Sequence
  Synthetic Polynucleotide
taatacgactcactatagggggaagcttgtctgcctgagccaacatggagaacagaggagactccatatgggctcaggcaacctggcggcagcgcaaaagatg

SEQ ID NO: 149448 - DNA, 103 bp, Artificial Sequence
  Synthetic Polynucleotide
taatacgactcactataggggtcagtcattggaagcttgtctgcctgagcaacagaggagagctcagatggacaagcttaacctggcggcagcgcaaaagatg

SEQ ID NO: 149449 - DNA, 103 bp, Artificial Sequence
  Synthetic Polynucleotide
taatacgactcactatagggcaaccctcttgtcagtcattggaagcttgtaacagaggagaacaagcatgcaatgactgaacctggcggcagcgcaaaagatg

SEQ ID NO: 149450 - DNA, 103 bp, Artificial Sequence
  Synthetic Polynucleotide
taatacgactcactatagggaggaggctggcaaccctcttgtcagtcattaacagaggagaaatgacatgcaagagggtaacctggcggcagcgcaaaagatg

SEQ ID NO: 149451 - DNA, 103 bp, Artificial Sequence
  Synthetic Polynucleotide
taatacgactcactatagggggccttttttaggaggctggcaaccctcttaacagaggagaaagaggatggccagcctcaacctggcggcagcgcaaaagatg

SEQ ID NO: 149452 - DNA, 103 bp, Artificial Sequence
  Synthetic Polynucleotide
taatacgactcactataggggctgagctttggccttttttaggaggctggaacagaggagaccagccatgtaaaaaaggaacctggcggcagcgcaaaagatg

SEQ ID NO: 149453 - DNA, 103 bp, Artificial Sequence
  Synthetic Polynucleotide
taatacgactcactatagggatcttgcagagctgagctttggccttttttaacagaggagaaaaaaaatgcaaagctcaaacctggcggcagcgcaaaagatg

SEQ ID NO: 149454 - DNA, 103 bp, Artificial Sequence
  Synthetic Polynucleotide
taatacgactcactatagggcgggcccacccggagcagggccggccctgaaacagaggagatcagggatggccctgctcaacctggcggcagcgcaaaagatg

SEQ ID NO: 149455 - DNA, 103 bp, Artificial Sequence
  Synthetic Polynucleotide
taatacgactcactatagggactcttctcaatcttgcagagctgagctttaacagaggagaaaagctatgctctgcaagaacctggcggcagcgcaaaagatg

SEQ ID NO: 149456 - DNA, 103 bp, Artificial Sequence
  Synthetic Polynucleotide
taatacgactcactatagggtaagactcttactcttctcaatcttgcagaaacagaggagatctgcaatgttgagaagaaacctggcggcagcgcaaaagatg

SEQ ID NO: 149457 - DNA, 103 bp, Artificial Sequence
  Synthetic Polynucleotide
taatacgactcactatagggtcggtttgtttaagactcttactcttctcaaacagaggagatgagaaatgtaagagtctaacctggcggcagcgcaaaagatg

SEQ ID NO: 149458 - DNA, 103 bp, Artificial Sequence
  Synthetic Polynucleotide
taatacgactcactatagggtttgggctggtcggtttgtttaagactcttaacagaggagaaagagtatgaaacaaaccaacctggcggcagcgcaaaagatg

SEQ ID NO: 149459 - DNA, 103 bp, Artificial Sequence
  Synthetic Polynucleotide
taatacgactcactataggggaccctgtgctttgggctggtcggtttgttaacagaggagaaacaaaatgaccagcccaaacctggcggcagcgcaaaagatg

SEQ ID NO: 149460 - DNA, 103 bp, Artificial Sequence
  Synthetic Polynucleotide
taatacgactcactatagggtcactttcttgaccctgtgctttgggctggaacagaggagaccagccatgagcacagggaacctggcggcagcgcaaaagatg

SEQ ID NO: 149461 - DNA, 103 bp, Artificial Sequence
  Synthetic Polynucleotide
taatacgactcactatagggctctgatgagtcactttcttgaccctgtgcaacagaggagagcacagatgcaagaaagtaacctggcggcagcgcaaaagatg

SEQ ID NO: 149462 - DNA, 103 bp, Artificial Sequence
  Synthetic Polynucleotide
taatacgactcactataggggcacagaggtctctgatgagtcactttcttaacagaggagaaagaaaatgactcatcagaacctggcggcagcgcaaaagatg

SEQ ID NO: 149463 - DNA, 103 bp, Artificial Sequence
  Synthetic Polynucleotide
taatacgactcactatagggcggggtcctcgcacagaggtctctgatgagaacagaggagactcatcatggacctctgtaacctggcggcagcgcaaaagatg

SEQ ID NO: 149464 - DNA, 103 bp, Artificial Sequence
  Synthetic Polynucleotide
taatacgactcactatagggatgtttaatccggggtcctcgcacagaggtaacagaggagaacctctatgcgaggacccaacctggcggcagcgcaaaagatg

SEQ ID NO: 149465 - DNA, 103 bp, Artificial Sequence
  Synthetic Polynucleotide
taatacgactcactatagggcgtcgaagcccgggcccacccggagcagggaacagaggagaccctgcatggggtgggccaacctggcggcagcgcaaaagatg

SEQ ID NO: 149466 - DNA, 103 bp, Artificial Sequence
  Synthetic Polynucleotide
taatacgactcactatagggttctgcagacatgtttaatccggggtcctcaacagaggagagaggacatgggattaaacaacctggcggcagcgcaaaagatg

SEQ ID NO: 149467 - DNA, 103 bp, Artificial Sequence
  Synthetic Polynucleotide
taatacgactcactatagggacagctgctcttctgcagacatgtttaatcaacagaggagagattaaatgtgtctgcagaacctggcggcagcgcaaaagatg

SEQ ID NO: 149468 - DNA, 103 bp, Artificial Sequence
  Synthetic Polynucleotide
taatacgactcactataggggccaagggcaacagctgctcttctgcagacaacagaggagagtctgcatgagagcagctaacctggcggcagcgcaaaagatg

SEQ ID NO: 149469 - DNA, 103 bp, Artificial Sequence
  Synthetic Polynucleotide
taatacgactcactatagggctcgttttcggccaagggcaacagctgctcaacagaggagagagcagatgttgcccttgaacctggcggcagcgcaaaagatg

SEQ ID NO: 149470 - DNA, 103 bp, Artificial Sequence
  Synthetic Polynucleotide
taatacgactcactatagggggaaacacagctcgttttcggccaagggcaaacagaggagatgccctatgccgaaaacgaacctggcggcagcgcaaaagatg

SEQ ID NO: 149471 - DNA, 103 bp, Artificial Sequence
  Synthetic Polynucleotide
taatacgactcactatagggcatgtcatcaggaaacacagctcgttttcgaacagaggagacgaaaaatggctgtgtttaacctggcggcagcgcaaaagatg

SEQ ID NO: 149472 - DNA, 103 bp, Artificial Sequence
  Synthetic Polynucleotide
taatacgactcactatagggtcagggtgggcatgtcatcaggaaacacagaacagaggagactgtgtatgctgatgacaaacctggcggcagcgcaaaagatg

SEQ ID NO: 149473 - DNA, 103 bp, Artificial Sequence
  Synthetic Polynucleotide
taatacgactcactatagggggtaaggcactcagggtgggcatgtcatcaaacagaggagatgatgaatggcccaccctaacctggcggcagcgcaaaagatg

SEQ ID NO: 149474 - DNA, 103 bp, Artificial Sequence
  Synthetic Polynucleotide
taatacgactcactatagggttcttcccatggtaaggcactcagggtgggaacagaggagacccaccatgagtgccttaaacctggcggcagcgcaaaagatg

SEQ ID NO: 149475 - DNA, 103 bp, Artificial Sequence
  Synthetic Polynucleotide
taatacgactcactatagggtcttttctcgttcttcccatggtaaggcacaacagaggagagtgcctatgcatgggaagaacctggcggcagcgcaaaagatg

SEQ ID NO: 149476 - DNA, 103 bp, Artificial Sequence
  Synthetic Polynucleotide
taatacgactcactatagggtgcagcgccgcgtcgaagcccgggcccaccaacagaggagaggtgggatggggcttcgaaacctggcggcagcgcaaaagatg

SEQ ID NO: 149477 - DNA, 103 bp, Artificial Sequence
  Synthetic Polynucleotide
taatacgactcactataggggaagacaaaatcttttctcgttcttcccataacagaggagaatgggaatgacgagaaaaaacctggcggcagcgcaaaagatg

SEQ ID NO: 149478 - DNA, 103 bp, Artificial Sequence
  Synthetic Polynucleotide
taatacgactcactatagggattccccatggaagacaaaatcttttctcgaacagaggagacgagaaatgattttgtctaacctggcggcagcgcaaaagatg

SEQ ID NO: 149479 - DNA, 103 bp, Artificial Sequence
  Synthetic Polynucleotide
taatacgactcactatagggacttgtcatcattccccatggaagacaaaaaacagaggagattttgtatgccatggggaaacctggcggcagcgcaaaagatg

SEQ ID NO: 149480 - DNA, 103 bp, Artificial Sequence
  Synthetic Polynucleotide
taatacgactcactataggggcaattgatgacttgtcatcattccccatgaacagaggagacatgggatgtgatgacaaaacctggcggcagcgcaaaagatg

SEQ ID NO: 149481 - DNA, 103 bp, Artificial Sequence
  Synthetic Polynucleotide
taatacgactcactatagggttctgagccagcaattgatgacttgtcatcaacagaggagagatgacatgtcatcaattaacctggcggcagcgcaaaagatg

SEQ ID NO: 149482 - DNA, 103 bp, Artificial Sequence
  Synthetic Polynucleotide
taatacgactcactataggggttcagcatcttctgagccagcaattgatgaacagaggagacatcaaatgctggctcagaacctggcggcagcgcaaaagatg

SEQ ID NO: 149483 - DNA, 103 bp, Artificial Sequence
  Synthetic Polynucleotide
taatacgactcactatagggggagcaagaggttcagcatcttctgagccaaacagaggagatggctcatgagatgctgaaacctggcggcagcgcaaaagatg

SEQ ID NO: 149484 - DNA, 103 bp, Artificial Sequence
  Synthetic Polynucleotide
taatacgactcactatagggtttgatgggtggagcaagaggttcagcatcaacagaggagagatgctatgcctcttgctaacctggcggcagcgcaaaagatg

SEQ ID NO: 149485 - DNA, 103 bp, Artificial Sequence
  Synthetic Polynucleotide
taatacgactcactataggggtttaattggtttgatgggtggagcaagagaacagaggagactcttgatgcacccatcaaacctggcggcagcgcaaaagatg

SEQ ID NO: 149486 - DNA, 103 bp, Artificial Sequence
  Synthetic Polynucleotide
taatacgactcactatagggctagtgacaggtttaattggtttgatgggtaacagaggagaacccatatgaccaattaaaacctggcggcagcgcaaaagatg

SEQ ID NO: 149487 - DNA, 103 bp, Artificial Sequence
  Synthetic Polynucleotide
taatacgactcactatagggggccgagacctgcagcgccgcgtcgaagccaacagaggagaggcttcatggcggcgctgaacctggcggcagcgcaaaagatg

SEQ ID NO: 149488 - DNA, 103 bp, Artificial Sequence
  Synthetic Polynucleotide
taatacgactcactatagggtgccttgtttctagtgacaggtttaattggaacagaggagaccaattatgcctgtcactaacctggcggcagcgcaaaagatg

SEQ ID NO: 149489 - DNA, 103 bp, Artificial Sequence
  Synthetic Polynucleotide
taatacgactcactataggggttcctggggtgccttgtttctagtgacagaacagaggagactgtcaatggaaacaaggaacctggcggcagcgcaaaagatg

SEQ ID NO: 149490 - DNA, 103 bp, Artificial Sequence
  Synthetic Polynucleotide
taatacgactcactatagggtttactggaggttcctggggtgccttgtttaacagaggagaaaacaaatgaccccaggaaacctggcggcagcgcaaaagatg

SEQ ID NO: 149491 - DNA, 103 bp, Artificial Sequence
  Synthetic Polynucleotide
taatacgactcactatagggacgtcctttctttactggaggttcctggggaacagaggagaccccagatgcctccagtaaacctggcggcagcgcaaaagatg

SEQ ID NO: 149492 - DNA, 103 bp, Artificial Sequence
  Synthetic Polynucleotide
taatacgactcactataggggcctcgatcgacgtcctttctttactggagaacagaggagactccagatgagaaaggacaacctggcggcagcgcaaaagatg

SEQ ID NO: 149493 - DNA, 103 bp, Artificial Sequence
  Synthetic Polynucleotide
taatacgactcactatagggtgcccacaccgcctcgatcgacgtcctttcaacagaggagagaaaggatgtcgatcgagaacctggcggcagcgcaaaagatg

SEQ ID NO: 149494 - DNA, 103 bp, Artificial Sequence
  Synthetic Polynucleotide
taatacgactcactataggggccgggacactgcccacaccgcctcgatcgaacagaggagacgatcgatgcggtgtgggaacctggcggcagcgcaaaagatg

SEQ ID NO: 149495 - DNA, 103 bp, Artificial Sequence
  Synthetic Polynucleotide
taatacgactcactataggggcacctggcagccgggacactgcccacaccaacagaggagaggtgtgatgagtgtcccgaacctggcggcagcgcaaaagatg

SEQ ID NO: 149496 - DNA, 103 bp, Artificial Sequence
  Synthetic Polynucleotide
taatacgactcactatagggcagtcctcaggcacctggcagccgggacacaacagaggagagtgtccatgctgccaggtaacctggcggcagcgcaaaagatg

SEQ ID NO: 149497 - DNA, 103 bp, Artificial Sequence
  Synthetic Polynucleotide
taatacgactcactatagggacaaacaccacagtcctcaggcacctggcaaacagaggagatgccagatgcctgaggacaacctggcggcagcgcaaaagatg

SEQ ID NO: 149498 - DNA, 103 bp, Artificial Sequence
  Synthetic Polynucleotide
taatacgactcactatagggtgccgatggcggccgagacctgcagcgccgaacagaggagacggcgcatgaggtctcggaacctggcggcagcgcaaaagatg

SEQ ID NO: 149499 - DNA, 103 bp, Artificial Sequence
  Synthetic Polynucleotide
taatacgactcactatagggagcaattagtacaaacaccacagtcctcagaacagaggagactgaggatggtggtgtttaacctggcggcagcgcaaaagatg

SEQ ID NO: 149500 - DNA, 103 bp, Artificial Sequence
  Synthetic Polynucleotide
taatacgactcactatagggggcttatctaagcaattagtacaaacaccaaacagaggagatggtgtatgtactaattgaacctggcggcagcgcaaaagatg

SEQ ID NO: 149501 - DNA, 103 bp, Artificial Sequence
  Synthetic Polynucleotide
taatacgactcactatagggaccaaacttgggcttatctaagcaattagtaacagaggagaactaatatgttagataagaacctggcggcagcgcaaaagatg

SEQ ID NO: 149502 - DNA, 103 bp, Artificial Sequence
  Synthetic Polynucleotide
taatacgactcactatagggtattgcgaccaccaaacttgggcttatctaaacagaggagatagataatgccaagtttgaacctggcggcagcgcaaaagatg

SEQ ID NO: 149503 - DNA, 103 bp, Artificial Sequence
  Synthetic Polynucleotide
taatacgactcactatagggtgcttctttatattgcgaccaccaaacttgaacagaggagacaagttatgtggtcgcaaaacctggcggcagcgcaaaagatg

SEQ ID NO: 149504 - DNA, 103 bp, Artificial Sequence
  Synthetic Polynucleotide
taatacgactcactatagggcttgcagcactgcttctttatattgcgaccaacagaggagaggtcgcatgataaagaagaacctggcggcagcgcaaaagatg

SEQ ID NO: 149505 - DNA, 103 bp, Artificial Sequence
  Synthetic Polynucleotide
taatacgactcactatagggattttctcatcttgcagcactgcttctttaaacagaggagataaagaatgagtgctgcaaacctggcggcagcgcaaaagatg

SEQ ID NO: 149506 - DNA, 103 bp, Artificial Sequence
  Synthetic Polynucleotide
taatacgactcactatagggagattctgacattttctcatcttgcagcacaacagaggagagtgctgatggatgagaaaaacctggcggcagcgcaaaagatg

SEQ ID NO: 149507 - DNA, 103 bp, Artificial Sequence
  Synthetic Polynucleotide
taatacgactcactatagggcatccattgtagattctgacattttctcataacagaggagaatgagaatgtgtcagaataacctggcggcagcgcaaaagatg

SEQ ID NO: 149508 - DNA, 103 bp, Artificial Sequence
  Synthetic Polynucleotide
taatacgactcactatagggctttggaaggcatccattgtagattctgacaacagaggagagtcagaatgtacaatggaaacctggcggcagcgcaaaagatg

SEQ ID NO: 149509 - DNA, 103 bp, Artificial Sequence
  Synthetic Polynucleotide
taatacgactcactatagggcgcaggttggtgccgatggcggccgagaccaacagaggagaggtctcatgcgccatcggaacctggcggcagcgcaaaagatg

SEQ ID NO: 149510 - DNA, 103 bp, Artificial Sequence
  Synthetic Polynucleotide
taatacgactcactatagggtgcaggtaggctttggaaggcatccattgtaacagaggagaacaatgatggccttccaaaacctggcggcagcgcaaaagatg

SEQ ID NO: 149511 - DNA, 103 bp, Artificial Sequence
  Synthetic Polynucleotide
taatacgactcactatagggagcttgcttctgcaggtaggctttggaaggaacagaggagaccttccatggcctacctgaacctggcggcagcgcaaaagatg

SEQ ID NO: 149512 - DNA, 103 bp, Artificial Sequence
  Synthetic Polynucleotide
taatacgactcactatagggtcacagctttagcttgcttctgcaggtaggaacagaggagacctaccatgagaagcaagaacctggcggcagcgcaaaagatg

SEQ ID NO: 149513 - DNA, 103 bp, Artificial Sequence
  Synthetic Polynucleotide
taatacgactcactatagggtctttctttttcacagctttagcttgcttcaacagaggagagaagcaatgtaaagctgtaacctggcggcagcgcaaaagatg

SEQ ID NO: 149514 - DNA, 103 bp, Artificial Sequence
  Synthetic Polynucleotide
taatacgactcactatagggagactttttctctttctttttcacagctttaacagaggagaaaagctatgaaaaagaaaaacctggcggcagcgcaaaagatg

SEQ ID NO: 149515 - DNA, 103 bp, Artificial Sequence
  Synthetic Polynucleotide
taatacgactcactatagggcactggtcttagactttttctctttcttttaacagaggagaaaaagaatgagaaaaagtaacctggcggcagcgcaaaagatg

SEQ ID NO: 149516 - DNA, 103 bp, Artificial Sequence
  Synthetic Polynucleotide
taatacgactcactatagggtctttcttttcactggtcttagactttttcaacagaggagagaaaaaatgtaagaccagaacctggcggcagcgcaaaagatg

SEQ ID NO: 149517 - DNA, 103 bp, Artificial Sequence
  Synthetic Polynucleotide
taatacgactcactatagggctctttgctgtctttcttttcactggtcttaacagaggagaaagaccatggaaaagaaaaacctggcggcagcgcaaaagatg

SEQ ID NO: 149518 - DNA, 103 bp, Artificial Sequence
  Synthetic Polynucleotide
taatacgactcactatagggcaacactgctctctttgctgtctttcttttaacagaggagaaaaagaatgacagcaaagaacctggcggcagcgcaaaagatg

SEQ ID NO: 149519 - DNA, 103 bp, Artificial Sequence
  Synthetic Polynucleotide
taatacgactcactatagggacgttcttcacaacactgctctctttgctgaacagaggagacagcaaatggagcagtgtaacctggcggcagcgcaaaagatg

SEQ ID NO: 149520 - DNA, 103 bp, Artificial Sequence
  Synthetic Polynucleotide
taatacgactcactatagggccggaaccggcgcaggttggtgccgatggcaacagaggagagccatcatgaccaacctgaacctggcggcagcgcaaaagatg

SEQ ID NO: 149521 - DNA, 103 bp, Artificial Sequence
  Synthetic Polynucleotide
taatacgactcactatagggagagtccaccacgttcttcacaacactgctaacagaggagaagcagtatggtgaagaacaacctggcggcagcgcaaaagatg

SEQ ID NO: 149522 - DNA, 103 bp, Artificial Sequence
  Synthetic Polynucleotide
taatacgactcactataggggtttctgactagagtccaccacgttcttcaaacagaggagatgaagaatgtggtggactaacctggcggcagcgcaaaagatg

SEQ ID NO: 149523 - DNA, 103 bp, Artificial Sequence
  Synthetic Polynucleotide
taatacgactcactataggggatggggtaggtttctgactagagtccaccaacagaggagaggtggaatgtagtcagaaaacctggcggcagcgcaaaagatg

SEQ ID NO: 149524 - DNA, 103 bp, Artificial Sequence
  Synthetic Polynucleotide
taatacgactcactatagggctctcttgctgatggggtaggtttctgactaacagaggagaagtcagatgcctaccccaaacctggcggcagcgcaaaagatg

SEQ ID NO: 149525 - DNA, 103 bp, Artificial Sequence
  Synthetic Polynucleotide
taatacgactcactataggggggcaggatcctctcttgctgatggggtagaacagaggagactacccatgcagcaagagaacctggcggcagcgcaaaagatg

SEQ ID NO: 149526 - DNA, 103 bp, Artificial Sequence
  Synthetic Polynucleotide
taatacgactcactatagggcttttctttggggcaggatcctctcttgctaacagaggagaagcaagatgggatcctgcaacctggcggcagcgcaaaagatg

SEQ ID NO: 149527 - DNA, 103 bp, Artificial Sequence
  Synthetic Polynucleotide
taatacgactcactatagggctcactactgcttttctttggggcaggatcaacagaggagagatcctatgccaaagaaaaacctggcggcagcgcaaaagatg

SEQ ID NO: 149528 - DNA, 103 bp, Artificial Sequence
  Synthetic Polynucleotide
taatacgactcactataggggtggaggaggctcactactgcttttctttgaacagaggagacaaagaatggcagtagtgaacctggcggcagcgcaaaagatg

SEQ ID NO: 149529 - DNA, 103 bp, Artificial Sequence
  Synthetic Polynucleotide
taatacgactcactatagggacgggctttcgtggaggaggctcactactgaacagaggagacagtagatggcctcctccaacctggcggcagcgcaaaagatg

SEQ ID NO: 149530 - DNA, 103 bp, Artificial Sequence
  Synthetic Polynucleotide
taatacgactcactatagggcttttcctcgacgggctttcgtggaggaggaacagaggagacctcctatgcgaaagcccaacctggcggcagcgcaaaagatg

SEQ ID NO: 149531 - DNA, 103 bp, Artificial Sequence
  Synthetic Polynucleotide
taatacgactcactatagggcaaacacggcccggaaccggcgcaggttggaacagaggagaccaaccatggccggttccaacctggcggcagcgcaaaagatg

SEQ ID NO: 149532 - DNA, 103 bp, Artificial Sequence
  Synthetic Polynucleotide
taatacgactcactatagggcttcttcactcttttcctcgacgggctttcaacagaggagagaaagcatgtcgaggaaaaacctggcggcagcgcaaaagatg

SEQ ID NO: 149533 - DNA, 103 bp, Artificial Sequence
  Synthetic Polynucleotide
taatacgactcactataggggagacattcccttcttcactcttttcctcgaacagaggagacgaggaatggagtgaagaaacctggcggcagcgcaaaagatg

SEQ ID NO: 149534 - DNA, 103 bp, Artificial Sequence
  Synthetic Polynucleotide
taatacgactcactatagggcccaggggccgagacattcccttcttcactaacagaggagaagtgaaatggggaatgtcaacctggcggcagcgcaaaagatg

SEQ ID NO: 149535 - DNA, 103 bp, Artificial Sequence
  Synthetic Polynucleotide
taatacgactcactatagggtggattcaggcccaggggccgagacattccaacagaggagaggaatgatgcggcccctgaacctggcggcagcgcaaaagatg

SEQ ID NO: 149536 - DNA, 103 bp, Artificial Sequence
  Synthetic Polynucleotide
taatacgactcactataggggtggcctgtttggattcaggcccaggggccaacagaggagaggccccatggcctgaatcaacctggcggcagcgcaaaagatg

SEQ ID NO: 149537 - DNA, 103 bp, Artificial Sequence
  Synthetic Polynucleotide
taatacgactcactatagggagctggagtggtggcctgtttggattcaggaacagaggagacctgaaatgaaacaggccaacctggcggcagcgcaaaagatg

SEQ ID NO: 149538 - DNA, 103 bp, Artificial Sequence
  Synthetic Polynucleotide
taatacgactcactatagggacttcctggaagctggagtggtggcctgttaacagaggagaaacaggatgccactccagaacctggcggcagcgcaaaagatg

SEQ ID NO: 149539 - DNA, 103 bp, Artificial Sequence
  Synthetic Polynucleotide
taatacgactcactatagggtgcttgcttgacttcctggaagctggagtgaacagaggagacactccatgttccaggaaaacctggcggcagcgcaaaagatg

SEQ ID NO: 149540 - DNA, 103 bp, Artificial Sequence
  Synthetic Polynucleotide
taatacgactcactatagggctgggagacctgcttgcttgacttcctggaaacagaggagatccaggatgtcaagcaagaacctggcggcagcgcaaaagatg

SEQ ID NO: 149541 - DNA, 103 bp, Artificial Sequence
  Synthetic Polynucleotide
taatacgactcactatagggccagtgctggctgggagacctgcttgcttgaacagaggagacaagcaatgaggtctcccaacctggcggcagcgcaaaagatg

SEQ ID NO: 149542 - DNA, 103 bp, Artificial Sequence
  Synthetic Polynucleotide
taatacgactcactatagggccgctctccccaaacacggcccggaaccggaacagaggagaccggttatgggccgtgttaacctggcggcagcgcaaaagatg

SEQ ID NO: 149543 - DNA, 103 bp, Artificial Sequence
  Synthetic Polynucleotide
taatacgactcactatagggggcgggatgaccagtgctggctgggagaccaacagaggagaggtctcatggccagcactaacctggcggcagcgcaaaagatg

SEQ ID NO: 149544 - DNA, 103 bp, Artificial Sequence
  Synthetic Polynucleotide
taatacgactcactatagggaggtggctgaggcgggatgaccagtgctggaacagaggagaccagcaatggtcatcccgaacctggcggcagcgcaaaagatg

SEQ ID NO: 149545 - DNA, 103 bp, Artificial Sequence
  Synthetic Polynucleotide
taatacgactcactataggggtcctgtagtaggtggctgaggcgggatgaaacagaggagatcatccatgctcagccacaacctggcggcagcgcaaaagatg

SEQ ID NO: 149546 - DNA, 103 bp, Artificial Sequence
  Synthetic Polynucleotide
taatacgactcactatagggtttcttggcggtcctgtagtaggtggctgaaacagaggagatcagccatgtactacaggaacctggcggcagcgcaaaagatg

SEQ ID NO: 149547 - DNA, 103 bp, Artificial Sequence
  Synthetic Polynucleotide
taatacgactcactataggggggaacttcttttcttggcggtcctgtagtaacagaggagaactacaatgccgccaagaaacctggcggcagcgcaaaagatg

SEQ ID NO: 149548 - DNA, 103 bp, Artificial Sequence
  Synthetic Polynucleotide
taatacgactcactataggggagtggttttgggaacttcttttcttggcgaacagaggagacgccaaatgaagaagttcaacctggcggcagcgcaaaagatg

SEQ ID NO: 149549 - DNA, 103 bp, Artificial Sequence
  Synthetic Polynucleotide
taatacgactcactatagggggctcactaggagtggttttgggaacttctaacagaggagaagaagtatgcaaaaccacaacctggcggcagcgcaaaagatg

SEQ ID NO: 149550 - DNA, 103 bp, Artificial Sequence
  Synthetic Polynucleotide
taatacgactcactatagggctttttcttgggctcactaggagtggttttaacagaggagaaaaaccatgcctagtgagaacctggcggcagcgcaaaagatg

SEQ ID NO: 149551 - DNA, 103 bp, Artificial Sequence
  Synthetic Polynucleotide
taatacgactcactataggggtggaggctgctttttcttgggctcactagaacagaggagactagtgatgccaagaaaaaacctggcggcagcgcaaaagatg

SEQ ID NO: 149552 - DNA, 103 bp, Artificial Sequence
  Synthetic Polynucleotide
taatacgactcactataggggattctggtggtggaggctgctttttcttgaacagaggagacaagaaatggcagcctccaacctggcggcagcgcaaaagatg

SEQ ID NO: 149553 - DNA, 103 bp, Artificial Sequence
  Synthetic Polynucleotide
taatacgactcactataggggccgccgcccccggtggtcccgggtcgggcaacagaggagagcccgaatggggaccaccaacctggcggcagcgcaaaagatg

SEQ ID NO: 149554 - DNA, 103 bp, Artificial Sequence
  Synthetic Polynucleotide
taatacgactcactataggggcctcccccgccgctctccccaaacacggcaacagaggagagccgtgatgggggagagcaacctggcggcagcgcaaaagatg

SEQ ID NO: 149555 - DNA, 103 bp, Artificial Sequence
  Synthetic Polynucleotide
taatacgactcactatagggctctggacctgattctggtggtggaggctgaacagaggagacagcctatgccaccagaaaacctggcggcagcgcaaaagatg

SEQ ID NO: 149556 - DNA, 103 bp, Artificial Sequence
  Synthetic Polynucleotide
taatacgactcactataggggtttgctctgctctggacctgattctggtgaacagaggagacaccagatgcaggtccagaacctggcggcagcgcaaaagatg

SEQ ID NO: 149557 - DNA, 103 bp, Artificial Sequence
  Synthetic Polynucleotide
taatacgactcactatagggacttttttctgtttgctctgctctggacctaacagaggagaaggtccatggcagagcaaaacctggcggcagcgcaaaagatg

SEQ ID NO: 149558 - DNA, 103 bp, Artificial Sequence
  Synthetic Polynucleotide
taatacgactcactataggggcggggagccacttttttctgtttgctctgaacagaggagacagagcatgcagaaaaaaaacctggcggcagcgcaaaagatg

SEQ ID NO: 149559 - DNA, 103 bp, Artificial Sequence
  Synthetic Polynucleotide
taatacgactcactatagggggatacttgggcggggagccacttttttctaacagaggagaagaaaaatgtggctccccaacctggcggcagcgcaaaagatg

SEQ ID NO: 149560 - DNA, 103 bp, Artificial Sequence
  Synthetic Polynucleotide
taatacgactcactatagggtgttttacagggatacttgggcggggagccaacagaggagaggctccatgcccaagtataacctggcggcagcgcaaaagatg

SEQ ID NO: 149561 - DNA, 103 bp, Artificial Sequence
  Synthetic Polynucleotide
taatacgactcactatagggttttggtttttgttttacagggatacttggaacagaggagaccaagtatgcctgtaaaaaacctggcggcagcgcaaaagatg

SEQ ID NO: 149562 - DNA, 103 bp, Artificial Sequence
  Synthetic Polynucleotide
taatacgactcactatagggtttccttttcttttggtttttgttttacagaacagaggagactgtaaatgaaaaaccaaaacctggcggcagcgcaaaagatg

SEQ ID NO: 149563 - DNA, 103 bp, Artificial Sequence
  Synthetic Polynucleotide
taatacgactcactatagggggaggtggtttttccttttcttttggttttaacagaggagaaaaaccatgagaaaaggaaacctggcggcagcgcaaaagatg

SEQ ID NO: 149564 - DNA, 103 bp, Artificial Sequence
  Synthetic Polynucleotide
taatacgactcactatagggcttattgaccggaggtggtttttccttttcaacagaggagagaaaagatgaaaccacctaacctggcggcagcgcaaaagatg

SEQ ID NO: 149565 - DNA, 103 bp, Artificial Sequence
  Synthetic Polynucleotide
taatacgactcactatagggctccgctgccgcctcccccgccgctctcccaacagaggagagggagaatggcgggggagaacctggcggcagcgcaaaagatg

SEQ ID NO: 149566 - DNA, 103 bp, Artificial Sequence
  Synthetic Polynucleotide
taatacgactcactatagggcattctcctgcttattgaccggaggtggttaacagaggagaaaccacatgcggtcaataaacctggcggcagcgcaaaagatg

SEQ ID NO: 149567 - DNA, 103 bp, Artificial Sequence
  Synthetic Polynucleotide
taatacgactcactatagggaaagtgcctgcattctcctgcttattgaccaacagaggagaggtcaaatggcaggagaaaacctggcggcagcgcaaaagatg

SEQ ID NO: 149568 - DNA, 103 bp, Artificial Sequence
  Synthetic Polynucleotide
taatacgactcactataggggaggatgttcaaagtgcctgcattctcctgaacagaggagacaggagatggcaggcactaacctggcggcagcgcaaaagatg

SEQ ID NO: 149569 - DNA, 103 bp, Artificial Sequence
  Synthetic Polynucleotide
taatacgactcactatagggagagagtgctgaggatgttcaaagtgcctgaacagaggagacaggcaatgtgaacatccaacctggcggcagcgcaaaagatg

SEQ ID NO: 149570 - DNA, 103 bp, Artificial Sequence
  Synthetic Polynucleotide
taatacgactcactatagggttgccattggagagagtgctgaggatgttcaacagaggagagaacatatgcagcactctaacctggcggcagcgcaaaagatg

SEQ ID NO: 149571 - DNA, 103 bp, Artificial Sequence
  Synthetic Polynucleotide
taatacgactcactatagggcttagaactattgccattggagagagtgctaacagaggagaagcactatgtccaatggcaacctggcggcagcgcaaaagatg

SEQ ID NO: 149572 - DNA, 103 bp, Artificial Sequence
  Synthetic Polynucleotide
taatacgactcactataggggaattttttgcttagaactattgccattggaacagaggagaccaatgatgatagttctaaacctggcggcagcgcaaaagatg

SEQ ID NO: 149573 - DNA, 103 bp, Artificial Sequence
  Synthetic Polynucleotide
taatacgactcactatagggccatctgctggaattttttgcttagaactaaacagaggagatagttcatggcaaaaaataacctggcggcagcgcaaaagatg

SEQ ID NO: 149574 - DNA, 103 bp, Artificial Sequence
  Synthetic Polynucleotide
taatacgactcactatagggcctgtggactccatctgctggaattttttgaacagaggagacaaaaaatgccagcagataacctggcggcagcgcaaaagatg

SEQ ID NO: 149575 - DNA, 103 bp, Artificial Sequence
  Synthetic Polynucleotide
taatacgactcactatagggccactctgatcctgtggactccatctgctgaacagaggagacagcagatggagtccacaaacctggcggcagcgcaaaagatg

SEQ ID NO: 149576 - DNA, 103 bp, Artificial Sequence
  Synthetic Polynucleotide
taatacgactcactatagggtgctcatcctctccgctgccgcctcccccgaacagaggagacgggggatgcggcagcggaacctggcggcagcgcaaaagatg

SEQ ID NO: 149577 - DNA, 103 bp, Artificial Sequence
  Synthetic Polynucleotide
taatacgactcactatagggtccttaaagtccactctgatcctgtggactaacagaggagaagtccaatggatcagagtaacctggcggcagcgcaaaagatg

SEQ ID NO: 149578 - DNA, 103 bp, Artificial Sequence
  Synthetic Polynucleotide
taatacgactcactatagggttcacaatcctccttaaagtccactctgataacagaggagaatcagaatggactttaagaacctggcggcagcgcaaaagatg

SEQ ID NO: 149579 - DNA, 103 bp, Artificial Sequence
  Synthetic Polynucleotide
taatacgactcactatagggcattttctgcttcacaatcctccttaaagtaacagaggagaactttaatgaggattgtgaacctggcggcagcgcaaaagatg

SEQ ID NO: 149580 - DNA, 103 bp, Artificial Sequence
  Synthetic Polynucleotide
taatacgactcactatagggatctcccacacattttctgcttcacaatccaacagaggagaggattgatgagcagaaaaaacctggcggcagcgcaaaagatg

SEQ ID NO: 149581 - DNA, 103 bp, Artificial Sequence
  Synthetic Polynucleotide
taatacgactcactatagggtaagcctcccatctcccacacattttctgcaacagaggagagcagaaatggtgtgggagaacctggcggcagcgcaaaagatg

SEQ ID NO: 149582 - DNA, 103 bp, Artificial Sequence
  Synthetic Polynucleotide
taatacgactcactatagggtcaagattcctaagcctcccatctcccacaaacagaggagatgtgggatgtgggaggctaacctggcggcagcgcaaaagatg

SEQ ID NO: 149583 - DNA, 103 bp, Artificial Sequence
  Synthetic Polynucleotide
taatacgactcactatagggggaacagaagtcaagattcctaagcctcccaacagaggagagggaggatgaggaatcttaacctggcggcagcgcaaaagatg

SEQ ID NO: 149584 - DNA, 103 bp, Artificial Sequence
  Synthetic Polynucleotide
taatacgactcactataggggggtgttataggaacagaagtcaagattccaacagaggagaggaatcatgacttctgttaacctggcggcagcgcaaaagatg

SEQ ID NO: 149585 - DNA, 103 bp, Artificial Sequence
  Synthetic Polynucleotide
taatacgactcactatagggaaaccaccctgggtgttataggaacagaagaacagaggagacttctgatgctataacacaacctggcggcagcgcaaaagatg

SEQ ID NO: 149586 - DNA, 103 bp, Artificial Sequence
  Synthetic Polynucleotide
taatacgactcactatagggcagagaaagcaaaccaccctgggtgttataaacagaggagatataacatgcagggtggtaacctggcggcagcgcaaaagatg

SEQ ID NO: 149587 - DNA, 103 bp, Artificial Sequence
  Synthetic Polynucleotide
taatacgactcactatagggacctaagaattgctcatcctctccgctgccaacagaggagaggcagcatggaggatgagaacctggcggcagcgcaaaagatg

SEQ ID NO: 149588 - DNA, 103 bp, Artificial Sequence
  Synthetic Polynucleotide
taatacgactcactatagggactactggcacagagaaagcaaaccaccctaacagaggagaagggtgatgtgctttctcaacctggcggcagcgcaaaagatg

SEQ ID NO: 149589 - DNA, 103 bp, Artificial Sequence
  Synthetic Polynucleotide
taatacgactcactatagggctacatgcccactactggcacagagaaagcaacagaggagagctttcatggtgccagtaaacctggcggcagcgcaaaagatg

SEQ ID NO: 149590 - DNA, 103 bp, Artificial Sequence
  Synthetic Polynucleotide
taatacgactcactatagggtacacaaactctacatgcccactactggcaaacagaggagatgccagatgtgggcatgtaacctggcggcagcgcaaaagatg

SEQ ID NO: 149591 - DNA, 103 bp, Artificial Sequence
  Synthetic Polynucleotide
taatacgactcactataggggacttggcaatacacaaactctacatgcccaacagaggagagggcatatggagtttgtgaacctggcggcagcgcaaaagatg

SEQ ID NO: 149592 - DNA, 103 bp, Artificial Sequence
  Synthetic Polynucleotide
taatacgactcactataggggctcacaacagacttggcaatacacaaactaacagaggagaagtttgatgattgccaagaacctggcggcagcgcaaaagatg

SEQ ID NO: 149593 - DNA, 103 bp, Artificial Sequence
  Synthetic Polynucleotide
taatacgactcactatagggttgtggaagggctcacaacagacttggcaaaacagaggagattgccaatgctgttgtgaaacctggcggcagcgcaaaagatg

SEQ ID NO: 149594 - DNA, 103 bp, Artificial Sequence
  Synthetic Polynucleotide
taatacgactcactatagggtaaacaaaacttgtggaagggctcacaacaaacagaggagatgttgtatgcccttccacaacctggcggcagcgcaaaagatg

SEQ ID NO: 149595 - DNA, 103 bp, Artificial Sequence
  Synthetic Polynucleotide
taatacgactcactatagggcgttctcctctaaacaaaacttgtggaaggaacagaggagaccttccatgagttttgttaacctggcggcagcgcaaaagatg

SEQ ID NO: 149596 - DNA, 103 bp, Artificial Sequence
  Synthetic Polynucleotide
taatacgactcactatagggagagggcgctcgttctcctctaaacaaaacaacagaggagagttttgatgagaggagaaaacctggcggcagcgcaaaagatg

SEQ ID NO: 149597 - DNA, 103 bp, Artificial Sequence
  Synthetic Polynucleotide
taatacgactcactatagggctggtcctccagagggcgctcgttctcctcaacagaggagagaggagatggagcgccctaacctggcggcagcgcaaaagatg

SEQ ID NO: 149598 - DNA, 103 bp, Artificial Sequence
  Synthetic Polynucleotide
taatacgactcactatagggctgagccaaaacctaagaattgctcatcctaacagaggagaaggatgatgaattcttagaacctggcggcagcgcaaaagatg

SEQ ID NO: 149599 - DNA, 103 bp, Artificial Sequence
  Synthetic Polynucleotide
taatacgactcactatagggaattttccagctggtcctccagagggcgctaacagaggagaagcgccatgtggaggaccaacctggcggcagcgcaaaagatg

SEQ ID NO: 149600 - DNA, 103 bp, Artificial Sequence
  Synthetic Polynucleotide
taatacgactcactatagggcgacaacaccaattttccagctggtcctccaacagaggagaggaggaatggctggaaaaaacctggcggcagcgcaaaagatg

SEQ ID NO: 149601 - DNA, 103 bp, Artificial Sequence
  Synthetic Polynucleotide
taatacgactcactatagggtttgcaacgacgacaacaccaattttccagaacagaggagactggaaatgtggtgttgtaacctggcggcagcgcaaaagatg

SEQ ID NO: 149602 - DNA, 103 bp, Artificial Sequence
  Synthetic Polynucleotide
taatacgactcactatagggcgtgacagaatttgcaacgacgacaacaccaacagaggagaggtgttatggtcgttgcaaacctggcggcagcgcaaaagatg

SEQ ID NO: 149603 - DNA, 103 bp, Artificial Sequence
  Synthetic Polynucleotide
taatacgactcactatagggcttccacaaacgtgacagaatttgcaacgaaacagaggagatcgttgatgattctgtcaaacctggcggcagcgcaaaagatg

SEQ ID NO: 149604 - DNA, 103 bp, Artificial Sequence
  Synthetic Polynucleotide
taatacgactcactatagggctgatgttgccttccacaaacgtgacagaaaacagaggagattctgtatggtttgtggaaacctggcggcagcgcaaaagatg

SEQ ID NO: 149605 - DNA, 103 bp, Artificial Sequence
  Synthetic Polynucleotide
taatacgactcactataggggctttgtagcctgatgttgccttccacaaaaacagaggagatttgtgatgggcaacatcaacctggcggcagcgcaaaagatg

SEQ ID NO: 149606 - DNA, 103 bp, Artificial Sequence
  Synthetic Polynucleotide
taatacgactcactatagggtccagcagctgctttgtagcctgatgttgcaacagaggagagcaacaatgggctacaaaaacctggcggcagcgcaaaagatg

SEQ ID NO: 149607 - DNA, 103 bp, Artificial Sequence
  Synthetic Polynucleotide
taatacgactcactatagggcttattacactccagcagctgctttgtagcaacagaggagagctacaatgcagctgctgaacctggcggcagcgcaaaagatg

SEQ ID NO: 149608 - DNA, 103 bp, Artificial Sequence
  Synthetic Polynucleotide
taatacgactcactatagggtgtttcggcacttattacactccagcagctaacagaggagaagctgcatgagtgtaataaacctggcggcagcgcaaaagatg

SEQ ID NO: 149609 - DNA, 103 bp, Artificial Sequence
  Synthetic Polynucleotide
taatacgactcactatagggacttcttcatctgagccaaaacctaagaataacagaggagaattcttatgttttggctcaacctggcggcagcgcaaaagatg

SEQ ID NO: 149610 - DNA, 103 bp, Artificial Sequence
  Synthetic Polynucleotide
taatacgactcactataggggggtgatagctgtttcggcacttattacacaacagaggagagtgtaaatggtgccgaaaaacctggcggcagcgcaaaagatg

SEQ ID NO: 149611 - DNA, 103 bp, Artificial Sequence
  Synthetic Polynucleotide
taatacgactcactatagggcaggcactcagggtgatagctgtttcggcaaacagaggagatgccgaatgagctatcacaacctggcggcagcgcaaaagatg

SEQ ID NO: 149612 - DNA, 103 bp, Artificial Sequence
  Synthetic Polynucleotide
taatacgactcactatagggagtttggtcccaggcactcagggtgatagcaacagaggagagctatcatgctgagtgccaacctggcggcagcgcaaaagatg

SEQ ID NO: 149613 - DNA, 103 bp, Artificial Sequence
  Synthetic Polynucleotide
taatacgactcactatagggttggtggggtagtttggtcccaggcactcaaacagaggagatgagtgatggggaccaaaaacctggcggcagcgcaaaagatg

SEQ ID NO: 149614 - DNA, 103 bp, Artificial Sequence
  Synthetic Polynucleotide
taatacgactcactatagggctttgtgggtttggtggggtagtttggtccaacagaggagaggaccaatgtaccccaccaacctggcggcagcgcaaaagatg

SEQ ID NO: 149615 - DNA, 103 bp, Artificial Sequence
  Synthetic Polynucleotide
taatacgactcactatagggctttcttcttctttgtgggtttggtggggtaacagaggagaaccccaatgaacccacaaaacctggcggcagcgcaaaagatg

SEQ ID NO: 149616 - DNA, 103 bp, Artificial Sequence
  Synthetic Polynucleotide
taatacgactcactatagggcagatccagactttcttcttctttgtgggtaacagaggagaacccacatggaagaagaaaacctggcggcagcgcaaaagatg

SEQ ID NO: 149617 - DNA, 103 bp, Artificial Sequence
  Synthetic Polynucleotide
taatacgactcactatagggacacttggtacagatccagactttcttcttaacagaggagaaagaagatggtctggatcaacctggcggcagcgcaaaagatg

SEQ ID NO: 149618 - DNA, 103 bp, Artificial Sequence
  Synthetic Polynucleotide
taatacgactcactatagggtacagcgaacacacttggtacagatccagaaacagaggagatctggaatggtaccaagtaacctggcggcagcgcaaaagatg

SEQ ID NO: 149619 - DNA, 103 bp, Artificial Sequence
  Synthetic Polynucleotide
taatacgactcactatagggccacagctcttacagcgaacacacttggtaaacagaggagataccaaatgtgttcgctgaacctggcggcagcgcaaaagatg

SEQ ID NO: 149620 - DNA, 103 bp, Artificial Sequence
  Synthetic Polynucleotide
taatacgactcactatagggtcgcactctgacttcttcatctgagccaaaaacagaggagatttggcatggatgaagaaaacctggcggcagcgcaaaagatg

SEQ ID NO: 149621 - DNA, 103 bp, Artificial Sequence
  Synthetic Polynucleotide
taatacgactcactatagggagttgtggatccacagctcttacagcgaacaacagaggagagttcgcatgaagagctgtaacctggcggcagcgcaaaagatg

SEQ ID NO: 149622 - DNA, 103 bp, Artificial Sequence
  Synthetic Polynucleotide
taatacgactcactatagggctttgcctggagttgtggatccacagctctaacagaggagaagagctatggatccacaaaacctggcggcagcgcaaaagatg

SEQ ID NO: 149623 - DNA, 103 bp, Artificial Sequence
  Synthetic Polynucleotide
taatacgactcactataggggcatcccaccctttgcctggagttgtggataacagaggagaatccacatgtccaggcaaaacctggcggcagcgcaaaagatg

SEQ ID NO: 149624 - DNA, 103 bp, Artificial Sequence
  Synthetic Polynucleotide
taatacgactcactatagggagaccactgtgcatcccaccctttgcctggaacagaggagaccaggcatggggtgggataacctggcggcagcgcaaaagatg

SEQ ID NO: 149625 - DNA, 103 bp, Artificial Sequence
  Synthetic Polynucleotide
taatacgactcactatagggagaaatcatgagaccactgtgcatcccaccaacagaggagaggtgggatgcacagtggtaacctggcggcagcgcaaaagatg

SEQ ID NO: 149626 - DNA, 103 bp, Artificial Sequence
  Synthetic Polynucleotide
taatacgactcactatagggtgacacagtgagaaatcatgagaccactgtaacagaggagaacagtgatgtcatgatttaacctggcggcagcgcaaaagatg

SEQ ID NO: 149627 - DNA, 103 bp, Artificial Sequence
  Synthetic Polynucleotide
taatacgactcactatagggggcgcaatcatgacacagtgagaaatcatgaacagaggagacatgatatgtcactgtgtaacctggcggcagcgcaaaagatg

SEQ ID NO: 149628 - DNA, 103 bp, Artificial Sequence
  Synthetic Polynucleotide
taatacgactcactatagggcaaagagcttggcgcaatcatgacacagtgaacagaggagacactgtatgatgattgcgaacctggcggcagcgcaaaagatg

SEQ ID NO: 149629 - DNA, 103 bp, Artificial Sequence
  Synthetic Polynucleotide
taatacgactcactatagggtttcctttagcaaagagcttggcgcaatcaaacagaggagatgattgatgcaagctcttaacctggcggcagcgcaaaagatg

SEQ ID NO: 149630 - DNA, 103 bp, Artificial Sequence
  Synthetic Polynucleotide
taatacgactcactatagggagggcagaagtttcctttagcaaagagcttaacagaggagaaagctcatggctaaaggaaacctggcggcagcgcaaaagatg

SEQ ID NO: 149631 - DNA, 103 bp, Artificial Sequence
  Synthetic Polynucleotide
taatacgactcactatagggttgtgggacttcgcactctgacttcttcataacagaggagaatgaagatgtcagagtgcaacctggcggcagcgcaaaagatg

SEQ ID NO: 149632 - DNA, 103 bp, Artificial Sequence
  Synthetic Polynucleotide
taatacgactcactatagggtgtcacagagagggcagaagtttcctttagaacagaggagactaaagatgacttctgccaacctggcggcagcgcaaaagatg

SEQ ID NO: 149633 - DNA, 103 bp, Artificial Sequence
  Synthetic Polynucleotide
taatacgactcactatagggtcataacatttgtcacagagagggcagaagaacagaggagacttctgatgtctctgtgaaacctggcggcagcgcaaaagatg

SEQ ID NO: 149634 - DNA, 103 bp, Artificial Sequence
  Synthetic Polynucleotide
taatacgactcactataggggtcatcatcatcataacatttgtcacagagaacagaggagactctgtatgaaatgttataacctggcggcagcgcaaaagatg

SEQ ID NO: 149635 - DNA, 103 bp, Artificial Sequence
  Synthetic Polynucleotide
taatacgactcactatagggtactctcatagtcatcatcatcataacattaacagaggagaaatgttatgatgatgatgaacctggcggcagcgcaaaagatg

SEQ ID NO: 149636 - DNA, 103 bp, Artificial Sequence
  Synthetic Polynucleotide
taatacgactcactatagggtgcatcatcttactctcatagtcatcatcaaacagaggagatgatgaatgctatgagagaacctggcggcagcgcaaaagatg

SEQ ID NO: 149637 - DNA, 103 bp, Artificial Sequence
  Synthetic Polynucleotide
taatacgactcactatagggctttccacattgcatcatcttactctcataaacagaggagatatgagatgaagatgatgaacctggcggcagcgcaaaagatg

SEQ ID NO: 149638 - DNA, 103 bp, Artificial Sequence
  Synthetic Polynucleotide
taatacgactcactatagggagcgatcacactttccacattgcatcatctaacagaggagaagatgaatgaatgtggaaaacctggcggcagcgcaaaagatg

SEQ ID NO: 149639 - DNA, 103 bp, Artificial Sequence
  Synthetic Polynucleotide
taatacgactcactataggggaatggacccagcgatcacactttccacataacagaggagaatgtggatggtgtgatcgaacctggcggcagcgcaaaagatg

SEQ ID NO: 149640 - DNA, 103 bp, Artificial Sequence
  Synthetic Polynucleotide
taatacgactcactatagggctcacatttggaatggacccagcgatcacaaacagaggagatgtgatatgtgggtccataacctggcggcagcgcaaaagatg

SEQ ID NO: 149641 - DNA, 103 bp, Artificial Sequence
  Synthetic Polynucleotide
taatacgactcactatagggctgaaagattctcacatttggaatggacccaacagaggagagggtccatgccaaatgtgaacctggcggcagcgcaaaagatg

SEQ ID NO: 149642 - DNA, 103 bp, Artificial Sequence
  Synthetic Polynucleotide
taatacgactcactataggggaaggagaccttgtgggacttcgcactctgaacagaggagacagagtatgaagtcccacaacctggcggcagcgcaaaagatg

SEQ ID NO: 149643 - DNA, 103 bp, Artificial Sequence
  Synthetic Polynucleotide
taatacgactcactatagggtacatctcatctgaaagattctcacatttgaacagaggagacaaatgatggaatctttcaacctggcggcagcgcaaaagatg

SEQ ID NO: 149644 - DNA, 103 bp, Artificial Sequence
  Synthetic Polynucleotide
taatacgactcactatagggtagaatctcatacatctcatctgaaagattaacagaggagaaatcttatggatgagatgaacctggcggcagcgcaaaagatg

SEQ ID NO: 149645 - DNA, 103 bp, Artificial Sequence
  Synthetic Polynucleotide
taatacgactcactataggggcagattagatagaatctcatacatctcataacagaggagaatgagaatgatgagattcaacctggcggcagcgcaaaagatg

SEQ ID NO: 149646 - DNA, 103 bp, Artificial Sequence
  Synthetic Polynucleotide
taatacgactcactatagggacactttctggcagattagatagaatctcaaacagaggagatgagatatgatctaatctaacctggcggcagcgcaaaagatg

SEQ ID NO: 149647 - DNA, 103 bp, Artificial Sequence
  Synthetic Polynucleotide
taatacgactcactatagggagtgtaggccacactttctggcagattagaaacagaggagatctaatatgccagaaagtaacctggcggcagcgcaaaagatg

SEQ ID NO: 149648 - DNA, 103 bp, Artificial Sequence
  Synthetic Polynucleotide
taatacgactcactatagggagttcacacaagtgtaggccacactttctgaacagaggagacagaaaatgtggcctacaaacctggcggcagcgcaaaagatg

SEQ ID NO: 149649 - DNA, 103 bp, Artificial Sequence
  Synthetic Polynucleotide
taatacgactcactatagggcgctcagtacagttcacacaagtgtaggccaacagaggagaggcctaatgttgtgtgaaaacctggcggcagcgcaaaagatg

SEQ ID NO: 149650 - DNA, 103 bp, Artificial Sequence
  Synthetic Polynucleotide
taatacgactcactatagggtgcagggtgccgctcagtacagttcacacaaacagaggagatgtgtgatgtgtactgagaacctggcggcagcgcaaaagatg

SEQ ID NO: 149651 - DNA, 103 bp, Artificial Sequence
  Synthetic Polynucleotide
taatacgactcactataggggtcgccactctgcagggtgccgctcagtacaacagaggagagtactgatgggcaccctgaacctggcggcagcgcaaaagatg

SEQ ID NO: 149652 - DNA, 103 bp, Artificial Sequence
  Synthetic Polynucleotide
taatacgactcactatagggtcaagggccagtcgccactctgcagggtgcaacagaggagagcacccatgagagtggcgaacctggcggcagcgcaaaagatg

SEQ ID NO: 149653 - DNA, 103 bp, Artificial Sequence
  Synthetic Polynucleotide
taatacgactcactatagggagttttaactgaaggagaccttgtgggactaacagaggagaagtcccatgaggtctcctaacctggcggcagcgcaaaagatg

SEQ ID NO: 149654 - DNA, 103 bp, Artificial Sequence
  Synthetic Polynucleotide
taatacgactcactatagggcagctctttttcaagggccagtcgccactcaacagaggagagagtggatgctggcccttaacctggcggcagcgcaaaagatg

SEQ ID NO: 149655 - DNA, 103 bp, Artificial Sequence
  Synthetic Polynucleotide
taatacgactcactataggggagaaatctgcagctctttttcaagggccaaacagaggagatggcccatgaaaaagagcaacctggcggcagcgcaaaagatg

SEQ ID NO: 149656 - DNA, 103 bp, Artificial Sequence
  Synthetic Polynucleotide
taatacgactcactatagggacttgcttcagagaaatctgcagctcttttaacagaggagaaaaagaatggcagatttcaacctggcggcagcgcaaaagatg

SEQ ID NO: 149657 - DNA, 103 bp, Artificial Sequence
  Synthetic Polynucleotide
taatacgactcactatagggagctgtcagaacttgcttcagagaaatctgaacagaggagacagattatgctgaagcaaaacctggcggcagcgcaaaagatg

SEQ ID NO: 149658 - DNA, 103 bp, Artificial Sequence
  Synthetic Polynucleotide
taatacgactcactatagggaattcaacaaagctgtcagaacttgcttcaaacagaggagatgaagcatgttctgacagaacctggcggcagcgcaaaagatg

SEQ ID NO: 149659 - DNA, 103 bp, Artificial Sequence
  Synthetic Polynucleotide
taatacgactcactataggggtagtccgagaattcaacaaagctgtcagaaacagaggagatctgacatgtttgttgaaaacctggcggcagcgcaaaagatg

SEQ ID NO: 149660 - DNA, 103 bp, Artificial Sequence
  Synthetic Polynucleotide
taatacgactcactatagggcaaatggctggtagtccgagaattcaacaaaacagaggagattgttgatgtctcggactaacctggcggcagcgcaaaagatg

SEQ ID NO: 149661 - DNA, 103 bp, Artificial Sequence
  Synthetic Polynucleotide
taatacgactcactatagggggtagcgtagcaaatggctggtagtccgagaacagaggagactcggaatgccagccattaacctggcggcagcgcaaaagatg

SEQ ID NO: 149662 - DNA, 103 bp, Artificial Sequence
  Synthetic Polynucleotide
taatacgactcactataggggcagcctgccggtagcgtagcaaatggctgaacagaggagacagccaatggctacgctaaacctggcggcagcgcaaaagatg

SEQ ID NO: 149663 - DNA, 103 bp, Artificial Sequence
  Synthetic Polynucleotide
taatacgactcactatagggtggaggcttggcagcctgccggtagcgtagaacagaggagactacgcatgcggcaggctaacctggcggcagcgcaaaagatg

SEQ ID NO: 149664 - DNA, 103 bp, Artificial Sequence
  Synthetic Polynucleotide
taatacgactcactataggggccccccgccgccgccgcccccggtggtccaacagaggagaggaccaatgggggcggcgaacctggcggcagcgcaaaagatg

SEQ ID NO: 149665 - DNA, 103 bp, Artificial Sequence
  Synthetic Polynucleotide
taatacgactcactatagggttcgaggactagttttaactgaaggagaccaacagaggagaggtctcatgcagttaaaaaacctggcggcagcgcaaaagatg

SEQ ID NO: 149666 - DNA, 103 bp, Artificial Sequence
  Synthetic Polynucleotide
taatacgactcactataggggatttaagtctggaggcttggcagcctgccaacagaggagaggcaggatgccaagcctcaacctggcggcagcgcaaaagatg

SEQ ID NO: 149667 - DNA, 103 bp, Artificial Sequence
  Synthetic Polynucleotide
taatacgactcactatagggtctgtctcgggatttaagtctggaggcttgaacagaggagacaagccatgagacttaaaaacctggcggcagcgcaaaagatg

SEQ ID NO: 149668 - DNA, 103 bp, Artificial Sequence
  Synthetic Polynucleotide
taatacgactcactatagggtatactctcctctgtctcgggatttaagtcaacagaggagagacttaatgcccgagacaaacctggcggcagcgcaaaagatg

SEQ ID NO: 149669 - DNA, 103 bp, Artificial Sequence
  Synthetic Polynucleotide
taatacgactcactatagggtgcgggaaggtatactctcctctgtctcggaacagaggagaccgagaatgaggagagtaaacctggcggcagcgcaaaagatg

SEQ ID NO: 149670 - DNA, 103 bp, Artificial Sequence
  Synthetic Polynucleotide
taatacgactcactatagggtcgggggagctgcgggaaggtatactctccaacagaggagaggagagatgaccttcccgaacctggcggcagcgcaaaagatg

SEQ ID NO: 149671 - DNA, 103 bp, Artificial Sequence
  Synthetic Polynucleotide
taatacgactcactatagggatcaggtccttcgggggagctgcgggaaggaacagaggagaccttccatgagctcccccaacctggcggcagcgcaaaagatg

SEQ ID NO: 149672 - DNA, 103 bp, Artificial Sequence
  Synthetic Polynucleotide
taatacgactcactataggggaactggtggatcaggtccttcgggggagcaacagaggagagctcccatgaaggacctgaacctggcggcagcgcaaaagatg

SEQ ID NO: 149673 - DNA, 103 bp, Artificial Sequence
  Synthetic Polynucleotide
taatacgactcactatagggacctcagtaagaactggtggatcaggtcctaacagaggagaaggaccatgtccaccagtaacctggcggcagcgcaaaagatg

SEQ ID NO: 149674 - DNA, 103 bp, Artificial Sequence
  Synthetic Polynucleotide
taatacgactcactatagggctgtttgctgacctcagtaagaactggtggaacagaggagaccaccaatgcttactgagaacctggcggcagcgcaaaagatg

SEQ ID NO: 149675 - DNA, 103 bp, Artificial Sequence
  Synthetic Polynucleotide
taatacgactcactataggggctgatcatcctgtttgctgacctcagtaaaacagaggagattactgatgtcagcaaacaacctggcggcagcgcaaaagatg

SEQ ID NO: 149676 - DNA, 103 bp, Artificial Sequence
  Synthetic Polynucleotide
taatacgactcactatagggccacgaggttttcgaggactagttttaactaacagaggagaagttaaatgtagtcctcgaacctggcggcagcgcaaaagatg

SEQ ID NO: 149677 - DNA, 103 bp, Artificial Sequence
  Synthetic Polynucleotide
taatacgactcactatagggtctaaaggctgctgatcatcctgtttgctgaacagaggagacagcaaatgggatgatcaaacctggcggcagcgcaaaagatg

SEQ ID NO: 149678 - DNA, 103 bp, Artificial Sequence
  Synthetic Polynucleotide
taatacgactcactatagggtccttctagatctaaaggctgctgatcatcaacagaggagagatgatatgcagcctttaaacctggcggcagcgcaaaagatg

SEQ ID NO: 149679 - DNA, 103 bp, Artificial Sequence
  Synthetic Polynucleotide
taatacgactcactatagggtcctcttgactccttctagatctaaaggctaacagaggagaagccttatgatctagaagaacctggcggcagcgcaaaagatg

SEQ ID NO: 149680 - DNA, 103 bp, Artificial Sequence
  Synthetic Polynucleotide
taatacgactcactatagggtggtccatcttcctcttgactccttctagaaacagaggagatctagaatgagtcaagagaacctggcggcagcgcaaaagatg

SEQ ID NO: 149681 - DNA, 103 bp, Artificial Sequence
  Synthetic Polynucleotide
taatacgactcactataggggtaattcccttggtccatcttcctcttgacaacagaggagagtcaagatgaagatggacaacctggcggcagcgcaaaagatg

SEQ ID NO: 149682 - DNA, 103 bp, Artificial Sequence
  Synthetic Polynucleotide
taatacgactcactatagggacacagatgtgtaattcccttggtccatctaacagaggagaagatggatgaagggaattaacctggcggcagcgcaaaagatg

SEQ ID NO: 149683 - DNA, 103 bp, Artificial Sequence
  Synthetic Polynucleotide
taatacgactcactatagggctgaactccaacacagatgtgtaattccctaacagaggagaagggaaatgcacatctgtaacctggcggcagcgcaaaagatg

SEQ ID NO: 149684 - DNA, 103 bp, Artificial Sequence
  Synthetic Polynucleotide
taatacgactcactatagggaatatcatcactgaactccaacacagatgtaacagaggagaacatctatgttggagttcaacctggcggcagcgcaaaagatg

SEQ ID NO: 149685 - DNA, 103 bp, Artificial Sequence
  Synthetic Polynucleotide
taatacgactcactatagggtgatcttcacaatatcatcactgaactccaaacagaggagatggagtatggtgatgataaacctggcggcagcgcaaaagatg

SEQ ID NO: 149686 - DNA, 103 bp, Artificial Sequence
  Synthetic Polynucleotide
taatacgactcactataggggctgcttgaatgatcttcacaatatcatcaaacagaggagatgatgaatgtgtgaagataacctggcggcagcgcaaaagatg

SEQ ID NO: 149687 - DNA, 103 bp, Artificial Sequence
  Synthetic Polynucleotide
taatacgactcactatagggtctaggtctcccacgaggttttcgaggactaacagaggagaagtcctatgaaacctcgtaacctggcggcagcgcaaaagatg

SEQ ID NO: 149688 - DNA, 103 bp, Artificial Sequence
  Synthetic Polynucleotide
taatacgactcactatagggtgaattaatggctgcttgaatgatcttcacaacagaggagagtgaagatgattcaagcaaacctggcggcagcgcaaaagatg

SEQ ID NO: 149689 - DNA, 103 bp, Artificial Sequence
  Synthetic Polynucleotide
taatacgactcactataggggtcctccatctgaattaatggctgcttgaaaacagaggagattcaagatgccattaattaacctggcggcagcgcaaaagatg

SEQ ID NO: 149690 - DNA, 103 bp, Artificial Sequence
  Synthetic Polynucleotide
taatacgactcactatagggatttctggctgtcctccatctgaattaatgaacagaggagacattaaatgagatggaggaacctggcggcagcgcaaaagatg

SEQ ID NO: 149691 - DNA, 103 bp, Artificial Sequence
  Synthetic Polynucleotide
taatacgactcactatagggggcttttttaatttctggctgtcctccatcaacagaggagagatggaatgcagccagaaaacctggcggcagcgcaaaagatg

SEQ ID NO: 149692 - DNA, 103 bp, Artificial Sequence
  Synthetic Polynucleotide
taatacgactcactatagggccatgctgttggcttttttaatttctggctaacagaggagaagccagatgttaaaaaagaacctggcggcagcgcaaaagatg

SEQ ID NO: 149693 - DNA, 103 bp, Artificial Sequence
  Synthetic Polynucleotide
taatacgactcactatagggaaggacttgaccatgctgttggcttttttaaacagaggagataaaaaatgcaacagcataacctggcggcagcgcaaaagatg

SEQ ID NO: 149694 - DNA, 103 bp, Artificial Sequence
  Synthetic Polynucleotide
taatacgactcactatagggccgaatgaagaaggacttgaccatgctgttaacagaggagaaacagcatggtcaagtccaacctggcggcagcgcaaaagatg

SEQ ID NO: 149695 - DNA, 103 bp, Artificial Sequence
  Synthetic Polynucleotide
taatacgactcactataggggttccatttgccgaatgaagaaggacttgaaacagaggagatcaagtatgtcttcattcaacctggcggcagcgcaaaagatg

SEQ ID NO: 149696 - DNA, 103 bp, Artificial Sequence
  Synthetic Polynucleotide
taatacgactcactatagggggaaaaacacgttccatttgccgaatgaagaacagaggagacttcatatggcaaatggaaacctggcggcagcgcaaaagatg

SEQ ID NO: 149697 - DNA, 103 bp, Artificial Sequence
  Synthetic Polynucleotide
taatacgactcactatagggactgaaccatggaaaaacacgttccatttgaacagaggagacaaatgatgcgtgtttttaacctggcggcagcgcaaaagatg

SEQ ID NO: 149698 - DNA, 103 bp, Artificial Sequence
  Synthetic Polynucleotide
taatacgactcactatagggcagagccacttctaggtctcccacgaggttaacagaggagaaacctcatgggagacctaaacctggcggcagcgcaaaagatg

SEQ ID NO: 149699 - DNA, 103 bp, Artificial Sequence
  Synthetic Polynucleotide
taatacgactcactatagggactttttgacactgaaccatggaaaaacacaacagaggagagtgtttatgcatggttcaaacctggcggcagcgcaaaagatg

SEQ ID NO: 149700 - DNA, 103 bp, Artificial Sequence
  Synthetic Polynucleotide
taatacgactcactatagggcaaaacctggactttttgacactgaaccataacagaggagaatggttatgtgtcaaaaaaacctggcggcagcgcaaaagatg

SEQ ID NO: 149701 - DNA, 103 bp, Artificial Sequence
  Synthetic Polynucleotide
taatacgactcactatagggatttggctcccaaaacctggactttttgacaacagaggagagtcaaaatgtccaggtttaacctggcggcagcgcaaaagatg

SEQ ID NO: 149702 - DNA, 103 bp, Artificial Sequence
  Synthetic Polynucleotide
taatacgactcactatagggttgatactttatttggctcccaaaacctggaacagaggagaccaggtatggggagccaaaacctggcggcagcgcaaaagatg

SEQ ID NO: 149703 - DNA, 103 bp, Artificial Sequence
  Synthetic Polynucleotide
taatacgactcactatagggccactgttgcttgatactttatttggctccaacagaggagaggagccatgtaaagtatcaacctggcggcagcgcaaaagatg

SEQ ID NO: 149704 - DNA, 103 bp, Artificial Sequence
  Synthetic Polynucleotide
taatacgactcactatagggtggtaacatcccactgttgcttgatactttaacagaggagaaaagtaatgagcaacagtaacctggcggcagcgcaaaagatg

SEQ ID NO: 149705 - DNA, 103 bp, Artificial Sequence
  Synthetic Polynucleotide
taatacgactcactataggggcactgcgtttggtaacatcccactgttgcaacagaggagagcaacaatgggatgttacaacctggcggcagcgcaaaagatg

SEQ ID NO: 149706 - DNA, 103 bp, Artificial Sequence
  Synthetic Polynucleotide
taatacgactcactataggggaaggtggaagcactgcgtttggtaacatcaacagaggagagatgttatgaaacgcagtaacctggcggcagcgcaaaagatg

SEQ ID NO: 149707 - DNA, 103 bp, Artificial Sequence
  Synthetic Polynucleotide
taatacgactcactatagggatggtcaagtgaaggtggaagcactgcgttaacagaggagaaacgcaatgcttccacctaacctggcggcagcgcaaaagatg

SEQ ID NO: 149708 - DNA, 103 bp, Artificial Sequence
  Synthetic Polynucleotide
taatacgactcactataggggagcataattatggtcaagtgaaggtggaaaacagaggagattccacatgcacttgaccaacctggcggcagcgcaaaagatg

SEQ ID NO: 149709 - DNA, 103 bp, Artificial Sequence
  Synthetic Polynucleotide
taatacgactcactataggggaatttcggtcagagccacttctaggtctcaacagaggagagagaccatgaagtggctcaacctggcggcagcgcaaaagatg

SEQ ID NO: 149710 - DNA, 103 bp, Artificial Sequence
  Synthetic Polynucleotide
taatacgactcactatagggtcctgccactgagcataattatggtcaagtaacagaggagaacttgaatgtaattatgcaacctggcggcagcgcaaaagatg

SEQ ID NO: 149711 - DNA, 103 bp, Artificial Sequence
  Synthetic Polynucleotide
taatacgactcactatagggttcctctcgctcctgccactgagcataattaacagaggagaaattatatgcagtggcagaacctggcggcagcgcaaaagatg

SEQ ID NO: 149712 - DNA, 103 bp, Artificial Sequence
  Synthetic Polynucleotide
taatacgactcactatagggtgtggctgttttcctctcgctcctgccactaacagaggagaagtggcatgagcgagaggaacctggcggcagcgcaaaagatg

SEQ ID NO: 149713 - DNA, 103 bp, Artificial Sequence
  Synthetic Polynucleotide
taatacgactcactatagggggctgctcagtgtggctgttttcctctcgcaacagaggagagcgagaatgaaacagccaaacctggcggcagcgcaaaagatg

SEQ ID NO: 149714 - DNA, 103 bp, Artificial Sequence
  Synthetic Polynucleotide
taatacgactcactatagggcattaaaggaggctgctcagtgtggctgttaacagaggagaaacagcatgactgagcagaacctggcggcagcgcaaaagatg

SEQ ID NO: 149715 - DNA, 103 bp, Artificial Sequence
  Synthetic Polynucleotide
taatacgactcactatagggtgattttcttcattaaaggaggctgctcagaacagaggagactgagcatgctcctttaaaacctggcggcagcgcaaaagatg

SEQ ID NO: 149716 - DNA, 103 bp, Artificial Sequence
  Synthetic Polynucleotide
taatacgactcactatagggggagctggaatgattttcttcattaaaggaaacagaggagatcctttatggaagaaaataacctggcggcagcgcaaaagatg

SEQ ID NO: 149717 - DNA, 103 bp, Artificial Sequence
  Synthetic Polynucleotide
taatacgactcactatagggtttgggtttgggagctggaatgattttcttaacagaggagaaagaaaatgattccagctaacctggcggcagcgcaaaagatg

SEQ ID NO: 149718 - DNA, 103 bp, Artificial Sequence
  Synthetic Polynucleotide
taatacgactcactatagggctccaggacctttgggtttgggagctggaaaacagaggagattccagatgccaaacccaaacctggcggcagcgcaaaagatg

SEQ ID NO: 149719 - DNA, 103 bp, Artificial Sequence
  Synthetic Polynucleotide
taatacgactcactataggggagtctggttctccaggacctttgggtttgaacagaggagacaaaccatgaggtcctggaacctggcggcagcgcaaaagatg

SEQ ID NO: 149720 - DNA, 103 bp, Artificial Sequence
  Synthetic Polynucleotide
taatacgactcactataggggaggatagctgaatttcggtcagagccactaacagaggagaagtggcatggaccgaaataacctggcggcagcgcaaaagatg

SEQ ID NO: 149721 - DNA, 103 bp, Artificial Sequence
  Synthetic Polynucleotide
taatacgactcactatagggaggagttggtgagtctggttctccaggaccaacagaggagaggtcctatggaaccagacaacctggcggcagcgcaaaagatg

SEQ ID NO: 149722 - DNA, 103 bp, Artificial Sequence
  Synthetic Polynucleotide
taatacgactcactataggggaggatgcagaggagttggtgagtctggttaacagaggagaaaccagatgcaccaactcaacctggcggcagcgcaaaagatg

SEQ ID NO: 149723 - DNA, 103 bp, Artificial Sequence
  Synthetic Polynucleotide
taatacgactcactatagggggtggtgtaggaggatgcagaggagttggtaacagaggagaaccaacatgtctgcatccaacctggcggcagcgcaaaagatg

SEQ ID NO: 149724 - DNA, 103 bp, Artificial Sequence
  Synthetic Polynucleotide
taatacgactcactatagggactcaaaattggtggtgtaggaggatgcagaacagaggagactgcatatgcctacaccaaacctggcggcagcgcaaaagatg

SEQ ID NO: 149725 - DNA, 103 bp, Artificial Sequence
  Synthetic Polynucleotide
taatacgactcactatagggtcctatcagtactcaaaattggtggtgtagaacagaggagactacacatgcaattttgaaacctggcggcagcgcaaaagatg

SEQ ID NO: 149726 - DNA, 103 bp, Artificial Sequence
  Synthetic Polynucleotide
taatacgactcactatagggtcttctcgactcctatcagtactcaaaattaacagaggagaaattttatgtactgatagaacctggcggcagcgcaaaagatg

SEQ ID NO: 149727 - DNA, 103 bp, Artificial Sequence
  Synthetic Polynucleotide
taatacgactcactatagggctctggactgtcttctcgactcctatcagtaacagaggagaactgatatgagtcgagaaaacctggcggcagcgcaaaagatg

SEQ ID NO: 149728 - DNA, 103 bp, Artificial Sequence
  Synthetic Polynucleotide
taatacgactcactataggggtgggttcagctctggactgtcttctcgacaacagaggagagtcgagatgacagtccagaacctggcggcagcgcaaaagatg

SEQ ID NO: 149729 - DNA, 103 bp, Artificial Sequence
  Synthetic Polynucleotide
taatacgactcactatagggatgcctgggggtgggttcagctctggactgaacagaggagacagtccatggctgaacccaacctggcggcagcgcaaaagatg

SEQ ID NO: 149730 - DNA, 103 bp, Artificial Sequence
  Synthetic Polynucleotide
taatacgactcactatagggattgtcttctatgcctgggggtgggttcagaacagaggagactgaacatgcccccaggcaacctggcggcagcgcaaaagatg

SEQ ID NO: 149731 - DNA, 103 bp, Artificial Sequence
  Synthetic Polynucleotide
taatacgactcactatagggatggatctgagaggatagctgaatttcggtaacagaggagaaccgaaatgcagctatccaacctggcggcagcgcaaaagatg

SEQ ID NO: 149732 - DNA, 103 bp, Artificial Sequence
  Synthetic Polynucleotide
taatacgactcactatagggcacactgtctattgtcttctatgcctggggaacagaggagaccccagatgtagaagacaaacctggcggcagcgcaaaagatg

SEQ ID NO: 149733 - DNA, 103 bp, Artificial Sequence
  Synthetic Polynucleotide
taatacgactcactatagggaaacataacgcacactgtctattgtcttctaacagaggagaagaagaatgtagacagtgaacctggcggcagcgcaaaagatg

SEQ ID NO: 149734 - DNA, 103 bp, Artificial Sequence
  Synthetic Polynucleotide
taatacgactcactatagggaccataagtcaaacataacgcacactgtctaacagaggagaagacagatggcgttatgtaacctggcggcagcgcaaaagatg

SEQ ID NO: 149735 - DNA, 103 bp, Artificial Sequence
  Synthetic Polynucleotide
taatacgactcactatagggcactgtcatcaccataagtcaaacataacgaacagaggagacgttatatgtgacttatgaacctggcggcagcgcaaaagatg

SEQ ID NO: 149736 - DNA, 103 bp, Artificial Sequence
  Synthetic Polynucleotide
taatacgactcactataggggcatcattagcactgtcatcaccataagtcaacagaggagagacttaatgtgatgacagaacctggcggcagcgcaaaagatg

SEQ ID NO: 149737 - DNA, 103 bp, Artificial Sequence
  Synthetic Polynucleotide
taatacgactcactatagggtaaacgaccagcatcattagcactgtcatcaacagaggagagatgacatggctaatgataacctggcggcagcgcaaaagatg

SEQ ID NO: 149738 - DNA, 103 bp, Artificial Sequence
  Synthetic Polynucleotide
taatacgactcactatagggcaatatatagtaaacgaccagcatcattagaacagaggagactaatgatgctggtcgttaacctggcggcagcgcaaaagatg

SEQ ID NO: 149739 - DNA, 103 bp, Artificial Sequence
  Synthetic Polynucleotide
taatacgactcactatagggtcattttggccaatatatagtaaacgaccaaacagaggagatggtcgatgactatatataacctggcggcagcgcaaaagatg

SEQ ID NO: 149740 - DNA, 103 bp, Artificial Sequence
  Synthetic Polynucleotide
taatacgactcactatagggatgtgtccactcattttggccaatatatagaacagaggagactatatatgggccaaaataacctggcggcagcgcaaaagatg

SEQ ID NO: 149741 - DNA, 103 bp, Artificial Sequence
  Synthetic Polynucleotide
taatacgactcactatagggcacaatttacatgtgtccactcattttggcaacagaggagagccaaaatgagtggacacaacctggcggcagcgcaaaagatg

SEQ ID NO: 149742 - DNA, 103 bp, Artificial Sequence
  Synthetic Polynucleotide
taatacgactcactataggggaaaacacagatggatctgagaggatagctaacagaggagaagctatatgctcagatccaacctggcggcagcgcaaaagatg

SEQ ID NO: 149743 - DNA, 103 bp, Artificial Sequence
  Synthetic Polynucleotide
taatacgactcactataggggaccacaaagcacaatttacatgtgtccacaacagaggagagtggacatgtgtaaattgaacctggcggcagcgcaaaagatg

SEQ ID NO: 149744 - DNA, 103 bp, Artificial Sequence
  Synthetic Polynucleotide
taatacgactcactatagggcacttccgctgaccacaaagcacaatttacaacagaggagagtaaatatggctttgtggaacctggcggcagcgcaaaagatg

SEQ ID NO: 149745 - DNA, 103 bp, Artificial Sequence
  Synthetic Polynucleotide
taatacgactcactatagggcatcttcaaacacttccgctgaccacaaagaacagaggagactttgtatgcagcggaagaacctggcggcagcgcaaaagatg

SEQ ID NO: 149746 - DNA, 103 bp, Artificial Sequence
  Synthetic Polynucleotide
taatacgactcactataggggatccgtcatcatcttcaaacacttccgctaacagaggagaagcggaatggtttgaagaaacctggcggcagcgcaaaagatg

SEQ ID NO: 149747 - DNA, 103 bp, Artificial Sequence
  Synthetic Polynucleotide
taatacgactcactatagggattctttagtgatccgtcatcatcttcaaaaacagaggagatttgaaatggatgacggaaacctggcggcagcgcaaaagatg

SEQ ID NO: 149748 - DNA, 103 bp, Artificial Sequence
  Synthetic Polynucleotide
taatacgactcactatagggccatatgcacattctttagtgatccgtcataacagaggagaatgacgatgcactaaagaaacctggcggcagcgcaaaagatg

SEQ ID NO: 149749 - DNA, 103 bp, Artificial Sequence
  Synthetic Polynucleotide
taatacgactcactatagggctgatcacagccatatgcacattctttagtaacagaggagaactaaaatgtgtgcatataacctggcggcagcgcaaaagatg

SEQ ID NO: 149750 - DNA, 103 bp, Artificial Sequence
  Synthetic Polynucleotide
taatacgactcactatagggctgcttgcccctgatcacagccatatgcacaacagaggagagtgcatatggctgtgatcaacctggcggcagcgcaaaagatg

SEQ ID NO: 149751 - DNA, 103 bp, Artificial Sequence
  Synthetic Polynucleotide
taatacgactcactatagggcacatctcagctgcttgcccctgatcacagaacagaggagactgtgaatgggggcaagcaacctggcggcagcgcaaaagatg

SEQ ID NO: 149752 - DNA, 103 bp, Artificial Sequence
  Synthetic Polynucleotide
taatacgactcactatagggtggcagaattcacatctcagctgcttgcccaacagaggagagggcaaatggctgagatgaacctggcggcagcgcaaaagatg

SEQ ID NO: 149753 - DNA, 103 bp, Artificial Sequence
  Synthetic Polynucleotide
taatacgactcactatagggatttagaggggaaaacacagatggatctgaaacagaggagatcagatatgtctgtgtttaacctggcggcagcgcaaaagatg

SEQ ID NO: 149754 - DNA, 103 bp, Artificial Sequence
  Synthetic Polynucleotide
taatacgactcactatagggtcctggcttttggcagaattcacatctcagaacagaggagactgagaatggaattctgcaacctggcggcagcgcaaaagatg

SEQ ID NO: 149755 - DNA, 103 bp, Artificial Sequence
  Synthetic Polynucleotide
taatacgactcactatagggccacggtggctcctggcttttggcagaattaacagaggagaaattctatgaaaagccagaacctggcggcagcgcaaaagatg

SEQ ID NO: 149756 - DNA, 103 bp, Artificial Sequence
  Synthetic Polynucleotide
taatacgactcactatagggagacagcaacccacggtggctcctggctttaacagaggagaaaagccatgagccaccgtaacctggcggcagcgcaaaagatg

SEQ ID NO: 149757 - DNA, 103 bp, Artificial Sequence
  Synthetic Polynucleotide
taatacgactcactataggggcaggatgtgagacagcaacccacggtggcaacagaggagagccaccatgggttgctgtaacctggcggcagcgcaaaagatg

SEQ ID NO: 149758 - DNA, 103 bp, Artificial Sequence
  Synthetic Polynucleotide
taatacgactcactatagggagttgctggtgcaggatgtgagacagcaacaacagaggagagttgctatgtcacatcctaacctggcggcagcgcaaaagatg

SEQ ID NO: 149759 - DNA, 103 bp, Artificial Sequence
  Synthetic Polynucleotide
taatacgactcactatagggatgaagtgatagttgctggtgcaggatgtgaacagaggagacacatcatgcaccagcaaaacctggcggcagcgcaaaagatg

SEQ ID NO: 149760 - DNA, 103 bp, Artificial Sequence
  Synthetic Polynucleotide
taatacgactcactatagggtcgggaacacatgaagtgatagttgctggtaacagaggagaaccagcatgtatcacttcaacctggcggcagcgcaaaagatg

SEQ ID NO: 149761 - DNA, 103 bp, Artificial Sequence
  Synthetic Polynucleotide
taatacgactcactatagggagttcttggctcgggaacacatgaagtgataacagaggagaatcactatgtgtgttcccaacctggcggcagcgcaaaagatg

SEQ ID NO: 149762 - DNA, 103 bp, Artificial Sequence
  Synthetic Polynucleotide
taatacgactcactatagggagaaagacacagttcttggctcgggaacacaacagaggagagtgttcatgagccaagaaaacctggcggcagcgcaaaagatg

SEQ ID NO: 149763 - DNA, 103 bp, Artificial Sequence
  Synthetic Polynucleotide
taatacgactcactatagggtttatcatccagaaagacacagttcttggcaacagaggagagccaagatgtgtgtctttaacctggcggcagcgcaaaagatg

SEQ ID NO: 149764 - DNA, 103 bp, Artificial Sequence
  Synthetic Polynucleotide
taatacgactcactatagggtctctgatttatttagaggggaaaacacagaacagaggagactgtgtatgcccctctaaaacctggcggcagcgcaaaagatg

SEQ ID NO: 149765 - DNA, 103 bp, Artificial Sequence
  Synthetic Polynucleotide
taatacgactcactatagggaatatacttttttatcatccagaaagacacaacagaggagagtgtctatgtggatgataaacctggcggcagcgcaaaagatg

SEQ ID NO: 149766 - DNA, 103 bp, Artificial Sequence
  Synthetic Polynucleotide
taatacgactcactatagggtgtcgttggcaatatacttttttatcatccaacagaggagaggatgaatgaaaagtataaacctggcggcagcgcaaaagatg

SEQ ID NO: 149767 - DNA, 103 bp, Artificial Sequence
  Synthetic Polynucleotide
taatacgactcactatagggcaaatcccgatgtcgttggcaatatactttaacagaggagaaaagtaatgtgccaacgaaacctggcggcagcgcaaaagatg

SEQ ID NO: 149768 - DNA, 103 bp, Artificial Sequence
  Synthetic Polynucleotide
taatacgactcactatagggcgcctttgatcaaatcccgatgtcgttggcaacagaggagagccaacatgatcgggattaacctggcggcagcgcaaaagatg

SEQ ID NO: 149769 - DNA, 103 bp, Artificial Sequence
  Synthetic Polynucleotide
taatacgactcactatagggggaaccacttcgcctttgatcaaatcccgaaacagaggagatcgggaatggatcaaaggaacctggcggcagcgcaaaagatg

SEQ ID NO: 149770 - DNA, 103 bp, Artificial Sequence
  Synthetic Polynucleotide
taatacgactcactatagggtccattctcaggaaccacttcgcctttgataacagaggagaatcaaaatggaagtggttaacctggcggcagcgcaaaagatg

SEQ ID NO: 149771 - DNA, 103 bp, Artificial Sequence
  Synthetic Polynucleotide
taatacgactcactatagggaaacttcaaatccattctcaggaaccacttaacagaggagaaagtggatgctgagaatgaacctggcggcagcgcaaaagatg

SEQ ID NO: 149772 - DNA, 103 bp, Artificial Sequence
  Synthetic Polynucleotide
taatacgactcactatagggactcttctgaaaacttcaaatccattctcaaacagaggagatgagaaatgatttgaagtaacctggcggcagcgcaaaagatg

SEQ ID NO: 149773 - DNA, 103 bp, Artificial Sequence
  Synthetic Polynucleotide
taatacgactcactataggggtccacaaacactcttctgaaaacttcaaaaacagaggagatttgaaatgttcagaagaaacctggcggcagcgcaaaagatg

SEQ ID NO: 149774 - DNA, 103 bp, Artificial Sequence
  Synthetic Polynucleotide
taatacgactcactatagggttccttcaaagtccacaaacactcttctgaaacagaggagatcagaaatgtgtttgtggaacctggcggcagcgcaaaagatg

SEQ ID NO: 149775 - DNA, 103 bp, Artificial Sequence
  Synthetic Polynucleotide
taatacgactcactatagggaggccccggcgccccccgccgccgccgcccaacagaggagagggcggatgcggcgggggaacctggcggcagcgcaaaagatg

SEQ ID NO: 149776 - DNA, 103 bp, Artificial Sequence
  Synthetic Polynucleotide
taatacgactcactatagggccagatttggtctctgatttatttagagggaacagaggagaccctctatgtaaatcagaaacctggcggcagcgcaaaagatg

SEQ ID NO: 149777 - DNA, 103 bp, Artificial Sequence
  Synthetic Polynucleotide
taatacgactcactatagggctcaagctgattccttcaaagtccacaaacaacagaggagagtttgtatgctttgaaggaacctggcggcagcgcaaaagatg

SEQ ID NO: 149778 - DNA, 103 bp, Artificial Sequence
  Synthetic Polynucleotide
taatacgactcactatagggaaacttccttctcaagctgattccttcaaaaacagaggagatttgaaatgatcagcttgaacctggcggcagcgcaaaagatg

SEQ ID NO: 149779 - DNA, 103 bp, Artificial Sequence
  Synthetic Polynucleotide
taatacgactcactatagggagccattgagaaacttccttctcaagctgaaacagaggagatcagctatggaaggaagtaacctggcggcagcgcaaaagatg

SEQ ID NO: 149780 - DNA, 103 bp, Artificial Sequence
  Synthetic Polynucleotide
taatacgactcactatagggtctggttccaagccattgagaaacttccttaacagaggagaaaggaaatgtctcaatggaacctggcggcagcgcaaaagatg

SEQ ID NO: 149781 - DNA, 103 bp, Artificial Sequence
  Synthetic Polynucleotide
taatacgactcactataggggtggatattttctggttccaagccattgagaacagaggagactcaatatgttggaaccaaacctggcggcagcgcaaaagatg

SEQ ID NO: 149782 - DNA, 103 bp, Artificial Sequence
  Synthetic Polynucleotide
taatacgactcactatagggcaatcatcatgtggatattttctggttccaaacagaggagatggaacatgaaaatatccaacctggcggcagcgcaaaagatg

SEQ ID NO: 149783 - DNA, 103 bp, Artificial Sequence
  Synthetic Polynucleotide
taatacgactcactataggggtcatagacccaatcatcatgtggatatttaacagaggagaaaatatatgcatgatgataacctggcggcagcgcaaaagatg

SEQ ID NO: 149784 - DNA, 103 bp, Artificial Sequence
  Synthetic Polynucleotide
taatacgactcactataggggcagtcgattgtcatagacccaatcatcataacagaggagaatgatgatggggtctatgaacctggcggcagcgcaaaagatg

SEQ ID NO: 149785 - DNA, 103 bp, Artificial Sequence
  Synthetic Polynucleotide
taatacgactcactataggggaattcctaagcagtcgattgtcatagaccaacagaggagaggtctaatgcaatcgactaacctggcggcagcgcaaaagatg

SEQ ID NO: 149786 - DNA, 103 bp, Artificial Sequence
  Synthetic Polynucleotide
taatacgactcactatagggagatcatttagaattcctaagcagtcgattaacagaggagaaatcgaatgcttaggaataacctggcggcagcgcaaaagatg

SEQ ID NO: 149787 - DNA, 103 bp, Artificial Sequence
  Synthetic Polynucleotide
taatacgactcactataggggatcttatctccagatttggtctctgatttaacagaggagaaaatcaatgaccaaatctaacctggcggcagcgcaaaagatg

SEQ ID NO: 149788 - DNA, 103 bp, Artificial Sequence
  Synthetic Polynucleotide
taatacgactcactatagggacagtcggagagatcatttagaattcctaaaacagaggagattaggaatgctaaatgataacctggcggcagcgcaaaagatg

SEQ ID NO: 149789 - DNA, 103 bp, Artificial Sequence
  Synthetic Polynucleotide
taatacgactcactataggggcttatcttcacagtcggagagatcatttaaacagaggagataaatgatgtctccgactaacctggcggcagcgcaaaagatg

SEQ ID NO: 149790 - DNA, 103 bp, Artificial Sequence
  Synthetic Polynucleotide
taatacgactcactatagggataggaaagagcttatcttcacagtcggagaacagaggagactccgaatgtgaagataaaacctggcggcagcgcaaaagatg

SEQ ID NO: 149791 - DNA, 103 bp, Artificial Sequence
  Synthetic Polynucleotide
taatacgactcactatagggctgatatccaataggaaagagcttatcttcaacagaggagagaagatatgctctttcctaacctggcggcagcgcaaaagatg

SEQ ID NO: 149792 - DNA, 103 bp, Artificial Sequence
  Synthetic Polynucleotide
taatacgactcactatagggccctggaacactgatatccaataggaaagaaacagaggagatctttcatgttggatatcaacctggcggcagcgcaaaagatg

SEQ ID NO: 149793 - DNA, 103 bp, Artificial Sequence
  Synthetic Polynucleotide
taatacgactcactatagggctccagtataccctggaacactgatatccaaacagaggagatggataatggtgttccagaacctggcggcagcgcaaaagatg

SEQ ID NO: 149794 - DNA, 103 bp, Artificial Sequence
  Synthetic Polynucleotide
taatacgactcactatagggatctgtggtgctccagtataccctggaacaaacagaggagatgttccatggtatactggaacctggcggcagcgcaaaagatg

SEQ ID NO: 149795 - DNA, 103 bp, Artificial Sequence
  Synthetic Polynucleotide
taatacgactcactataggggcttgcgagcatctgtggtgctccagtataaacagaggagatatactatggcaccacagaacctggcggcagcgcaaaagatg

SEQ ID NO: 149796 - DNA, 103 bp, Artificial Sequence
  Synthetic Polynucleotide
taatacgactcactatagggtatacacagcgcttgcgagcatctgtggtgaacagaggagacaccacatgtgctcgcaaaacctggcggcagcgcaaaagatg

SEQ ID NO: 149797 - DNA, 103 bp, Artificial Sequence
  Synthetic Polynucleotide
taatacgactcactatagggcttgcatgtatatacacagcgcttgcgagcaacagaggagagctcgcatgcgctgtgtaaacctggcggcagcgcaaaagatg

SEQ ID NO: 149798 - DNA, 103 bp, Artificial Sequence
  Synthetic Polynucleotide
taatacgactcactatagggctttcttcttgatcttatctccagatttggaacagaggagaccaaatatggagataagaaacctggcggcagcgcaaaagatg

SEQ ID NO: 149799 - DNA, 103 bp, Artificial Sequence
  Synthetic Polynucleotide
taatacgactcactatagggactccactatcttgcatgtatatacacagcaacagaggagagctgtgatgatacatgcaaacctggcggcagcgcaaaagatg

SEQ ID NO: 149800 - DNA, 103 bp, Artificial Sequence
  Synthetic Polynucleotide
taatacgactcactatagggggaggacggcactccactatcttgcatgtaaacagaggagatacatgatggatagtggaaacctggcggcagcgcaaaagatg

SEQ ID NO: 149801 - DNA, 103 bp, Artificial Sequence
  Synthetic Polynucleotide
taatacgactcactatagggctctacgactggaggacggcactccactataacagaggagaatagtgatgtgccgtcctaacctggcggcagcgcaaaagatg

SEQ ID NO: 149802 - DNA, 103 bp, Artificial Sequence
  Synthetic Polynucleotide
taatacgactcactatagggtgatatccggctctacgactggaggacggcaacagaggagagccgtcatgcagtcgtagaacctggcggcagcgcaaaagatg

SEQ ID NO: 149803 - DNA, 103 bp, Artificial Sequence
  Synthetic Polynucleotide
taatacgactcactatagggacagtgctgttgatatccggctctacgactaacagaggagaagtcgtatggccggatataacctggcggcagcgcaaaagatg

SEQ ID NO: 149804 - DNA, 103 bp, Artificial Sequence
  Synthetic Polynucleotide
taatacgactcactatagggatcatgttcaacagtgctgttgatatccggaacagaggagaccggatatgaacagcactaacctggcggcagcgcaaaagatg

SEQ ID NO: 149805 - DNA, 103 bp, Artificial Sequence
  Synthetic Polynucleotide
taatacgactcactatagggtcctgttttcatcatgttcaacagtgctgtaacagaggagaacagcaatgttgaacatgaacctggcggcagcgcaaaagatg

SEQ ID NO: 149806 - DNA, 103 bp, Artificial Sequence
  Synthetic Polynucleotide
taatacgactcactatagggtgggcaatggtcctgttttcatcatgttcaaacagaggagatgaacaatgtgaaaacagaacctggcggcagcgcaaaagatg

SEQ ID NO: 149807 - DNA, 103 bp, Artificial Sequence
  Synthetic Polynucleotide
taatacgactcactatagggtgttggactatgggcaatggtcctgttttcaacagaggagagaaaacatgaccattgccaacctggcggcagcgcaaaagatg

SEQ ID NO: 149808 - DNA, 103 bp, Artificial Sequence
  Synthetic Polynucleotide
taatacgactcactatagggctgtaaaagatgttggactatgggcaatggaacagaggagaccattgatgatagtccaaaacctggcggcagcgcaaaagatg

SEQ ID NO: 149809 - DNA, 103 bp, Artificial Sequence
  Synthetic Polynucleotide
taatacgactcactatagggcttttagaatctttcttcttgatcttatctaacagaggagaagataaatgcaagaagaaaacctggcggcagcgcaaaagatg

SEQ ID NO: 149810 - DNA, 103 bp, Artificial Sequence
  Synthetic Polynucleotide
taatacgactcactataggggatgaactttctgtaaaagatgttggactaaacagaggagatagtccatgatcttttacaacctggcggcagcgcaaaagatg

SEQ ID NO: 149811 - DNA, 103 bp, Artificial Sequence
  Synthetic Polynucleotide
taatacgactcactatagggactctcttttgatgaactttctgtaaaagaaacagaggagatcttttatggaaagttcaaacctggcggcagcgcaaaagatg

SEQ ID NO: 149812 - DNA, 103 bp, Artificial Sequence
  Synthetic Polynucleotide
taatacgactcactatagggctgtgttttgactctcttttgatgaactttaacagaggagaaaagttatgcaaaagagaaacctggcggcagcgcaaaagatg

SEQ ID NO: 149813 - DNA, 103 bp, Artificial Sequence
  Synthetic Polynucleotide
taatacgactcactatagggataatttcagctgtgttttgactctcttttaacagaggagaaaaagaatgtcaaaacacaacctggcggcagcgcaaaagatg

SEQ ID NO: 149814 - DNA, 103 bp, Artificial Sequence
  Synthetic Polynucleotide
taatacgactcactatagggtggaggacttataatttcagctgtgttttgaacagaggagacaaaacatggctgaaattaacctggcggcagcgcaaaagatg

SEQ ID NO: 149815 - DNA, 103 bp, Artificial Sequence
  Synthetic Polynucleotide
taatacgactcactatagggggtctggtgatggaggacttataatttcagaacagaggagactgaaaatgtaagtcctcaacctggcggcagcgcaaaagatg

SEQ ID NO: 149816 - DNA, 103 bp, Artificial Sequence
  Synthetic Polynucleotide
taatacgactcactatagggtgaggaggtcggtctggtgatggaggacttaacagaggagaaagtccatgatcaccagaaacctggcggcagcgcaaaagatg

SEQ ID NO: 149817 - DNA, 103 bp, Artificial Sequence
  Synthetic Polynucleotide
taatacgactcactatagggggtttgtgaatgaggaggtcggtctggtgaaacagaggagatcaccaatgcgacctcctaacctggcggcagcgcaaaagatg

SEQ ID NO: 149818 - DNA, 103 bp, Artificial Sequence
  Synthetic Polynucleotide
taatacgactcactatagggaggagccagaggtttgtgaatgaggaggtcaacagaggagagacctcatgattcacaaaaacctggcggcagcgcaaaagatg

SEQ ID NO: 149819 - DNA, 103 bp, Artificial Sequence
  Synthetic Polynucleotide
taatacgactcactatagggtgataataacaggagccagaggtttgtgaaaacagaggagattcacaatgctctggctcaacctggcggcagcgcaaaagatg

SEQ ID NO: 149820 - DNA, 103 bp, Artificial Sequence
  Synthetic Polynucleotide
taatacgactcactatagggcttttctatacttttagaatctttcttcttaacagaggagaaagaagatggattctaaaaacctggcggcagcgcaaaagatg

SEQ ID NO: 149821 - DNA, 103 bp, Artificial Sequence
  Synthetic Polynucleotide
taatacgactcactatagggtgagatgacatgataataacaggagccagaaacagaggagatctggcatgtgttattataacctggcggcagcgcaaaagatg

SEQ ID NO: 149822 - DNA, 103 bp, Artificial Sequence
  Synthetic Polynucleotide
taatacgactcactatagggtggggacctttgagatgacatgataataacaacagaggagagttattatgatgtcatctaacctggcggcagcgcaaaagatg

SEQ ID NO: 149823 - DNA, 103 bp, Artificial Sequence
  Synthetic Polynucleotide
taatacgactcactataggggttcgaatcctggggacctttgagatgacaaacagaggagatgtcatatgaaaggtcccaacctggcggcagcgcaaaagatg

SEQ ID NO: 149824 - DNA, 103 bp, Artificial Sequence
  Synthetic Polynucleotide
taatacgactcactatagggataactgggtgttcgaatcctggggaccttaacagaggagaaaggtcatgaggattcgaaacctggcggcagcgcaaaagatg

SEQ ID NO: 149825 - DNA, 103 bp, Artificial Sequence
  Synthetic Polynucleotide
taatacgactcactataggggtgttggagaataactgggtgttcgaatccaacagaggagaggattcatgcacccagttaacctggcggcagcgcaaaagatg

SEQ ID NO: 149826 - DNA, 103 bp, Artificial Sequence
  Synthetic Polynucleotide
taatacgactcactatagggggggatctctgtgttggagaataactgggtaacagaggagaacccagatgttctccaacaacctggcggcagcgcaaaagatg

SEQ ID NO: 149827 - DNA, 103 bp, Artificial Sequence
  Synthetic Polynucleotide
taatacgactcactatagggtcgacagccaggggatctctgtgttggagaaacagaggagatctccaatgcagagatccaacctggcggcagcgcaaaagatg

SEQ ID NO: 149828 - DNA, 103 bp, Artificial Sequence
  Synthetic Polynucleotide
taatacgactcactatagggaaggcaacggtcgacagccaggggatctctaacagaggagaagagatatgctggctgtcaacctggcggcagcgcaaaagatg

SEQ ID NO: 149829 - DNA, 103 bp, Artificial Sequence
  Synthetic Polynucleotide
taatacgactcactatagggcttcctgcagaaggcaacggtcgacagccaaacagaggagatggctgatgaccgttgccaacctggcggcagcgcaaaagatg

SEQ ID NO: 149830 - DNA, 103 bp, Artificial Sequence
  Synthetic Polynucleotide
taatacgactcactatagggtggggtaggacttcctgcagaaggcaacggaacagaggagaccgttgatgtctgcaggaaacctggcggcagcgcaaaagatg

SEQ ID NO: 149831 - DNA, 103 bp, Artificial Sequence
  Synthetic Polynucleotide
taatacgactcactatagggttcctctcttcttttctatacttttagaataacagaggagaattctaatggtatagaaaaacctggcggcagcgcaaaagatg

SEQ ID NO: 149832 - DNA, 103 bp, Artificial Sequence
  Synthetic Polynucleotide
taatacgactcactatagggcatgagtggttggggtaggacttcctgcagaacagaggagactgcagatggtcctacccaacctggcggcagcgcaaaagatg

SEQ ID NO: 149833 - DNA, 103 bp, Artificial Sequence
  Synthetic Polynucleotide
taatacgactcactataggggtgactatttcatgagtggttggggtaggaaacagaggagatcctacatgaaccactcaaacctggcggcagcgcaaaagatg

SEQ ID NO: 149834 - DNA, 103 bp, Artificial Sequence
  Synthetic Polynucleotide
taatacgactcactatagggatcacctactgtgactatttcatgagtggtaacagaggagaaccactatggaaatagtcaacctggcggcagcgcaaaagatg

SEQ ID NO: 149835 - DNA, 103 bp, Artificial Sequence
  Synthetic Polynucleotide
taatacgactcactatagggagagtaaaggatcacctactgtgactatttaacagaggagaaaatagatgcagtaggtgaacctggcggcagcgcaaaagatg

SEQ ID NO: 149836 - DNA, 103 bp, Artificial Sequence
  Synthetic Polynucleotide
taatacgactcactatagggagtccagaggagagtaaaggatcacctactaacagaggagaagtaggatgtcctttactaacctggcggcagcgcaaaagatg

SEQ ID NO: 149837 - DNA, 103 bp, Artificial Sequence
  Synthetic Polynucleotide
taatacgactcactatagggaatgcttcgaagtccagaggagagtaaaggaacagaggagacctttaatgtcctctggaaacctggcggcagcgcaaaagatg

SEQ ID NO: 149838 - DNA, 103 bp, Artificial Sequence
  Synthetic Polynucleotide
taatacgactcactataggggcctggagccaatgcttcgaagtccagaggaacagaggagacctctgatgttcgaagcaaacctggcggcagcgcaaaagatg

SEQ ID NO: 149839 - DNA, 103 bp, Artificial Sequence
  Synthetic Polynucleotide
taatacgactcactataggggtactgtgacgcctggagccaatgcttcgaaacagaggagatcgaagatgtggctccagaacctggcggcagcgcaaaagatg

SEQ ID NO: 149840 - DNA, 103 bp, Artificial Sequence
  Synthetic Polynucleotide
taatacgactcactatagggtaaggaagaggtactgtgacgcctggagccaacagaggagaggctccatgcgtcacagtaacctggcggcagcgcaaaagatg

SEQ ID NO: 149841 - DNA, 103 bp, Artificial Sequence
  Synthetic Polynucleotide
taatacgactcactataggggctggggtgataaggaagaggtactgtgacaacagaggagagtcacaatgcctcttcctaacctggcggcagcgcaaaagatg

SEQ ID NO: 149842 - DNA, 103 bp, Artificial Sequence
  Synthetic Polynucleotide
taatacgactcactataggggtgggaggtcttcctctcttcttttctataaacagaggagatatagaatggaagagaggaacctggcggcagcgcaaaagatg

SEQ ID NO: 149843 - DNA, 103 bp, Artificial Sequence
  Synthetic Polynucleotide
taatacgactcactatagggagtttggaccgctggggtgataaggaagagaacagaggagactcttcatgatcaccccaaacctggcggcagcgcaaaagatg

SEQ ID NO: 149844 - DNA, 103 bp, Artificial Sequence
  Synthetic Polynucleotide
taatacgactcactatagggcattatccggagtttggaccgctggggtgaaacagaggagatcacccatgcggtccaaaaacctggcggcagcgcaaaagatg

SEQ ID NO: 149845 - DNA, 103 bp, Artificial Sequence
  Synthetic Polynucleotide
taatacgactcactatagggtcattggagacattatccggagtttggaccaacagaggagaggtccaatgtccggataaaacctggcggcagcgcaaaagatg

SEQ ID NO: 149846 - DNA, 103 bp, Artificial Sequence
  Synthetic Polynucleotide
taatacgactcactatagggttcccagttctcattggagacattatccggaacagaggagaccggatatggtctccaataacctggcggcagcgcaaaagatg

SEQ ID NO: 149847 - DNA, 103 bp, Artificial Sequence
  Synthetic Polynucleotide
taatacgactcactatagggagagtaagtattcccagttctcattggagaaacagaggagatctccaatgagaactgggaacctggcggcagcgcaaaagatg

SEQ ID NO: 149848 - DNA, 103 bp, Artificial Sequence
  Synthetic Polynucleotide
taatacgactcactatagggcattattcctagagtaagtattcccagttcaacagaggagagaactgatgatacttactaacctggcggcagcgcaaaagatg

SEQ ID NO: 149849 - DNA, 103 bp, Artificial Sequence
  Synthetic Polynucleotide
taatacgactcactatagggactgaggaaacattattcctagagtaagtaaacagaggagatacttaatgtaggaataaaacctggcggcagcgcaaaagatg

SEQ ID NO: 149850 - DNA, 103 bp, Artificial Sequence
  Synthetic Polynucleotide
taatacgactcactatagggggtggtggagactgaggaaacattattcctaacagaggagaaggaatatggtttcctcaaacctggcggcagcgcaaaagatg

SEQ ID NO: 149851 - DNA, 103 bp, Artificial Sequence
  Synthetic Polynucleotide
taatacgactcactatagggtagcggtcccggtggtggagactgaggaaaaacagaggagatttcctatgtctccaccaaacctggcggcagcgcaaaagatg

SEQ ID NO: 149852 - DNA, 103 bp, Artificial Sequence
  Synthetic Polynucleotide
taatacgactcactatagggtcaagatcagtagcggtcccggtggtggagaacagaggagactccacatgcgggaccgcaacctggcggcagcgcaaaagatg

SEQ ID NO: 149853 - DNA, 103 bp, Artificial Sequence
  Synthetic Polynucleotide
taatacgactcactatagggtccagggaaggtgggaggtcttcctctcttaacagaggagaaagagaatgagacctcccaacctggcggcagcgcaaaagatg

SEQ ID NO: 149854 - DNA, 103 bp, Artificial Sequence
  Synthetic Polynucleotide
taatacgactcactatagggggcacttgattcaagatcagtagcggtcccaacagaggagagggaccatgactgatcttaacctggcggcagcgcaaaagatg

SEQ ID NO: 149855 - DNA, 103 bp, Artificial Sequence
  Synthetic Polynucleotide
taatacgactcactatagggcaactactttggcacttgattcaagatcagaacagaggagactgatcatgaatcaagtgaacctggcggcagcgcaaaagatg

SEQ ID NO: 149856 - DNA, 103 bp, Artificial Sequence
  Synthetic Polynucleotide
taatacgactcactatagggaagacatgatcaactactttggcacttgataacagaggagaatcaagatgcaaagtagtaacctggcggcagcgcaaaagatg

SEQ ID NO: 149857 - DNA, 103 bp, Artificial Sequence
  Synthetic Polynucleotide
taatacgactcactatagggcagtggccctaagacatgatcaactactttaacagaggagaaaagtaatggatcatgtcaacctggcggcagcgcaaaagatg

SEQ ID NO: 149858 - DNA, 103 bp, Artificial Sequence
  Synthetic Polynucleotide
taatacgactcactatagggtacttgaattcagtggccctaagacatgataacagaggagaatcatgatgtagggccacaacctggcggcagcgcaaaagatg

SEQ ID NO: 149859 - DNA, 103 bp, Artificial Sequence
  Synthetic Polynucleotide
taatacgactcactatagggcctaaactagtacttgaattcagtggccctaacagaggagaagggccatggaattcaagaacctggcggcagcgcaaaagatg

SEQ ID NO: 149860 - DNA, 103 bp, Artificial Sequence
  Synthetic Polynucleotide
taatacgactcactatagggagtgttttgccctaaactagtacttgaattaacagaggagaaattcaatgactagtttaaacctggcggcagcgcaaaagatg

SEQ ID NO: 149861 - DNA, 103 bp, Artificial Sequence
  Synthetic Polynucleotide
taatacgactcactatagggaagaggtggaagtgttttgccctaaactagaacagaggagactagttatgggcaaaacaaacctggcggcagcgcaaaagatg

SEQ ID NO: 149862 - DNA, 103 bp, Artificial Sequence
  Synthetic Polynucleotide
taatacgactcactatagggtgcaaatttgaagaggtggaagtgttttgcaacagaggagagcaaaaatgttccacctcaacctggcggcagcgcaaaagatg

SEQ ID NO: 149863 - DNA, 103 bp, Artificial Sequence
  Synthetic Polynucleotide
taatacgactcactatagggcactgtcctttgcaaatttgaagaggtggaaacagaggagatccaccatgtcaaatttgaacctggcggcagcgcaaaagatg

SEQ ID NO: 149864 - DNA, 103 bp, Artificial Sequence
  Synthetic Polynucleotide
taatacgactcactatagggtgatttttactccagggaaggtgggaggtcaacagaggagagacctcatgccttccctgaacctggcggcagcgcaaaagatg

SEQ ID NO: 149865 - DNA, 103 bp, Artificial Sequence
  Synthetic Polynucleotide
taatacgactcactatagggctacagtaaccactgtcctttgcaaatttgaacagaggagacaaattatgaaaggacagaacctggcggcagcgcaaaagatg

SEQ ID NO: 149866 - DNA, 103 bp, Artificial Sequence
  Synthetic Polynucleotide
taatacgactcactatagggtttttattgcctacagtaaccactgtccttaacagaggagaaaggacatgggttactgtaacctggcggcagcgcaaaagatg

SEQ ID NO: 149867 - DNA, 103 bp, Artificial Sequence
  Synthetic Polynucleotide
taatacgactcactatagggcaagtgactgtttttattgcctacagtaacaacagaggagagttactatgggcaataaaaacctggcggcagcgcaaaagatg

SEQ ID NO: 149868 - DNA, 103 bp, Artificial Sequence
  Synthetic Polynucleotide
taatacgactcactatagggaagatccatccaagtgactgtttttattgcaacagaggagagcaataatgacagtcactaacctggcggcagcgcaaaagatg

SEQ ID NO: 149869 - DNA, 103 bp, Artificial Sequence
  Synthetic Polynucleotide
taatacgactcactatagggtctgaagatgaagatccatccaagtgactgaacagaggagacagtcaatgggatggatcaacctggcggcagcgcaaaagatg

SEQ ID NO: 149870 - DNA, 103 bp, Artificial Sequence
  Synthetic Polynucleotide
taatacgactcactatagggctgcttcatttctgaagatgaagatccatcaacagaggagagatggaatgtcatcttcaaacctggcggcagcgcaaaagatg

SEQ ID NO: 149871 - DNA, 103 bp, Artificial Sequence
  Synthetic Polynucleotide
taatacgactcactatagggaagcactggactgcttcatttctgaagatgaacagaggagacatcttatgaaatgaagcaacctggcggcagcgcaaaagatg

SEQ ID NO: 149872 - DNA, 103 bp, Artificial Sequence
  Synthetic Polynucleotide
taatacgactcactatagggaccaagtctgaagcactggactgcttcattaacagaggagaaatgaaatggtccagtgcaacctggcggcagcgcaaaagatg

SEQ ID NO: 149873 - DNA, 103 bp, Artificial Sequence
  Synthetic Polynucleotide
taatacgactcactataggggctcttggacaccaagtctgaagcactggaaacagaggagatccagtatgtcagacttgaacctggcggcagcgcaaaagatg

SEQ ID NO: 149874 - DNA, 103 bp, Artificial Sequence
  Synthetic Polynucleotide
taatacgactcactatagggttaaagaggagctcttggacaccaagtctgaacagaggagacagactatgtgtccaagaaacctggcggcagcgcaaaagatg

SEQ ID NO: 149875 - DNA, 103 bp, Artificial Sequence
  Synthetic Polynucleotide
taatacgactcactatagggtgtgttattttgatttttactccagggaagaacagaggagacttcccatgagtaaaaataacctggcggcagcgcaaaagatg

SEQ ID NO: 149876 - DNA, 103 bp, Artificial Sequence
  Synthetic Polynucleotide
taatacgactcactatagggttctctccctttaaagaggagctcttggacaacagaggagagtccaaatgctcctctttaacctggcggcagcgcaaaagatg

SEQ ID NO: 149877 - DNA, 103 bp, Artificial Sequence
  Synthetic Polynucleotide
taatacgactcactatagggcactttggtcttctctccctttaaagaggaaacagaggagatcctctatgaagggagagaacctggcggcagcgcaaaagatg

SEQ ID NO: 149878 - DNA, 103 bp, Artificial Sequence
  Synthetic Polynucleotide
taatacgactcactatagggtggaactcagcactttggtcttctctccctaacagaggagaagggagatgagaccaaagaacctggcggcagcgcaaaagatg

SEQ ID NO: 149879 - DNA, 103 bp, Artificial Sequence
  Synthetic Polynucleotide
taatacgactcactatagggtctgagctcttggaactcagcactttggtcaacagaggagagaccaaatggctgagttcaacctggcggcagcgcaaaagatg

SEQ ID NO: 149880 - DNA, 103 bp, Artificial Sequence
  Synthetic Polynucleotide
taatacgactcactatagggtgcagatccctctgagctcttggaactcagaacagaggagactgagtatgaagagctcaaacctggcggcagcgcaaaagatg

SEQ ID NO: 149881 - DNA, 103 bp, Artificial Sequence
  Synthetic Polynucleotide
taatacgactcactatagggccacattatgtgcagatccctctgagctctaacagaggagaagagctatgagggatctgaacctggcggcagcgcaaaagatg

SEQ ID NO: 149882 - DNA, 103 bp, Artificial Sequence
  Synthetic Polynucleotide
taatacgactcactatagggccagggtaagccacattatgtgcagatcccaacagaggagagggatcatgacataatgtaacctggcggcagcgcaaaagatg

SEQ ID NO: 149883 - DNA, 103 bp, Artificial Sequence
  Synthetic Polynucleotide
taatacgactcactatagggtttaggaattccagggtaagccacattatgaacagaggagacataatatggcttaccctaacctggcggcagcgcaaaagatg

SEQ ID NO: 149884 - DNA, 103 bp, Artificial Sequence
  Synthetic Polynucleotide
taatacgactcactataggggtggggccagtttaggaattccagggtaagaacagaggagacttaccatggaattcctaaacctggcggcagcgcaaaagatg

SEQ ID NO: 149885 - DNA, 103 bp, Artificial Sequence
  Synthetic Polynucleotide
taatacgactcactatagggttatgaacctgtggggccagtttaggaattaacagaggagaaattccatgactggccccaacctggcggcagcgcaaaagatg

SEQ ID NO: 149886 - DNA, 103 bp, Artificial Sequence
  Synthetic Polynucleotide
taatacgactcactatagggggcgccccctaggccccggcgccccccgccaacagaggagaggcgggatgcgccggggcaacctggcggcagcgcaaaagatg

SEQ ID NO: 149887 - DNA, 103 bp, Artificial Sequence
  Synthetic Polynucleotide
taatacgactcactataggggtcctttccatgtgttattttgatttttacaacagaggagagtaaaaatgaaaataacaaacctggcggcagcgcaaaagatg

SEQ ID NO: 149888 - DNA, 103 bp, Artificial Sequence
  Synthetic Polynucleotide
taatacgactcactatagggagatgttgtgttatgaacctgtggggccagaacagaggagactggccatgcaggttcataacctggcggcagcgcaaaagatg

SEQ ID NO: 149889 - DNA, 103 bp, Artificial Sequence
  Synthetic Polynucleotide
taatacgactcactatagggtcagttctctagatgttgtgttatgaacctaacagaggagaaggttcatgacacaacataacctggcggcagcgcaaaagatg

SEQ ID NO: 149890 - DNA, 103 bp, Artificial Sequence
  Synthetic Polynucleotide
taatacgactcactatagggttactaacattcagttctctagatgttgtgaacagaggagacacaacatgtagagaactaacctggcggcagcgcaaaagatg

SEQ ID NO: 149891 - DNA, 103 bp, Artificial Sequence
  Synthetic Polynucleotide
taatacgactcactatagggggagccgattttactaacattcagttctctaacagaggagaagagaaatgaatgttagtaacctggcggcagcgcaaaagatg

SEQ ID NO: 149892 - DNA, 103 bp, Artificial Sequence
  Synthetic Polynucleotide
taatacgactcactataggggttcagcaaaggagccgattttactaacataacagaggagaatgttaatgaaatcggctaacctggcggcagcgcaaaagatg

SEQ ID NO: 149893 - DNA, 103 bp, Artificial Sequence
  Synthetic Polynucleotide
taatacgactcactatagggactgaagagggttcagcaaaggagccgattaacagaggagaaatcggatgctttgctgaaacctggcggcagcgcaaaagatg

SEQ ID NO: 149894 - DNA, 103 bp, Artificial Sequence
  Synthetic Polynucleotide
taatacgactcactatagggagaaaacgacactgaagagggttcagcaaaaacagaggagatttgctatgccctcttcaaacctggcggcagcgcaaaagatg

SEQ ID NO: 149895 - DNA, 103 bp, Artificial Sequence
  Synthetic Polynucleotide
taatacgactcactatagggcctctttagaagaaaacgacactgaagaggaacagaggagacctcttatgtgtcgttttaacctggcggcagcgcaaaagatg

SEQ ID NO: 149896 - DNA, 103 bp, Artificial Sequence
  Synthetic Polynucleotide
taatacgactcactatagggaaggagagggcctctttagaagaaaacgacaacagaggagagtcgttatgttctaaagaaacctggcggcagcgcaaaagatg

SEQ ID NO: 149897 - DNA, 103 bp, Artificial Sequence
  Synthetic Polynucleotide
taatacgactcactataggggaggtgtgggaaggagagggcctctttagaaacagaggagatctaaaatggccctctccaacctggcggcagcgcaaaagatg

SEQ ID NO: 149898 - DNA, 103 bp, Artificial Sequence
  Synthetic Polynucleotide
taatacgactcactatagggactctgaaatgtcctttccatgtgttatttaacagaggagaaaataaatgatggaaaggaacctggcggcagcgcaaaagatg

SEQ ID NO: 149899 - DNA, 103 bp, Artificial Sequence
  Synthetic Polynucleotide
taatacgactcactatagggctctcaaatggaggtgtgggaaggagagggaacagaggagaccctctatgtcccacaccaacctggcggcagcgcaaaagatg

SEQ ID NO: 149900 - DNA, 103 bp, Artificial Sequence
  Synthetic Polynucleotide
taatacgactcactatagggttcctttgccctctcaaatggaggtgtgggaacagaggagacccacaatgccatttgagaacctggcggcagcgcaaaagatg

SEQ ID NO: 149901 - DNA, 103 bp, Artificial Sequence
  Synthetic Polynucleotide
taatacgactcactataggggtctcgatcattcctttgccctctcaaatgaacagaggagacatttgatggggcaaaggaacctggcggcagcgcaaaagatg

SEQ ID NO: 149902 - DNA, 103 bp, Artificial Sequence
  Synthetic Polynucleotide
taatacgactcactatagggctgtgtgttggtctcgatcattcctttgccaacagaggagaggcaaaatgatgatcgagaacctggcggcagcgcaaaagatg

SEQ ID NO: 149903 - DNA, 103 bp, Artificial Sequence
  Synthetic Polynucleotide
taatacgactcactatagggtgggtagaatctgtgtgttggtctcgatcaaacagaggagatgatcgatgccaacacacaacctggcggcagcgcaaaagatg

SEQ ID NO: 149904 - DNA, 103 bp, Artificial Sequence
  Synthetic Polynucleotide
taatacgactcactataggggtttgctgattgggtagaatctgtgtgttgaacagaggagacaacacatggattctaccaacctggcggcagcgcaaaagatg

SEQ ID NO: 149905 - DNA, 103 bp, Artificial Sequence
  Synthetic Polynucleotide
taatacgactcactatagggctggagaggagtttgctgattgggtagaataacagaggagaattctaatgaatcagcaaaacctggcggcagcgcaaaagatg

SEQ ID NO: 149906 - DNA, 103 bp, Artificial Sequence
  Synthetic Polynucleotide
taatacgactcactataggggtatcttcatctggagaggagtttgctgataacagaggagaatcagcatgctcctctccaacctggcggcagcgcaaaagatg

SEQ ID NO: 149907 - DNA, 103 bp, Artificial Sequence
  Synthetic Polynucleotide
taatacgactcactatagggtttgacttcagtatcttcatctggagaggaaacagaggagatcctctatggatgaagataacctggcggcagcgcaaaagatg

SEQ ID NO: 149908 - DNA, 103 bp, Artificial Sequence
  Synthetic Polynucleotide
taatacgactcactataggggcttcaaggttttgacttcagtatcttcataacagaggagaatgaagatgctgaagtcaaacctggcggcagcgcaaaagatg

SEQ ID NO: 149909 - DNA, 103 bp, Artificial Sequence
  Synthetic Polynucleotide
taatacgactcactatagggccctttggtaactctgaaatgtcctttccaaacagaggagatggaaaatgcatttcagaaacctggcggcagcgcaaaagatg

SEQ ID NO: 149910 - DNA, 103 bp, Artificial Sequence
  Synthetic Polynucleotide
taatacgactcactatagggattccagatagcttcaaggttttgacttcaaacagaggagatgaagtatgaaccttgaaaacctggcggcagcgcaaaagatg

SEQ ID NO: 149911 - DNA, 103 bp, Artificial Sequence
  Synthetic Polynucleotide
taatacgactcactatagggtctgttgctcattccagatagcttcaaggtaacagaggagaaccttgatgctatctggaaacctggcggcagcgcaaaagatg

SEQ ID NO: 149912 - DNA, 103 bp, Artificial Sequence
  Synthetic Polynucleotide
taatacgactcactatagggtaatggatgatctgttgctcattccagataaacagaggagatatctgatgtgagcaacaaacctggcggcagcgcaaaagatg

SEQ ID NO: 149913 - DNA, 103 bp, Artificial Sequence
  Synthetic Polynucleotide
taatacgactcactatagggtgttcgttgataatggatgatctgttgctcaacagaggagagagcaaatgatcatccataacctggcggcagcgcaaaagatg

SEQ ID NO: 149914 - DNA, 103 bp, Artificial Sequence
  Synthetic Polynucleotide
taatacgactcactatagggagatcccatatgttcgttgataatggatgaaacagaggagatcatccatgatcaacgaaaacctggcggcagcgcaaaagatg

SEQ ID NO: 149915 - DNA, 103 bp, Artificial Sequence
  Synthetic Polynucleotide
taatacgactcactatagggctctggaactagatcccatatgttcgttgaaacagaggagatcaacgatgatatgggataacctggcggcagcgcaaaagatg

SEQ ID NO: 149916 - DNA, 103 bp, Artificial Sequence
  Synthetic Polynucleotide
taatacgactcactatagggtgtctcctatctctggaactagatcccataaacagaggagatatgggatgtagttccagaacctggcggcagcgcaaaagatg

SEQ ID NO: 149917 - DNA, 103 bp, Artificial Sequence
  Synthetic Polynucleotide
taatacgactcactatagggtttccctttctgtctcctatctctggaactaacagaggagaagttccatggataggagaaacctggcggcagcgcaaaagatg

SEQ ID NO: 149918 - DNA, 103 bp, Artificial Sequence
  Synthetic Polynucleotide
taatacgactcactatagggtacaggattttttccctttctgtctcctataacagaggagaataggaatgagaaagggaaacctggcggcagcgcaaaagatg

SEQ ID NO: 149919 - DNA, 103 bp, Artificial Sequence
  Synthetic Polynucleotide
taatacgactcactatagggaaagtttctttacaggattttttccctttcaacagaggagagaaaggatgaaaatcctgaacctggcggcagcgcaaaagatg

SEQ ID NO: 149920 - DNA, 103 bp, Artificial Sequence
  Synthetic Polynucleotide
taatacgactcactatagggttctttgtttccctttggtaactctgaaataacagaggagaatttcaatgttaccaaagaacctggcggcagcgcaaaagatg

SEQ ID NO: 149921 - DNA, 103 bp, Artificial Sequence
  Synthetic Polynucleotide
taatacgactcactatagggcttttctttgaaagtttctttacaggatttaacagaggagaaaatccatgaaagaaactaacctggcggcagcgcaaaagatg

SEQ ID NO: 149922 - DNA, 103 bp, Artificial Sequence
  Synthetic Polynucleotide
taatacgactcactatagggtactggaatgcttttctttgaaagtttcttaacagaggagaaagaaaatgtcaaagaaaaacctggcggcagcgcaaaagatg

SEQ ID NO: 149923 - DNA, 103 bp, Artificial Sequence
  Synthetic Polynucleotide
taatacgactcactatagggaaaaaagatttactggaatgcttttctttgaacagaggagacaaagaatggcattccagaacctggcggcagcgcaaaagatg

SEQ ID NO: 149924 - DNA, 103 bp, Artificial Sequence
  Synthetic Polynucleotide
taatacgactcactatagggaccaggttccaaaaaagatttactggaatgaacagaggagacattccatgaaatcttttaacctggcggcagcgcaaaagatg

SEQ ID NO: 149925 - DNA, 103 bp, Artificial Sequence
  Synthetic Polynucleotide
taatacgactcactatagggttgtcacctgaccaggttccaaaaaagattaacagaggagaaatcttatgtggaacctgaacctggcggcagcgcaaaagatg

SEQ ID NO: 149926 - DNA, 103 bp, Artificial Sequence
  Synthetic Polynucleotide
taatacgactcactatagggtcctcaccagttgtcacctgaccaggttccaacagaggagaggaaccatgtcaggtgacaacctggcggcagcgcaaaagatg

SEQ ID NO: 149927 - DNA, 103 bp, Artificial Sequence
  Synthetic Polynucleotide
taatacgactcactatagggcaagtttccttcctcaccagttgtcacctgaacagaggagacaggtgatgactggtgagaacctggcggcagcgcaaaagatg

SEQ ID NO: 149928 - DNA, 103 bp, Artificial Sequence
  Synthetic Polynucleotide
taatacgactcactatagggactctggcttcaagtttccttcctcaccagaacagaggagactggtgatgaaggaaactaacctggcggcagcgcaaaagatg

SEQ ID NO: 149929 - DNA, 103 bp, Artificial Sequence
  Synthetic Polynucleotide
taatacgactcactatagggtcatccataaactctggcttcaagtttcctaacagaggagaaggaaaatggaagccagaaacctggcggcagcgcaaaagatg

SEQ ID NO: 149930 - DNA, 103 bp, Artificial Sequence
  Synthetic Polynucleotide
taatacgactcactatagggagtcaaaacctcatccataaactctggcttaacagaggagaaagccaatgtttatggataacctggcggcagcgcaaaagatg

SEQ ID NO: 149931 - DNA, 103 bp, Artificial Sequence
  Synthetic Polynucleotide
taatacgactcactatagggtcaggctatcttctttgtttccctttggtaaacagaggagataccaaatggaaacaaagaacctggcggcagcgcaaaagatg

SEQ ID NO: 149932 - DNA, 103 bp, Artificial Sequence
  Synthetic Polynucleotide
taatacgactcactatagggtatactcaggagtcaaaacctcatccataaaacagaggagattatggatgaggttttgaaacctggcggcagcgcaaaagatg

SEQ ID NO: 149933 - DNA, 103 bp, Artificial Sequence
  Synthetic Polynucleotide
taatacgactcactatagggcgttggcccatatactcaggagtcaaaaccaacagaggagaggttttatgtcctgagtaaacctggcggcagcgcaaaagatg

SEQ ID NO: 149934 - DNA, 103 bp, Artificial Sequence
  Synthetic Polynucleotide
taatacgactcactataggggttacatggtcgttggcccatatactcaggaacagaggagacctgagatgatgggccaaaacctggcggcagcgcaaaagatg

SEQ ID NO: 149935 - DNA, 103 bp, Artificial Sequence
  Synthetic Polynucleotide
taatacgactcactatagggaagaaacattgttacatggtcgttggcccaaacagaggagatgggccatggaccatgtaaacctggcggcagcgcaaaagatg

SEQ ID NO: 149936 - DNA, 103 bp, Artificial Sequence
  Synthetic Polynucleotide
taatacgactcactatagggatcttatcagaagaaacattgttacatggtaacagaggagaaccatgatgcaatgtttcaacctggcggcagcgcaaaagatg

SEQ ID NO: 149937 - DNA, 103 bp, Artificial Sequence
  Synthetic Polynucleotide
taatacgactcactatagggtttatcaccaatcttatcagaagaaacattaacagaggagaaatgttatgtctgataagaacctggcggcagcgcaaaagatg

SEQ ID NO: 149938 - DNA, 103 bp, Artificial Sequence
  Synthetic Polynucleotide
taatacgactcactatagggtagaaaggcctttatcaccaatcttatcagaacagaggagactgataatgttggtgataaacctggcggcagcgcaaaagatg

SEQ ID NO: 149939 - DNA, 103 bp, Artificial Sequence
  Synthetic Polynucleotide
taatacgactcactatagggactcctggcatagaaaggcctttatcaccaaacagaggagatggtgaatgaggcctttcaacctggcggcagcgcaaaagatg

SEQ ID NO: 149940 - DNA, 103 bp, Artificial Sequence
  Synthetic Polynucleotide
taatacgactcactatagggagctttggggactcctggcatagaaaggccaacagaggagaggccttatgatgccaggaaacctggcggcagcgcaaaagatg

SEQ ID NO: 149941 - DNA, 103 bp, Artificial Sequence
  Synthetic Polynucleotide
taatacgactcactataggggcatgggtggagctttggggactcctggcaaacagaggagatgccagatgtccccaaagaacctggcggcagcgcaaaagatg

SEQ ID NO: 149942 - DNA, 103 bp, Artificial Sequence
  Synthetic Polynucleotide
taatacgactcactatagggttaatttttttcaggctatcttctttgtttaacagaggagaaaacaaatgagatagcctaacctggcggcagcgcaaaagatg

SEQ ID NO: 149943 - DNA, 103 bp, Artificial Sequence
  Synthetic Polynucleotide
taatacgactcactatagggccttctacttgcatgggtggagctttggggaacagaggagaccccaaatgtccacccataacctggcggcagcgcaaaagatg

SEQ ID NO: 149944 - DNA, 103 bp, Artificial Sequence
  Synthetic Polynucleotide
taatacgactcactatagggcttggcagatccttctacttgcatgggtggaacagaggagaccacccatgcaagtagaaaacctggcggcagcgcaaaagatg

SEQ ID NO: 149945 - DNA, 103 bp, Artificial Sequence
  Synthetic Polynucleotide
taatacgactcactatagggcctgtaattccttggcagatccttctacttaacagaggagaaagtagatggatctgccaaacctggcggcagcgcaaaagatg

SEQ ID NO: 149946 - DNA, 103 bp, Artificial Sequence
  Synthetic Polynucleotide
taatacgactcactatagggttccgtggtgcctgtaattccttggcagataacagaggagaatctgcatgggaattacaaacctggcggcagcgcaaaagatg

SEQ ID NO: 149947 - DNA, 103 bp, Artificial Sequence
  Synthetic Polynucleotide
taatacgactcactataggggactgtgcgtttccgtggtgcctgtaattcaacagaggagagaattaatggcaccacggaacctggcggcagcgcaaaagatg

SEQ ID NO: 149948 - DNA, 103 bp, Artificial Sequence
  Synthetic Polynucleotide
taatacgactcactataggggtgtcactttgactgtgcgtttccgtggtgaacagaggagacaccacatgaacgcacagaacctggcggcagcgcaaaagatg

SEQ ID NO: 149949 - DNA, 103 bp, Artificial Sequence
  Synthetic Polynucleotide
taatacgactcactatagggagaggtgtcagtgtcactttgactgtgcgtaacagaggagaacgcacatgcaaagtgacaacctggcggcagcgcaaaagatg

SEQ ID NO: 149950 - DNA, 103 bp, Artificial Sequence
  Synthetic Polynucleotide
taatacgactcactatagggttccatttttagaggtgtcagtgtcactttaacagaggagaaaagtgatgctgacacctaacctggcggcagcgcaaaagatg

SEQ ID NO: 149951 - DNA, 103 bp, Artificial Sequence
  Synthetic Polynucleotide
taatacgactcactataggggactctcattttccatttttagaggtgtcaaacagaggagatgacacatgtaaaaatggaacctggcggcagcgcaaaagatg

SEQ ID NO: 149952 - DNA, 103 bp, Artificial Sequence
  Synthetic Polynucleotide
taatacgactcactatagggtttttggattgactctcattttccatttttaacagaggagaaaaaatatgaaatgagagaacctggcggcagcgcaaaagatg

SEQ ID NO: 149953 - DNA, 103 bp, Artificial Sequence
  Synthetic Polynucleotide
taatacgactcactatagggaggtgtccttttaatttttttcaggctatcaacagaggagagatagcatgaaaaaaattaacctggcggcagcgcaaaagatg

SEQ ID NO: 149954 - DNA, 103 bp, Artificial Sequence
  Synthetic Polynucleotide
taatacgactcactatagggtttcagggcatttttggattgactctcattaacagaggagaaatgagatgcaatccaaaaacctggcggcagcgcaaaagatg

SEQ ID NO: 149955 - DNA, 103 bp, Artificial Sequence
  Synthetic Polynucleotide
taatacgactcactataggggactactttctttcagggcatttttggattaacagaggagaaatccaatgatgccctgaaacctggcggcagcgcaaaagatg

SEQ ID NO: 149956 - DNA, 103 bp, Artificial Sequence
  Synthetic Polynucleotide
taatacgactcactatagggggggaagcaggactactttctttcagggcaaacagaggagatgccctatgagaaagtagaacctggcggcagcgcaaaagatg

SEQ ID NO: 149957 - DNA, 103 bp, Artificial Sequence
  Synthetic Polynucleotide
taatacgactcactatagggtatttgcaaaggggaagcaggactactttcaacagaggagagaaagtatgcctgcttccaacctggcggcagcgcaaaagatg

SEQ ID NO: 149958 - DNA, 103 bp, Artificial Sequence
  Synthetic Polynucleotide
taatacgactcactatagggatgttgactctatttgcaaaggggaagcagaacagaggagactgcttatgctttgcaaaaacctggcggcagcgcaaaagatg

SEQ ID NO: 149959 - DNA, 103 bp, Artificial Sequence
  Synthetic Polynucleotide
taatacgactcactatagggtctgtgggagatgttgactctatttgcaaaaacagaggagatttgcaatgagagtcaacaacctggcggcagcgcaaaagatg

SEQ ID NO: 149960 - DNA, 103 bp, Artificial Sequence
  Synthetic Polynucleotide
taatacgactcactatagggtgaaattggttctgtgggagatgttgactcaacagaggagagagtcaatgtctcccacaaacctggcggcagcgcaaaagatg

SEQ ID NO: 149961 - DNA, 103 bp, Artificial Sequence
  Synthetic Polynucleotide
taatacgactcactatagggtttcagaggctgaaattggttctgtgggagaacagaggagactcccaatgaaccaatttaacctggcggcagcgcaaaagatg

SEQ ID NO: 149962 - DNA, 103 bp, Artificial Sequence
  Synthetic Polynucleotide
taatacgactcactatagggtctcctggattttcagaggctgaaattggtaacagaggagaaccaatatgagcctctgaaacctggcggcagcgcaaaagatg

SEQ ID NO: 149963 - DNA, 103 bp, Artificial Sequence
  Synthetic Polynucleotide
taatacgactcactatagggcactggaccatctcctggattttcagaggcaacagaggagagcctctatgaatccaggaaacctggcggcagcgcaaaagatg

SEQ ID NO: 149964 - DNA, 103 bp, Artificial Sequence
  Synthetic Polynucleotide
taatacgactcactatagggacgtagcagaaggtgtccttttaattttttaacagaggagaaaaaaaatgaaaggacacaacctggcggcagcgcaaaagatg

SEQ ID NO: 149965 - DNA, 103 bp, Artificial Sequence
  Synthetic Polynucleotide
taatacgactcactatagggttggttgggccactggaccatctcctggataacagaggagaatccagatgatggtccagaacctggcggcagcgcaaaagatg

SEQ ID NO: 149966 - DNA, 103 bp, Artificial Sequence
  Synthetic Polynucleotide
taatacgactcactatagggttattggggcttggttgggccactggaccaaacagaggagatggtccatgggcccaaccaacctggcggcagcgcaaaagatg

SEQ ID NO: 149967 - DNA, 103 bp, Artificial Sequence
  Synthetic Polynucleotide
taatacgactcactataggggcatgaggtattattggggcttggttgggcaacagaggagagcccaaatgagccccaataacctggcggcagcgcaaaagatg

SEQ ID NO: 149968 - DNA, 103 bp, Artificial Sequence
  Synthetic Polynucleotide
taatacgactcactataggggagaatcctggcatgaggtattattggggcaacagaggagagccccaatgatacctcataacctggcggcagcgcaaaagatg

SEQ ID NO: 149969 - DNA, 103 bp, Artificial Sequence
  Synthetic Polynucleotide
taatacgactcactatagggttgttactttgagaatcctggcatgaggtaaacagaggagatacctcatgccaggattcaacctggcggcagcgcaaaagatg

SEQ ID NO: 149970 - DNA, 103 bp, Artificial Sequence
  Synthetic Polynucleotide
taatacgactcactatagggattctgatagttgttactttgagaatcctgaacagaggagacaggatatgcaaagtaacaacctggcggcagcgcaaaagatg

SEQ ID NO: 149971 - DNA, 103 bp, Artificial Sequence
  Synthetic Polynucleotide
taatacgactcactataggggtactggaagattctgatagttgttactttaacagaggagaaaagtaatgactatcagaaacctggcggcagcgcaaaagatg

SEQ ID NO: 149972 - DNA, 103 bp, Artificial Sequence
  Synthetic Polynucleotide
taatacgactcactatagggtttctgtcctgtactggaagattctgatagaacagaggagactatcaatgtcttccagtaacctggcggcagcgcaaaagatg

SEQ ID NO: 149973 - DNA, 103 bp, Artificial Sequence
  Synthetic Polynucleotide
taatacgactcactatagggaagcattaggtttctgtcctgtactggaagaacagaggagacttccaatgcaggacagaaacctggcggcagcgcaaaagatg

SEQ ID NO: 149974 - DNA, 103 bp, Artificial Sequence
  Synthetic Polynucleotide
taatacgactcactatagggggccatctggaagcattaggtttctgtcctaacagaggagaaggacaatgacctaatgcaacctggcggcagcgcaaaagatg

SEQ ID NO: 149975 - DNA, 103 bp, Artificial Sequence
  Synthetic Polynucleotide
taatacgactcactataggggcttgctgaaacgtagcagaaggtgtccttaacagaggagaaaggacatgttctgctacaacctggcggcagcgcaaaagatg

SEQ ID NO: 149976 - DNA, 103 bp, Artificial Sequence
  Synthetic Polynucleotide
taatacgactcactatagggtgaggtttggggccatctggaagcattaggaacagaggagacctaatatgtccagatggaacctggcggcagcgcaaaagatg

SEQ ID NO: 149977 - DNA, 103 bp, Artificial Sequence
  Synthetic Polynucleotide
taatacgactcactataggggccatcctcctgaggtttggggccatctggaacagaggagaccagatatgcccaaacctaacctggcggcagcgcaaaagatg

SEQ ID NO: 149978 - DNA, 103 bp, Artificial Sequence
  Synthetic Polynucleotide
taatacgactcactatagggttttaaaagagccatcctcctgaggtttggaacagaggagaccaaacatgaggaggatgaacctggcggcagcgcaaaagatg

SEQ ID NO: 149979 - DNA, 103 bp, Artificial Sequence
  Synthetic Polynucleotide
taatacgactcactatagggggatacctccttttaaaagagccatcctccaacagaggagaggaggaatgctcttttaaaacctggcggcagcgcaaaagatg

SEQ ID NO: 149980 - DNA, 103 bp, Artificial Sequence
  Synthetic Polynucleotide
taatacgactcactatagggactgcgacggggatacctccttttaaaagaaacagaggagatcttttatgaggaggtataacctggcggcagcgcaaaagatg

SEQ ID NO: 149981 - DNA, 103 bp, Artificial Sequence
  Synthetic Polynucleotide
taatacgactcactataggggtgcacgggcactgcgacggggatacctccaacagaggagaggaggtatgcccgtcgcaaacctggcggcagcgcaaaagatg

SEQ ID NO: 149982 - DNA, 103 bp, Artificial Sequence
  Synthetic Polynucleotide
taatacgactcactatagggatgttagaacgtgcacgggcactgcgacggaacagaggagaccgtcgatgtgcccgtgcaacctggcggcagcgcaaaagatg

SEQ ID NO: 149983 - DNA, 103 bp, Artificial Sequence
  Synthetic Polynucleotide
taatacgactcactatagggcccaaaaaacatgttagaacgtgcacgggcaacagaggagagcccgtatgcgttctaacaacctggcggcagcgcaaaagatg

SEQ ID NO: 149984 - DNA, 103 bp, Artificial Sequence
  Synthetic Polynucleotide
taatacgactcactataggggtggggtaagcccaaaaaacatgttagaacaacagaggagagttctaatgtgttttttgaacctggcggcagcgcaaaagatg

SEQ ID NO: 149985 - DNA, 103 bp, Artificial Sequence
  Synthetic Polynucleotide
taatacgactcactatagggactccatagagtggggtaagcccaaaaaacaacagaggagagtttttatggcttaccccaacctggcggcagcgcaaaagatg

SEQ ID NO: 149986 - DNA, 103 bp, Artificial Sequence
  Synthetic Polynucleotide
taatacgactcactatagggaatctttgtggcttgctgaaacgtagcagaaacagaggagatctgctatgtttcagcaaaacctggcggcagcgcaaaagatg

SEQ ID NO: 149987 - DNA, 103 bp, Artificial Sequence
  Synthetic Polynucleotide
taatacgactcactatagggataggatcttactccatagagtggggtaagaacagaggagacttaccatgctctatggaaacctggcggcagcgcaaaagatg

SEQ ID NO: 149988 - DNA, 103 bp, Artificial Sequence
  Synthetic Polynucleotide
taatacgactcactatagggcttcttcaccataggatcttactccatagaaacagaggagatctatgatgtaagatcctaacctggcggcagcgcaaaagatg

SEQ ID NO: 149989 - DNA, 103 bp, Artificial Sequence
  Synthetic Polynucleotide
taatacgactcactatagggaatggaatgtcttcttcaccataggatcttaacagaggagaaagatcatgtggtgaagaaacctggcggcagcgcaaaagatg

SEQ ID NO: 149990 - DNA, 103 bp, Artificial Sequence
  Synthetic Polynucleotide
taatacgactcactataggggctgctgtagaatggaatgtcttcttcaccaacagaggagaggtgaaatggacattccaaacctggcggcagcgcaaaagatg

SEQ ID NO: 149991 - DNA, 103 bp, Artificial Sequence
  Synthetic Polynucleotide
taatacgactcactatagggtcccagttgagctgctgtagaatggaatgtaacagaggagaacattcatgtctacagcaaacctggcggcagcgcaaaagatg

SEQ ID NO: 149992 - DNA, 103 bp, Artificial Sequence
  Synthetic Polynucleotide
taatacgactcactatagggcctcgcttcttcccagttgagctgctgtagaacagaggagactacagatgctcaactggaacctggcggcagcgcaaaagatg

SEQ ID NO: 149993 - DNA, 103 bp, Artificial Sequence
  Synthetic Polynucleotide
taatacgactcactatagggtgatctcttgcctcgcttcttcccagttgaaacagaggagatcaactatgaagaagcgaaacctggcggcagcgcaaaagatg

SEQ ID NO: 149994 - DNA, 103 bp, Artificial Sequence
  Synthetic Polynucleotide
taatacgactcactataggggtccttcagctgatctcttgcctcgcttctaacagaggagaagaagcatggcaagagataacctggcggcagcgcaaaagatg

SEQ ID NO: 149995 - DNA, 103 bp, Artificial Sequence
  Synthetic Polynucleotide
taatacgactcactatagggccatccacctgtccttcagctgatctcttgaacagaggagacaagagatgagctgaaggaacctggcggcagcgcaaaagatg

SEQ ID NO: 149996 - DNA, 103 bp, Artificial Sequence
  Synthetic Polynucleotide
taatacgactcactataggggtcatcggccccatccacctgtccttcagcaacagaggagagctgaaatgcaggtggataacctggcggcagcgcaaaagatg

SEQ ID NO: 149997 - DNA, 103 bp, Artificial Sequence
  Synthetic Polynucleotide
taatacgactcactataggggttgccgcggggcgccccctaggccccggcaacagaggagagccgggatgtagggggcgaacctggcggcagcgcaaaagatg

SEQ ID NO: 149998 - DNA, 103 bp, Artificial Sequence
  Synthetic Polynucleotide
taatacgactcactatagggttaattttttaatctttgtggcttgctgaaaacagaggagattcagcatgccacaaagaaacctggcggcagcgcaaaagatg

SEQ ID NO: 149999 - DNA, 103 bp, Artificial Sequence
  Synthetic Polynucleotide
taatacgactcactatagggaagtgcttaagtcatcggccccatccacctaacagaggagaaggtggatggggccgatgaacctggcggcagcgcaaaagatg

SEQ ID NO: 150000 - DNA, 103 bp, Artificial Sequence
  Synthetic Polynucleotide
taatacgactcactatagggtcttcatctgaagtgcttaagtcatcggccaacagaggagaggccgaatgcttaagcacaacctggcggcagcgcaaaagatg

SEQ ID NO: 150001 - DNA, 103 bp, Artificial Sequence
  Synthetic Polynucleotide
taatacgactcactataggggtataagtcgtcttcatctgaagtgcttaaaacagaggagattaagcatgtcagatgaaaacctggcggcagcgcaaaagatg

SEQ ID NO: 150002 - DNA, 103 bp, Artificial Sequence
  Synthetic Polynucleotide
taatacgactcactatagggagttgtaatagtataagtcgtcttcatctgaacagaggagacagatgatgacgacttataacctggcggcagcgcaaaagatg

SEQ ID NO: 150003 - DNA, 103 bp, Artificial Sequence
  Synthetic Polynucleotide
taatacgactcactataggggttctagtgaagttgtaatagtataagtcgaacagaggagacgacttatgctattacaaaacctggcggcagcgcaaaagatg

SEQ ID NO: 150004 - DNA, 103 bp, Artificial Sequence
  Synthetic Polynucleotide
taatacgactcactatagggagaaatcactgttctagtgaagttgtaataaacagaggagatattacatgttcactagaaacctggcggcagcgcaaaagatg

SEQ ID NO: 150005 - DNA, 103 bp, Artificial Sequence
  Synthetic Polynucleotide
taatacgactcactatagggctccacctgaagaaatcactgttctagtgaaacagaggagatcactaatgcagtgatttaacctggcggcagcgcaaaagatg

SEQ ID NO: 150006 - DNA, 103 bp, Artificial Sequence
  Synthetic Polynucleotide
taatacgactcactatagggagtcgttcctctccacctgaagaaatcactaacagaggagaagtgatatgttcaggtggaacctggcggcagcgcaaaagatg

SEQ ID NO: 150007 - DNA, 103 bp, Artificial Sequence
  Synthetic Polynucleotide
taatacgactcactatagggatgggatgccagtcgttcctctccacctgaaacagaggagatcaggtatggaggaacgaaacctggcggcagcgcaaaagatg

SEQ ID NO: 150008 - DNA, 103 bp, Artificial Sequence
  Synthetic Polynucleotide
taatacgactcactataggggaaataaattatgggatgccagtcgttcctaacagaggagaaggaacatgtggcatcccaacctggcggcagcgcaaaagatg

SEQ ID NO: 150009 - DNA, 103 bp, Artificial Sequence
  Synthetic Polynucleotide
taatacgactcactatagggttacctgctcttaattttttaatctttgtgaacagaggagacacaaaatgtaaaaaattaacctggcggcagcgcaaaagatg

SEQ ID NO: 150010 - DNA, 103 bp, Artificial Sequence
  Synthetic Polynucleotide
taatacgactcactatagggtcctcctcccgaaataaattatgggatgccaacagaggagaggcatcatgtaatttattaacctggcggcagcgcaaaagatg

SEQ ID NO: 150011 - DNA, 103 bp, Artificial Sequence
  Synthetic Polynucleotide
taatacgactcactatagggatcacactgttcctcctcccgaaataaattaacagaggagaaatttaatgcgggaggagaacctggcggcagcgcaaaagatg

SEQ ID NO: 150012 - DNA, 103 bp, Artificial Sequence
  Synthetic Polynucleotide
taatacgactcactatagggtttttggaagatcacactgttcctcctcccaacagaggagagggaggatgaacagtgtgaacctggcggcagcgcaaaagatg

SEQ ID NO: 150013 - DNA, 103 bp, Artificial Sequence
  Synthetic Polynucleotide
taatacgactcactatagggaactgtgagatttttggaagatcacactgtaacagaggagaacagtgatgtcttccaaaaacctggcggcagcgcaaaagatg

SEQ ID NO: 150014 - DNA, 103 bp, Artificial Sequence
  Synthetic Polynucleotide
taatacgactcactatagggaacaccatccaactgtgagatttttggaagaacagaggagacttccaatgatctcacagaacctggcggcagcgcaaaagatg

SEQ ID NO: 150015 - DNA, 103 bp, Artificial Sequence
  Synthetic Polynucleotide
taatacgactcactatagggtcccatcatcaacaccatccaactgtgagaaacagaggagatctcacatgtggatggtgaacctggcggcagcgcaaaagatg

SEQ ID NO: 150016 - DNA, 103 bp, Artificial Sequence
  Synthetic Polynucleotide
taatacgactcactatagggtcactctctgtcccatcatcaacaccatccaacagaggagaggatggatgtgatgatggaacctggcggcagcgcaaaagatg

SEQ ID NO: 150017 - DNA, 103 bp, Artificial Sequence
  Synthetic Polynucleotide
taatacgactcactataggggacactagtatcactctctgtcccatcatcaacagaggagagatgatatgacagagagtaacctggcggcagcgcaaaagatg

SEQ ID NO: 150018 - DNA, 103 bp, Artificial Sequence
  Synthetic Polynucleotide
taatacgactcactatagggttgtggctgtgacactagtatcactctctgaacagaggagacagagaatgatactagtgaacctggcggcagcgcaaaagatg

SEQ ID NO: 150019 - DNA, 103 bp, Artificial Sequence
  Synthetic Polynucleotide
taatacgactcactatagggcttttccttgttgtggctgtgacactagtaaacagaggagatactagatgcacagccacaacctggcggcagcgcaaaagatg

SEQ ID NO: 150020 - DNA, 103 bp, Artificial Sequence
  Synthetic Polynucleotide
taatacgactcactatagggaggagagagtttacctgctcttaattttttaacagaggagaaaaaaaatgagagcaggtaacctggcggcagcgcaaaagatg

SEQ ID NO: 150021 - DNA, 103 bp, Artificial Sequence
  Synthetic Polynucleotide
taatacgactcactatagggaatctggctgcttttccttgttgtggctgtaacagaggagaacagccatgacaaggaaaaacctggcggcagcgcaaaagatg

SEQ ID NO: 150022 - DNA, 103 bp, Artificial Sequence
  Synthetic Polynucleotide
taatacgactcactatagggttctttttggaatctggctgcttttccttgaacagaggagacaaggaatggcagccagaaacctggcggcagcgcaaaagatg

SEQ ID NO: 150023 - DNA, 103 bp, Artificial Sequence
  Synthetic Polynucleotide
taatacgactcactatagggtctttaccatttctttttggaatctggctgaacagaggagacagccaatgtccaaaaagaacctggcggcagcgcaaaagatg

SEQ ID NO: 150024 - DNA, 103 bp, Artificial Sequence
  Synthetic Polynucleotide
taatacgactcactatagggtgttccattttctttaccatttctttttggaacagaggagaccaaaaatgaatggtaaaaacctggcggcagcgcaaaagatg

SEQ ID NO: 150025 - DNA, 103 bp, Artificial Sequence
  Synthetic Polynucleotide
taatacgactcactatagggttaagttctctgttccattttctttaccataacagaggagaatggtaatgaaaatggaaaacctggcggcagcgcaaaagatg

SEQ ID NO: 150026 - DNA, 103 bp, Artificial Sequence
  Synthetic Polynucleotide
taatacgactcactatagggctatcaatctttaagttctctgttccatttaacagaggagaaaatggatgagagaacttaacctggcggcagcgcaaaagatg

SEQ ID NO: 150027 - DNA, 103 bp, Artificial Sequence
  Synthetic Polynucleotide
taatacgactcactatagggatcttcaggtctatcaatctttaagttctcaacagaggagagagaacatgaagattgataacctggcggcagcgcaaaagatg

SEQ ID NO: 150028 - DNA, 103 bp, Artificial Sequence
  Synthetic Polynucleotide
taatacgactcactatagggtctccccagcatcttcaggtctatcaatctaacagaggagaagattgatggacctgaagaacctggcggcagcgcaaaagatg

SEQ ID NO: 150029 - DNA, 103 bp, Artificial Sequence
  Synthetic Polynucleotide
taatacgactcactatagggacatgttctttctccccagcatcttcaggtaacagaggagaacctgaatgtgctggggaaacctggcggcagcgcaaaagatg

SEQ ID NO: 150030 - DNA, 103 bp, Artificial Sequence
  Synthetic Polynucleotide
taatacgactcactatagggactcttagtgacatgttctttctccccagcaacagaggagagctgggatgaaagaacataacctggcggcagcgcaaaagatg

SEQ ID NO: 150031 - DNA, 103 bp, Artificial Sequence
  Synthetic Polynucleotide
taatacgactcactatagggtagacttgagaggagagagtttacctgctcaacagaggagagagcagatgaactctctcaacctggcggcagcgcaaaagatg

SEQ ID NO: 150032 - DNA, 103 bp, Artificial Sequence
  Synthetic Polynucleotide
taatacgactcactatagggggccaacagaactcttagtgacatgttcttaacagaggagaaagaacatgtcactaagaaacctggcggcagcgcaaaagatg

SEQ ID NO: 150033 - DNA, 103 bp, Artificial Sequence
  Synthetic Polynucleotide
taatacgactcactatagggtcatttttgtggccaacagaactcttagtgaacagaggagacactaaatgttctgttggaacctggcggcagcgcaaaagatg

SEQ ID NO: 150034 - DNA, 103 bp, Artificial Sequence
  Synthetic Polynucleotide
taatacgactcactatagggcatctttggctcatttttgtggccaacagaaacagaggagatctgttatgcacaaaaataacctggcggcagcgcaaaagatg

SEQ ID NO: 150035 - DNA, 103 bp, Artificial Sequence
  Synthetic Polynucleotide
taatacgactcactatagggggcagttatccatctttggctcatttttgtaacagaggagaacaaaaatgagccaaagaaacctggcggcagcgcaaaagatg

SEQ ID NO: 150036 - DNA, 103 bp, Artificial Sequence
  Synthetic Polynucleotide
taatacgactcactatagggcttacagaatggcagttatccatctttggcaacagaggagagccaaaatgggataactgaacctggcggcagcgcaaaagatg

SEQ ID NO: 150037 - DNA, 103 bp, Artificial Sequence
  Synthetic Polynucleotide
taatacgactcactatagggtttaactctgcttacagaatggcagttatcaacagaggagagataacatgcattctgtaaacctggcggcagcgcaaaagatg

SEQ ID NO: 150038 - DNA, 103 bp, Artificial Sequence
  Synthetic Polynucleotide
taatacgactcactataggggtccctgtgttttaactctgcttacagaataacagaggagaattctgatggcagagttaaacctggcggcagcgcaaaagatg

SEQ ID NO: 150039 - DNA, 103 bp, Artificial Sequence
  Synthetic Polynucleotide
taatacgactcactatagggaaggaatcttgtccctgtgttttaactctgaacagaggagacagagtatgaacacagggaacctggcggcagcgcaaaagatg

SEQ ID NO: 150040 - DNA, 103 bp, Artificial Sequence
  Synthetic Polynucleotide
taatacgactcactatagggctgagcttccaaggaatcttgtccctgtgtaacagaggagaacacagatgcaagattccaacctggcggcagcgcaaaagatg

SEQ ID NO: 150041 - DNA, 103 bp, Artificial Sequence
  Synthetic Polynucleotide
taatacgactcactatagggatgagctgagctgagcttccaaggaatcttaacagaggagaaagattatgtggaagctcaacctggcggcagcgcaaaagatg

SEQ ID NO: 150042 - DNA, 103 bp, Artificial Sequence
  Synthetic Polynucleotide
taatacgactcactataggggtcttaaacttagacttgagaggagagagtaacagaggagaactctcatgtctcaagtcaacctggcggcagcgcaaaagatg

SEQ ID NO: 150043 - DNA, 103 bp, Artificial Sequence
  Synthetic Polynucleotide
taatacgactcactatagggcttgactccaatgagctgagctgagcttccaacagaggagaggaagcatggctcagctcaacctggcggcagcgcaaaagatg

SEQ ID NO: 150044 - DNA, 103 bp, Artificial Sequence
  Synthetic Polynucleotide
taatacgactcactataggggactctgcggcttgactccaatgagctgagaacagaggagactcagcatgttggagtcaaacctggcggcagcgcaaaagatg

SEQ ID NO: 150045 - DNA, 103 bp, Artificial Sequence
  Synthetic Polynucleotide
taatacgactcactatagggtacttgtgtggactctgcggcttgactccaaacagaggagatggagtatggccgcagagaacctggcggcagcgcaaaagatg

SEQ ID NO: 150046 - DNA, 103 bp, Artificial Sequence
  Synthetic Polynucleotide
taatacgactcactatagggtcggagggggtacttgtgtggactctgcggaacagaggagaccgcagatgccacacaagaacctggcggcagcgcaaaagatg

SEQ ID NO: 150047 - DNA, 103 bp, Artificial Sequence
  Synthetic Polynucleotide
taatacgactcactatagggtaaatttttgtcggagggggtacttgtgtgaacagaggagacacacaatgaccccctccaacctggcggcagcgcaaaagatg

SEQ ID NO: 150048 - DNA, 103 bp, Artificial Sequence
  Synthetic Polynucleotide
taatacgactcactatagggaggtgtccagtaaatttttgtcggagggggaacagaggagaccccctatgacaaaaattaacctggcggcagcgcaaaagatg

SEQ ID NO: 150049 - DNA, 103 bp, Artificial Sequence
  Synthetic Polynucleotide
taatacgactcactatagggtcagtattataggtgtccagtaaatttttgaacagaggagacaaaaaatgactggacacaacctggcggcagcgcaaaagatg

SEQ ID NO: 150050 - DNA, 103 bp, Artificial Sequence
  Synthetic Polynucleotide
taatacgactcactatagggtttcaggagctcagtattataggtgtccagaacagaggagactggacatgtataatactaacctggcggcagcgcaaaagatg

SEQ ID NO: 150051 - DNA, 103 bp, Artificial Sequence
  Synthetic Polynucleotide
taatacgactcactatagggctgaatctgatttcaggagctcagtattataacagaggagaataataatgagctcctgaaacctggcggcagcgcaaaagatg

SEQ ID NO: 150052 - DNA, 103 bp, Artificial Sequence
  Synthetic Polynucleotide
taatacgactcactatagggttgttattgtctgaatctgatttcaggagcaacagaggagagctcctatgatcagattcaacctggcggcagcgcaaaagatg

SEQ ID NO: 150053 - DNA, 103 bp, Artificial Sequence
  Synthetic Polynucleotide
taatacgactcactatagggaagcttccctgtcttaaacttagacttgagaacagaggagactcaagatgaagtttaagaacctggcggcagcgcaaaagatg

SEQ ID NO: 150054 - DNA, 103 bp, Artificial Sequence
  Synthetic Polynucleotide
taatacgactcactataggggtcatcactgttgttattgtctgaatctgaaacagaggagatcagatatggacaataacaacctggcggcagcgcaaaagatg

SEQ ID NO: 150055 - DNA, 103 bp, Artificial Sequence
  Synthetic Polynucleotide
taatacgactcactatagggtattcccacagtcatcactgttgttattgtaacagaggagaacaataatgacagtgatgaacctggcggcagcgcaaaagatg

SEQ ID NO: 150056 - DNA, 103 bp, Artificial Sequence
  Synthetic Polynucleotide
taatacgactcactataggggaaggcaggatattcccacagtcatcactgaacagaggagacagtgaatgctgtgggaaaacctggcggcagcgcaaaagatg

SEQ ID NO: 150057 - DNA, 103 bp, Artificial Sequence
  Synthetic Polynucleotide
taatacgactcactatagggcataatgtctgaaggcaggatattcccacaaacagaggagatgtgggatgatcctgcctaacctggcggcagcgcaaaagatg

SEQ ID NO: 150058 - DNA, 103 bp, Artificial Sequence
  Synthetic Polynucleotide
taatacgactcactataggggtacaaagtccataatgtctgaaggcaggaaacagaggagatcctgcatgcagacattaaacctggcggcagcgcaaaagatg

SEQ ID NO: 150059 - DNA, 103 bp, Artificial Sequence
  Synthetic Polynucleotide
taatacgactcactataggggtattctttagtacaaagtccataatgtctaacagaggagaagacatatgggactttgtaacctggcggcagcgcaaaagatg

SEQ ID NO: 150060 - DNA, 103 bp, Artificial Sequence
  Synthetic Polynucleotide
taatacgactcactatagggcatggatggagtattctttagtacaaagtcaacagaggagagactttatgctaaagaataacctggcggcagcgcaaaagatg

SEQ ID NO: 150061 - DNA, 103 bp, Artificial Sequence
  Synthetic Polynucleotide
taatacgactcactatagggccaaagcctgcatggatggagtattctttaaacagaggagataaagaatgctccatccaaacctggcggcagcgcaaaagatg

SEQ ID NO: 150062 - DNA, 103 bp, Artificial Sequence
  Synthetic Polynucleotide
taatacgactcactataggggggctctcacccaaagcctgcatggatggaaacagaggagatccatcatggcaggctttaacctggcggcagcgcaaaagatg

SEQ ID NO: 150063 - DNA, 103 bp, Artificial Sequence
  Synthetic Polynucleotide
taatacgactcactatagggagatgactctgggctctcacccaaagcctgaacagaggagacaggctatgggtgagagcaacctggcggcagcgcaaaagatg

SEQ ID NO: 150064 - DNA, 103 bp, Artificial Sequence
  Synthetic Polynucleotide
taatacgactcactatagggttcctatttgaagcttccctgtcttaaactaacagaggagaagtttaatgcagggaagcaacctggcggcagcgcaaaagatg

SEQ ID NO: 150065 - DNA, 103 bp, Artificial Sequence
  Synthetic Polynucleotide
taatacgactcactataggggttctgatgaagatgactctgggctctcacaacagaggagagtgagaatgcagagtcataacctggcggcagcgcaaaagatg

SEQ ID NO: 150066 - DNA, 103 bp, Artificial Sequence
  Synthetic Polynucleotide
taatacgactcactatagggagattcaggagttctgatgaagatgactctaacagaggagaagagtcatgttcatcagaaacctggcggcagcgcaaaagatg

SEQ ID NO: 150067 - DNA, 103 bp, Artificial Sequence
  Synthetic Polynucleotide
taatacgactcactatagggtccttcaccaagattcaggagttctgatgaaacagaggagatcatcaatgctcctgaataacctggcggcagcgcaaaagatg

SEQ ID NO: 150068 - DNA, 103 bp, Artificial Sequence
  Synthetic Polynucleotide
taatacgactcactatagggcaagacccaatccttcaccaagattcaggaaacagaggagatcctgaatgttggtgaagaacctggcggcagcgcaaaagatg

SEQ ID NO: 150069 - DNA, 103 bp, Artificial Sequence
  Synthetic Polynucleotide
taatacgactcactatagggcgattactgtcaagacccaatccttcaccaaacagaggagatggtgaatgattgggtctaacctggcggcagcgcaaaagatg

SEQ ID NO: 150070 - DNA, 103 bp, Artificial Sequence
  Synthetic Polynucleotide
taatacgactcactataggggtctttttcacgattactgtcaagacccaaaacagaggagattgggtatggacagtaataacctggcggcagcgcaaaagatg

SEQ ID NO: 150071 - DNA, 103 bp, Artificial Sequence
  Synthetic Polynucleotide
taatacgactcactatagggaaagacccatgtctttttcacgattactgtaacagaggagaacagtaatggtgaaaaagaacctggcggcagcgcaaaagatg

SEQ ID NO: 150072 - DNA, 103 bp, Artificial Sequence
  Synthetic Polynucleotide
taatacgactcactatagggaatacttcaaaaagacccatgtctttttcaaacagaggagatgaaaaatgcatgggtctaacctggcggcagcgcaaaagatg

SEQ ID NO: 150073 - DNA, 103 bp, Artificial Sequence
  Synthetic Polynucleotide
taatacgactcactatagggctgctgagaaaatacttcaaaaagacccataacagaggagaatgggtatgtttgaagtaaacctggcggcagcgcaaaagatg

SEQ ID NO: 150074 - DNA, 103 bp, Artificial Sequence
  Synthetic Polynucleotide
taatacgactcactatagggttgtaggcagctgctgagaaaatacttcaaaacagaggagattgaagatgtttctcagcaacctggcggcagcgcaaaagatg

SEQ ID NO: 150075 - DNA, 103 bp, Artificial Sequence
  Synthetic Polynucleotide
taatacgactcactatagggacccccttccttcctatttgaagcttccctaacagaggagaagggaaatgtcaaataggaacctggcggcagcgcaaaagatg

SEQ ID NO: 150076 - DNA, 103 bp, Artificial Sequence
  Synthetic Polynucleotide
taatacgactcactatagggacaggttctgttgtaggcagctgctgagaaaacagaggagattctcaatggctgcctacaacctggcggcagcgcaaaagatg

SEQ ID NO: 150077 - DNA, 103 bp, Artificial Sequence
  Synthetic Polynucleotide
taatacgactcactatagggactactatccacaggttctgttgtaggcagaacagaggagactgcctatgacagaacctaacctggcggcagcgcaaaagatg

SEQ ID NO: 150078 - DNA, 103 bp, Artificial Sequence
  Synthetic Polynucleotide
taatacgactcactatagggaggaagagacactactatccacaggttctgaacagaggagacagaacatgtggatagtaaacctggcggcagcgcaaaagatg

SEQ ID NO: 150079 - DNA, 103 bp, Artificial Sequence
  Synthetic Polynucleotide
taatacgactcactataggggctgagatagaggaagagacactactatccaacagaggagaggatagatgtgtctcttcaacctggcggcagcgcaaaagatg

SEQ ID NO: 150080 - DNA, 103 bp, Artificial Sequence
  Synthetic Polynucleotide
taatacgactcactatagggctgttcctctgctgagatagaggaagagacaacagaggagagtctctatgtctatctcaaacctggcggcagcgcaaaagatg

SEQ ID NO: 150081 - DNA, 103 bp, Artificial Sequence
  Synthetic Polynucleotide
taatacgactcactataggggcaactcaaactgttcctctgctgagatagaacagaggagactatctatgcagaggaacaacctggcggcagcgcaaaagatg

SEQ ID NO: 150082 - DNA, 103 bp, Artificial Sequence
  Synthetic Polynucleotide
taatacgactcactatagggagctctagaggcaactcaaactgttcctctaacagaggagaagaggaatggtttgagttaacctggcggcagcgcaaaagatg

SEQ ID NO: 150083 - DNA, 103 bp, Artificial Sequence
  Synthetic Polynucleotide
taatacgactcactatagggatcagatggtagctctagaggcaactcaaaaacagaggagatttgagatgcctctagagaacctggcggcagcgcaaaagatg

SEQ ID NO: 150084 - DNA, 103 bp, Artificial Sequence
  Synthetic Polynucleotide
taatacgactcactatagggagacagacagatcagatggtagctctagagaacagaggagactctagatgtaccatctgaacctggcggcagcgcaaaagatg

SEQ ID NO: 150085 - DNA, 103 bp, Artificial Sequence
  Synthetic Polynucleotide
taatacgactcactatagggcgggtggtcaagacagacagatcagatggtaacagaggagaaccatcatgtctgtctgtaacctggcggcagcgcaaaagatg

SEQ ID NO: 150086 - DNA, 103 bp, Artificial Sequence
  Synthetic Polynucleotide
taatacgactcactatagggtacaatttgtacccccttccttcctatttgaacagaggagacaaataatgaggaaggggaacctggcggcagcgcaaaagatg

SEQ ID NO: 150087 - DNA, 103 bp, Artificial Sequence
  Synthetic Polynucleotide
taatacgactcactatagggagtgggactccgggtggtcaagacagacagaacagaggagactgtctatgttgaccaccaacctggcggcagcgcaaaagatg

SEQ ID NO: 150088 - DNA, 103 bp, Artificial Sequence
  Synthetic Polynucleotide
taatacgactcactatagggggctggggacagtgggactccgggtggtcaaacagaggagatgaccaatgggagtcccaaacctggcggcagcgcaaaagatg

SEQ ID NO: 150089 - DNA, 103 bp, Artificial Sequence
  Synthetic Polynucleotide
taatacgactcactatagggctgggattctggctggggacagtgggactcaacagaggagagagtccatgtgtccccagaacctggcggcagcgcaaaagatg

SEQ ID NO: 150090 - DNA, 103 bp, Artificial Sequence
  Synthetic Polynucleotide
taatacgactcactatagggagctagtctactgggattctggctggggacaacagaggagagtccccatgcagaatcccaacctggcggcagcgcaaaagatg

SEQ ID NO: 150091 - DNA, 103 bp, Artificial Sequence
  Synthetic Polynucleotide
taatacgactcactatagggctgagataacagctagtctactgggattctaacagaggagaagaatcatggtagactagaacctggcggcagcgcaaaagatg

SEQ ID NO: 150092 - DNA, 103 bp, Artificial Sequence
  Synthetic Polynucleotide
taatacgactcactatagggtcccctgagtctgagataacagctagtctaaacagaggagatagactatgtgttatctcaacctggcggcagcgcaaaagatg

SEQ ID NO: 150093 - DNA, 103 bp, Artificial Sequence
  Synthetic Polynucleotide
taatacgactcactatagggtactctcttctcccctgagtctgagataacaacagaggagagttatcatggactcagggaacctggcggcagcgcaaaagatg

SEQ ID NO: 150094 - DNA, 103 bp, Artificial Sequence
  Synthetic Polynucleotide
taatacgactcactatagggctgtgatggttactctcttctcccctgagtaacagaggagaactcagatgagaagagagaacctggcggcagcgcaaaagatg

SEQ ID NO: 150095 - DNA, 103 bp, Artificial Sequence
  Synthetic Polynucleotide
taatacgactcactatagggacagatttttctgtgatggttactctcttcaacagaggagagaagagatgaaccatcacaacctggcggcagcgcaaaagatg

SEQ ID NO: 150096 - DNA, 103 bp, Artificial Sequence
  Synthetic Polynucleotide
taatacgactcactatagggagaggaggctacagatttttctgtgatggtaacagaggagaaccatcatggaaaaatctaacctggcggcagcgcaaaagatg

SEQ ID NO: 150097 - DNA, 103 bp, Artificial Sequence
  Synthetic Polynucleotide
taatacgactcactatagggctctccgtcgtacaatttgtacccccttccaacagaggagaggaaggatgtacaaattgaacctggcggcagcgcaaaagatg

SEQ ID NO: 150098 - DNA, 103 bp, Artificial Sequence
  Synthetic Polynucleotide
taatacgactcactatagggggtcactttcagaggaggctacagatttttaacagaggagaaaaaatatgtagcctcctaacctggcggcagcgcaaaagatg

SEQ ID NO: 150099 - DNA, 103 bp, Artificial Sequence
  Synthetic Polynucleotide
taatacgactcactatagggagcagtgctgggtcactttcagaggaggctaacagaggagaagcctcatgtgaaagtgaaacctggcggcagcgcaaaagatg

SEQ ID NO: 150100 - DNA, 103 bp, Artificial Sequence
  Synthetic Polynucleotide
taatacgactcactatagggtcctgggctcagcagtgctgggtcactttcaacagaggagagaaagtatgccagcactgaacctggcggcagcgcaaaagatg

SEQ ID NO: 150101 - DNA, 103 bp, Artificial Sequence
  Synthetic Polynucleotide
taatacgactcactatagggttggatctactcctgggctcagcagtgctgaacagaggagacagcacatgtgagcccagaacctggcggcagcgcaaaagatg

SEQ ID NO: 150102 - DNA, 103 bp, Artificial Sequence
  Synthetic Polynucleotide
taatacgactcactatagggccttcaggagttggatctactcctgggctcaacagaggagagagcccatgagtagatccaacctggcggcagcgcaaaagatg

SEQ ID NO: 150103 - DNA, 103 bp, Artificial Sequence
  Synthetic Polynucleotide
taatacgactcactatagggagtcatgtggccttcaggagttggatctacaacagaggagagtagatatgactcctgaaaacctggcggcagcgcaaaagatg

SEQ ID NO: 150104 - DNA, 103 bp, Artificial Sequence
  Synthetic Polynucleotide
taatacgactcactatagggaatgatcaggagtcatgtggccttcaggagaacagaggagactcctgatggccacatgaaacctggcggcagcgcaaaagatg

SEQ ID NO: 150105 - DNA, 103 bp, Artificial Sequence
  Synthetic Polynucleotide
taatacgactcactatagggccttggataaaatgatcaggagtcatgtggaacagaggagaccacatatgtcctgatcaaacctggcggcagcgcaaaagatg

SEQ ID NO: 150106 - DNA, 103 bp, Artificial Sequence
  Synthetic Polynucleotide
taatacgactcactatagggatccatgtgtccttggataaaatgatcaggaacagaggagacctgatatgtttatccaaaacctggcggcagcgcaaaagatg

SEQ ID NO: 150107 - DNA, 103 bp, Artificial Sequence
  Synthetic Polynucleotide
taatacgactcactatagggtgtggtctgcatccatgtgtccttggataaaacagaggagattatccatggacacatggaacctggcggcagcgcaaaagatg

SEQ ID NO: 150108 - DNA, 103 bp, Artificial Sequence
  Synthetic Polynucleotide
taatacgactcactataggggccgggacgcgttgccgcggggcgccccctaacagaggagaagggggatgcccgcggcaaacctggcggcagcgcaaaagatg

SEQ ID NO: 150109 - DNA, 103 bp, Artificial Sequence
  Synthetic Polynucleotide
taatacgactcactatagggggaggccttcctctccgtcgtacaatttgtaacagaggagaacaaatatgacgacggagaacctggcggcagcgcaaaagatg

SEQ ID NO: 150110 - DNA, 103 bp, Artificial Sequence
  Synthetic Polynucleotide
taatacgactcactataggggggctagagatgtggtctgcatccatgtgtaacagaggagaacacatatgtgcagaccaaacctggcggcagcgcaaaagatg

SEQ ID NO: 150111 - DNA, 103 bp, Artificial Sequence
  Synthetic Polynucleotide
taatacgactcactatagggaccacaaggagggctagagatgtggtctgcaacagaggagagcagacatgatctctagcaacctggcggcagcgcaaaagatg

SEQ ID NO: 150112 - DNA, 103 bp, Artificial Sequence
  Synthetic Polynucleotide
taatacgactcactataggggctctactgaaccacaaggagggctagagaaacagaggagatctctaatgctccttgtgaacctggcggcagcgcaaaagatg

SEQ ID NO: 150113 - DNA, 103 bp, Artificial Sequence
  Synthetic Polynucleotide
taatacgactcactatagggccatgaccttgctctactgaaccacaaggaaacagaggagatccttgatgttcagtagaaacctggcggcagcgcaaaagatg

SEQ ID NO: 150114 - DNA, 103 bp, Artificial Sequence
  Synthetic Polynucleotide
taatacgactcactatagggctgattgttgccatgaccttgctctactgaaacagaggagatcagtaatgcaaggtcataacctggcggcagcgcaaaagatg

SEQ ID NO: 150115 - DNA, 103 bp, Artificial Sequence
  Synthetic Polynucleotide
taatacgactcactatagggtagttaaatcctgattgttgccatgaccttaacagaggagaaaggtcatggcaacaatcaacctggcggcagcgcaaaagatg

SEQ ID NO: 150116 - DNA, 103 bp, Artificial Sequence
  Synthetic Polynucleotide
taatacgactcactatagggctactgttcctagttaaatcctgattgttgaacagaggagacaacaaatgggatttaacaacctggcggcagcgcaaaagatg

SEQ ID NO: 150117 - DNA, 103 bp, Artificial Sequence
  Synthetic Polynucleotide
taatacgactcactataggggccaggggtgctactgttcctagttaaatcaacagaggagagatttaatgaggaacagtaacctggcggcagcgcaaaagatg

SEQ ID NO: 150118 - DNA, 103 bp, Artificial Sequence
  Synthetic Polynucleotide
taatacgactcactataggggtacctgaaggccaggggtgctactgttccaacagaggagaggaacaatggcacccctgaacctggcggcagcgcaaaagatg

SEQ ID NO: 150119 - DNA, 103 bp, Artificial Sequence
  Synthetic Polynucleotide
taatacgactcactatagggggggaaacaggtacctgaaggccaggggtgaacagaggagacaccccatgccttcaggtaacctggcggcagcgcaaaagatg

SEQ ID NO: 150120 - DNA, 103 bp, Artificial Sequence
  Synthetic Polynucleotide
taatacgactcactatagggttctgttgatggaggccttcctctccgtcgaacagaggagacgacggatgggaaggcctaacctggcggcagcgcaaaagatg

SEQ ID NO: 150121 - DNA, 103 bp, Artificial Sequence
  Synthetic Polynucleotide
taatacgactcactataggggggaacagttggggaaacaggtacctgaagaacagaggagacttcagatgcctgtttccaacctggcggcagcgcaaaagatg

SEQ ID NO: 150122 - DNA, 103 bp, Artificial Sequence
  Synthetic Polynucleotide
taatacgactcactatagggggttctggatgggaacagttggggaaacagaacagaggagactgtttatgcaactgttcaacctggcggcagcgcaaaagatg

SEQ ID NO: 150123 - DNA, 103 bp, Artificial Sequence
  Synthetic Polynucleotide
taatacgactcactatagggacatacttctggttctggatgggaacagttaacagaggagaaactgtatgcatccagaaaacctggcggcagcgcaaaagatg

SEQ ID NO: 150124 - DNA, 103 bp, Artificial Sequence
  Synthetic Polynucleotide
taatacgactcactatagggagaattgggcacatacttctggttctggataacagaggagaatccagatgcagaagtataacctggcggcagcgcaaaagatg

SEQ ID NO: 150125 - DNA, 103 bp, Artificial Sequence
  Synthetic Polynucleotide
taatacgactcactataggggactatcagtagaattgggcacatacttctaacagaggagaagaagtatgtgcccaattaacctggcggcagcgcaaaagatg

SEQ ID NO: 150126 - DNA, 103 bp, Artificial Sequence
  Synthetic Polynucleotide
taatacgactcactataggggacgggccaggactatcagtagaattgggcaacagaggagagcccaaatgtactgatagaacctggcggcagcgcaaaagatg

SEQ ID NO: 150127 - DNA, 103 bp, Artificial Sequence
  Synthetic Polynucleotide
taatacgactcactatagggggaaatctgagacgggccaggactatcagtaacagaggagaactgatatgcctggcccgaacctggcggcagcgcaaaagatg

SEQ ID NO: 150128 - DNA, 103 bp, Artificial Sequence
  Synthetic Polynucleotide
taatacgactcactatagggcagctgcattggaaatctgagacgggccagaacagaggagactggccatgctcagatttaacctggcggcagcgcaaaagatg

SEQ ID NO: 150129 - DNA, 103 bp, Artificial Sequence
  Synthetic Polynucleotide
taatacgactcactataggggtggtctggacagctgcattggaaatctgaaacagaggagatcagatatgcaatgcagcaacctggcggcagcgcaaaagatg

SEQ ID NO: 150130 - DNA, 103 bp, Artificial Sequence
  Synthetic Polynucleotide
taatacgactcactataggggtggggtggagtggtctggacagctgcattaacagaggagaaatgcaatggtccagaccaacctggcggcagcgcaaaagatg

SEQ ID NO: 150131 - DNA, 103 bp, Artificial Sequence
  Synthetic Polynucleotide
taatacgactcactatagggtctttatcctttctgttgatggaggccttcaacagaggagagaaggcatgcatcaacagaacctggcggcagcgcaaaagatg

SEQ ID NO: 150132 - DNA, 103 bp, Artificial Sequence
  Synthetic Polynucleotide
taatacgactcactatagggctggcttcaggtggggtggagtggtctggaaacagaggagatccagaatgctccaccccaacctggcggcagcgcaaaagatg

SEQ ID NO: 150133 - DNA, 103 bp, Artificial Sequence
  Synthetic Polynucleotide
taatacgactcactatagggttctcagtggctggcttcaggtggggtggaaacagaggagatccaccatgcctgaagccaacctggcggcagcgcaaaagatg

SEQ ID NO: 150134 - DNA, 103 bp, Artificial Sequence
  Synthetic Polynucleotide
taatacgactcactatagggaactatgagtttctcagtggctggcttcagaacagaggagactgaagatggccactgagaacctggcggcagcgcaaaagatg

SEQ ID NO: 150135 - DNA, 103 bp, Artificial Sequence
  Synthetic Polynucleotide
taatacgactcactatagggtctggttaacaactatgagtttctcagtggaacagaggagaccactgatgaactcatagaacctggcggcagcgcaaaagatg

SEQ ID NO: 150136 - DNA, 103 bp, Artificial Sequence
  Synthetic Polynucleotide
taatacgactcactatagggggctgcatgttctggttaacaactatgagtaacagaggagaactcatatgtgttaaccaaacctggcggcagcgcaaaagatg

SEQ ID NO: 150137 - DNA, 103 bp, Artificial Sequence
  Synthetic Polynucleotide
taatacgactcactatagggaacataaagtggctgcatgttctggttaacaacagaggagagttaacatgaacatgcagaacctggcggcagcgcaaaagatg

SEQ ID NO: 150138 - DNA, 103 bp, Artificial Sequence
  Synthetic Polynucleotide
taatacgactcactataggggagtttggagaacataaagtggctgcatgtaacagaggagaacatgcatgcactttatgaacctggcggcagcgcaaaagatg

SEQ ID NO: 150139 - DNA, 103 bp, Artificial Sequence
  Synthetic Polynucleotide
taatacgactcactatagggccatttggaagagtttggagaacataaagtaacagaggagaactttaatgtctccaaacaacctggcggcagcgcaaaagatg

SEQ ID NO: 150140 - DNA, 103 bp, Artificial Sequence
  Synthetic Polynucleotide
taatacgactcactatagggttgggtcactccatttggaagagtttggagaacagaggagactccaaatgcttccaaataacctggcggcagcgcaaaagatg

SEQ ID NO: 150141 - DNA, 103 bp, Artificial Sequence
  Synthetic Polynucleotide
taatacgactcactatagggattggattttttgggtcactccatttggaaaacagaggagattccaaatggagtgacccaacctggcggcagcgcaaaagatg

SEQ ID NO: 150142 - DNA, 103 bp, Artificial Sequence
  Synthetic Polynucleotide
taatacgactcactatagggcccgaaggggtctttatcctttctgttgataacagaggagaatcaacatgaaggataaaaacctggcggcagcgcaaaagatg

SEQ ID NO: 150143 - DNA, 103 bp, Artificial Sequence
  Synthetic Polynucleotide
taatacgactcactataggggaagaggtcaattggattttttgggtcactaacagaggagaagtgacatgaaaaatccaaacctggcggcagcgcaaaagatg

SEQ ID NO: 150144 - DNA, 103 bp, Artificial Sequence
  Synthetic Polynucleotide
taatacgactcactatagggagaactaacagaagaggtcaattggattttaacagaggagaaaaatcatgttgacctctaacctggcggcagcgcaaaagatg

SEQ ID NO: 150145 - DNA, 103 bp, Artificial Sequence
  Synthetic Polynucleotide
taatacgactcactatagggcactgggtgtagaactaacagaagaggtcaaacagaggagatgacctatgctgttagttaacctggcggcagcgcaaaagatg

SEQ ID NO: 150146 - DNA, 103 bp, Artificial Sequence
  Synthetic Polynucleotide
taatacgactcactataggggtctccatcacactgggtgtagaactaacaaacagaggagatgttagatgtacacccagaacctggcggcagcgcaaaagatg

SEQ ID NO: 150147 - DNA, 103 bp, Artificial Sequence
  Synthetic Polynucleotide
taatacgactcactatagggtgaagtatttgtctccatcacactgggtgtaacagaggagaacacccatggtgatggagaacctggcggcagcgcaaaagatg

SEQ ID NO: 150148 - DNA, 103 bp, Artificial Sequence
  Synthetic Polynucleotide
taatacgactcactataggggtcccaatactgaagtatttgtctccatcaaacagaggagatgatggatgcaaatacttaacctggcggcagcgcaaaagatg

SEQ ID NO: 150149 - DNA, 103 bp, Artificial Sequence
  Synthetic Polynucleotide
taatacgactcactatagggcctcccatgggtcccaatactgaagtatttaacagaggagaaaatacatgagtattgggaacctggcggcagcgcaaaagatg

SEQ ID NO: 150150 - DNA, 103 bp, Artificial Sequence
  Synthetic Polynucleotide
taatacgactcactatagggggtgagaccacctcccatgggtcccaatacaacagaggagagtattgatgcccatgggaaacctggcggcagcgcaaaagatg

SEQ ID NO: 150151 - DNA, 103 bp, Artificial Sequence
  Synthetic Polynucleotide
taatacgactcactatagggctgtggtaagggtgagaccacctcccatggaacagaggagaccatggatggtggtctcaaacctggcggcagcgcaaaagatg

SEQ ID NO: 150152 - DNA, 103 bp, Artificial Sequence
  Synthetic Polynucleotide
taatacgactcactatagggggatttagtcctgtggtaagggtgagaccaaacagaggagatggtctatgccttaccacaacctggcggcagcgcaaaagatg

SEQ ID NO: 150153 - DNA, 103 bp, Artificial Sequence
  Synthetic Polynucleotide
taatacgactcactatagggaatgaggagacccgaaggggtctttatcctaacagaggagaaggataatgaccccttcgaacctggcggcagcgcaaaagatg

SEQ ID NO: 150154 - DNA, 103 bp, Artificial Sequence
  Synthetic Polynucleotide
taatacgactcactatagggtggcaagcttggatttagtcctgtggtaagaacagaggagacttaccatgggactaaataacctggcggcagcgcaaaagatg

SEQ ID NO: 150155 - DNA, 103 bp, Artificial Sequence
  Synthetic Polynucleotide
taatacgactcactatagggattgagaagttggcaagcttggatttagtcaacagaggagagactaaatgcaagcttgcaacctggcggcagcgcaaaagatg

SEQ ID NO: 150156 - DNA, 103 bp, Artificial Sequence
  Synthetic Polynucleotide
taatacgactcactataggggggaacaaagattgagaagttggcaagcttaacagaggagaaagcttatgaacttctcaaacctggcggcagcgcaaaagatg

SEQ ID NO: 150157 - DNA, 103 bp, Artificial Sequence
  Synthetic Polynucleotide
taatacgactcactataggggctagcagaagggaacaaagattgagaagtaacagaggagaacttctatgtctttgttcaacctggcggcagcgcaaaagatg

SEQ ID NO: 150158 - DNA, 103 bp, Artificial Sequence
  Synthetic Polynucleotide
taatacgactcactataggggcaatcctttgctagcagaagggaacaaagaacagaggagactttgtatgcttctgctaaacctggcggcagcgcaaaagatg

SEQ ID NO: 150159 - DNA, 103 bp, Artificial Sequence
  Synthetic Polynucleotide
taatacgactcactataggggacatgggtagcaatcctttgctagcagaaaacagaggagattctgcatgcaaaggattaacctggcggcagcgcaaaagatg

SEQ ID NO: 150160 - DNA, 103 bp, Artificial Sequence
  Synthetic Polynucleotide
taatacgactcactatagggctggtgatgagacatgggtagcaatcctttaacagaggagaaaaggaatgctacccatgaacctggcggcagcgcaaaagatg

SEQ ID NO: 150161 - DNA, 103 bp, Artificial Sequence
  Synthetic Polynucleotide
taatacgactcactatagggaatgtaagtgctggtgatgagacatgggtaaacagaggagatacccaatgctcatcaccaacctggcggcagcgcaaaagatg

SEQ ID NO: 150162 - DNA, 103 bp, Artificial Sequence
  Synthetic Polynucleotide
taatacgactcactataggggcagggaaggaatgtaagtgctggtgatgaaacagaggagatcatcaatggcacttacaaacctggcggcagcgcaaaagatg

SEQ ID NO: 150163 - DNA, 103 bp, Artificial Sequence
  Synthetic Polynucleotide
taatacgactcactatagggttgagtagctgcagggaaggaatgtaagtgaacagaggagacacttaatgtccttccctaacctggcggcagcgcaaaagatg

SEQ ID NO: 150164 - DNA, 103 bp, Artificial Sequence
  Synthetic Polynucleotide
taatacgactcactataggggttcagaattaatgaggagacccgaaggggaacagaggagaccccttatggtctcctcaaacctggcggcagcgcaaaagatg

SEQ ID NO: 150165 - DNA, 103 bp, Artificial Sequence
  Synthetic Polynucleotide
taatacgactcactatagggggaaactactttgagtagctgcagggaaggaacagaggagaccttccatgcagctactcaacctggcggcagcgcaaaagatg

SEQ ID NO: 150166 - DNA, 103 bp, Artificial Sequence
  Synthetic Polynucleotide
taatacgactcactatagggatgtttggtgggaaactactttgagtagctaacagaggagaagctacatgaagtagtttaacctggcggcagcgcaaaagatg

SEQ ID NO: 150167 - DNA, 103 bp, Artificial Sequence
  Synthetic Polynucleotide
taatacgactcactatagggaggattgctgatgtttggtgggaaactactaacagaggagaagtagtatgccaccaaacaacctggcggcagcgcaaaagatg

SEQ ID NO: 150168 - DNA, 103 bp, Artificial Sequence
  Synthetic Polynucleotide
taatacgactcactatagggggcctgaaggaggattgctgatgtttggtgaacagaggagacaccaaatgtcagcaatcaacctggcggcagcgcaaaagatg

SEQ ID NO: 150169 - DNA, 103 bp, Artificial Sequence
  Synthetic Polynucleotide
taatacgactcactatagggccaataagcaggcctgaaggaggattgctgaacagaggagacagcaaatgtccttcaggaacctggcggcagcgcaaaagatg

SEQ ID NO: 150170 - DNA, 103 bp, Artificial Sequence
  Synthetic Polynucleotide
taatacgactcactatagggaggctgaaccccaataagcaggcctgaaggaacagaggagaccttcaatgctgcttattaacctggcggcagcgcaaaagatg

SEQ ID NO: 150171 - DNA, 103 bp, Artificial Sequence
  Synthetic Polynucleotide
taatacgactcactataggggatccggaggaggctgaaccccaataagcaaacagaggagatgcttaatggggttcagcaacctggcggcagcgcaaaagatg

SEQ ID NO: 150172 - DNA, 103 bp, Artificial Sequence
  Synthetic Polynucleotide
taatacgactcactatagggaaaagttggggatccggaggaggctgaaccaacagaggagaggttcaatgtcctccggaaacctggcggcagcgcaaaagatg

SEQ ID NO: 150173 - DNA, 103 bp, Artificial Sequence
  Synthetic Polynucleotide
taatacgactcactatagggttctgaaaccaaaagttggggatccggaggaacagaggagacctccgatgccccaacttaacctggcggcagcgcaaaagatg

SEQ ID NO: 150174 - DNA, 103 bp, Artificial Sequence
  Synthetic Polynucleotide
taatacgactcactatagggtctggctggattctgaaaccaaaagttgggaacagaggagacccaacatgtggtttcagaacctggcggcagcgcaaaagatg

SEQ ID NO: 150175 - DNA, 103 bp, Artificial Sequence
  Synthetic Polynucleotide
taatacgactcactatagggggcttttccagttcagaattaatgaggagaaacagaggagatctcctatgtaattctgaaacctggcggcagcgcaaaagatg

SEQ ID NO: 150176 - DNA, 103 bp, Artificial Sequence
  Synthetic Polynucleotide
taatacgactcactatagggaggtctgtcctctggctggattctgaaaccaacagaggagaggtttcatgatccagccaaacctggcggcagcgcaaaagatg

SEQ ID NO: 150177 - DNA, 103 bp, Artificial Sequence
  Synthetic Polynucleotide
taatacgactcactatagggtgtggtactgaggtctgtcctctggctggaaacagaggagatccagcatgaggacagacaacctggcggcagcgcaaaagatg

SEQ ID NO: 150178 - DNA, 103 bp, Artificial Sequence
  Synthetic Polynucleotide
taatacgactcactataggggagtggctactgtggtactgaggtctgtccaacagaggagaggacagatgtcagtaccaaacctggcggcagcgcaaaagatg

SEQ ID NO: 150179 - DNA, 103 bp, Artificial Sequence
  Synthetic Polynucleotide
taatacgactcactatagggccagaggatggagtggctactgtggtactgaacagaggagacagtacatgagtagccacaacctggcggcagcgcaaaagatg

SEQ ID NO: 150180 - DNA, 103 bp, Artificial Sequence
  Synthetic Polynucleotide
taatacgactcactatagggtttcttgagtccagaggatggagtggctacaacagaggagagtagccatgccatcctctaacctggcggcagcgcaaaagatg

SEQ ID NO: 150181 - DNA, 103 bp, Artificial Sequence
  Synthetic Polynucleotide
taatacgactcactatagggatatgggtcttttcttgagtccagaggatgaacagaggagacatcctatggactcaagaaacctggcggcagcgcaaaagatg

SEQ ID NO: 150182 - DNA, 103 bp, Artificial Sequence
  Synthetic Polynucleotide
taatacgactcactatagggtgtagacgagatatgggtcttttcttgagtaacagaggagaactcaaatgaagacccataacctggcggcagcgcaaaagatg

SEQ ID NO: 150183 - DNA, 103 bp, Artificial Sequence
  Synthetic Polynucleotide
taatacgactcactatagggctttcgggtctgtagacgagatatgggtctaacagaggagaagacccatgtctcgtctaaacctggcggcagcgcaaaagatg

SEQ ID NO: 150184 - DNA, 103 bp, Artificial Sequence
  Synthetic Polynucleotide
taatacgactcactataggggttttttattctttcgggtctgtagacgagaacagaggagactcgtcatgagacccgaaaacctggcggcagcgcaaaagatg

SEQ ID NO: 150185 - DNA, 103 bp, Artificial Sequence
  Synthetic Polynucleotide
taatacgactcactataggggagggagcaagttttttattctttcgggtcaacagaggagagacccgatggaataaaaaaacctggcggcagcgcaaaagatg

SEQ ID NO: 150186 - DNA, 103 bp, Artificial Sequence
  Synthetic Polynucleotide
taatacgactcactataggggactttctggggcttttccagttcagaattaacagaggagaaattctatgctggaaaagaacctggcggcagcgcaaaagatg

SEQ ID NO: 150187 - DNA, 103 bp, Artificial Sequence
  Synthetic Polynucleotide
taatacgactcactatagggaggggtactagagggagcaagttttttattaacagaggagaaataaaatgcttgctcccaacctggcggcagcgcaaaagatg

SEQ ID NO: 150188 - DNA, 103 bp, Artificial Sequence
  Synthetic Polynucleotide
taatacgactcactatagggcaatgtttgaaggggtactagagggagcaaaacagaggagattgctcatgctagtacccaacctggcggcagcgcaaaagatg

SEQ ID NO: 150189 - DNA, 103 bp, Artificial Sequence
  Synthetic Polynucleotide
taatacgactcactatagggtcagaaggggcaatgtttgaaggggtactaaacagaggagatagtacatgttcaaacataacctggcggcagcgcaaaagatg

SEQ ID NO: 150190 - DNA, 103 bp, Artificial Sequence
  Synthetic Polynucleotide
taatacgactcactatagggagaaaccacatcagaaggggcaatgtttgaaacagaggagatcaaacatggccccttctaacctggcggcagcgcaaaagatg

SEQ ID NO: 150191 - DNA, 103 bp, Artificial Sequence
  Synthetic Polynucleotide
taatacgactcactatagggatgtcatattagaaaccacatcagaaggggaacagaggagaccccttatgatgtggtttaacctggcggcagcgcaaaagatg

SEQ ID NO: 150192 - DNA, 103 bp, Artificial Sequence
  Synthetic Polynucleotide
taatacgactcactatagggaagttaatcaatgtcatattagaaaccacaaacagaggagatgtggtatgtaatatgacaacctggcggcagcgcaaaagatg

SEQ ID NO: 150193 - DNA, 103 bp, Artificial Sequence
  Synthetic Polynucleotide
taatacgactcactatagggggagggtgtgaagttaatcaatgtcatattaacagaggagaaatatgatgttgattaacaacctggcggcagcgcaaaagatg

SEQ ID NO: 150194 - DNA, 103 bp, Artificial Sequence
  Synthetic Polynucleotide
taatacgactcactatagggtaggaagctgggagggtgtgaagttaatcaaacagaggagatgattaatgtcacaccctaacctggcggcagcgcaaaagatg

SEQ ID NO: 150195 - DNA, 103 bp, Artificial Sequence
  Synthetic Polynucleotide
taatacgactcactatagggcttggatgattaggaagctgggagggtgtgaacagaggagacacaccatgccagcttccaacctggcggcagcgcaaaagatg

SEQ ID NO: 150196 - DNA, 103 bp, Artificial Sequence
  Synthetic Polynucleotide
taatacgactcactatagggatctaacagacttggatgattaggaagctgaacagaggagacagcttatgaatcatccaaacctggcggcagcgcaaaagatg

SEQ ID NO: 150197 - DNA, 103 bp, Artificial Sequence
  Synthetic Polynucleotide
taatacgactcactatagggtgtctttccggactttctggggcttttccaaacagaggagatggaaaatgcccagaaagaacctggcggcagcgcaaaagatg

SEQ ID NO: 150198 - DNA, 103 bp, Artificial Sequence
  Synthetic Polynucleotide
taatacgactcactataggggtgaccccaaatctaacagacttggatgataacagaggagaatcatcatggtctgttagaacctggcggcagcgcaaaagatg

SEQ ID NO: 150199 - DNA, 103 bp, Artificial Sequence
  Synthetic Polynucleotide
taatacgactcactataggggaagtattaagtgaccccaaatctaacagaaacagaggagatctgttatgtttggggtcaacctggcggcagcgcaaaagatg

SEQ ID NO: 150200 - DNA, 103 bp, Artificial Sequence
  Synthetic Polynucleotide
taatacgactcactatagggtcggtgagatgaagtattaagtgaccccaaaacagaggagattggggatgcttaatactaacctggcggcagcgcaaaagatg

SEQ ID NO: 150201 - DNA, 103 bp, Artificial Sequence
  Synthetic Polynucleotide
taatacgactcactatagggtggggacagttcggtgagatgaagtattaaaacagaggagattaataatgcatctcaccaacctggcggcagcgcaaaagatg

SEQ ID NO: 150202 - DNA, 103 bp, Artificial Sequence
  Synthetic Polynucleotide
taatacgactcactatagggtttatgatgttggggacagttcggtgagataacagaggagaatctcaatgaactgtcccaacctggcggcagcgcaaaagatg

SEQ ID NO: 150203 - DNA, 103 bp, Artificial Sequence
  Synthetic Polynucleotide
taatacgactcactatagggtttagatctttttatgatgttggggacagtaacagaggagaactgtcatgaacatcataaacctggcggcagcgcaaaagatg

SEQ ID NO: 150204 - DNA, 103 bp, Artificial Sequence
  Synthetic Polynucleotide
taatacgactcactatagggtgatgctagatttagatctttttatgatgtaacagaggagaacatcaatgaaagatctaaacctggcggcagcgcaaaagatg

SEQ ID NO: 150205 - DNA, 103 bp, Artificial Sequence
  Synthetic Polynucleotide
taatacgactcactatagggtcaaaatacatgatgctagatttagatcttaacagaggagaaagatcatgatctagcataacctggcggcagcgcaaaagatg

SEQ ID NO: 150206 - DNA, 103 bp, Artificial Sequence
  Synthetic Polynucleotide
taatacgactcactataggggggtgccggttcaaaatacatgatgctagaaacagaggagatctagcatgatgtattttaacctggcggcagcgcaaaagatg

SEQ ID NO: 150207 - DNA, 103 bp, Artificial Sequence
  Synthetic Polynucleotide
taatacgactcactataggggtggtaacaggggtgccggttcaaaatacaaacagaggagatgtattatgaaccggcacaacctggcggcagcgcaaaagatg

SEQ ID NO: 150208 - DNA, 103 bp, Artificial Sequence
  Synthetic Polynucleotide
taatacgactcactataggggttccttccttgtctttccggactttctggaacagaggagaccagaaatgccggaaagaaacctggcggcagcgcaaaagatg

SEQ ID NO: 150209 - DNA, 103 bp, Artificial Sequence
  Synthetic Polynucleotide
taatacgactcactatagggcccacactctgtggtaacaggggtgccggtaacagaggagaaccggcatgcctgttaccaacctggcggcagcgcaaaagatg

SEQ ID NO: 150210 - DNA, 103 bp, Artificial Sequence
  Synthetic Polynucleotide
taatacgactcactatagggagcagttcctcccacactctgtggtaacagaacagaggagactgttaatgcagagtgtgaacctggcggcagcgcaaaagatg

SEQ ID NO: 150211 - DNA, 103 bp, Artificial Sequence
  Synthetic Polynucleotide
taatacgactcactatagggccgctgtggcagcagttcctcccacactctaacagaggagaagagtgatggaggaactgaacctggcggcagcgcaaaagatg

SEQ ID NO: 150212 - DNA, 103 bp, Artificial Sequence
  Synthetic Polynucleotide
taatacgactcactataggggatgtgcctgccgctgtggcagcagttcctaacagaggagaaggaacatgtgccacagcaacctggcggcagcgcaaaagatg

SEQ ID NO: 150213 - DNA, 103 bp, Artificial Sequence
  Synthetic Polynucleotide
taatacgactcactataggggcttattgttgatgtgcctgccgctgtggcaacagaggagagccacaatggcaggcacaaacctggcggcagcgcaaaagatg

SEQ ID NO: 150214 - DNA, 103 bp, Artificial Sequence
  Synthetic Polynucleotide
taatacgactcactatagggtagtatcctggcttattgttgatgtgcctgaacagaggagacaggcaatgcaacaataaaacctggcggcagcgcaaaagatg

SEQ ID NO: 150215 - DNA, 103 bp, Artificial Sequence
  Synthetic Polynucleotide
taatacgactcactataggggtgaggtggctagtatcctggcttattgttaacagaggagaaacaatatgccaggatacaacctggcggcagcgcaaaagatg

SEQ ID NO: 150216 - DNA, 103 bp, Artificial Sequence
  Synthetic Polynucleotide
taatacgactcactatagggagaccctgatgtgaggtggctagtatcctgaacagaggagacaggatatgagccacctcaacctggcggcagcgcaaaagatg

SEQ ID NO: 150217 - DNA, 103 bp, Artificial Sequence
  Synthetic Polynucleotide
taatacgactcactatagggagccagacacagaccctgatgtgaggtggcaacagaggagagccaccatgcatcagggtaacctggcggcagcgcaaaagatg

SEQ ID NO: 150218 - DNA, 103 bp, Artificial Sequence
  Synthetic Polynucleotide
taatacgactcactatagggctggatgccaagccagacacagaccctgataacagaggagaatcaggatgtgtgtctggaacctggcggcagcgcaaaagatg

SEQ ID NO: 150219 - DNA, 103 bp, Artificial Sequence
  Synthetic Polynucleotide
taatacgactcactatagggatcctcaccagccagcttctggctgtccataacagaggagaatggacatgcagaagctgaacctggcggcagcgcaaaagatg

SEQ ID NO: 150220 - DNA, 103 bp, Artificial Sequence
  Synthetic Polynucleotide
taatacgactcactatagggctctcccacatgtgggttgggcaggtctgaaacagaggagatcagacatgcccaacccaaacctggcggcagcgcaaaagatg

SEQ ID NO: 150221 - DNA, 103 bp, Artificial Sequence
  Synthetic Polynucleotide
taatacgactcactatagggaaaccactccgagttgggattcagttctgcaacagaggagagcagaaatgaatcccaacaacctggcggcagcgcaaaagatg

SEQ ID NO: 150222 - DNA, 103 bp, Artificial Sequence
  Synthetic Polynucleotide
taatacgactcactatagggctggagggcatgagctggtggctgggtgggaacagaggagacccaccatgccaccagctaacctggcggcagcgcaaaagatg

SEQ ID NO: 150223 - DNA, 103 bp, Artificial Sequence
  Synthetic Polynucleotide
taatacgactcactatagggccaggcgttgctggagggcatgagctggtgaacagaggagacaccagatgatgccctccaacctggcggcagcgcaaaagatg

SEQ ID NO: 150224 - DNA, 103 bp, Artificial Sequence
  Synthetic Polynucleotide
taatacgactcactatagggatggatggagccaggcgttgctggagggcaaacagaggagatgccctatggcaacgcctaacctggcggcagcgcaaaagatg

SEQ ID NO: 150225 - DNA, 103 bp, Artificial Sequence
  Synthetic Polynucleotide
taatacgactcactatagggcaccatagccatggatggagccaggcgttgaacagaggagacaacgcatggctccatccaacctggcggcagcgcaaaagatg

SEQ ID NO: 150226 - DNA, 103 bp, Artificial Sequence
  Synthetic Polynucleotide
taatacgactcactatagggcttgattggacaccatagccatggatggagaacagaggagactccatatgtggctatggaacctggcggcagcgcaaaagatg

SEQ ID NO: 150227 - DNA, 103 bp, Artificial Sequence
  Synthetic Polynucleotide
taatacgactcactatagggagcatatgcccttgattggacaccatagccaacagaggagaggctatatggtccaatcaaacctggcggcagcgcaaaagatg

SEQ ID NO: 150228 - DNA, 103 bp, Artificial Sequence
  Synthetic Polynucleotide
taatacgactcactatagggctgcccacttagcatatgcccttgattggaaacagaggagatccaatatggggcatatgaacctggcggcagcgcaaaagatg

SEQ ID NO: 150229 - DNA, 103 bp, Artificial Sequence
  Synthetic Polynucleotide
taatacgactcactataggggccctccatgctgcccacttagcatatgccaacagaggagaggcataatgtaagtgggcaacctggcggcagcgcaaaagatg

SEQ ID NO: 150230 - DNA, 103 bp, Artificial Sequence
  Synthetic Polynucleotide
taatacgactcactatagggaagcctgcctgccctccatgctgcccacttaacagaggagaaagtggatggcatggaggaacctggcggcagcgcaaaagatg

SEQ ID NO: 150231 - DNA, 103 bp, Artificial Sequence
  Synthetic Polynucleotide
taatacgactcactatagggctggggtaccaagcctgcctgccctccatgaacagaggagacatggaatgcaggcaggcaacctggcggcagcgcaaaagatg

SEQ ID NO: 150232 - DNA, 103 bp, Artificial Sequence
  Synthetic Polynucleotide
taatacgactcactatagggagtagttctcaaaccactccgagttgggataacagaggagaatcccaatgcggagtggtaacctggcggcagcgcaaaagatg

SEQ ID NO: 150233 - DNA, 103 bp, Artificial Sequence
  Synthetic Polynucleotide
taatacgactcactataggggtgagctctgctggggtaccaagcctgcctaacagaggagaaggcagatgtggtaccccaacctggcggcagcgcaaaagatg

SEQ ID NO: 150234 - DNA, 103 bp, Artificial Sequence
  Synthetic Polynucleotide
taatacgactcactatagggagcactggctgtgagctctgctggggtaccaacagaggagaggtaccatggcagagctcaacctggcggcagcgcaaaagatg

SEQ ID NO: 150235 - DNA, 103 bp, Artificial Sequence
  Synthetic Polynucleotide
taatacgactcactatagggcttctgtgatagcactggctgtgagctctgaacagaggagacagagcatgcagccagtgaacctggcggcagcgcaaaagatg

SEQ ID NO: 150236 - DNA, 103 bp, Artificial Sequence
  Synthetic Polynucleotide
taatacgactcactatagggtgcccatgggcttctgtgatagcactggctaacagaggagaagccagatgtatcacagaaacctggcggcagcgcaaaagatg

SEQ ID NO: 150237 - DNA, 103 bp, Artificial Sequence
  Synthetic Polynucleotide
taatacgactcactatagggggtggcatggtgcccatgggcttctgtgataacagaggagaatcacaatggcccatgggaacctggcggcagcgcaaaagatg

SEQ ID NO: 150238 - DNA, 103 bp, Artificial Sequence
  Synthetic Polynucleotide
taatacgactcactataggggcacatggaaggtggcatggtgcccatgggaacagaggagacccatgatgaccatgccaaacctggcggcagcgcaaaagatg

SEQ ID NO: 150239 - DNA, 103 bp, Artificial Sequence
  Synthetic Polynucleotide
taatacgactcactataggggcggcttcatgcacatggaaggtggcatggaacagaggagaccatgcatgcttccatgtaacctggcggcagcgcaaaagatg

SEQ ID NO: 150240 - DNA, 103 bp, Artificial Sequence
  Synthetic Polynucleotide
taatacgactcactataggggccaattgctgcggcttcatgcacatggaaaacagaggagattccatatgcatgaagccaacctggcggcagcgcaaaagatg

SEQ ID NO: 150241 - DNA, 103 bp, Artificial Sequence
  Synthetic Polynucleotide
taatacgactcactatagggctgctgcattgccaattgctgcggcttcataacagaggagaatgaagatgcagcaattgaacctggcggcagcgcaaaagatg

SEQ ID NO: 150242 - DNA, 103 bp, Artificial Sequence
  Synthetic Polynucleotide
taatacgactcactatagggttgccagctgctgctgcattgccaattgctaacagaggagaagcaatatgcaatgcagcaacctggcggcagcgcaaaagatg

SEQ ID NO: 150243 - DNA, 103 bp, Artificial Sequence
  Synthetic Polynucleotide
taatacgactcactatagggtgacagagagagtagttctcaaaccactccaacagaggagaggagtgatgtgagaactaaacctggcggcagcgcaaaagatg

SEQ ID NO: 150244 - DNA, 103 bp, Artificial Sequence
  Synthetic Polynucleotide
taatacgactcactatagggaagaagctgtttgccagctgctgctgcattaacagaggagaaatgcaatggcagctggcaacctggcggcagcgcaaaagatg

SEQ ID NO: 150245 - DNA, 103 bp, Artificial Sequence
  Synthetic Polynucleotide
taatacgactcactatagggtgtatctgggaagaagctgtttgccagctgaacagaggagacagctgatgaacagcttcaacctggcggcagcgcaaaagatg

SEQ ID NO: 150246 - DNA, 103 bp, Artificial Sequence
  Synthetic Polynucleotide
taatacgactcactatagggtgtccaggtctgtatctgggaagaagctgtaacagaggagaacagctatgtcccagataaacctggcggcagcgcaaaagatg

SEQ ID NO: 150247 - DNA, 103 bp, Artificial Sequence
  Synthetic Polynucleotide
taatacgactcactataggggcagcaaatttgtccaggtctgtatctgggaacagaggagacccagaatgagacctggaaacctggcggcagcgcaaaagatg

SEQ ID NO: 150248 - DNA, 103 bp, Artificial Sequence
  Synthetic Polynucleotide
taatacgactcactataggggatatcttctgcagcaaatttgtccaggtcaacagaggagagacctgatgaaatttgctaacctggcggcagcgcaaaagatg

SEQ ID NO: 150249 - DNA, 103 bp, Artificial Sequence
  Synthetic Polynucleotide
taatacgactcactatagggtgggatcaatgatatcttctgcagcaaattaacagaggagaaatttgatgcagaagataaacctggcggcagcgcaaaagatg

SEQ ID NO: 150250 - DNA, 103 bp, Artificial Sequence
  Synthetic Polynucleotide
taatacgactcactataggggcctttgcaatgggatcaatgatatcttctaacagaggagaagaagaatgcattgatccaacctggcggcagcgcaaaagatg

SEQ ID NO: 150251 - DNA, 103 bp, Artificial Sequence
  Synthetic Polynucleotide
taatacgactcactatagggcaccatcttggcctttgcaatgggatcaataacagaggagaattgatatgattgcaaagaacctggcggcagcgcaaaagatg

SEQ ID NO: 150252 - DNA, 103 bp, Artificial Sequence
  Synthetic Polynucleotide
taatacgactcactatagggctttcaaagccaccatcttggcctttgcaaaacagaggagattgcaaatgccaagatggaacctggcggcagcgcaaaagatg

SEQ ID NO: 150253 - DNA, 103 bp, Artificial Sequence
  Synthetic Polynucleotide
taatacgactcactatagggttcttgatgcctttcaaagccaccatcttgaacagaggagacaagatatgggctttgaaaacctggcggcagcgcaaaagatg

SEQ ID NO: 150254 - DNA, 103 bp, Artificial Sequence
  Synthetic Polynucleotide
taatacgactcactataggggtgacagcggtgacagagagagtagttctcaacagaggagagagaacatgtctctctgtaacctggcggcagcgcaaaagatg

SEQ ID NO: 150255 - DNA, 103 bp, Artificial Sequence
  Synthetic Polynucleotide
taatacgactcactatagggagccatcactttcttgatgcctttcaaagcaacagaggagagctttgatgggcatcaagaacctggcggcagcgcaaaagatg

SEQ ID NO: 150256 - DNA, 103 bp, Artificial Sequence
  Synthetic Polynucleotide
taatacgactcactatagggtgctgccctgagccatcactttcttgatgcaacagaggagagcatcaatgaagtgatggaacctggcggcagcgcaaaagatg

SEQ ID NO: 150257 - DNA, 103 bp, Artificial Sequence
  Synthetic Polynucleotide
taatacgactcactataggggccaccccaatgctgccctgagccatcactaacagaggagaagtgatatgtcagggcagaacctggcggcagcgcaaaagatg

SEQ ID NO: 150258 - DNA, 103 bp, Artificial Sequence
  Synthetic Polynucleotide
taatacgactcactatagggcataccaggtgccaccccaatgctgccctgaacagaggagacagggcatgattggggtgaacctggcggcagcgcaaaagatg

SEQ ID NO: 150259 - DNA, 103 bp, Artificial Sequence
  Synthetic Polynucleotide
taatacgactcactataggggctgtctgttcataccaggtgccaccccaaaacagaggagattggggatgcacctggtaaacctggcggcagcgcaaaagatg

SEQ ID NO: 150260 - DNA, 103 bp, Artificial Sequence
  Synthetic Polynucleotide
taatacgactcactatagggagagacacttgctgtctgttcataccaggtaacagaggagaacctggatggaacagacaaacctggcggcagcgcaaaagatg

SEQ ID NO: 150261 - DNA, 103 bp, Artificial Sequence
  Synthetic Polynucleotide
taatacgactcactatagggctgggctagcagagacacttgctgtctgttaacagaggagaaacagaatgcaagtgtctaacctggcggcagcgcaaaagatg

SEQ ID NO: 150262 - DNA, 103 bp, Artificial Sequence
  Synthetic Polynucleotide
taatacgactcactatagggccgagagcctctgggctagcagagacacttaacagaggagaaagtgtatgtgctagcccaacctggcggcagcgcaaaagatg

SEQ ID NO: 150263 - DNA, 103 bp, Artificial Sequence
  Synthetic Polynucleotide
taatacgactcactatagggctaggtccccccgagagcctctgggctagcaacagaggagagctagcatggaggctctcaacctggcggcagcgcaaaagatg

SEQ ID NO: 150264 - DNA, 103 bp, Artificial Sequence
  Synthetic Polynucleotide
taatacgactcactatagggcagatcactgctaggtccccccgagagcctaacagaggagaaggctcatggggggacctaacctggcggcagcgcaaaagatg

SEQ ID NO: 150265 - DNA, 103 bp, Artificial Sequence
  Synthetic Polynucleotide
taatacgactcactatagggcctgggctttgtgacagcggtgacagagagaacagaggagactctctatgaccgctgtcaacctggcggcagcgcaaaagatg

SEQ ID NO: 150266 - DNA, 103 bp, Artificial Sequence
  Synthetic Polynucleotide
taatacgactcactatagggcatggttctgcagatcactgctaggtccccaacagaggagaggggacatggcagtgatcaacctggcggcagcgcaaaagatg

SEQ ID NO: 150267 - DNA, 103 bp, Artificial Sequence
  Synthetic Polynucleotide
taatacgactcactatagggccagctgccacatggttctgcagatcactgaacagaggagacagtgaatggcagaaccaaacctggcggcagcgcaaaagatg

SEQ ID NO: 150268 - DNA, 103 bp, Artificial Sequence
  Synthetic Polynucleotide
taatacgactcactatagggctggccactcccagctgccacatggttctgaacagaggagacagaacatggtggcagctaacctggcggcagcgcaaaagatg

SEQ ID NO: 150269 - DNA, 103 bp, Artificial Sequence
  Synthetic Polynucleotide
taatacgactcactatagggcactccgctcctggccactcccagctgccaaacagaggagatggcagatgggagtggccaacctggcggcagcgcaaaagatg

SEQ ID NO: 150270 - DNA, 103 bp, Artificial Sequence
  Synthetic Polynucleotide
taatacgactcactatagggggatcaccagcactccgctcctggccactcaacagaggagagagtggatgggagcggagaacctggcggcagcgcaaaagatg

SEQ ID NO: 150271 - DNA, 103 bp, Artificial Sequence
  Synthetic Polynucleotide
taatacgactcactatagggaggctgggagggatcaccagcactccgctcaacagaggagagagcggatggctggtgataacctggcggcagcgcaaaagatg

SEQ ID NO: 150272 - DNA, 103 bp, Artificial Sequence
  Synthetic Polynucleotide
taatacgactcactatagggggttgggacgaggctgggagggatcaccagaacagaggagactggtgatgcctcccagcaacctggcggcagcgcaaaagatg

SEQ ID NO: 150273 - DNA, 103 bp, Artificial Sequence
  Synthetic Polynucleotide
taatacgactcactatagggaaagtgggcgggttgggacgaggctgggagaacagaggagactcccaatgtcgtcccaaaacctggcggcagcgcaaaagatg

SEQ ID NO: 150274 - DNA, 103 bp, Artificial Sequence
  Synthetic Polynucleotide
taatacgactcactatagggtccctgagcaaaagtgggcgggttgggacgaacagaggagacgtcccatgccgcccactaacctggcggcagcgcaaaagatg

SEQ ID NO: 150275 - DNA, 103 bp, Artificial Sequence
  Synthetic Polynucleotide
taatacgactcactatagggcattgatcactccctgagcaaaagtgggcgaacagaggagacgcccaatgttgctcaggaacctggcggcagcgcaaaagatg

SEQ ID NO: 150276 - DNA, 103 bp, Artificial Sequence
  Synthetic Polynucleotide
taatacgactcactataggggtctgacctccctgggctttgtgacagcggaacagaggagaccgctgatgcaaagcccaaacctggcggcagcgcaaaagatg

SEQ ID NO: 150277 - DNA, 103 bp, Artificial Sequence
  Synthetic Polynucleotide
taatacgactcactatagggtggtcagcttcattgatcactccctgagcaaacagaggagatgctcaatgagtgatcaaaacctggcggcagcgcaaaagatg

SEQ ID NO: 150278 - DNA, 103 bp, Artificial Sequence
  Synthetic Polynucleotide
taatacgactcactatagggatactgccgctggtcagcttcattgatcacaacagaggagagtgatcatggaagctgacaacctggcggcagcgcaaaagatg

SEQ ID NO: 150279 - DNA, 103 bp, Artificial Sequence
  Synthetic Polynucleotide
taatacgactcactataggggccactcctcatactgccgctggtcagcttaacagaggagaaagctgatgagcggcagtaacctggcggcagcgcaaaagatg

SEQ ID NO: 150280 - DNA, 103 bp, Artificial Sequence
  Synthetic Polynucleotide
taatacgactcactataggggtatggaacagccactcctcatactgccgcaacagaggagagcggcaatgtgaggagtgaacctggcggcagcgcaaaagatg

SEQ ID NO: 150281 - DNA, 103 bp, Artificial Sequence
  Synthetic Polynucleotide
taatacgactcactataggggagctgctgggtatggaacagccactcctcaacagaggagagaggagatgctgttccataacctggcggcagcgcaaaagatg

SEQ ID NO: 150282 - DNA, 103 bp, Artificial Sequence
  Synthetic Polynucleotide
taatacgactcactataggggcatctgtaggagctgctgggtatggaacaaacagaggagatgttccatgcccagcagcaacctggcggcagcgcaaaagatg

SEQ ID NO: 150283 - DNA, 103 bp, Artificial Sequence
  Synthetic Polynucleotide
taatacgactcactatagggaccttcagctgcatctgtaggagctgctggaacagaggagaccagcaatgcctacagataacctggcggcagcgcaaaagatg

SEQ ID NO: 150284 - DNA, 103 bp, Artificial Sequence
  Synthetic Polynucleotide
taatacgactcactatagggctcctctagcaccttcagctgcatctgtagaacagaggagactacagatgcagctgaagaacctggcggcagcgcaaaagatg

SEQ ID NO: 150285 - DNA, 103 bp, Artificial Sequence
  Synthetic Polynucleotide
taatacgactcactatagggcaccaatctgctcctctagcaccttcagctaacagaggagaagctgaatgtgctagaggaacctggcggcagcgcaaaagatg

SEQ ID NO: 150286 - DNA, 103 bp, Artificial Sequence
  Synthetic Polynucleotide
taatacgactcactatagggttgcggtgtacaccaatctgctcctctagcaacagaggagagctagaatggcagattggaacctggcggcagcgcaaaagatg

SEQ ID NO: 150287 - DNA, 103 bp, Artificial Sequence
  Synthetic Polynucleotide
taatacgactcactatagggggagcggatagtctgacctccctgggctttaacagaggagaaaagccatgggaggtcagaacctggcggcagcgcaaaagatg

SEQ ID NO: 150288 - DNA, 103 bp, Artificial Sequence
  Synthetic Polynucleotide
taatacgactcactatagggcttccgggacttgcggtgtacaccaatctgaacagaggagacagattatggtacaccgcaacctggcggcagcgcaaaagatg

SEQ ID NO: 150289 - DNA, 103 bp, Artificial Sequence
  Synthetic Polynucleotide
taatacgactcactatagggcacacagagccttccgggacttgcggtgtaaacagaggagatacaccatgagtcccggaaacctggcggcagcgcaaaagatg

SEQ ID NO: 150290 - DNA, 103 bp, Artificial Sequence
  Synthetic Polynucleotide
taatacgactcactatagggcgctgcttggcacacagagccttccgggacaacagaggagagtcccgatgggctctgtgaacctggcggcagcgcaaaagatg

SEQ ID NO: 150291 - DNA, 103 bp, Artificial Sequence
  Synthetic Polynucleotide
taatacgactcactatagggtttggcagtgcgctgcttggcacacagagcaacagaggagagctctgatggccaagcagaacctggcggcagcgcaaaagatg

SEQ ID NO: 150292 - DNA, 103 bp, Artificial Sequence
  Synthetic Polynucleotide
taatacgactcactatagggggccagcttttttggcagtgcgctgcttggaacagaggagaccaagcatggcactgccaaacctggcggcagcgcaaaagatg

SEQ ID NO: 150293 - DNA, 103 bp, Artificial Sequence
  Synthetic Polynucleotide
taatacgactcactataggggggaactcacggccagcttttttggcagtgaacagaggagacactgcatgaaaagctggaacctggcggcagcgcaaaagatg

SEQ ID NO: 150294 - DNA, 103 bp, Artificial Sequence
  Synthetic Polynucleotide
taatacgactcactatagggatcagcttctgggaactcacggccagctttaacagaggagaaaagctatgcgtgagttcaacctggcggcagcgcaaaagatg

SEQ ID NO: 150295 - DNA, 103 bp, Artificial Sequence
  Synthetic Polynucleotide
taatacgactcactataggggcttctcagcatcagcttctgggaactcacaacagaggagagtgagtatgcagaagctgaacctggcggcagcgcaaaagatg

SEQ ID NO: 150296 - DNA, 103 bp, Artificial Sequence
  Synthetic Polynucleotide
taatacgactcactatagggaccagcttgagcttctcagcatcagcttctaacagaggagaagaagcatgtgctgagaaaacctggcggcagcgcaaaagatg

SEQ ID NO: 150297 - DNA, 103 bp, Artificial Sequence
  Synthetic Polynucleotide
taatacgactcactatagggctgctctgtaaccagcttgagcttctcagcaacagaggagagctgagatgctcaagctgaacctggcggcagcgcaaaagatg

SEQ ID NO: 150298 - DNA, 103 bp, Artificial Sequence
  Synthetic Polynucleotide
taatacgactcactataggggctcagcaacggagcggatagtctgacctcaacagaggagagaggtcatgctatccgctaacctggcggcagcgcaaaagatg

SEQ ID NO: 150299 - DNA, 103 bp, Artificial Sequence
  Synthetic Polynucleotide
taatacgactcactatagggtcttgctctgctgctctgtaaccagcttgaaacagaggagatcaagcatgttacagagcaacctggcggcagcgcaaaagatg

SEQ ID NO: 150300 - DNA, 103 bp, Artificial Sequence
  Synthetic Polynucleotide
taatacgactcactatagggtgtttctggatcttgctctgctgctctgtaaacagaggagatacagaatggcagagcaaaacctggcggcagcgcaaaagatg

SEQ ID NO: 150301 - DNA, 103 bp, Artificial Sequence
  Synthetic Polynucleotide
taatacgactcactatagggctgatccagttgtttctggatcttgctctgaacagaggagacagagcatgatccagaaaaacctggcggcagcgcaaaagatg

SEQ ID NO: 150302 - DNA, 103 bp, Artificial Sequence
  Synthetic Polynucleotide
taatacgactcactataggggtttccggacctgatccagttgtttctggaaacagaggagatccagaatgaactggatcaacctggcggcagcgcaaaagatg

SEQ ID NO: 150303 - DNA, 103 bp, Artificial Sequence
  Synthetic Polynucleotide
taatacgactcactatagggtccttctgctgtttccggacctgatccagtaacagaggagaactggaatgggtccggaaaacctggcggcagcgcaaaagatg

SEQ ID NO: 150304 - DNA, 103 bp, Artificial Sequence
  Synthetic Polynucleotide
taatacgactcactatagggattagtgtgctccttctgctgtttccggacaacagaggagagtccggatgcagcagaagaacctggcggcagcgcaaaagatg

SEQ ID NO: 150305 - DNA, 103 bp, Artificial Sequence
  Synthetic Polynucleotide
taatacgactcactatagggctgccatgagattagtgtgctccttctgctaacagaggagaagcagaatgagcacactaaacctggcggcagcgcaaaagatg

SEQ ID NO: 150306 - DNA, 103 bp, Artificial Sequence
  Synthetic Polynucleotide
taatacgactcactatagggttccgatattctgccatgagattagtgtgcaacagaggagagcacacatgtctcatggcaacctggcggcagcgcaaaagatg

SEQ ID NO: 150307 - DNA, 103 bp, Artificial Sequence
  Synthetic Polynucleotide
taatacgactcactatagggctgctgcttgttccgatattctgccatgagaacagaggagactcatgatggaatatcggaacctggcggcagcgcaaaagatg

SEQ ID NO: 150308 - DNA, 103 bp, Artificial Sequence
  Synthetic Polynucleotide
taatacgactcactataggggctgttgttgctgctgcttgttccgatattaacagaggagaaatatcatgacaagcagcaacctggcggcagcgcaaaagatg

SEQ ID NO: 150309 - DNA, 103 bp, Artificial Sequence
  Synthetic Polynucleotide
taatacgactcactatagggggggtatgctgctcagcaacggagcggataaacagaggagatatccgatgcgttgctgaaacctggcggcagcgcaaaagatg

SEQ ID NO: 150310 - DNA, 103 bp, Artificial Sequence
  Synthetic Polynucleotide
taatacgactcactatagggtgctgctgctgctgttgttgctgctgcttgaacagaggagacaagcaatggcaacaacaaacctggcggcagcgcaaaagatg

SEQ ID NO: 150311 - DNA, 103 bp, Artificial Sequence
  Synthetic Polynucleotide
taatacgactcactatagggctgttgttgctgctgctgctgctgttgttgaacagaggagacaacaaatgcagcagcagaacctggcggcagcgcaaaagatg

SEQ ID NO: 150312 - DNA, 103 bp, Artificial Sequence
  Synthetic Polynucleotide
taatacgactcactatagggagtgctgttgctgttgttgctgctgctgctaacagaggagaagcagcatgagcaacaacaacctggcggcagcgcaaaagatg

SEQ ID NO: 150313 - DNA, 103 bp, Artificial Sequence
  Synthetic Polynucleotide
taatacgactcactatagggagcacagctgagtgctgttgctgttgttgcaacagaggagagcaacaatggcaacagcaaacctggcggcagcgcaaaagatg

SEQ ID NO: 150314 - DNA, 103 bp, Artificial Sequence
  Synthetic Polynucleotide
taatacgactcactataggggctgagagccagcacagctgagtgctgttgaacagaggagacaacagatgtcagctgtgaacctggcggcagcgcaaaagatg

SEQ ID NO: 150315 - DNA, 103 bp, Artificial Sequence
  Synthetic Polynucleotide
taatacgactcactatagggtctgggaagggctgagagccagcacagctgaacagaggagacagctgatgtggctctcaaacctggcggcagcgcaaaagatg

SEQ ID NO: 150316 - DNA, 103 bp, Artificial Sequence
  Synthetic Polynucleotide
taatacgactcactatagggagccggggactctgggaagggctgagagccaacagaggagaggctctatgcccttcccaaacctggcggcagcgcaaaagatg

SEQ ID NO: 150317 - DNA, 103 bp, Artificial Sequence
  Synthetic Polynucleotide
taatacgactcactatagggcttggtgagcagccggggactctgggaaggaacagaggagaccttccatgagtccccggaacctggcggcagcgcaaaagatg

SEQ ID NO: 150318 - DNA, 103 bp, Artificial Sequence
  Synthetic Polynucleotide
taatacgactcactataggggaccagggagcttggtgagcagccggggacaacagaggagagtccccatgtgctcaccaaacctggcggcagcgcaaaagatg

SEQ ID NO: 150319 - DNA, 103 bp, Artificial Sequence
  Synthetic Polynucleotide
taatacgactcactataggggggagcagctgaccagggagcttggtgagcaacagaggagagctcacatggctccctggaacctggcggcagcgcaaaagatg

SEQ ID NO: 150320 - DNA, 103 bp, Artificial Sequence
  Synthetic Polynucleotide
taatacgactcactataggggctacacaccggggtatgctgctcagcaacaacagaggagagttgctatgcagcataccaacctggcggcagcgcaaaagatg

SEQ ID NO: 150321 - DNA, 103 bp, Artificial Sequence
  Synthetic Polynucleotide
taatacgactcactatagggcccatggccagggagcagctgaccagggagaacagaggagactccctatgcagctgctcaacctggcggcagcgcaaaagatg

SEQ ID NO: 150322 - DNA, 103 bp, Artificial Sequence
  Synthetic Polynucleotide
taatacgactcactataggggtggctgcagcccatggccagggagcagctaacagaggagaagctgcatgctggccatgaacctggcggcagcgcaaaagatg

SEQ ID NO: 150323 - DNA, 103 bp, Artificial Sequence
  Synthetic Polynucleotide
taatacgactcactatagggggcccctgtggtggctgcagcccatggccaaacagaggagatggccaatggctgcagccaacctggcggcagcgcaaaagatg

SEQ ID NO: 150324 - DNA, 103 bp, Artificial Sequence
  Synthetic Polynucleotide
taatacgactcactatagggcccacccggaggcccctgtggtggctgcagaacagaggagactgcagatgccacaggggaacctggcggcagcgcaaaagatg

SEQ ID NO: 150325 - DNA, 103 bp, Artificial Sequence
  Synthetic Polynucleotide
taatacgactcactatagggctccggcttgcccacccggaggcccctgtgaacagaggagacacaggatgctccgggtgaacctggcggcagcgcaaaagatg

SEQ ID NO: 150326 - DNA, 103 bp, Artificial Sequence
  Synthetic Polynucleotide
taatacgactcactatagggaggcgaagacctccggcttgcccacccggaaacagaggagatccgggatggcaagccggaacctggcggcagcgcaaaagatg

SEQ ID NO: 150327 - DNA, 103 bp, Artificial Sequence
  Synthetic Polynucleotide
taatacgactcactatagggcccaggggtcaggcgaagacctccggcttgaacagaggagacaagccatgggtcttcgcaacctggcggcagcgcaaaagatg

SEQ ID NO: 150328 - DNA, 103 bp, Artificial Sequence
  Synthetic Polynucleotide
taatacgactcactataggggtgccatacccccaggggtcaggcgaagacaacagaggagagtcttcatgtgacccctgaacctggcggcagcgcaaaagatg

SEQ ID NO: 150329 - DNA, 103 bp, Artificial Sequence
  Synthetic Polynucleotide
taatacgactcactatagggtgtccaggtagtgccatacccccaggggtcaacagaggagagaccccatggggtatggcaacctggcggcagcgcaaaagatg

SEQ ID NO: 150330 - DNA, 103 bp, Artificial Sequence
  Synthetic Polynucleotide
taatacgactcactataggggccaccaggctgtccaggtagtgccataccaacagaggagaggtatgatgctacctggaaacctggcggcagcgcaaaagatg

SEQ ID NO: 150331 - DNA, 103 bp, Artificial Sequence
  Synthetic Polynucleotide
taatacgactcactatagggggacagagacctctcccacatgtgggttggaacagaggagaccaaccatgatgtgggagaacctggcggcagcgcaaaagatg

SEQ ID NO: 150332 - DNA, 103 bp, Artificial Sequence
  Synthetic Polynucleotide
taatacgactcactataggggtgaaaatctgctacacaccggggtatgctaacagaggagaagcataatgcggtgtgtaaacctggcggcagcgcaaaagatg

SEQ ID NO: 150333 - DNA, 103 bp, Artificial Sequence
  Synthetic Polynucleotide
taatacgactcactatagggtaaggaaggggccaccaggctgtccaggtaaacagaggagatacctgatgagcctggtgaacctggcggcagcgcaaaagatg

SEQ ID NO: 150334 - DNA, 103 bp, Artificial Sequence
  Synthetic Polynucleotide
taatacgactcactatagggagagctgtattaaggaaggggccaccaggcaacagaggagagcctggatgccccttcctaacctggcggcagcgcaaaagatg

SEQ ID NO: 150335 - DNA, 103 bp, Artificial Sequence
  Synthetic Polynucleotide
taatacgactcactatagggctgttgggccagagctgtattaaggaagggaacagaggagacccttcatgaatacagctaacctggcggcagcgcaaaagatg

SEQ ID NO: 150336 - DNA, 103 bp, Artificial Sequence
  Synthetic Polynucleotide
taatacgactcactataggggctgttgctgctgttgggccagagctgtataacagaggagaatacagatgtggcccaacaacctggcggcagcgcaaaagatg

SEQ ID NO: 150337 - DNA, 103 bp, Artificial Sequence
  Synthetic Polynucleotide
taatacgactcactatagggccagaatgttgctgttgctgctgttgggccaacagaggagaggcccaatggcagcaacaaacctggcggcagcgcaaaagatg

SEQ ID NO: 150338 - DNA, 103 bp, Artificial Sequence
  Synthetic Polynucleotide
taatacgactcactatagggtccagccccaccagaatgttgctgttgctgaacagaggagacagcaaatgcaacattctaacctggcggcagcgcaaaagatg

SEQ ID NO: 150339 - DNA, 103 bp, Artificial Sequence
  Synthetic Polynucleotide
taatacgactcactatagggcagccagggatccagccccaccagaatgttaacagaggagaaacattatggtggggctgaacctggcggcagcgcaaaagatg

SEQ ID NO: 150340 - DNA, 103 bp, Artificial Sequence
  Synthetic Polynucleotide
taatacgactcactatagggcctgaagggccagccagggatccagccccaaacagaggagatggggcatgatccctggcaacctggcggcagcgcaaaagatg

SEQ ID NO: 150341 - DNA, 103 bp, Artificial Sequence
  Synthetic Polynucleotide
taatacgactcactataggggaagaagccccctgaagggccagccagggaaacagaggagatccctgatgggcccttcaaacctggcggcagcgcaaaagatg

SEQ ID NO: 150342 - DNA, 103 bp, Artificial Sequence
  Synthetic Polynucleotide
taatacgactcactatagggggttgccagggaagaagccccctgaagggcaacagaggagagcccttatgggggcttctaacctggcggcagcgcaaaagatg

SEQ ID NO: 150343 - DNA, 103 bp, Artificial Sequence
  Synthetic Polynucleotide
taatacgactcactatagggggctctgggggtgaaaatctgctacacaccaacagaggagaggtgtgatgcagattttcaacctggcggcagcgcaaaagatg

SEQ ID NO: 150344 - DNA, 103 bp, Artificial Sequence
  Synthetic Polynucleotide
taatacgactcactatagggcgaagagcaaggttgccagggaagaagcccaacagaggagagggcttatgccctggcaaaacctggcggcagcgcaaaagatg

SEQ ID NO: 150345 - DNA, 103 bp, Artificial Sequence
  Synthetic Polynucleotide
taatacgactcactatagggtccgaggcttcgaagagcaaggttgccaggaacagaggagacctggcatgcttgctcttaacctggcggcagcgcaaaagatg

SEQ ID NO: 150346 - DNA, 103 bp, Artificial Sequence
  Synthetic Polynucleotide
taatacgactcactatagggttgaatcaggtccgaggcttcgaagagcaaaacagaggagattgctcatggaagcctcgaacctggcggcagcgcaaaagatg

SEQ ID NO: 150347 - DNA, 103 bp, Artificial Sequence
  Synthetic Polynucleotide
taatacgactcactatagggtgtaaaagccttgaatcaggtccgaggcttaacagaggagaaagcctatgacctgattcaacctggcggcagcgcaaaagatg

SEQ ID NO: 150348 - DNA, 103 bp, Artificial Sequence
  Synthetic Polynucleotide
taatacgactcactatagggctgcctttcctgtaaaagccttgaatcaggaacagaggagacctgatatgaggcttttaaacctggcggcagcgcaaaagatg

SEQ ID NO: 150349 - DNA, 103 bp, Artificial Sequence
  Synthetic Polynucleotide
taatacgactcactataggggcagctgcagctgcctttcctgtaaaagccaacagaggagaggctttatgaggaaaggcaacctggcggcagcgcaaaagatg

SEQ ID NO: 150350 - DNA, 103 bp, Artificial Sequence
  Synthetic Polynucleotide
taatacgactcactatagggcgttgctgctgcagctgcagctgcctttccaacagaggagaggaaagatggctgcagctaacctggcggcagcgcaaaagatg

SEQ ID NO: 150351 - DNA, 103 bp, Artificial Sequence
  Synthetic Polynucleotide
taatacgactcactatagggcagctgcatacgttgctgctgcagctgcagaacagaggagactgcagatgcagcagcaaaacctggcggcagcgcaaaagatg

SEQ ID NO: 150352 - DNA, 103 bp, Artificial Sequence
  Synthetic Polynucleotide
taatacgactcactataggggtttctgggccagctgcatacgttgctgctaacagaggagaagcagcatggtatgcagcaacctggcggcagcgcaaaagatg

SEQ ID NO: 150353 - DNA, 103 bp, Artificial Sequence
  Synthetic Polynucleotide
taatacgactcactatagggtgctgctgcagtttctgggccagctgcataaacagaggagatatgcaatgggcccagaaaacctggcggcagcgcaaaagatg

SEQ ID NO: 150354 - DNA, 103 bp, Artificial Sequence
  Synthetic Polynucleotide
taatacgactcactatagggggtatcgccaggctctgggggtgaaaatctaacagaggagaagatttatgcccccagagaacctggcggcagcgcaaaagatg

SEQ ID NO: 150355 - DNA, 103 bp, Artificial Sequence
  Synthetic Polynucleotide
taatacgactcactatagggctgctgctgctgctgctgcagtttctgggcaacagaggagagcccagatgctgcagcagaacctggcggcagcgcaaaagatg

SEQ ID NO: 150356 - DNA, 103 bp, Artificial Sequence
  Synthetic Polynucleotide
taatacgactcactataggggctgctgttgctgctgctgctgctgctgcaaacagaggagatgcagcatgagcagcagcaacctggcggcagcgcaaaagatg

SEQ ID NO: 150357 - DNA, 103 bp, Artificial Sequence
  Synthetic Polynucleotide
taatacgactcactatagggaggtgctgctgctgctgttgctgctgctgcaacagaggagagcagcaatggcaacagcaaacctggcggcagcgcaaaagatg

SEQ ID NO: 150358 - DNA, 103 bp, Artificial Sequence
  Synthetic Polynucleotide
taatacgactcactatagggctgtcctagaaggtgctgctgctgctgttgaacagaggagacaacagatgcagcagcacaacctggcggcagcgcaaaagatg

SEQ ID NO: 150359 - DNA, 103 bp, Artificial Sequence
  Synthetic Polynucleotide
taatacgactcactatagggggattgccacctgtcctagaaggtgctgctaacagaggagaagcagcatgttctaggacaacctggcggcagcgcaaaagatg

SEQ ID NO: 150360 - DNA, 103 bp, Artificial Sequence
  Synthetic Polynucleotide
taatacgactcactatagggtgttgctgctggattgccacctgtcctagaaacagaggagatctaggatgggtggcaataacctggcggcagcgcaaaagatg

SEQ ID NO: 150361 - DNA, 103 bp, Artificial Sequence
  Synthetic Polynucleotide
taatacgactcactatagggaccctgctgctgttgctgctggattgccacaacagaggagagtggcaatgcagcagcaaaacctggcggcagcgcaaaagatg

SEQ ID NO: 150362 - DNA, 103 bp, Artificial Sequence
  Synthetic Polynucleotide
taatacgactcactataggggtactccaggaccctgctgctgttgctgctaacagaggagaagcagcatgagcagcaggaacctggcggcagcgcaaaagatg

SEQ ID NO: 150363 - DNA, 103 bp, Artificial Sequence
  Synthetic Polynucleotide
taatacgactcactatagggtggtttgtctgtactccaggaccctgctgcaacagaggagagcagcaatgtcctggagtaacctggcggcagcgcaaaagatg

SEQ ID NO: 150364 - DNA, 103 bp, Artificial Sequence
  Synthetic Polynucleotide
taatacgactcactatagggacccagagcttggtttgtctgtactccaggaacagaggagacctggaatgcagacaaacaacctggcggcagcgcaaaagatg

SEQ ID NO: 150365 - DNA, 103 bp, Artificial Sequence
  Synthetic Polynucleotide
taatacgactcactatagggcgtcagtgggggtatcgccaggctctggggaacagaggagaccccagatgctggcgataaacctggcggcagcgcaaaagatg

SEQ ID NO: 150366 - DNA, 103 bp, Artificial Sequence
  Synthetic Polynucleotide
taatacgactcactatagggggggcttgggacccagagcttggtttgtctaacagaggagaagacaaatgaagctctggaacctggcggcagcgcaaaagatg

SEQ ID NO: 150367 - DNA, 103 bp, Artificial Sequence
  Synthetic Polynucleotide
taatacgactcactatagggataaggccctggggcttgggacccagagctaacagaggagaagctctatgtcccaagccaacctggcggcagcgcaaaagatg

SEQ ID NO: 150368 - DNA, 103 bp, Artificial Sequence
  Synthetic Polynucleotide
taatacgactcactataggggctgggaggcataaggccctggggcttgggaacagaggagacccaagatgcagggccttaacctggcggcagcgcaaaagatg

SEQ ID NO: 150369 - DNA, 103 bp, Artificial Sequence
  Synthetic Polynucleotide
taatacgactcactatagggcttggtggctgctgggaggcataaggccctaacagaggagaagggccatgtgcctcccaaacctggcggcagcgcaaaagatg

SEQ ID NO: 150370 - DNA, 103 bp, Artificial Sequence
  Synthetic Polynucleotide
taatacgactcactatagggaccaggaggccttggtggctgctgggaggcaacagaggagagcctccatgcagccaccaaacctggcggcagcgcaaaagatg

SEQ ID NO: 150371 - DNA, 103 bp, Artificial Sequence
  Synthetic Polynucleotide
taatacgactcactatagggcagctgctggaccaggaggccttggtggctaacagaggagaagccacatgggcctcctgaacctggcggcagcgcaaaagatg

SEQ ID NO: 150372 - DNA, 103 bp, Artificial Sequence
  Synthetic Polynucleotide
taatacgactcactataggggttgaggggacagctgctggaccaggaggcaacagaggagagcctccatgtccagcagcaacctggcggcagcgcaaaagatg

SEQ ID NO: 150373 - DNA, 103 bp, Artificial Sequence
  Synthetic Polynucleotide
taatacgactcactatagggccctggggtggttgaggggacagctgctggaacagaggagaccagcaatggtcccctcaaacctggcggcagcgcaaaagatg

SEQ ID NO: 150374 - DNA, 103 bp, Artificial Sequence
  Synthetic Polynucleotide
taatacgactcactataggggccctggggcccctggggtggttgaggggaaacagaggagatcccctatgccaccccagaacctggcggcagcgcaaaagatg

SEQ ID NO: 150375 - DNA, 103 bp, Artificial Sequence
  Synthetic Polynucleotide
taatacgactcactatagggggcccagcatgccctggggcccctggggtgaacagaggagacaccccatgggccccaggaacctggcggcagcgcaaaagatg

SEQ ID NO: 150376 - DNA, 103 bp, Artificial Sequence
  Synthetic Polynucleotide
taatacgactcactataggggcatcgggctcgtcagtgggggtatcgccaaacagaggagatggcgaatgccccactgaaacctggcggcagcgcaaaagatg

SEQ ID NO: 150377 - DNA, 103 bp, Artificial Sequence
  Synthetic Polynucleotide
taatacgactcactatagggacctgggcagggcccagcatgccctggggcaacagaggagagccccaatgcatgctgggaacctggcggcagcgcaaaagatg

SEQ ID NO: 150378 - DNA, 103 bp, Artificial Sequence
  Synthetic Polynucleotide
taatacgactcactatagggcaacacagccacctgggcagggcccagcataacagaggagaatgctgatgcctgcccagaacctggcggcagcgcaaaagatg

SEQ ID NO: 150379 - DNA, 103 bp, Artificial Sequence
  Synthetic Polynucleotide
taatacgactcactataggggctgctgctgcaacacagccacctgggcagaacagaggagactgcccatgtggctgtgtaacctggcggcagcgcaaaagatg

SEQ ID NO: 150380 - DNA, 103 bp, Artificial Sequence
  Synthetic Polynucleotide
taatacgactcactataggggctccagggtgctgctgctgcaacacagccaacagaggagaggctgtatggcagcagcaaacctggcggcagcgcaaaagatg

SEQ ID NO: 150381 - DNA, 103 bp, Artificial Sequence
  Synthetic Polynucleotide
taatacgactcactatagggggggcccaaagctccagggtgctgctgctgaacagaggagacagcagatgcaccctggaaacctggcggcagcgcaaaagatg

SEQ ID NO: 150382 - DNA, 103 bp, Artificial Sequence
  Synthetic Polynucleotide
taatacgactcactataggggagggccctgggggcccaaagctccagggtaacagaggagaaccctgatgctttgggccaacctggcggcagcgcaaaagatg

SEQ ID NO: 150383 - DNA, 103 bp, Artificial Sequence
  Synthetic Polynucleotide
taatacgactcactatagggacctgtctgtgagggccctgggggcccaaaaacagaggagatttgggatgccagggcccaacctggcggcagcgcaaaagatg

SEQ ID NO: 150384 - DNA, 103 bp, Artificial Sequence
  Synthetic Polynucleotide
taatacgactcactatagggggtcataagcacctgtctgtgagggccctgaacagaggagacagggcatgcacagacagaacctggcggcagcgcaaaagatg

SEQ ID NO: 150385 - DNA, 103 bp, Artificial Sequence
  Synthetic Polynucleotide
taatacgactcactatagggcccgggactgggtcataagcacctgtctgtaacagaggagaacagacatgtgcttatgaaacctggcggcagcgcaaaagatg

SEQ ID NO: 150386 - DNA, 103 bp, Artificial Sequence
  Synthetic Polynucleotide
taatacgactcactataggggaactgagcacccgggactgggtcataagcaacagaggagagcttatatgccagtcccgaacctggcggcagcgcaaaagatg

SEQ ID NO: 150387 - DNA, 103 bp, Artificial Sequence
  Synthetic Polynucleotide
taatacgactcactatagggaacgtacagagcatcgggctcgtcagtgggaacagaggagacccactatggagcccgataacctggcggcagcgcaaaagatg

SEQ ID NO: 150388 - DNA, 103 bp, Artificial Sequence
  Synthetic Polynucleotide
taatacgactcactatagggcagctggggggaactgagcacccgggactgaacagaggagacagtccatggtgctcagtaacctggcggcagcgcaaaagatg

SEQ ID NO: 150389 - DNA, 103 bp, Artificial Sequence
  Synthetic Polynucleotide
taatacgactcactatagggcctgctgtgccagctggggggaactgagcaaacagaggagatgctcaatgccccccagcaacctggcggcagcgcaaaagatg

SEQ ID NO: 150390 - DNA, 103 bp, Artificial Sequence
  Synthetic Polynucleotide
taatacgactcactatagggaggccctgaccctgctgtgccagctgggggaacagaggagacccccaatgggcacagcaaacctggcggcagcgcaaaagatg

SEQ ID NO: 150391 - DNA, 103 bp, Artificial Sequence
  Synthetic Polynucleotide
taatacgactcactataggggtgtcccataaggccctgaccctgctgtgcaacagaggagagcacagatgggtcagggcaacctggcggcagcgcaaaagatg

SEQ ID NO: 150392 - DNA, 103 bp, Artificial Sequence
  Synthetic Polynucleotide
taatacgactcactatagggtgaccagcctgtgtcccataaggccctgacaacagaggagagtcaggatgttatgggacaacctggcggcagcgcaaaagatg

SEQ ID NO: 150393 - DNA, 103 bp, Artificial Sequence
  Synthetic Polynucleotide
taatacgactcactatagggtgctgggctgtgaccagcctgtgtcccataaacagaggagatatgggatgcaggctggtaacctggcggcagcgcaaaagatg

SEQ ID NO: 150394 - DNA, 103 bp, Artificial Sequence
  Synthetic Polynucleotide
taatacgactcactatagggctgctgctgctgctgggctgtgaccagcctaacagaggagaaggctgatgacagcccagaacctggcggcagcgcaaaagatg

SEQ ID NO: 150395 - DNA, 103 bp, Artificial Sequence
  Synthetic Polynucleotide
taatacgactcactataggggctgttgttgctgctgctgctgctgggctgaacagaggagacagcccatgagcagcagcaacctggcggcagcgcaaaagatg

SEQ ID NO: 150396 - DNA, 103 bp, Artificial Sequence
  Synthetic Polynucleotide
taatacgactcactatagggtgctgttggtgctgttgttgctgctgctgcaacagaggagagcagcaatggcaacaacaaacctggcggcagcgcaaaagatg

SEQ ID NO: 150397 - DNA, 103 bp, Artificial Sequence
  Synthetic Polynucleotide
taatacgactcactatagggcatggacccttgctgttggtgctgttgttgaacagaggagacaacaaatgcaccaacagaacctggcggcagcgcaaaagatg

SEQ ID NO: 150398 - DNA, 103 bp, Artificial Sequence
  Synthetic Polynucleotide
taatacgactcactatagggcttggcatgcaacgtacagagcatcgggctaacagaggagaagcccgatgctctgtacgaacctggcggcagcgcaaaagatg

SEQ ID NO: 150399 - DNA, 103 bp, Artificial Sequence
  Synthetic Polynucleotide
taatacgactcactatagggacagccctgccatggacccttgctgttggtaacagaggagaaccaacatgaagggtccaaacctggcggcagcgcaaaagatg

SEQ ID NO: 150400 - DNA, 103 bp, Artificial Sequence
  Synthetic Polynucleotide
taatacgactcactatagggtgaagatgggacagccctgccatggaccctaacagaggagaagggtcatgggcagggctaacctggcggcagcgcaaaagatg

SEQ ID NO: 150401 - DNA, 103 bp, Artificial Sequence
  Synthetic Polynucleotide
taatacgactcactatagggcagactctgctgaagatgggacagccctgcaacagaggagagcagggatgtcccatcttaacctggcggcagcgcaaaagatg

SEQ ID NO: 150402 - DNA, 103 bp, Artificial Sequence
  Synthetic Polynucleotide
taatacgactcactatagggtgtgtgacatcagactctgctgaagatgggaacagaggagacccatcatgagcagagtcaacctggcggcagcgcaaaagatg

SEQ ID NO: 150403 - DNA, 103 bp, Artificial Sequence
  Synthetic Polynucleotide
taatacgactcactatagggggctgcccactgtgtgacatcagactctgcaacagaggagagcagagatggatgtcacaaacctggcggcagcgcaaaagatg

SEQ ID NO: 150404 - DNA, 103 bp, Artificial Sequence
  Synthetic Polynucleotide
taatacgactcactataggggctcagtttgggctgcccactgtgtgacataacagaggagaatgtcaatgagtgggcagaacctggcggcagcgcaaaagatg

SEQ ID NO: 150405 - DNA, 103 bp, Artificial Sequence
  Synthetic Polynucleotide
taatacgactcactatagggtgggctgagcgctcagtttgggctgcccacaacagaggagagtgggcatgccaaactgaaacctggcggcagcgcaaaagatg

SEQ ID NO: 150406 - DNA, 103 bp, Artificial Sequence
  Synthetic Polynucleotide
taatacgactcactatagggaaagagcccatgggctgagcgctcagtttgaacagaggagacaaactatgcgctcagccaacctggcggcagcgcaaaagatg

SEQ ID NO: 150407 - DNA, 103 bp, Artificial Sequence
  Synthetic Polynucleotide
taatacgactcactatagggaagctgctgtaaagagcccatgggctgagcaacagaggagagctcagatgatgggctctaacctggcggcagcgcaaaagatg

SEQ ID NO: 150408 - DNA, 103 bp, Artificial Sequence
  Synthetic Polynucleotide
taatacgactcactataggggctgctgctgaagctgctgtaaagagcccaaacagaggagatgggctatgtacagcagcaacctggcggcagcgcaaaagatg

SEQ ID NO: 150409 - DNA, 103 bp, Artificial Sequence
  Synthetic Polynucleotide
taatacgactcactatagggtttggctgcccttggcatgcaacgtacagaaacagaggagatctgtaatgtgcatgccaaacctggcggcagcgcaaaagatg

SEQ ID NO: 150410 - DNA, 103 bp, Artificial Sequence
  Synthetic Polynucleotide
taatacgactcactatagggtgcagctgctgctgctgctgaagctgctgtaacagaggagaacagcaatgtcagcagcaaacctggcggcagcgcaaaagatg

SEQ ID NO: 150411 - DNA, 103 bp, Artificial Sequence
  Synthetic Polynucleotide
taatacgactcactatagggctgttgctgttgcagctgctgctgctgctgaacagaggagacagcagatgcagcagctgaacctggcggcagcgcaaaagatg

SEQ ID NO: 150412 - DNA, 103 bp, Artificial Sequence
  Synthetic Polynucleotide
taatacgactcactataggggctgaagttgctgttgctgttgcagctgctaacagaggagaagcagcatgaacagcaacaacctggcggcagcgcaaaagatg

SEQ ID NO: 150413 - DNA, 103 bp, Artificial Sequence
  Synthetic Polynucleotide
taatacgactcactatagggtgctgctgctgctgaagttgctgttgctgtaacagaggagaacagcaatggcaacttcaaacctggcggcagcgcaaaagatg

SEQ ID NO: 150414 - DNA, 103 bp, Artificial Sequence
  Synthetic Polynucleotide
taatacgactcactatagggtagctgctgctgctgctgctgctgaagttgaacagaggagacaacttatgcagcagcagaacctggcggcagcgcaaaagatg

SEQ ID NO: 150415 - DNA, 103 bp, Artificial Sequence
  Synthetic Polynucleotide
taatacgactcactataggggttgctgttgtagctgctgctgctgctgctaacagaggagaagcagcatgagcagcagcaacctggcggcagcgcaaaagatg

SEQ ID NO: 150416 - DNA, 103 bp, Artificial Sequence
  Synthetic Polynucleotide
taatacgactcactatagggtgaagttgctgttgctgttgtagctgctgcaacagaggagagcagcaatgacaacagcaaacctggcggcagcgcaaaagatg

SEQ ID NO: 150417 - DNA, 103 bp, Artificial Sequence
  Synthetic Polynucleotide
taatacgactcactatagggctgttgctgctgaagttgctgttgctgttgaacagaggagacaacagatgcagcaacttaacctggcggcagcgcaaaagatg

SEQ ID NO: 150418 - DNA, 103 bp, Artificial Sequence
  Synthetic Polynucleotide
taatacgactcactataggggctgttgaagctgttgctgctgaagttgctaacagaggagaagcaacatgagcagcaacaacctggcggcagcgcaaaagatg

SEQ ID NO: 150419 - DNA, 103 bp, Artificial Sequence
  Synthetic Polynucleotide
taatacgactcactatagggtgctgttgctgctgttgaagctgttgctgcaacagaggagagcagcaatggcttcaacaaacctggcggcagcgcaaaagatg

SEQ ID NO: 150420 - DNA, 103 bp, Artificial Sequence
  Synthetic Polynucleotide
taatacgactcactataggggtgcccaccctttggctgcccttggcatgcaacagaggagagcatgcatggggcagccaaacctggcggcagcgcaaaagatg

SEQ ID NO: 150421 - DNA, 103 bp, Artificial Sequence
  Synthetic Polynucleotide
taatacgactcactatagggaagctgctgctgctgttgctgctgttgaagaacagaggagacttcaaatgcagcaacagaacctggcggcagcgcaaaagatg

SEQ ID NO: 150422 - DNA, 103 bp, Artificial Sequence
  Synthetic Polynucleotide
taatacgactcactataggggctgttgttgaagctgctgctgctgttgctaacagaggagaagcaacatgagcagcagcaacctggcggcagcgcaaaagatg

SEQ ID NO: 150423 - DNA, 103 bp, Artificial Sequence
  Synthetic Polynucleotide
taatacgactcactatagggtgttgctgctgctgttgttgaagctgctgcaacagaggagagcagcaatgtcaacaacaaacctggcggcagcgcaaaagatg

SEQ ID NO: 150424 - DNA, 103 bp, Artificial Sequence
  Synthetic Polynucleotide
taatacgactcactatagggctgttgaagctgttgctgctgctgttgttgaacagaggagacaacaaatgcagcagcaaaacctggcggcagcgcaaaagatg

SEQ ID NO: 150425 - DNA, 103 bp, Artificial Sequence
  Synthetic Polynucleotide
taatacgactcactataggggctgttgctgctgttgaagctgttgctgctaacagaggagaagcagcatgagcttcaacaacctggcggcagcgcaaaagatg

SEQ ID NO: 150426 - DNA, 103 bp, Artificial Sequence
  Synthetic Polynucleotide
taatacgactcactatagggtgttgtagctgctgttgctgctgttgaagcaacagaggagagcttcaatggcagcaacaaacctggcggcagcgcaaaagatg

SEQ ID NO: 150427 - DNA, 103 bp, Artificial Sequence
  Synthetic Polynucleotide
taatacgactcactatagggttgctgttgctgttgtagctgctgttgctgaacagaggagacagcaaatgcagctacaaaacctggcggcagcgcaaaagatg

SEQ ID NO: 150428 - DNA, 103 bp, Artificial Sequence
  Synthetic Polynucleotide
taatacgactcactataggggctgttgttgttgctgttgctgttgtagctaacagaggagaagctacatgagcaacagcaacctggcggcagcgcaaaagatg

SEQ ID NO: 150429 - DNA, 103 bp, Artificial Sequence
  Synthetic Polynucleotide
taatacgactcactatagggtgaaactgctgctgttgttgttgctgttgcaacagaggagagcaacaatgacaacaacaaacctggcggcagcgcaaaagatg

SEQ ID NO: 150430 - DNA, 103 bp, Artificial Sequence
  Synthetic Polynucleotide
taatacgactcactatagggctgctgctgttgaaactgctgctgttgttgaacagaggagacaacaaatgcagcagtttaacctggcggcagcgcaaaagatg

SEQ ID NO: 150431 - DNA, 103 bp, Artificial Sequence
  Synthetic Polynucleotide
taatacgactcactatagggtagaggtcacgtgcccaccctttggctgccaacagaggagaggcagcatgagggtgggcaacctggcggcagcgcaaaagatg

SEQ ID NO: 150432 - DNA, 103 bp, Artificial Sequence
  Synthetic Polynucleotide
taatacgactcactataggggctgctgttgctgctgctgttgaaactgctaacagaggagaagcagtatgaacagcagcaacctggcggcagcgcaaaagatg

SEQ ID NO: 150433 - DNA, 103 bp, Artificial Sequence
  Synthetic Polynucleotide
taatacgactcactatagggaggcccatctgctgctgttgctgctgctgtaacagaggagaacagcaatggcaacagcaaacctggcggcagcgcaaaagatg

SEQ ID NO: 150434 - DNA, 103 bp, Artificial Sequence
  Synthetic Polynucleotide
taatacgactcactatagggctggtttaaaaggcccatctgctgctgttgaacagaggagacaacagatgcagatgggcaacctggcggcagcgcaaaagatg

SEQ ID NO: 150435 - DNA, 103 bp, Artificial Sequence
  Synthetic Polynucleotide
taatacgactcactatagggaagttcgactctggtttaaaaggcccatctaacagaggagaagatggatgttttaaaccaacctggcggcagcgcaaaagatg

SEQ ID NO: 150436 - DNA, 103 bp, Artificial Sequence
  Synthetic Polynucleotide
taatacgactcactatagggggagacagtaaagttcgactctggtttaaaaacagaggagatttaaaatggagtcgaacaacctggcggcagcgcaaaagatg

SEQ ID NO: 150437 - DNA, 103 bp, Artificial Sequence
  Synthetic Polynucleotide
taatacgactcactatagggttgttgctgaggagacagtaaagttcgactaacagaggagaagtcgaatgttactgtctaacctggcggcagcgcaaaagatg

SEQ ID NO: 150438 - DNA, 103 bp, Artificial Sequence
  Synthetic Polynucleotide
taatacgactcactataggggctgctgctgttgttgctgaggagacagtaaacagaggagatactgtatgctcagcaacaacctggcggcagcgcaaaagatg

SEQ ID NO: 150439 - DNA, 103 bp, Artificial Sequence
  Synthetic Polynucleotide
taatacgactcactatagggagtgccacttgctgctgctgttgttgctgaaacagaggagatcagcaatgacagcagcaaacctggcggcagcgcaaaagatg

SEQ ID NO: 150440 - DNA, 103 bp, Artificial Sequence
  Synthetic Polynucleotide
taatacgactcactataggggccagggccaagtgccacttgctgctgctgaacagaggagacagcagatgcaagtggcaaacctggcggcagcgcaaaagatg

SEQ ID NO: 150441 - DNA, 103 bp, Artificial Sequence
  Synthetic Polynucleotide
taatacgactcactatagggttgctggcatgccagggccaagtgccacttaacagaggagaaagtggatgttggccctgaacctggcggcagcgcaaaagatg

SEQ ID NO: 150442 - DNA, 103 bp, Artificial Sequence
  Synthetic Polynucleotide
taatacgactcactatagggccagaactaaggacagagacctctcccacaaacagaggagatgtgggatgggtctctgtaacctggcggcagcgcaaaagatg

SEQ ID NO: 150443 - DNA, 103 bp, Artificial Sequence
  Synthetic Polynucleotide
taatacgactcactatagggttgggttgcatagaggtcacgtgcccacccaacagaggagagggtggatgcgtgacctcaacctggcggcagcgcaaaagatg

SEQ ID NO: 150444 - DNA, 103 bp, Artificial Sequence
  Synthetic Polynucleotide
taatacgactcactatagggtgaagaggctttgctggcatgccagggccaaacagaggagatggcccatgcatgccagcaacctggcggcagcgcaaaagatg

SEQ ID NO: 150445 - DNA, 103 bp, Artificial Sequence
  Synthetic Polynucleotide
taatacgactcactatagggagaaaagtgttgaagaggctttgctggcataacagaggagaatgccaatgaagcctcttaacctggcggcagcgcaaaagatg

SEQ ID NO: 150446 - DNA, 103 bp, Artificial Sequence
  Synthetic Polynucleotide
taatacgactcactatagggctccagggctagaaaagtgttgaagaggctaacagaggagaagcctcatgaacacttttaacctggcggcagcgcaaaagatg

SEQ ID NO: 150447 - DNA, 103 bp, Artificial Sequence
  Synthetic Polynucleotide
taatacgactcactatagggggacccagggctccagggctagaaaagtgtaacagaggagaacacttatgtagccctggaacctggcggcagcgcaaaagatg

SEQ ID NO: 150448 - DNA, 103 bp, Artificial Sequence
  Synthetic Polynucleotide
taatacgactcactataggggaggagggttggacccagggctccagggctaacagaggagaagccctatggccctgggtaacctggcggcagcgcaaaagatg

SEQ ID NO: 150449 - DNA, 103 bp, Artificial Sequence
  Synthetic Polynucleotide
taatacgactcactatagggtgcccgtcaggaggagggttggacccagggaacagaggagaccctggatgcaaccctccaacctggcggcagcgcaaaagatg

SEQ ID NO: 150450 - DNA, 103 bp, Artificial Sequence
  Synthetic Polynucleotide
taatacgactcactatagggttttgttccttgcccgtcaggaggagggttaacagaggagaaaccctatgcctgacgggaacctggcggcagcgcaaaagatg

SEQ ID NO: 150451 - DNA, 103 bp, Artificial Sequence
  Synthetic Polynucleotide
taatacgactcactataggggtctacggtgttttgttccttgcccgtcagaacagaggagactgacgatgaaggaacaaaacctggcggcagcgcaaaagatg

SEQ ID NO: 150452 - DNA, 103 bp, Artificial Sequence
  Synthetic Polynucleotide
taatacgactcactatagggaaacggctgggtctacggtgttttgttcctaacagaggagaaggaacatgacaccgtagaacctggcggcagcgcaaaagatg

SEQ ID NO: 150453 - DNA, 103 bp, Artificial Sequence
  Synthetic Polynucleotide
taatacgactcactataggggcctctgaagaaacggctgggtctacggtgaacagaggagacaccgtatgcccagccgtaacctggcggcagcgcaaaagatg

SEQ ID NO: 150454 - DNA, 103 bp, Artificial Sequence
  Synthetic Polynucleotide
taatacgactcactatagggccctggttccttgggttgcatagaggtcacaacagaggagagtgaccatgatgcaacccaacctggcggcagcgcaaaagatg

SEQ ID NO: 150455 - DNA, 103 bp, Artificial Sequence
  Synthetic Polynucleotide
taatacgactcactatagggcccctcagtggcctctgaagaaacggctggaacagaggagaccagccatgtcttcagagaacctggcggcagcgcaaaagatg

SEQ ID NO: 150456 - DNA, 103 bp, Artificial Sequence
  Synthetic Polynucleotide
taatacgactcactataggggtgtagagggcccctcagtggcctctgaagaacagaggagacttcagatgccactgaggaacctggcggcagcgcaaaagatg

SEQ ID NO: 150457 - DNA, 103 bp, Artificial Sequence
  Synthetic Polynucleotide
taatacgactcactatagggcctccctgatgtgtagagggcccctcagtgaacagaggagacactgaatggccctctacaacctggcggcagcgcaaaagatg

SEQ ID NO: 150458 - DNA, 103 bp, Artificial Sequence
  Synthetic Polynucleotide
taatacgactcactatagggtgctaacggccctccctgatgtgtagagggaacagaggagaccctctatgcatcagggaaacctggcggcagcgcaaaagatg

SEQ ID NO: 150459 - DNA, 103 bp, Artificial Sequence
  Synthetic Polynucleotide
taatacgactcactatagggtagttcctattgctaacggccctccctgataacagaggagaatcaggatgggccgttagaacctggcggcagcgcaaaagatg

SEQ ID NO: 150460 - DNA, 103 bp, Artificial Sequence
  Synthetic Polynucleotide
taatacgactcactataggggactcaggggtagttcctattgctaacggcaacagaggagagccgttatgaataggaacaacctggcggcagcgcaaaagatg

SEQ ID NO: 150461 - DNA, 103 bp, Artificial Sequence
  Synthetic Polynucleotide
taatacgactcactatagggagtggccattgactcaggggtagttcctataacagaggagaataggaatgacccctgagaacctggcggcagcgcaaaagatg

SEQ ID NO: 150462 - DNA, 103 bp, Artificial Sequence
  Synthetic Polynucleotide
taatacgactcactatagggctcctggttcagtggccattgactcaggggaacagaggagacccctgatgcaatggccaaacctggcggcagcgcaaaagatg

SEQ ID NO: 150463 - DNA, 103 bp, Artificial Sequence
  Synthetic Polynucleotide
taatacgactcactatagggggctttacctctcctggttcagtggccattaacagaggagaaatggcatgtgaaccaggaacctggcggcagcgcaaaagatg

SEQ ID NO: 150464 - DNA, 103 bp, Artificial Sequence
  Synthetic Polynucleotide
taatacgactcactatagggagagagtgagggctttacctctcctggttcaacagaggagagaaccaatggaggtaaagaacctggcggcagcgcaaaagatg

SEQ ID NO: 150465 - DNA, 103 bp, Artificial Sequence
  Synthetic Polynucleotide
taatacgactcactatagggattgcaggggccctggttccttgggttgcaaacagaggagatgcaacatgaggaaccagaacctggcggcagcgcaaaagatg

SEQ ID NO: 150466 - DNA, 103 bp, Artificial Sequence
  Synthetic Polynucleotide
taatacgactcactataggggtgagtccccagagagtgagggctttacctaacagaggagaaggtaaatgcctcactctaacctggcggcagcgcaaaagatg

SEQ ID NO: 150467 - DNA, 103 bp, Artificial Sequence
  Synthetic Polynucleotide
taatacgactcactatagggagcaggagttgtgagtccccagagagtgagaacagaggagactcactatgtggggactcaacctggcggcagcgcaaaagatg

SEQ ID NO: 150468 - DNA, 103 bp, Artificial Sequence
  Synthetic Polynucleotide
taatacgactcactataggggggttggacaagcaggagttgtgagtccccaacagaggagaggggacatgcaactcctgaacctggcggcagcgcaaaagatg

SEQ ID NO: 150469 - DNA, 103 bp, Artificial Sequence
  Synthetic Polynucleotide
taatacgactcactataggggctggggctggggttggacaagcaggagttaacagaggagaaactccatgttgtccaacaacctggcggcagcgcaaaagatg

SEQ ID NO: 150470 - DNA, 103 bp, Artificial Sequence
  Synthetic Polynucleotide
taatacgactcactatagggctgggctgaggctggggctggggttggacaaacagaggagatgtccaatgccagccccaaacctggcggcagcgcaaaagatg

SEQ ID NO: 150471 - DNA, 103 bp, Artificial Sequence
  Synthetic Polynucleotide
taatacgactcactatagggctgcagagagctgggctgaggctggggctgaacagaggagacagcccatgcctcagcccaacctggcggcagcgcaaaagatg

SEQ ID NO: 150472 - DNA, 103 bp, Artificial Sequence
  Synthetic Polynucleotide
taatacgactcactataggggtggctgcagctgcagagagctgggctgagaacagaggagactcagcatggctctctgcaacctggcggcagcgcaaaagatg

SEQ ID NO: 150473 - DNA, 103 bp, Artificial Sequence
  Synthetic Polynucleotide
taatacgactcactatagggagcctcagaggtggctgcagctgcagagagaacagaggagactctctatggctgcagccaacctggcggcagcgcaaaagatg

SEQ ID NO: 150474 - DNA, 103 bp, Artificial Sequence
  Synthetic Polynucleotide
taatacgactcactatagggttgtcctggaagcctcagaggtggctgcagaacagaggagactgcagatgcctctgaggaacctggcggcagcgcaaaagatg

SEQ ID NO: 150475 - DNA, 103 bp, Artificial Sequence
  Synthetic Polynucleotide
taatacgactcactataggggctgctgctgttgtcctggaagcctcagagaacagaggagactctgaatgttccaggacaacctggcggcagcgcaaaagatg

SEQ ID NO: 150476 - DNA, 103 bp, Artificial Sequence
  Synthetic Polynucleotide
taatacgactcactatagggttggcttcacattgcaggggccctggttccaacagaggagaggaaccatggcccctgcaaacctggcggcagcgcaaaagatg

SEQ ID NO: 150477 - DNA, 103 bp, Artificial Sequence
  Synthetic Polynucleotide
taatacgactcactatagggaggctaacttgctgctgctgttgtcctggaaacagaggagatccaggatgacagcagcaaacctggcggcagcgcaaaagatg

SEQ ID NO: 150478 - DNA, 103 bp, Artificial Sequence
  Synthetic Polynucleotide
taatacgactcactatagggtgtgtggagcaggctaacttgctgctgctgaacagaggagacagcagatgcaagttagcaacctggcggcagcgcaaaagatg

SEQ ID NO: 150479 - DNA, 103 bp, Artificial Sequence
  Synthetic Polynucleotide
taatacgactcactatagggctccacctgctgtgtggagcaggctaacttaacagaggagaaagttaatgtgctccacaaacctggcggcagcgcaaaagatg

SEQ ID NO: 150480 - DNA, 103 bp, Artificial Sequence
  Synthetic Polynucleotide
taatacgactcactatagggccatggcttcctccacctgctgtgtggagcaacagaggagagctccaatgagcaggtggaacctggcggcagcgcaaaagatg

SEQ ID NO: 150481 - DNA, 103 bp, Artificial Sequence
  Synthetic Polynucleotide
taatacgactcactataggggcctagctgcccatggcttcctccacctgcaacagaggagagcaggtatgggaagccataacctggcggcagcgcaaaagatg

SEQ ID NO: 150482 - DNA, 103 bp, Artificial Sequence
  Synthetic Polynucleotide
taatacgactcactatagggatgatccactgcctagctgcccatggcttcaacagaggagagaagccatgggcagctagaacctggcggcagcgcaaaagatg

SEQ ID NO: 150483 - DNA, 103 bp, Artificial Sequence
  Synthetic Polynucleotide
taatacgactcactataggggcctcagaagatgatccactgcctagctgcaacagaggagagcagctatgcagtggatcaacctggcggcagcgcaaaagatg

SEQ ID NO: 150484 - DNA, 103 bp, Artificial Sequence
  Synthetic Polynucleotide
taatacgactcactatagggcacagatgaggcctcagaagatgatccactaacagaggagaagtggaatgtcttctgagaacctggcggcagcgcaaaagatg

SEQ ID NO: 150485 - DNA, 103 bp, Artificial Sequence
  Synthetic Polynucleotide
taatacgactcactataggggcaggtggggcacagatgaggcctcagaagaacagaggagacttctgatgcctcatctgaacctggcggcagcgcaaaagatg

SEQ ID NO: 150486 - DNA, 103 bp, Artificial Sequence
  Synthetic Polynucleotide
taatacgactcactatagggggctgagccagcaggtggggcacagatgagaacagaggagactcatcatggccccacctaacctggcggcagcgcaaaagatg

SEQ ID NO: 150487 - DNA, 103 bp, Artificial Sequence
  Synthetic Polynucleotide
taatacgactcactatagggccctagtggtttggcttcacattgcaggggaacagaggagacccctgatgtgtgaagccaacctggcggcagcgcaaaagatg

SEQ ID NO: 150488 - DNA, 103 bp, Artificial Sequence
  Synthetic Polynucleotide
taatacgactcactatagggggaaacagagggctgagccagcaggtggggaacagaggagaccccacatgctggctcagaacctggcggcagcgcaaaagatg

SEQ ID NO: 150489 - DNA, 103 bp, Artificial Sequence
  Synthetic Polynucleotide
taatacgactcactataggggatcccctaaggaaacagagggctgagccaaacagaggagatggctcatgcctctgtttaacctggcggcagcgcaaaagatg

SEQ ID NO: 150490 - DNA, 103 bp, Artificial Sequence
  Synthetic Polynucleotide
taatacgactcactataggggacccaggctgatcccctaaggaaacagagaacagaggagactctgtatgcttaggggaaacctggcggcagcgcaaaagatg

SEQ ID NO: 150491 - DNA, 103 bp, Artificial Sequence
  Synthetic Polynucleotide
taatacgactcactatagggctgggtcatggacccaggctgatcccctaaaacagaggagattagggatgcagcctgggaacctggcggcagcgcaaaagatg

SEQ ID NO: 150492 - DNA, 103 bp, Artificial Sequence
  Synthetic Polynucleotide
taatacgactcactatagggccagaaggttctgggtcatggacccaggctaacagaggagaagcctgatgccatgacccaacctggcggcagcgcaaaagatg

SEQ ID NO: 150493 - DNA, 103 bp, Artificial Sequence
  Synthetic Polynucleotide
taatacgactcactatagggtgttgggggcccagaaggttctgggtcatgaacagaggagacatgacatggaaccttctaacctggcggcagcgcaaaagatg

SEQ ID NO: 150494 - DNA, 103 bp, Artificial Sequence
  Synthetic Polynucleotide
taatacgactcactatagggtagcatgggctgttgggggcccagaaggttaacagaggagaaaccttatgggcccccaaaacctggcggcagcgcaaaagatg

SEQ ID NO: 150495 - DNA, 103 bp, Artificial Sequence
  Synthetic Polynucleotide
taatacgactcactatagggtgggccgctctagcatgggctgttgggggcaacagaggagagcccccatgagcccatgcaacctggcggcagcgcaaaagatg

SEQ ID NO: 150496 - DNA, 103 bp, Artificial Sequence
  Synthetic Polynucleotide
taatacgactcactatagggttattttgcatgggccgctctagcatgggcaacagaggagagcccatatgagagcggccaacctggcggcagcgcaaaagatg

SEQ ID NO: 150497 - DNA, 103 bp, Artificial Sequence
  Synthetic Polynucleotide
taatacgactcactatagggtggccctgtattattttgcatgggccgctcaacagaggagagagcggatgatgcaaaataacctggcggcagcgcaaaagatg

SEQ ID NO: 150498 - DNA, 103 bp, Artificial Sequence
  Synthetic Polynucleotide
taatacgactcactatagggcccctgctttccctagtggtttggcttcacaacagaggagagtgaagatgaaccactagaacctggcggcagcgcaaaagatg

SEQ ID NO: 150499 - DNA, 103 bp, Artificial Sequence
  Synthetic Polynucleotide
taatacgactcactatagggtgggaggttgtggccctgtattattttgcaaacagaggagatgcaaaatgatacagggcaacctggcggcagcgcaaaagatg

SEQ ID NO: 150500 - DNA, 103 bp, Artificial Sequence
  Synthetic Polynucleotide
taatacgactcactatagggggtcctggtttgggaggttgtggccctgtaaacagaggagatacaggatgacaacctccaacctggcggcagcgcaaaagatg

SEQ ID NO: 150501 - DNA, 103 bp, Artificial Sequence
  Synthetic Polynucleotide
taatacgactcactatagggctggaggacaggtcctggtttgggaggttgaacagaggagacaacctatgaaaccaggaaacctggcggcagcgcaaaagatg

SEQ ID NO: 150502 - DNA, 103 bp, Artificial Sequence
  Synthetic Polynucleotide
taatacgactcactatagggcctgcccagactggaggacaggtcctggttaacagaggagaaaccagatgctgtcctccaacctggcggcagcgcaaaagatg

SEQ ID NO: 150503 - DNA, 103 bp, Artificial Sequence
  Synthetic Polynucleotide
taatacgactcactatagggccaggcagaccctgcccagactggaggacaaacagaggagatgtcctatggtctgggcaaacctggcggcagcgcaaaagatg

SEQ ID NO: 150504 - DNA, 103 bp, Artificial Sequence
  Synthetic Polynucleotide
taatacgactcactataggggattccaaccccaggcagaccctgcccagaaacagaggagatctgggatgggtctgcctaacctggcggcagcgcaaaagatg

SEQ ID NO: 150505 - DNA, 103 bp, Artificial Sequence
  Synthetic Polynucleotide
taatacgactcactatagggccgtaggcatgattccaaccccaggcagacaacagaggagagtctgcatggggttggaaaacctggcggcagcgcaaaagatg

SEQ ID NO: 150506 - DNA, 103 bp, Artificial Sequence
  Synthetic Polynucleotide
taatacgactcactatagggagctgacccaccgtaggcatgattccaaccaacagaggagaggttggatgcatgcctacaacctggcggcagcgcaaaagatg

SEQ ID NO: 150507 - DNA, 103 bp, Artificial Sequence
  Synthetic Polynucleotide
taatacgactcactatagggctgtgctcgaagctgacccaccgtaggcataacagaggagaatgcctatggtgggtcagaacctggcggcagcgcaaaagatg

SEQ ID NO: 150508 - DNA, 103 bp, Artificial Sequence
  Synthetic Polynucleotide
taatacgactcactatagggctccttggagctgtgctcgaagctgacccaaacagaggagatgggtcatgttcgagcacaacctggcggcagcgcaaaagatg

SEQ ID NO: 150509 - DNA, 103 bp, Artificial Sequence
  Synthetic Polynucleotide
taatacgactcactatagggtcaagttggacccctgctttccctagtggtaacagaggagaaccactatggaaagcaggaacctggcggcagcgcaaaagatg

SEQ ID NO: 150510 - DNA, 103 bp, Artificial Sequence
  Synthetic Polynucleotide
taatacgactcactatagggttggccaggactccttggagctgtgctcgaaacagaggagatcgagcatggctccaaggaacctggcggcagcgcaaaagatg

SEQ ID NO: 150511 - DNA, 103 bp, Artificial Sequence
  Synthetic Polynucleotide
taatacgactcactatagggctgtgggtttttggccaggactccttggagaacagaggagactccaaatggtcctggccaacctggcggcagcgcaaaagatg

SEQ ID NO: 150512 - DNA, 103 bp, Artificial Sequence
  Synthetic Polynucleotide
taatacgactcactatagggagtgccgcagctgtgggtttttggccaggaaacagaggagatcctggatgaaaacccacaacctggcggcagcgcaaaagatg

SEQ ID NO: 150513 - DNA, 103 bp, Artificial Sequence
  Synthetic Polynucleotide
taatacgactcactatagggtgaggacttaagtgccgcagctgtgggtttaacagaggagaaaacccatggctgcggcaaacctggcggcagcgcaaaagatg

SEQ ID NO: 150514 - DNA, 103 bp, Artificial Sequence
  Synthetic Polynucleotide
taatacgactcactatagggctgctgctgctgaggacttaagtgccgcagaacagaggagactgcggatgttaagtcctaacctggcggcagcgcaaaagatg

SEQ ID NO: 150515 - DNA, 103 bp, Artificial Sequence
  Synthetic Polynucleotide
taatacgactcactatagggcctgtagctgctgctgctgctgaggacttaaacagaggagataagtcatgagcagcagcaacctggcggcagcgcaaaagatg

SEQ ID NO: 150516 - DNA, 103 bp, Artificial Sequence
  Synthetic Polynucleotide
taatacgactcactatagggatgaggagtgcctgtagctgctgctgctgcaacagaggagagcagcaatggcagctacaaacctggcggcagcgcaaaagatg

SEQ ID NO: 150517 - DNA, 103 bp, Artificial Sequence
  Synthetic Polynucleotide
taatacgactcactatagggctgccgctgcatgaggagtgcctgtagctgaacagaggagacagctaatggcactcctcaacctggcggcagcgcaaaagatg

SEQ ID NO: 150518 - DNA, 103 bp, Artificial Sequence
  Synthetic Polynucleotide
taatacgactcactatagggtctgctgcagctgccgctgcatgaggagtgaacagaggagacactccatgtgcagcggcaacctggcggcagcgcaaaagatg

SEQ ID NO: 150519 - DNA, 103 bp, Artificial Sequence
  Synthetic Polynucleotide
taatacgactcactatagggactgcctgactctgctgcagctgccgctgcaacagaggagagcagcgatggctgcagcaaacctggcggcagcgcaaaagatg

SEQ ID NO: 150520 - DNA, 103 bp, Artificial Sequence
  Synthetic Polynucleotide
taatacgactcactatagggcaactggggctcaagttggacccctgctttaacagaggagaaaagcaatggtccaacttaacctggcggcagcgcaaaagatg

SEQ ID NO: 150521 - DNA, 103 bp, Artificial Sequence
  Synthetic Polynucleotide
taatacgactcactatagggggtctggcgtactgcctgactctgctgcagaacagaggagactgcagatgagtcaggcaaacctggcggcagcgcaaaagatg

SEQ ID NO: 150522 - DNA, 103 bp, Artificial Sequence
  Synthetic Polynucleotide
taatacgactcactatagggggtagggtggggtctggcgtactgcctgacaacagaggagagtcaggatgtacgccagaaacctggcggcagcgcaaaagatg

SEQ ID NO: 150523 - DNA, 103 bp, Artificial Sequence
  Synthetic Polynucleotide
taatacgactcactatagggccaggctcctggtagggtggggtctggcgtaacagaggagaacgccaatgcccaccctaaacctggcggcagcgcaaaagatg

SEQ ID NO: 150524 - DNA, 103 bp, Artificial Sequence
  Synthetic Polynucleotide
taatacgactcactatagggggtctgggtcccaggctcctggtagggtggaacagaggagaccacccatgcaggagcctaacctggcggcagcgcaaaagatg

SEQ ID NO: 150525 - DNA, 103 bp, Artificial Sequence
  Synthetic Polynucleotide
taatacgactcactatagggggaggggagaggtctgggtcccaggctcctaacagaggagaaggagcatgggacccagaaacctggcggcagcgcaaaagatg

SEQ ID NO: 150526 - DNA, 103 bp, Artificial Sequence
  Synthetic Polynucleotide
taatacgactcactatagggaggaggccctggaggggagaggtctgggtcaacagaggagagacccaatgctctcccctaacctggcggcagcgcaaaagatg

SEQ ID NO: 150527 - DNA, 103 bp, Artificial Sequence
  Synthetic Polynucleotide
taatacgactcactatagggttggcagcccaggaggccctggaggggagaaacagaggagatctcccatgcagggcctcaacctggcggcagcgcaaaagatg

SEQ ID NO: 150528 - DNA, 103 bp, Artificial Sequence
  Synthetic Polynucleotide
taatacgactcactatagggcaagttgaggttggcagcccaggaggccctaacagaggagaagggccatgtgggctgccaacctggcggcagcgcaaaagatg

SEQ ID NO: 150529 - DNA, 103 bp, Artificial Sequence
  Synthetic Polynucleotide
taatacgactcactataggggggaagcccccaagttgaggttggcagcccaacagaggagagggctgatgacctcaactaacctggcggcagcgcaaaagatg

SEQ ID NO: 150530 - DNA, 103 bp, Artificial Sequence
  Synthetic Polynucleotide
taatacgactcactatagggctgtggtccagggaagcccccaagttgaggaacagaggagacctcaaatggggggcttcaacctggcggcagcgcaaaagatg

SEQ ID NO: 150531 - DNA, 103 bp, Artificial Sequence
  Synthetic Polynucleotide
taatacgactcactatagggggggggcctccaactggggctcaagttggaaacagaggagatccaacatgagccccagtaacctggcggcagcgcaaaagatg

SEQ ID NO: 150532 - DNA, 103 bp, Artificial Sequence
  Synthetic Polynucleotide
taatacgactcactataggggggggcctgtctgtggtccagggaagccccaacagaggagaggggctatgctggaccacaacctggcggcagcgcaaaagatg

SEQ ID NO: 150533 - DNA, 103 bp, Artificial Sequence
  Synthetic Polynucleotide
taatacgactcactatagggagctcctggagggggcctgtctgtggtccaaacagaggagatggaccatggacaggcccaacctggcggcagcgcaaaagatg

SEQ ID NO: 150534 - DNA, 103 bp, Artificial Sequence
  Synthetic Polynucleotide
taatacgactcactatagggccctgcccctagctcctggagggggcctgtaacagaggagaacaggcatgctccaggagaacctggcggcagcgcaaaagatg

SEQ ID NO: 150535 - DNA, 103 bp, Artificial Sequence
  Synthetic Polynucleotide
taatacgactcactataggggaggtcgaggccctgcccctagctcctggaaacagaggagatccaggatgtaggggcagaacctggcggcagcgcaaaagatg

SEQ ID NO: 150536 - DNA, 103 bp, Artificial Sequence
  Synthetic Polynucleotide
taatacgactcactatagggggtgggccctgaggtcgaggccctgcccctaacagaggagaaggggcatggcctcgaccaacctggcggcagcgcaaaagatg

SEQ ID NO: 150537 - DNA, 103 bp, Artificial Sequence
  Synthetic Polynucleotide
taatacgactcactatagggagggagccggggtgggccctgaggtcgaggaacagaggagacctcgaatgcagggcccaaacctggcggcagcgcaaaagatg

SEQ ID NO: 150538 - DNA, 103 bp, Artificial Sequence
  Synthetic Polynucleotide
taatacgactcactatagggctggtggggcagggagccggggtgggccctaacagaggagaagggccatgcccggctccaacctggcggcagcgcaaaagatg

SEQ ID NO: 150539 - DNA, 103 bp, Artificial Sequence
  Synthetic Polynucleotide
taatacgactcactataggggataaggctcctggtggggcagggagccggaacagaggagaccggctatgtgccccaccaacctggcggcagcgcaaaagatg

SEQ ID NO: 150540 - DNA, 103 bp, Artificial Sequence
  Synthetic Polynucleotide
taatacgactcactatagggtggtcctgtagataaggctcctggtggggcaacagaggagagccccaatgggagccttaaacctggcggcagcgcaaaagatg

SEQ ID NO: 150541 - DNA, 103 bp, Artificial Sequence
  Synthetic Polynucleotide
taatacgactcactatagggggccaaggactggtcctgtagataaggctcaacagaggagagagcctatgctacaggacaacctggcggcagcgcaaaagatg

SEQ ID NO: 150542 - DNA, 103 bp, Artificial Sequence
  Synthetic Polynucleotide
taatacgactcactatagggtcctcgtttaggggggcctccaactggggcaacagaggagagccccaatgggaggccccaacctggcggcagcgcaaaagatg

SEQ ID NO: 150543 - DNA, 103 bp, Artificial Sequence
  Synthetic Polynucleotide
taatacgactcactatagggggatggacagggccaaggactggtcctgtaaacagaggagatacaggatgagtccttggaacctggcggcagcgcaaaagatg

SEQ ID NO: 150544 - DNA, 103 bp, Artificial Sequence
  Synthetic Polynucleotide
taatacgactcactatagggtggaggtgtgggatggacagggccaaggacaacagaggagagtccttatgcctgtccataacctggcggcagcgcaaaagatg

SEQ ID NO: 150545 - DNA, 103 bp, Artificial Sequence
  Synthetic Polynucleotide
taatacgactcactatagggggctggatggtggaggtgtgggatggacagaacagaggagactgtccatgccacacctcaacctggcggcagcgcaaaagatg

SEQ ID NO: 150546 - DNA, 103 bp, Artificial Sequence
  Synthetic Polynucleotide
taatacgactcactatagggggctcttgagggctggatggtggaggtgtgaacagaggagacacaccatgaccatccagaacctggcggcagcgcaaaagatg

SEQ ID NO: 150547 - DNA, 103 bp, Artificial Sequence
  Synthetic Polynucleotide
taatacgactcactatagggaggtctctttggctcttgagggctggatggaacagaggagaccatccatgcctcaagagaacctggcggcagcgcaaaagatg

SEQ ID NO: 150548 - DNA, 103 bp, Artificial Sequence
  Synthetic Polynucleotide
taatacgactcactataggggtaattgtgaaggtctctttggctcttgagaacagaggagactcaagatgcaaagagacaacctggcggcagcgcaaaagatg

SEQ ID NO: 150549 - DNA, 103 bp, Artificial Sequence
  Synthetic Polynucleotide
taatacgactcactatagggctgggggaaggtaattgtgaaggtctctttaacagaggagaaaagagatgttcacaattaacctggcggcagcgcaaaagatg

SEQ ID NO: 150550 - DNA, 103 bp, Artificial Sequence
  Synthetic Polynucleotide
taatacgactcactatagggaagctgggagctgggggaaggtaattgtgaaacagaggagatcacaaatgccttcccccaacctggcggcagcgcaaaagatg

SEQ ID NO: 150551 - DNA, 103 bp, Artificial Sequence
  Synthetic Polynucleotide
taatacgactcactatagggcctcagtgggaagctgggagctgggggaagaacagaggagacttcccatggctcccagcaacctggcggcagcgcaaaagatg

SEQ ID NO: 150552 - DNA, 103 bp, Artificial Sequence
  Synthetic Polynucleotide
taatacgactcactataggggggagctgggcctcagtgggaagctgggagaacagaggagactcccaatgtcccactgaaacctggcggcagcgcaaaagatg

SEQ ID NO: 150553 - DNA, 103 bp, Artificial Sequence
  Synthetic Polynucleotide
taatacgactcactatagggcctgggactcccagaactaaggacagagacaacagaggagagtctctatgcttagttctaacctggcggcagcgcaaaagatg

SEQ ID NO: 150554 - DNA, 103 bp, Artificial Sequence
  Synthetic Polynucleotide
taatacgactcactatagggcagtggcatctcctcgtttaggggggcctcaacagaggagagaggccatgctaaacgagaacctggcggcagcgcaaaagatg

SEQ ID NO: 150555 - DNA, 103 bp, Artificial Sequence
  Synthetic Polynucleotide
taatacgactcactatagggatgggtgggagggagctgggcctcagtgggaacagaggagacccactatggcccagctcaacctggcggcagcgcaaaagatg

SEQ ID NO: 150556 - DNA, 103 bp, Artificial Sequence
  Synthetic Polynucleotide
taatacgactcactataggggggtccctggatgggtgggagggagctgggaacagaggagacccagcatgctcccacccaacctggcggcagcgcaaaagatg

SEQ ID NO: 150557 - DNA, 103 bp, Artificial Sequence
  Synthetic Polynucleotide
taatacgactcactatagggtgaggtttgggggtccctggatgggtgggaaacagaggagatcccacatgtccagggacaacctggcggcagcgcaaaagatg

SEQ ID NO: 150558 - DNA, 103 bp, Artificial Sequence
  Synthetic Polynucleotide
taatacgactcactatagggggttggcccctgaggtttgggggtccctggaacagaggagaccagggatgcccaaacctaacctggcggcagcgcaaaagatg

SEQ ID NO: 150559 - DNA, 103 bp, Artificial Sequence
  Synthetic Polynucleotide
taatacgactcactataggggcggctccaaggttggcccctgaggtttggaacagaggagaccaaacatgaggggccaaaacctggcggcagcgcaaaagatg

SEQ ID NO: 150560 - DNA, 103 bp, Artificial Sequence
  Synthetic Polynucleotide
taatacgactcactatagggctcccaggaggcggctccaaggttggccccaacagaggagaggggccatgcttggagccaacctggcggcagcgcaaaagatg

SEQ ID NO: 150561 - DNA, 103 bp, Artificial Sequence
  Synthetic Polynucleotide
taatacgactcactatagggaggtgagaccctcccaggaggcggctccaaaacagaggagattggagatgcctcctgggaacctggcggcagcgcaaaagatg

SEQ ID NO: 150562 - DNA, 103 bp, Artificial Sequence
  Synthetic Polynucleotide
taatacgactcactataggggggcagcagcaggtgagaccctcccaggagaacagaggagactcctgatggggtctcacaacctggcggcagcgcaaaagatg

SEQ ID NO: 150563 - DNA, 103 bp, Artificial Sequence
  Synthetic Polynucleotide
taatacgactcactatagggtctgcaagctgggcagcagcaggtgagaccaacagaggagaggtctcatgtgctgctgcaacctggcggcagcgcaaaagatg

SEQ ID NO: 150564 - DNA, 103 bp, Artificial Sequence
  Synthetic Polynucleotide
taatacgactcactatagggaaacaaggtatctgcaagctgggcagcagcaacagaggagagctgctatgcagcttgcaaacctggcggcagcgcaaaagatg

SEQ ID NO: 150565 - DNA, 103 bp, Artificial Sequence
  Synthetic Polynucleotide
taatacgactcactataggggtgggggcagcagtggcatctcctcgtttaaacagaggagataaacgatgagatgccacaacctggcggcagcgcaaaagatg

SEQ ID NO: 150566 - DNA, 103 bp, Artificial Sequence
  Synthetic Polynucleotide
taatacgactcactataggggacccttgctaaacaaggtatctgcaagctaacagaggagaagcttgatgataccttgtaacctggcggcagcgcaaaagatg

SEQ ID NO: 150567 - DNA, 103 bp, Artificial Sequence
  Synthetic Polynucleotide
taatacgactcactatagggcaaggtcccagacccttgctaaacaaggtaaacagaggagataccttatgtagcaagggaacctggcggcagcgcaaaagatg

SEQ ID NO: 150568 - DNA, 103 bp, Artificial Sequence
  Synthetic Polynucleotide
taatacgactcactatagggtgggggatcccaaggtcccagacccttgctaacagaggagaagcaagatgctgggacctaacctggcggcagcgcaaaagatg

SEQ ID NO: 150569 - DNA, 103 bp, Artificial Sequence
  Synthetic Polynucleotide
taatacgactcactatagggctaggttgtctgggggatcccaaggtcccaaacagaggagatgggacatggggatccccaacctggcggcagcgcaaaagatg

SEQ ID NO: 150570 - DNA, 103 bp, Artificial Sequence
  Synthetic Polynucleotide
taatacgactcactatagggtgggtttctgctaggttgtctgggggatccaacagaggagaggatccatgagacaacctaacctggcggcagcgcaaaagatg

SEQ ID NO: 150571 - DNA, 103 bp, Artificial Sequence
  Synthetic Polynucleotide
taatacgactcactatagggctctggcttctgggtttctgctaggttgtcaacagaggagagacaacatggcagaaaccaacctggcggcagcgcaaaagatg

SEQ ID NO: 150572 - DNA, 103 bp, Artificial Sequence
  Synthetic Polynucleotide
taatacgactcactatagggggctgctctgctctggcttctgggtttctgaacagaggagacagaaaatgagaagccagaacctggcggcagcgcaaaagatg

SEQ ID NO: 150573 - DNA, 103 bp, Artificial Sequence
  Synthetic Polynucleotide
taatacgactcactatagggccaggtaccaggctgctctgctctggcttcaacagaggagagaagccatggcagagcagaacctggcggcagcgcaaaagatg

SEQ ID NO: 150574 - DNA, 103 bp, Artificial Sequence
  Synthetic Polynucleotide
taatacgactcactataggggtccagatgcccaggtaccaggctgctctgaacagaggagacagagcatgctggtacctaacctggcggcagcgcaaaagatg

SEQ ID NO: 150575 - DNA, 103 bp, Artificial Sequence
  Synthetic Polynucleotide
taatacgactcactatagggcattcacctggtccagatgcccaggtaccaaacagaggagatggtacatgggcatctggaacctggcggcagcgcaaaagatg

SEQ ID NO: 150576 - DNA, 103 bp, Artificial Sequence
  Synthetic Polynucleotide
taatacgactcactataggggactcctcaggtgggggcagcagtggcatcaacagaggagagatgccatggctgcccccaacctggcggcagcgcaaaagatg

SEQ ID NO: 150577 - DNA, 103 bp, Artificial Sequence
  Synthetic Polynucleotide
taatacgactcactatagggaccacctgtccattcacctggtccagatgcaacagaggagagcatctatgccaggtgaaaacctggcggcagcgcaaaagatg

SEQ ID NO: 150578 - DNA, 103 bp, Artificial Sequence
  Synthetic Polynucleotide
taatacgactcactatagggtgcctcaggcaccacctgtccattcacctgaacagaggagacaggtgatgggacaggtgaacctggcggcagcgcaaaagatg

SEQ ID NO: 150579 - DNA, 103 bp, Artificial Sequence
  Synthetic Polynucleotide
taatacgactcactatagggtgagttgggatgcctcaggcaccacctgtcaacagaggagagacaggatgtgcctgaggaacctggcggcagcgcaaaagatg

SEQ ID NO: 150580 - DNA, 103 bp, Artificial Sequence
  Synthetic Polynucleotide
taatacgactcactatagggtgcttgatgctgagttgggatgcctcaggcaacagaggagagcctgaatgatcccaactaacctggcggcagcgcaaaagatg

SEQ ID NO: 150581 - DNA, 103 bp, Artificial Sequence
  Synthetic Polynucleotide
taatacgactcactatagggccgaggttcctgcttgatgctgagttgggaaacagaggagatcccaaatgagcatcaagaacctggcggcagcgcaaaagatg

SEQ ID NO: 150582 - DNA, 103 bp, Artificial Sequence
  Synthetic Polynucleotide
taatacgactcactatagggatggctcttcccgaggttcctgcttgatgcaacagaggagagcatcaatgaggaacctcaacctggcggcagcgcaaaagatg

SEQ ID NO: 150583 - DNA, 103 bp, Artificial Sequence
  Synthetic Polynucleotide
taatacgactcactatagggcccagggcacatggctcttcccgaggttccaacagaggagaggaaccatgggaagagccaacctggcggcagcgcaaaagatg

SEQ ID NO: 150584 - DNA, 103 bp, Artificial Sequence
  Synthetic Polynucleotide
taatacgactcactatagggtgactgggctcccagggcacatggctcttcaacagaggagagaagagatgtgtgccctgaacctggcggcagcgcaaaagatg

SEQ ID NO: 150585 - DNA, 103 bp, Artificial Sequence
  Synthetic Polynucleotide
taatacgactcactatagggccctcttcactgactgggctcccagggcacaacagaggagagtgcccatggagcccagtaacctggcggcagcgcaaaagatg

SEQ ID NO: 150586 - DNA, 103 bp, Artificial Sequence
  Synthetic Polynucleotide
taatacgactcactatagggccattggcctccctcttcactgactgggctaacagaggagaagcccaatgagtgaagagaacctggcggcagcgcaaaagatg

SEQ ID NO: 150587 - DNA, 103 bp, Artificial Sequence
  Synthetic Polynucleotide
taatacgactcactatagggggacaggggtgactcctcaggtgggggcagaacagaggagactgcccatgcctgaggagaacctggcggcagcgcaaaagatg

SEQ ID NO: 150588 - DNA, 103 bp, Artificial Sequence
  Synthetic Polynucleotide
taatacgactcactatagggtattggctccccattggcctccctcttcacaacagaggagagtgaagatggaggccaataacctggcggcagcgcaaaagatg

SEQ ID NO: 150589 - DNA, 103 bp, Artificial Sequence
  Synthetic Polynucleotide
taatacgactcactatagggctggtgcccctattggctccccattggcctaacagaggagaaggccaatggggagccaaaacctggcggcagcgcaaaagatg

SEQ ID NO: 150590 - DNA, 103 bp, Artificial Sequence
  Synthetic Polynucleotide
taatacgactcactatagggttgctggttcctggtgcccctattggctccaacagaggagaggagccatgaggggcaccaacctggcggcagcgcaaaagatg

SEQ ID NO: 150591 - DNA, 103 bp, Artificial Sequence
  Synthetic Polynucleotide
taatacgactcactatagggcaggaggtggttgctggttcctggtgccccaacagaggagaggggcaatgggaaccagcaacctggcggcagcgcaaaagatg

SEQ ID NO: 150592 - DNA, 103 bp, Artificial Sequence
  Synthetic Polynucleotide
taatacgactcactatagggggcctgccagcaggaggtggttgctggttcaacagaggagagaaccaatgaccacctccaacctggcggcagcgcaaaagatg

SEQ ID NO: 150593 - DNA, 103 bp, Artificial Sequence
  Synthetic Polynucleotide
taatacgactcactatagggtctgagcgagggcctgccagcaggaggtggaacagaggagaccacctatggctggcaggaacctggcggcagcgcaaaagatg

SEQ ID NO: 150594 - DNA, 103 bp, Artificial Sequence
  Synthetic Polynucleotide
taatacgactcactatagggatgcccagcttctgagcgagggcctgccagaacagaggagactggcaatgcctcgctcaaacctggcggcagcgcaaaagatg

SEQ ID NO: 150595 - DNA, 103 bp, Artificial Sequence
  Synthetic Polynucleotide
taatacgactcactataggggcaagagcagatgcccagcttctgagcgagaacagaggagactcgctatgaagctgggcaacctggcggcagcgcaaaagatg

SEQ ID NO: 150596 - DNA, 103 bp, Artificial Sequence
  Synthetic Polynucleotide
taatacgactcactatagggagtagcttctgcaagagcagatgcccagctaacagaggagaagctggatgtctgctcttaacctggcggcagcgcaaaagatg

SEQ ID NO: 150597 - DNA, 103 bp, Artificial Sequence
  Synthetic Polynucleotide
taatacgactcactatagggctttgcccggagtagcttctgcaagagcagaacagaggagactgctcatgcagaagctaaacctggcggcagcgcaaaagatg

SEQ ID NO: 150598 - DNA, 103 bp, Artificial Sequence
  Synthetic Polynucleotide
taatacgactcactatagggcaggtggtggggacaggggtgactcctcagaacagaggagactgaggatgcacccctgtaacctggcggcagcgcaaaagatg

SEQ ID NO: 150599 - DNA, 103 bp, Artificial Sequence
  Synthetic Polynucleotide
taatacgactcactataggggttgcacattctttgcccggagtagcttctaacagaggagaagaagcatgtccgggcaaaacctggcggcagcgcaaaagatg

SEQ ID NO: 150600 - DNA, 103 bp, Artificial Sequence
  Synthetic Polynucleotide
taatacgactcactatagggccagtgctgagttgcacattctttgcccggaacagaggagaccgggcatggaatgtgcaaacctggcggcagcgcaaaagatg

SEQ ID NO: 150601 - DNA, 103 bp, Artificial Sequence
  Synthetic Polynucleotide
taatacgactcactatagggggacccccgcccagtgctgagttgcacattaacagaggagaaatgtgatgctcagcactaacctggcggcagcgcaaaagatg

SEQ ID NO: 150602 - DNA, 103 bp, Artificial Sequence
  Synthetic Polynucleotide
taatacgactcactataggggcagcccctcggacccccgcccagtgctgaaacagaggagatcagcaatgggcgggggtaacctggcggcagcgcaaaagatg

SEQ ID NO: 150603 - DNA, 103 bp, Artificial Sequence
  Synthetic Polynucleotide
taatacgactcactatagggatctcagctcgcagcccctcggacccccgcaacagaggagagcggggatgcgaggggctaacctggcggcagcgcaaaagatg

SEQ ID NO: 150604 - DNA, 103 bp, Artificial Sequence
  Synthetic Polynucleotide
taatacgactcactataggggtgcccgttgatctcagctcgcagcccctcaacagaggagagaggggatgcgagctgagaacctggcggcagcgcaaaagatg

SEQ ID NO: 150605 - DNA, 103 bp, Artificial Sequence
  Synthetic Polynucleotide
taatacgactcactatagggtgctgtcaatgtgcccgttgatctcagctcaacagaggagagagctgatgtcaacgggcaacctggcggcagcgcaaaagatg

SEQ ID NO: 150606 - DNA, 103 bp, Artificial Sequence
  Synthetic Polynucleotide
taatacgactcactatagggccagccagcttgctgtcaatgtgcccgttgaacagaggagacaacggatgcattgacagaacctggcggcagcgcaaaagatg

SEQ ID NO: 150607 - DNA, 103 bp, Artificial Sequence
  Synthetic Polynucleotide
taatacgactcactatagggctgctccagcccagccagcttgctgtcaataacagaggagaattgacatgaagctggctaacctggcggcagcgcaaaagatg

SEQ ID NO: 150608 - DNA, 103 bp, Artificial Sequence
  Synthetic Polynucleotide
taatacgactcactatagggcctgtagtttctgctccagcccagccagctaacagaggagaagctggatgggctggagcaacctggcggcagcgcaaaagatg

SEQ ID NO: 150609 - DNA, 103 bp, Artificial Sequence
  Synthetic Polynucleotide
taatacgactcactatagggggtgattcctcaggtggtggggacaggggtaacagaggagaacccctatgcccaccaccaacctggcggcagcgcaaaagatg

SEQ ID NO: 150610 - DNA, 103 bp, Artificial Sequence
  Synthetic Polynucleotide
taatacgactcactatagggctgggggtaccctgtagtttctgctccagcaacagaggagagctggaatggaaactacaaacctggcggcagcgcaaaagatg

SEQ ID NO: 150611 - DNA, 103 bp, Artificial Sequence
  Synthetic Polynucleotide
taatacgactcactatagggctccttgttgctgggggtaccctgtagtttaacagaggagaaaactaatgggtacccccaacctggcggcagcgcaaaagatg

SEQ ID NO: 150612 - DNA, 103 bp, Artificial Sequence
  Synthetic Polynucleotide
taatacgactcactatagggctgctgcatcctccttgttgctgggggtacaacagaggagagtacccatggcaacaaggaacctggcggcagcgcaaaagatg

SEQ ID NO: 150613 - DNA, 103 bp, Artificial Sequence
  Synthetic Polynucleotide
taatacgactcactatagggggcttccttgctgctgcatcctccttgttgaacagaggagacaacaaatgggatgcagcaacctggcggcagcgcaaaagatg

SEQ ID NO: 150614 - DNA, 103 bp, Artificial Sequence
  Synthetic Polynucleotide
taatacgactcactatagggcggtgtcaaaggcttccttgctgctgcatcaacagaggagagatgcaatggcaaggaagaacctggcggcagcgcaaaagatg

SEQ ID NO: 150615 - DNA, 103 bp, Artificial Sequence
  Synthetic Polynucleotide
taatacgactcactataggggcttgggcttcggtgtcaaaggcttccttgaacagaggagacaaggaatgctttgacacaacctggcggcagcgcaaaagatg

SEQ ID NO: 150616 - DNA, 103 bp, Artificial Sequence
  Synthetic Polynucleotide
taatacgactcactatagggttctgtacccgcttgggcttcggtgtcaaaaacagaggagatttgacatggaagcccaaaacctggcggcagcgcaaaagatg

SEQ ID NO: 150617 - DNA, 103 bp, Artificial Sequence
  Synthetic Polynucleotide
taatacgactcactataggggtcgcttgccttctgtacccgcttgggcttaacagaggagaaagcccatgcgggtacagaacctggcggcagcgcaaaagatg

SEQ ID NO: 150618 - DNA, 103 bp, Artificial Sequence
  Synthetic Polynucleotide
taatacgactcactatagggtcaccaacctgtcgcttgccttctgtacccaacagaggagagggtacatgaggcaagcgaacctggcggcagcgcaaaagatg

SEQ ID NO: 150619 - DNA, 103 bp, Artificial Sequence
  Synthetic Polynucleotide
taatacgactcactatagggtttcgggagctcaccaacctgtcgcttgccaacagaggagaggcaagatgcaggttggtaacctggcggcagcgcaaaagatg

SEQ ID NO: 150620 - DNA, 103 bp, Artificial Sequence
  Synthetic Polynucleotide
taatacgactcactatagggtggggacgtgggtgattcctcaggtggtggaacagaggagaccaccaatggaggaatcaaacctggcggcagcgcaaaagatg

SEQ ID NO: 150621 - DNA, 103 bp, Artificial Sequence
  Synthetic Polynucleotide
taatacgactcactatagggccgcagcttctttcgggagctcaccaacctaacagaggagaaggttgatgagctcccgaaacctggcggcagcgcaaaagatg

SEQ ID NO: 150622 - DNA, 103 bp, Artificial Sequence
  Synthetic Polynucleotide
taatacgactcactatagggcgtcctccttccgcagcttctttcgggagcaacagaggagagctcccatgagaagctgcaacctggcggcagcgcaaaagatg

SEQ ID NO: 150623 - DNA, 103 bp, Artificial Sequence
  Synthetic Polynucleotide
taatacgactcactataggggccctgaccccgtcctccttccgcagcttcaacagaggagagaagctatggaaggaggaaacctggcggcagcgcaaaagatg

SEQ ID NO: 150624 - DNA, 103 bp, Artificial Sequence
  Synthetic Polynucleotide
taatacgactcactatagggggcctcgctggccctgaccccgtcctccttaacagaggagaaaggagatgggggtcaggaacctggcggcagcgcaaaagatg

SEQ ID NO: 150625 - DNA, 103 bp, Artificial Sequence
  Synthetic Polynucleotide
taatacgactcactataggggtttcagcaaggcctcgctggccctgacccaacagaggagagggtcaatgccagcgaggaacctggcggcagcgcaaaagatg

SEQ ID NO: 150626 - DNA, 103 bp, Artificial Sequence
  Synthetic Polynucleotide
taatacgactcactatagggtgtttcagctgtttcagcaaggcctcgctgaacagaggagacagcgaatgcttgctgaaaacctggcggcagcgcaaaagatg

SEQ ID NO: 150627 - DNA, 103 bp, Artificial Sequence
  Synthetic Polynucleotide
taatacgactcactatagggggacagctcctgtttcagctgtttcagcaaaacagaggagattgctgatgcagctgaaaaacctggcggcagcgcaaaagatg

SEQ ID NO: 150628 - DNA, 103 bp, Artificial Sequence
  Synthetic Polynucleotide
taatacgactcactatagggggggcagcagggacagctcctgtttcagctaacagaggagaagctgaatgaggagctgtaacctggcggcagcgcaaaagatg

SEQ ID NO: 150629 - DNA, 103 bp, Artificial Sequence
  Synthetic Polynucleotide
taatacgactcactatagggggctccgttaggggcagcagggacagctccaacagaggagaggagctatgcctgctgccaacctggcggcagcgcaaaagatg

SEQ ID NO: 150630 - DNA, 103 bp, Artificial Sequence
  Synthetic Polynucleotide
taatacgactcactatagggggtgatagcaggctccgttaggggcagcagaacagaggagactgctgatgctaacggagaacctggcggcagcgcaaaagatg

SEQ ID NO: 150631 - DNA, 103 bp, Artificial Sequence
  Synthetic Polynucleotide
taatacgactcactatagggcctcaggtggtggggacgtgggtgattcctaacagaggagaaggaatatgccacgtcccaacctggcggcagcgcaaaagatg

SEQ ID NO: 150632 - DNA, 103 bp, Artificial Sequence
  Synthetic Polynucleotide
taatacgactcactatagggtaaaattggcggtgatagcaggctccgttaaacagaggagataacggatgctgctatcaaacctggcggcagcgcaaaagatg

SEQ ID NO: 150633 - DNA, 103 bp, Artificial Sequence
  Synthetic Polynucleotide
taatacgactcactataggggcaaagaggctaaaattggcggtgatagcaaacagaggagatgctatatgcgccaatttaacctggcggcagcgcaaaagatg

SEQ ID NO: 150634 - DNA, 103 bp, Artificial Sequence
  Synthetic Polynucleotide
taatacgactcactataggggccaaagggggcaaagaggctaaaattggcaacagaggagagccaatatgagcctctttaacctggcggcagcgcaaaagatg

SEQ ID NO: 150635 - DNA, 103 bp, Artificial Sequence
  Synthetic Polynucleotide
taatacgactcactatagggggcagccactgccaaagggggcaaagaggcaacagaggagagcctctatgccccctttgaacctggcggcagcgcaaaagatg

SEQ ID NO: 150636 - DNA, 103 bp, Artificial Sequence
  Synthetic Polynucleotide
taatacgactcactatagggccattgactgggcagccactgccaaaggggaacagaggagaccccttatgcagtggctgaacctggcggcagcgcaaaagatg

SEQ ID NO: 150637 - DNA, 103 bp, Artificial Sequence
  Synthetic Polynucleotide
taatacgactcactatagggctggctctgcccattgactgggcagccactaacagaggagaagtggcatgccagtcaataacctggcggcagcgcaaaagatg

SEQ ID NO: 150638 - DNA, 103 bp, Artificial Sequence
  Synthetic Polynucleotide
taatacgactcactatagggcccccctcagctggctctgcccattgactgaacagaggagacagtcaatgggcagagccaacctggcggcagcgcaaaagatg

SEQ ID NO: 150639 - DNA, 103 bp, Artificial Sequence
  Synthetic Polynucleotide
taatacgactcactatagggcttccaaaggcccccctcagctggctctgcaacagaggagagcagagatggctgaggggaacctggcggcagcgcaaaagatg

SEQ ID NO: 150640 - DNA, 103 bp, Artificial Sequence
  Synthetic Polynucleotide
taatacgactcactatagggcagcgccccacttccaaaggcccccctcagaacagaggagactgaggatggcctttggaaacctggcggcagcgcaaaagatg

SEQ ID NO: 150641 - DNA, 103 bp, Artificial Sequence
  Synthetic Polynucleotide
taatacgactcactatagggggccagtgggcagcgccccacttccaaaggaacagaggagacctttgatggtggggcgcaacctggcggcagcgcaaaagatg

SEQ ID NO: 150642 - DNA, 103 bp, Artificial Sequence
  Synthetic Polynucleotide
taatacgactcactatagggaggcgtgatgcctcaggtggtggggacgtgaacagaggagacacgtcatgaccacctgaaacctggcggcagcgcaaaagatg

SEQ ID NO: 150643 - DNA, 103 bp, Artificial Sequence
  Synthetic Polynucleotide
taatacgactcactatagggtagtagtcagggccagtgggcagcgccccaaacagaggagatggggcatggcccactggaacctggcggcagcgcaaaagatg

SEQ ID NO: 150644 - DNA, 103 bp, Artificial Sequence
  Synthetic Polynucleotide
taatacgactcactatagggcagctgggaatagtagtcagggccagtgggaacagaggagacccactatgcctgactacaacctggcggcagcgcaaaagatg

SEQ ID NO: 150645 - DNA, 103 bp, Artificial Sequence
  Synthetic Polynucleotide
taatacgactcactatagggtcttggtaagcagctgggaatagtagtcagaacagaggagactgactatgattcccagcaacctggcggcagcgcaaaagatg

SEQ ID NO: 150646 - DNA, 103 bp, Artificial Sequence
  Synthetic Polynucleotide
taatacgactcactatagggctcaggttattcttggtaagcagctgggaaaacagaggagattcccaatggcttaccaaaacctggcggcagcgcaaaagatg

SEQ ID NO: 150647 - DNA, 103 bp, Artificial Sequence
  Synthetic Polynucleotide
taatacgactcactatagggcggcgggttactcaggttattcttggtaagaacagaggagacttaccatgaataacctgaacctggcggcagcgcaaaagatg

SEQ ID NO: 150648 - DNA, 103 bp, Artificial Sequence
  Synthetic Polynucleotide
taatacgactcactatagggagggtggtgtcggcgggttactcaggttataacagaggagaataaccatggtaacccgcaacctggcggcagcgcaaaagatg

SEQ ID NO: 150649 - DNA, 103 bp, Artificial Sequence
  Synthetic Polynucleotide
taatacgactcactatagggggcagcgacgagggtggtgtcggcgggttaaacagaggagataacccatggacaccaccaacctggcggcagcgcaaaagatg

SEQ ID NO: 150650 - DNA, 103 bp, Artificial Sequence
  Synthetic Polynucleotide
taatacgactcactatagggtggggtggggggcagcgacgagggtggtgtaacagaggagaacaccaatgtcgtcgctgaacctggcggcagcgcaaaagatg

SEQ ID NO: 150651 - DNA, 103 bp, Artificial Sequence
  Synthetic Polynucleotide
taatacgactcactatagggccgatgggggtggggtggggggcagcgacgaacagaggagacgtcgcatgcccccacccaacctggcggcagcgcaaaagatg

SEQ ID NO: 150652 - DNA, 103 bp, Artificial Sequence
  Synthetic Polynucleotide
taatacgactcactatagggttctgctgcaccgatgggggtggggtggggaacagaggagaccccacatgacccccatcaacctggcggcagcgcaaaagatg

SEQ ID NO: 150653 - DNA, 103 bp, Artificial Sequence
  Synthetic Polynucleotide
taatacgactcactatagggtggtggtgacaggcgtgatgcctcaggtggaacagaggagaccacctatggcatcacgcaacctggcggcagcgcaaaagatg

SEQ ID NO: 150654 - DNA, 103 bp, Artificial Sequence
  Synthetic Polynucleotide
taatacgactcactatagggattcaccatcttctgctgcaccgatgggggaacagaggagacccccaatggtgcagcagaacctggcggcagcgcaaaagatg

SEQ ID NO: 150655 - DNA, 103 bp, Artificial Sequence
  Synthetic Polynucleotide
taatacgactcactataggggggtgacgccattcaccatcttctgctgcaaacagaggagatgcagcatgagatggtgaaacctggcggcagcgcaaaagatg

SEQ ID NO: 150656 - DNA, 103 bp, Artificial Sequence
  Synthetic Polynucleotide
taatacgactcactatagggtcttcagatggggtgacgccattcaccatcaacagaggagagatggtatgtggcgtcacaacctggcggcagcgcaaaagatg

SEQ ID NO: 150657 - DNA, 103 bp, Artificial Sequence
  Synthetic Polynucleotide
taatacgactcactatagggctcccccagctcttcagatggggtgacgccaacagaggagaggcgtcatgccatctgaaaacctggcggcagcgcaaaagatg

SEQ ID NO: 150658 - DNA, 103 bp, Artificial Sequence
  Synthetic Polynucleotide
taatacgactcactatagggccttggggtgctcccccagctcttcagatgaacagaggagacatctgatgagctgggggaacctggcggcagcgcaaaagatg

SEQ ID NO: 150659 - DNA, 103 bp, Artificial Sequence
  Synthetic Polynucleotide
taatacgactcactataggggaggcagcatccttggggtgctcccccagcaacagaggagagctgggatggcaccccaaaacctggcggcagcgcaaaagatg

SEQ ID NO: 150660 - DNA, 103 bp, Artificial Sequence
  Synthetic Polynucleotide
taatacgactcactatagggatcccgggcagaggcagcatccttggggtgaacagaggagacaccccatggatgctgccaacctggcggcagcgcaaaagatg

SEQ ID NO: 150661 - DNA, 103 bp, Artificial Sequence
  Synthetic Polynucleotide
taatacgactcactatagggccctttcactatcccgggcagaggcagcataacagaggagaatgctgatgctgcccgggaacctggcggcagcgcaaaagatg

SEQ ID NO: 150662 - DNA, 103 bp, Artificial Sequence
  Synthetic Polynucleotide
taatacgactcactatagggtccctcagtgccctttcactatcccgggcaaacagaggagatgcccgatgtagtgaaagaacctggcggcagcgcaaaagatg

SEQ ID NO: 150663 - DNA, 103 bp, Artificial Sequence
  Synthetic Polynucleotide
taatacgactcactatagggctctgaagtatccctcagtgccctttcactaacagaggagaagtgaaatggcactgaggaacctggcggcagcgcaaaagatg

SEQ ID NO: 150664 - DNA, 103 bp, Artificial Sequence
  Synthetic Polynucleotide
taatacgactcactatagggtctcctgaagcctgggactcccagaactaaaacagaggagattagttatgggagtcccaaacctggcggcagcgcaaaagatg

SEQ ID NO: 150665 - DNA, 103 bp, Artificial Sequence
  Synthetic Polynucleotide
taatacgactcactatagggattcctcaggtggtggtgacaggcgtgatgaacagaggagacatcacatgtgtcaccacaacctggcggcagcgcaaaagatg

SEQ ID NO: 150666 - DNA, 103 bp, Artificial Sequence
  Synthetic Polynucleotide
taatacgactcactataggggactcttcacctctgaagtatccctcagtgaacagaggagacactgaatgatacttcagaacctggcggcagcgcaaaagatg

SEQ ID NO: 150667 - DNA, 103 bp, Artificial Sequence
  Synthetic Polynucleotide
taatacgactcactatagggagcaggtctagactcttcacctctgaagtaaacagaggagatacttcatgggtgaagagaacctggcggcagcgcaaaagatg

SEQ ID NO: 150668 - DNA, 103 bp, Artificial Sequence
  Synthetic Polynucleotide
taatacgactcactatagggcaaggcagccagcaggtctagactcttcacaacagaggagagtgaagatgctagacctgaacctggcggcagcgcaaaagatg

SEQ ID NO: 150669 - DNA, 103 bp, Artificial Sequence
  Synthetic Polynucleotide
taatacgactcactatagggggggtgtaggcaaggcagccagcaggtctaaacagaggagatagaccatgtggctgcctaacctggcggcagcgcaaaagatg

SEQ ID NO: 150670 - DNA, 103 bp, Artificial Sequence
  Synthetic Polynucleotide
taatacgactcactatagggtgattgtgagggggtgtaggcaaggcagccaacagaggagaggctgcatggcctacaccaacctggcggcagcgcaaaagatg

SEQ ID NO: 150671 - DNA, 103 bp, Artificial Sequence
  Synthetic Polynucleotide
taatacgactcactatagggatcctcagtctgattgtgagggggtgtaggaacagaggagacctacaatgcctcacaataacctggcggcagcgcaaaagatg

SEQ ID NO: 150672 - DNA, 103 bp, Artificial Sequence
  Synthetic Polynucleotide
taatacgactcactatagggccatcctgacatcctcagtctgattgtgagaacagaggagactcacaatgagactgaggaacctggcggcagcgcaaaagatg

SEQ ID NO: 150673 - DNA, 103 bp, Artificial Sequence
  Synthetic Polynucleotide
taatacgactcactatagggtcatcactctccatcctgacatcctcagtcaacagaggagagactgaatgtgtcaggataacctggcggcagcgcaaaagatg

SEQ ID NO: 150674 - DNA, 103 bp, Artificial Sequence
  Synthetic Polynucleotide
taatacgactcactatagggatcgctatcctcatcactctccatcctgacaacagaggagagtcaggatggagagtgataacctggcggcagcgcaaaagatg

SEQ ID NO: 150675 - DNA, 103 bp, Artificial Sequence
  Synthetic Polynucleotide
taatacgactcactatagggtgtcaggagaatcgctatcctcatcactctaacagaggagaagagtgatgaggatagcgaacctggcggcagcgcaaaagatg

SEQ ID NO: 150676 - DNA, 103 bp, Artificial Sequence
  Synthetic Polynucleotide
taatacgactcactataggggatgcgggcaattcctcaggtggtggtgacaacagaggagagtcaccatgacctgaggaaacctggcggcagcgcaaaagatg

SEQ ID NO: 150677 - DNA, 103 bp, Artificial Sequence
  Synthetic Polynucleotide
taatacgactcactatagggggcacaatgctgtcaggagaatcgctatccaacagaggagaggatagatgttctcctgaaacctggcggcagcgcaaaagatg

SEQ ID NO: 150678 - DNA, 103 bp, Artificial Sequence
  Synthetic Polynucleotide
taatacgactcactatagggggatgaagctggcacaatgctgtcaggagaaacagaggagatctcctatgagcattgtgaacctggcggcagcgcaaaagatg

SEQ ID NO: 150679 - DNA, 103 bp, Artificial Sequence
  Synthetic Polynucleotide
taatacgactcactatagggtgctctcaggggatgaagctggcacaatgcaacagaggagagcattgatgcagcttcataacctggcggcagcgcaaaagatg

SEQ ID NO: 150680 - DNA, 103 bp, Artificial Sequence
  Synthetic Polynucleotide
taatacgactcactatagggtcccccaagatgctctcaggggatgaagctaacagaggagaagcttcatgccctgagagaacctggcggcagcgcaaaagatg

SEQ ID NO: 150681 - DNA, 103 bp, Artificial Sequence
  Synthetic Polynucleotide
taatacgactcactatagggaggggcctcctcccccaagatgctctcaggaacagaggagacctgagatgatcttggggaacctggcggcagcgcaaaagatg

SEQ ID NO: 150682 - DNA, 103 bp, Artificial Sequence
  Synthetic Polynucleotide
taatacgactcactataggggagggaaacgaggggcctcctcccccaagaaacagaggagatcttggatgaggaggcccaacctggcggcagcgcaaaagatg

SEQ ID NO: 150683 - DNA, 103 bp, Artificial Sequence
  Synthetic Polynucleotide
taatacgactcactataggggagcccagatgagggaaacgaggggcctccaacagaggagaggaggcatgtcgtttcccaacctggcggcagcgcaaaagatg

SEQ ID NO: 150684 - DNA, 103 bp, Artificial Sequence
  Synthetic Polynucleotide
taatacgactcactatagggccaccggcctgagcccagatgagggaaacgaacagaggagacgtttcatgcatctgggcaacctggcggcagcgcaaaagatg

SEQ ID NO: 150685 - DNA, 103 bp, Artificial Sequence
  Synthetic Polynucleotide
taatacgactcactatagggcctcttgctcccaccggcctgagcccagataacagaggagaatctggatgcaggccggtaacctggcggcagcgcaaaagatg

SEQ ID NO: 150686 - DNA, 103 bp, Artificial Sequence
  Synthetic Polynucleotide
taatacgactcactatagggagggcccggtcctcttgctcccaccggcctaacagaggagaaggccgatgggagcaagaaacctggcggcagcgcaaaagatg

SEQ ID NO: 150687 - DNA, 103 bp, Artificial Sequence
  Synthetic Polynucleotide
taatacgactcactatagggaggaagtggggatgcgggcaattcctcaggaacagaggagacctgagatgttgcccgcaaacctggcggcagcgcaaaagatg

SEQ ID NO: 150688 - DNA, 103 bp, Artificial Sequence
  Synthetic Polynucleotide
taatacgactcactataggggacaggggagagggcccggtcctcttgctcaacagaggagagagcaaatggaccgggccaacctggcggcagcgcaaaagatg

SEQ ID NO: 150689 - DNA, 103 bp, Artificial Sequence
  Synthetic Polynucleotide
taatacgactcactatagggtgagggggatgacaggggagagggcccggtaacagaggagaaccgggatgtctcccctgaacctggcggcagcgcaaaagatg

SEQ ID NO: 150690 - DNA, 103 bp, Artificial Sequence
  Synthetic Polynucleotide
taatacgactcactataggggcccgaggaatgagggggatgacaggggagaacagaggagactccccatgcatccccctaacctggcggcagcgcaaaagatg

SEQ ID NO: 150691 - DNA, 103 bp, Artificial Sequence
  Synthetic Polynucleotide
taatacgactcactatagggtgggatgctggcccgaggaatgagggggataacagaggagaatccccatgattcctcggaacctggcggcagcgcaaaagatg

SEQ ID NO: 150692 - DNA, 103 bp, Artificial Sequence
  Synthetic Polynucleotide
taatacgactcactatagggctgggaagactgggatgctggcccgaggaaaacagaggagattcctcatgccagcatccaacctggcggcagcgcaaaagatg

SEQ ID NO: 150693 - DNA, 103 bp, Artificial Sequence
  Synthetic Polynucleotide
taatacgactcactatagggggtttggtatctgggaagactgggatgctgaacagaggagacagcatatgagtcttcccaacctggcggcagcgcaaaagatg

SEQ ID NO: 150694 - DNA, 103 bp, Artificial Sequence
  Synthetic Polynucleotide
taatacgactcactatagggggccccataaggtttggtatctgggaagacaacagaggagagtcttcatggataccaaaaacctggcggcagcgcaaaagatg

SEQ ID NO: 150695 - DNA, 103 bp, Artificial Sequence
  Synthetic Polynucleotide
taatacgactcactatagggccaggccaagggccccataaggtttggtataacagaggagaataccaatgcttatggggaacctggcggcagcgcaaaagatg

SEQ ID NO: 150696 - DNA, 103 bp, Artificial Sequence
  Synthetic Polynucleotide
taatacgactcactatagggccagggacctccaggccaagggccccataaaacagaggagattatggatgccttggcctaacctggcggcagcgcaaaagatg

SEQ ID NO: 150697 - DNA, 103 bp, Artificial Sequence
  Synthetic Polynucleotide
taatacgactcactatagggaggcagctttccagggacctccaggccaagaacagaggagacttggcatggaggtccctaacctggcggcagcgcaaaagatg

SEQ ID NO: 150698 - DNA, 103 bp, Artificial Sequence
  Synthetic Polynucleotide
taatacgactcactataggggcaatgcctcaggaagtggggatgcgggcaaacagaggagatgcccgatgccccacttcaacctggcggcagcgcaaaagatg

SEQ ID NO: 150699 - DNA, 103 bp, Artificial Sequence
  Synthetic Polynucleotide
taatacgactcactatagggaagttgtgacaggcagctttccagggacctaacagaggagaaggtccatggaaagctgcaacctggcggcagcgcaaaagatg

SEQ ID NO: 150700 - DNA, 103 bp, Artificial Sequence
  Synthetic Polynucleotide
taatacgactcactatagggcccttttcccaagttgtgacaggcagctttaacagaggagaaaagctatgtgtcacaacaacctggcggcagcgcaaaagatg

SEQ ID NO: 150701 - DNA, 103 bp, Artificial Sequence
  Synthetic Polynucleotide
taatacgactcactatagggacttcctttgcccttttcccaagttgtgacaacagaggagagtcacaatgtgggaaaagaacctggcggcagcgcaaaagatg

SEQ ID NO: 150702 - DNA, 103 bp, Artificial Sequence
  Synthetic Polynucleotide
taatacgactcactatagggctgacacctcacttcctttgcccttttcccaacagaggagagggaaaatggcaaaggaaaacctggcggcagcgcaaaagatg

SEQ ID NO: 150703 - DNA, 103 bp, Artificial Sequence
  Synthetic Polynucleotide
taatacgactcactataggggtgagcatgactgacacctcacttcctttgaacagaggagacaaaggatgtgaggtgtcaacctggcggcagcgcaaaagatg

SEQ ID NO: 150704 - DNA, 103 bp, Artificial Sequence
  Synthetic Polynucleotide
taatacgactcactatagggagcagagactgtgagcatgactgacacctcaacagaggagagaggtgatggtcatgctcaacctggcggcagcgcaaaagatg

SEQ ID NO: 150705 - DNA, 103 bp, Artificial Sequence
  Synthetic Polynucleotide
taatacgactcactatagggtggctgcagcagcagagactgtgagcatgaaacagaggagatcatgcatgcagtctctgaacctggcggcagcgcaaaagatg

SEQ ID NO: 150706 - DNA, 103 bp, Artificial Sequence
  Synthetic Polynucleotide
taatacgactcactatagggttcaggttcttggctgcagcagcagagactaacagaggagaagtctcatgtgctgcagcaacctggcggcagcgcaaaagatg

SEQ ID NO: 150707 - DNA, 103 bp, Artificial Sequence
  Synthetic Polynucleotide
taatacgactcactatagggcatcacgccattcaggttcttggctgcagcaacagaggagagctgcaatgaagaacctgaacctggcggcagcgcaaaagatg

SEQ ID NO: 150708 - DNA, 103 bp, Artificial Sequence
  Synthetic Polynucleotide
taatacgactcactatagggccactgccaccatcacgccattcaggttctaacagaggagaagaaccatgatggcgtgaaacctggcggcagcgcaaaagatg

SEQ ID NO: 150709 - DNA, 103 bp, Artificial Sequence
  Synthetic Polynucleotide
taatacgactcactatagggcgggacaggtgcaatgcctcaggaagtgggaacagaggagacccactatgtgaggcattaacctggcggcagcgcaaaagatg

SEQ ID NO: 150710 - DNA, 103 bp, Artificial Sequence
  Synthetic Polynucleotide
taatacgactcactatagggagcagctccgccactgccaccatcacgccaaacagaggagatggcgtatgggtggcagtaacctggcggcagcgcaaaagatg

SEQ ID NO: 150711 - DNA, 103 bp, Artificial Sequence
  Synthetic Polynucleotide
taatacgactcactatagggcttcatgctcagcagctccgccactgccacaacagaggagagtggcaatggcggagctgaacctggcggcagcgcaaaagatg

SEQ ID NO: 150712 - DNA, 103 bp, Artificial Sequence
  Synthetic Polynucleotide
taatacgactcactatagggagttggggatcttcatgctcagcagctccgaacagaggagacggagcatgtgagcatgaaacctggcggcagcgcaaaagatg

SEQ ID NO: 150713 - DNA, 103 bp, Artificial Sequence
  Synthetic Polynucleotide
taatacgactcactatagggacctcataggagttggggatcttcatgctcaacagaggagagagcatatggatccccaaaacctggcggcagcgcaaaagatg

SEQ ID NO: 150714 - DNA, 103 bp, Artificial Sequence
  Synthetic Polynucleotide
taatacgactcactatagggtgggaacagcacctcataggagttggggataacagaggagaatccccatgtcctatgagaacctggcggcagcgcaaaagatg

SEQ ID NO: 150715 - DNA, 103 bp, Artificial Sequence
  Synthetic Polynucleotide
taatacgactcactatagggcggggctctctgggaacagcacctcataggaacagaggagacctatgatgtgctgttccaacctggcggcagcgcaaaagatg

SEQ ID NO: 150716 - DNA, 103 bp, Artificial Sequence
  Synthetic Polynucleotide
taatacgactcactatagggcctgcccgggcggggctctctgggaacagcaacagaggagagctgttatgagagagcccaacctggcggcagcgcaaaagatg

SEQ ID NO: 150717 - DNA, 103 bp, Artificial Sequence
  Synthetic Polynucleotide
taatacgactcactatagggtggctcagtgcctgcccgggcggggctctcaacagaggagagagagcatggcccgggcaaacctggcggcagcgcaaaagatg

SEQ ID NO: 150718 - DNA, 103 bp, Artificial Sequence
  Synthetic Polynucleotide
taatacgactcactatagggcccccttctttggctcagtgcctgcccgggaacagaggagacccgggatggcactgagcaacctggcggcagcgcaaaagatg

SEQ ID NO: 150719 - DNA, 103 bp, Artificial Sequence
  Synthetic Polynucleotide
taatacgactcactatagggccctcagcttcccccttctttggctcagtgaacagaggagacactgaatgaaagaagggaacctggcggcagcgcaaaagatg

SEQ ID NO: 150720 - DNA, 103 bp, Artificial Sequence
  Synthetic Polynucleotide
taatacgactcactatagggctccagcggccgggacaggtgcaatgcctcaacagaggagagaggcaatgcacctgtccaacctggcggcagcgcaaaagatg

SEQ ID NO: 150721 - DNA, 103 bp, Artificial Sequence
  Synthetic Polynucleotide
taatacgactcactatagggcccaccaggaccctcagcttcccccttcttaacagaggagaaagaagatggaagctgagaacctggcggcagcgcaaaagatg

SEQ ID NO: 150722 - DNA, 103 bp, Artificial Sequence
  Synthetic Polynucleotide
taatacgactcactatagggccttttccttcccaccaggaccctcagcttaacagaggagaaagctgatggtcctggtgaacctggcggcagcgcaaaagatg

SEQ ID NO: 150723 - DNA, 103 bp, Artificial Sequence
  Synthetic Polynucleotide
taatacgactcactatagggccttccagacccttttccttcccaccaggaaacagaggagatcctggatggaaggaaaaaacctggcggcagcgcaaaagatg

SEQ ID NO: 150724 - DNA, 103 bp, Artificial Sequence
  Synthetic Polynucleotide
taatacgactcactatagggtgggctcttgccttccagacccttttccttaacagaggagaaaggaaatgggtctggaaaacctggcggcagcgcaaaagatg

SEQ ID NO: 150725 - DNA, 103 bp, Artificial Sequence
  Synthetic Polynucleotide
taatacgactcactatagggggccagtgtctgggctcttgccttccagacaacagaggagagtctggatggcaagagccaacctggcggcagcgcaaaagatg

SEQ ID NO: 150726 - DNA, 103 bp, Artificial Sequence
  Synthetic Polynucleotide
taatacgactcactatagggagccaatcagggccagtgtctgggctcttgaacagaggagacaagagatgagacactggaacctggcggcagcgcaaaagatg

SEQ ID NO: 150727 - DNA, 103 bp, Artificial Sequence
  Synthetic Polynucleotide
taatacgactcactatagggaaactgcttcagccaatcagggccagtgtcaacagaggagagacactatgcctgattggaacctggcggcagcgcaaaagatg

SEQ ID NO: 150728 - DNA, 103 bp, Artificial Sequence
  Synthetic Polynucleotide
taatacgactcactatagggacactgcatcaaactgcttcagccaatcagaacagaggagactgattatgtgaagcagtaacctggcggcagcgcaaaagatg

SEQ ID NO: 150729 - DNA, 103 bp, Artificial Sequence
  Synthetic Polynucleotide
taatacgactcactatagggtagccaggcaacactgcatcaaactgcttcaacagaggagagaagcaatgtgatgcagtaacctggcggcagcgcaaaagatg

SEQ ID NO: 150730 - DNA, 103 bp, Artificial Sequence
  Synthetic Polynucleotide
taatacgactcactatagggcttcagggtatagccaggcaacactgcatcaacagaggagagatgcaatgttgcctggcaacctggcggcagcgcaaaagatg

SEQ ID NO: 150731 - DNA, 103 bp, Artificial Sequence
  Synthetic Polynucleotide
taatacgactcactatagggggggcgattcctccagcggccgggacaggtaacagaggagaacctgtatgggccgctggaacctggcggcagcgcaaaagatg

SEQ ID NO: 150732 - DNA, 103 bp, Artificial Sequence
  Synthetic Polynucleotide
taatacgactcactatagggctagttggctcttcagggtatagccaggcaaacagaggagatgcctgatgataccctgaaacctggcggcagcgcaaaagatg

SEQ ID NO: 150733 - DNA, 103 bp, Artificial Sequence
  Synthetic Polynucleotide
taatacgactcactatagggctcaagatgtctagttggctcttcagggtaaacagaggagataccctatggagccaactaacctggcggcagcgcaaaagatg

SEQ ID NO: 150734 - DNA, 103 bp, Artificial Sequence
  Synthetic Polynucleotide
taatacgactcactatagggtttcaggaggctcaagatgtctagttggctaacagaggagaagccaaatggacatcttgaacctggcggcagcgcaaaagatg

SEQ ID NO: 150735 - DNA, 103 bp, Artificial Sequence
  Synthetic Polynucleotide
taatacgactcactatagggggctctcctgtttcaggaggctcaagatgtaacagaggagaacatctatggcctcctgaaacctggcggcagcgcaaaagatg

SEQ ID NO: 150736 - DNA, 103 bp, Artificial Sequence
  Synthetic Polynucleotide
taatacgactcactatagggtctggggcggggctctcctgtttcaggaggaacagaggagacctcctatgacaggagagaacctggcggcagcgcaaaagatg

SEQ ID NO: 150737 - DNA, 103 bp, Artificial Sequence
  Synthetic Polynucleotide
taatacgactcactatagggagtgggtggctctggggcggggctctcctgaacagaggagacaggagatgcccgccccaaacctggcggcagcgcaaaagatg

SEQ ID NO: 150738 - DNA, 103 bp, Artificial Sequence
  Synthetic Polynucleotide
taatacgactcactatagggagctgtgctgagtgggtggctctggggcggaacagaggagaccgcccatgagccacccaaacctggcggcagcgcaaaagatg

SEQ ID NO: 150739 - DNA, 103 bp, Artificial Sequence
  Synthetic Polynucleotide
taatacgactcactatagggttgtaggtatagctgtgctgagtgggtggcaacagaggagagccaccatgtcagcacagaacctggcggcagcgcaaaagatg

SEQ ID NO: 150740 - DNA, 103 bp, Artificial Sequence
  Synthetic Polynucleotide
taatacgactcactatagggattggagacattgtaggtatagctgtgctgaacagaggagacagcacatgtatacctacaacctggcggcagcgcaaaagatg

SEQ ID NO: 150741 - DNA, 103 bp, Artificial Sequence
  Synthetic Polynucleotide
taatacgactcactataggggcacatccagattggagacattgtaggtataacagaggagaatacctatgatgtctccaaacctggcggcagcgcaaaagatg

SEQ ID NO: 150742 - DNA, 103 bp, Artificial Sequence
  Synthetic Polynucleotide
taatacgactcactatagggggcggagagaggggcgattcctccagcggcaacagaggagagccgctatgggaatcgccaacctggcggcagcgcaaaagatg

SEQ ID NO: 150743 - DNA, 103 bp, Artificial Sequence
  Synthetic Polynucleotide
taatacgactcactataggggagagctgtcgcacatccagattggagacaaacagaggagatgtctcatgtctggatgtaacctggcggcagcgcaaaagatg

SEQ ID NO: 150744 - DNA, 103 bp, Artificial Sequence
  Synthetic Polynucleotide
taatacgactcactatagggaggtggggccgagagctgtcgcacatccagaacagaggagactggatatgcgacagctcaacctggcggcagcgcaaaagatg

SEQ ID NO: 150745 - DNA, 103 bp, Artificial Sequence
  Synthetic Polynucleotide
taatacgactcactataggggttcttcaggaggtggggccgagagctgtcaacagaggagagacagcatgcggccccacaacctggcggcagcgcaaaagatg

SEQ ID NO: 150746 - DNA, 103 bp, Artificial Sequence
  Synthetic Polynucleotide
taatacgactcactatagggggcggggagggttcttcaggaggtggggccaacagaggagaggccccatgtcctgaagaaacctggcggcagcgcaaaagatg

SEQ ID NO: 150747 - DNA, 103 bp, Artificial Sequence
  Synthetic Polynucleotide
taatacgactcactataggggggggaagggggcggggagggttcttcaggaacagaggagacctgaaatgccctccccgaacctggcggcagcgcaaaagatg

SEQ ID NO: 150748 - DNA, 103 bp, Artificial Sequence
  Synthetic Polynucleotide
taatacgactcactatagggaaggtgccaagggggaagggggcggggaggaacagaggagacctcccatgccccttcccaacctggcggcagcgcaaaagatg

SEQ ID NO: 150749 - DNA, 103 bp, Artificial Sequence
  Synthetic Polynucleotide
taatacgactcactatagggctggcaggagaaggtgccaagggggaagggaacagaggagacccttcatgcttggcaccaacctggcggcagcgcaaaagatg

SEQ ID NO: 150750 - DNA, 103 bp, Artificial Sequence
  Synthetic Polynucleotide
taatacgactcactatagggagtagggggactggcaggagaaggtgccaaaacagaggagattggcaatgtctcctgccaacctggcggcagcgcaaaagatg

SEQ ID NO: 150751 - DNA, 103 bp, Artificial Sequence
  Synthetic Polynucleotide
taatacgactcactatagggccaagggctcagtagggggactggcaggagaacagaggagactcctgatggtccccctaaacctggcggcagcgcaaaagatg

SEQ ID NO: 150752 - DNA, 103 bp, Artificial Sequence
  Synthetic Polynucleotide
taatacgactcactatagggggaagttcaaccaagggctcagtagggggaaacagaggagatcccccatgtgagcccttaacctggcggcagcgcaaaagatg

SEQ ID NO: 150753 - DNA, 103 bp, Artificial Sequence
  Synthetic Polynucleotide
taatacgactcactatagggctcctcaggcggcggagagaggggcgattcaacagaggagagaatcgatgctctctccgaacctggcggcagcgcaaaagatg

SEQ ID NO: 150754 - DNA, 103 bp, Artificial Sequence
  Synthetic Polynucleotide
taatacgactcactataggggggttcggtgggaagttcaaccaagggctcaacagaggagagagcccatggttgaacttaacctggcggcagcgcaaaagatg

SEQ ID NO: 150755 - DNA, 103 bp, Artificial Sequence
  Synthetic Polynucleotide
taatacgactcactataggggctcagccaagggttcggtgggaagttcaaaacagaggagattgaacatgccaccgaacaacctggcggcagcgcaaaagatg

SEQ ID NO: 150756 - DNA, 103 bp, Artificial Sequence
  Synthetic Polynucleotide
taatacgactcactataggggggacgggtggctcagccaagggttcggtgaacagaggagacaccgaatgcttggctgaaacctggcggcagcgcaaaagatg

SEQ ID NO: 150757 - DNA, 103 bp, Artificial Sequence
  Synthetic Polynucleotide
taatacgactcactatagggcagaggtgaggggacgggtggctcagccaaaacagaggagattggctatgccacccgtcaacctggcggcagcgcaaaagatg

SEQ ID NO: 150758 - DNA, 103 bp, Artificial Sequence
  Synthetic Polynucleotide
taatacgactcactatagggaggccagtggcagaggtgaggggacgggtgaacagaggagacacccgatgcctcacctcaacctggcggcagcgcaaaagatg

SEQ ID NO: 150759 - DNA, 103 bp, Artificial Sequence
  Synthetic Polynucleotide
taatacgactcactatagggtcaggggatgaggccagtggcagaggtgagaacagaggagactcaccatggccactggcaacctggcggcagcgcaaaagatg

SEQ ID NO: 150760 - DNA, 103 bp, Artificial Sequence
  Synthetic Polynucleotide
taatacgactcactatagggtcgggctgattcaggggatgaggccagtggaacagaggagaccactgatgtcatcccctaacctggcggcagcgcaaaagatg

SEQ ID NO: 150761 - DNA, 103 bp, Artificial Sequence
  Synthetic Polynucleotide
taatacgactcactatagggggggcttgggtcgggctgattcaggggatgaacagaggagacatcccatgaatcagcccaacctggcggcagcgcaaaagatg

SEQ ID NO: 150762 - DNA, 103 bp, Artificial Sequence
  Synthetic Polynucleotide
taatacgactcactatagggggccgggcacggggcttgggtcgggctgataacagaggagaatcagcatgacccaagccaacctggcggcagcgcaaaagatg

SEQ ID NO: 150763 - DNA, 103 bp, Artificial Sequence
  Synthetic Polynucleotide
taatacgactcactatagggttcttcagggggccgggcacggggcttgggaacagaggagacccaagatgcgtgcccggaacctggcggcagcgcaaaagatg

SEQ ID NO: 150764 - DNA, 103 bp, Artificial Sequence
  Synthetic Polynucleotide
taatacgactcactatagggacagaggagactcctcaggcggcggagagaaacagaggagatctctcatgcgcctgaggaacctggcggcagcgcaaaagatg

SEQ ID NO: 150765 - DNA, 103 bp, Artificial Sequence
  Synthetic Polynucleotide
taatacgactcactatagggaatcttcaccttcttcagggggccgggcacaacagaggagagtgcccatgcccctgaagaacctggcggcagcgcaaaagatg

SEQ ID NO: 150766 - DNA, 103 bp, Artificial Sequence
  Synthetic Polynucleotide
taatacgactcactatagggggaggacgggaatcttcaccttcttcagggaacagaggagaccctgaatgaggtgaagaaacctggcggcagcgcaaaagatg

SEQ ID NO: 150767 - DNA, 103 bp, Artificial Sequence
  Synthetic Polynucleotide
taatacgactcactatagggcttgaggcgaggaggacgggaatcttcaccaacagaggagaggtgaaatgtcccgtcctaacctggcggcagcgcaaaagatg

SEQ ID NO: 150768 - DNA, 103 bp, Artificial Sequence
  Synthetic Polynucleotide
taatacgactcactatagggctttccatttcttgaggcgaggaggacgggaacagaggagacccgtcatgctcgcctcaaacctggcggcagcgcaaaagatg

SEQ ID NO: 150769 - DNA, 103 bp, Artificial Sequence
  Synthetic Polynucleotide
taatacgactcactatagggcagcgcactcctttccatttcttgaggcgaaacagaggagatcgcctatggaaatggaaaacctggcggcagcgcaaaagatg

SEQ ID NO: 150770 - DNA, 103 bp, Artificial Sequence
  Synthetic Polynucleotide
taatacgactcactatagggaagccgcttccagcgcactcctttccatttaacagaggagaaaatggatgggagtgcgcaacctggcggcagcgcaaaagatg

SEQ ID NO: 150771 - DNA, 103 bp, Artificial Sequence
  Synthetic Polynucleotide
taatacgactcactataggggcagcagccgaagccgcttccagcgcactcaacagaggagagagtgcatgggaagcggcaacctggcggcagcgcaaaagatg

SEQ ID NO: 150772 - DNA, 103 bp, Artificial Sequence
  Synthetic Polynucleotide
taatacgactcactatagggtggatggtcagcagcagccgaagccgcttcaacagaggagagaagcgatgtcggctgctaacctggcggcagcgcaaaagatg

SEQ ID NO: 150773 - DNA, 103 bp, Artificial Sequence
  Synthetic Polynucleotide
taatacgactcactatagggactgcccttctggatggtcagcagcagccgaacagaggagacggctgatgctgaccatcaacctggcggcagcgcaaaagatg

SEQ ID NO: 150774 - DNA, 103 bp, Artificial Sequence
  Synthetic Polynucleotide
taatacgactcactatagggcctgccgcccactgcccttctggatggtcaaacagaggagatgaccaatgagaagggcaaacctggcggcagcgcaaaagatg

SEQ ID NO: 150775 - DNA, 103 bp, Artificial Sequence
  Synthetic Polynucleotide
taatacgactcactatagggtcctgaggagtctcctgaagcctgggactcaacagaggagagagtccatggcttcaggaaacctggcggcagcgcaaaagatg

SEQ ID NO: 150776 - DNA, 103 bp, Artificial Sequence
  Synthetic Polynucleotide
taatacgactcactatagggggtgggggagacagaggagactcctcaggcaacagaggagagcctgaatggtctcctctaacctggcggcagcgcaaaagatg

SEQ ID NO: 150777 - DNA, 103 bp, Artificial Sequence
  Synthetic Polynucleotide
taatacgactcactatagggcgctcatcctcctgccgcccactgcccttcaacagaggagagaagggatgtgggcggcaaacctggcggcagcgcaaaagatg

SEQ ID NO: 150778 - DNA, 103 bp, Artificial Sequence
  Synthetic Polynucleotide
taatacgactcactatagggtgccacttcccgctcatcctcctgccgcccaacagaggagagggcggatggaggatgagaacctggcggcagcgcaaaagatg

SEQ ID NO: 150779 - DNA, 103 bp, Artificial Sequence
  Synthetic Polynucleotide
taatacgactcactatagggccataaactctgccacttcccgctcatcctaacagaggagaaggatgatggggaagtggaacctggcggcagcgcaaaagatg

SEQ ID NO: 150780 - DNA, 103 bp, Artificial Sequence
  Synthetic Polynucleotide
taatacgactcactatagggccaagctgctccataaactctgccacttccaacagaggagaggaagtatgagagtttataacctggcggcagcgcaaaagatg

SEQ ID NO: 150781 - DNA, 103 bp, Artificial Sequence
  Synthetic Polynucleotide
taatacgactcactatagggcaaggctgtgccaagctgctccataaactcaacagaggagagagtttatggagcagcttaacctggcggcagcgcaaaagatg

SEQ ID NO: 150782 - DNA, 103 bp, Artificial Sequence
  Synthetic Polynucleotide
taatacgactcactatagggtgtcaggtcgcaaggctgtgccaagctgctaacagaggagaagcagcatggcacagcctaacctggcggcagcgcaaaagatg

SEQ ID NO: 150783 - DNA, 103 bp, Artificial Sequence
  Synthetic Polynucleotide
taatacgactcactatagggcgcggtaccttgtcaggtcgcaaggctgtgaacagaggagacacagcatggcgacctgaaacctggcggcagcgcaaaagatg

SEQ ID NO: 150784 - DNA, 103 bp, Artificial Sequence
  Synthetic Polynucleotide
taatacgactcactatagggacgcatgtctcgcggtaccttgtcaggtcgaacagaggagacgacctatgaaggtaccgaacctggcggcagcgcaaaagatg

SEQ ID NO: 150785 - DNA, 103 bp, Artificial Sequence
  Synthetic Polynucleotide
taatacgactcactatagggaacagcagcgacgcatgtctcgcggtacctaacagaggagaaggtacatggagacatgcaacctggcggcagcgcaaaagatg

SEQ ID NO: 150786 - DNA, 103 bp, Artificial Sequence
  Synthetic Polynucleotide
taatacgactcactatagggtcatgacagaaacagcagcgacgcatgtctaacagaggagaagacatatgtcgctgctgaacctggcggcagcgcaaaagatg

SEQ ID NO: 150787 - DNA, 103 bp, Artificial Sequence
  Synthetic Polynucleotide
taatacgactcactatagggtgatgattcaggtgggggagacagaggagaaacagaggagatctcctatgtctcccccaaacctggcggcagcgcaaaagatg

SEQ ID NO: 150788 - DNA, 103 bp, Artificial Sequence
  Synthetic Polynucleotide
taatacgactcactataggggtcaccctcctcatgacagaaacagcagcgaacagaggagacgctgcatgttctgtcataacctggcggcagcgcaaaagatg

SEQ ID NO: 150789 - DNA, 103 bp, Artificial Sequence
  Synthetic Polynucleotide
taatacgactcactatagggcagtggccccgtcaccctcctcatgacagaaacagaggagatctgtcatgaggagggtgaacctggcggcagcgcaaaagatg

SEQ ID NO: 150790 - DNA, 103 bp, Artificial Sequence
  Synthetic Polynucleotide
taatacgactcactataggggcaggcccatcagtggccccgtcaccctccaacagaggagaggagggatgcggggccacaacctggcggcagcgcaaaagatg

SEQ ID NO: 150791 - DNA, 103 bp, Artificial Sequence
  Synthetic Polynucleotide
taatacgactcactatagggcagcagacgggcaggcccatcagtggccccaacagaggagaggggccatggatgggcctaacctggcggcagcgcaaaagatg

SEQ ID NO: 150792 - DNA, 103 bp, Artificial Sequence
  Synthetic Polynucleotide
taatacgactcactatagggggtccaggttcagcagacgggcaggcccataacagaggagaatgggcatgcccgtctgcaacctggcggcagcgcaaaagatg

SEQ ID NO: 150793 - DNA, 103 bp, Artificial Sequence
  Synthetic Polynucleotide
taatacgactcactatagggcacaggtccaggtccaggttcagcagacggaacagaggagaccgtctatggaacctggaaacctggcggcagcgcaaaagatg

SEQ ID NO: 150794 - DNA, 103 bp, Artificial Sequence
  Synthetic Polynucleotide
taatacgactcactataggggaggtgcacccacaggtccaggtccaggttaacagaggagaaacctgatgctggacctgaacctggcggcagcgcaaaagatg

SEQ ID NO: 150795 - DNA, 103 bp, Artificial Sequence
  Synthetic Polynucleotide
taatacgactcactataggggggcacagttgaggtgcacccacaggtccaaacagaggagatggaccatggggtgcaccaacctggcggcagcgcaaaagatg

SEQ ID NO: 150796 - DNA, 103 bp, Artificial Sequence
  Synthetic Polynucleotide
taatacgactcactataggggtggaccaaagggcacagttgaggtgcaccaacagaggagaggtgcaatgcaactgtgcaacctggcggcagcgcaaaagatg

SEQ ID NO: 150797 - DNA, 103 bp, Artificial Sequence
  Synthetic Polynucleotide
taatacgactcactatagggatacacctccgtggaccaaagggcacagttaacagaggagaaactgtatgctttggtccaacctggcggcagcgcaaaagatg

SEQ ID NO: 150798 - DNA, 103 bp, Artificial Sequence
  Synthetic Polynucleotide
taatacgactcactataggggagaaaaaggtgatgattcaggtgggggagaacagaggagactccccatgctgaatcataacctggcggcagcgcaaaagatg

SEQ ID NO: 150799 - DNA, 103 bp, Artificial Sequence
  Synthetic Polynucleotide
taatacgactcactatagggcctgggtctcatacacctccgtggaccaaaaacagaggagatttggtatgcggaggtgtaacctggcggcagcgcaaaagatg

SEQ ID NO: 150800 - DNA, 103 bp, Artificial Sequence
  Synthetic Polynucleotide
taatacgactcactatagggagtgccccgccctgggtctcatacacctccaacagaggagaggaggtatgtgagacccaaacctggcggcagcgcaaaagatg

SEQ ID NO: 150801 - DNA, 103 bp, Artificial Sequence
  Synthetic Polynucleotide
taatacgactcactatagggcacattcatcagtgccccgccctgggtctcaacagaggagagagaccatgggcggggcaaacctggcggcagcgcaaaagatg

SEQ ID NO: 150802 - DNA, 103 bp, Artificial Sequence
  Synthetic Polynucleotide
taatacgactcactataggggggcaacctccacattcatcagtgccccgcaacagaggagagcggggatgtgatgaatgaacctggcggcagcgcaaaagatg

SEQ ID NO: 150803 - DNA, 103 bp, Artificial Sequence
  Synthetic Polynucleotide
taatacgactcactatagggcctcggtgcagggcaacctccacattcatcaacagaggagagatgaaatgggaggttgcaacctggcggcagcgcaaaagatg

SEQ ID NO: 150804 - DNA, 103 bp, Artificial Sequence
  Synthetic Polynucleotide
taatacgactcactatagggggttagcagtcctcggtgcagggcaacctcaacagaggagagaggttatgctgcaccgaaacctggcggcagcgcaaaagatg

SEQ ID NO: 150805 - DNA, 103 bp, Artificial Sequence
  Synthetic Polynucleotide
taatacgactcactataggggggagcacttggttagcagtcctcggtgcaaacagaggagatgcaccatggactgctaaaacctggcggcagcgcaaaagatg

SEQ ID NO: 150806 - DNA, 103 bp, Artificial Sequence
  Synthetic Polynucleotide
taatacgactcactatagggcgctggcacagggagcacttggttagcagtaacagaggagaactgctatgcaagtgctcaacctggcggcagcgcaaaagatg

SEQ ID NO: 150807 - DNA, 103 bp, Artificial Sequence
  Synthetic Polynucleotide
taatacgactcactatagggggcaccagttcgctggcacagggagcacttaacagaggagaaagtgcatgctgtgccagaacctggcggcagcgcaaaagatg

SEQ ID NO: 150808 - DNA, 103 bp, Artificial Sequence
  Synthetic Polynucleotide
taatacgactcactatagggagctgctggtggcaccagttcgctggcacaaacagaggagatgtgccatggaactggtgaacctggcggcagcgcaaaagatg

SEQ ID NO: 150809 - DNA, 103 bp, Artificial Sequence
  Synthetic Polynucleotide
taatacgactcactatagggtcctccagtggagaaaaaggtgatgattcaaacagaggagatgaatcatgacctttttcaacctggcggcagcgcaaaagatg

SEQ ID NO: 150810 - DNA, 103 bp, Artificial Sequence
  Synthetic Polynucleotide
taatacgactcactatagggatgcgattgcagctgctggtggcaccagttaacagaggagaaactggatgcaccagcagaacctggcggcagcgcaaaagatg

SEQ ID NO: 150811 - DNA, 103 bp, Artificial Sequence
  Synthetic Polynucleotide
taatacgactcactatagggggggcaacgcatgcgattgcagctgctggtaacagaggagaaccagcatgtgcaatcgcaacctggcggcagcgcaaaagatg

SEQ ID NO: 150812 - DNA, 103 bp, Artificial Sequence
  Synthetic Polynucleotide
taatacgactcactatagggggtagacattggggcaacgcatgcgattgcaacagaggagagcaatcatgtgcgttgccaacctggcggcagcgcaaaagatg

SEQ ID NO: 150813 - DNA, 103 bp, Artificial Sequence
  Synthetic Polynucleotide
taatacgactcactatagggcaagcaaaatggtagacattggggcaacgcaacagaggagagcgttgatgcaatgtctaaacctggcggcagcgcaaaagatg

SEQ ID NO: 150814 - DNA, 103 bp, Artificial Sequence
  Synthetic Polynucleotide
taatacgactcactatagggacggatggcacaagcaaaatggtagacattaacagaggagaaatgtcatgcattttgctaacctggcggcagcgcaaaagatg

SEQ ID NO: 150815 - DNA, 103 bp, Artificial Sequence
  Synthetic Polynucleotide
taatacgactcactatagggtgcacttggcacggatggcacaagcaaaataacagaggagaattttgatggtgccatccaacctggcggcagcgcaaaagatg

SEQ ID NO: 150816 - DNA, 103 bp, Artificial Sequence
  Synthetic Polynucleotide
taatacgactcactatagggttgaagaacatgcacttggcacggatggcaaacagaggagatgccatatgtgccaagtgaacctggcggcagcgcaaaagatg

SEQ ID NO: 150817 - DNA, 103 bp, Artificial Sequence
  Synthetic Polynucleotide
taatacgactcactatagggggtcttgtccttgaagaacatgcacttggcaacagaggagagccaagatgatgttcttcaacctggcggcagcgcaaaagatg

SEQ ID NO: 150818 - DNA, 103 bp, Artificial Sequence
  Synthetic Polynucleotide
taatacgactcactataggggacacagcatggtcttgtccttgaagaacaaacagaggagatgttctatgaggacaagaaacctggcggcagcgcaaaagatg

SEQ ID NO: 150819 - DNA, 103 bp, Artificial Sequence
  Synthetic Polynucleotide
taatacgactcactatagggttatgcattggacacagcatggtcttgtccaacagaggagaggacaaatgcatgctgtgaacctggcggcagcgcaaaagatg

SEQ ID NO: 150820 - DNA, 103 bp, Artificial Sequence
  Synthetic Polynucleotide
taatacgactcactatagggcaagggcgactcctccagtggagaaaaaggaacagaggagaccttttatgccactggagaacctggcggcagcgcaaaagatg

SEQ ID NO: 150821 - DNA, 103 bp, Artificial Sequence
  Synthetic Polynucleotide
taatacgactcactatagggccccttgatcttatgcattggacacagcataacagaggagaatgctgatgccaatgcataacctggcggcagcgcaaaagatg

SEQ ID NO: 150822 - DNA, 103 bp, Artificial Sequence
  Synthetic Polynucleotide
taatacgactcactataggggctcacagggccccttgatcttatgcattgaacagaggagacaatgcatgagatcaaggaacctggcggcagcgcaaaagatg

SEQ ID NO: 150823 - DNA, 103 bp, Artificial Sequence
  Synthetic Polynucleotide
taatacgactcactatagggctcagctcttgctcacagggccccttgatcaacagaggagagatcaaatggccctgtgaaacctggcggcagcgcaaaagatg

SEQ ID NO: 150824 - DNA, 103 bp, Artificial Sequence
  Synthetic Polynucleotide
taatacgactcactatagggagcaaaagagctcagctcttgctcacagggaacagaggagaccctgtatgcaagagctgaacctggcggcagcgcaaaagatg

SEQ ID NO: 150825 - DNA, 103 bp, Artificial Sequence
  Synthetic Polynucleotide
taatacgactcactataggggccggaagacagcaaaagagctcagctcttaacagaggagaaagagcatggctcttttgaacctggcggcagcgcaaaagatg

SEQ ID NO: 150826 - DNA, 103 bp, Artificial Sequence
  Synthetic Polynucleotide
taatacgactcactatagggatgtagacccgccggaagacagcaaaagagaacagaggagactctttatgtgtcttccgaacctggcggcagcgcaaaagatg

SEQ ID NO: 150827 - DNA, 103 bp, Artificial Sequence
  Synthetic Polynucleotide
taatacgactcactataggggtcccgctcaatgtagacccgccggaagacaacagaggagagtcttcatgcgggtctacaacctggcggcagcgcaaaagatg

SEQ ID NO: 150828 - DNA, 103 bp, Artificial Sequence
  Synthetic Polynucleotide
taatacgactcactataggggcttcacctcgtcccgctcaatgtagacccaacagaggagagggtctatgttgagcgggaacctggcggcagcgcaaaagatg

SEQ ID NO: 150829 - DNA, 103 bp, Artificial Sequence
  Synthetic Polynucleotide
taatacgactcactatagggctagcgatttgcttcacctcgtcccgctcaaacagaggagatgagcgatgcgaggtgaaaacctggcggcagcgcaaaagatg

SEQ ID NO: 150830 - DNA, 103 bp, Artificial Sequence
  Synthetic Polynucleotide
taatacgactcactatagggctgaatgatgctagcgatttgcttcacctcaacagaggagagaggtgatgcaaatcgctaacctggcggcagcgcaaaagatg

SEQ ID NO: 150831 - DNA, 103 bp, Artificial Sequence
  Synthetic Polynucleotide
taatacgactcactatagggccggtggagacaagggcgactcctccagtgaacagaggagacactggatgagtcgccctaacctggcggcagcgcaaaagatg

SEQ ID NO: 150832 - DNA, 103 bp, Artificial Sequence
  Synthetic Polynucleotide
taatacgactcactataggggttctccccgctgaatgatgctagcgatttaacagaggagaaaatcgatggcatcattcaacctggcggcagcgcaaaagatg

SEQ ID NO: 150833 - DNA, 103 bp, Artificial Sequence
  Synthetic Polynucleotide
taatacgactcactatagggatgtgcagccgttctccccgctgaatgatgaacagaggagacatcatatggcggggagaaacctggcggcagcgcaaaagatg

SEQ ID NO: 150834 - DNA, 103 bp, Artificial Sequence
  Synthetic Polynucleotide
taatacgactcactatagggcacacggaacatgtgcagccgttctccccgaacagaggagacggggaatgcggctgcacaacctggcggcagcgcaaaagatg

SEQ ID NO: 150835 - DNA, 103 bp, Artificial Sequence
  Synthetic Polynucleotide
taatacgactcactatagggcaaggccccccacacggaacatgtgcagccaacagaggagaggctgcatgtgttccgtgaacctggcggcagcgcaaaagatg

SEQ ID NO: 150836 - DNA, 103 bp, Artificial Sequence
  Synthetic Polynucleotide
taatacgactcactataggggcgtggaacacaaggccccccacacggaacaacagaggagagttccgatgggggggcctaacctggcggcagcgcaaaagatg

SEQ ID NO: 150837 - DNA, 103 bp, Artificial Sequence
  Synthetic Polynucleotide
taatacgactcactatagggctgtccgatggcgtggaacacaaggcccccaacagaggagagggggcatggtgttccacaacctggcggcagcgcaaaagatg

SEQ ID NO: 150838 - DNA, 103 bp, Artificial Sequence
  Synthetic Polynucleotide
taatacgactcactataggggaggcagcagctgtccgatggcgtggaacaaacagaggagatgttccatgccatcggacaacctggcggcagcgcaaaagatg

SEQ ID NO: 150839 - DNA, 103 bp, Artificial Sequence
  Synthetic Polynucleotide
taatacgactcactataggggccatctggtgaggcagcagctgtccgatgaacagaggagacatcggatggctgctgccaacctggcggcagcgcaaaagatg

SEQ ID NO: 150840 - DNA, 103 bp, Artificial Sequence
  Synthetic Polynucleotide
taatacgactcactatagggatgaaagtcagccatctggtgaggcagcagaacagaggagactgctgatgcaccagatgaacctggcggcagcgcaaaagatg

SEQ ID NO: 150841 - DNA, 103 bp, Artificial Sequence
  Synthetic Polynucleotide
taatacgactcactatagggcagtggcactatgaaagtcagccatctggtaacagaggagaaccagaatgctgactttcaacctggcggcagcgcaaaagatg

SEQ ID NO: 150842 - DNA, 103 bp, Artificial Sequence
  Synthetic Polynucleotide
taatacgactcactatagggggtgactcttccggtggagacaagggcgacaacagaggagagtcgccatggtctccaccaacctggcggcagcgcaaaagatg

SEQ ID NO: 150843 - DNA, 103 bp, Artificial Sequence
  Synthetic Polynucleotide
taatacgactcactatagggggatagagggcagtggcactatgaaagtcaaacagaggagatgacttatgtagtgccacaacctggcggcagcgcaaaagatg

SEQ ID NO: 150844 - DNA, 103 bp, Artificial Sequence
  Synthetic Polynucleotide
taatacgactcactataggggtagcccacgggatagagggcagtggcactaacagaggagaagtgccatggccctctataacctggcggcagcgcaaaagatg

SEQ ID NO: 150845 - DNA, 103 bp, Artificial Sequence
  Synthetic Polynucleotide
taatacgactcactataggggcgtggcctcgtagcccacgggatagagggaacagaggagaccctctatgccgtgggctaacctggcggcagcgcaaaagatg

SEQ ID NO: 150846 - DNA, 103 bp, Artificial Sequence
  Synthetic Polynucleotide
taatacgactcactatagggcaatagatgcgcgtggcctcgtagcccacgaacagaggagacgtgggatgcgaggccacaacctggcggcagcgcaaaagatg

SEQ ID NO: 150847 - DNA, 103 bp, Artificial Sequence
  Synthetic Polynucleotide
taatacgactcactataggggcggaggctccaatagatgcgcgtggcctcaacagaggagagaggccatgcgcatctataacctggcggcagcgcaaaagatg

SEQ ID NO: 150848 - DNA, 103 bp, Artificial Sequence
  Synthetic Polynucleotide
taatacgactcactataggggattgttggtgcggaggctccaatagatgcaacagaggagagcatctatgggagcctccaacctggcggcagcgcaaaagatg

SEQ ID NO: 150849 - DNA, 103 bp, Artificial Sequence
  Synthetic Polynucleotide
taatacgactcactatagggcagcagcgacgattgttggtgcggaggctcaacagaggagagagcctatgcaccaacaaaacctggcggcagcgcaaaagatg

SEQ ID NO: 150850 - DNA, 103 bp, Artificial Sequence
  Synthetic Polynucleotide
taatacgactcactatagggacagcgatagcagcagcgacgattgttggtaacagaggagaaccaacatgcgtcgctgcaacctggcggcagcgcaaaagatg

SEQ ID NO: 150851 - DNA, 103 bp, Artificial Sequence
  Synthetic Polynucleotide
taatacgactcactatagggcaccaatagaacagcgatagcagcagcgacaacagaggagagtcgctatggctatcgctaacctggcggcagcgcaaaagatg

SEQ ID NO: 150852 - DNA, 103 bp, Artificial Sequence
  Synthetic Polynucleotide
taatacgactcactatagggccgttgttctcaccaatagaacagcgatagaacagaggagactatcgatgttctattggaacctggcggcagcgcaaaagatg

SEQ ID NO: 150853 - DNA, 103 bp, Artificial Sequence
  Synthetic Polynucleotide
taatacgactcactatagggaggagatgggggtgactcttccggtggagaaacagaggagatctccaatggaagagtcaaacctggcggcagcgcaaaagatg

SEQ ID NO: 150854 - DNA, 103 bp, Artificial Sequence
  Synthetic Polynucleotide
taatacgactcactatagggctccggccgcccgttgttctcaccaatagaaacagaggagatctattatggagaacaacaacctggcggcagcgcaaaagatg

SEQ ID NO: 150855 - DNA, 103 bp, Artificial Sequence
  Synthetic Polynucleotide
taatacgactcactatagggtgattacaaactccggccgcccgttgttctaacagaggagaagaacaatgggcggccggaacctggcggcagcgcaaaagatg

SEQ ID NO: 150856 - DNA, 103 bp, Artificial Sequence
  Synthetic Polynucleotide
taatacgactcactatagggtcgatgactttgattacaaactccggccgcaacagaggagagcggccatggtttgtaataacctggcggcagcgcaaaagatg

SEQ ID NO: 150857 - DNA, 103 bp, Artificial Sequence
  Synthetic Polynucleotide
taatacgactcactatagggcaggccctgctcgatgactttgattacaaaaacagaggagatttgtaatgaaagtcatcaacctggcggcagcgcaaaagatg

SEQ ID NO: 150858 - DNA, 103 bp, Artificial Sequence
  Synthetic Polynucleotide
taatacgactcactatagggccaggtcctccaggccctgctcgatgacttaacagaggagaaagtcaatgagcagggccaacctggcggcagcgcaaaagatg

SEQ ID NO: 150859 - DNA, 103 bp, Artificial Sequence
  Synthetic Polynucleotide
taatacgactcactatagggtcagtgaagaccaggtcctccaggccctgcaacagaggagagcagggatgggaggacctaacctggcggcagcgcaaaagatg

SEQ ID NO: 150860 - DNA, 103 bp, Artificial Sequence
  Synthetic Polynucleotide
taatacgactcactataggggggagaggcgtcagtgaagaccaggtcctcaacagaggagagaggacatggtcttcactaacctggcggcagcgcaaaagatg

SEQ ID NO: 150861 - DNA, 103 bp, Artificial Sequence
  Synthetic Polynucleotide
taatacgactcactatagggacacggcctggggagaggcgtcagtgaagaaacagaggagatcttcaatgacgcctctcaacctggcggcagcgcaaaagatg

SEQ ID NO: 150862 - DNA, 103 bp, Artificial Sequence
  Synthetic Polynucleotide
taatacgactcactatagggatgcgattccacacggcctggggagaggcgaacagaggagacgcctcatgccaggccgtaacctggcggcagcgcaaaagatg

SEQ ID NO: 150863 - DNA, 103 bp, Artificial Sequence
  Synthetic Polynucleotide
taatacgactcactatagggaggctcaatgatgcgattccacacggcctgaacagaggagacaggccatgtggaatcgcaacctggcggcagcgcaaaagatg

SEQ ID NO: 150864 - DNA, 103 bp, Artificial Sequence
  Synthetic Polynucleotide
taatacgactcactatagggtctcaagtgcaggagatgggggtgactcttaacagaggagaaagagtatgccccatctcaacctggcggcagcgcaaaagatg

SEQ ID NO: 150865 - DNA, 103 bp, Artificial Sequence
  Synthetic Polynucleotide
taatacgactcactatagggtggcagccacaggctcaatgatgcgattccaacagaggagaggaatcatgtcattgagcaacctggcggcagcgcaaaagatg

SEQ ID NO: 150866 - DNA, 103 bp, Artificial Sequence
  Synthetic Polynucleotide
taatacgactcactatagggtcttttctcatggcagccacaggctcaatgaacagaggagacattgaatgtgtggctgcaacctggcggcagcgcaaaagatg

SEQ ID NO: 150867 - DNA, 103 bp, Artificial Sequence
  Synthetic Polynucleotide
taatacgactcactatagggcatgtcagcctcttttctcatggcagccacaacagaggagagtggctatgatgagaaaaaacctggcggcagcgcaaaagatg

SEQ ID NO: 150868 - DNA, 103 bp, Artificial Sequence
  Synthetic Polynucleotide
taatacgactcactatagggagagtcgcagcatgtcagcctcttttctcaaacagaggagatgagaaatgaggctgacaaacctggcggcagcgcaaaagatg

SEQ ID NO: 150869 - DNA, 103 bp, Artificial Sequence
  Synthetic Polynucleotide
taatacgactcactatagggtactcagggaagagtcgcagcatgtcagccaacagaggagaggctgaatggctgcgactaacctggcggcagcgcaaaagatg

SEQ ID NO: 150870 - DNA, 103 bp, Artificial Sequence
  Synthetic Polynucleotide
taatacgactcactataggggcccttcagatactcagggaagagtcgcagaacagaggagactgcgaatgttccctgagaacctggcggcagcgcaaaagatg

SEQ ID NO: 150871 - DNA, 103 bp, Artificial Sequence
  Synthetic Polynucleotide
taatacgactcactatagggagagctcctcgcccttcagatactcagggaaacagaggagatccctgatgatctgaaggaacctggcggcagcgcaaaagatg

SEQ ID NO: 150872 - DNA, 103 bp, Artificial Sequence
  Synthetic Polynucleotide
taatacgactcactataggggtcagcccaaagagctcctcgcccttcagaaacagaggagatctgaaatgcgaggagctaacctggcggcagcgcaaaagatg

SEQ ID NO: 150873 - DNA, 103 bp, Artificial Sequence
  Synthetic Polynucleotide
taatacgactcactatagggggcatgcaccgtcagcccaaagagctcctcaacagaggagagaggagatgtttgggctgaacctggcggcagcgcaaaagatg

SEQ ID NO: 150874 - DNA, 103 bp, Artificial Sequence
  Synthetic Polynucleotide
taatacgactcactatagggtgcgaagcacggcatgcaccgtcagcccaaaacagaggagattgggcatgcggtgcatgaacctggcggcagcgcaaaagatg

SEQ ID NO: 150875 - DNA, 103 bp, Artificial Sequence
  Synthetic Polynucleotide
taatacgactcactataggggatagaggcgtctcaagtgcaggagatgggaacagaggagacccatcatgtgcacttgaaacctggcggcagcgcaaaagatg

SEQ ID NO: 150876 - DNA, 103 bp, Artificial Sequence
  Synthetic Polynucleotide
taatacgactcactataggggattcagctatgcgaagcacggcatgcaccaacagaggagaggtgcaatgcgtgcttcgaacctggcggcagcgcaaaagatg

SEQ ID NO: 150877 - DNA, 103 bp, Artificial Sequence
  Synthetic Polynucleotide
taatacgactcactatagggcccgggcagtgattcagctatgcgaagcacaacagaggagagtgcttatgatagctgaaaacctggcggcagcgcaaaagatg

SEQ ID NO: 150878 - DNA, 103 bp, Artificial Sequence
  Synthetic Polynucleotide
taatacgactcactatagggagctctccaccccgggcagtgattcagctaaacagaggagatagctgatgcactgcccgaacctggcggcagcgcaaaagatg

SEQ ID NO: 150879 - DNA, 103 bp, Artificial Sequence
  Synthetic Polynucleotide
taatacgactcactatagggtagttttgacagctctccaccccgggcagtaacagaggagaactgccatgggtggagagaacctggcggcagcgcaaaagatg

SEQ ID NO: 150880 - DNA, 103 bp, Artificial Sequence
  Synthetic Polynucleotide
taatacgactcactataggggcggaataaatagttttgacagctctccacaacagaggagagtggagatgtgtcaaaacaacctggcggcagcgcaaaagatg

SEQ ID NO: 150881 - DNA, 103 bp, Artificial Sequence
  Synthetic Polynucleotide
taatacgactcactatagggggcgcccatagcggaataaatagttttgacaacagaggagagtcaaaatgatttattccaacctggcggcagcgcaaaagatg

SEQ ID NO: 150882 - DNA, 103 bp, Artificial Sequence
  Synthetic Polynucleotide
taatacgactcactatagggataagggggtggcgcccatagcggaataaaaacagaggagatttattatgctatgggcgaacctggcggcagcgcaaaagatg

SEQ ID NO: 150883 - DNA, 103 bp, Artificial Sequence
  Synthetic Polynucleotide
taatacgactcactatagggtggcagctccataagggggtggcgcccataaacagaggagatatgggatgcacccccttaacctggcggcagcgcaaaagatg

SEQ ID NO: 150884 - DNA, 103 bp, Artificial Sequence
  Synthetic Polynucleotide
taatacgactcactatagggtgatcatgagtggcagctccataagggggtaacagaggagaacccccatgtggagctgcaacctggcggcagcgcaaaagatg

SEQ ID NO: 150885 - DNA, 103 bp, Artificial Sequence
  Synthetic Polynucleotide
taatacgactcactatagggccagtggggttgatcatgagtggcagctccaacagaggagaggagctatgactcatgataacctggcggcagcgcaaaagatg

SEQ ID NO: 150886 - DNA, 103 bp, Artificial Sequence
  Synthetic Polynucleotide
taatacgactcactatagggcccactgcagtcctgaggagtctcctgaagaacagaggagacttcagatgactcctcagaacctggcggcagcgcaaaagatg

SEQ ID NO: 150887 - DNA, 103 bp, Artificial Sequence
  Synthetic Polynucleotide
taatacgactcactatagggaggtggtggggatagaggcgtctcaagtgcaacagaggagagcacttatgacgcctctaaacctggcggcagcgcaaaagatg

SEQ ID NO: 150888 - DNA, 103 bp, Artificial Sequence
  Synthetic Polynucleotide
taatacgactcactatagggtcgggcacagccagtggggttgatcatgagaacagaggagactcatgatgaaccccactaacctggcggcagcgcaaaagatg

SEQ ID NO: 150889 - DNA, 103 bp, Artificial Sequence
  Synthetic Polynucleotide
taatacgactcactatagggtaggctctgatcgggcacagccagtggggtaacagaggagaaccccaatggctgtgcccaacctggcggcagcgcaaaagatg

SEQ ID NO: 150890 - DNA, 103 bp, Artificial Sequence
  Synthetic Polynucleotide
taatacgactcactataggggtgaggattttaggctctgatcgggcacagaacagaggagactgtgcatgatcagagccaacctggcggcagcgcaaaagatg

SEQ ID NO: 150891 - DNA, 103 bp, Artificial Sequence
  Synthetic Polynucleotide
taatacgactcactatagggtttgtagtgtgtgaggattttaggctctgaaacagaggagatcagagatgaaaatcctcaacctggcggcagcgcaaaagatg

SEQ ID NO: 150892 - DNA, 103 bp, Artificial Sequence
  Synthetic Polynucleotide
taatacgactcactatagggtatggggccgtttgtagtgtgtgaggatttaacagaggagaaaatccatgcacactacaaacctggcggcagcgcaaaagatg

SEQ ID NO: 150893 - DNA, 103 bp, Artificial Sequence
  Synthetic Polynucleotide
taatacgactcactatagggctgttcagggtatggggccgtttgtagtgtaacagaggagaacactaatgacggccccaaacctggcggcagcgcaaaagatg

SEQ ID NO: 150894 - DNA, 103 bp, Artificial Sequence
  Synthetic Polynucleotide
taatacgactcactatagggcatgctggtgctgttcagggtatggggccgaacagaggagacggcccatgaccctgaacaacctggcggcagcgcaaaagatg

SEQ ID NO: 150895 - DNA, 103 bp, Artificial Sequence
  Synthetic Polynucleotide
taatacgactcactatagggatgccttagacatgctggtgctgttcagggaacagaggagaccctgaatggcaccagcaaacctggcggcagcgcaaaagatg

SEQ ID NO: 150896 - DNA, 103 bp, Artificial Sequence
  Synthetic Polynucleotide
taatacgactcactataggggtgctctgatatgccttagacatgctggtgaacagaggagacaccagatggtctaaggcaacctggcggcagcgcaaaagatg

SEQ ID NO: 150897 - DNA, 103 bp, Artificial Sequence
  Synthetic Polynucleotide
taatacgactcactataggggcctgtgaaggtgctctgatatgccttagaaacagaggagatctaagatgtatcagagcaacctggcggcagcgcaaaagatg

SEQ ID NO: 150898 - DNA, 103 bp, Artificial Sequence
  Synthetic Polynucleotide
taatacgactcactataggggcgatgcttcaggtggtggggatagaggcgaacagaggagacgcctcatgccccaccacaacctggcggcagcgcaaaagatg

SEQ ID NO: 150899 - DNA, 103 bp, Artificial Sequence
  Synthetic Polynucleotide
taatacgactcactatagggtgttggtctcgcctgtgaaggtgctctgataacagaggagaatcagaatgccttcacagaacctggcggcagcgcaaaagatg

SEQ ID NO: 150900 - DNA, 103 bp, Artificial Sequence
  Synthetic Polynucleotide
taatacgactcactatagggctgtagggggtgttggtctcgcctgtgaagaacagaggagacttcacatgcgagaccaaaacctggcggcagcgcaaaagatg

SEQ ID NO: 150901 - DNA, 103 bp, Artificial Sequence
  Synthetic Polynucleotide
taatacgactcactatagggaaactgcttgctgtagggggtgttggtctcaacagaggagagagaccatgaccccctacaacctggcggcagcgcaaaagatg

SEQ ID NO: 150902 - DNA, 103 bp, Artificial Sequence
  Synthetic Polynucleotide
taatacgactcactatagggtggagtgcacaaactgcttgctgtagggggaacagaggagaccccctatggcaagcagtaacctggcggcagcgcaaaagatg

SEQ ID NO: 150903 - DNA, 103 bp, Artificial Sequence
  Synthetic Polynucleotide
taatacgactcactatagggtgagatgacttggagtgcacaaactgcttgaacagaggagacaagcaatgtgtgcactcaacctggcggcagcgcaaaagatg

SEQ ID NO: 150904 - DNA, 103 bp, Artificial Sequence
  Synthetic Polynucleotide
taatacgactcactatagggccgccggtactgagatgacttggagtgcacaacagaggagagtgcacatgaagtcatctaacctggcggcagcgcaaaagatg

SEQ ID NO: 150905 - DNA, 103 bp, Artificial Sequence
  Synthetic Polynucleotide
taatacgactcactatagggcggtgcgcagccgccggtactgagatgactaacagaggagaagtcatatgagtaccggcaacctggcggcagcgcaaaagatg

SEQ ID NO: 150906 - DNA, 103 bp, Artificial Sequence
  Synthetic Polynucleotide
taatacgactcactatagggttcttccattcggtgcgcagccgccggtacaacagaggagagtaccgatggctgcgcacaacctggcggcagcgcaaaagatg

SEQ ID NO: 150907 - DNA, 103 bp, Artificial Sequence
  Synthetic Polynucleotide
taatacgactcactataggggtacacgttgttcttccattcggtgcgcagaacagaggagactgcgcatggaatggaagaacctggcggcagcgcaaaagatg

SEQ ID NO: 150908 - DNA, 103 bp, Artificial Sequence
  Synthetic Polynucleotide
taatacgactcactatagggagcgagccaggtacacgttgttcttccattaacagaggagaaatggaatgacaacgtgtaacctggcggcagcgcaaaagatg

SEQ ID NO: 150909 - DNA, 103 bp, Artificial Sequence
  Synthetic Polynucleotide
taatacgactcactatagggggggacaggggcgatgcttcaggtggtgggaacagaggagacccaccatgtgaagcatcaacctggcggcagcgcaaaagatg

SEQ ID NO: 150910 - DNA, 103 bp, Artificial Sequence
  Synthetic Polynucleotide
taatacgactcactatagggtggatacgggagcgagccaggtacacgttgaacagaggagacaacgtatgcctggctcgaacctggcggcagcgcaaaagatg

SEQ ID NO: 150911 - DNA, 103 bp, Artificial Sequence
  Synthetic Polynucleotide
taatacgactcactatagggccccaggccctggatacgggagcgagccagaacagaggagactggctatgtcccgtatcaacctggcggcagcgcaaaagatg

SEQ ID NO: 150912 - DNA, 103 bp, Artificial Sequence
  Synthetic Polynucleotide
taatacgactcactatagggctgcatagagccccaggccctggatacgggaacagaggagacccgtaatgagggcctggaacctggcggcagcgcaaaagatg

SEQ ID NO: 150913 - DNA, 103 bp, Artificial Sequence
  Synthetic Polynucleotide
taatacgactcactatagggaggtccttggctgcatagagccccaggcccaacagaggagagggcctatggctctatgcaacctggcggcagcgcaaaagatg

SEQ ID NO: 150914 - DNA, 103 bp, Artificial Sequence
  Synthetic Polynucleotide
taatacgactcactataggggtgcttttctaggtccttggctgcatagagaacagaggagactctatatggccaaggacaacctggcggcagcgcaaaagatg

SEQ ID NO: 150915 - DNA, 103 bp, Artificial Sequence
  Synthetic Polynucleotide
taatacgactcactatagggtaaccattgtgtgcttttctaggtccttggaacagaggagaccaaggatgtagaaaagcaacctggcggcagcgcaaaagatg

SEQ ID NO: 150916 - DNA, 103 bp, Artificial Sequence
  Synthetic Polynucleotide
taatacgactcactatagggatgtactcgataaccattgtgtgcttttctaacagaggagaagaaaaatgcacaatggtaacctggcggcagcgcaaaagatg

SEQ ID NO: 150917 - DNA, 103 bp, Artificial Sequence
  Synthetic Polynucleotide
taatacgactcactataggggatggtgccaatgtactcgataaccattgtaacagaggagaacaatgatgatcgagtacaacctggcggcagcgcaaaagatg

SEQ ID NO: 150918 - DNA, 103 bp, Artificial Sequence
  Synthetic Polynucleotide
taatacgactcactatagggcgttccgaatgatggtgccaatgtactcgaaacagaggagatcgagtatgttggcaccaaacctggcggcagcgcaaaagatg

SEQ ID NO: 150919 - DNA, 103 bp, Artificial Sequence
  Synthetic Polynucleotide
taatacgactcactatagggttggccacctcgttccgaatgatggtgccaaacagaggagatggcacatgcattcggaaaacctggcggcagcgcaaaagatg

SEQ ID NO: 150920 - DNA, 103 bp, Artificial Sequence
  Synthetic Polynucleotide
taatacgactcactatagggttcaaatggtggggacaggggcgatgcttcaacagaggagagaagcaatgcccctgtccaacctggcggcagcgcaaaagatg

SEQ ID NO: 150921 - DNA, 103 bp, Artificial Sequence
  Synthetic Polynucleotide
taatacgactcactatagggctcccgccggttggccacctcgttccgaataacagaggagaattcggatggaggtggccaacctggcggcagcgcaaaagatg

SEQ ID NO: 150922 - DNA, 103 bp, Artificial Sequence
  Synthetic Polynucleotide
taatacgactcactatagggcgtagattttctcccgccggttggccacctaacagaggagaaggtggatgaccggcgggaacctggcggcagcgcaaaagatg

SEQ ID NO: 150923 - DNA, 103 bp, Artificial Sequence
  Synthetic Polynucleotide
taatacgactcactatagggttctgctcttcgtagattttctcccgccggaacagaggagaccggcgatggaaaatctaaacctggcggcagcgcaaaagatg

SEQ ID NO: 150924 - DNA, 103 bp, Artificial Sequence
  Synthetic Polynucleotide
taatacgactcactataggggatgcctcgattctgctcttcgtagattttaacagaggagaaaaatcatggaagagcagaacctggcggcagcgcaaaagatg

SEQ ID NO: 150925 - DNA, 103 bp, Artificial Sequence
  Synthetic Polynucleotide
taatacgactcactatagggggaacatgtagatgcctcgattctgctcttaacagaggagaaagagcatgatcgaggcaaacctggcggcagcgcaaaagatg

SEQ ID NO: 150926 - DNA, 103 bp, Artificial Sequence
  Synthetic Polynucleotide
taatacgactcactatagggttgtttattcggaacatgtagatgcctcgaaacagaggagatcgaggatgctacatgttaacctggcggcagcgcaaaagatg

SEQ ID NO: 150927 - DNA, 103 bp, Artificial Sequence
  Synthetic Polynucleotide
taatacgactcactatagggcacatgttcattgtttattcggaacatgtaaacagaggagatacatgatgcgaataaacaacctggcggcagcgcaaaagatg

SEQ ID NO: 150928 - DNA, 103 bp, Artificial Sequence
  Synthetic Polynucleotide
taatacgactcactatagggtagcatcaatcacatgttcattgtttattcaacagaggagagaataaatgatgaacatgaacctggcggcagcgcaaaagatg

SEQ ID NO: 150929 - DNA, 103 bp, Artificial Sequence
  Synthetic Polynucleotide
taatacgactcactatagggccggtcaacgtagcatcaatcacatgttcaaacagaggagatgaacaatggattgatgcaacctggcggcagcgcaaaagatg

SEQ ID NO: 150930 - DNA, 103 bp, Artificial Sequence
  Synthetic Polynucleotide
taatacgactcactatagggggcagggccgccggtcaacgtagcatcaataacagaggagaattgatatgacgttgaccaacctggcggcagcgcaaaagatg

SEQ ID NO: 150931 - DNA, 103 bp, Artificial Sequence
  Synthetic Polynucleotide
taatacgactcactatagggaaggagattcttcaaatggtggggacagggaacagaggagaccctgtatgcaccatttgaacctggcggcagcgcaaaagatg

SEQ ID NO: 150932 - DNA, 103 bp, Artificial Sequence
  Synthetic Polynucleotide
taatacgactcactatagggtaatgtacctggcagggccgccggtcaacgaacagaggagacgttgaatggcggccctgaacctggcggcagcgcaaaagatg

SEQ ID NO: 150933 - DNA, 103 bp, Artificial Sequence
  Synthetic Polynucleotide
taatacgactcactatagggcaggaatggttaatgtacctggcagggccgaacagaggagacggcccatgcaggtacataacctggcggcagcgcaaaagatg

SEQ ID NO: 150934 - DNA, 103 bp, Artificial Sequence
  Synthetic Polynucleotide
taatacgactcactataggggttaggggcacaggaatggttaatgtacctaacagaggagaaggtacatgaaccattccaacctggcggcagcgcaaaagatg

SEQ ID NO: 150935 - DNA, 103 bp, Artificial Sequence
  Synthetic Polynucleotide
taatacgactcactatagggcggccacacagttaggggcacaggaatggtaacagaggagaaccattatggtgcccctaaacctggcggcagcgcaaaagatg

SEQ ID NO: 150936 - DNA, 103 bp, Artificial Sequence
  Synthetic Polynucleotide
taatacgactcactataggggtcacgacttcggccacacagttaggggcaaacagaggagatgccccatgctgtgtggcaacctggcggcagcgcaaaagatg

SEQ ID NO: 150937 - DNA, 103 bp, Artificial Sequence
  Synthetic Polynucleotide
taatacgactcactatagggtttgtcaaatgtcacgacttcggccacacaaacagaggagatgtgtgatggaagtcgtgaacctggcggcagcgcaaaagatg

SEQ ID NO: 150938 - DNA, 103 bp, Artificial Sequence
  Synthetic Polynucleotide
taatacgactcactatagggttttgtcctctttgtcaaatgtcacgacttaacagaggagaaagtcgatgcatttgacaaacctggcggcagcgcaaaagatg

SEQ ID NO: 150939 - DNA, 103 bp, Artificial Sequence
  Synthetic Polynucleotide
taatacgactcactatagggatgatgatgattttgtcctctttgtcaaataacagaggagaatttgaatgagaggacaaaacctggcggcagcgcaaaagatg

SEQ ID NO: 150940 - DNA, 103 bp, Artificial Sequence
  Synthetic Polynucleotide
taatacgactcactatagggccggctggagatgatgatgattttgtcctcaacagaggagagaggacatgatcatcatcaacctggcggcagcgcaaaagatg

SEQ ID NO: 150941 - DNA, 103 bp, Artificial Sequence
  Synthetic Polynucleotide
taatacgactcactatagggtggggattcgccggctggagatgatgatgaaacagaggagatcatcaatgtctccagccaacctggcggcagcgcaaaagatg

SEQ ID NO: 150942 - DNA, 103 bp, Artificial Sequence
  Synthetic Polynucleotide
taatacgactcactatagggggcggggacaaaggagattcttcaaatggtaacagaggagaaccattatgagaatctccaacctggcggcagcgcaaaagatg

SEQ ID NO: 150943 - DNA, 103 bp, Artificial Sequence
  Synthetic Polynucleotide
taatacgactcactatagggtcctctcctttggggattcgccggctggagaacagaggagactccagatggcgaatcccaacctggcggcagcgcaaaagatg

SEQ ID NO: 150944 - DNA, 103 bp, Artificial Sequence
  Synthetic Polynucleotide
taatacgactcactatagggataggttagctcctctcctttggggattcgaacagaggagacgaatcatgaaaggagagaacctggcggcagcgcaaaagatg

SEQ ID NO: 150945 - DNA, 103 bp, Artificial Sequence
  Synthetic Polynucleotide
taatacgactcactatagggactgatagtcataggttagctcctctccttaacagaggagaaaggagatgagctaacctaacctggcggcagcgcaaaagatg

SEQ ID NO: 150946 - DNA, 103 bp, Artificial Sequence
  Synthetic Polynucleotide
taatacgactcactatagggtcaaaatcaaactgatagtcataggttagcaacagaggagagctaacatgtgactatcaaacctggcggcagcgcaaaagatg

SEQ ID NO: 150947 - DNA, 103 bp, Artificial Sequence
  Synthetic Polynucleotide
taatacgactcactatagggctgatcgtcctcaaaatcaaactgatagtcaacagaggagagactatatgtttgattttaacctggcggcagcgcaaaagatg

SEQ ID NO: 150948 - DNA, 103 bp, Artificial Sequence
  Synthetic Polynucleotide
taatacgactcactatagggggatcttgtgctgatcgtcctcaaaatcaaaacagaggagattgattatgaggacgatcaacctggcggcagcgcaaaagatg

SEQ ID NO: 150949 - DNA, 103 bp, Artificial Sequence
  Synthetic Polynucleotide
taatacgactcactatagggcagtggcaggggatcttgtgctgatcgtccaacagaggagaggacgaatggcacaagataacctggcggcagcgcaaaagatg

SEQ ID NO: 150950 - DNA, 103 bp, Artificial Sequence
  Synthetic Polynucleotide
taatacgactcactatagggccaggctccacagtggcaggggatcttgtgaacagaggagacacaagatgccctgccacaacctggcggcagcgcaaaagatg

SEQ ID NO: 150951 - DNA, 103 bp, Artificial Sequence
  Synthetic Polynucleotide
taatacgactcactatagggtccgacaattccaggctccacagtggcaggaacagaggagacctgccatggtggagcctaacctggcggcagcgcaaaagatg

SEQ ID NO: 150952 - DNA, 103 bp, Artificial Sequence
  Synthetic Polynucleotide
taatacgactcactatagggttcatccatttccgacaattccaggctccaaacagaggagatggagcatggaattgtcgaacctggcggcagcgcaaaagatg

SEQ ID NO: 150953 - DNA, 103 bp, Artificial Sequence
  Synthetic Polynucleotide
taatacgactcactatagggttcctcaggtggcggggacaaaggagattcaacagaggagagaatctatgttgtccccgaacctggcggcagcgcaaaagatg

SEQ ID NO: 150954 - DNA, 103 bp, Artificial Sequence
  Synthetic Polynucleotide
taatacgactcactatagggaagtgggcaattcctcaggtggcggggacaaacagaggagatgtcccatgcacctgaggaacctggcggcagcgcaaaagatg

SEQ ID NO: 150955 - DNA, 103 bp, Artificial Sequence
  Synthetic Polynucleotide
taatacgactcactatagggggtggcggggaagtgggcaattcctcaggtaacagaggagaacctgaatgattgcccacaacctggcggcagcgcaaaagatg

SEQ ID NO: 150956 - DNA, 103 bp, Artificial Sequence
  Synthetic Polynucleotide
taatacgactcactatagggagatgcttcaggtggcggggaagtgggcaaaacagaggagattgcccatgtccccgccaaacctggcggcagcgcaaaagatg

SEQ ID NO: 150957 - DNA, 103 bp, Artificial Sequence
  Synthetic Polynucleotide
taatacgactcactataggggcaccggacccccactgcagtcctgaggagaacagaggagactcctcatgactgcagtgaacctggcggcagcgcaaaagatg

SEQ ID NO: 150958 - DNA, 103 bp, Artificial Sequence
  Synthetic Polynucleotide
taatacgactcactataggggagacaggcgagatgcttcaggtggcggggaacagaggagaccccgcatgctgaagcataacctggcggcagcgcaaaagatg

SEQ ID NO: 150959 - DNA, 103 bp, Artificial Sequence
  Synthetic Polynucleotide
taatacgactcactatagggtcaggtggtggagacaggcgagatgcttcaaacagaggagatgaagcatgtcgcctgtcaacctggcggcagcgcaaaagatg

SEQ ID NO: 150960 - DNA, 103 bp, Artificial Sequence
  Synthetic Polynucleotide
taatacgactcactataggggggtgactcctcaggtggtggagacaggcgaacagaggagacgcctgatgccaccacctaacctggcggcagcgcaaaagatg

SEQ ID NO: 150961 - DNA, 103 bp, Artificial Sequence
  Synthetic Polynucleotide
taatacgactcactataggggaggggacatgggtgactcctcaggtggtgaacagaggagacaccacatgaggagtcacaacctggcggcagcgcaaaagatg

SEQ ID NO: 150962 - DNA, 103 bp, Artificial Sequence
  Synthetic Polynucleotide
taatacgactcactatagggtcttcaggtggaggggacatgggtgactccaacagaggagaggagtcatgcatgtccccaacctggcggcagcgcaaaagatg

SEQ ID NO: 150963 - DNA, 103 bp, Artificial Sequence
  Synthetic Polynucleotide
taatacgactcactatagggcatgggtgactcttcaggtggaggggacataacagaggagaatgtccatgccacctgaaaacctggcggcagcgcaaaagatg

SEQ ID NO: 150964 - DNA, 103 bp, Artificial Sequence
  Synthetic Polynucleotide
taatacgactcactataggggtggtggagacatgggtgactcttcaggtgaacagaggagacacctgatgagtcacccaaacctggcggcagcgcaaaagatg

SEQ ID NO: 150965 - DNA, 103 bp, Artificial Sequence
  Synthetic Polynucleotide
taatacgactcactataggggatgcctccggtggtggagacatgggtgacaacagaggagagtcaccatggtctccaccaacctggcggcagcgcaaaagatg

SEQ ID NO: 150966 - DNA, 103 bp, Artificial Sequence
  Synthetic Polynucleotide
taatacgactcactataggggaacagacgagatgcctccggtggtggagaaacagaggagatctccaatgccggaggcaaacctggcggcagcgcaaaagatg

SEQ ID NO: 150967 - DNA, 103 bp, Artificial Sequence
  Synthetic Polynucleotide
taatacgactcactatagggcaaatggtgggaacagacgagatgcctccgaacagaggagacggaggatgctcgtctgtaacctggcggcagcgcaaaagatg

SEQ ID NO: 150968 - DNA, 103 bp, Artificial Sequence
  Synthetic Polynucleotide
taatacgactcactataggggcacaacgccgcaccggacccccactgcagaacagaggagactgcagatggggtccggtaacctggcggcagcgcaaaagatg

SEQ ID NO: 150969 - DNA, 103 bp, Artificial Sequence
  Synthetic Polynucleotide
taatacgactcactatagggggagactcttcaaatggtgggaacagacgaaacagaggagatcgtctatgcccaccattaacctggcggcagcgcaaaagatg

SEQ ID NO: 150970 - DNA, 103 bp, Artificial Sequence
  Synthetic Polynucleotide
taatacgactcactatagggaggggacagaggagactcttcaaatggtggaacagaggagaccaccaatggaagagtctaacctggcggcagcgcaaaagatg

SEQ ID NO: 150971 - DNA, 103 bp, Artificial Sequence
  Synthetic Polynucleotide
taatacgactcactatagggcctcaggtggaggggacagaggagactcttaacagaggagaaagagtatgctctgtcccaacctggcggcagcgcaaaagatg

SEQ ID NO: 150972 - DNA, 103 bp, Artificial Sequence
  Synthetic Polynucleotide
taatacgactcactatagggaggggagactcctcaggtggaggggacagaaacagaggagatctgtcatgtccacctgaaacctggcggcagcgcaaaagatg

SEQ ID NO: 150973 - DNA, 103 bp, Artificial Sequence
  Synthetic Polynucleotide
taatacgactcactatagggtggtggggaaaggggagactcctcaggtggaacagaggagaccacctatggagtctcccaacctggcggcagcgcaaaagatg

SEQ ID NO: 150974 - DNA, 103 bp, Artificial Sequence
  Synthetic Polynucleotide
taatacgactcactatagggatgcctcaggtggtggggaaaggggagactaacagaggagaagtctcatgtttccccacaacctggcggcagcgcaaaagatg

SEQ ID NO: 150975 - DNA, 103 bp, Artificial Sequence
  Synthetic Polynucleotide
taatacgactcactataggggacaggcgtgatgcctcaggtggtggggaaaacagaggagattccccatgacctgaggcaacctggcggcagcgcaaaagatg

SEQ ID NO: 150976 - DNA, 103 bp, Artificial Sequence
  Synthetic Polynucleotide
taatacgactcactatagggaggtggtggggacaggcgtgatgcctcaggaacagaggagacctgagatgtcacgcctgaacctggcggcagcgcaaaagatg

SEQ ID NO: 150977 - DNA, 103 bp, Artificial Sequence
  Synthetic Polynucleotide
taatacgactcactataggggcgagtcctcaggtggtggggacaggcgtgaacagaggagacacgccatgccccaccacaacctggcggcagcgcaaaagatg

SEQ ID NO: 150978 - DNA, 103 bp, Artificial Sequence
  Synthetic Polynucleotide
taatacgactcactatagggggggacataggcgagtcctcaggtggtgggaacagaggagacccaccatgtgaggactcaacctggcggcagcgcaaaagatg

SEQ ID NO: 150979 - DNA, 103 bp, Artificial Sequence
  Synthetic Polynucleotide
taatacgactcactataggggttacagagagcacaacgccgcaccggaccaacagaggagaggtccgatgcggcgttgtaacctggcggcagcgcaaaagatg

SEQ ID NO: 150980 - DNA, 103 bp, Artificial Sequence
  Synthetic Polynucleotide
taatacgactcactatagggttcaggtggtggggacataggcgagtcctcaacagaggagagaggacatgcctatgtccaacctggcggcagcgcaaaagatg

SEQ ID NO: 150981 - DNA, 103 bp, Artificial Sequence
  Synthetic Polynucleotide
taatacgactcactatagggtaggtgattcttcaggtggtggggacatagaacagaggagactatgtatgcaccacctgaacctggcggcagcgcaaaagatg

SEQ ID NO: 150982 - DNA, 103 bp, Artificial Sequence
  Synthetic Polynucleotide
taatacgactcactataggggggggggacataggtgattcttcaggtggtaacagaggagaaccaccatgagaatcaccaacctggcggcagcgcaaaagatg

SEQ ID NO: 150983 - DNA, 103 bp, Artificial Sequence
  Synthetic Polynucleotide
taatacgactcactatagggtacctcaggtgggggggacataggtgattcaacagaggagagaatcaatgatgtcccccaacctggcggcagcgcaaaagatg

SEQ ID NO: 150984 - DNA, 103 bp, Artificial Sequence
  Synthetic Polynucleotide
taatacgactcactatagggataggcgcgatacctcaggtgggggggacaaacagaggagatgtcccatgcacctgaggaacctggcggcagcgcaaaagatg

SEQ ID NO: 150985 - DNA, 103 bp, Artificial Sequence
  Synthetic Polynucleotide
taatacgactcactatagggggcaggggggataggcgcgatacctcaggtaacagaggagaacctgaatgatcgcgcctaacctggcggcagcgcaaaagatg

SEQ ID NO: 150986 - DNA, 103 bp, Artificial Sequence
  Synthetic Polynucleotide
taatacgactcactatagggtgacaccacaggcaggggggataggcgcgaaacagaggagatcgcgcatgtcccccctgaacctggcggcagcgcaaaagatg

SEQ ID NO: 150987 - DNA, 103 bp, Artificial Sequence
  Synthetic Polynucleotide
taatacgactcactataggggagacaggcgtgacaccacaggcaggggggaacagaggagaccccccatgctgtggtgtaacctggcggcagcgcaaaagatg

SEQ ID NO: 150988 - DNA, 103 bp, Artificial Sequence
  Synthetic Polynucleotide
taatacgactcactatagggtcaggcggtggagacaggcgtgacaccacaaacagaggagatgtggtatgacgcctgtcaacctggcggcagcgcaaaagatg

SEQ ID NO: 150989 - DNA, 103 bp, Artificial Sequence
  Synthetic Polynucleotide
taatacgactcactataggggggagattcctcaggcggtggagacaggcgaacagaggagacgcctgatgccaccgcctaacctggcggcagcgcaaaagatg

SEQ ID NO: 150990 - DNA, 103 bp, Artificial Sequence
  Synthetic Polynucleotide
taatacgactcactatagggctgaatctttatcctcaccagccagcttctaacagaggagaagaagcatgctggtgaggaacctggcggcagcgcaaaagatg

SEQ ID NO: 150991 - DNA, 103 bp, Artificial Sequence
  Synthetic Polynucleotide
taatacgactcactataggggctccccgcagttacagagagcacaacgccaacagaggagaggcgttatgctctctgtaaacctggcggcagcgcaaaagatg

SEQ ID NO: 150992 - DNA, 103 bp, Artificial Sequence
  Synthetic Polynucleotide
taatacgactcactataggggtggggacaagggagattcctcaggcggtgaacagaggagacaccgcatgaggaatctcaacctggcggcagcgcaaaagatg

SEQ ID NO: 150993 - DNA, 103 bp, Artificial Sequence
  Synthetic Polynucleotide
taatacgactcactatagggtcctcaggcggtggggacaagggagattccaacagaggagaggaatcatgcttgtccccaacctggcggcagcgcaaaagatg

SEQ ID NO: 150994 - DNA, 103 bp, Artificial Sequence
  Synthetic Polynucleotide
taatacgactcactatagggcgtgggagactcctcaggcggtggggacaaaacagaggagattgtccatgccgcctgagaacctggcggcagcgcaaaagatg

SEQ ID NO: 150995 - DNA, 103 bp, Artificial Sequence
  Synthetic Polynucleotide
taatacgactcactataggggtggaggggacgtgggagactcctcaggcgaacagaggagacgcctgatgagtctcccaaacctggcggcagcgcaaaagatg

SEQ ID NO: 150996 - DNA, 103 bp, Artificial Sequence
  Synthetic Polynucleotide
taatacgactcactataggggaagcctcaggtggaggggacgtgggagacaacagaggagagtctccatggtcccctccaacctggcggcagcgcaaaagatg

SEQ ID NO: 150997 - DNA, 103 bp, Artificial Sequence
  Synthetic Polynucleotide
taatacgactcactatagggggagaggcgtgaagcctcaggtggaggggaaacagaggagatcccctatgcctgaggctaacctggcggcagcgcaaaagatg

SEQ ID NO: 150998 - DNA, 103 bp, Artificial Sequence
  Synthetic Polynucleotide
taatacgactcactatagggcaggtggtggggagaggcgtgaagcctcagaacagaggagactgaggatgcacgcctctaacctggcggcagcgcaaaagatg

SEQ ID NO: 150999 - DNA, 103 bp, Artificial Sequence
  Synthetic Polynucleotide
taatacgactcactatagggggggagtcctcaggtggtggggagaggcgtaacagaggagaacgcctatgcccaccaccaacctggcggcagcgcaaaagatg

SEQ ID NO: 151000 - DNA, 103 bp, Artificial Sequence
  Synthetic Polynucleotide
taatacgactcactatagggtggggatgtgggggagtcctcaggtggtggaacagaggagaccaccaatggaggactccaacctggcggcagcgcaaaagatg

SEQ ID NO: 151001 - DNA, 103 bp, Artificial Sequence
  Synthetic Polynucleotide
taatacgactcactatagggcctcaggtggtggggatgtgggggagtcctaacagaggagaaggactatgccacatcccaacctggcggcagcgcaaaagatg

SEQ ID NO: 151002 - DNA, 103 bp, Artificial Sequence
  Synthetic Polynucleotide
taatacgactcactatagggtgtagactgggctccccgcagttacagagaaacagaggagatctctgatgctgcggggaaacctggcggcagcgcaaaagatg

SEQ ID NO: 151003 - DNA, 103 bp, Artificial Sequence
  Synthetic Polynucleotide
taatacgactcactataggggcaggtgagtcctcaggtggtggggatgtgaacagaggagacacatcatgaccacctgaaacctggcggcagcgcaaaagatg

SEQ ID NO: 151004 - DNA, 103 bp, Artificial Sequence
  Synthetic Polynucleotide
taatacgactcactatagggtggtggggaagcaggtgagtcctcaggtggaacagaggagaccacctatggactcacctaacctggcggcagcgcaaaagatg

SEQ ID NO: 151005 - DNA, 103 bp, Artificial Sequence
  Synthetic Polynucleotide
taatacgactcactatagggagtcctccggtggtggggaagcaggtgagtaacagaggagaactcacatgcttccccacaacctggcggcagcgcaaaagatg

SEQ ID NO: 151006 - DNA, 103 bp, Artificial Sequence
  Synthetic Polynucleotide
taatacgactcactataggggacatgagcgagtcctccggtggtggggaaaacagaggagattccccatgaccggaggaaacctggcggcagcgcaaaagatg

SEQ ID NO: 151007 - DNA, 103 bp, Artificial Sequence
  Synthetic Polynucleotide
taatacgactcactatagggcagcggcagggacatgagcgagtcctccggaacagaggagaccggagatgtcgctcatgaacctggcggcagcgcaaaagatg

SEQ ID NO: 151008 - DNA, 103 bp, Artificial Sequence
  Synthetic Polynucleotide
taatacgactcactataggggtgactcctccagcggcagggacatgagcgaacagaggagacgctcaatgccctgccgcaacctggcggcagcgcaaaagatg

SEQ ID NO: 151009 - DNA, 103 bp, Artificial Sequence
  Synthetic Polynucleotide
taatacgactcactatagggggcaacaggggtgactcctccagcggcaggaacagaggagacctgccatgggaggagtcaacctggcggcagcgcaaaagatg

SEQ ID NO: 151010 - DNA, 103 bp, Artificial Sequence
  Synthetic Polynucleotide
taatacgactcactatagggctcaggtagtggcaacaggggtgactcctcaacagaggagagaggagatgcccctgttgaacctggcggcagcgcaaaagatg

SEQ ID NO: 151011 - DNA, 103 bp, Artificial Sequence
  Synthetic Polynucleotide
taatacgactcactataggggttgcggctcctcaggtagtggcaacagggaacagaggagaccctgtatgcactacctgaacctggcggcagcgcaaaagatg

SEQ ID NO: 151012 - DNA, 103 bp, Artificial Sequence
  Synthetic Polynucleotide
taatacgactcactatagggcgggggcagagttgcggctcctcaggtagtaacagaggagaactaccatgggagccgcaaacctggcggcagcgcaaaagatg

SEQ ID NO: 151013 - DNA, 103 bp, Artificial Sequence
  Synthetic Polynucleotide
taatacgactcactatagggccgctgcccgtgtagactgggctccccgcaaacagaggagatgcgggatgcccagtctaaacctggcggcagcgcaaaagatg

SEQ ID NO: 151014 - DNA, 103 bp, Artificial Sequence
  Synthetic Polynucleotide
taatacgactcactatagggcccctcggaccgggggcagagttgcggctcaacagaggagagagccgatgctctgccccaacctggcggcagcgcaaaagatg

SEQ ID NO: 151015 - DNA, 103 bp, Artificial Sequence
  Synthetic Polynucleotide
taatacgactcactatagggacaggtgcggcccctcggaccgggggcagaaacagaggagatctgccatgggtccgaggaacctggcggcagcgcaaaagatg

SEQ ID NO: 151016 - DNA, 103 bp, Artificial Sequence
  Synthetic Polynucleotide
taatacgactcactatagggggccggggtgacaggtgcggcccctcggacaacagaggagagtccgaatggccgcacctaacctggcggcagcgcaaaagatg

SEQ ID NO: 151017 - DNA, 103 bp, Artificial Sequence
  Synthetic Polynucleotide
taatacgactcactatagggcggctcctcaggccggggtgacaggtgcggaacagaggagaccgcacatgtcaccccggaacctggcggcagcgcaaaagatg

SEQ ID NO: 151018 - DNA, 103 bp, Artificial Sequence
  Synthetic Polynucleotide
taatacgactcactataggggggacaggtgcggctcctcaggccggggtgaacagaggagacaccccatgctgaggagcaacctggcggcagcgcaaaagatg

SEQ ID NO: 151019 - DNA, 103 bp, Artificial Sequence
  Synthetic Polynucleotide
taatacgactcactatagggtcaggccggggggacaggtgcggctcctcaaacagaggagatgaggaatggcacctgtcaacctggcggcagcgcaaaagatg

SEQ ID NO: 151020 - DNA, 103 bp, Artificial Sequence
  Synthetic Polynucleotide
taatacgactcactataggggtgtggctcctcaggccggggggacaggtgaacagaggagacacctgatgccccggcctaacctggcggcagcgcaaaagatg

SEQ ID NO: 151021 - DNA, 103 bp, Artificial Sequence
  Synthetic Polynucleotide
taatacgactcactataggggcggagataggtgtggctcctcaggccgggaacagaggagacccggcatgaggagccacaacctggcggcagcgcaaaagatg

SEQ ID NO: 151022 - DNA, 103 bp, Artificial Sequence
  Synthetic Polynucleotide
taatacgactcactatagggtcctcagcctgcggagataggtgtggctccaacagaggagaggagccatgcctatctccaacctggcggcagcgcaaaagatg

SEQ ID NO: 151023 - DNA, 103 bp, Artificial Sequence
  Synthetic Polynucleotide
taatacgactcactatagggcaggtgtggctcctcagcctgcggagatagaacagaggagactatctatgcaggctgagaacctggcggcagcgcaaaagatg

SEQ ID NO: 151024 - DNA, 103 bp, Artificial Sequence
  Synthetic Polynucleotide
taatacgactcactataggggccgtagctcccgctgcccgtgtagactggaacagaggagaccagtcatgacgggcagcaacctggcggcagcgcaaaagatg

SEQ ID NO: 151025 - DNA, 103 bp, Artificial Sequence
  Synthetic Polynucleotide
taatacgactcactataggggctggggggacaggtgtggctcctcagcctaacagaggagaaggctgatgagccacaccaacctggcggcagcgcaaaagatg

SEQ ID NO: 151026 - DNA, 103 bp, Artificial Sequence
  Synthetic Polynucleotide
taatacgactcactatagggggctcctcaggctggggggacaggtgtggcaacagaggagagccacaatggtccccccaaacctggcggcagcgcaaaagatg

SEQ ID NO: 151027 - DNA, 103 bp, Artificial Sequence
  Synthetic Polynucleotide
taatacgactcactataggggcataggcatggctcctcaggctggggggaaacagaggagatcccccatgcctgaggagaacctggcggcagcgcaaaagatg

SEQ ID NO: 151028 - DNA, 103 bp, Artificial Sequence
  Synthetic Polynucleotide
taatacgactcactatagggcaggcacagcgcataggcatggctcctcagaacagaggagactgaggatgcatgcctataacctggcggcagcgcaaaagatg

SEQ ID NO: 151029 - DNA, 103 bp, Artificial Sequence
  Synthetic Polynucleotide
taatacgactcactatagggtgtggctcctcaggcacagcgcataggcataacagaggagaatgcctatgcgctgtgccaacctggcggcagcgcaaaagatg

SEQ ID NO: 151030 - DNA, 103 bp, Artificial Sequence
  Synthetic Polynucleotide
taatacgactcactataggggggggacaagtgtggctcctcaggcacagcaacagaggagagctgtgatggaggagccaaacctggcggcagcgcaaaagatg

SEQ ID NO: 151031 - DNA, 103 bp, Artificial Sequence
  Synthetic Polynucleotide
taatacgactcactatagggcctcagcctggggggacaagtgtggctcctaacagaggagaaggagcatgacttgtcccaacctggcggcagcgcaaaagatg

SEQ ID NO: 151032 - DNA, 103 bp, Artificial Sequence
  Synthetic Polynucleotide
taatacgactcactatagggagatgtggtccctcagcctggggggacaagaacagaggagacttgtcatgccaggctgaaacctggcggcagcgcaaaagatg

SEQ ID NO: 151033 - DNA, 103 bp, Artificial Sequence
  Synthetic Polynucleotide
taatacgactcactatagggctgaggggacagatgtggtccctcagcctgaacagaggagacaggctatgggaccacataacctggcggcagcgcaaaagatg

SEQ ID NO: 151034 - DNA, 103 bp, Artificial Sequence
  Synthetic Polynucleotide
taatacgactcactatagggattcctcaggctgaggggacagatgtggtcaacagaggagagaccacatgtgtcccctcaacctggcggcagcgcaaaagatg

SEQ ID NO: 151035 - DNA, 103 bp, Artificial Sequence
  Synthetic Polynucleotide
taatacgactcactatagggaactcaaagcgccgtagctcccgctgcccgaacagaggagacgggcaatgggagctacgaacctggcggcagcgcaaaagatg

SEQ ID NO: 151036 - DNA, 103 bp, Artificial Sequence
  Synthetic Polynucleotide
taatacgactcactataggggacaggtgcaattcctcaggctgaggggacaacagaggagagtccccatggcctgaggaaacctggcggcagcgcaaaagatg

SEQ ID NO: 151037 - DNA, 103 bp, Artificial Sequence
  Synthetic Polynucleotide
taatacgactcactatagggagtctggggggacaggtgcaattcctcaggaacagaggagacctgagatgttgcacctgaacctggcggcagcgcaaaagatg

SEQ ID NO: 151038 - DNA, 103 bp, Artificial Sequence
  Synthetic Polynucleotide
taatacgactcactataggggcggctcctcagtctggggggacaggtgcaaacagaggagatgcaccatgccccccagaaacctggcggcagcgcaaaagatg

SEQ ID NO: 151039 - DNA, 103 bp, Artificial Sequence
  Synthetic Polynucleotide
taatacgactcactatagggggagacaggtgcggctcctcagtctgggggaacagaggagacccccaatgtgaggagccaacctggcggcagcgcaaaagatg

SEQ ID NO: 151040 - DNA, 103 bp, Artificial Sequence
  Synthetic Polynucleotide
taatacgactcactatagggctcaggcacaggagacaggtgcggctcctcaacagaggagagaggagatgcacctgtctaacctggcggcagcgcaaaagatg

SEQ ID NO: 151041 - DNA, 103 bp, Artificial Sequence
  Synthetic Polynucleotide
taatacgactcactatagggagcatggctcctcaggcacaggagacaggtaacagaggagaacctgtatgctgtgcctgaacctggcggcagcgcaaaagatg

SEQ ID NO: 151042 - DNA, 103 bp, Artificial Sequence
  Synthetic Polynucleotide
taatacgactcactatagggtggggggacaagcatggctcctcaggcacaaacagaggagatgtgccatgggagccatgaacctggcggcagcgcaaaagatg

SEQ ID NO: 151043 - DNA, 103 bp, Artificial Sequence
  Synthetic Polynucleotide
taatacgactcactatagggttcctcaggttggggggacaagcatggctcaacagaggagagagccaatgttgtcccccaacctggcggcagcgcaaaagatg

SEQ ID NO: 151044 - DNA, 103 bp, Artificial Sequence
  Synthetic Polynucleotide
taatacgactcactatagggacaggtgtgattcctcaggttggggggacaaacagaggagatgtcccatgaacctgaggaacctggcggcagcgcaaaagatg

SEQ ID NO: 151045 - DNA, 103 bp, Artificial Sequence
  Synthetic Polynucleotide
taatacgactcactataggggactggggggacaggtgtgattcctcaggtaacagaggagaacctgaatgatcacacctaacctggcggcagcgcaaaagatg

SEQ ID NO: 151046 - DNA, 103 bp, Artificial Sequence
  Synthetic Polynucleotide
taatacgactcactatagggatcaaatggcaactcaaagcgccgtagctcaacagaggagagagctaatgcgctttgagaacctggcggcagcgcaaaagatg

SEQ ID NO: 151047 - DNA, 103 bp, Artificial Sequence
  Synthetic Polynucleotide
taatacgactcactatagggtggctcctcagactggggggacaggtgtgaaacagaggagatcacacatgtccccccagaacctggcggcagcgcaaaagatg

SEQ ID NO: 151048 - DNA, 103 bp, Artificial Sequence
  Synthetic Polynucleotide
taatacgactcactataggggggacaggcatggctcctcagactggggggaacagaggagaccccccatgctgaggagcaacctggcggcagcgcaaaagatg

SEQ ID NO: 151049 - DNA, 103 bp, Artificial Sequence
  Synthetic Polynucleotide
taatacgactcactatagggtcaggccggggggacaggcatggctcctcaaacagaggagatgaggaatgatgcctgtcaacctggcggcagcgcaaaagatg

SEQ ID NO: 151050 - DNA, 103 bp, Artificial Sequence
  Synthetic Polynucleotide
taatacgactcactatagggatgcgattcctcaggccggggggacaggcaaacagaggagatgcctgatgccccggcctaacctggcggcagcgcaaaagatg

SEQ ID NO: 151051 - DNA, 103 bp, Artificial Sequence
  Synthetic Polynucleotide
taatacgactcactatagggcaggggacagatgcgattcctcaggccgggaacagaggagacccggcatgaggaatcgcaacctggcggcagcgcaaaagatg

SEQ ID NO: 151052 - DNA, 103 bp, Artificial Sequence
  Synthetic Polynucleotide
taatacgactcactatagggttctcaagctcaggggacagatgcgattccaacagaggagaggaatcatgtctgtccccaacctggcggcagcgcaaaagatg

SEQ ID NO: 151053 - DNA, 103 bp, Artificial Sequence
  Synthetic Polynucleotide
taatacgactcactatagggcaggggtggcttctcaagctcaggggacagaacagaggagactgtccatggagcttgagaacctggcggcagcgcaaaagatg

SEQ ID NO: 151054 - DNA, 103 bp, Artificial Sequence
  Synthetic Polynucleotide
taatacgactcactataggggccgaggggacaggggtggcttctcaagctaacagaggagaagcttgatgagccaccccaacctggcggcagcgcaaaagatg

SEQ ID NO: 151055 - DNA, 103 bp, Artificial Sequence
  Synthetic Polynucleotide
taatacgactcactatagggggcttttcaggccgaggggacaggggtggcaacagaggagagccaccatggtcccctcgaacctggcggcagcgcaaaagatg

SEQ ID NO: 151056 - DNA, 103 bp, Artificial Sequence
  Synthetic Polynucleotide
taatacgactcactatagggctcctcagggggcttttcaggccgaggggaaacagaggagatcccctatgcctgaaaagaacctggcggcagcgcaaaagatg

SEQ ID NO: 151057 - DNA, 103 bp, Artificial Sequence
  Synthetic Polynucleotide
taatacgactcactatagggaccggggccaatcaaatggcaactcaaagcaacagaggagagctttgatgtgccatttgaacctggcggcagcgcaaaagatg

SEQ ID NO: 151058 - DNA, 103 bp, Artificial Sequence
  Synthetic Polynucleotide
taatacgactcactatagggattggcctggctcctcagggggcttttcagaacagaggagactgaaaatgcccctgaggaacctggcggcagcgcaaaagatg

SEQ ID NO: 151059 - DNA, 103 bp, Artificial Sequence
  Synthetic Polynucleotide
taatacgactcactatagggggtgcagggcattggcctggctcctcagggaacagaggagaccctgaatggccaggccaaacctggcggcagcgcaaaagatg

SEQ ID NO: 151060 - DNA, 103 bp, Artificial Sequence
  Synthetic Polynucleotide
taatacgactcactatagggcagctcctcaggtgcagggcattggcctggaacagaggagaccaggcatgtgccctgcaaacctggcggcagcgcaaaagatg

SEQ ID NO: 151061 - DNA, 103 bp, Artificial Sequence
  Synthetic Polynucleotide
taatacgactcactatagggggaacaagggcagctcctcaggtgcagggcaacagaggagagccctgatgctgaggagcaacctggcggcagcgcaaaagatg

SEQ ID NO: 151062 - DNA, 103 bp, Artificial Sequence
  Synthetic Polynucleotide
taatacgactcactatagggccagggggagggaacaagggcagctcctcaaacagaggagatgaggaatggcccttgttaacctggcggcagcgcaaaagatg

SEQ ID NO: 151063 - DNA, 103 bp, Artificial Sequence
  Synthetic Polynucleotide
taatacgactcactatagggggatggttccccagggggagggaacaagggaacagaggagacccttgatgcctccccctaacctggcggcagcgcaaaagatg

SEQ ID NO: 151064 - DNA, 103 bp, Artificial Sequence
  Synthetic Polynucleotide
taatacgactcactatagggagggagataaggatggttccccagggggagaacagaggagactccccatggggaaccataacctggcggcagcgcaaaagatg

SEQ ID NO: 151065 - DNA, 103 bp, Artificial Sequence
  Synthetic Polynucleotide
taatacgactcactatagggtctccaagcaagggagataaggatggttccaacagaggagaggaaccatgcttatctccaacctggcggcagcgcaaaagatg

SEQ ID NO: 151066 - DNA, 103 bp, Artificial Sequence
  Synthetic Polynucleotide
taatacgactcactatagggcagggctggctctccaagcaagggagataaaacagaggagattatctatgttgcttggaaacctggcggcagcgcaaaagatg

SEQ ID NO: 151067 - DNA, 103 bp, Artificial Sequence
  Synthetic Polynucleotide
taatacgactcactatagggcaggctcagacagggctggctctccaagcaaacagaggagatgcttgatgagccagcccaacctggcggcagcgcaaaagatg

SEQ ID NO: 151068 - DNA, 103 bp, Artificial Sequence
  Synthetic Polynucleotide
taatacgactcactatagggaccactggacaccggggccaatcaaatggcaacagaggagagccattatgttggccccgaacctggcggcagcgcaaaagatg

SEQ ID NO: 151069 - DNA, 103 bp, Artificial Sequence
  Synthetic Polynucleotide
taatacgactcactatagggggtggttccccaggctcagacagggctggcaacagaggagagccagcatggtctgagccaacctggcggcagcgcaaaagatg

SEQ ID NO: 151070 - DNA, 103 bp, Artificial Sequence
  Synthetic Polynucleotide
taatacgactcactatagggaggggacagaggtggttccccaggctcagaaacagaggagatctgagatgggggaaccaaacctggcggcagcgcaaaagatg

SEQ ID NO: 151071 - DNA, 103 bp, Artificial Sequence
  Synthetic Polynucleotide
taatacgactcactatagggcctcgggcagaggggacagaggtggttcccaacagaggagagggaacatgctctgtcccaacctggcggcagcgcaaaagatg

SEQ ID NO: 151072 - DNA, 103 bp, Artificial Sequence
  Synthetic Polynucleotide
taatacgactcactatagggaacggcagctcctcgggcagaggggacagaaacagaggagatctgtcatgtctgcccgaaacctggcggcagcgcaaaagatg

SEQ ID NO: 151073 - DNA, 103 bp, Artificial Sequence
  Synthetic Polynucleotide
taatacgactcactatagggagatggggacaacggcagctcctcgggcagaacagaggagactgcccatggagctgccgaacctggcggcagcgcaaaagatg

SEQ ID NO: 151074 - DNA, 103 bp, Artificial Sequence
  Synthetic Polynucleotide
taatacgactcactatagggatggctccccagatggggacaacggcagctaacagaggagaagctgcatgtgtccccataacctggcggcagcgcaaaagatg

SEQ ID NO: 151075 - DNA, 103 bp, Artificial Sequence
  Synthetic Polynucleotide
taatacgactcactatagggggcgacaaggatggctccccagatggggacaacagaggagagtccccatgtggggagccaacctggcggcagcgcaaaagatg

SEQ ID NO: 151076 - DNA, 103 bp, Artificial Sequence
  Synthetic Polynucleotide
taatacgactcactatagggcatcagctgaggcgacaaggatggctccccaacagaggagaggggagatgtccttgtcgaacctggcggcagcgcaaaagatg

SEQ ID NO: 151077 - DNA, 103 bp, Artificial Sequence
  Synthetic Polynucleotide
taatacgactcactataggggatctggtggcatcagctgaggcgacaaggaacagaggagaccttgtatgctcagctgaaacctggcggcagcgcaaaagatg

SEQ ID NO: 151078 - DNA, 103 bp, Artificial Sequence
  Synthetic Polynucleotide
taatacgactcactatagggggaggaaggggatctggtggcatcagctgaaacagaggagatcagctatggccaccagaaacctggcggcagcgcaaaagatg

SEQ ID NO: 151079 - DNA, 103 bp, Artificial Sequence
  Synthetic Polynucleotide
taatacgactcactatagggcccaggggacaccactggacaccggggccaaacagaggagatggcccatgtgtccagtgaacctggcggcagcgcaaaagatg

SEQ ID NO: 151080 - DNA, 103 bp, Artificial Sequence
  Synthetic Polynucleotide
taatacgactcactatagggtgagagtggaggaggaaggggatctggtggaacagaggagaccaccaatgccccttcctaacctggcggcagcgcaaaagatg

SEQ ID NO: 151081 - DNA, 103 bp, Artificial Sequence
  Synthetic Polynucleotide
taatacgactcactatagggtgatgatgggtgagagtggaggaggaagggaacagaggagacccttcatgctccactctaacctggcggcagcgcaaaagatg

SEQ ID NO: 151082 - DNA, 103 bp, Artificial Sequence
  Synthetic Polynucleotide
taatacgactcactataggggccgcagctgtgatgatgggtgagagtggaaacagaggagatccactatgacccatcataacctggcggcagcgcaaaagatg

SEQ ID NO: 151083 - DNA, 103 bp, Artificial Sequence
  Synthetic Polynucleotide
taatacgactcactatagggggccggtggggccgcagctgtgatgatgggaacagaggagacccatcatgacagctgcgaacctggcggcagcgcaaaagatg

SEQ ID NO: 151084 - DNA, 103 bp, Artificial Sequence
  Synthetic Polynucleotide
taatacgactcactatagggaaggagacagggccggtggggccgcagctgaacagaggagacagctgatgccccaccggaacctggcggcagcgcaaaagatg

SEQ ID NO: 151085 - DNA, 103 bp, Artificial Sequence
  Synthetic Polynucleotide
taatacgactcactatagggaactcccccaaaggagacagggccggtgggaacagaggagacccaccatgcctgtctccaacctggcggcagcgcaaaagatg

SEQ ID NO: 151086 - DNA, 103 bp, Artificial Sequence
  Synthetic Polynucleotide
taatacgactcactatagggggggtactctaactcccccaaaggagacagaacagaggagactgtctatgttgggggagaacctggcggcagcgcaaaagatg

SEQ ID NO: 151087 - DNA, 103 bp, Artificial Sequence
  Synthetic Polynucleotide
taatacgactcactatagggtggcaccaaaggggtactctaactcccccaaacagaggagatgggggatgtagagtaccaacctggcggcagcgcaaaagatg

SEQ ID NO: 151088 - DNA, 103 bp, Artificial Sequence
  Synthetic Polynucleotide
taatacgactcactatagggctgtcccctttggcaccaaaggggtactctaacagaggagaagagtaatgctttggtgcaacctggcggcagcgcaaaagatg

SEQ ID NO: 151089 - DNA, 103 bp, Artificial Sequence
  Synthetic Polynucleotide
taatacgactcactatagggctcagggtcactgtcccctttggcaccaaaaacagaggagatttggtatgaaaggggacaacctggcggcagcgcaaaagatg

SEQ ID NO: 151090 - DNA, 103 bp, Artificial Sequence
  Synthetic Polynucleotide
taatacgactcactatagggctgggctccccccaggggacaccactggacaacagaggagagtccagatgtgtcccctgaacctggcggcagcgcaaaagatg

SEQ ID NO: 151091 - DNA, 103 bp, Artificial Sequence
  Synthetic Polynucleotide
taatacgactcactatagggccaacggtgactcagggtcactgtccccttaacagaggagaaaggggatggtgaccctgaacctggcggcagcgcaaaagatg

SEQ ID NO: 151092 - DNA, 103 bp, Artificial Sequence
  Synthetic Polynucleotide
taatacgactcactatagggatgggggcagccaacggtgactcagggtcaaacagaggagatgacccatggtcaccgttaacctggcggcagcgcaaaagatg

SEQ ID NO: 151093 - DNA, 103 bp, Artificial Sequence
  Synthetic Polynucleotide
taatacgactcactatagggtgtctccaggatgggggcagccaacggtgaaacagaggagatcaccgatggctgcccccaacctggcggcagcgcaaaagatg

SEQ ID NO: 151094 - DNA, 103 bp, Artificial Sequence
  Synthetic Polynucleotide
taatacgactcactatagggggctgatgggtgtctccaggatgggggcagaacagaggagactgcccatgtcctggagaaacctggcggcagcgcaaaagatg

SEQ ID NO: 151095 - DNA, 103 bp, Artificial Sequence
  Synthetic Polynucleotide
taatacgactcactatagggtctggtggagggctgatgggtgtctccaggaacagaggagacctggaatgacccatcagaacctggcggcagcgcaaaagatg

SEQ ID NO: 151096 - DNA, 103 bp, Artificial Sequence
  Synthetic Polynucleotide
taatacgactcactataggggcagttagcttctggtggagggctgatgggaacagaggagacccatcatgcctccaccaaacctggcggcagcgcaaaagatg

SEQ ID NO: 151097 - DNA, 103 bp, Artificial Sequence
  Synthetic Polynucleotide
taatacgactcactatagggcagggtcagtgcagttagcttctggtggagaacagaggagactccacatgaagctaactaacctggcggcagcgcaaaagatg

SEQ ID NO: 151098 - DNA, 103 bp, Artificial Sequence
  Synthetic Polynucleotide
taatacgactcactataggggggacaggctcagggtcagtgcagttagctaacagaggagaagctaaatgcactgacccaacctggcggcagcgcaaaagatg

SEQ ID NO: 151099 - DNA, 103 bp, Artificial Sequence
  Synthetic Polynucleotide
taatacgactcactataggggatcataggggggacaggctcagggtcagtaacagaggagaactgacatggagcctgtcaacctggcggcagcgcaaaagatg

SEQ ID NO: 151100 - DNA, 103 bp, Artificial Sequence
  Synthetic Polynucleotide
taatacgactcactatagggatgggggaaggatcataggggggacaggctaacagaggagaagcctgatgcccctatgaaacctggcggcagcgcaaaagatg

SEQ ID NO: 151101 - DNA, 103 bp, Artificial Sequence
  Synthetic Polynucleotide
taatacgactcactataggggctgccggttctgaatctttatcctcaccaaacagaggagatggtgaatgtaaagattcaacctggcggcagcgcaaaagatg

SEQ ID NO: 151102 - DNA, 103 bp, Artificial Sequence
  Synthetic Polynucleotide
taatacgactcactatagggtcattgggccctgggctccccccaggggacaacagaggagagtccccatgggggagcccaacctggcggcagcgcaaaagatg

SEQ ID NO: 151103 - DNA, 103 bp, Artificial Sequence
  Synthetic Polynucleotide
taatacgactcactataggggagcctggagatgggggaaggatcatagggaacagaggagaccctatatgccttcccccaacctggcggcagcgcaaaagatg

SEQ ID NO: 151104 - DNA, 103 bp, Artificial Sequence
  Synthetic Polynucleotide
taatacgactcactatagggccccactggggagcctggagatgggggaagaacagaggagacttcccatgtctccaggcaacctggcggcagcgcaaaagatg

SEQ ID NO: 151105 - DNA, 103 bp, Artificial Sequence
  Synthetic Polynucleotide
taatacgactcactataggggagaagccggccccactggggagcctggagaacagaggagactccagatgccccagtggaacctggcggcagcgcaaaagatg

SEQ ID NO: 151106 - DNA, 103 bp, Artificial Sequence
  Synthetic Polynucleotide
taatacgactcactatagggatcaggatgggagaagccggccccactgggaacagaggagacccagtatggccggcttcaacctggcggcagcgcaaaagatg

SEQ ID NO: 151107 - DNA, 103 bp, Artificial Sequence
  Synthetic Polynucleotide
taatacgactcactatagggaaggggctccatcaggatgggagaagccggaacagaggagaccggctatgcccatcctgaacctggcggcagcgcaaaagatg

SEQ ID NO: 151108 - DNA, 103 bp, Artificial Sequence
  Synthetic Polynucleotide
taatacgactcactatagggactgaggaggaaggggctccatcaggatggaacagaggagaccatccatgtggagccccaacctggcggcagcgcaaaagatg

SEQ ID NO: 151109 - DNA, 103 bp, Artificial Sequence
  Synthetic Polynucleotide
taatacgactcactatagggagtggcgaacactgaggaggaaggggctccaacagaggagaggagccatgtcctcctcaaacctggcggcagcgcaaaagatg

SEQ ID NO: 151110 - DNA, 103 bp, Artificial Sequence
  Synthetic Polynucleotide
taatacgactcactatagggatgctgaaggagtggcgaacactgaggaggaacagaggagacctcctatgtgttcgccaaacctggcggcagcgcaaaagatg

SEQ ID NO: 151111 - DNA, 103 bp, Artificial Sequence
  Synthetic Polynucleotide
taatacgactcactataggggaaccagggaatgctgaaggagtggcgaacaacagaggagagttcgcatgtccttcagcaacctggcggcagcgcaaaagatg

SEQ ID NO: 151112 - DNA, 103 bp, Artificial Sequence
  Synthetic Polynucleotide
taatacgactcactataggggagttttggggaaccagggaatgctgaaggaacagaggagaccttcaatgttccctggtaacctggcggcagcgcaaaagatg

SEQ ID NO: 151113 - DNA, 103 bp, Artificial Sequence
  Synthetic Polynucleotide
taatacgactcactatagggcagcactgcctcattgggccctgggctcccaacagaggagagggagcatggggcccaataacctggcggcagcgcaaaagatg

SEQ ID NO: 151114 - DNA, 103 bp, Artificial Sequence
  Synthetic Polynucleotide
taatacgactcactatagggggaaggaggggagttttggggaaccagggaaacagaggagatccctgatgccccaaaacaacctggcggcagcgcaaaagatg

SEQ ID NO: 151115 - DNA, 103 bp, Artificial Sequence
  Synthetic Polynucleotide
taatacgactcactataggggagagcactgggaaggaggggagttttgggaacagaggagacccaaaatgcccctccttaacctggcggcagcgcaaaagatg

SEQ ID NO: 151116 - DNA, 103 bp, Artificial Sequence
  Synthetic Polynucleotide
taatacgactcactatagggagggcaggaggagagcactgggaaggagggaacagaggagaccctccatgccagtgctcaacctggcggcagcgcaaaagatg

SEQ ID NO: 151117 - DNA, 103 bp, Artificial Sequence
  Synthetic Polynucleotide
taatacgactcactatagggggacagtggtagggcaggaggagagcactgaacagaggagacagtgcatgcctcctgccaacctggcggcagcgcaaaagatg

SEQ ID NO: 151118 - DNA, 103 bp, Artificial Sequence
  Synthetic Polynucleotide
taatacgactcactataggggggagggaacggacagtggtagggcaggagaacagaggagactcctgatgtaccactgtaacctggcggcagcgcaaaagatg

SEQ ID NO: 151119 - DNA, 103 bp, Artificial Sequence
  Synthetic Polynucleotide
taatacgactcactatagggggactcaacggggagggaacggacagtggtaacagaggagaaccactatgcgttccctcaacctggcggcagcgcaaaagatg

SEQ ID NO: 151120 - DNA, 103 bp, Artificial Sequence
  Synthetic Polynucleotide
taatacgactcactatagggcttccctatgggactcaacggggagggaacaacagaggagagttcccatgccgttgagtaacctggcggcagcgcaaaagatg

SEQ ID NO: 151121 - DNA, 103 bp, Artificial Sequence
  Synthetic Polynucleotide
taatacgactcactatagggcccccactaccttccctatgggactcaacgaacagaggagacgttgaatgccatagggaaacctggcggcagcgcaaaagatg

SEQ ID NO: 151122 - DNA, 103 bp, Artificial Sequence
  Synthetic Polynucleotide
taatacgactcactatagggtcatctgagacccccactaccttccctatgaacagaggagacataggatgggtagtgggaacctggcggcagcgcaaaagatg

SEQ ID NO: 151123 - DNA, 103 bp, Artificial Sequence
  Synthetic Polynucleotide
taatacgactcactatagggcagctcagcctcatctgagacccccactacaacagaggagagtagtgatggtctcagataacctggcggcagcgcaaaagatg

SEQ ID NO: 151124 - DNA, 103 bp, Artificial Sequence
  Synthetic Polynucleotide
taatacgactcactatagggcctcactgggcagcactgcctcattgggccaacagaggagaggcccaatgaggcagtgcaacctggcggcagcgcaaaagatg

SEQ ID NO: 151125 - DNA, 103 bp, Artificial Sequence
  Synthetic Polynucleotide
taatacgactcactatagggccatctcgtgcagctcagcctcatctgagaaacagaggagatctcagatgaggctgagcaacctggcggcagcgcaaaagatg

SEQ ID NO: 151126 - DNA, 103 bp, Artificial Sequence
  Synthetic Polynucleotide
taatacgactcactatagggttctcagtctccatctcgtgcagctcagccaacagaggagaggctgaatggcacgagataacctggcggcagcgcaaaagatg

SEQ ID NO: 151127 - DNA, 103 bp, Artificial Sequence
  Synthetic Polynucleotide
taatacgactcactatagggttctgaaactttctcagtctccatctcgtgaacagaggagacacgagatggagactgagaacctggcggcagcgcaaaagatg

SEQ ID NO: 151128 - DNA, 103 bp, Artificial Sequence
  Synthetic Polynucleotide
taatacgactcactatagggggcattcaggttctgaaactttctcagtctaacagaggagaagactgatgaagtttcagaacctggcggcagcgcaaaagatg

SEQ ID NO: 151129 - DNA, 103 bp, Artificial Sequence
  Synthetic Polynucleotide
taatacgactcactatagggtccaaggctgggcattcaggttctgaaactaacagaggagaagtttcatgacctgaatgaacctggcggcagcgcaaaagatg

SEQ ID NO: 151130 - DNA, 103 bp, Artificial Sequence
  Synthetic Polynucleotide
taatacgactcactatagggggcactgggttccaaggctgggcattcaggaacagaggagacctgaaatgccagccttgaacctggcggcagcgcaaaagatg

SEQ ID NO: 151131 - DNA, 103 bp, Artificial Sequence
  Synthetic Polynucleotide
taatacgactcactataggggaggactggtggcactgggttccaaggctgaacagaggagacagcctatgaacccagtgaacctggcggcagcgcaaaagatg

SEQ ID NO: 151132 - DNA, 103 bp, Artificial Sequence
  Synthetic Polynucleotide
taatacgactcactatagggggggaagggagaggactggtggcactgggtaacagaggagaacccagatgcaccagtccaacctggcggcagcgcaaaagatg

SEQ ID NO: 151133 - DNA, 103 bp, Artificial Sequence
  Synthetic Polynucleotide
taatacgactcactataggggtcccccattggggaagggagaggactggtaacagaggagaaccagtatgctcccttccaacctggcggcagcgcaaaagatg

SEQ ID NO: 151134 - DNA, 103 bp, Artificial Sequence
  Synthetic Polynucleotide
taatacgactcactatagggggcaggaaaggtcccccattggggaagggaaacagaggagatcccttatgcaatgggggaacctggcggcagcgcaaaagatg

SEQ ID NO: 151135 - DNA, 103 bp, Artificial Sequence
  Synthetic Polynucleotide
taatacgactcactatagggtgtgataggtcctcactgggcagcactgccaacagaggagaggcagtatggcccagtgaaacctggcggcagcgcaaaagatg

SEQ ID NO: 151136 - DNA, 103 bp, Artificial Sequence
  Synthetic Polynucleotide
taatacgactcactatagggctgggggcggggcaggaaaggtcccccattaacagaggagaaatgggatgcctttcctgaacctggcggcagcgcaaaagatg

SEQ ID NO: 151137 - DNA, 103 bp, Artificial Sequence
  Synthetic Polynucleotide
taatacgactcactatagggtggggcagggctgggggcggggcaggaaagaacagaggagactttccatgcccgcccccaacctggcggcagcgcaaaagatg

SEQ ID NO: 151138 - DNA, 103 bp, Artificial Sequence
  Synthetic Polynucleotide
taatacgactcactatagggcatccagggctggggcagggctgggggcggaacagaggagaccgcccatggccctgcccaacctggcggcagcgcaaaagatg

SEQ ID NO: 151139 - DNA, 103 bp, Artificial Sequence
  Synthetic Polynucleotide
taatacgactcactatagggccagagaagtcatccagggctggggcagggaacagaggagaccctgcatgagccctggaaacctggcggcagcgcaaaagatg

SEQ ID NO: 151140 - DNA, 103 bp, Artificial Sequence
  Synthetic Polynucleotide
taatacgactcactatagggttcccctaggccagagaagtcatccagggcaacagaggagagccctgatggacttctctaacctggcggcagcgcaaaagatg

SEQ ID NO: 151141 - DNA, 103 bp, Artificial Sequence
  Synthetic Polynucleotide
taatacgactcactataggggggctgtgtcttcccctaggccagagaagtaacagaggagaacttctatggcctaggggaacctggcggcagcgcaaaagatg

SEQ ID NO: 151142 - DNA, 103 bp, Artificial Sequence
  Synthetic Polynucleotide
taatacgactcactatagggccatccagaggggctgtgtcttcccctaggaacagaggagacctaggatgagacacagcaacctggcggcagcgcaaaagatg

SEQ ID NO: 151143 - DNA, 103 bp, Artificial Sequence
  Synthetic Polynucleotide
taatacgactcactatagggagcatcaatcccatccagaggggctgtgtcaacagaggagagacacaatgcctctggataacctggcggcagcgcaaaagatg

SEQ ID NO: 151144 - DNA, 103 bp, Artificial Sequence
  Synthetic Polynucleotide
taatacgactcactataggggtgaacccggagcatcaatcccatccagagaacagaggagactctggatgggattgatgaacctggcggcagcgcaaaagatg

SEQ ID NO: 151145 - DNA, 103 bp, Artificial Sequence
  Synthetic Polynucleotide
taatacgactcactatagggggctctggctgtgaacccggagcatcaatcaacagaggagagattgaatgtccgggttcaacctggcggcagcgcaaaagatg

SEQ ID NO: 151146 - DNA, 103 bp, Artificial Sequence
  Synthetic Polynucleotide
taatacgactcactataggggaaaccaatctgtgataggtcctcactgggaacagaggagacccagtatggacctatcaaacctggcggcagcgcaaaagatg

SEQ ID NO: 151147 - DNA, 103 bp, Artificial Sequence
  Synthetic Polynucleotide
taatacgactcactatagggggtctgtccaggctctggctgtgaacccggaacagaggagaccgggtatgcagccagagaacctggcggcagcgcaaaagatg

SEQ ID NO: 151148 - DNA, 103 bp, Artificial Sequence
  Synthetic Polynucleotide
taatacgactcactatagggaactgccaggggtctgtccaggctctggctaacagaggagaagccagatgctggacagaaacctggcggcagcgcaaaagatg

SEQ ID NO: 151149 - DNA, 103 bp, Artificial Sequence
  Synthetic Polynucleotide
taatacgactcactatagggtcactagccaaactgccaggggtctgtccaaacagaggagatggacaatgccctggcagaacctggcggcagcgcaaaagatg

SEQ ID NO: 151150 - DNA, 103 bp, Artificial Sequence
  Synthetic Polynucleotide
taatacgactcactataggggcctttaagttcactagccaaactgccaggaacagaggagacctggcatgttggctagtaacctggcggcagcgcaaaagatg

SEQ ID NO: 151151 - DNA, 103 bp, Artificial Sequence
  Synthetic Polynucleotide
taatacgactcactataggggcacaggggagcctttaagttcactagccaaacagaggagatggctaatgaacttaaagaacctggcggcagcgcaaaagatg

SEQ ID NO: 151152 - DNA, 103 bp, Artificial Sequence
  Synthetic Polynucleotide
taatacgactcactataggggggtccaggagcacaggggagcctttaagtaacagaggagaacttaaatgctcccctgtaacctggcggcagcgcaaaagatg

SEQ ID NO: 151153 - DNA, 103 bp, Artificial Sequence
  Synthetic Polynucleotide
taatacgactcactatagggcagctcctcggggtccaggagcacaggggaaacagaggagatcccctatgctcctggacaacctggcggcagcgcaaaagatg

SEQ ID NO: 151154 - DNA, 103 bp, Artificial Sequence
  Synthetic Polynucleotide
taatacgactcactatagggtcacaggggccagctcctcggggtccaggaaacagaggagatcctggatgccgaggagcaacctggcggcagcgcaaaagatg

SEQ ID NO: 151155 - DNA, 103 bp, Artificial Sequence
  Synthetic Polynucleotide
taatacgactcactatagggtccataggggtcacaggggccagctcctcgaacagaggagacgaggaatgggcccctgtaacctggcggcagcgcaaaagatg

SEQ ID NO: 151156 - DNA, 103 bp, Artificial Sequence
  Synthetic Polynucleotide
taatacgactcactatagggggggtagacctccataggggtcacaggggcaacagaggagagcccctatgacccctatgaacctggcggcagcgcaaaagatg

SEQ ID NO: 151157 - DNA, 103 bp, Artificial Sequence
  Synthetic Polynucleotide
taatacgactcactatagggggccctcagggaaaccaatctgtgataggtaacagaggagaacctatatgagattggttaacctggcggcagcgcaaaagatg

SEQ ID NO: 151158 - DNA, 103 bp, Artificial Sequence
  Synthetic Polynucleotide
taatacgactcactataggggcttgcattcggggtagacctccataggggaacagaggagacccctaatgaggtctaccaacctggcggcagcgcaaaagatg

SEQ ID NO: 151159 - DNA, 103 bp, Artificial Sequence
  Synthetic Polynucleotide
taatacgactcactatagggcctgctgtctgcttgcattcggggtagaccaacagaggagaggtctaatgcgaatgcaaaacctggcggcagcgcaaaagatg

SEQ ID NO: 151160 - DNA, 103 bp, Artificial Sequence
  Synthetic Polynucleotide
taatacgactcactatagggtgagccctgccctgctgtctgcttgcattcaacagaggagagaatgcatgcagacagcaaacctggcggcagcgcaaaagatg

SEQ ID NO: 151161 - DNA, 103 bp, Artificial Sequence
  Synthetic Polynucleotide
taatacgactcactatagggcttcacatggtgagccctgccctgctgtctaacagaggagaagacagatgggcagggctaacctggcggcagcgcaaaagatg

SEQ ID NO: 151162 - DNA, 103 bp, Artificial Sequence
  Synthetic Polynucleotide
taatacgactcactatagggtcttcctgttcttcacatggtgagccctgcaacagaggagagcagggatgaccatgtgaaacctggcggcagcgcaaaagatg

SEQ ID NO: 151163 - DNA, 103 bp, Artificial Sequence
  Synthetic Polynucleotide
taatacgactcactatagggtgcacgtggctcttcctgttcttcacatggaacagaggagaccatgtatggaacaggaaaacctggcggcagcgcaaaagatg

SEQ ID NO: 151164 - DNA, 103 bp, Artificial Sequence
  Synthetic Polynucleotide
taatacgactcactataggggggccaccggtgcacgtggctcttcctgttaacagaggagaaacaggatgagccacgtgaacctggcggcagcgcaaaagatg

SEQ ID NO: 151165 - DNA, 103 bp, Artificial Sequence
  Synthetic Polynucleotide
taatacgactcactatagggggtggtgtgggggccaccggtgcacgtggcaacagaggagagccacgatgaccggtggcaacctggcggcagcgcaaaagatg

SEQ ID NO: 151166 - DNA, 103 bp, Artificial Sequence
  Synthetic Polynucleotide
taatacgactcactataggggatgagagtgggtggtgtgggggccaccggaacagaggagaccggtgatgcccacaccaaacctggcggcagcgcaaaagatg

SEQ ID NO: 151167 - DNA, 103 bp, Artificial Sequence
  Synthetic Polynucleotide
taatacgactcactatagggtgtcggatttgatgagagtgggtggtgtggaacagaggagaccacacatgccactctcaaacctggcggcagcgcaaaagatg

SEQ ID NO: 151168 - DNA, 103 bp, Artificial Sequence
  Synthetic Polynucleotide
taatacgactcactataggggcaggtgtaaggccctcagggaaaccaatcaacagaggagagattggatgccctgagggaacctggcggcagcgcaaaagatg

SEQ ID NO: 151169 - DNA, 103 bp, Artificial Sequence
  Synthetic Polynucleotide
taatacgactcactatagggtcgttaacgatgtcggatttgatgagagtgaacagaggagacactctatgcaaatccgaaacctggcggcagcgcaaaagatg

SEQ ID NO: 151170 - DNA, 103 bp, Artificial Sequence
  Synthetic Polynucleotide
taatacgactcactatagggattagagatctcgttaacgatgtcggatttaacagaggagaaaatccatgatcgttaacaacctggcggcagcgcaaaagatg

SEQ ID NO: 151171 - DNA, 103 bp, Artificial Sequence
  Synthetic Polynucleotide
taatacgactcactatagggcctggctcagattagagatctcgttaacgaaacagaggagatcgttaatgagatctctaaacctggcggcagcgcaaaagatg

SEQ ID NO: 151172 - DNA, 103 bp, Artificial Sequence
  Synthetic Polynucleotide
taatacgactcactatagggctggcatcaccctggctcagattagagatcaacagaggagagatctcatgtctgagccaaacctggcggcagcgcaaaagatg

SEQ ID NO: 151173 - DNA, 103 bp, Artificial Sequence
  Synthetic Polynucleotide
taatacgactcactatagggaaaactggcactggcatcaccctggctcagaacagaggagactgagcatgggtgatgccaacctggcggcagcgcaaaagatg

SEQ ID NO: 151174 - DNA, 103 bp, Artificial Sequence
  Synthetic Polynucleotide
taatacgactcactatagggctgagccaggaaaactggcactggcatcacaacagaggagagtgatgatggtgccagttaacctggcggcagcgcaaaagatg

SEQ ID NO: 151175 - DNA, 103 bp, Artificial Sequence
  Synthetic Polynucleotide
taatacgactcactatagggaggaggggctctgagccaggaaaactggcaaacagaggagatgccagatgtcctggctcaacctggcggcagcgcaaaagatg

SEQ ID NO: 151176 - DNA, 103 bp, Artificial Sequence
  Synthetic Polynucleotide
taatacgactcactatagggtggagagcccaggaggggctctgagccaggaacagaggagacctggcatggagcccctcaacctggcggcagcgcaaaagatg

SEQ ID NO: 151177 - DNA, 103 bp, Artificial Sequence
  Synthetic Polynucleotide
taatacgactcactatagggcctccgggtctggagagcccaggaggggctaacagaggagaagccccatgtgggctctcaacctggcggcagcgcaaaagatg

SEQ ID NO: 151178 - DNA, 103 bp, Artificial Sequence
  Synthetic Polynucleotide
taatacgactcactataggggagccacccccctccgggtctggagagcccaacagaggagagggctcatgagacccggaaacctggcggcagcgcaaaagatg

SEQ ID NO: 151179 - DNA, 103 bp, Artificial Sequence
  Synthetic Polynucleotide
taatacgactcactatagggtcctaggtgggcaggtgtaaggccctcaggaacagaggagacctgagatgcttacacctaacctggcggcagcgcaaaagatg

SEQ ID NO: 151180 - DNA, 103 bp, Artificial Sequence
  Synthetic Polynucleotide
taatacgactcactatagggcatggacagggagccacccccctccgggtcaacagaggagagacccgatggggggtggcaacctggcggcagcgcaaaagatg

SEQ ID NO: 151181 - DNA, 103 bp, Artificial Sequence
  Synthetic Polynucleotide
taatacgactcactatagggcccccaactccatggacagggagccaccccaacagaggagaggggtgatgccctgtccaaacctggcggcagcgcaaaagatg

SEQ ID NO: 151182 - DNA, 103 bp, Artificial Sequence
  Synthetic Polynucleotide
taatacgactcactatagggtccgtagagacccccaactccatggacaggaacagaggagacctgtcatgggagttgggaacctggcggcagcgcaaaagatg

SEQ ID NO: 151183 - DNA, 103 bp, Artificial Sequence
  Synthetic Polynucleotide
taatacgactcactatagggtggactaacatccgtagagacccccaactcaacagaggagagagttgatggtctctacgaacctggcggcagcgcaaaagatg

SEQ ID NO: 151184 - DNA, 103 bp, Artificial Sequence
  Synthetic Polynucleotide
taatacgactcactatagggcatctcgggctggactaacatccgtagagaaacagaggagatctctaatgatgttagtcaacctggcggcagcgcaaaagatg

SEQ ID NO: 151185 - DNA, 103 bp, Artificial Sequence
  Synthetic Polynucleotide
taatacgactcactatagggagggagccctcatctcgggctggactaacaaacagaggagatgttagatgagcccgagaaacctggcggcagcgcaaaagatg

SEQ ID NO: 151186 - DNA, 103 bp, Artificial Sequence
  Synthetic Polynucleotide
taatacgactcactatagggacagagccgtagggagccctcatctcgggcaacagaggagagcccgaatggagggctccaacctggcggcagcgcaaaagatg

SEQ ID NO: 151187 - DNA, 103 bp, Artificial Sequence
  Synthetic Polynucleotide
taatacgactcactataggggtgagtcagtacagagccgtagggagccctaacagaggagaagggctatgtacggctctaacctggcggcagcgcaaaagatg

SEQ ID NO: 151188 - DNA, 103 bp, Artificial Sequence
  Synthetic Polynucleotide
taatacgactcactataggggtctctggcagtgagtcagtacagagccgtaacagaggagaacggctatgtactgactcaacctggcggcagcgcaaaagatg

SEQ ID NO: 151189 - DNA, 103 bp, Artificial Sequence
  Synthetic Polynucleotide
taatacgactcactatagggtgagtcatcagtctctggcagtgagtcagtaacagaggagaactgacatgctgccagagaacctggcggcagcgcaaaagatg

SEQ ID NO: 151190 - DNA, 103 bp, Artificial Sequence
  Synthetic Polynucleotide
taatacgactcactatagggctccaggttctcctaggtgggcaggtgtaaaacagaggagattacacatgcccacctagaacctggcggcagcgcaaaagatg

SEQ ID NO: 151191 - DNA, 103 bp, Artificial Sequence
  Synthetic Polynucleotide
taatacgactcactatagggcgcacaatagtgagtcatcagtctctggcaaacagaggagatgccagatgctgatgactaacctggcggcagcgcaaaagatg

SEQ ID NO: 151192 - DNA, 103 bp, Artificial Sequence
  Synthetic Polynucleotide
taatacgactcactataggggtcccagcatcgcacaatagtgagtcatcaaacagaggagatgatgaatgactattgtgaacctggcggcagcgcaaaagatg

SEQ ID NO: 151193 - DNA, 103 bp, Artificial Sequence
  Synthetic Polynucleotide
taatacgactcactataggggctgatagctgtcccagcatcgcacaatagaacagaggagactattgatggatgctgggaacctggcggcagcgcaaaagatg

SEQ ID NO: 151194 - DNA, 103 bp, Artificial Sequence
  Synthetic Polynucleotide
taatacgactcactatagggctttgcctccgctgatagctgtcccagcataacagaggagaatgctgatgcagctatcaaacctggcggcagcgcaaaagatg

SEQ ID NO: 151195 - DNA, 103 bp, Artificial Sequence
  Synthetic Polynucleotide
taatacgactcactatagggtccccctcagctttgcctccgctgatagctaacagaggagaagctatatgcggaggcaaaacctggcggcagcgcaaaagatg

SEQ ID NO: 151196 - DNA, 103 bp, Artificial Sequence
  Synthetic Polynucleotide
taatacgactcactatagggccgccccttctccccctcagctttgcctccaacagaggagaggaggcatggctgaggggaacctggcggcagcgcaaaagatg

SEQ ID NO: 151197 - DNA, 103 bp, Artificial Sequence
  Synthetic Polynucleotide
taatacgactcactatagggagctgcgccgccgccccttctccccctcagaacagaggagactgaggatgagaaggggcaacctggcggcagcgcaaaagatg

SEQ ID NO: 151198 - DNA, 103 bp, Artificial Sequence
  Synthetic Polynucleotide
taatacgactcactatagggcgggctggggagctgcgccgccgccccttcaacagaggagagaagggatggcggcgcagaacctggcggcagcgcaaaagatg

SEQ ID NO: 151199 - DNA, 103 bp, Artificial Sequence
  Synthetic Polynucleotide
taatacgactcactataggggatgcgggaacgggctggggagctgcgccgaacagaggagacggcgcatgtccccagccaacctggcggcagcgcaaaagatg

SEQ ID NO: 151200 - DNA, 103 bp, Artificial Sequence
  Synthetic Polynucleotide
taatacgactcactataggggaccctgtttgatgcgggaacgggctggggaacagaggagaccccagatggttcccgcaaacctggcggcagcgcaaaagatg

SEQ ID NO: 151201 - DNA, 103 bp, Artificial Sequence
  Synthetic Polynucleotide
taatacgactcactatagggcagcaggaccctccaggttctcctaggtggaacagaggagaccacctatgagaacctggaacctggcggcagcgcaaaagatg

SEQ ID NO: 151202 - DNA, 103 bp, Artificial Sequence
  Synthetic Polynucleotide
taatacgactcactatagggctgctgctgcgaccctgtttgatgcgggaaaacagaggagattcccgatgcaaacagggaacctggcggcagcgcaaaagatg

SEQ ID NO: 151203 - DNA, 103 bp, Artificial Sequence
  Synthetic Polynucleotide
taatacgactcactatagggtcctgggaaactgctgctgcgaccctgtttaacagaggagaaaacagatgcgcagcagcaacctggcggcagcgcaaaagatg

SEQ ID NO: 151204 - DNA, 103 bp, Artificial Sequence
  Synthetic Polynucleotide
taatacgactcactataggggccggcgtcttcctgggaaactgctgctgcaacagaggagagcagcaatggtttcccagaacctggcggcagcgcaaaagatg

SEQ ID NO: 151205 - DNA, 103 bp, Artificial Sequence
  Synthetic Polynucleotide
taatacgactcactatagggcctccacgaggccggcgtcttcctgggaaaaacagaggagatttcccatgaagacgccgaacctggcggcagcgcaaaagatg

SEQ ID NO: 151206 - DNA, 103 bp, Artificial Sequence
  Synthetic Polynucleotide
taatacgactcactatagggtccatgggctcctccacgaggccggcgtctaacagaggagaagacgcatgcctcgtggaaacctggcggcagcgcaaaagatg

SEQ ID NO: 151207 - DNA, 103 bp, Artificial Sequence
  Synthetic Polynucleotide
taatacgactcactatagggtaccacgtcctccatgggctcctccacgagaacagaggagactcgtgatggagcccatgaacctggcggcagcgcaaaagatg

SEQ ID NO: 151208 - DNA, 103 bp, Artificial Sequence
  Synthetic Polynucleotide
taatacgactcactataggggcccgtcctctaccacgtcctccatgggctaacagaggagaagcccaatgaggacgtggaacctggcggcagcgcaaaagatg

SEQ ID NO: 151209 - DNA, 103 bp, Artificial Sequence
  Synthetic Polynucleotide
taatacgactcactatagggctttagccgggcccgtcctctaccacgtccaacagaggagaggacgtatgagaggacggaacctggcggcagcgcaaaagatg

SEQ ID NO: 151210 - DNA, 103 bp, Artificial Sequence
  Synthetic Polynucleotide
taatacgactcactatagggaagcagttgactttagccgggcccgtcctcaacagaggagagaggacatgcccggctaaaacctggcggcagcgcaaaagatg

SEQ ID NO: 151211 - DNA, 103 bp, Artificial Sequence
  Synthetic Polynucleotide
taatacgactcactatagggtcaatggaagaagcagttgactttagccggaacagaggagaccggctatggtcaactgcaacctggcggcagcgcaaaagatg

SEQ ID NO: 151212 - DNA, 103 bp, Artificial Sequence
  Synthetic Polynucleotide
taatacgactcactatagggaggtccatcagctgccggttctgaatctttaacagaggagaaaagatatggaaccggcaaacctggcggcagcgcaaaagatg

SEQ ID NO: 151213 - DNA, 103 bp, Artificial Sequence
  Synthetic Polynucleotide
taatacgactcactatagggatggtgagcccagcaggaccctccaggttcaacagaggagagaacctatggggtcctgcaacctggcggcagcgcaaaagatg

SEQ ID NO: 151214 - DNA, 103 bp, Artificial Sequence
  Synthetic Polynucleotide
taatacgactcactatagggtaccagagtctcaatggaagaagcagttgaaacagaggagatcaactatgtcttccattaacctggcggcagcgcaaaagatg

SEQ ID NO: 151215 - DNA, 103 bp, Artificial Sequence
  Synthetic Polynucleotide
taatacgactcactatagggtgtcagcaactaccagagtctcaatggaagaacagaggagacttccaatgagactctggaacctggcggcagcgcaaaagatg

SEQ ID NO: 151216 - DNA, 103 bp, Artificial Sequence
  Synthetic Polynucleotide
taatacgactcactataggggagctatcaatgtcagcaactaccagagtcaacagaggagagactctatgagttgctgaaacctggcggcagcgcaaaagatg

SEQ ID NO: 151217 - DNA, 103 bp, Artificial Sequence
  Synthetic Polynucleotide
taatacgactcactatagggcttactgggagagctatcaatgtcagcaacaacagaggagagttgctatgattgatagcaacctggcggcagcgcaaaagatg

SEQ ID NO: 151218 - DNA, 103 bp, Artificial Sequence
  Synthetic Polynucleotide
taatacgactcactatagggcctcctcctccttactgggagagctatcaaaacagaggagattgataatgctcccagtaaacctggcggcagcgcaaaagatg

SEQ ID NO: 151219 - DNA, 103 bp, Artificial Sequence
  Synthetic Polynucleotide
taatacgactcactatagggtcatcttcttcctcctcctccttactgggaaacagaggagatcccagatgggaggaggaaacctggcggcagcgcaaaagatg

SEQ ID NO: 151220 - DNA, 103 bp, Artificial Sequence
  Synthetic Polynucleotide
taatacgactcactatagggcatggtgtcatcatcttcttcctcctcctcaacagaggagagaggagatggaagaagataacctggcggcagcgcaaaagatg

SEQ ID NO: 151221 - DNA, 103 bp, Artificial Sequence
  Synthetic Polynucleotide
taatacgactcactatagggcggtattctgcatggtgtcatcatcttcttaacagaggagaaagaagatgatgacaccaaacctggcggcagcgcaaaagatg

SEQ ID NO: 151222 - DNA, 103 bp, Artificial Sequence
  Synthetic Polynucleotide
taatacgactcactatagggaagagaaccacggtattctgcatggtgtcaaacagaggagatgacacatggcagaatacaacctggcggcagcgcaaaagatg

SEQ ID NO: 151223 - DNA, 103 bp, Artificial Sequence
  Synthetic Polynucleotide
taatacgactcactatagggtgtgttggagaagagaaccacggtattctgaacagaggagacagaatatggtggttctcaacctggcggcagcgcaaaagatg

SEQ ID NO: 151224 - DNA, 103 bp, Artificial Sequence
  Synthetic Polynucleotide
taatacgactcactatagggcagcacaccaatggtgagcccagcaggaccaacagaggagaggtcctatggggctcaccaacctggcggcagcgcaaaagatg

SEQ ID NO: 151225 - DNA, 103 bp, Artificial Sequence
  Synthetic Polynucleotide
taatacgactcactatagggcaaatttgtctgtgttggagaagagaaccaaacagaggagatggttcatgtctccaacaaacctggcggcagcgcaaaagatg

SEQ ID NO: 151226 - DNA, 103 bp, Artificial Sequence
  Synthetic Polynucleotide
taatacgactcactatagggtgcattaggacaaatttgtctgtgttggagaacagaggagactccaaatgagacaaattaacctggcggcagcgcaaaagatg

SEQ ID NO: 151227 - DNA, 103 bp, Artificial Sequence
  Synthetic Polynucleotide
taatacgactcactatagggacacatgtcctgcattaggacaaatttgtcaacagaggagagacaaaatggtcctaatgaacctggcggcagcgcaaaagatg

SEQ ID NO: 151228 - DNA, 103 bp, Artificial Sequence
  Synthetic Polynucleotide
taatacgactcactatagggcacataccacacacatgtcctgcattaggaaacagaggagatcctaaatgaggacatgtaacctggcggcagcgcaaaagatg

SEQ ID NO: 151229 - DNA, 103 bp, Artificial Sequence
  Synthetic Polynucleotide
taatacgactcactatagggccaaagctgccacataccacacacatgtccaacagaggagaggacatatgtgtggtatgaacctggcggcagcgcaaaagatg

SEQ ID NO: 151230 - DNA, 103 bp, Artificial Sequence
  Synthetic Polynucleotide
taatacgactcactatagggtgccccccggccaaagctgccacataccacaacagaggagagtggtaatgggcagctttaacctggcggcagcgcaaaagatg

SEQ ID NO: 151231 - DNA, 103 bp, Artificial Sequence
  Synthetic Polynucleotide
taatacgactcactatagggggtggccctctgccccccggccaaagctgcaacagaggagagcagctatggccggggggaacctggcggcagcgcaaaagatg

SEQ ID NO: 151232 - DNA, 103 bp, Artificial Sequence
  Synthetic Polynucleotide
taatacgactcactatagggcaggcaaggaggtggccctctgccccccggaacagaggagaccggggatgagagggccaaacctggcggcagcgcaaaagatg

SEQ ID NO: 151233 - DNA, 103 bp, Artificial Sequence
  Synthetic Polynucleotide
taatacgactcactataggggcactgcgaacaggcaaggaggtggccctcaacagaggagagagggcatgctccttgccaacctggcggcagcgcaaaagatg

SEQ ID NO: 151234 - DNA, 103 bp, Artificial Sequence
  Synthetic Polynucleotide
taatacgactcactatagggagcactgagagcactgcgaacaggcaaggaaacagaggagatccttgatggttcgcagtaacctggcggcagcgcaaaagatg

SEQ ID NO: 151235 - DNA, 103 bp, Artificial Sequence
  Synthetic Polynucleotide
taatacgactcactataggggccgaccatgcagcacaccaatggtgagccaacagaggagaggctcaatgttggtgtgcaacctggcggcagcgcaaaagatg

SEQ ID NO: 151236 - DNA, 103 bp, Artificial Sequence
  Synthetic Polynucleotide
taatacgactcactatagggtaagggtgatagcactgagagcactgcgaaaacagaggagattcgcaatgctctcagtgaacctggcggcagcgcaaaagatg

SEQ ID NO: 151237 - DNA, 103 bp, Artificial Sequence
  Synthetic Polynucleotide
taatacgactcactataggggttgacacagtaagggtgatagcactgagaaacagaggagatctcagatgtatcaccctaacctggcggcagcgcaaaagatg

SEQ ID NO: 151238 - DNA, 103 bp, Artificial Sequence
  Synthetic Polynucleotide
taatacgactcactatagggtgatcttgctgttgacacagtaagggtgataacagaggagaatcaccatgactgtgtcaaacctggcggcagcgcaaaagatg

SEQ ID NO: 151239 - DNA, 103 bp, Artificial Sequence
  Synthetic Polynucleotide
taatacgactcactatagggatcaccttggtgatcttgctgttgacacagaacagaggagactgtgtatgcagcaagataacctggcggcagcgcaaaagatg

SEQ ID NO: 151240 - DNA, 103 bp, Artificial Sequence
  Synthetic Polynucleotide
taatacgactcactatagggcttgagcagcatcaccttggtgatcttgctaacagaggagaagcaagatgaccaaggtgaacctggcggcagcgcaaaagatg

SEQ ID NO: 151241 - DNA, 103 bp, Artificial Sequence
  Synthetic Polynucleotide
taatacgactcactatagggaacgccagcccttgagcagcatcaccttggaacagaggagaccaaggatgtgctgctcaaacctggcggcagcgcaaaagatg

SEQ ID NO: 151242 - DNA, 103 bp, Artificial Sequence
  Synthetic Polynucleotide
taatacgactcactatagggcactccacacaacgccagcccttgagcagcaacagaggagagctgctatggggctggcgaacctggcggcagcgcaaaagatg

SEQ ID NO: 151243 - DNA, 103 bp, Artificial Sequence
  Synthetic Polynucleotide
taatacgactcactatagggacacacaatacactccacacaacgccagccaacagaggagaggctggatgtgtgtggagaacctggcggcagcgcaaaagatg

SEQ ID NO: 151244 - DNA, 103 bp, Artificial Sequence
  Synthetic Polynucleotide
taatacgactcactatagggcacacacctcacacacaatacactccacacaacagaggagagtgtggatggtattgtgtaacctggcggcagcgcaaaagatg

SEQ ID NO: 151245 - DNA, 103 bp, Artificial Sequence
  Synthetic Polynucleotide
taatacgactcactataggggaggcctggccacacacctcacacacaataaacagaggagatattgtatgtgaggtgtgaacctggcggcagcgcaaaagatg

SEQ ID NO: 151246 - DNA, 103 bp, Artificial Sequence
  Synthetic Polynucleotide
taatacgactcactatagggccatacgcctgccgaccatgcagcacaccaaacagaggagatggtgtatggcatggtcgaacctggcggcagcgcaaaagatg

SEQ ID NO: 151247 - DNA, 103 bp, Artificial Sequence
  Synthetic Polynucleotide
taatacgactcactatagggtgaggggtcggaggcctggccacacacctcaacagaggagagaggtgatgggccaggccaacctggcggcagcgcaaaagatg

SEQ ID NO: 151248 - DNA, 103 bp, Artificial Sequence
  Synthetic Polynucleotide
taatacgactcactataggggcagcaggcgtgaggggtcggaggcctggcaacagaggagagccaggatgccgacccctaacctggcggcagcgcaaaagatg

SEQ ID NO: 151249 - DNA, 103 bp, Artificial Sequence
  Synthetic Polynucleotide
taatacgactcactatagggtcatcacagagcagcaggcgtgaggggtcgaacagaggagacgacccatgacgcctgctaacctggcggcagcgcaaaagatg

SEQ ID NO: 151250 - DNA, 103 bp, Artificial Sequence
  Synthetic Polynucleotide
taatacgactcactatagggaatatcacagtcatcacagagcagcaggcgaacagaggagacgcctgatgctctgtgataacctggcggcagcgcaaaagatg

SEQ ID NO: 151251 - DNA, 103 bp, Artificial Sequence
  Synthetic Polynucleotide
taatacgactcactatagggtgtggtagctaatatcacagtcatcacagaaacagaggagatctgtgatgactgtgataaacctggcggcagcgcaaaagatg

SEQ ID NO: 151252 - DNA, 103 bp, Artificial Sequence
  Synthetic Polynucleotide
taatacgactcactatagggaggcagtatgtgtggtagctaatatcacagaacagaggagactgtgaatgtagctaccaaacctggcggcagcgcaaaagatg

SEQ ID NO: 151253 - DNA, 103 bp, Artificial Sequence
  Synthetic Polynucleotide
taatacgactcactatagggtggggggtccaggcagtatgtgtggtagctaacagaggagaagctacatgacatactgcaacctggcggcagcgcaaaagatg

SEQ ID NO: 151254 - DNA, 103 bp, Artificial Sequence
  Synthetic Polynucleotide
taatacgactcactatagggcggtgagcagtggggggtccaggcagtatgaacagaggagacatactatgtggacccccaacctggcggcagcgcaaaagatg

SEQ ID NO: 151255 - DNA, 103 bp, Artificial Sequence
  Synthetic Polynucleotide
taatacgactcactatagggcccttggggacggtgagcagtggggggtccaacagaggagaggacccatgactgctcacaacctggcggcagcgcaaaagatg

SEQ ID NO: 151256 - DNA, 103 bp, Artificial Sequence
  Synthetic Polynucleotide
taatacgactcactatagggcttccagccgcccttggggacggtgagcagaacagaggagactgctcatggtccccaagaacctggcggcagcgcaaaagatg

SEQ ID NO: 151257 - DNA, 103 bp, Artificial Sequence
  Synthetic Polynucleotide
taatacgactcactatagggcctcctgcccccatacgcctgccgaccatgaacagaggagacatggtatgcaggcgtataacctggcggcagcgcaaaagatg

SEQ ID NO: 151258 - DNA, 103 bp, Artificial Sequence
  Synthetic Polynucleotide
taatacgactcactatagggaccacttgcacttccagccgcccttggggaaacagaggagatccccaatggcggctggaaacctggcggcagcgcaaaagatg

SEQ ID NO: 151259 - DNA, 103 bp, Artificial Sequence
  Synthetic Polynucleotide
taatacgactcactatagggcaggacacacaccacttgcacttccagccgaacagaggagacggctgatggtgcaagtgaacctggcggcagcgcaaaagatg

SEQ ID NO: 151260 - DNA, 103 bp, Artificial Sequence
  Synthetic Polynucleotide
taatacgactcactatagggacactgcatacaggacacacaccacttgcaaacagaggagatgcaagatgtgtgtgtccaacctggcggcagcgcaaaagatg

SEQ ID NO: 151261 - DNA, 103 bp, Artificial Sequence
  Synthetic Polynucleotide
taatacgactcactatagggaagcagccccacactgcatacaggacacacaacagaggagagtgtgtatggtatgcagtaacctggcggcagcgcaaaagatg

SEQ ID NO: 151262 - DNA, 103 bp, Artificial Sequence
  Synthetic Polynucleotide
taatacgactcactatagggaagccaggggaagcagccccacactgcataaacagaggagatatgcaatgtggggctgcaacctggcggcagcgcaaaagatg

SEQ ID NO: 151263 - DNA, 103 bp, Artificial Sequence
  Synthetic Polynucleotide
taatacgactcactatagggttcacagtggaagccaggggaagcagccccaacagaggagaggggctatgtcccctggcaacctggcggcagcgcaaaagatg

SEQ ID NO: 151264 - DNA, 103 bp, Artificial Sequence
  Synthetic Polynucleotide
taatacgactcactatagggtattctgccattcacagtggaagccaggggaacagaggagacccctgatgtccactgtgaacctggcggcagcgcaaaagatg

SEQ ID NO: 151265 - DNA, 103 bp, Artificial Sequence
  Synthetic Polynucleotide
taatacgactcactatagggtgtgtgtaactattctgccattcacagtggaacagaggagaccactgatgatggcagaaaacctggcggcagcgcaaaagatg

SEQ ID NO: 151266 - DNA, 103 bp, Artificial Sequence
  Synthetic Polynucleotide
taatacgactcactataggggggcccacagtgtgtgtaactattctgccaaacagaggagatggcagatgagttacacaaacctggcggcagcgcaaaagatg

SEQ ID NO: 151267 - DNA, 103 bp, Artificial Sequence
  Synthetic Polynucleotide
taatacgactcactatagggggctggcacagggcccacagtgtgtgtaacaacagaggagagttacaatgactgtgggcaacctggcggcagcgcaaaagatg

SEQ ID NO: 151268 - DNA, 103 bp, Artificial Sequence
  Synthetic Polynucleotide
taatacgactcactatagggagttctgggccctcctgcccccatacgcctaacagaggagaaggcgtatgggggcaggaaacctggcggcagcgcaaaagatg

SEQ ID NO: 151269 - DNA, 103 bp, Artificial Sequence
  Synthetic Polynucleotide
taatacgactcactatagggcaggtcaccaggctggcacagggcccacagaacagaggagactgtggatgctgtgccagaacctggcggcagcgcaaaagatg

SEQ ID NO: 151270 - DNA, 103 bp, Artificial Sequence
  Synthetic Polynucleotide
taatacgactcactatagggacagatagggcaggtcaccaggctggcacaaacagaggagatgtgccatgctggtgaccaacctggcggcagcgcaaaagatg

SEQ ID NO: 151271 - DNA, 103 bp, Artificial Sequence
  Synthetic Polynucleotide
taatacgactcactatagggaaggagcatgacagatagggcaggtcaccaaacagaggagatggtgaatggccctatctaacctggcggcagcgcaaaagatg

SEQ ID NO: 151272 - DNA, 103 bp, Artificial Sequence
  Synthetic Polynucleotide
taatacgactcactatagggtcttctacgtaaggagcatgacagatagggaacagaggagaccctatatgtcatgctccaacctggcggcagcgcaaaagatg

SEQ ID NO: 151273 - DNA, 103 bp, Artificial Sequence
  Synthetic Polynucleotide
taatacgactcactatagggtagtaggtcctcttctacgtaaggagcatgaacagaggagacatgctatgtacgtagaaaacctggcggcagcgcaaaagatg

SEQ ID NO: 151274 - DNA, 103 bp, Artificial Sequence
  Synthetic Polynucleotide
taatacgactcactatagggggcactggattagtaggtcctcttctacgtaacagaggagaacgtagatgaggacctacaacctggcggcagcgcaaaagatg

SEQ ID NO: 151275 - DNA, 103 bp, Artificial Sequence
  Synthetic Polynucleotide
taatacgactcactatagggtcacagtggcggcactggattagtaggtccaacagaggagaggacctatgaatccagtgaacctggcggcagcgcaaaagatg

SEQ ID NO: 151276 - DNA, 103 bp, Artificial Sequence
  Synthetic Polynucleotide
taatacgactcactatagggcatccaccgttcacagtggcggcactggataacagaggagaatccagatgcgccactgtaacctggcggcagcgcaaaagatg

SEQ ID NO: 151277 - DNA, 103 bp, Artificial Sequence
  Synthetic Polynucleotide
taatacgactcactatagggagcctgcatgcatccaccgttcacagtggcaacagaggagagccactatgaacggtggaaacctggcggcagcgcaaaagatg

SEQ ID NO: 151278 - DNA, 103 bp, Artificial Sequence
  Synthetic Polynucleotide
taatacgactcactatagggaggctctcacagcctgcatgcatccaccgtaacagaggagaacggtgatggcatgcaggaacctggcggcagcgcaaaagatg

SEQ ID NO: 151279 - DNA, 103 bp, Artificial Sequence
  Synthetic Polynucleotide
taatacgactcactatagggcacaccacatagttctgggccctcctgcccaacagaggagagggcagatgggcccagaaaacctggcggcagcgcaaaagatg

SEQ ID NO: 151280 - DNA, 103 bp, Artificial Sequence
  Synthetic Polynucleotide
taatacgactcactatagggctctgtgaagaggctctcacagcctgcatgaacagaggagacatgcaatgtgtgagagcaacctggcggcagcgcaaaagatg

SEQ ID NO: 151281 - DNA, 103 bp, Artificial Sequence
  Synthetic Polynucleotide
taatacgactcactatagggccacatcgtcctctgtgaagaggctctcacaacagaggagagtgagaatgtcttcacagaacctggcggcagcgcaaaagatg

SEQ ID NO: 151282 - DNA, 103 bp, Artificial Sequence
  Synthetic Polynucleotide
taatacgactcactataggggctgcctgctccacatcgtcctctgtgaagaacagaggagacttcacatgggacgatgtaacctggcggcagcgcaaaagatg

SEQ ID NO: 151283 - DNA, 103 bp, Artificial Sequence
  Synthetic Polynucleotide
taatacgactcactataggggccttcatcggctgcctgctccacatcgtcaacagaggagagacgatatggagcaggcaaacctggcggcagcgcaaaagatg

SEQ ID NO: 151284 - DNA, 103 bp, Artificial Sequence
  Synthetic Polynucleotide
taatacgactcactatagggcacagtcaaagccttcatcggctgcctgctaacagaggagaagcaggatgccgatgaagaacctggcggcagcgcaaaagatg

SEQ ID NO: 151285 - DNA, 103 bp, Artificial Sequence
  Synthetic Polynucleotide
taatacgactcactatagggtggcaggagacacagtcaaagccttcatcgaacagaggagacgatgaatgctttgactgaacctggcggcagcgcaaaagatg

SEQ ID NO: 151286 - DNA, 103 bp, Artificial Sequence
  Synthetic Polynucleotide
taatacgactcactatagggcacgtagggctggcaggagacacagtcaaaaacagaggagatttgacatggtctcctgcaacctggcggcagcgcaaaagatg

SEQ ID NO: 151287 - DNA, 103 bp, Artificial Sequence
  Synthetic Polynucleotide
taatacgactcactatagggcaggctttaccacgtagggctggcaggagaaacagaggagatctcctatgagccctacgaacctggcggcagcgcaaaagatg

SEQ ID NO: 151288 - DNA, 103 bp, Artificial Sequence
  Synthetic Polynucleotide
taatacgactcactatagggacaggcgccacaggctttaccacgtagggcaacagaggagagccctaatgggtaaagccaacctggcggcagcgcaaaagatg

SEQ ID NO: 151289 - DNA, 103 bp, Artificial Sequence
  Synthetic Polynucleotide
taatacgactcactatagggtggaggtgcaacaggcgccacaggctttacaacagaggagagtaaagatggtggcgcctaacctggcggcagcgcaaaagatg

SEQ ID NO: 151290 - DNA, 103 bp, Artificial Sequence
  Synthetic Polynucleotide
taatacgactcactatagggtggccttgtccacaccacatagttctgggcaacagaggagagcccagatgtatgtggtgaacctggcggcagcgcaaaagatg

SEQ ID NO: 151291 - DNA, 103 bp, Artificial Sequence
  Synthetic Polynucleotide
taatacgactcactataggggcaccagctctggaggtgcaacaggcgccaaacagaggagatggcgcatgttgcacctcaacctggcggcagcgcaaaagatg

SEQ ID NO: 151292 - DNA, 103 bp, Artificial Sequence
  Synthetic Polynucleotide
taatacgactcactatagggaccttcatgggcaccagctctggaggtgcaaacagaggagatgcaccatgagagctggtaacctggcggcagcgcaaaagatg

SEQ ID NO: 151293 - DNA, 103 bp, Artificial Sequence
  Synthetic Polynucleotide
taatacgactcactatagggtggctctttcaccttcatgggcaccagctcaacagaggagagagctgatgcccatgaagaacctggcggcagcgcaaaagatg

SEQ ID NO: 151294 - DNA, 103 bp, Artificial Sequence
  Synthetic Polynucleotide
taatacgactcactatagggactggggctctggctctttcaccttcatggaacagaggagaccatgaatgtgaaagagcaacctggcggcagcgcaaaagatg

SEQ ID NO: 151295 - DNA, 103 bp, Artificial Sequence
  Synthetic Polynucleotide
taatacgactcactatagggaagcgaaagtactggggctctggctctttcaacagaggagagaaagaatgagagccccaaacctggcggcagcgcaaaagatg

SEQ ID NO: 151296 - DNA, 103 bp, Artificial Sequence
  Synthetic Polynucleotide
taatacgactcactatagggcacaccttcgaagcgaaagtactggggctcaacagaggagagagcccatgtactttcgcaacctggcggcagcgcaaaagatg

SEQ ID NO: 151297 - DNA, 103 bp, Artificial Sequence
  Synthetic Polynucleotide
taatacgactcactatagggctgtcagccacacaccttcgaagcgaaagtaacagaggagaactttcatgtcgaaggtgaacctggcggcagcgcaaaagatg

SEQ ID NO: 151298 - DNA, 103 bp, Artificial Sequence
  Synthetic Polynucleotide
taatacgactcactatagggatgccagtttctgtcagccacacaccttcgaacagaggagacgaaggatggtggctgacaacctggcggcagcgcaaaagatg

SEQ ID NO: 151299 - DNA, 103 bp, Artificial Sequence
  Synthetic Polynucleotide
taatacgactcactatagggcagcaaggccatgccagtttctgtcagccaaacagaggagatggctgatggaaactggcaacctggcggcagcgcaaaagatg

SEQ ID NO: 151300 - DNA, 103 bp, Artificial Sequence
  Synthetic Polynucleotide
taatacgactcactatagggtcaggttacgcagcaaggccatgccagtttaacagaggagaaaactgatgtggccttgcaacctggcggcagcgcaaaagatg

SEQ ID NO: 151301 - DNA, 103 bp, Artificial Sequence
  Synthetic Polynucleotide
taatacgactcactatagggcctgagaagatggccttgtccacaccacataacagaggagaatgtggatgggacaaggcaacctggcggcagcgcaaaagatg

SEQ ID NO: 151302 - DNA, 103 bp, Artificial Sequence
  Synthetic Polynucleotide
taatacgactcactatagggggtgacatggtcaggttacgcagcaaggccaacagaggagaggccttatggcgtaacctaacctggcggcagcgcaaaagatg

SEQ ID NO: 151303 - DNA, 103 bp, Artificial Sequence
  Synthetic Polynucleotide
taatacgactcactatagggcttgtgcagtggtgacatggtcaggttacgaacagaggagacgtaacatgaccatgtcaaacctggcggcagcgcaaaagatg

SEQ ID NO: 151304 - DNA, 103 bp, Artificial Sequence
  Synthetic Polynucleotide
taatacgactcactataggggttggcgccgcttgtgcagtggtgacatggaacagaggagaccatgtatgcactgcacaaacctggcggcagcgcaaaagatg

SEQ ID NO: 151305 - DNA, 103 bp, Artificial Sequence
  Synthetic Polynucleotide
taatacgactcactatagggcgtcctcgccgttggcgccgcttgtgcagtaacagaggagaactgcaatggcggcgccaaacctggcggcagcgcaaaagatg

SEQ ID NO: 151306 - DNA, 103 bp, Artificial Sequence
  Synthetic Polynucleotide
taatacgactcactataggggaggccaagccgtcctcgccgttggcgccgaacagaggagacggcgcatgcggcgaggaaacctggcggcagcgcaaaagatg

SEQ ID NO: 151307 - DNA, 103 bp, Artificial Sequence
  Synthetic Polynucleotide
taatacgactcactatagggcctcgcctgggaggccaagccgtcctcgccaacagaggagaggcgagatgggcttggccaacctggcggcagcgcaaaagatg

SEQ ID NO: 151308 - DNA, 103 bp, Artificial Sequence
  Synthetic Polynucleotide
taatacgactcactatagggtccaatcctgcctcgcctgggaggccaagcaacagaggagagcttggatgcccaggcgaaacctggcggcagcgcaaaagatg

SEQ ID NO: 151309 - DNA, 103 bp, Artificial Sequence
  Synthetic Polynucleotide
taatacgactcactatagggctcagaaccctccaatcctgcctcgcctggaacagaggagaccaggcatggcaggattgaacctggcggcagcgcaaaagatg

SEQ ID NO: 151310 - DNA, 103 bp, Artificial Sequence
  Synthetic Polynucleotide
taatacgactcactatagggcatctgagggctcagaaccctccaatcctgaacagaggagacaggatatgagggttctgaacctggcggcagcgcaaaagatg

SEQ ID NO: 151311 - DNA, 103 bp, Artificial Sequence
  Synthetic Polynucleotide
taatacgactcactataggggggccaagggcatctgagggctcagaacccaacagaggagagggttcatggccctcagaaacctggcggcagcgcaaaagatg

SEQ ID NO: 151312 - DNA, 103 bp, Artificial Sequence
  Synthetic Polynucleotide
taatacgactcactatagggctgtgagatccctgagaagatggccttgtcaacagaggagagacaagatgatcttctcaaacctggcggcagcgcaaaagatg

SEQ ID NO: 151313 - DNA, 103 bp, Artificial Sequence
  Synthetic Polynucleotide
taatacgactcactatagggcttgtcatcagggccaagggcatctgagggaacagaggagaccctcaatggcccttggcaacctggcggcagcgcaaaagatg

SEQ ID NO: 151314 - DNA, 103 bp, Artificial Sequence
  Synthetic Polynucleotide
taatacgactcactatagggccccatccttcttgtcatcagggccaagggaacagaggagacccttgatgctgatgacaaacctggcggcagcgcaaaagatg

SEQ ID NO: 151315 - DNA, 103 bp, Artificial Sequence
  Synthetic Polynucleotide
taatacgactcactataggggtgtccaggtccccatccttcttgtcatcaaacagaggagatgatgaatggaaggatggaacctggcggcagcgcaaaagatg

SEQ ID NO: 151316 - DNA, 103 bp, Artificial Sequence
  Synthetic Polynucleotide
taatacgactcactatagggcagctcatcggtgtccaggtccccatccttaacagaggagaaaggatatggacctggacaacctggcggcagcgcaaaagatg

SEQ ID NO: 151317 - DNA, 103 bp, Artificial Sequence
  Synthetic Polynucleotide
taatacgactcactatagggcacccttgagcagctcatcggtgtccaggtaacagaggagaacctggatgccgatgagcaacctggcggcagcgcaaaagatg

SEQ ID NO: 151318 - DNA, 103 bp, Artificial Sequence
  Synthetic Polynucleotide
taatacgactcactatagggacaccaccttcacccttgagcagctcatcgaacagaggagacgatgaatggctcaagggaacctggcggcagcgcaaaagatg

SEQ ID NO: 151319 - DNA, 103 bp, Artificial Sequence
  Synthetic Polynucleotide
taatacgactcactatagggcatgtgctccacaccaccttcacccttgagaacagaggagactcaagatggaaggtggtaacctggcggcagcgcaaaagatg

SEQ ID NO: 151320 - DNA, 103 bp, Artificial Sequence
  Synthetic Polynucleotide
taatacgactcactatagggtttcgcactccatgtgctccacaccaccttaacagaggagaaaggtgatgtggagcacaaacctggcggcagcgcaaaagatg

SEQ ID NO: 151321 - DNA, 103 bp, Artificial Sequence
  Synthetic Polynucleotide
taatacgactcactatagggtccagtttaatttcgcactccatgtgctccaacagaggagaggagcaatgggagtgcgaaacctggcggcagcgcaaaagatg

SEQ ID NO: 151322 - DNA, 103 bp, Artificial Sequence
  Synthetic Polynucleotide
taatacgactcactataggggacggggccctccagtttaatttcgcactcaacagaggagagagtgcatgattaaactgaacctggcggcagcgcaaaagatg

SEQ ID NO: 151323 - DNA, 103 bp, Artificial Sequence
  Synthetic Polynucleotide
taatacgactcactatagggcagaagctgcaggtccatcagctgccggttaacagaggagaaaccggatgctgatggacaacctggcggcagcgcaaaagatg

SEQ ID NO: 151324 - DNA, 103 bp, Artificial Sequence
  Synthetic Polynucleotide
taatacgactcactataggggggagcagcgctgtgagatccctgagaagaaacagaggagatcttctatgggatctcacaacctggcggcagcgcaaaagatg

SEQ ID NO: 151325 - DNA, 103 bp, Artificial Sequence
  Synthetic Polynucleotide
taatacgactcactatagggcatcagggctgacggggccctccagtttaaaacagaggagattaaacatgagggccccgaacctggcggcagcgcaaaagatg

SEQ ID NO: 151326 - DNA, 103 bp, Artificial Sequence
  Synthetic Polynucleotide
taatacgactcactatagggccaggctccacatcagggctgacggggcccaacagaggagagggcccatgcagccctgaaacctggcggcagcgcaaaagatg

SEQ ID NO: 151327 - DNA, 103 bp, Artificial Sequence
  Synthetic Polynucleotide
taatacgactcactatagggctcctctttgccaggctccacatcagggctaacagaggagaagccctatggtggagcctaacctggcggcagcgcaaaagatg

SEQ ID NO: 151328 - DNA, 103 bp, Artificial Sequence
  Synthetic Polynucleotide
taatacgactcactatagggtttcctcggtctcctctttgccaggctccaaacagaggagatggagcatggcaaagaggaacctggcggcagcgcaaaagatg

SEQ ID NO: 151329 - DNA, 103 bp, Artificial Sequence
  Synthetic Polynucleotide
taatacgactcactatagggcgttttttgctttcctcggtctcctctttgaacagaggagacaaagaatggaccgaggaaacctggcggcagcgcaaaagatg

SEQ ID NO: 151330 - DNA, 103 bp, Artificial Sequence
  Synthetic Polynucleotide
taatacgactcactatagggtttacgcttgcgttttttgctttcctcggtaacagaggagaaccgagatgagcaaaaaaaacctggcggcagcgcaaaagatg

SEQ ID NO: 151331 - DNA, 103 bp, Artificial Sequence
  Synthetic Polynucleotide
taatacgactcactataggggccgatatggtttacgcttgcgttttttgcaacagaggagagcaaaaatggcaagcgtaaacctggcggcagcgcaaaagatg

SEQ ID NO: 151332 - DNA, 103 bp, Artificial Sequence
  Synthetic Polynucleotide
taatacgactcactatagggccaatgccaggccgatatggtttacgcttgaacagaggagacaagcgatgaccatatcgaacctggcggcagcgcaaaagatg

SEQ ID NO: 151333 - DNA, 103 bp, Artificial Sequence
  Synthetic Polynucleotide
taatacgactcactatagggcatgaaaccaccaatgccaggccgatatggaacagaggagaccatatatgcctggcattaacctggcggcagcgcaaaagatg

SEQ ID NO: 151334 - DNA, 103 bp, Artificial Sequence
  Synthetic Polynucleotide
taatacgactcactataggggctgtcgcaccatgaaaccaccaatgccagaacagaggagactggcaatggtggtttcaaacctggcggcagcgcaaaagatg

SEQ ID NO: 151335 - DNA, 103 bp, Artificial Sequence
  Synthetic Polynucleotide
taatacgactcactatagggctggtgcagtgggagcagcgctgtgagatcaacagaggagagatctcatggcgctgctcaacctggcggcagcgcaaaagatg

SEQ ID NO: 151336 - DNA, 103 bp, Artificial Sequence
  Synthetic Polynucleotide
taatacgactcactatagggtgggatttccgctgtcgcaccatgaaaccaaacagaggagatggtttatgggtgcgacaaacctggcggcagcgcaaaagatg

SEQ ID NO: 151337 - DNA, 103 bp, Artificial Sequence
  Synthetic Polynucleotide
taatacgactcactatagggcgtgcgtgtgtgggatttccgctgtcgcacaacagaggagagtgcgaatgcggaaatccaacctggcggcagcgcaaaagatg

SEQ ID NO: 151338 - DNA, 103 bp, Artificial Sequence
  Synthetic Polynucleotide
taatacgactcactataggggcccctttttcgtgcgtgtgtgggatttccaacagaggagaggaaatatgacacacgcaaacctggcggcagcgcaaaagatg

SEQ ID NO: 151339 - DNA, 103 bp, Artificial Sequence
  Synthetic Polynucleotide
taatacgactcactatagggtgtgcagcaggcccctttttcgtgcgtgtgaacagaggagacacacgatggaaaaagggaacctggcggcagcgcaaaagatg

SEQ ID NO: 151340 - DNA, 103 bp, Artificial Sequence
  Synthetic Polynucleotide
taatacgactcactatagggcacctccgcctgtgcagcaggcccctttttaacagaggagaaaaaagatgcctgctgcaaacctggcggcagcgcaaaagatg

SEQ ID NO: 151341 - DNA, 103 bp, Artificial Sequence
  Synthetic Polynucleotide
taatacgactcactatagggccccactcaacacctccgcctgtgcagcagaacagaggagactgctgatgaggcggaggaacctggcggcagcgcaaaagatg

SEQ ID NO: 151342 - DNA, 103 bp, Artificial Sequence
  Synthetic Polynucleotide
taatacgactcactatagggggctgcccatccccactcaacacctccgccaacagaggagaggcggaatggttgagtggaacctggcggcagcgcaaaagatg

SEQ ID NO: 151343 - DNA, 103 bp, Artificial Sequence
  Synthetic Polynucleotide
taatacgactcactatagggcacctcgtcgggctgcccatccccactcaaaacagaggagattgagtatggatgggcagaacctggcggcagcgcaaaagatg

SEQ ID NO: 151344 - DNA, 103 bp, Artificial Sequence
  Synthetic Polynucleotide
taatacgactcactatagggcagcaggtatcacctcgtcgggctgcccataacagaggagaatgggcatgccgacgaggaacctggcggcagcgcaaaagatg

SEQ ID NO: 151345 - DNA, 103 bp, Artificial Sequence
  Synthetic Polynucleotide
taatacgactcactataggggcaggcaggtcagcaggtatcacctcgtcgaacagaggagacgacgaatggatacctgcaacctggcggcagcgcaaaagatg

SEQ ID NO: 151346 - DNA, 103 bp, Artificial Sequence
  Synthetic Polynucleotide
taatacgactcactatagggggcaccgagcctggtgcagtgggagcagcgaacagaggagacgctgcatgcactgcaccaacctggcggcagcgcaaaagatg

SEQ ID NO: 151347 - DNA, 103 bp, Artificial Sequence
  Synthetic Polynucleotide
taatacgactcactatagggggcgccctctgcaggcaggtcagcaggtataacagaggagaatacctatggacctgcctaacctggcggcagcgcaaaagatg

SEQ ID NO: 151348 - DNA, 103 bp, Artificial Sequence
  Synthetic Polynucleotide
taatacgactcactatagggtctgctccacggcgccctctgcaggcaggtaacagaggagaacctgcatgcagagggcgaacctggcggcagcgcaaaagatg

SEQ ID NO: 151349 - DNA, 103 bp, Artificial Sequence
  Synthetic Polynucleotide
taatacgactcactatagggtcagctaagctctgctccacggcgccctctaacagaggagaagagggatgcgtggagcaaacctggcggcagcgcaaaagatg

SEQ ID NO: 151350 - DNA, 103 bp, Artificial Sequence
  Synthetic Polynucleotide
taatacgactcactatagggctcatccccttcagctaagctctgctccacaacagaggagagtggagatgagcttagctaacctggcggcagcgcaaaagatg

SEQ ID NO: 151351 - DNA, 103 bp, Artificial Sequence
  Synthetic Polynucleotide
taatacgactcactataggggcttcttcttctcatccccttcagctaagcaacagaggagagcttagatgaaggggatgaacctggcggcagcgcaaaagatg

SEQ ID NO: 151352 - DNA, 103 bp, Artificial Sequence
  Synthetic Polynucleotide
taatacgactcactatagggcgccgctgttgcttcttcttctcatcccctaacagaggagaaggggaatggaagaagaaaacctggcggcagcgcaaaagatg

SEQ ID NO: 151353 - DNA, 103 bp, Artificial Sequence
  Synthetic Polynucleotide
taatacgactcactatagggcttgcgccctcgccgctgttgcttcttcttaacagaggagaaagaagatgcaacagcggaacctggcggcagcgcaaaagatg

SEQ ID NO: 151354 - DNA, 103 bp, Artificial Sequence
  Synthetic Polynucleotide
taatacgactcactataggggtttgctcttcttgcgccctcgccgctgttaacagaggagaaacagcatggagggcgcaaacctggcggcagcgcaaaagatg

SEQ ID NO: 151355 - DNA, 103 bp, Artificial Sequence
  Synthetic Polynucleotide
taatacgactcactatagggatgtcctccagtttgctcttcttgcgccctaacagaggagaagggcgatggaagagcaaaacctggcggcagcgcaaaagatg

SEQ ID NO: 151356 - DNA, 103 bp, Artificial Sequence
  Synthetic Polynucleotide
taatacgactcactatagggagcagggaacatgtcctccagtttgctcttaacagaggagaaagagcatgctggaggacaacctggcggcagcgcaaaagatg

SEQ ID NO: 151357 - DNA, 103 bp, Artificial Sequence
  Synthetic Polynucleotide
taatacgactcactatagggaagggatggaggcaccgagcctggtgcagtaacagaggagaactgcaatgggctcggtgaacctggcggcagcgcaaaagatg

SEQ ID NO: 151358 - DNA, 103 bp, Artificial Sequence
  Synthetic Polynucleotide
taatacgactcactatagggcctgcaagtaagcagggaacatgtcctccaaacagaggagatggaggatgtgttccctgaacctggcggcagcgcaaaagatg

SEQ ID NO: 151359 - DNA, 103 bp, Artificial Sequence
  Synthetic Polynucleotide
taatacgactcactatagggaagaaggcttcctgcaagtaagcagggaacaacagaggagagttcccatgttacttgcaaacctggcggcagcgcaaaagatg

SEQ ID NO: 151360 - DNA, 103 bp, Artificial Sequence
  Synthetic Polynucleotide
taatacgactcactatagggctccttcccaaagaaggcttcctgcaagtaaacagaggagatacttgatggaagccttcaacctggcggcagcgcaaaagatg

SEQ ID NO: 151361 - DNA, 103 bp, Artificial Sequence
  Synthetic Polynucleotide
taatacgactcactatagggggtccagcagctccttcccaaagaaggcttaacagaggagaaagcctatgttgggaaggaacctggcggcagcgcaaaagatg

SEQ ID NO: 151362 - DNA, 103 bp, Artificial Sequence
  Synthetic Polynucleotide
taatacgactcactatagggttacggctcaggtccagcagctccttcccaaacagaggagatgggaaatggctgctggaaacctggcggcagcgcaaaagatg

SEQ ID NO: 151363 - DNA, 103 bp, Artificial Sequence
  Synthetic Polynucleotide
taatacgactcactatagggaaaaagggccttacggctcaggtccagcagaacagaggagactgctgatgctgagccgtaacctggcggcagcgcaaaagatg

SEQ ID NO: 151364 - DNA, 103 bp, Artificial Sequence
  Synthetic Polynucleotide
taatacgactcactatagggccccaactgcaaaaagggccttacggctcaaacagaggagatgagccatgaggccctttaacctggcggcagcgcaaaagatg

SEQ ID NO: 151365 - DNA, 103 bp, Artificial Sequence
  Synthetic Polynucleotide
taatacgactcactatagggggccggcccaccccaactgcaaaaagggccaacagaggagaggccctatgtgcagttggaacctggcggcagcgcaaaagatg

SEQ ID NO: 151366 - DNA, 103 bp, Artificial Sequence
  Synthetic Polynucleotide
taatacgactcactatagggtccaaagcttggccggcccaccccaactgcaacagaggagagcagttatggtgggccggaacctggcggcagcgcaaaagatg

SEQ ID NO: 151367 - DNA, 103 bp, Artificial Sequence
  Synthetic Polynucleotide
taatacgactcactataggggggtccctagtccaaagcttggccggcccaaacagaggagatgggccatgcaagctttgaacctggcggcagcgcaaaagatg

SEQ ID NO: 151368 - DNA, 103 bp, Artificial Sequence
  Synthetic Polynucleotide
taatacgactcactatagggggtgagcggcaagggatggaggcaccgagcaacagaggagagctcggatgctccatcccaacctggcggcagcgcaaaagatg

SEQ ID NO: 151369 - DNA, 103 bp, Artificial Sequence
  Synthetic Polynucleotide
taatacgactcactatagggttggcttttggggtccctagtccaaagcttaacagaggagaaagcttatgactagggacaacctggcggcagcgcaaaagatg

SEQ ID NO: 151370 - DNA, 103 bp, Artificial Sequence
  Synthetic Polynucleotide
taatacgactcactatagggtccatctcccttggcttttggggtccctagaacagaggagactagggatgccaaaagccaacctggcggcagcgcaaaagatg

SEQ ID NO: 151371 - DNA, 103 bp, Artificial Sequence
  Synthetic Polynucleotide
taatacgactcactatagggtttctgagcctccatctcccttggcttttgaacagaggagacaaaagatgagggagatgaacctggcggcagcgcaaaagatg

SEQ ID NO: 151372 - DNA, 103 bp, Artificial Sequence
  Synthetic Polynucleotide
taatacgactcactatagggagttccttcctttctgagcctccatctcccaacagaggagagggagaatgaggctcagaaacctggcggcagcgcaaaagatg

SEQ ID NO: 151373 - DNA, 103 bp, Artificial Sequence
  Synthetic Polynucleotide
taatacgactcactatagggcgatgtggggagttccttcctttctgagccaacagaggagaggctcaatgaggaaggaaaacctggcggcagcgcaaaagatg

SEQ ID NO: 151374 - DNA, 103 bp, Artificial Sequence
  Synthetic Polynucleotide
taatacgactcactatagggctcctttctgcgatgtggggagttccttccaacagaggagaggaaggatgtccccacataacctggcggcagcgcaaaagatg

SEQ ID NO: 151375 - DNA, 103 bp, Artificial Sequence
  Synthetic Polynucleotide
taatacgactcactatagggggaccatcatctcctttctgcgatgtggggaacagaggagaccccacatggcagaaaggaacctggcggcagcgcaaaagatg

SEQ ID NO: 151376 - DNA, 103 bp, Artificial Sequence
  Synthetic Polynucleotide
taatacgactcactatagggtgcaatatctggaccatcatctcctttctgaacagaggagacagaaaatggatgatggtaacctggcggcagcgcaaaagatg

SEQ ID NO: 151377 - DNA, 103 bp, Artificial Sequence
  Synthetic Polynucleotide
taatacgactcactatagggattcttcatctgcaatatctggaccatcataacagaggagaatgatgatgcagatattgaacctggcggcagcgcaaaagatg

SEQ ID NO: 151378 - DNA, 103 bp, Artificial Sequence
  Synthetic Polynucleotide
taatacgactcactatagggaggccacgggattcttcatctgcaatatctaacagaggagaagatatatgagatgaagaaacctggcggcagcgcaaaagatg

SEQ ID NO: 151379 - DNA, 103 bp, Artificial Sequence
  Synthetic Polynucleotide
taatacgactcactatagggtggacatccaggtgagcggcaagggatggaaacagaggagatccatcatgtgccgctcaaacctggcggcagcgcaaaagatg

SEQ ID NO: 151380 - DNA, 103 bp, Artificial Sequence
  Synthetic Polynucleotide
taatacgactcactatagggtttgccctcgaggccacgggattcttcatcaacagaggagagatgaaatgtcccgtggcaacctggcggcagcgcaaaagatg

SEQ ID NO: 151381 - DNA, 103 bp, Artificial Sequence
  Synthetic Polynucleotide
taatacgactcactataggggtgtatcggctttgccctcgaggccacgggaacagaggagacccgtgatgtcgagggcaaacctggcggcagcgcaaaagatg

SEQ ID NO: 151382 - DNA, 103 bp, Artificial Sequence
  Synthetic Polynucleotide
taatacgactcactatagggtcaggtcctggtgtatcggctttgccctcgaacagaggagacgagggatgagccgatacaacctggcggcagcgcaaaagatg

SEQ ID NO: 151383 - DNA, 103 bp, Artificial Sequence
  Synthetic Polynucleotide
taatacgactcactataggggcccccatcctcaggtcctggtgtatcggcaacagaggagagccgatatgccaggacctaacctggcggcagcgcaaaagatg

SEQ ID NO: 151384 - DNA, 103 bp, Artificial Sequence
  Synthetic Polynucleotide
taatacgactcactatagggatgccttcacgcccccatcctcaggtcctgaacagaggagacaggacatgaggatggggaacctggcggcagcgcaaaagatg

SEQ ID NO: 151385 - DNA, 103 bp, Artificial Sequence
  Synthetic Polynucleotide
taatacgactcactatagggggcactggggatgccttcacgcccccatccaacagaggagaggatggatgcgtgaaggcaacctggcggcagcgcaaaagatg

SEQ ID NO: 151386 - DNA, 103 bp, Artificial Sequence
  Synthetic Polynucleotide
taatacgactcactatagggagggtcactgggcactggggatgccttcacaacagaggagagtgaagatgtccccagtgaacctggcggcagcgcaaaagatg

SEQ ID NO: 151387 - DNA, 103 bp, Artificial Sequence
  Synthetic Polynucleotide
taatacgactcactatagggctggcttctcagggtcactgggcactggggaacagaggagaccccagatgccagtgaccaacctggcggcagcgcaaaagatg

SEQ ID NO: 151388 - DNA, 103 bp, Artificial Sequence
  Synthetic Polynucleotide
taatacgactcactatagggcctggggtgcctggcttctcagggtcactgaacagaggagacagtgaatgtgagaagccaacctggcggcagcgcaaaagatg

SEQ ID NO: 151389 - DNA, 103 bp, Artificial Sequence
  Synthetic Polynucleotide
taatacgactcactatagggcatcccttcacctggggtgcctggcttctcaacagaggagagagaagatgggcaccccaaacctggcggcagcgcaaaagatg

SEQ ID NO: 151390 - DNA, 103 bp, Artificial Sequence
  Synthetic Polynucleotide
taatacgactcactatagggggtaaagccgtggacatccaggtgagcggcaacagaggagagccgctatgctggatgtcaacctggcggcagcgcaaaagatg

SEQ ID NO: 151391 - DNA, 103 bp, Artificial Sequence
  Synthetic Polynucleotide
taatacgactcactatagggcagagctaagcatcccttcacctggggtgcaacagaggagagcacccatggtgaagggaaacctggcggcagcgcaaaagatg

SEQ ID NO: 151392 - DNA, 103 bp, Artificial Sequence
  Synthetic Polynucleotide
taatacgactcactatagggctgtctaagtcagagctaagcatcccttcaaacagaggagatgaaggatggcttagctcaacctggcggcagcgcaaaagatg

SEQ ID NO: 151393 - DNA, 103 bp, Artificial Sequence
  Synthetic Polynucleotide
taatacgactcactatagggtgtggaaatcctgtctaagtcagagctaagaacagaggagacttagcatggacttagacaacctggcggcagcgcaaaagatg

SEQ ID NO: 151394 - DNA, 103 bp, Artificial Sequence
  Synthetic Polynucleotide
taatacgactcactataggggcagttcttctgtggaaatcctgtctaagtaacagaggagaacttagatgggatttccaaacctggcggcagcgcaaaagatg

SEQ ID NO: 151395 - DNA, 103 bp, Artificial Sequence
  Synthetic Polynucleotide
taatacgactcactatagggtccatcttgggcagttcttctgtggaaatcaacagaggagagatttcatgagaagaactaacctggcggcagcgcaaaagatg

SEQ ID NO: 151396 - DNA, 103 bp, Artificial Sequence
  Synthetic Polynucleotide
taatacgactcactataggggtccttggattccatcttgggcagttcttcaacagaggagagaagaaatgcccaagatgaacctggcggcagcgcaaaagatg

SEQ ID NO: 151397 - DNA, 103 bp, Artificial Sequence
  Synthetic Polynucleotide
taatacgactcactataggggctgctgcaggtccttggattccatcttggaacagaggagaccaagaatgaatccaaggaacctggcggcagcgcaaaagatg

SEQ ID NO: 151398 - DNA, 103 bp, Artificial Sequence
  Synthetic Polynucleotide
taatacgactcactatagggtccttgaagagctgctgcaggtccttggataacagaggagaatccaaatgcctgcagcaaacctggcggcagcgcaaaagatg

SEQ ID NO: 151399 - DNA, 103 bp, Artificial Sequence
  Synthetic Polynucleotide
taatacgactcactataggggcccagaacatccttgaagagctgctgcagaacagaggagactgcagatgctcttcaagaacctggcggcagcgcaaaagatg

SEQ ID NO: 151400 - DNA, 103 bp, Artificial Sequence
  Synthetic Polynucleotide
taatacgactcactatagggctcgttcagagcccagaacatccttgaagaaacagaggagatcttcaatgatgttctggaacctggcggcagcgcaaaagatg

SEQ ID NO: 151401 - DNA, 103 bp, Artificial Sequence
  Synthetic Polynucleotide
taatacgactcactatagggcaggggaagtggtaaagccgtggacatccaaacagaggagatggatgatgacggctttaaacctggcggcagcgcaaaagatg

SEQ ID NO: 151402 - DNA, 103 bp, Artificial Sequence
  Synthetic Polynucleotide
taatacgactcactatagggagatgctgttctcgttcagagcccagaacaaacagaggagatgttctatgctctgaacgaacctggcggcagcgcaaaagatg

SEQ ID NO: 151403 - DNA, 103 bp, Artificial Sequence
  Synthetic Polynucleotide
taatacgactcactatagggtccacaacccagatgctgttctcgttcagaaacagaggagatctgaaatggaacagcataacctggcggcagcgcaaaagatg

SEQ ID NO: 151404 - DNA, 103 bp, Artificial Sequence
  Synthetic Polynucleotide
taatacgactcactatagggggccaggggttccacaacccagatgctgttaacagaggagaaacagcatgtgggttgtgaacctggcggcagcgcaaaagatg

SEQ ID NO: 151405 - DNA, 103 bp, Artificial Sequence
  Synthetic Polynucleotide
taatacgactcactatagggctgccttctaggccaggggttccacaacccaacagaggagagggttgatgaacccctggaacctggcggcagcgcaaaagatg

SEQ ID NO: 151406 - DNA, 103 bp, Artificial Sequence
  Synthetic Polynucleotide
taatacgactcactatagggtggcgtacggctgccttctaggccaggggtaacagaggagaacccctatgctagaaggcaacctggcggcagcgcaaaagatg

SEQ ID NO: 151407 - DNA, 103 bp, Artificial Sequence
  Synthetic Polynucleotide
taatacgactcactataggggcctctgcagtggcgtacggctgccttctaaacagaggagatagaagatggccgtacgcaacctggcggcagcgcaaaagatg

SEQ ID NO: 151408 - DNA, 103 bp, Artificial Sequence
  Synthetic Polynucleotide
taatacgactcactatagggtgaagaaagggcctctgcagtggcgtacggaacagaggagaccgtacatgactgcagagaacctggcggcagcgcaaaagatg

SEQ ID NO: 151409 - DNA, 103 bp, Artificial Sequence
  Synthetic Polynucleotide
taatacgactcactataggggagtccaccttgaagaaagggcctctgcagaacagaggagactgcagatgccctttcttaacctggcggcagcgcaaaagatg

SEQ ID NO: 151410 - DNA, 103 bp, Artificial Sequence
  Synthetic Polynucleotide
taatacgactcactatagggtgcccaaagggagtccaccttgaagaaaggaacagaggagacctttcatgaaggtggacaacctggcggcagcgcaaaagatg

SEQ ID NO: 151411 - DNA, 103 bp, Artificial Sequence
  Synthetic Polynucleotide
taatacgactcactataggggagggcagattgcccaaagggagtccacctaacagaggagaaggtggatgccctttgggaacctggcggcagcgcaaaagatg

SEQ ID NO: 151412 - DNA, 103 bp, Artificial Sequence
  Synthetic Polynucleotide
taatacgactcactatagggggcagtcgcgcaggggaagtggtaaagccgaacagaggagacggcttatgcacttccccaacctggcggcagcgcaaaagatg

SEQ ID NO: 151413 - DNA, 103 bp, Artificial Sequence
  Synthetic Polynucleotide
taatacgactcactatagggtgggctgctggagggcagattgcccaaaggaacagaggagacctttgatgaatctgcccaacctggcggcagcgcaaaagatg

SEQ ID NO: 151414 - DNA, 103 bp, Artificial Sequence
  Synthetic Polynucleotide
taatacgactcactatagggaggagtccattgggctgctggagggcagataacagaggagaatctgcatgccagcagccaacctggcggcagcgcaaaagatg

SEQ ID NO: 151415 - DNA, 103 bp, Artificial Sequence
  Synthetic Polynucleotide
taatacgactcactatagggaggcctgggtaggagtccattgggctgctgaacagaggagacagcagatgaatggactcaacctggcggcagcgcaaaagatg

SEQ ID NO: 151416 - DNA, 103 bp, Artificial Sequence
  Synthetic Polynucleotide
taatacgactcactatagggggactggcagaggcctgggtaggagtccataacagaggagaatggacatgtacccaggcaacctggcggcagcgcaaaagatg

SEQ ID NO: 151417 - DNA, 103 bp, Artificial Sequence
  Synthetic Polynucleotide
taatacgactcactatagggccaggaacggggactggcagaggcctgggtaacagaggagaacccagatgtctgccagtaacctggcggcagcgcaaaagatg

SEQ ID NO: 151418 - DNA, 103 bp, Artificial Sequence
  Synthetic Polynucleotide
taatacgactcactatagggtccctagaatccaggaacggggactggcagaacagaggagactgccaatgcccgttcctaacctggcggcagcgcaaaagatg

SEQ ID NO: 151419 - DNA, 103 bp, Artificial Sequence
  Synthetic Polynucleotide
taatacgactcactataggggcccccgcgctccctagaatccaggaacggaacagaggagaccgttcatggattctaggaacctggcggcagcgcaaaagatg

SEQ ID NO: 151420 - DNA, 103 bp, Artificial Sequence
  Synthetic Polynucleotide
taatacgactcactatagggggctaaagaagcccccgcgctccctagaataacagaggagaattctaatgagcgcggggaacctggcggcagcgcaaaagatg

SEQ ID NO: 151421 - DNA, 103 bp, Artificial Sequence
  Synthetic Polynucleotide
taatacgactcactatagggccgggttccgggctaaagaagcccccgcgcaacagaggagagcgcggatgcttctttagaacctggcggcagcgcaaaagatg

SEQ ID NO: 151422 - DNA, 103 bp, Artificial Sequence
  Synthetic Polynucleotide
taatacgactcactataggggtcgggctcaccgggttccgggctaaagaaaacagaggagattctttatgccggaacccaacctggcggcagcgcaaaagatg

SEQ ID NO: 151423 - DNA, 103 bp, Artificial Sequence
  Synthetic Polynucleotide
taatacgactcactatagggaggaaccgctggcagtcgcgcaggggaagtaacagaggagaacttccatggcgcgactgaacctggcggcagcgcaaaagatg

SEQ ID NO: 151424 - DNA, 103 bp, Artificial Sequence
  Synthetic Polynucleotide
taatacgactcactatagggtccaggggctgtcgggctcaccgggttccgaacagaggagacggaacatggtgagcccgaacctggcggcagcgcaaaagatg

SEQ ID NO: 151425 - DNA, 103 bp, Artificial Sequence
  Synthetic Polynucleotide
taatacgactcactatagggcctgagcccgtccaggggctgtcgggctcaaacagaggagatgagccatgcagcccctgaacctggcggcagcgcaaaagatg

SEQ ID NO: 151426 - DNA, 103 bp, Artificial Sequence
  Synthetic Polynucleotide
taatacgactcactatagggcgtggtgccacctgagcccgtccaggggctaacagaggagaagccccatgacgggctcaaacctggcggcagcgcaaaagatg

SEQ ID NO: 151427 - DNA, 103 bp, Artificial Sequence
  Synthetic Polynucleotide
taatacgactcactataggggggtggagggcgtggtgccacctgagcccgaacagaggagacgggctatggtggcaccaaacctggcggcagcgcaaaagatg

SEQ ID NO: 151428 - DNA, 103 bp, Artificial Sequence
  Synthetic Polynucleotide
taatacgactcactatagggggggttgtgggggtggagggcgtggtgccaaacagaggagatggcacatggccctccacaacctggcggcagcgcaaaagatg

SEQ ID NO: 151429 - DNA, 103 bp, Artificial Sequence
  Synthetic Polynucleotide
taatacgactcactatagggctccgtggtgggggttgtgggggtggagggaacagaggagaccctccatgcccacaaccaacctggcggcagcgcaaaagatg

SEQ ID NO: 151430 - DNA, 103 bp, Artificial Sequence
  Synthetic Polynucleotide
taatacgactcactatagggcgccctcaccctccgtggtgggggttgtggaacagaggagaccacaaatgccaccacggaacctggcggcagcgcaaaagatg

SEQ ID NO: 151431 - DNA, 103 bp, Artificial Sequence
  Synthetic Polynucleotide
taatacgactcactataggggagagtccgtcgccctcaccctccgtggtgaacagaggagacaccacatggggtgagggaacctggcggcagcgcaaaagatg

SEQ ID NO: 151432 - DNA, 103 bp, Artificial Sequence
  Synthetic Polynucleotide
taatacgactcactatagggctggttataggagagtccgtcgccctcaccaacagaggagaggtgagatggacggactcaacctggcggcagcgcaaaagatg

SEQ ID NO: 151433 - DNA, 103 bp, Artificial Sequence
  Synthetic Polynucleotide
taatacgactcactataggggaagactccgctggttataggagagtccgtaacagaggagaacggacatgcctataaccaacctggcggcagcgcaaaagatg

SEQ ID NO: 151434 - DNA, 103 bp, Artificial Sequence
  Synthetic Polynucleotide
taatacgactcactatagggcttgggtcctcagaagctgcaggtccatcaaacagaggagatgatggatgtgcagcttcaacctggcggcagcgcaaaagatg

SEQ ID NO: 151435 - DNA, 103 bp, Artificial Sequence
  Synthetic Polynucleotide
taatacgactcactatagggatggataggaaggaaccgctggcagtcgcgaacagaggagacgcgacatgcagcggttcaacctggcggcagcgcaaaagatg

SEQ ID NO: 151436 - DNA, 103 bp, Artificial Sequence
  Synthetic Polynucleotide
taatacgactcactatagggtcccagcgctgaagactccgctggttatagaacagaggagactataaatggcggagtctaacctggcggcagcgcaaaagatg

SEQ ID NO: 151437 - DNA, 103 bp, Artificial Sequence
  Synthetic Polynucleotide
taatacgactcactatagggctcatccttctcccagcgctgaagactccgaacagaggagacggagtatgcagcgctggaacctggcggcagcgcaaaagatg

SEQ ID NO: 151438 - DNA, 103 bp, Artificial Sequence
  Synthetic Polynucleotide
taatacgactcactatagggggcccaactcctcatccttctcccagcgctaacagaggagaagcgctatgagaaggatgaacctggcggcagcgcaaaagatg

SEQ ID NO: 151439 - DNA, 103 bp, Artificial Sequence
  Synthetic Polynucleotide
taatacgactcactataggggtggacagctggcccaactcctcatccttcaacagaggagagaaggaatgggagttgggaacctggcggcagcgcaaaagatg

SEQ ID NO: 151440 - DNA, 103 bp, Artificial Sequence
  Synthetic Polynucleotide
taatacgactcactatagggaggtgagatggtggacagctggcccaactcaacagaggagagagttgatgcagctgtccaacctggcggcagcgcaaaagatg

SEQ ID NO: 151441 - DNA, 103 bp, Artificial Sequence
  Synthetic Polynucleotide
taatacgactcactatagggcatagagcacaggtgagatggtggacagctaacagaggagaagctgtatgccatctcacaacctggcggcagcgcaaaagatg

SEQ ID NO: 151442 - DNA, 103 bp, Artificial Sequence
  Synthetic Polynucleotide
taatacgactcactatagggttaatgttggcatagagcacaggtgagatgaacagaggagacatctcatgtgtgctctaaacctggcggcagcgcaaaagatg

SEQ ID NO: 151443 - DNA, 103 bp, Artificial Sequence
  Synthetic Polynucleotide
taatacgactcactatagggattaggaaaattaatgttggcatagagcacaacagaggagagtgctcatggccaacattaacctggcggcagcgcaaaagatg

SEQ ID NO: 151444 - DNA, 103 bp, Artificial Sequence
  Synthetic Polynucleotide
taatacgactcactatagggcttgcttgagattaggaaaattaatgttggaacagaggagaccaacaatgattttcctaaacctggcggcagcgcaaaagatg

SEQ ID NO: 151445 - DNA, 103 bp, Artificial Sequence
  Synthetic Polynucleotide
taatacgactcactatagggtctgggtagtcttgcttgagattaggaaaaaacagaggagattttccatgtctcaagcaaacctggcggcagcgcaaaagatg

SEQ ID NO: 151446 - DNA, 103 bp, Artificial Sequence
  Synthetic Polynucleotide
taatacgactcactatagggcagtgttttcatggataggaaggaaccgctaacagaggagaagcggtatgttcctatccaacctggcggcagcgcaaaagatg

SEQ ID NO: 151447 - DNA, 103 bp, Artificial Sequence
  Synthetic Polynucleotide
taatacgactcactataggggcttgaccagtctgggtagtcttgcttgagaacagaggagactcaagatggactacccaaacctggcggcagcgcaaaagatg

SEQ ID NO: 151448 - DNA, 103 bp, Artificial Sequence
  Synthetic Polynucleotide
taatacgactcactataggggtttgcaacggcttgaccagtctgggtagtaacagaggagaactaccatgactggtcaaaacctggcggcagcgcaaaagatg

SEQ ID NO: 151449 - DNA, 103 bp, Artificial Sequence
  Synthetic Polynucleotide
taatacgactcactatagggttcatgatttgtttgcaacggcttgaccagaacagaggagactggtcatgccgttgcaaaacctggcggcagcgcaaaagatg

SEQ ID NO: 151450 - DNA, 103 bp, Artificial Sequence
  Synthetic Polynucleotide
taatacgactcactatagggtctccagagcttcatgatttgtttgcaacgaacagaggagacgttgcatgcaaatcatgaacctggcggcagcgcaaaagatg

SEQ ID NO: 151451 - DNA, 103 bp, Artificial Sequence
  Synthetic Polynucleotide
taatacgactcactatagggctggaacctttctccagagcttcatgatttaacagaggagaaaatcaatgagctctggaaacctggcggcagcgcaaaagatg

SEQ ID NO: 151452 - DNA, 103 bp, Artificial Sequence
  Synthetic Polynucleotide
taatacgactcactatagggttgtcagctgctggaacctttctccagagcaacagaggagagctctgatgaaaggttccaacctggcggcagcgcaaaagatg

SEQ ID NO: 151453 - DNA, 103 bp, Artificial Sequence
  Synthetic Polynucleotide
taatacgactcactataggggtagggggctttgtcagctgctggaaccttaacagaggagaaaggttatggcagctgacaacctggcggcagcgcaaaagatg

SEQ ID NO: 151454 - DNA, 103 bp, Artificial Sequence
  Synthetic Polynucleotide
taatacgactcactatagggccttttgcaggtagggggctttgtcagctgaacagaggagacagctgatgaagccccctaacctggcggcagcgcaaaagatg

SEQ ID NO: 151455 - DNA, 103 bp, Artificial Sequence
  Synthetic Polynucleotide
taatacgactcactatagggttatctttggccttttgcaggtagggggctaacagaggagaagccccatgcctgcaaaaaacctggcggcagcgcaaaagatg

SEQ ID NO: 151456 - DNA, 103 bp, Artificial Sequence
  Synthetic Polynucleotide
taatacgactcactatagggagctgcccggttatctttggccttttgcagaacagaggagactgcaaatggccaaagataacctggcggcagcgcaaaagatg

SEQ ID NO: 151457 - DNA, 103 bp, Artificial Sequence
  Synthetic Polynucleotide
taatacgactcactatagggatagcagctgcagtgttttcatggataggaaacagaggagatcctatatgtgaaaacacaacctggcggcagcgcaaaagatg

SEQ ID NO: 151458 - DNA, 103 bp, Artificial Sequence
  Synthetic Polynucleotide
taatacgactcactatagggtgatgcggtgagctgcccggttatctttggaacagaggagaccaaagatgaccgggcagaacctggcggcagcgcaaaagatg

SEQ ID NO: 151459 - DNA, 103 bp, Artificial Sequence
  Synthetic Polynucleotide
taatacgactcactatagggtgcaccttgttgatgcggtgagctgcccggaacagaggagaccgggcatgtcaccgcataacctggcggcagcgcaaaagatg

SEQ ID NO: 151460 - DNA, 103 bp, Artificial Sequence
  Synthetic Polynucleotide
taatacgactcactatagggagcctgcttctgcaccttgttgatgcggtgaacagaggagacaccgcatgaacaaggtgaacctggcggcagcgcaaaagatg

SEQ ID NO: 151461 - DNA, 103 bp, Artificial Sequence
  Synthetic Polynucleotide
taatacgactcactatagggtctggctctcagcctgcttctgcaccttgtaacagaggagaacaaggatgagaagcaggaacctggcggcagcgcaaaagatg

SEQ ID NO: 151462 - DNA, 103 bp, Artificial Sequence
  Synthetic Polynucleotide
taatacgactcactatagggtgcttgttgatctggctctcagcctgcttcaacagaggagagaagcaatgtgagagccaaacctggcggcagcgcaaaagatg

SEQ ID NO: 151463 - DNA, 103 bp, Artificial Sequence
  Synthetic Polynucleotide
taatacgactcactatagggcaccttggtctgcttgttgatctggctctcaacagaggagagagagcatgatcaacaagaacctggcggcagcgcaaaagatg

SEQ ID NO: 151464 - DNA, 103 bp, Artificial Sequence
  Synthetic Polynucleotide
taatacgactcactatagggctatgtcgcccaccttggtctgcttgttgaaacagaggagatcaacaatgagaccaaggaacctggcggcagcgcaaaagatg

SEQ ID NO: 151465 - DNA, 103 bp, Artificial Sequence
  Synthetic Polynucleotide
taatacgactcactataggggtcttacgggctatgtcgcccaccttggtcaacagaggagagaccaaatggggcgacataacctggcggcagcgcaaaagatg

SEQ ID NO: 151466 - DNA, 103 bp, Artificial Sequence
  Synthetic Polynucleotide
taatacgactcactatagggcggtcggtcagtcttacgggctatgtcgccaacagaggagaggcgacatggcccgtaagaacctggcggcagcgcaaaagatg

SEQ ID NO: 151467 - DNA, 103 bp, Artificial Sequence
  Synthetic Polynucleotide
taatacgactcactataggggatgtagggccggtcggtcagtcttacgggaacagaggagacccgtaatgctgaccgacaacctggcggcagcgcaaaagatg

SEQ ID NO: 151468 - DNA, 103 bp, Artificial Sequence
  Synthetic Polynucleotide
taatacgactcactatagggtgctctgggcatagcagctgcagtgttttcaacagaggagagaaaacatggcagctgctaacctggcggcagcgcaaaagatg

SEQ ID NO: 151469 - DNA, 103 bp, Artificial Sequence
  Synthetic Polynucleotide
taatacgactcactatagggggaatgcggagatgtagggccggtcggtcaaacagaggagatgaccgatgggccctacaaacctggcggcagcgcaaaagatg

SEQ ID NO: 151470 - DNA, 103 bp, Artificial Sequence
  Synthetic Polynucleotide
taatacgactcactatagggtggctgcgggggaatgcggagatgtagggcaacagaggagagccctaatgctccgcattaacctggcggcagcgcaaaagatg

SEQ ID NO: 151471 - DNA, 103 bp, Artificial Sequence
  Synthetic Polynucleotide
taatacgactcactatagggccagtgcccctggctgcgggggaatgcggaaacagaggagatccgcaatgccccgcagcaacctggcggcagcgcaaaagatg

SEQ ID NO: 151472 - DNA, 103 bp, Artificial Sequence
  Synthetic Polynucleotide
taatacgactcactatagggggcgggctgcccagtgcccctggctgcgggaacagaggagacccgcaatgaggggcactaacctggcggcagcgcaaaagatg

SEQ ID NO: 151473 - DNA, 103 bp, Artificial Sequence
  Synthetic Polynucleotide
taatacgactcactatagggagcagcggggggcgggctgcccagtgccccaacagaggagaggggcaatgggcagcccgaacctggcggcagcgcaaaagatg

SEQ ID NO: 151474 - DNA, 103 bp, Artificial Sequence
  Synthetic Polynucleotide
taatacgactcactatagggtggtgggggcagcagcggggggcgggctgcaacagaggagagcagccatgcccccgctgaacctggcggcagcgcaaaagatg

SEQ ID NO: 151475 - DNA, 103 bp, Artificial Sequence
  Synthetic Polynucleotide
taatacgactcactatagggccaatgaaaatggtgggggcagcagcggggaacagaggagaccccgcatgtgcccccacaacctggcggcagcgcaaaagatg

SEQ ID NO: 151476 - DNA, 103 bp, Artificial Sequence
  Synthetic Polynucleotide
taatacgactcactatagggagtggggctgccaatgaaaatggtgggggcaacagaggagagcccccatgattttcattaacctggcggcagcgcaaaagatg

SEQ ID NO: 151477 - DNA, 103 bp, Artificial Sequence
  Synthetic Polynucleotide
taatacgactcactatagggcggcgggggtagtggggctgccaatgaaaaaacagaggagattttcaatggcagccccaaacctggcggcagcgcaaaagatg

SEQ ID NO: 151478 - DNA, 103 bp, Artificial Sequence
  Synthetic Polynucleotide
taatacgactcactataggggtagacaagccggcgggggtagtggggctgaacagaggagacagcccatgtacccccgcaacctggcggcagcgcaaaagatg

SEQ ID NO: 151479 - DNA, 103 bp, Artificial Sequence
  Synthetic Polynucleotide
taatacgactcactatagggcccctcactgtgctctgggcatagcagctgaacagaggagacagctgatgtgcccagagaacctggcggcagcgcaaaagatg

SEQ ID NO: 151480 - DNA, 103 bp, Artificial Sequence
  Synthetic Polynucleotide
taatacgactcactataggggtccgcagaggtagacaagccggcgggggtaacagaggagaacccccatgggcttgtctaacctggcggcagcgcaaaagatg

SEQ ID NO: 151481 - DNA, 103 bp, Artificial Sequence
  Synthetic Polynucleotide
taatacgactcactatagggtcaggaacccgtccgcagaggtagacaagcaacagaggagagcttgtatgcctctgcggaacctggcggcagcgcaaaagatg

SEQ ID NO: 151482 - DNA, 103 bp, Artificial Sequence
  Synthetic Polynucleotide
taatacgactcactataggggccggcggcttcaggaacccgtccgcagagaacagaggagactctgcatgcgggttcctaacctggcggcagcgcaaaagatg

SEQ ID NO: 151483 - DNA, 103 bp, Artificial Sequence
  Synthetic Polynucleotide
taatacgactcactatagggcaccgagcccgccggcggcttcaggaacccaacagaggagagggttcatgaagccgccgaacctggcggcagcgcaaaagatg

SEQ ID NO: 151484 - DNA, 103 bp, Artificial Sequence
  Synthetic Polynucleotide
taatacgactcactatagggcagggccaggcaccgagcccgccggcggctaacagaggagaagccgcatgcgggctcggaacctggcggcagcgcaaaagatg

SEQ ID NO: 151485 - DNA, 103 bp, Artificial Sequence
  Synthetic Polynucleotide
taatacgactcactatagggccaggcgagtcagggccaggcaccgagcccaacagaggagagggctcatggcctggcccaacctggcggcagcgcaaaagatg

SEQ ID NO: 151486 - DNA, 103 bp, Artificial Sequence
  Synthetic Polynucleotide
taatacgactcactataggggaagagctcaccaggcgagtcagggccaggaacagaggagacctggcatggactcgcctaacctggcggcagcgcaaaagatg

SEQ ID NO: 151487 - DNA, 103 bp, Artificial Sequence
  Synthetic Polynucleotide
taatacgactcactatagggggagcttgaggaagagctcaccaggcgagtaacagaggagaactcgcatggtgagctctaacctggcggcagcgcaaaagatg

SEQ ID NO: 151488 - DNA, 103 bp, Artificial Sequence
  Synthetic Polynucleotide
taatacgactcactatagggacctggggtgggagcttgaggaagagctcaaacagaggagatgagctatgcctcaagctaacctggcggcagcgcaaaagatg

SEQ ID NO: 151489 - DNA, 103 bp, Artificial Sequence
  Synthetic Polynucleotide
taatacgactcactatagggttgggcgggcacctggggtgggagcttgagaacagaggagactcaagatgccaccccagaacctggcggcagcgcaaaagatg

SEQ ID NO: 151490 - DNA, 103 bp, Artificial Sequence
  Synthetic Polynucleotide
taatacgactcactataggggatatgcagccccctcactgtgctctgggcaacagaggagagcccagatgacagtgaggaacctggcggcagcgcaaaagatg

SEQ ID NO: 151491 - DNA, 103 bp, Artificial Sequence
  Synthetic Polynucleotide
taatacgactcactataggggcgaaggcacttgggcgggcacctggggtgaacagaggagacaccccatgtgcccgcccaacctggcggcagcgcaaaagatg

SEQ ID NO: 151492 - DNA, 103 bp, Artificial Sequence
  Synthetic Polynucleotide
taatacgactcactatagggaaggggtcctgcgaaggcacttgggcgggcaacagaggagagcccgcatgagtgccttcaacctggcggcagcgcaaaagatg

SEQ ID NO: 151493 - DNA, 103 bp, Artificial Sequence
  Synthetic Polynucleotide
taatacgactcactatagggggccagtccaaaggggtcctgcgaaggcacaacagaggagagtgcctatgcaggaccccaacctggcggcagcgcaaaagatg

SEQ ID NO: 151494 - DNA, 103 bp, Artificial Sequence
  Synthetic Polynucleotide
taatacgactcactataggggataggcaggggccagtccaaaggggtcctaacagaggagaaggaccatgttggactggaacctggcggcagcgcaaaagatg

SEQ ID NO: 151495 - DNA, 103 bp, Artificial Sequence
  Synthetic Polynucleotide
taatacgactcactatagggggctccaggggataggcaggggccagtccaaacagaggagatggactatgccctgcctaaacctggcggcagcgcaaaagatg

SEQ ID NO: 151496 - DNA, 103 bp, Artificial Sequence
  Synthetic Polynucleotide
taatacgactcactatagggggggaagcggggctccaggggataggcaggaacagaggagacctgccatgcccctggagaacctggcggcagcgcaaaagatg

SEQ ID NO: 151497 - DNA, 103 bp, Artificial Sequence
  Synthetic Polynucleotide
taatacgactcactataggggcggtgccgtggggaagcggggctccagggaacagaggagaccctggatgcccgcttccaacctggcggcagcgcaaaagatg

SEQ ID NO: 151498 - DNA, 103 bp, Artificial Sequence
  Synthetic Polynucleotide
taatacgactcactatagggggataggtgggcggtgccgtggggaagcggaacagaggagaccgcttatgcacggcaccaacctggcggcagcgcaaaagatg

SEQ ID NO: 151499 - DNA, 103 bp, Artificial Sequence
  Synthetic Polynucleotide
taatacgactcactatagggaggataggggggataggtgggcggtgccgtaacagaggagaacggcaatgcccacctataacctggcggcagcgcaaaagatg

SEQ ID NO: 151500 - DNA, 103 bp, Artificial Sequence
  Synthetic Polynucleotide
taatacgactcactatagggccgtaggactaggataggggggataggtggaacagaggagaccacctatgccccctatcaacctggcggcagcgcaaaagatg

SEQ ID NO: 151501 - DNA, 103 bp, Artificial Sequence
  Synthetic Polynucleotide
taatacgactcactataggggcctcctccagatatgcagccccctcactgaacagaggagacagtgaatgggctgcataaacctggcggcagcgcaaaagatg

SEQ ID NO: 151502 - DNA, 103 bp, Artificial Sequence
  Synthetic Polynucleotide
taatacgactcactataggggcaggggcccccgtaggactaggataggggaacagaggagacccctaatgtagtcctacaacctggcggcagcgcaaaagatg

SEQ ID NO: 151503 - DNA, 103 bp, Artificial Sequence
  Synthetic Polynucleotide
taatacgactcactatagggcgggggctgcgcaggggcccccgtaggactaacagaggagaagtcctatgggggcccctaacctggcggcagcgcaaaagatg

SEQ ID NO: 151504 - DNA, 103 bp, Artificial Sequence
  Synthetic Polynucleotide
taatacgactcactatagggcgcccagcatcgggggctgcgcaggggcccaacagaggagagggcccatgcgcagccccaacctggcggcagcgcaaaagatg

SEQ ID NO: 151505 - DNA, 103 bp, Artificial Sequence
  Synthetic Polynucleotide
taatacgactcactatagggcgagatgaggcgcccagcatcgggggctgcaacagaggagagcagccatggatgctgggaacctggcggcagcgcaaaagatg

SEQ ID NO: 151506 - DNA, 103 bp, Artificial Sequence
  Synthetic Polynucleotide
taatacgactcactatagggagccccaggacgagatgaggcgcccagcataacagaggagaatgctgatggcctcatctaacctggcggcagcgcaaaagatg

SEQ ID NO: 151507 - DNA, 103 bp, Artificial Sequence
  Synthetic Polynucleotide
taatacgactcactatagggctggctggccagccccaggacgagatgaggaacagaggagacctcatatggtcctggggaacctggcggcagcgcaaaagatg

SEQ ID NO: 151508 - DNA, 103 bp, Artificial Sequence
  Synthetic Polynucleotide
taatacgactcactatagggtggaattcccctggctggccagccccaggaaacagaggagatcctggatgtggccagccaacctggcggcagcgcaaaagatg

SEQ ID NO: 151509 - DNA, 103 bp, Artificial Sequence
  Synthetic Polynucleotide
taatacgactcactatagggtggggtagtgtggaattcccctggctggccaacagaggagaggccagatgggggaattcaacctggcggcagcgcaaaagatg

SEQ ID NO: 151510 - DNA, 103 bp, Artificial Sequence
  Synthetic Polynucleotide
taatacgactcactataggggggtgccaggtggggtagtgtggaattcccaacagaggagagggaatatgacactacccaacctggcggcagcgcaaaagatg

SEQ ID NO: 151511 - DNA, 103 bp, Artificial Sequence
  Synthetic Polynucleotide
taatacgactcactatagggtggtgtctgggggtgccaggtggggtagtgaacagaggagacactacatgacctggcacaacctggcggcagcgcaaaagatg

SEQ ID NO: 151512 - DNA, 103 bp, Artificial Sequence
  Synthetic Polynucleotide
taatacgactcactatagggtgcacagcgagcctcctccagatatgcagcaacagaggagagctgcaatgctggaggagaacctggcggcagcgcaaaagatg

SEQ ID NO: 151513 - DNA, 103 bp, Artificial Sequence
  Synthetic Polynucleotide
taatacgactcactatagggtgtggagggctggtgtctgggggtgccaggaacagaggagacctggcatgcccagacacaacctggcggcagcgcaaaagatg

SEQ ID NO: 151514 - DNA, 103 bp, Artificial Sequence
  Synthetic Polynucleotide
taatacgactcactatagggatgggtcaggtgtggagggctggtgtctggaacagaggagaccagacatgagccctccaaacctggcggcagcgcaaaagatg

SEQ ID NO: 151515 - DNA, 103 bp, Artificial Sequence
  Synthetic Polynucleotide
taatacgactcactatagggggtttgaggaatgggtcaggtgtggagggcaacagaggagagccctcatgacctgacccaacctggcggcagcgcaaaagatg

SEQ ID NO: 151516 - DNA, 103 bp, Artificial Sequence
  Synthetic Polynucleotide
taatacgactcactatagggggggcagcggggtttgaggaatgggtcaggaacagaggagacctgacatgttcctcaaaaacctggcggcagcgcaaaagatg

SEQ ID NO: 151517 - DNA, 103 bp, Artificial Sequence
  Synthetic Polynucleotide
taatacgactcactatagggtatccagcgaggggcagcggggtttgaggaaacagaggagatcctcaatgcccgctgccaacctggcggcagcgcaaaagatg

SEQ ID NO: 151518 - DNA, 103 bp, Artificial Sequence
  Synthetic Polynucleotide
taatacgactcactatagggacagccaagttatccagcgaggggcagcggaacagaggagaccgctgatgctcgctggaaacctggcggcagcgcaaaagatg

SEQ ID NO: 151519 - DNA, 103 bp, Artificial Sequence
  Synthetic Polynucleotide
taatacgactcactataggggctctcaggcacagccaagttatccagcgaaacagaggagatcgctgatgaacttggctaacctggcggcagcgcaaaagatg

SEQ ID NO: 151520 - DNA, 103 bp, Artificial Sequence
  Synthetic Polynucleotide
taatacgactcactatagggctaccccagggctctcaggcacagccaagtaacagaggagaacttggatgtgcctgagaaacctggcggcagcgcaaaagatg

SEQ ID NO: 151521 - DNA, 103 bp, Artificial Sequence
  Synthetic Polynucleotide
taatacgactcactatagggttgcctccccctaccccagggctctcaggcaacagaggagagcctgaatgccctggggtaacctggcggcagcgcaaaagatg

SEQ ID NO: 151522 - DNA, 103 bp, Artificial Sequence
  Synthetic Polynucleotide
taatacgactcactatagggctcggaagctttgcctccccctaccccaggaacagaggagacctgggatggggggaggcaacctggcggcagcgcaaaagatg

SEQ ID NO: 151523 - DNA, 103 bp, Artificial Sequence
  Synthetic Polynucleotide
taatacgactcactatagggcctcacacactgcacagcgagcctcctccaaacagaggagatggaggatgctcgctgtgaacctggcggcagcgcaaaagatg

SEQ ID NO: 151524 - DNA, 103 bp, Artificial Sequence
  Synthetic Polynucleotide
taatacgactcactatagggagagcaggggctcggaagctttgcctccccaacagaggagaggggagatgaagcttccgaacctggcggcagcgcaaaagatg

SEQ ID NO: 151525 - DNA, 103 bp, Artificial Sequence
  Synthetic Polynucleotide
taatacgactcactatagggggtgggggcgagagcaggggctcggaagctaacagaggagaagcttcatggcccctgctaacctggcggcagcgcaaaagatg

SEQ ID NO: 151526 - DNA, 103 bp, Artificial Sequence
  Synthetic Polynucleotide
taatacgactcactatagggctccccaaaaggtgggggcgagagcaggggaacagaggagacccctgatgtcgcccccaaacctggcggcagcgcaaaagatg

SEQ ID NO: 151527 - DNA, 103 bp, Artificial Sequence
  Synthetic Polynucleotide
taatacgactcactatagggccttccgggactccccaaaaggtgggggcgaacagaggagacgccccatgcttttggggaacctggcggcagcgcaaaagatg

SEQ ID NO: 151528 - DNA, 103 bp, Artificial Sequence
  Synthetic Polynucleotide
taatacgactcactatagggacctctagggccttccgggactccccaaaaaacagaggagattttggatggtcccggaaaacctggcggcagcgcaaaagatg

SEQ ID NO: 151529 - DNA, 103 bp, Artificial Sequence
  Synthetic Polynucleotide
taatacgactcactatagggttccttcttcacctctagggccttccgggaaacagaggagatcccggatggccctagagaacctggcggcagcgcaaaagatg

SEQ ID NO: 151530 - DNA, 103 bp, Artificial Sequence
  Synthetic Polynucleotide
taatacgactcactatagggccccaagctcttccttcttcacctctagggaacagaggagaccctagatgtgaagaaggaacctggcggcagcgcaaaagatg

SEQ ID NO: 151531 - DNA, 103 bp, Artificial Sequence
  Synthetic Polynucleotide
taatacgactcactatagggggagaggatgccccaagctcttccttcttcaacagaggagagaagaaatgagagcttggaacctggcggcagcgcaaaagatg

SEQ ID NO: 151532 - DNA, 103 bp, Artificial Sequence
  Synthetic Polynucleotide
taatacgactcactatagggcccatagctaggagaggatgccccaagctcaacagaggagagagcttatggcatcctctaacctggcggcagcgcaaaagatg

SEQ ID NO: 151533 - DNA, 103 bp, Artificial Sequence
  Synthetic Polynucleotide
taatacgactcactatagggggtttgggggcccatagctaggagaggatgaacagaggagacatcctatgctagctatgaacctggcggcagcgcaaaagatg

SEQ ID NO: 151534 - DNA, 103 bp, Artificial Sequence
  Synthetic Polynucleotide
taatacgactcactatagggtcccctggcccctcacacactgcacagcgaaacagaggagatcgctgatgagtgtgtgaaacctggcggcagcgcaaaagatg

SEQ ID NO: 151535 - DNA, 103 bp, Artificial Sequence
  Synthetic Polynucleotide
taatacgactcactatagggacaaagcccaggtttgggggcccatagctaaacagaggagatagctaatggcccccaaaaacctggcggcagcgcaaaagatg

SEQ ID NO: 151536 - DNA, 103 bp, Artificial Sequence
  Synthetic Polynucleotide
taatacgactcactataggggggtgagtcaacaaagcccaggtttgggggaacagaggagacccccaatgctgggctttaacctggcggcagcgcaaaagatg

SEQ ID NO: 151537 - DNA, 103 bp, Artificial Sequence
  Synthetic Polynucleotide
taatacgactcactatagggtgcctgaggagggtgagtcaacaaagcccaaacagaggagatgggctatgttgactcacaacctggcggcagcgcaaaagatg

SEQ ID NO: 151538 - DNA, 103 bp, Artificial Sequence
  Synthetic Polynucleotide
taatacgactcactatagggcccaggtgggtgcctgaggagggtgagtcaaacagaggagatgactcatgctcctcaggaacctggcggcagcgcaaaagatg

SEQ ID NO: 151539 - DNA, 103 bp, Artificial Sequence
  Synthetic Polynucleotide
taatacgactcactatagggctccaggccacccaggtgggtgcctgaggaaacagaggagatcctcaatgacccacctgaacctggcggcagcgcaaaagatg

SEQ ID NO: 151540 - DNA, 103 bp, Artificial Sequence
  Synthetic Polynucleotide
taatacgactcactataggggtgtctttaactccaggccacccaggtgggaacagaggagacccaccatggtggcctggaacctggcggcagcgcaaaagatg

SEQ ID NO: 151541 - DNA, 103 bp, Artificial Sequence
  Synthetic Polynucleotide
taatacgactcactatagggaagacatcaggtgtctttaactccaggccaaacagaggagatggcctatggttaaagacaacctggcggcagcgcaaaagatg

SEQ ID NO: 151542 - DNA, 103 bp, Artificial Sequence
  Synthetic Polynucleotide
taatacgactcactataggggggggctttgaagacatcaggtgtctttaaaacagaggagattaaagatgcctgatgtcaacctggcggcagcgcaaaagatg

SEQ ID NO: 151543 - DNA, 103 bp, Artificial Sequence
  Synthetic Polynucleotide
taatacgactcactataggggaggggtcaggggggctttgaagacatcagaacagaggagactgatgatgtcaaagcccaacctggcggcagcgcaaaagatg

SEQ ID NO: 151544 - DNA, 103 bp, Artificial Sequence
  Synthetic Polynucleotide
taatacgactcactatagggtgagatgcccgaggggtcaggggggctttgaacagaggagacaaagcatgcctgaccccaacctggcggcagcgcaaaagatg

SEQ ID NO: 151545 - DNA, 103 bp, Artificial Sequence
  Synthetic Polynucleotide
taatacgactcactatagggctcagtggcacttgggtcctcagaagctgcaacagaggagagcagctatggaggacccaaacctggcggcagcgcaaaagatg

SEQ ID NO: 151546 - DNA, 103 bp, Artificial Sequence
  Synthetic Polynucleotide
taatacgactcactataggggtcacacaactcccctggcccctcacacacaacagaggagagtgtgtatggggccagggaacctggcggcagcgcaaaagatg

SEQ ID NO: 151547 - DNA, 103 bp, Artificial Sequence
  Synthetic Polynucleotide
taatacgactcactataggggggctctacctgagatgcccgaggggtcagaacagaggagactgaccatgcgggcatctaacctggcggcagcgcaaaagatg

SEQ ID NO: 151548 - DNA, 103 bp, Artificial Sequence
  Synthetic Polynucleotide
taatacgactcactatagggccgggctctggggctctacctgagatgcccaacagaggagagggcatatgaggtagagcaacctggcggcagcgcaaaagatg

SEQ ID NO: 151549 - DNA, 103 bp, Artificial Sequence
  Synthetic Polynucleotide
taatacgactcactatagggaggcccaagcccgggctctggggctctaccaacagaggagaggtagaatgccagagcccaacctggcggcagcgcaaaagatg

SEQ ID NO: 151550 - DNA, 103 bp, Artificial Sequence
  Synthetic Polynucleotide
taatacgactcactatagggctggggccttaggcccaagcccgggctctgaacagaggagacagagcatgggcttgggcaacctggcggcagcgcaaaagatg

SEQ ID NO: 151551 - DNA, 103 bp, Artificial Sequence
  Synthetic Polynucleotide
taatacgactcactatagggggggtggctcctggggccttaggcccaagcaacagaggagagcttggatgtaaggccccaacctggcggcagcgcaaaagatg

SEQ ID NO: 151552 - DNA, 103 bp, Artificial Sequence
  Synthetic Polynucleotide
taatacgactcactataggggcctgggcagggggtggctcctggggccttaacagaggagaaaggccatgggagccaccaacctggcggcagcgcaaaagatg

SEQ ID NO: 151553 - DNA, 103 bp, Artificial Sequence
  Synthetic Polynucleotide
taatacgactcactatagggaggtgccaaagcctgggcagggggtggctcaacagaggagagagccaatgcctgcccagaacctggcggcagcgcaaaagatg

SEQ ID NO: 151554 - DNA, 103 bp, Artificial Sequence
  Synthetic Polynucleotide
taatacgactcactatagggttggaggagaaggtgccaaagcctgggcagaacagaggagactgcccatgctttggcacaacctggcggcagcgcaaaagatg

SEQ ID NO: 151555 - DNA, 103 bp, Artificial Sequence
  Synthetic Polynucleotide
taatacgactcactatagggtctgggtgacttggaggagaaggtgccaaaaacagaggagatttggcatgttctcctccaacctggcggcagcgcaaaagatg

SEQ ID NO: 151556 - DNA, 103 bp, Artificial Sequence
  Synthetic Polynucleotide
taatacgactcactataggggcgaaagatgtctgggtgacttggaggagaaacagaggagatctcctatgagtcacccaaacctggcggcagcgcaaaagatg

SEQ ID NO: 151557 - DNA, 103 bp, Artificial Sequence
  Synthetic Polynucleotide
taatacgactcactatagggagaagaacaggtcacacaactcccctggccaacagaggagaggccagatgagttgtgtgaacctggcggcagcgcaaaagatg

SEQ ID NO: 151558 - DNA, 103 bp, Artificial Sequence
  Synthetic Polynucleotide
taatacgactcactatagggaggagccagggcgaaagatgtctgggtgacaacagaggagagtcaccatgacatctttcaacctggcggcagcgcaaaagatg

SEQ ID NO: 151559 - DNA, 103 bp, Artificial Sequence
  Synthetic Polynucleotide
taatacgactcactataggggggtcagtgtaggagccagggcgaaagatgaacagaggagacatcttatgccctggctcaacctggcggcagcgcaaaagatg

SEQ ID NO: 151560 - DNA, 103 bp, Artificial Sequence
  Synthetic Polynucleotide
taatacgactcactatagggctgagcatatgggtcagtgtaggagccaggaacagaggagacctggcatgtacactgacaacctggcggcagcgcaaaagatg

SEQ ID NO: 151561 - DNA, 103 bp, Artificial Sequence
  Synthetic Polynucleotide
taatacgactcactatagggtcaatgggggctgagcatatgggtcagtgtaacagaggagaacactgatgcatatgctcaacctggcggcagcgcaaaagatg

SEQ ID NO: 151562 - DNA, 103 bp, Artificial Sequence
  Synthetic Polynucleotide
taatacgactcactatagggggccgaggagtcaatgggggctgagcatataacagaggagaatatgcatggcccccattaacctggcggcagcgcaaaagatg

SEQ ID NO: 151563 - DNA, 103 bp, Artificial Sequence
  Synthetic Polynucleotide
taatacgactcactatagggcggaggttggggccgaggagtcaatgggggaacagaggagacccccaatgactcctcggaacctggcggcagcgcaaaagatg

SEQ ID NO: 151564 - DNA, 103 bp, Artificial Sequence
  Synthetic Polynucleotide
taatacgactcactatagggtctcagggggcggaggttggggccgaggagaacagaggagactcctcatgcccaacctcaacctggcggcagcgcaaaagatg

SEQ ID NO: 151565 - DNA, 103 bp, Artificial Sequence
  Synthetic Polynucleotide
taatacgactcactataggggcacagcagctctcagggggcggaggttggaacagaggagaccaaccatggccccctgaaacctggcggcagcgcaaaagatg

SEQ ID NO: 151566 - DNA, 103 bp, Artificial Sequence
  Synthetic Polynucleotide
taatacgactcactatagggagggggcagagcacagcagctctcagggggaacagaggagaccccctatgagctgctgtaacctggcggcagcgcaaaagatg

SEQ ID NO: 151567 - DNA, 103 bp, Artificial Sequence
  Synthetic Polynucleotide
taatacgactcactataggggcagtgagcgagggggcagagcacagcagcaacagaggagagctgctatgctctgccccaacctggcggcagcgcaaaagatg

SEQ ID NO: 151568 - DNA, 103 bp, Artificial Sequence
  Synthetic Polynucleotide
taatacgactcactatagggcagctggtacagaagaacaggtcacacaacaacagaggagagttgtgatgcctgttcttaacctggcggcagcgcaaaagatg

SEQ ID NO: 151569 - DNA, 103 bp, Artificial Sequence
  Synthetic Polynucleotide
taatacgactcactataggggggtcggagggcagtgagcgagggggcagaaacagaggagatctgccatgtcgctcactaacctggcggcagcgcaaaagatg

SEQ ID NO: 151570 - DNA, 103 bp, Artificial Sequence
  Synthetic Polynucleotide
taatacgactcactatagggtcgggagaaagggtcggagggcagtgagcgaacagaggagacgctcaatgccctccgacaacctggcggcagcgcaaaagatg

SEQ ID NO: 151571 - DNA, 103 bp, Artificial Sequence
  Synthetic Polynucleotide
taatacgactcactatagggtggcaggcactcgggagaaagggtcggaggaacagaggagacctccgatgctttctcccaacctggcggcagcgcaaaagatg

SEQ ID NO: 151572 - DNA, 103 bp, Artificial Sequence
  Synthetic Polynucleotide
taatacgactcactataggggactgaggactggcaggcactcgggagaaaaacagaggagatttctcatgagtgcctgcaacctggcggcagcgcaaaagatg

SEQ ID NO: 151573 - DNA, 103 bp, Artificial Sequence
  Synthetic Polynucleotide
taatacgactcactataggggctggactgggactgaggactggcaggcacaacagaggagagtgcctatgagtcctcagaacctggcggcagcgcaaaagatg

SEQ ID NO: 151574 - DNA, 103 bp, Artificial Sequence
  Synthetic Polynucleotide
taatacgactcactataggggagactgggagctggactgggactgaggacaacagaggagagtcctcatgcccagtccaaacctggcggcagcgcaaaagatg

SEQ ID NO: 151575 - DNA, 103 bp, Artificial Sequence
  Synthetic Polynucleotide
taatacgactcactatagggggtgtcagtggagactgggagctggactggaacagaggagaccagtcatgctcccagtcaacctggcggcagcgcaaaagatg

SEQ ID NO: 151576 - DNA, 103 bp, Artificial Sequence
  Synthetic Polynucleotide
taatacgactcactatagggcagaggccggggtgtcagtggagactgggaaacagaggagatcccagatgccactgacaaacctggcggcagcgcaaaagatg

SEQ ID NO: 151577 - DNA, 103 bp, Artificial Sequence
  Synthetic Polynucleotide
taatacgactcactatagggcttcagcagacagaggccggggtgtcagtgaacagaggagacactgaatgcccggcctcaacctggcggcagcgcaaaagatg

SEQ ID NO: 151578 - DNA, 103 bp, Artificial Sequence
  Synthetic Polynucleotide
taatacgactcactataggggggcaaaaagcttcagcagacagaggccggaacagaggagaccggccatggtctgctgaaacctggcggcagcgcaaaagatg

SEQ ID NO: 151579 - DNA, 103 bp, Artificial Sequence
  Synthetic Polynucleotide
taatacgactcactataggggtgatgcccacagctggtacagaagaacagaacagaggagactgttcatgtgtaccagcaacctggcggcagcgcaaaagatg

SEQ ID NO: 151580 - DNA, 103 bp, Artificial Sequence
  Synthetic Polynucleotide
taatacgactcactatagggaacgggtgatgggcaaaaagcttcagcagaaacagaggagatctgctatggctttttgcaacctggcggcagcgcaaaagatg

SEQ ID NO: 151581 - DNA, 103 bp, Artificial Sequence
  Synthetic Polynucleotide
taatacgactcactatagggagcgaggggtaacgggtgatgggcaaaaagaacagaggagactttttatgcatcacccgaacctggcggcagcgcaaaagatg

SEQ ID NO: 151582 - DNA, 103 bp, Artificial Sequence
  Synthetic Polynucleotide
taatacgactcactatagggggggactggaagcgaggggtaacgggtgataacagaggagaatcaccatgtacccctcgaacctggcggcagcgcaaaagatg

SEQ ID NO: 151583 - DNA, 103 bp, Artificial Sequence
  Synthetic Polynucleotide
taatacgactcactatagggataagggtcaggggactggaagcgaggggtaacagaggagaacccctatgttccagtccaacctggcggcagcgcaaaagatg

SEQ ID NO: 151584 - DNA, 103 bp, Artificial Sequence
  Synthetic Polynucleotide
taatacgactcactataggggtgggcgagaataagggtcaggggactggaaacagaggagatccagtatgctgacccttaacctggcggcagcgcaaaagatg

SEQ ID NO: 151585 - DNA, 103 bp, Artificial Sequence
  Synthetic Polynucleotide
taatacgactcactataggggggcgtgagggtgggcgagaataagggtcaaacagaggagatgacccatgttctcgcccaacctggcggcagcgcaaaagatg

SEQ ID NO: 151586 - DNA, 103 bp, Artificial Sequence
  Synthetic Polynucleotide
taatacgactcactatagggacgggactgagggcgtgagggtgggcgagaaacagaggagatctcgcatgccctcacgcaacctggcggcagcgcaaaagatg

SEQ ID NO: 151587 - DNA, 103 bp, Artificial Sequence
  Synthetic Polynucleotide
taatacgactcactatagggcaaatgggtcacgggactgagggcgtgaggaacagaggagacctcacatgctcagtcccaacctggcggcagcgcaaaagatg

SEQ ID NO: 151588 - DNA, 103 bp, Artificial Sequence
  Synthetic Polynucleotide
taatacgactcactatagggtgcaatggggcaaatgggtcacgggactgaaacagaggagatcagtcatgtgacccattaacctggcggcagcgcaaaagatg

SEQ ID NO: 151589 - DNA, 103 bp, Artificial Sequence
  Synthetic Polynucleotide
taatacgactcactataggggggtggcttatgcaatggggcaaatgggtcaacagaggagagacccaatggccccattgaacctggcggcagcgcaaaagatg

SEQ ID NO: 151590 - DNA, 103 bp, Artificial Sequence
  Synthetic Polynucleotide
taatacgactcactatagggccccgtgatagtgatgcccacagctggtacaacagaggagagtaccaatggtgggcatcaacctggcggcagcgcaaaagatg

SEQ ID NO: 151591 - DNA, 103 bp, Artificial Sequence
  Synthetic Polynucleotide
taatacgactcactataggggctggggtcggggtggcttatgcaatggggaacagaggagaccccatatgataagccacaacctggcggcagcgcaaaagatg

SEQ ID NO: 151592 - DNA, 103 bp, Artificial Sequence
  Synthetic Polynucleotide
taatacgactcactatagggacttcagggggctggggtcggggtggcttaaacagaggagataagccatgccgaccccaaacctggcggcagcgcaaaagatg

SEQ ID NO: 151593 - DNA, 103 bp, Artificial Sequence
  Synthetic Polynucleotide
taatacgactcactatagggcttaaaggcaacttcagggggctggggtcgaacagaggagacgacccatgccccctgaaaacctggcggcagcgcaaaagatg

SEQ ID NO: 151594 - DNA, 103 bp, Artificial Sequence
  Synthetic Polynucleotide
taatacgactcactataggggagacccagccttaaaggcaacttcaggggaacagaggagacccctgatgttgcctttaaacctggcggcagcgcaaaagatg

SEQ ID NO: 151595 - DNA, 103 bp, Artificial Sequence
  Synthetic Polynucleotide
taatacgactcactataggggtgtgggctagagacccagccttaaaggcaaacagaggagatgccttatgggctgggtcaacctggcggcagcgcaaaagatg

SEQ ID NO: 151596 - DNA, 103 bp, Artificial Sequence
  Synthetic Polynucleotide
taatacgactcactatagggccccagcgaagtgtgggctagagacccagcaacagaggagagctgggatgctagcccacaacctggcggcagcgcaaaagatg

SEQ ID NO: 151597 - DNA, 103 bp, Artificial Sequence
  Synthetic Polynucleotide
taatacgactcactatagggaccccccagcccccagcgaagtgtgggctaaacagaggagatagcccatgcttcgctggaacctggcggcagcgcaaaagatg

SEQ ID NO: 151598 - DNA, 103 bp, Artificial Sequence
  Synthetic Polynucleotide
taatacgactcactataggggctgctgggaaccccccagcccccagcgaaaacagaggagattcgctatgggctgggggaacctggcggcagcgcaaaagatg

SEQ ID NO: 151599 - DNA, 103 bp, Artificial Sequence
  Synthetic Polynucleotide
taatacgactcactatagggcgcgggcagggctgctgggaaccccccagcaacagaggagagctgggatgttcccagcaaacctggcggcagcgcaaaagatg

SEQ ID NO: 151600 - DNA, 103 bp, Artificial Sequence
  Synthetic Polynucleotide
taatacgactcactatagggctgctggccccgcgggcagggctgctgggaaacagaggagatcccagatgccctgcccgaacctggcggcagcgcaaaagatg

SEQ ID NO: 151601 - DNA, 103 bp, Artificial Sequence
  Synthetic Polynucleotide
taatacgactcactatagggtccaggcaggccccgtgatagtgatgcccaaacagaggagatgggcaatgctatcacggaacctggcggcagcgcaaaagatg

SEQ ID NO: 151602 - DNA, 103 bp, Artificial Sequence
  Synthetic Polynucleotide
taatacgactcactatagggtggagctcacctgctggccccgcgggcaggaacagaggagacctgccatgggggccagcaacctggcggcagcgcaaaagatg

SEQ ID NO: 151603 - DNA, 103 bp, Artificial Sequence
  Synthetic Polynucleotide
taatacgactcactataggggaccttggcatggagctcacctgctggcccaacagaggagagggccaatgggtgagctcaacctggcggcagcgcaaaagatg

SEQ ID NO: 151604 - DNA, 103 bp, Artificial Sequence
  Synthetic Polynucleotide
taatacgactcactataggggcccacttgggaccttggcatggagctcacaacagaggagagtgagcatgatgccaaggaacctggcggcagcgcaaaagatg

SEQ ID NO: 151605 - DNA, 103 bp, Artificial Sequence
  Synthetic Polynucleotide
taatacgactcactatagggttggggggctgcccacttgggaccttggcaaacagaggagatgccaaatgcccaagtggaacctggcggcagcgcaaaagatg

SEQ ID NO: 151606 - DNA, 103 bp, Artificial Sequence
  Synthetic Polynucleotide
taatacgactcactatagggccggacaaaattggggggctgcccacttggaacagaggagaccaagtatgcagccccccaacctggcggcagcgcaaaagatg

SEQ ID NO: 151607 - DNA, 103 bp, Artificial Sequence
  Synthetic Polynucleotide
taatacgactcactatagggtcccaggggaccggacaaaattggggggctaacagaggagaagccccatgattttgtccaacctggcggcagcgcaaaagatg

SEQ ID NO: 151608 - DNA, 103 bp, Artificial Sequence
  Synthetic Polynucleotide
taatacgactcactatagggaatgcacccgtcccaggggaccggacaaaaaacagaggagattttgtatggtcccctggaacctggcggcagcgcaaaagatg

SEQ ID NO: 151609 - DNA, 103 bp, Artificial Sequence
  Synthetic Polynucleotide
taatacgactcactatagggggtgcccacaaatgcacccgtcccaggggaaacagaggagatcccctatgacgggtgcaaacctggcggcagcgcaaaagatg

SEQ ID NO: 151610 - DNA, 103 bp, Artificial Sequence
  Synthetic Polynucleotide
taatacgactcactatagggtgggagagggggtgcccacaaatgcacccgaacagaggagacgggtgatgttgtgggcaaacctggcggcagcgcaaaagatg

SEQ ID NO: 151611 - DNA, 103 bp, Artificial Sequence
  Synthetic Polynucleotide
taatacgactcactataggggtgaaacgcatgggagagggggtgcccacaaacagaggagatgtgggatgcccctctccaacctggcggcagcgcaaaagatg

SEQ ID NO: 151612 - DNA, 103 bp, Artificial Sequence
  Synthetic Polynucleotide
taatacgactcactatagggcagagcagtgtccaggcaggccccgtgataaacagaggagatatcacatggcctgcctgaacctggcggcagcgcaaaagatg

SEQ ID NO: 151613 - DNA, 103 bp, Artificial Sequence
  Synthetic Polynucleotide
taatacgactcactatagggctgagggaaagtgaaacgcatgggagagggaacagaggagaccctctatgatgcgtttcaacctggcggcagcgcaaaagatg

SEQ ID NO: 151614 - DNA, 103 bp, Artificial Sequence
  Synthetic Polynucleotide
taatacgactcactatagggcccctactgcctgagggaaagtgaaacgcaaacagaggagatgcgttatgctttccctcaacctggcggcagcgcaaaagatg

SEQ ID NO: 151615 - DNA, 103 bp, Artificial Sequence
  Synthetic Polynucleotide
taatacgactcactatagggagggaaggctcccctactgcctgagggaaaaacagaggagatttcccatgggcagtaggaacctggcggcagcgcaaaagatg

SEQ ID NO: 151616 - DNA, 103 bp, Artificial Sequence
  Synthetic Polynucleotide
taatacgactcactatagggagggggctttagggaaggctcccctactgcaacagaggagagcagtaatggagccttccaacctggcggcagcgcaaaagatg

SEQ ID NO: 151617 - DNA, 103 bp, Artificial Sequence
  Synthetic Polynucleotide
taatacgactcactataggggctgagggacagggggctttagggaaggctaacagaggagaagccttatgtaaagccccaacctggcggcagcgcaaaagatg

SEQ ID NO: 151618 - DNA, 103 bp, Artificial Sequence
  Synthetic Polynucleotide
taatacgactcactataggggggagaccaggctgagggacagggggctttaacagaggagaaaagccatgtgtccctcaaacctggcggcagcgcaaaagatg

SEQ ID NO: 151619 - DNA, 103 bp, Artificial Sequence
  Synthetic Polynucleotide
taatacgactcactatagggatggggtggcgggagaccaggctgagggacaacagaggagagtccctatgcctggtctcaacctggcggcagcgcaaaagatg

SEQ ID NO: 151620 - DNA, 103 bp, Artificial Sequence
  Synthetic Polynucleotide
taatacgactcactatagggtgttgatcccatggggtggcgggagaccagaacagaggagactggtcatgcgccaccccaacctggcggcagcgcaaaagatg

SEQ ID NO: 151621 - DNA, 103 bp, Artificial Sequence
  Synthetic Polynucleotide
taatacgactcactatagggccaaaatggctgttgatcccatggggtggcaacagaggagagccaccatgtgggatcaaaacctggcggcagcgcaaaagatg

SEQ ID NO: 151622 - DNA, 103 bp, Artificial Sequence
  Synthetic Polynucleotide
taatacgactcactatagggggggccgggcccaaaatggctgttgatcccaacagaggagagggatcatgagccattttaacctggcggcagcgcaaaagatg

SEQ ID NO: 151623 - DNA, 103 bp, Artificial Sequence
  Synthetic Polynucleotide
taatacgactcactatagggtgcgggcagtcagagcagtgtccaggcaggaacagaggagacctgccatgacactgctcaacctggcggcagcgcaaaagatg

SEQ ID NO: 151624 - DNA, 103 bp, Artificial Sequence
  Synthetic Polynucleotide
taatacgactcactatagggtgcccaaggtggggccgggcccaaaatggcaacagaggagagccattatgggcccggccaacctggcggcagcgcaaaagatg

SEQ ID NO: 151625 - DNA, 103 bp, Artificial Sequence
  Synthetic Polynucleotide
taatacgactcactatagggctttgaggcttgcccaaggtggggccgggcaacagaggagagcccggatgcaccttgggaacctggcggcagcgcaaaagatg

SEQ ID NO: 151626 - DNA, 103 bp, Artificial Sequence
  Synthetic Polynucleotide
taatacgactcactataggggtagtttgtgctttgaggcttgcccaaggtaacagaggagaaccttgatgaagcctcaaaacctggcggcagcgcaaaagatg

SEQ ID NO: 151627 - DNA, 103 bp, Artificial Sequence
  Synthetic Polynucleotide
taatacgactcactatagggtggctactgtgtagtttgtgctttgaggctaacagaggagaagcctcatggcacaaactaacctggcggcagcgcaaaagatg

SEQ ID NO: 151628 - DNA, 103 bp, Artificial Sequence
  Synthetic Polynucleotide
taatacgactcactatagggaagttccctgtggctactgtgtagtttgtgaacagaggagacacaaaatgcacagtagcaacctggcggcagcgcaaaagatg

SEQ ID NO: 151629 - DNA, 103 bp, Artificial Sequence
  Synthetic Polynucleotide
taatacgactcactatagggcgatgggtggaagttccctgtggctactgtaacagaggagaacagtaatgacagggaacaacctggcggcagcgcaaaagatg

SEQ ID NO: 151630 - DNA, 103 bp, Artificial Sequence
  Synthetic Polynucleotide
taatacgactcactataggggggggctgcccgatgggtggaagttccctgaacagaggagacagggaatgtccacccataacctggcggcagcgcaaaagatg

SEQ ID NO: 151631 - DNA, 103 bp, Artificial Sequence
  Synthetic Polynucleotide
taatacgactcactatagggctgggccccagggggctgcccgatgggtggaacagaggagaccacccatggggcagcccaacctggcggcagcgcaaaagatg

SEQ ID NO: 151632 - DNA, 103 bp, Artificial Sequence
  Synthetic Polynucleotide
taatacgactcactatagggggacccgctgctgggccccagggggctgccaacagaggagaggcagcatgctggggcccaacctggcggcagcgcaaaagatg

SEQ ID NO: 151633 - DNA, 103 bp, Artificial Sequence
  Synthetic Polynucleotide
taatacgactcactatagggtctcccctgtggacccgctgctgggccccaaacagaggagatggggcatggcagcgggtaacctggcggcagcgcaaaagatg

SEQ ID NO: 151634 - DNA, 103 bp, Artificial Sequence
  Synthetic Polynucleotide
taatacgactcactatagggccagcacgtttgcgggcagtcagagcagtgaacagaggagacactgcatggactgcccgaacctggcggcagcgcaaaagatg

SEQ ID NO: 151635 - DNA, 103 bp, Artificial Sequence
  Synthetic Polynucleotide
taatacgactcactatagggagcccatagctctcccctgtggacccgctgaacagaggagacagcggatgcacaggggaaacctggcggcagcgcaaaagatg

SEQ ID NO: 151636 - DNA, 103 bp, Artificial Sequence
  Synthetic Polynucleotide
taatacgactcactatagggtagtggggacagcccatagctctcccctgtaacagaggagaacagggatgagctatgggaacctggcggcagcgcaaaagatg

SEQ ID NO: 151637 - DNA, 103 bp, Artificial Sequence
  Synthetic Polynucleotide
taatacgactcactatagggacggagggcgtagtggggacagcccatagcaacagaggagagctatgatgtgtccccacaacctggcggcagcgcaaaagatg

SEQ ID NO: 151638 - DNA, 103 bp, Artificial Sequence
  Synthetic Polynucleotide
taatacgactcactatagggggcagaaccgacggagggcgtagtggggacaacagaggagagtccccatgacgccctccaacctggcggcagcgcaaaagatg

SEQ ID NO: 151639 - DNA, 103 bp, Artificial Sequence
  Synthetic Polynucleotide
taatacgactcactatagggtgcaggtggtggcagaaccgacggagggcgaacagaggagacgccctatgtcggttctgaacctggcggcagcgcaaaagatg

SEQ ID NO: 151640 - DNA, 103 bp, Artificial Sequence
  Synthetic Polynucleotide
taatacgactcactatagggatccgtcgggtgcaggtggtggcagaaccgaacagaggagacggttcatgcaccacctgaacctggcggcagcgcaaaagatg

SEQ ID NO: 151641 - DNA, 103 bp, Artificial Sequence
  Synthetic Polynucleotide
taatacgactcactatagggtaggggagggatccgtcgggtgcaggtggtaacagaggagaaccaccatgacccgacggaacctggcggcagcgcaaaagatg

SEQ ID NO: 151642 - DNA, 103 bp, Artificial Sequence
  Synthetic Polynucleotide
taatacgactcactatagggatgggacaggtaggggagggatccgtcgggaacagaggagacccgacatgtccctccccaacctggcggcagcgcaaaagatg

SEQ ID NO: 151643 - DNA, 103 bp, Artificial Sequence
  Synthetic Polynucleotide
taatacgactcactataggggtgaggctccatgggacaggtaggggagggaacagaggagaccctccatgacctgtcccaacctggcggcagcgcaaaagatg

SEQ ID NO: 151644 - DNA, 103 bp, Artificial Sequence
  Synthetic Polynucleotide
taatacgactcactatagggcctgatcgctgtgaggctccatgggacaggaacagaggagacctgtcatgtggagcctcaacctggcggcagcgcaaaagatg

SEQ ID NO: 151645 - DNA, 103 bp, Artificial Sequence
  Synthetic Polynucleotide
taatacgactcactataggggcactgccagccagcacgtttgcgggcagtaacagaggagaactgccatgaaacgtgctaacctggcggcagcgcaaaagatg

SEQ ID NO: 151646 - DNA, 103 bp, Artificial Sequence
  Synthetic Polynucleotide
taatacgactcactatagggagaggtgatgcctgatcgctgtgaggctccaacagaggagaggagccatgcagcgatcaaacctggcggcagcgcaaaagatg

SEQ ID NO: 151647 - DNA, 103 bp, Artificial Sequence
  Synthetic Polynucleotide
taatacgactcactatagggtttcgacaggagaggtgatgcctgatcgctaacagaggagaagcgatatggcatcacctaacctggcggcagcgcaaaagatg

SEQ ID NO: 151648 - DNA, 103 bp, Artificial Sequence
  Synthetic Polynucleotide
taatacgactcactatagggtcttctcgcttttcgacaggagaggtgatgaacagaggagacatcacatgtcctgtcgaaacctggcggcagcgcaaaagatg

SEQ ID NO: 151649 - DNA, 103 bp, Artificial Sequence
  Synthetic Polynucleotide
taatacgactcactatagggagtccctgggtcttctcgcttttcgacaggaacagaggagacctgtcatgaagcgagaaaacctggcggcagcgcaaaagatg

SEQ ID NO: 151650 - DNA, 103 bp, Artificial Sequence
  Synthetic Polynucleotide
taatacgactcactatagggtacccattccagtccctgggtcttctcgctaacagaggagaagcgagatgacccagggaaacctggcggcagcgcaaaagatg

SEQ ID NO: 151651 - DNA, 103 bp, Artificial Sequence
  Synthetic Polynucleotide
taatacgactcactataggggccaaagagctacccattccagtccctgggaacagaggagacccaggatgtggaatgggaacctggcggcagcgcaaaagatg

SEQ ID NO: 151652 - DNA, 103 bp, Artificial Sequence
  Synthetic Polynucleotide
taatacgactcactatagggttcagctgtcgccaaagagctacccattccaacagaggagaggaatgatgagctctttgaacctggcggcagcgcaaaagatg

SEQ ID NO: 151653 - DNA, 103 bp, Artificial Sequence
  Synthetic Polynucleotide
taatacgactcactatagggtacctgggagttcagctgtcgccaaagagcaacagaggagagctcttatgcgacagctgaacctggcggcagcgcaaaagatg

SEQ ID NO: 151654 - DNA, 103 bp, Artificial Sequence
  Synthetic Polynucleotide
taatacgactcactataggggggtcctgggtacctgggagttcagctgtcaacagaggagagacagcatgactcccaggaacctggcggcagcgcaaaagatg

SEQ ID NO: 151655 - DNA, 103 bp, Artificial Sequence
  Synthetic Polynucleotide
taatacgactcactatagggggacatgcctgggtcctgggtacctgggagaacagaggagactcccaatgacccaggacaacctggcggcagcgcaaaagatg

SEQ ID NO: 151656 - DNA, 103 bp, Artificial Sequence
  Synthetic Polynucleotide
taatacgactcactataggggcaggtctgactcagtggcacttgggtcctaacagaggagaaggaccatggtgccactgaacctggcggcagcgcaaaagatg

SEQ ID NO: 151657 - DNA, 103 bp, Artificial Sequence
  Synthetic Polynucleotide
taatacgactcactatagggtgcattcagggcactgccagccagcacgttaacagaggagaaacgtgatggctggcagtaacctggcggcagcgcaaaagatg

SEQ ID NO: 151658 - DNA, 103 bp, Artificial Sequence
  Synthetic Polynucleotide
taatacgactcactatagggggctaaggccggacatgcctgggtcctgggaacagaggagacccaggatgcaggcatgtaacctggcggcagcgcaaaagatg

SEQ ID NO: 151659 - DNA, 103 bp, Artificial Sequence
  Synthetic Polynucleotide
taatacgactcactatagggagctctgtttggctaaggccggacatgcctaacagaggagaaggcatatgcggccttagaacctggcggcagcgcaaaagatg

SEQ ID NO: 151660 - DNA, 103 bp, Artificial Sequence
  Synthetic Polynucleotide
taatacgactcactatagggttgcttctccagctctgtttggctaaggccaacagaggagaggccttatgcaaacagagaacctggcggcagcgcaaaagatg

SEQ ID NO: 151661 - DNA, 103 bp, Artificial Sequence
  Synthetic Polynucleotide
taatacgactcactatagggggcgctgccgttgcttctccagctctgtttaacagaggagaaaacagatgtggagaagcaacctggcggcagcgcaaaagatg

SEQ ID NO: 151662 - DNA, 103 bp, Artificial Sequence
  Synthetic Polynucleotide
taatacgactcactatagggcgtagtcgctggcgctgccgttgcttctccaacagaggagaggagaaatgacggcagcgaacctggcggcagcgcaaaagatg

SEQ ID NO: 151663 - DNA, 103 bp, Artificial Sequence
  Synthetic Polynucleotide
taatacgactcactatagggcagcagctctcgtagtcgctggcgctgccgaacagaggagacggcagatgcagcgactaaacctggcggcagcgcaaaagatg

SEQ ID NO: 151664 - DNA, 103 bp, Artificial Sequence
  Synthetic Polynucleotide
taatacgactcactataggggctgccgaatcagcagctctcgtagtcgctaacagaggagaagcgacatggagagctgcaacctggcggcagcgcaaaagatg

SEQ ID NO: 151665 - DNA, 103 bp, Artificial Sequence
  Synthetic Polynucleotide
taatacgactcactatagggcgctggatctgctgccgaatcagcagctctaacagaggagaagagctatggattcggcaaacctggcggcagcgcaaaagatg

SEQ ID NO: 151666 - DNA, 103 bp, Artificial Sequence
  Synthetic Polynucleotide
taatacgactcactatagggcagggtgttgcgctggatctgctgccgaataacagaggagaattcggatgcagatccagaacctggcggcagcgcaaaagatg

SEQ ID NO: 151667 - DNA, 103 bp, Artificial Sequence
  Synthetic Polynucleotide
taatacgactcactatagggtctcctgccgcagggtgttgcgctggatctaacagaggagaagatccatggcaacacccaacctggcggcagcgcaaaagatg

SEQ ID NO: 151668 - DNA, 103 bp, Artificial Sequence
  Synthetic Polynucleotide
taatacgactcactatagggtggcacactttgcattcagggcactgccagaacagaggagactggcaatgccctgaatgaacctggcggcagcgcaaaagatg

SEQ ID NO: 151669 - DNA, 103 bp, Artificial Sequence
  Synthetic Polynucleotide
taatacgactcactataggggctgtttccttctcctgccgcagggtgttgaacagaggagacaacacatggcggcaggaaacctggcggcagcgcaaaagatg

SEQ ID NO: 151670 - DNA, 103 bp, Artificial Sequence
  Synthetic Polynucleotide
taatacgactcactatagggagctgctgcagctgtttccttctcctgccgaacagaggagacggcagatgaaggaaacaaacctggcggcagcgcaaaagatg

SEQ ID NO: 151671 - DNA, 103 bp, Artificial Sequence
  Synthetic Polynucleotide
taatacgactcactatagggctgctcctgcagctgctgcagctgtttcctaacagaggagaaggaaaatgctgcagcagaacctggcggcagcgcaaaagatg

SEQ ID NO: 151672 - DNA, 103 bp, Artificial Sequence
  Synthetic Polynucleotide
taatacgactcactatagggggaggccccactgctcctgcagctgctgcaaacagaggagatgcagcatgtgcaggagcaacctggcggcagcgcaaaagatg

SEQ ID NO: 151673 - DNA, 103 bp, Artificial Sequence
  Synthetic Polynucleotide
taatacgactcactatagggccagctgcctggaggccccactgctcctgcaacagaggagagcaggaatggtggggcctaacctggcggcagcgcaaaagatg

SEQ ID NO: 151674 - DNA, 103 bp, Artificial Sequence
  Synthetic Polynucleotide
taatacgactcactataggggctcagcaccccagctgcctggaggccccaaacagaggagatggggcatgcaggcagctaacctggcggcagcgcaaaagatg

SEQ ID NO: 151675 - DNA, 103 bp, Artificial Sequence
  Synthetic Polynucleotide
taatacgactcactataggggggctgctgggctcagcaccccagctgcctaacagaggagaaggcagatggggtgctgaaacctggcggcagcgcaaaagatg

SEQ ID NO: 151676 - DNA, 103 bp, Artificial Sequence
  Synthetic Polynucleotide
taatacgactcactatagggctcaaaggcagggctgctgggctcagcaccaacagaggagaggtgctatgcccagcagcaacctggcggcagcgcaaaagatg

SEQ ID NO: 151677 - DNA, 103 bp, Artificial Sequence
  Synthetic Polynucleotide
taatacgactcactataggggactcagctgctcaaaggcagggctgctggaacagaggagaccagcaatgctgcctttgaacctggcggcagcgcaaaagatg

SEQ ID NO: 151678 - DNA, 103 bp, Artificial Sequence
  Synthetic Polynucleotide
taatacgactcactataggggtctggcctcgactcagctgctcaaaggcaaacagaggagatgccttatggcagctgagaacctggcggcagcgcaaaagatg

SEQ ID NO: 151679 - DNA, 103 bp, Artificial Sequence
  Synthetic Polynucleotide
taatacgactcactatagggcctgcaggcttggcacactttgcattcaggaacagaggagacctgaaatgaaagtgtgcaacctggcggcagcgcaaaagatg

SEQ ID NO: 151680 - DNA, 103 bp, Artificial Sequence
  Synthetic Polynucleotide
taatacgactcactatagggagcaaagggggtctggcctcgactcagctgaacagaggagacagctgatgcgaggccagaacctggcggcagcgcaaaagatg

SEQ ID NO: 151681 - DNA, 103 bp, Artificial Sequence
  Synthetic Polynucleotide
taatacgactcactatagggcctgtgtcccagcaaagggggtctggcctcaacagaggagagaggccatgccccctttgaacctggcggcagcgcaaaagatg

SEQ ID NO: 151682 - DNA, 103 bp, Artificial Sequence
  Synthetic Polynucleotide
taatacgactcactatagggctgctcttgtcctgtgtcccagcaaaggggaacagaggagaccccttatgtgggacacaaacctggcggcagcgcaaaagatg

SEQ ID NO: 151683 - DNA, 103 bp, Artificial Sequence
  Synthetic Polynucleotide
taatacgactcactatagggccccacaaggctgctcttgtcctgtgtcccaacagaggagagggacaatggacaagagcaacctggcggcagcgcaaaagatg

SEQ ID NO: 151684 - DNA, 103 bp, Artificial Sequence
  Synthetic Polynucleotide
taatacgactcactatagggttgggggcaaccccacaaggctgctcttgtaacagaggagaacaagaatggccttgtggaacctggcggcagcgcaaaagatg

SEQ ID NO: 151685 - DNA, 103 bp, Artificial Sequence
  Synthetic Polynucleotide
taatacgactcactatagggctcagcttgcttgggggcaaccccacaaggaacagaggagaccttgtatggttgcccccaacctggcggcagcgcaaaagatg

SEQ ID NO: 151686 - DNA, 103 bp, Artificial Sequence
  Synthetic Polynucleotide
taatacgactcactataggggatggggccactcagcttgcttgggggcaaaacagaggagattgcccatgagcaagctgaacctggcggcagcgcaaaagatg

SEQ ID NO: 151687 - DNA, 103 bp, Artificial Sequence
  Synthetic Polynucleotide
taatacgactcactatagggctggccccaggatggggccactcagcttgcaacagaggagagcaagcatggtggccccaaacctggcggcagcgcaaaagatg

SEQ ID NO: 151688 - DNA, 103 bp, Artificial Sequence
  Synthetic Polynucleotide
taatacgactcactataggggggaaggaccctggccccaggatggggccaaacagaggagatggcccatgcctggggccaacctggcggcagcgcaaaagatg

SEQ ID NO: 151689 - DNA, 103 bp, Artificial Sequence
  Synthetic Polynucleotide
taatacgactcactataggggtcatcgctagggaaggaccctggccccagaacagaggagactggggatggggtccttcaacctggcggcagcgcaaaagatg

SEQ ID NO: 151690 - DNA, 103 bp, Artificial Sequence
  Synthetic Polynucleotide
taatacgactcactatagggtcccaggtttcctgcaggcttggcacacttaacagaggagaaagtgtatgaagcctgcaaacctggcggcagcgcaaaagatg

SEQ ID NO: 151691 - DNA, 103 bp, Artificial Sequence
  Synthetic Polynucleotide
taatacgactcactataggggggagagtcggtcatcgctagggaaggaccaacagaggagaggtcctatgctagcgatgaacctggcggcagcgcaaaagatg

SEQ ID NO: 151692 - DNA, 103 bp, Artificial Sequence
  Synthetic Polynucleotide
taatacgactcactatagggggaggtggccgggagagtcggtcatcgctaaacagaggagatagcgaatgccgactctcaacctggcggcagcgcaaaagatg

SEQ ID NO: 151693 - DNA, 103 bp, Artificial Sequence
  Synthetic Polynucleotide
taatacgactcactatagggcgtggctggtggaggtggccgggagagtcgaacagaggagacgactcatgcggccacctaacctggcggcagcgcaaaagatg

SEQ ID NO: 151694 - DNA, 103 bp, Artificial Sequence
  Synthetic Polynucleotide
taatacgactcactatagggtagaggaaggcgtggctggtggaggtggccaacagaggagaggccacatgcaccagccaaacctggcggcagcgcaaaagatg

SEQ ID NO: 151695 - DNA, 103 bp, Artificial Sequence
  Synthetic Polynucleotide
taatacgactcactatagggttcacatccatagaggaaggcgtggctggtaacagaggagaaccagcatggccttcctcaacctggcggcagcgcaaaagatg

SEQ ID NO: 151696 - DNA, 103 bp, Artificial Sequence
  Synthetic Polynucleotide
taatacgactcactatagggttgccggctgttcacatccatagaggaaggaacagaggagaccttccatgatggatgtgaacctggcggcagcgcaaaagatg

SEQ ID NO: 151697 - DNA, 103 bp, Artificial Sequence
  Synthetic Polynucleotide
taatacgactcactatagggctcctaccagttgccggctgttcacatccaaacagaggagatggatgatgacagccggcaacctggcggcagcgcaaaagatg

SEQ ID NO: 151698 - DNA, 103 bp, Artificial Sequence
  Synthetic Polynucleotide
taatacgactcactataggggcttgggagcctcctaccagttgccggctgaacagaggagacagccgatgactggtaggaacctggcggcagcgcaaaagatg

SEQ ID NO: 151699 - DNA, 103 bp, Artificial Sequence
  Synthetic Polynucleotide
taatacgactcactatagggctgatagaaagcttgggagcctcctaccagaacagaggagactggtaatgggctcccaaaacctggcggcagcgcaaaagatg

SEQ ID NO: 151700 - DNA, 103 bp, Artificial Sequence
  Synthetic Polynucleotide
taatacgactcactatagggagggtgctcgctgatagaaagcttgggagcaacagaggagagctcccatgctttctatcaacctggcggcagcgcaaaagatg

SEQ ID NO: 151701 - DNA, 103 bp, Artificial Sequence
  Synthetic Polynucleotide
taatacgactcactatagggttagagtcattcccaggtttcctgcaggctaacagaggagaagcctgatggaaacctggaacctggcggcagcgcaaaagatg

SEQ ID NO: 151702 - DNA, 103 bp, Artificial Sequence
  Synthetic Polynucleotide
taatacgactcactataggggacccaggatagggtgctcgctgatagaaaaacagaggagatttctaatggcgagcaccaacctggcggcagcgcaaaagatg

SEQ ID NO: 151703 - DNA, 103 bp, Artificial Sequence
  Synthetic Polynucleotide
taatacgactcactatagggtaagggcagggacccaggatagggtgctcgaacagaggagacgagcaatgtatcctgggaacctggcggcagcgcaaaagatg

SEQ ID NO: 151704 - DNA, 103 bp, Artificial Sequence
  Synthetic Polynucleotide
taatacgactcactataggggttgctgctgtaagggcagggacccaggataacagaggagaatcctgatgccctgccctaacctggcggcagcgcaaaagatg

SEQ ID NO: 151705 - DNA, 103 bp, Artificial Sequence
  Synthetic Polynucleotide
taatacgactcactatagggagttgttgctgttgctgctgtaagggcaggaacagaggagacctgccatgacagcagcaaacctggcggcagcgcaaaagatg

SEQ ID NO: 151706 - DNA, 103 bp, Artificial Sequence
  Synthetic Polynucleotide
taatacgactcactatagggttgctgccacagttgttgctgttgctgctgaacagaggagacagcagatgcagcaacaaaacctggcggcagcgcaaaagatg

SEQ ID NO: 151707 - DNA, 103 bp, Artificial Sequence
  Synthetic Polynucleotide
taatacgactcactatagggttgcctgttgttgctgccacagttgttgctaacagaggagaagcaacatgtgtggcagcaacctggcggcagcgcaaaagatg

SEQ ID NO: 151708 - DNA, 103 bp, Artificial Sequence
  Synthetic Polynucleotide
taatacgactcactataggggttgctgctgttgcctgttgttgctgccacaacagaggagagtggcaatgacaacaggcaacctggcggcagcgcaaaagatg

SEQ ID NO: 151709 - DNA, 103 bp, Artificial Sequence
  Synthetic Polynucleotide
taatacgactcactatagggtcgcatggaggttgctgctgttgcctgttgaacagaggagacaacagatgacagcagcaaacctggcggcagcgcaaaagatg

SEQ ID NO: 151710 - DNA, 103 bp, Artificial Sequence
  Synthetic Polynucleotide
taatacgactcactatagggacatggcaaatcgcatggaggttgctgctgaacagaggagacagcagatgcctccatgcaacctggcggcagcgcaaaagatg

SEQ ID NO: 151711 - DNA, 103 bp, Artificial Sequence
  Synthetic Polynucleotide
taatacgactcactatagggaagcgagctgacatggcaaatcgcatggagaacagaggagactccatatgatttgccataacctggcggcagcgcaaaagatg

SEQ ID NO: 151712 - DNA, 103 bp, Artificial Sequence
  Synthetic Polynucleotide
taatacgactcactatagggaaccaacatcttagagtcattcccaggtttaacagaggagaaaacctatgaatgactctaacctggcggcagcgcaaaagatg

SEQ ID NO: 151713 - DNA, 103 bp, Artificial Sequence
  Synthetic Polynucleotide
taatacgactcactatagggagttgatggaaagcgagctgacatggcaaaaacagaggagatttgccatgtcagctcgcaacctggcggcagcgcaaaagatg

SEQ ID NO: 151714 - DNA, 103 bp, Artificial Sequence
  Synthetic Polynucleotide
taatacgactcactatagggcaggtccaggagttgatggaaagcgagctgaacagaggagacagctcatgttccatcaaaacctggcggcagcgcaaaagatg

SEQ ID NO: 151715 - DNA, 103 bp, Artificial Sequence
  Synthetic Polynucleotide
taatacgactcactatagggcggccaagttcaggtccaggagttgatggaaacagaggagatccatcatgtcctggaccaacctggcggcagcgcaaaagatg

SEQ ID NO: 151716 - DNA, 103 bp, Artificial Sequence
  Synthetic Polynucleotide
taatacgactcactatagggtagggcttggcggccaagttcaggtccaggaacagaggagacctggaatggaacttggcaacctggcggcagcgcaaaagatg

SEQ ID NO: 151717 - DNA, 103 bp, Artificial Sequence
  Synthetic Polynucleotide
taatacgactcactatagggacggggaacctagggcttggcggccaagttaacagaggagaaacttgatggccaagcccaacctggcggcagcgcaaaagatg

SEQ ID NO: 151718 - DNA, 103 bp, Artificial Sequence
  Synthetic Polynucleotide
taatacgactcactatagggattcccgccaacggggaacctagggcttggaacagaggagaccaagcatgaggttccccaacctggcggcagcgcaaaagatg

SEQ ID NO: 151719 - DNA, 103 bp, Artificial Sequence
  Synthetic Polynucleotide
taatacgactcactatagggacgggtggaaattcccgccaacggggaaccaacagaggagaggttccatgttggcgggaaacctggcggcagcgcaaaagatg

SEQ ID NO: 151720 - DNA, 103 bp, Artificial Sequence
  Synthetic Polynucleotide
taatacgactcactatagggggcctggcagacgggtggaaattcccgccaaacagaggagatggcggatgtttccacccaacctggcggcagcgcaaaagatg

SEQ ID NO: 151721 - DNA, 103 bp, Artificial Sequence
  Synthetic Polynucleotide
taatacgactcactatagggggctcaccagggcctggcagacgggtggaaaacagaggagattccacatgtctgccaggaacctggcggcagcgcaaaagatg

SEQ ID NO: 151722 - DNA, 103 bp, Artificial Sequence
  Synthetic Polynucleotide
taatacgactcactatagggaccaggcactggctcaccagggcctggcagaacagaggagactgccaatgcctggtgagaacctggcggcagcgcaaaagatg

SEQ ID NO: 151723 - DNA, 103 bp, Artificial Sequence
  Synthetic Polynucleotide
taatacgactcactatagggacgtctcacaaaccaacatcttagagtcataacagaggagaatgactatgagatgttggaacctggcggcagcgcaaaagatg

SEQ ID NO: 151724 - DNA, 103 bp, Artificial Sequence
  Synthetic Polynucleotide
taatacgactcactataggggaccagctggaccaggcactggctcaccagaacagaggagactggtgatgcagtgcctgaacctggcggcagcgcaaaagatg

SEQ ID NO: 151725 - DNA, 103 bp, Artificial Sequence
  Synthetic Polynucleotide
taatacgactcactatagggaactgggcaggaccagctggaccaggcactaacagaggagaagtgccatgtccagctggaacctggcggcagcgcaaaagatg

SEQ ID NO: 151726 - DNA, 103 bp, Artificial Sequence
  Synthetic Polynucleotide
taatacgactcactatagggcagctcaatgaactgggcaggaccagctggaacagaggagaccagctatgcctgcccagaacctggcggcagcgcaaaagatg

SEQ ID NO: 151727 - DNA, 103 bp, Artificial Sequence
  Synthetic Polynucleotide
taatacgactcactatagggcattgtgccgcagctcaatgaactgggcagaacagaggagactgcccatgtcattgagcaacctggcggcagcgcaaaagatg

SEQ ID NO: 151728 - DNA, 103 bp, Artificial Sequence
  Synthetic Polynucleotide
taatacgactcactatagggcctttctgtacattgtgccgcagctcaatgaacagaggagacattgaatggcggcacaaaacctggcggcagcgcaaaagatg

SEQ ID NO: 151729 - DNA, 103 bp, Artificial Sequence
  Synthetic Polynucleotide
taatacgactcactatagggaggtcccagtcctttctgtacattgtgccgaacagaggagacggcacatggtacagaaaaacctggcggcagcgcaaaagatg

SEQ ID NO: 151730 - DNA, 103 bp, Artificial Sequence
  Synthetic Polynucleotide
taatacgactcactataggggagtgcccccaggtcccagtcctttctgtaaacagaggagatacagaatggactgggacaacctggcggcagcgcaaaagatg

SEQ ID NO: 151731 - DNA, 103 bp, Artificial Sequence
  Synthetic Polynucleotide
taatacgactcactatagggccaggaaacggagtgcccccaggtcccagtaacagaggagaactgggatgtgggggcacaacctggcggcagcgcaaaagatg

SEQ ID NO: 151732 - DNA, 103 bp, Artificial Sequence
  Synthetic Polynucleotide
taatacgactcactatagggtgggccctgaccaggaaacggagtgcccccaacagaggagagggggcatgccgtttcctaacctggcggcagcgcaaaagatg

SEQ ID NO: 151733 - DNA, 103 bp, Artificial Sequence
  Synthetic Polynucleotide
taatacgactcactataggggtctctgaggtgggccctgaccaggaaacgaacagaggagacgtttcatggtcagggccaacctggcggcagcgcaaaagatg

SEQ ID NO: 151734 - DNA, 103 bp, Artificial Sequence
  Synthetic Polynucleotide
taatacgactcactatagggcctttgtcacacgtctcacaaaccaacatcaacagaggagagatgttatgttgtgagacaacctggcggcagcgcaaaagatg

SEQ ID NO: 151735 - DNA, 103 bp, Artificial Sequence
  Synthetic Polynucleotide
taatacgactcactatagggtaaaaacggggtctctgaggtgggccctgaaacagaggagatcagggatgacctcagagaacctggcggcagcgcaaaagatg

SEQ ID NO: 151736 - DNA, 103 bp, Artificial Sequence
  Synthetic Polynucleotide
taatacgactcactatagggacttacagggtaaaaacggggtctctgaggaacagaggagacctcagatgccccgttttaacctggcggcagcgcaaaagatg

SEQ ID NO: 151737 - DNA, 103 bp, Artificial Sequence
  Synthetic Polynucleotide
taatacgactcactataggggggggtcctcacttacagggtaaaaacgggaacagaggagacccgttatgaccctgtaaaacctggcggcagcgcaaaagatg

SEQ ID NO: 151738 - DNA, 103 bp, Artificial Sequence
  Synthetic Polynucleotide
taatacgactcactataggggccagtcggtgggggtcctcacttacagggaacagaggagaccctgtatgtgaggacccaacctggcggcagcgcaaaagatg

SEQ ID NO: 151739 - DNA, 103 bp, Artificial Sequence
  Synthetic Polynucleotide
taatacgactcactatagggcccttcaggagccagtcggtgggggtcctcaacagaggagagaggacatgcaccgactgaacctggcggcagcgcaaaagatg

SEQ ID NO: 151740 - DNA, 103 bp, Artificial Sequence
  Synthetic Polynucleotide
taatacgactcactatagggggccccgaagcccttcaggagccagtcggtaacagaggagaaccgacatgctcctgaagaacctggcggcagcgcaaaagatg

SEQ ID NO: 151741 - DNA, 103 bp, Artificial Sequence
  Synthetic Polynucleotide
taatacgactcactataggggataccgccaggccccgaagcccttcaggaaacagaggagatcctgaatggcttcggggaacctggcggcagcgcaaaagatg

SEQ ID NO: 151742 - DNA, 103 bp, Artificial Sequence
  Synthetic Polynucleotide
taatacgactcactataggggggaagacctgataccgccaggccccgaagaacagaggagacttcggatgctggcggtaaacctggcggcagcgcaaaagatg

SEQ ID NO: 151743 - DNA, 103 bp, Artificial Sequence
  Synthetic Polynucleotide
taatacgactcactataggggtttctgtgggggaagacctgataccgccaaacagaggagatggcggatgcaggtcttcaacctggcggcagcgcaaaagatg

SEQ ID NO: 151744 - DNA, 103 bp, Artificial Sequence
  Synthetic Polynucleotide
taatacgactcactatagggggggctgagggtttctgtgggggaagacctaacagaggagaaggtctatgcccacagaaaacctggcggcagcgcaaaagatg

SEQ ID NO: 151745 - DNA, 103 bp, Artificial Sequence
  Synthetic Polynucleotide
taatacgactcactatagggagtatggtatcctttgtcacacgtctcacaaacagaggagatgtgagatgtgtgacaaaaacctggcggcagcgcaaaagatg

SEQ ID NO: 151746 - DNA, 103 bp, Artificial Sequence
  Synthetic Polynucleotide
taatacgactcactatagggaggggccggtggggctgagggtttctgtggaacagaggagaccacagatgccctcagccaacctggcggcagcgcaaaagatg

SEQ ID NO: 151747 - DNA, 103 bp, Artificial Sequence
  Synthetic Polynucleotide
taatacgactcactatagggtgttcaattcaggggccggtggggctgaggaacagaggagacctcagatgcaccggcccaacctggcggcagcgcaaaagatg

SEQ ID NO: 151748 - DNA, 103 bp, Artificial Sequence
  Synthetic Polynucleotide
taatacgactcactatagggtgaagactgttgttcaattcaggggccggtaacagaggagaaccggcatgtgaattgaaaacctggcggcagcgcaaaagatg

SEQ ID NO: 151749 - DNA, 103 bp, Artificial Sequence
  Synthetic Polynucleotide
taatacgactcactataggggggtgttggatgaagactgttgttcaattcaacagaggagagaattgatgaacagtcttaacctggcggcagcgcaaaagatg

SEQ ID NO: 151750 - DNA, 103 bp, Artificial Sequence
  Synthetic Polynucleotide
taatacgactcactatagggccttggtgtggggtgttggatgaagactgtaacagaggagaacagtcatgatccaacacaacctggcggcagcgcaaaagatg

SEQ ID NO: 151751 - DNA, 103 bp, Artificial Sequence
  Synthetic Polynucleotide
taatacgactcactatagggagggtaggacccttggtgtggggtgttggaaacagaggagatccaacatgccacaccaaaacctggcggcagcgcaaaagatg

SEQ ID NO: 151752 - DNA, 103 bp, Artificial Sequence
  Synthetic Polynucleotide
taatacgactcactatagggaccagttggcagggtaggacccttggtgtgaacagaggagacacaccatgggtcctaccaacctggcggcagcgcaaaagatg

SEQ ID NO: 151753 - DNA, 103 bp, Artificial Sequence
  Synthetic Polynucleotide
taatacgactcactatagggccagctccaaaccagttggcagggtaggacaacagaggagagtcctaatgtgccaactgaacctggcggcagcgcaaaagatg

SEQ ID NO: 151754 - DNA, 103 bp, Artificial Sequence
  Synthetic Polynucleotide
taatacgactcactatagggggccggttgaccagctccaaaccagttggcaacagaggagagccaacatgtttggagctaacctggcggcagcgcaaaagatg

SEQ ID NO: 151755 - DNA, 103 bp, Artificial Sequence
  Synthetic Polynucleotide
taatacgactcactataggggctcgacgggggccggttgaccagctccaaaacagaggagattggagatggtcaaccggaacctggcggcagcgcaaaagatg

SEQ ID NO: 151756 - DNA, 103 bp, Artificial Sequence
  Synthetic Polynucleotide
taatacgactcactatagggttaggcagaaagtatggtatcctttgtcacaacagaggagagtgacaatggataccataaacctggcggcagcgcaaaagatg

SEQ ID NO: 151757 - DNA, 103 bp, Artificial Sequence
  Synthetic Polynucleotide
taatacgactcactatagggcaagctcagtgctcgacgggggccggttgaaacagaggagatcaaccatgccccgtcgaaacctggcggcagcgcaaaagatg

SEQ ID NO: 151758 - DNA, 103 bp, Artificial Sequence
  Synthetic Polynucleotide
taatacgactcactatagggttggggcggccaagctcagtgctcgacgggaacagaggagacccgtcatgcactgagctaacctggcggcagcgcaaaagatg

SEQ ID NO: 151759 - DNA, 103 bp, Artificial Sequence
  Synthetic Polynucleotide
taatacgactcactatagggggccagaggattggggcggccaagctcagtaacagaggagaactgagatgggccgccccaacctggcggcagcgcaaaagatg

SEQ ID NO: 151760 - DNA, 103 bp, Artificial Sequence
  Synthetic Polynucleotide
taatacgactcactatagggcagcttccagggccagaggattggggcggcaacagaggagagccgccatgatcctctggaacctggcggcagcgcaaaagatg

SEQ ID NO: 151761 - DNA, 103 bp, Artificial Sequence
  Synthetic Polynucleotide
taatacgactcactatagggggcaacttcccagcttccagggccagaggaaacagaggagatcctctatgcctggaagcaacctggcggcagcgcaaaagatg

SEQ ID NO: 151762 - DNA, 103 bp, Artificial Sequence
  Synthetic Polynucleotide
taatacgactcactatagggatcctcacagggcaacttcccagcttccagaacagaggagactggaaatggggaagttgaacctggcggcagcgcaaaagatg

SEQ ID NO: 151763 - DNA, 103 bp, Artificial Sequence
  Synthetic Polynucleotide
taatacgactcactatagggccagctcgggatcctcacagggcaacttccaacagaggagaggaagtatgcctgtgaggaacctggcggcagcgcaaaagatg

SEQ ID NO: 151764 - DNA, 103 bp, Artificial Sequence
  Synthetic Polynucleotide
taatacgactcactatagggaaatcgtcatccagctcgggatcctcacagaacagaggagactgtgaatgtcccgagctaacctggcggcagcgcaaaagatg

SEQ ID NO: 151765 - DNA, 103 bp, Artificial Sequence
  Synthetic Polynucleotide
taatacgactcactataggggtgggcatcaaaatcgtcatccagctcgggaacagaggagacccgagatggatgacgataacctggcggcagcgcaaaagatg

SEQ ID NO: 151766 - DNA, 103 bp, Artificial Sequence
  Synthetic Polynucleotide
taatacgactcactatagggctagggccttgtgggcatcaaaatcgtcataacagaggagaatgacgatgttgatgcccaacctggcggcagcgcaaaagatg

SEQ ID NO: 151767 - DNA, 103 bp, Artificial Sequence
  Synthetic Polynucleotide
taatacgactcactatagggtgtgggttgggcaggtctgactcagtggcaaacagaggagatgccacatggtcagacctaacctggcggcagcgcaaaagatg

SEQ ID NO: 151768 - DNA, 103 bp, Artificial Sequence
  Synthetic Polynucleotide
taatacgactcactatagggatgggtggttttaggcagaaagtatggtataacagaggagaataccaatgtttctgcctaacctggcggcagcgcaaaagatg

SEQ ID NO: 151769 - DNA, 103 bp, Artificial Sequence
  Synthetic Polynucleotide
taatacgactcactatagggtcatcatcctctagggccttgtgggcatcaaacagaggagatgatgcatgcaaggccctaacctggcggcagcgcaaaagatg

SEQ ID NO: 151770 - DNA, 103 bp, Artificial Sequence
  Synthetic Polynucleotide
taatacgactcactatagggagcaagctcttcatcatcctctagggccttaacagaggagaaaggccatggaggatgataacctggcggcagcgcaaaagatg

SEQ ID NO: 151771 - DNA, 103 bp, Artificial Sequence
  Synthetic Polynucleotide
taatacgactcactataggggacccaggtgagcaagctcttcatcatcctaacagaggagaaggatgatgaagagcttgaacctggcggcagcgcaaaagatg

SEQ ID NO: 151772 - DNA, 103 bp, Artificial Sequence
  Synthetic Polynucleotide
taatacgactcactatagggtccacacccagacccaggtgagcaagctctaacagaggagaagagctatgtcacctgggaacctggcggcagcgcaaaagatg

SEQ ID NO: 151773 - DNA, 103 bp, Artificial Sequence
  Synthetic Polynucleotide
taatacgactcactatagggcttggccacatccacacccagacccaggtgaacagaggagacacctgatgctgggtgtgaacctggcggcagcgcaaaagatg

SEQ ID NO: 151774 - DNA, 103 bp, Artificial Sequence
  Synthetic Polynucleotide
taatacgactcactatagggcatcatcacccttggccacatccacacccaaacagaggagatgggtgatgatgtggccaaacctggcggcagcgcaaaagatg

SEQ ID NO: 151775 - DNA, 103 bp, Artificial Sequence
  Synthetic Polynucleotide
taatacgactcactataggggtgccaagttcatcatcacccttggccacaaacagaggagatgtggcatggggtgatgaaacctggcggcagcgcaaaagatg

SEQ ID NO: 151776 - DNA, 103 bp, Artificial Sequence
  Synthetic Polynucleotide
taatacgactcactataggggttttctaaggtgccaagttcatcatcaccaacagaggagaggtgatatggaacttggcaacctggcggcagcgcaaaagatg

SEQ ID NO: 151777 - DNA, 103 bp, Artificial Sequence
  Synthetic Polynucleotide
taatacgactcactatagggtggtctccaggttttctaaggtgccaagttaacagaggagaaacttgatgccttagaaaaacctggcggcagcgcaaaagatg

SEQ ID NO: 151778 - DNA, 103 bp, Artificial Sequence
  Synthetic Polynucleotide
taatacgactcactatagggtgggggtcattggtctccaggttttctaagaacagaggagacttagaatgcctggagacaacctggcggcagcgcaaaagatg

SEQ ID NO: 151779 - DNA, 103 bp, Artificial Sequence
  Synthetic Polynucleotide
taatacgactcactatagggcagttcctccatgggtggttttaggcagaaaacagaggagattctgcatgaaaccacccaacctggcggcagcgcaaaagatg

SEQ ID NO: 151780 - DNA, 103 bp, Artificial Sequence
  Synthetic Polynucleotide
taatacgactcactataggggtcatccaagtgggggtcattggtctccagaacagaggagactggagatgaatgaccccaacctggcggcagcgcaaaagatg

SEQ ID NO: 151781 - DNA, 103 bp, Artificial Sequence
  Synthetic Polynucleotide
taatacgactcactatagggcattgagcaggtcatccaagtgggggtcataacagaggagaatgaccatgacttggatgaacctggcggcagcgcaaaagatg

SEQ ID NO: 151782 - DNA, 103 bp, Artificial Sequence
  Synthetic Polynucleotide
taatacgactcactatagggaactcgtctccattgagcaggtcatccaagaacagaggagacttggaatgcctgctcaaaacctggcggcagcgcaaaagatg

SEQ ID NO: 151783 - DNA, 103 bp, Artificial Sequence
  Synthetic Polynucleotide
taatacgactcactatagggcagcaggtcaaactcgtctccattgagcagaacagaggagactgctcatgggagacgagaacctggcggcagcgcaaaagatg

SEQ ID NO: 151784 - DNA, 103 bp, Artificial Sequence
  Synthetic Polynucleotide
taatacgactcactatagggcagtatatgccagcaggtcaaactcgtctcaacagaggagagagacgatgttgacctgcaacctggcggcagcgcaaaagatg

SEQ ID NO: 151785 - DNA, 103 bp, Artificial Sequence
  Synthetic Polynucleotide
taatacgactcactatagggagctcaggatcagtatatgccagcaggtcaaacagaggagatgacctatgggcatatacaacctggcggcagcgcaaaagatg

SEQ ID NO: 151786 - DNA, 103 bp, Artificial Sequence
  Synthetic Polynucleotide
taatacgactcactatagggcccagtgtccagctcaggatcagtatatgcaacagaggagagcatatatggatcctgagaacctggcggcagcgcaaaagatg

SEQ ID NO: 151787 - DNA, 103 bp, Artificial Sequence
  Synthetic Polynucleotide
taatacgactcactatagggccttcttgtccccagtgtccagctcaggataacagaggagaatcctgatgtggacactgaacctggcggcagcgcaaaagatg

SEQ ID NO: 151788 - DNA, 103 bp, Artificial Sequence
  Synthetic Polynucleotide
taatacgactcactatagggttgaagatatccttcttgtccccagtgtccaacagaggagaggacacatgggacaagaaaacctggcggcagcgcaaaagatg

SEQ ID NO: 151789 - DNA, 103 bp, Artificial Sequence
  Synthetic Polynucleotide
taatacgactcactatagggcaggtgctcattgaagatatccttcttgtcaacagaggagagacaagatggatatcttcaacctggcggcagcgcaaaagatg

SEQ ID NO: 151790 - DNA, 103 bp, Artificial Sequence
  Synthetic Polynucleotide
taatacgactcactatagggagtgagcaggcagttcctccatgggtggttaacagaggagaaaccacatgtggaggaacaacctggcggcagcgcaaaagatg

SEQ ID NO: 151791 - DNA, 103 bp, Artificial Sequence
  Synthetic Polynucleotide
taatacgactcactatagggctaccagcctcaggtgctcattgaagatataacagaggagaatatctatgatgagcaccaacctggcggcagcgcaaaagatg

SEQ ID NO: 151792 - DNA, 103 bp, Artificial Sequence
  Synthetic Polynucleotide
taatacgactcactatagggttagccgattctaccagcctcaggtgctcaaacagaggagatgagcaatggaggctggtaacctggcggcagcgcaaaagatg

SEQ ID NO: 151793 - DNA, 103 bp, Artificial Sequence
  Synthetic Polynucleotide
taatacgactcactatagggagccttctcattagccgattctaccagcctaacagaggagaaggctgatggaatcggctaacctggcggcagcgcaaaagatg

SEQ ID NO: 151794 - DNA, 103 bp, Artificial Sequence
  Synthetic Polynucleotide
taatacgactcactatagggcctcccgttcagccttctcattagccgattaacagaggagaaatcggatgatgagaaggaacctggcggcagcgcaaaagatg

SEQ ID NO: 151795 - DNA, 103 bp, Artificial Sequence
  Synthetic Polynucleotide
taatacgactcactatagggcgcagcagggcctcccgttcagccttctcaaacagaggagatgagaaatgtgaacgggaaacctggcggcagcgcaaaagatg

SEQ ID NO: 151796 - DNA, 103 bp, Artificial Sequence
  Synthetic Polynucleotide
taatacgactcactatagggctccaccccccgcagcagggcctcccgttcaacagaggagagaacggatggccctgctgaacctggcggcagcgcaaaagatg

SEQ ID NO: 151797 - DNA, 103 bp, Artificial Sequence
  Synthetic Polynucleotide
taatacgactcactatagggagggtcctggctccaccccccgcagcagggaacagaggagaccctgcatgggggggtggaacctggcggcagcgcaaaagatg

SEQ ID NO: 151798 - DNA, 103 bp, Artificial Sequence
  Synthetic Polynucleotide
taatacgactcactatagggtcagggcccaagggtcctggctccacccccaacagaggagagggggtatggccaggaccaacctggcggcagcgcaaaagatg

SEQ ID NO: 151799 - DNA, 103 bp, Artificial Sequence
  Synthetic Polynucleotide
taatacgactcactatagggagggcgctcctcagggcccaagggtcctggaacagaggagaccaggaatgttgggccctaacctggcggcagcgcaaaagatg

SEQ ID NO: 151800 - DNA, 103 bp, Artificial Sequence
  Synthetic Polynucleotide
taatacgactcactatagggcagcagggggagggcgctcctcagggcccaaacagaggagatgggccatgaggagcgccaacctggcggcagcgcaaaagatg

SEQ ID NO: 151801 - DNA, 103 bp, Artificial Sequence
  Synthetic Polynucleotide
taatacgactcactatagggcacttccaagagtgagcaggcagttcctccaacagaggagaggaggaatggcctgctcaaacctggcggcagcgcaaaagatg

SEQ ID NO: 151802 - DNA, 103 bp, Artificial Sequence
  Synthetic Polynucleotide
taatacgactcactataggggaggcatcagcagcagggggagggcgctccaacagaggagaggagcgatgtccccctgcaacctggcggcagcgcaaaagatg

SEQ ID NO: 151803 - DNA, 103 bp, Artificial Sequence
  Synthetic Polynucleotide
taatacgactcactataggggcggggttcagaggcatcagcagcagggggaacagaggagaccccctatggctgatgccaacctggcggcagcgcaaaagatg

SEQ ID NO: 151804 - DNA, 103 bp, Artificial Sequence
  Synthetic Polynucleotide
taatacgactcactatagggcagatgccaggcggggttcagaggcatcagaacagaggagactgatgatgctgaaccccaacctggcggcagcgcaaaagatg

SEQ ID NO: 151805 - DNA, 103 bp, Artificial Sequence
  Synthetic Polynucleotide
taatacgactcactatagggtcagggagcacagatgccaggcggggttcaaacagaggagatgaaccatgcctggcatcaacctggcggcagcgcaaaagatg

SEQ ID NO: 151806 - DNA, 103 bp, Artificial Sequence
  Synthetic Polynucleotide
taatacgactcactataggggggcttcacctcagggagcacagatgccagaacagaggagactggcaatggtgctccctaacctggcggcagcgcaaaagatg

SEQ ID NO: 151807 - DNA, 103 bp, Artificial Sequence
  Synthetic Polynucleotide
taatacgactcactatagggcctccaccttgggcttcacctcagggagcaaacagaggagatgctccatgaggtgaagcaacctggcggcagcgcaaaagatg

SEQ ID NO: 151808 - DNA, 103 bp, Artificial Sequence
  Synthetic Polynucleotide
taatacgactcactatagggcgtccaccctcctccaccttgggcttcaccaacagaggagaggtgaaatgcaaggtggaaacctggcggcagcgcaaaagatg

SEQ ID NO: 151809 - DNA, 103 bp, Artificial Sequence
  Synthetic Polynucleotide
taatacgactcactatagggagaagggtggcgtccaccctcctccaccttaacagaggagaaaggtgatggagggtggaaacctggcggcagcgcaaaagatg

SEQ ID NO: 151810 - DNA, 103 bp, Artificial Sequence
  Synthetic Polynucleotide
taatacgactcactatagggattggcaaggagaagggtggcgtccaccctaacagaggagaagggtgatggccacccttaacctggcggcagcgcaaaagatg

SEQ ID NO: 151811 - DNA, 103 bp, Artificial Sequence
  Synthetic Polynucleotide
taatacgactcactataggggcaatggtgaattggcaaggagaagggtggaacagaggagaccacccatgtccttgccaaacctggcggcagcgcaaaagatg

SEQ ID NO: 151812 - DNA, 103 bp, Artificial Sequence
  Synthetic Polynucleotide
taatacgactcactataggggcacgccttgcacttccaagagtgagcaggaacagaggagacctgctatgtcttggaagaacctggcggcagcgcaaaagatg

SEQ ID NO: 151813 - DNA, 103 bp, Artificial Sequence
  Synthetic Polynucleotide
taatacgactcactatagggcttgggggtagcaatggtgaattggcaaggaacagaggagaccttgcatgttcaccattaacctggcggcagcgcaaaagatg

SEQ ID NO: 151814 - DNA, 103 bp, Artificial Sequence
  Synthetic Polynucleotide
taatacgactcactatagggcgggctctaccttgggggtagcaatggtgaaacagaggagatcaccaatgctacccccaaacctggcggcagcgcaaaagatg

SEQ ID NO: 151815 - DNA, 103 bp, Artificial Sequence
  Synthetic Polynucleotide
taatacgactcactataggggcagcaggtgcgggctctaccttgggggtaaacagaggagataccccatgggtagagccaacctggcggcagcgcaaaagatg

SEQ ID NO: 151816 - DNA, 103 bp, Artificial Sequence
  Synthetic Polynucleotide
taatacgactcactatagggaagggaattggcagcaggtgcgggctctacaacagaggagagtagagatggcacctgctaacctggcggcagcgcaaaagatg

SEQ ID NO: 151817 - DNA, 103 bp, Artificial Sequence
  Synthetic Polynucleotide
taatacgactcactataggggccccaggccaagggaattggcagcaggtgaacagaggagacacctgatgccaattcccaacctggcggcagcgcaaaagatg

SEQ ID NO: 151818 - DNA, 103 bp, Artificial Sequence
  Synthetic Polynucleotide
taatacgactcactatagggcctggctttagccccaggccaagggaattgaacagaggagacaattcatgtggcctgggaacctggcggcagcgcaaaagatg

SEQ ID NO: 151819 - DNA, 103 bp, Artificial Sequence
  Synthetic Polynucleotide
taatacgactcactatagggcatgctctgtcctggctttagccccaggccaacagaggagaggcctgatgctaaagccaaacctggcggcagcgcaaaagatg

SEQ ID NO: 151820 - DNA, 103 bp, Artificial Sequence
  Synthetic Polynucleotide
taatacgactcactatagggggctgcccatcatgctctgtcctggctttaaacagaggagataaagcatggacagagcaaacctggcggcagcgcaaaagatg

SEQ ID NO: 151821 - DNA, 103 bp, Artificial Sequence
  Synthetic Polynucleotide
taatacgactcactatagggcgggtatcccggctgcccatcatgctctgtaacagaggagaacagagatggatgggcagaacctggcggcagcgcaaaagatg

SEQ ID NO: 151822 - DNA, 103 bp, Artificial Sequence
  Synthetic Polynucleotide
taatacgactcactatagggtgtgcccatccgggtatcccggctgcccataacagaggagaatgggcatgcgggataccaacctggcggcagcgcaaaagatg

SEQ ID NO: 151823 - DNA, 103 bp, Artificial Sequence
  Synthetic Polynucleotide
taatacgactcactatagggggcacacccggcacgccttgcacttccaagaacagaggagacttggaatggcaaggcgtaacctggcggcagcgcaaaagatg

SEQ ID NO: 151824 - DNA, 103 bp, Artificial Sequence
  Synthetic Polynucleotide
taatacgactcactatagggaaaatggccctgtgcccatccgggtatcccaacagaggagagggataatgggatgggcaaacctggcggcagcgcaaaagatg

SEQ ID NO: 151825 - DNA, 103 bp, Artificial Sequence
  Synthetic Polynucleotide
taatacgactcactatagggccactgctagaaaatggccctgtgcccatcaacagaggagagatgggatgagggccattaacctggcggcagcgcaaaagatg

SEQ ID NO: 151826 - DNA, 103 bp, Artificial Sequence
  Synthetic Polynucleotide
taatacgactcactatagggagctgtgtgcccactgctagaaaatggcccaacagaggagagggccaatgtctagcagtaacctggcggcagcgcaaaagatg

SEQ ID NO: 151827 - DNA, 103 bp, Artificial Sequence
  Synthetic Polynucleotide
taatacgactcactatagggaggccttctcagctgtgtgcccactgctagaacagaggagactagcaatgggcacacagaacctggcggcagcgcaaaagatg

SEQ ID NO: 151828 - DNA, 103 bp, Artificial Sequence
  Synthetic Polynucleotide
taatacgactcactataggggccccaaaggaggccttctcagctgtgtgcaacagaggagagcacacatgtgagaaggcaacctggcggcagcgcaaaagatg

SEQ ID NO: 151829 - DNA, 103 bp, Artificial Sequence
  Synthetic Polynucleotide
taatacgactcactatagggtcctcccgtggccccaaaggaggccttctcaacagaggagagagaagatgtcctttgggaacctggcggcagcgcaaaagatg

SEQ ID NO: 151830 - DNA, 103 bp, Artificial Sequence
  Synthetic Polynucleotide
taatacgactcactataggggagctggtggtcctcccgtggccccaaaggaacagaggagacctttgatgccacgggagaacctggcggcagcgcaaaagatg

SEQ ID NO: 151831 - DNA, 103 bp, Artificial Sequence
  Synthetic Polynucleotide
taatacgactcactataggggtcagcaggtgagctggtggtcctcccgtgaacagaggagacacgggatgaccaccagcaacctggcggcagcgcaaaagatg

SEQ ID NO: 151832 - DNA, 103 bp, Artificial Sequence
  Synthetic Polynucleotide
taatacgactcactatagggtgggctgggggtcagcaggtgagctggtggaacagaggagaccaccaatgcacctgctgaacctggcggcagcgcaaaagatg

SEQ ID NO: 151833 - DNA, 103 bp, Artificial Sequence
  Synthetic Polynucleotide
taatacgactcactatagggggccactcagtgggctgggggtcagcaggtaacagaggagaacctgcatgcccccagccaacctggcggcagcgcaaaagatg

SEQ ID NO: 151834 - DNA, 103 bp, Artificial Sequence
  Synthetic Polynucleotide
taatacgactcactatagggccacaggcccggcacacccggcacgccttgaacagaggagacaaggcatgccgggtgtgaacctggcggcagcgcaaaagatg

SEQ ID NO: 151835 - DNA, 103 bp, Artificial Sequence
  Synthetic Polynucleotide
taatacgactcactataggggatcctcctgggccactcagtgggctggggaacagaggagaccccagatgactgagtggaacctggcggcagcgcaaaagatg

SEQ ID NO: 151836 - DNA, 103 bp, Artificial Sequence
  Synthetic Polynucleotide
taatacgactcactatagggcagcagggaggatcctcctgggccactcagaacagaggagactgagtatgccaggaggaaacctggcggcagcgcaaaagatg

SEQ ID NO: 151837 - DNA, 103 bp, Artificial Sequence
  Synthetic Polynucleotide
taatacgactcactatagggcaaacttttccagcagggaggatcctcctgaacagaggagacaggagatgcctccctgcaacctggcggcagcgcaaaagatg

SEQ ID NO: 151838 - DNA, 103 bp, Artificial Sequence
  Synthetic Polynucleotide
taatacgactcactatagggctctcgagctcaaacttttccagcagggagaacagaggagactccctatgggaaaagttaacctggcggcagcgcaaaagatg

SEQ ID NO: 151839 - DNA, 103 bp, Artificial Sequence
  Synthetic Polynucleotide
taatacgactcactatagggcaaagccccactctcgagctcaaacttttcaacagaggagagaaaagatggagctcgagaacctggcggcagcgcaaaagatg

SEQ ID NO: 151840 - DNA, 103 bp, Artificial Sequence
  Synthetic Polynucleotide
taatacgactcactatagggcaggcaaggtcaaagccccactctcgagctaacagaggagaagctcgatggtggggcttaacctggcggcagcgcaaaagatg

SEQ ID NO: 151841 - DNA, 103 bp, Artificial Sequence
  Synthetic Polynucleotide
taatacgactcactataggggcaggtccaccaggcaaggtcaaagccccaaacagaggagatggggcatggaccttgccaacctggcggcagcgcaaaagatg

SEQ ID NO: 151842 - DNA, 103 bp, Artificial Sequence
  Synthetic Polynucleotide
taatacgactcactatagggcccagatgctgcaggtccaccaggcaaggtaacagaggagaaccttgatgggtggacctaacctggcggcagcgcaaaagatg

SEQ ID NO: 151843 - DNA, 103 bp, Artificial Sequence
  Synthetic Polynucleotide
taatacgactcactatagggctagctcatccccagatgctgcaggtccacaacagaggagagtggacatgcagcatctgaacctggcggcagcgcaaaagatg

SEQ ID NO: 151844 - DNA, 103 bp, Artificial Sequence
  Synthetic Polynucleotide
taatacgactcactatagggtccatcttgtctagctcatccccagatgctaacagaggagaagcatcatgggatgagctaacctggcggcagcgcaaaagatg

SEQ ID NO: 151845 - DNA, 103 bp, Artificial Sequence
  Synthetic Polynucleotide
taatacgactcactatagggtgagcccgccccacaggcccggcacacccgaacagaggagacgggtgatgcgggcctgtaacctggcggcagcgcaaaagatg

SEQ ID NO: 151846 - DNA, 103 bp, Artificial Sequence
  Synthetic Polynucleotide
taatacgactcactatagggcagtgagctctccatcttgtctagctcatcaacagaggagagatgagatggacaagatgaacctggcggcagcgcaaaagatg

SEQ ID NO: 151847 - DNA, 103 bp, Artificial Sequence
  Synthetic Polynucleotide
taatacgactcactatagggcgctggctaccagtgagctctccatcttgtaacagaggagaacaagaatgagagctcacaacctggcggcagcgcaaaagatg

SEQ ID NO: 151848 - DNA, 103 bp, Artificial Sequence
  Synthetic Polynucleotide
taatacgactcactatagggaggggtaactcgctggctaccagtgagctcaacagaggagagagctcatgggtagccagaacctggcggcagcgcaaaagatg

SEQ ID NO: 151849 - DNA, 103 bp, Artificial Sequence
  Synthetic Polynucleotide
taatacgactcactatagggctcaatgagcaggggtaactcgctggctacaacagaggagagtagccatggagttacccaacctggcggcagcgcaaaagatg

SEQ ID NO: 151850 - DNA, 103 bp, Artificial Sequence
  Synthetic Polynucleotide
taatacgactcactatagggccaacaggtcctcaatgagcaggggtaactaacagaggagaagttacatgtgctcattgaacctggcggcagcgcaaaagatg

SEQ ID NO: 151851 - DNA, 103 bp, Artificial Sequence
  Synthetic Polynucleotide
taatacgactcactatagggttctcatgctccaacaggtcctcaatgagcaacagaggagagctcatatgggacctgttaacctggcggcagcgcaaaagatg

SEQ ID NO: 151852 - DNA, 103 bp, Artificial Sequence
  Synthetic Polynucleotide
taatacgactcactatagggcagctccttcttctcatgctccaacaggtcaacagaggagagacctgatggagcatgagaacctggcggcagcgcaaaagatg

SEQ ID NO: 151853 - DNA, 103 bp, Artificial Sequence
  Synthetic Polynucleotide
taatacgactcactataggggcttcttctgcagctccttcttctcatgctaacagaggagaagcatgatgagaaggagcaacctggcggcagcgcaaaagatg

SEQ ID NO: 151854 - DNA, 103 bp, Artificial Sequence
  Synthetic Polynucleotide
taatacgactcactataggggaaagctgctgcttcttctgcagctccttcaacagaggagagaaggaatggcagaagaaaacctggcggcagcgcaaaagatg

SEQ ID NO: 151855 - DNA, 103 bp, Artificial Sequence
  Synthetic Polynucleotide
taatacgactcactatagggcaactgtgctgaaagctgctgcttcttctgaacagaggagacagaagatgcagcagcttaacctggcggcagcgcaaaagatg

SEQ ID NO: 151856 - DNA, 103 bp, Artificial Sequence
  Synthetic Polynucleotide
taatacgactcactatagggtcagttctgctgagcccgccccacaggcccaacagaggagagggcctatggggcgggctaacctggcggcagcgcaaaagatg

SEQ ID NO: 151857 - DNA, 103 bp, Artificial Sequence
  Synthetic Polynucleotide
taatacgactcactataggggggcaggctgcaactgtgctgaaagctgctaacagaggagaagcagcatgcagcacagtaacctggcggcagcgcaaaagatg

SEQ ID NO: 151858 - DNA, 103 bp, Artificial Sequence
  Synthetic Polynucleotide
taatacgactcactatagggtgctgctgctgggcaggctgcaactgtgctaacagaggagaagcacaatggcagcctgcaacctggcggcagcgcaaaagatg

SEQ ID NO: 151859 - DNA, 103 bp, Artificial Sequence
  Synthetic Polynucleotide
taatacgactcactatagggctgctgttgctgctgctgctgggcaggctgaacagaggagacagcctatgcagcagcagaacctggcggcagcgcaaaagatg

SEQ ID NO: 151860 - DNA, 103 bp, Artificial Sequence
  Synthetic Polynucleotide
taatacgactcactatagggaatgctgctgctgctgttgctgctgctgctaacagaggagaagcagcatgagcaacagcaacctggcggcagcgcaaaagatg

SEQ ID NO: 151861 - DNA, 103 bp, Artificial Sequence
  Synthetic Polynucleotide
taatacgactcactataggggacagtagggaatgctgctgctgctgttgcaacagaggagagcaacaatggcagcagcaaacctggcggcagcgcaaaagatg

SEQ ID NO: 151862 - DNA, 103 bp, Artificial Sequence
  Synthetic Polynucleotide
taatacgactcactataggggcctggtgcagacagtagggaatgctgctgaacagaggagacagcagatgtccctactgaacctggcggcagcgcaaaagatg

SEQ ID NO: 151863 - DNA, 103 bp, Artificial Sequence
  Synthetic Polynucleotide
taatacgactcactatagggcctgggcagggcctggtgcagacagtagggaacagaggagaccctacatgctgcaccagaacctggcggcagcgcaaaagatg

SEQ ID NO: 151864 - DNA, 103 bp, Artificial Sequence
  Synthetic Polynucleotide
taatacgactcactatagggaaagacatggcctgggcagggcctggtgcaaacagaggagatgcaccatgccctgcccaaacctggcggcagcgcaaaagatg

SEQ ID NO: 151865 - DNA, 103 bp, Artificial Sequence
  Synthetic Polynucleotide
taatacgactcactatagggctcatgtggcaaagacatggcctgggcaggaacagaggagacctgccatggccatgtctaacctggcggcagcgcaaaagatg

SEQ ID NO: 151866 - DNA, 103 bp, Artificial Sequence
  Synthetic Polynucleotide
taatacgactcactataggggagaagagccctcatgtggcaaagacatggaacagaggagaccatgtatgtgccacatgaacctggcggcagcgcaaaagatg

SEQ ID NO: 151867 - DNA, 103 bp, Artificial Sequence
  Synthetic Polynucleotide
taatacgactcactataggggagttgggattcagttctgctgagcccgccaacagaggagaggcgggatgagcagaactaacctggcggcagcgcaaaagatg

SEQ ID NO: 151868 - DNA, 103 bp, Artificial Sequence
  Synthetic Polynucleotide
taatacgactcactataggggccaaactgggagaagagccctcatgtggcaacagaggagagccacaatggggctcttcaacctggcggcagcgcaaaagatg

SEQ ID NO: 151869 - DNA, 103 bp, Artificial Sequence
  Synthetic Polynucleotide
taatacgactcactatagggttgggacccagccaaactgggagaagagccaacagaggagaggctctatgcccagtttgaacctggcggcagcgcaaaagatg

SEQ ID NO: 151870 - DNA, 103 bp, Artificial Sequence
  Synthetic Polynucleotide
taatacgactcactatagggaaagctgctgttgggacccagccaaactggaacagaggagaccagttatgctgggtcccaacctggcggcagcgcaaaagatg

SEQ ID NO: 151871 - DNA, 103 bp, Artificial Sequence
  Synthetic Polynucleotide
taatacgactcactatagggagacccagggaaagctgctgttgggacccaaacagaggagatgggtcatgacagcagctaacctggcggcagcgcaaaagatg

SEQ ID NO: 151872 - DNA, 103 bp, Artificial Sequence
  Synthetic Polynucleotide
taatacgactcactatagggggcacctgcaagacccagggaaagctgctgaacagaggagacagcagatgtccctgggtaacctggcggcagcgcaaaagatg

SEQ ID NO: 151873 - DNA, 103 bp, Artificial Sequence
  Synthetic Polynucleotide
taatacgactcactatagggctggctgtcgggcacctgcaagacccagggaacagaggagaccctggatgttgcaggtgaacctggcggcagcgcaaaagatg

SEQ ID NO: 151874 - DNA, 103 bp, Artificial Sequence
  Synthetic Polynucleotide
taatacgactcactatagggtggggcaaacctggctgtcgggcacctgcaaacagaggagatgcaggatgccgacagccaacctggcggcagcgcaaaagatg

SEQ ID NO: 151875 - DNA, 103 bp, Artificial Sequence
  Synthetic Polynucleotide
taatacgactcactatagggcatcagtggctggggcaaacctggctgtcgaacagaggagacgacagatgggtttgcccaacctggcggcagcgcaaaagatg

SEQ ID NO: 151876 - DNA, 103 bp, Artificial Sequence
  Synthetic Polynucleotide
taatacgactcactataggggctgggtgggcatcagtggctggggcaaacaacagaggagagtttgcatgagccactgaaacctggcggcagcgcaaaagatg

SEQ ID NO: 151877 - DNA, 103 bp, Artificial Sequence
  Synthetic Polynucleotide
taatacgactcactatagggtgagctggtggctgggtgggcatcagtggcaacagaggagagccactatggcccacccaaacctggcggcagcgcaaaagatg

SEQ ID NO: 151878 - DNA, 103 bp, Artificial Sequence
  Synthetic Polynucleotide
taatacgactcactatagggacaaccaggacaggcacagcccactgacataacagaggagaatgtcaatgggctgtgccaacctggcggcagcgcaaaagatg

SEQ ID NO: 151879 - DNA, 103 bp, Artificial Sequence
  Synthetic Polynucleotide
taatacgactcactatagggcctatccagcatggtgccgggatggaagggaacagaggagacccttcatgcccggcaccaacctggcggcagcgcaaaagatg

SEQ ID NO: 151880 - DNA, 103 bp, Artificial Sequence
  Synthetic Polynucleotide
taatacgactcactatagggcaccaccatcacatcaggtacctggctggaaacagaggagatccagcatggtacctgataacctggcggcagcgcaaaagatg

SEQ ID NO: 151881 - DNA, 103 bp, Artificial Sequence
  Synthetic Polynucleotide
taatacgactcactatagggtgggctcccccaccaccatcacatcaggtaaacagaggagatacctgatgtgatggtggaacctggcggcagcgcaaaagatg

SEQ ID NO: 151882 - DNA, 103 bp, Artificial Sequence
  Synthetic Polynucleotide
taatacgactcactatagggcccatcagggtgggctcccccaccaccatcaacagaggagagatggtatggggggagccaacctggcggcagcgcaaaagatg

SEQ ID NO: 151883 - DNA, 103 bp, Artificial Sequence
  Synthetic Polynucleotide
taatacgactcactataggggaactccccgcccatcagggtgggctccccaacagaggagaggggagatgaccctgatgaacctggcggcagcgcaaaagatg

SEQ ID NO: 151884 - DNA, 103 bp, Artificial Sequence
  Synthetic Polynucleotide
taatacgactcactatagggcctcgtccccgaactccccgcccatcagggaacagaggagaccctgaatggcggggagtaacctggcggcagcgcaaaagatg

SEQ ID NO: 151885 - DNA, 103 bp, Artificial Sequence
  Synthetic Polynucleotide
taatacgactcactatagggagcctctcgtcctcgtccccgaactccccgaacagaggagacggggaatgcggggacgaaacctggcggcagcgcaaaagatg

SEQ ID NO: 151886 - DNA, 103 bp, Artificial Sequence
  Synthetic Polynucleotide
taatacgactcactatagggccgggtgatgagcctctcgtcctcgtccccaacagaggagaggggacatggacgagaggaacctggcggcagcgcaaaagatg

SEQ ID NO: 151887 - DNA, 103 bp, Artificial Sequence
  Synthetic Polynucleotide
taatacgactcactatagggtgttctccagccgggtgatgagcctctcgtaacagaggagaacgagaatgtcatcacccaacctggcggcagcgcaaaagatg

SEQ ID NO: 151888 - DNA, 103 bp, Artificial Sequence
  Synthetic Polynucleotide
taatacgactcactatagggtcaaactgggtgttctccagccgggtgatgaacagaggagacatcacatggctggagaaaacctggcggcagcgcaaaagatg

SEQ ID NO: 151889 - DNA, 103 bp, Artificial Sequence
  Synthetic Polynucleotide
taatacgactcactataggggttggctgcgtcaaactgggtgttctccagaacagaggagactggagatgacccagtttaacctggcggcagcgcaaaagatg

SEQ ID NO: 151890 - DNA, 103 bp, Artificial Sequence
  Synthetic Polynucleotide
taatacgactcactatagggggcccacatccctatccagcatggtgccggaacagaggagaccggcaatgtgctggataaacctggcggcagcgcaaaagatg

SEQ ID NO: 151891 - DNA, 103 bp, Artificial Sequence
  Synthetic Polynucleotide
taatacgactcactatagggcgtcaatgccgttggctgcgtcaaactgggaacagaggagacccagtatgacgcagccaaacctggcggcagcgcaaaagatg

SEQ ID NO: 151892 - DNA, 103 bp, Artificial Sequence
  Synthetic Polynucleotide
taatacgactcactatagggctgtcctcgtcgtcaatgccgttggctgcgaacagaggagacgcagcatgcggcattgaaacctggcggcagcgcaaaagatg

SEQ ID NO: 151893 - DNA, 103 bp, Artificial Sequence
  Synthetic Polynucleotide
taatacgactcactataggggttgttaaagctgtcctcgtcgtcaatgccaacagaggagaggcattatggacgaggacaacctggcggcagcgcaaaagatg

SEQ ID NO: 151894 - DNA, 103 bp, Artificial Sequence
  Synthetic Polynucleotide
taatacgactcactataggggtgcaggggagttgttaaagctgtcctcgtaacagaggagaacgaggatggctttaacaaacctggcggcagcgcaaaagatg

SEQ ID NO: 151895 - DNA, 103 bp, Artificial Sequence
  Synthetic Polynucleotide
taatacgactcactatagggttggcgcccagtgcaggggagttgttaaagaacagaggagactttaaatgctcccctgcaacctggcggcagcgcaaaagatg

SEQ ID NO: 151896 - DNA, 103 bp, Artificial Sequence
  Synthetic Polynucleotide
taatacgactcactatagggccaggggctgttggcgcccagtgcaggggaaacagaggagatcccctatgctgggcgccaacctggcggcagcgcaaaagatg

SEQ ID NO: 151897 - DNA, 103 bp, Artificial Sequence
  Synthetic Polynucleotide
taatacgactcactataggggcttgctgttccaggggctgttggcgcccaaacagaggagatgggcgatgacagcccctaacctggcggcagcgcaaaagatg

SEQ ID NO: 151898 - DNA, 103 bp, Artificial Sequence
  Synthetic Polynucleotide
taatacgactcactatagggctggacggaggcttgctgttccaggggctgaacagaggagacagcccatggaacagcaaaacctggcggcagcgcaaaagatg

SEQ ID NO: 151899 - DNA, 103 bp, Artificial Sequence
  Synthetic Polynucleotide
taatacgactcactataggggctttcttggctggacggaggcttgctgttaacagaggagaaacagcatgcctccgtccaacctggcggcagcgcaaaagatg

SEQ ID NO: 151900 - DNA, 103 bp, Artificial Sequence
  Synthetic Polynucleotide
taatacgactcactatagggtctccgatttgctttcttggctggacggagaacagaggagactccgtatggccaagaaaaacctggcggcagcgcaaaagatg

SEQ ID NO: 151901 - DNA, 103 bp, Artificial Sequence
  Synthetic Polynucleotide
taatacgactcactatagggatgggagttgggcccacatccctatccagcaacagaggagagctggaatgggatgtgggaacctggcggcagcgcaaaagatg

SEQ ID NO: 151902 - DNA, 103 bp, Artificial Sequence
  Synthetic Polynucleotide
taatacgactcactataggggacgtggggttctccgatttgctttcttggaacagaggagaccaagaatgcaaatcggaaacctggcggcagcgcaaaagatg

SEQ ID NO: 151903 - DNA, 103 bp, Artificial Sequence
  Synthetic Polynucleotide
taatacgactcactatagggggaggcctgtgacgtggggttctccgatttaacagaggagaaaatcgatgaaccccacgaacctggcggcagcgcaaaagatg

SEQ ID NO: 151904 - DNA, 103 bp, Artificial Sequence
  Synthetic Polynucleotide
taatacgactcactatagggaggcggatacatgggagttgggcccacatcaacagaggagagatgtgatgccaactcccaacctggcggcagcgcaaaagatg

SEQ ID NO: 151905 - DNA, 103 bp, Artificial Sequence
  Synthetic Polynucleotide
taatacgactcactatagggccaggtatgtaggcggatacatgggagttgaacagaggagacaactcatgtgtatccgcaacctggcggcagcgcaaaagatg

SEQ ID NO: 151906 - DNA, 103 bp, Artificial Sequence
  Synthetic Polynucleotide
taatacgactcactatagggatccctggctccaggtatgtaggcggatacaacagaggagagtatccatgtacatacctaacctggcggcagcgcaaaagatg

SEQ ID NO: 151907 - DNA, 103 bp, Artificial Sequence
  Synthetic Polynucleotide
taatacgactcactataggggtgcctcccaatccctggctccaggtatgtaacagaggagaacatacatggagccagggaacctggcggcagcgcaaaagatg

SEQ ID NO: 151908 - DNA, 103 bp, Artificial Sequence
  Synthetic Polynucleotide
taatacgactcactatagggcatatggtgtgtgcctcccaatccctggctaacagaggagaagccagatgttgggaggcaacctggcggcagcgcaaaagatg

SEQ ID NO: 151909 - DNA, 103 bp, Artificial Sequence
  Synthetic Polynucleotide
taatacgactcactataggggtttggttgccatatggtgtgtgcctcccaaacagaggagatgggagatgcacaccataaacctggcggcagcgcaaaagatg

SEQ ID NO: 151910 - DNA, 103 bp, Artificial Sequence
  Synthetic Polynucleotide
taatacgactcactatagggtctgtagtcagtttggttgccatatggtgtaacagaggagaacaccaatgggcaaccaaaacctggcggcagcgcaaaagatg

SEQ ID NO: 151911 - DNA, 103 bp, Artificial Sequence
  Synthetic Polynucleotide
taatacgactcactatagggactttgaggaacaaccaggacaggcacagcaacagaggagagctgtgatggtcctggttaacctggcggcagcgcaaaagatg

SEQ ID NO: 151912 - DNA, 103 bp, Artificial Sequence
  Synthetic Polynucleotide
taatacgactcactataggggctcaaatattctgtagtcagtttggttgcaacagaggagagcaaccatgctgactacaaacctggcggcagcgcaaaagatg

SEQ ID NO: 151913 - DNA, 103 bp, Artificial Sequence
  Synthetic Polynucleotide
taatacgactcactatagggcgtttgttaagctcaaatattctgtagtcaaacagaggagatgactaatgaatatttgaaacctggcggcagcgcaaaagatg

SEQ ID NO: 151914 - DNA, 103 bp, Artificial Sequence
  Synthetic Polynucleotide
taatacgactcactataggggttctgaagccgtttgttaagctcaaatataacagaggagaatatttatgcttaacaaaaacctggcggcagcgcaaaagatg

SEQ ID NO: 151915 - DNA, 103 bp, Artificial Sequence
  Synthetic Polynucleotide
taatacgactcactatagggcctctgtccagttctgaagccgtttgttaaaacagaggagattaacaatgggcttcagaaacctggcggcagcgcaaaagatg

SEQ ID NO: 151916 - DNA, 103 bp, Artificial Sequence
  Synthetic Polynucleotide
taatacgactcactatagggttgtcacactcctctgtccagttctgaagcaacagaggagagcttcaatgctggacagaaacctggcggcagcgcaaaagatg

SEQ ID NO: 151917 - DNA, 103 bp, Artificial Sequence
  Synthetic Polynucleotide
taatacgactcactatagggccaccagagattgtcacactcctctgtccaaacagaggagatggacaatggagtgtgacaacctggcggcagcgcaaaagatg

SEQ ID NO: 151918 - DNA, 103 bp, Artificial Sequence
  Synthetic Polynucleotide
taatacgactcactatagggtgaatgcatcccaccagagattgtcacactaacagaggagaagtgtgatgatctctggtaacctggcggcagcgcaaaagatg

SEQ ID NO: 151919 - DNA, 103 bp, Artificial Sequence
  Synthetic Polynucleotide
taatacgactcactatagggaactcagtcgtgaatgcatcccaccagagaaacagaggagatctctgatgggatgcattaacctggcggcagcgcaaaagatg

SEQ ID NO: 151920 - DNA, 103 bp, Artificial Sequence
  Synthetic Polynucleotide
taatacgactcactatagggatcctcaaagaactcagtcgtgaatgcatcaacagaggagagatgcaatgacgactgagaacctggcggcagcgcaaaagatg

SEQ ID NO: 151921 - DNA, 103 bp, Artificial Sequence
  Synthetic Polynucleotide
taatacgactcactatagggacatggcatcatcctcaaagaactcagtcgaacagaggagacgactgatgtctttgaggaacctggcggcagcgcaaaagatg

SEQ ID NO: 151922 - DNA, 103 bp, Artificial Sequence
  Synthetic Polynucleotide
taatacgactcactatagggagcttgaatgactttgaggaacaaccaggaaacagaggagatcctggatgttcctcaaaaacctggcggcagcgcaaaagatg

SEQ ID NO: 151923 - DNA, 103 bp, Artificial Sequence
  Synthetic Polynucleotide
taatacgactcactataggggtgatggtcaacatggcatcatcctcaaagaacagaggagactttgaatgtgatgccataacctggcggcagcgcaaaagatg

SEQ ID NO: 151924 - DNA, 103 bp, Artificial Sequence
  Synthetic Polynucleotide
taatacgactcactatagggcaggcagaaagtgatggtcaacatggcatcaacagaggagagatgccatgttgaccatcaacctggcggcagcgcaaaagatg

SEQ ID NO: 151925 - DNA, 103 bp, Artificial Sequence
  Synthetic Polynucleotide
taatacgactcactataggggtccatcctccaggcagaaagtgatggtcaaacagaggagatgaccaatgctttctgccaacctggcggcagcgcaaaagatg

SEQ ID NO: 151926 - DNA, 103 bp, Artificial Sequence
  Synthetic Polynucleotide
taatacgactcactatagggtatctctttggtccatcctccaggcagaaaaacagaggagatttctgatgggaggatggaacctggcggcagcgcaaaagatg

SEQ ID NO: 151927 - DNA, 103 bp, Artificial Sequence
  Synthetic Polynucleotide
taatacgactcactataggggccaatggtatatctctttggtccatcctcaacagaggagagaggatatgccaaagagaaacctggcggcagcgcaaaagatg

SEQ ID NO: 151928 - DNA, 103 bp, Artificial Sequence
  Synthetic Polynucleotide
taatacgactcactatagggtcagggtccggccaatggtatatctctttgaacagaggagacaaagaatgataccattgaacctggcggcagcgcaaaagatg

SEQ ID NO: 151929 - DNA, 103 bp, Artificial Sequence
  Synthetic Polynucleotide
taatacgactcactatagggtagcgtgggatcagggtccggccaatggtaaacagaggagataccatatgccggaccctaacctggcggcagcgcaaaagatg

SEQ ID NO: 151930 - DNA, 103 bp, Artificial Sequence
  Synthetic Polynucleotide
taatacgactcactataggggctgcggaagtagcgtgggatcagggtccgaacagaggagacggaccatgatcccacgcaacctggcggcagcgcaaaagatg

SEQ ID NO: 151931 - DNA, 103 bp, Artificial Sequence
  Synthetic Polynucleotide
taatacgactcactatagggcctcaaagatgctgcggaagtagcgtgggaaacagaggagatcccacatgacttccgcaaacctggcggcagcgcaaaagatg

SEQ ID NO: 151932 - DNA, 103 bp, Artificial Sequence
  Synthetic Polynucleotide
taatacgactcactataggggtagcacccccctcaaagatgctgcggaagaacagaggagacttccgatgcatctttgaaacctggcggcagcgcaaaagatg

SEQ ID NO: 151933 - DNA, 103 bp, Artificial Sequence
  Synthetic Polynucleotide
taatacgactcactatagggcggcgagtacagcttgaatgactttgaggaaacagaggagatcctcaatgtcattcaagaacctggcggcagcgcaaaagatg

SEQ ID NO: 151934 - DNA, 103 bp, Artificial Sequence
  Synthetic Polynucleotide
taatacgactcactataggggtacagctccgtagcacccccctcaaagataacagaggagaatctttatggggggtgctaacctggcggcagcgcaaaagatg

SEQ ID NO: 151935 - DNA, 103 bp, Artificial Sequence
  Synthetic Polynucleotide
taatacgactcactatagggtaagaacatagtacagctccgtagcaccccaacagaggagaggggtgatgcggagctgtaacctggcggcagcgcaaaagatg

SEQ ID NO: 151936 - DNA, 103 bp, Artificial Sequence
  Synthetic Polynucleotide
taatacgactcactatagggttggggtgcttaagaacatagtacagctccaacagaggagaggagctatgctatgttctaacctggcggcagcgcaaaagatg

SEQ ID NO: 151937 - DNA, 103 bp, Artificial Sequence
  Synthetic Polynucleotide
taatacgactcactataggggaatgcctccttggggtgcttaagaacataaacagaggagatatgttatgaagcaccccaacctggcggcagcgcaaaagatg

SEQ ID NO: 151938 - DNA, 103 bp, Artificial Sequence
  Synthetic Polynucleotide
taatacgactcactatagggagttgctgtggaatgcctccttggggtgctaacagaggagaagcaccatgaggaggcataacctggcggcagcgcaaaagatg

SEQ ID NO: 151939 - DNA, 103 bp, Artificial Sequence
  Synthetic Polynucleotide
taatacgactcactatagggagggacacaaagttgctgtggaatgcctccaacagaggagaggaggcatgccacagcaaaacctggcggcagcgcaaaagatg

SEQ ID NO: 151940 - DNA, 103 bp, Artificial Sequence
  Synthetic Polynucleotide
taatacgactcactataggggtcacagtcgagggacacaaagttgctgtgaacagaggagacacagcatgtttgtgtccaacctggcggcagcgcaaaagatg

SEQ ID NO: 151941 - DNA, 103 bp, Artificial Sequence
  Synthetic Polynucleotide
taatacgactcactatagggtgctgccctggtcacagtcgagggacacaaaacagaggagattgtgtatgtcgactgtgaacctggcggcagcgcaaaagatg

SEQ ID NO: 151942 - DNA, 103 bp, Artificial Sequence
  Synthetic Polynucleotide
taatacgactcactatagggtgggtcaccatgctgccctggtcacagtcgaacagaggagacgactgatgccagggcagaacctggcggcagcgcaaaagatg

SEQ ID NO: 151943 - DNA, 103 bp, Artificial Sequence
  Synthetic Polynucleotide
taatacgactcactatagggcttgccatgctgggtcaccatgctgccctgaacagaggagacagggcatgatggtgaccaacctggcggcagcgcaaaagatg

SEQ ID NO: 151944 - DNA, 103 bp, Artificial Sequence
  Synthetic Polynucleotide
taatacgactcactatagggggggctccttcggcgagtacagcttgaatgaacagaggagacattcaatgtgtactcgcaacctggcggcagcgcaaaagatg

SEQ ID NO: 151945 - DNA, 103 bp, Artificial Sequence
  Synthetic Polynucleotide
taatacgactcactatagggtgaacatgggcttgccatgctgggtcaccaaacagaggagatggtgaatgagcatggcaaacctggcggcagcgcaaaagatg

SEQ ID NO: 151946 - DNA, 103 bp, Artificial Sequence
  Synthetic Polynucleotide
taatacgactcactatagggcacacctgggtgaacatgggcttgccatgcaacagaggagagcatggatggcccatgttaacctggcggcagcgcaaaagatg

SEQ ID NO: 151947 - DNA, 103 bp, Artificial Sequence
  Synthetic Polynucleotide
taatacgactcactataggggccctccacacacacctgggtgaacatgggaacagaggagacccatgatgacccaggtgaacctggcggcagcgcaaaagatg

SEQ ID NO: 151948 - DNA, 103 bp, Artificial Sequence
  Synthetic Polynucleotide
taatacgactcactatagggggtacaaccggccctccacacacacctgggaacagaggagacccaggatggtgtggaggaacctggcggcagcgcaaaagatg

SEQ ID NO: 151949 - DNA, 103 bp, Artificial Sequence
  Synthetic Polynucleotide
taatacgactcactatagggatgaactccaggtacaaccggccctccacaaacagaggagatgtggaatgccggttgtaaacctggcggcagcgcaaaagatg

SEQ ID NO: 151950 - DNA, 103 bp, Artificial Sequence
  Synthetic Polynucleotide
taatacgactcactataggggtcgtcaaacatgaactccaggtacaaccgaacagaggagacggttgatgctggagttcaacctggcggcagcgcaaaagatg

SEQ ID NO: 151951 - DNA, 103 bp, Artificial Sequence
  Synthetic Polynucleotide
taatacgactcactatagggtccgcatcatgtcgtcaaacatgaactccaaacagaggagatggagtatgtgtttgacgaacctggcggcagcgcaaaagatg

SEQ ID NO: 151952 - DNA, 103 bp, Artificial Sequence
  Synthetic Polynucleotide
taatacgactcactatagggcacgtctttatccgcatcatgtcgtcaaacaacagaggagagtttgaatgcatgatgcgaacctggcggcagcgcaaaagatg

SEQ ID NO: 151953 - DNA, 103 bp, Artificial Sequence
  Synthetic Polynucleotide
taatacgactcactataggggctgaagtgccacgtctttatccgcatcataacagaggagaatgatgatgataaagacgaacctggcggcagcgcaaaagatg

SEQ ID NO: 151954 - DNA, 103 bp, Artificial Sequence
  Synthetic Polynucleotide
taatacgactcactataggggctgccggatgctgaagtgccacgtctttaaacagaggagataaagaatgggcacttcaaacctggcggcagcgcaaaagatg

SEQ ID NO: 151955 - DNA, 103 bp, Artificial Sequence
  Synthetic Polynucleotide
taatacgactcactatagggttgccgttcgggggctccttcggcgagtacaacagaggagagtactcatggaaggagccaacctggcggcagcgcaaaagatg

SEQ ID NO: 151956 - DNA, 103 bp, Artificial Sequence
  Synthetic Polynucleotide
taatacgactcactatagggagctctcggtgctgccggatgctgaagtgcaacagaggagagcacttatgcatccggcaaacctggcggcagcgcaaaagatg

SEQ ID NO: 151957 - DNA, 103 bp, Artificial Sequence
  Synthetic Polynucleotide
taatacgactcactataggggcgggggatgagctctcggtgctgccggataacagaggagaatccggatgcaccgagagaacctggcggcagcgcaaaagatg

SEQ ID NO: 151958 - DNA, 103 bp, Artificial Sequence
  Synthetic Polynucleotide
taatacgactcactatagggcaaggatgctgcgggggatgagctctcggtaacagaggagaaccgagatgtcatcccccaacctggcggcagcgcaaaagatg

SEQ ID NO: 151959 - DNA, 103 bp, Artificial Sequence
  Synthetic Polynucleotide
taatacgactcactataggggcatgcatggcaaggatgctgcgggggatgaacagaggagacatcccatgcagcatcctaacctggcggcagcgcaaaagatg

SEQ ID NO: 151960 - DNA, 103 bp, Artificial Sequence
  Synthetic Polynucleotide
taatacgactcactatagggggggtcttgggcatgcatggcaaggatgctaacagaggagaagcatcatggccatgcataacctggcggcagcgcaaaagatg

SEQ ID NO: 151961 - DNA, 103 bp, Artificial Sequence
  Synthetic Polynucleotide
taatacgactcactatagggccaacatctgggggtcttgggcatgcatggaacagaggagaccatgcatgcccaagaccaacctggcggcagcgcaaaagatg

SEQ ID NO: 151962 - DNA, 103 bp, Artificial Sequence
  Synthetic Polynucleotide
taatacgactcactataggggagagctgatccaacatctgggggtcttggaacagaggagaccaagaatgccagatgttaacctggcggcagcgcaaaagatg

SEQ ID NO: 151963 - DNA, 103 bp, Artificial Sequence
  Synthetic Polynucleotide
taatacgactcactataggggatgtttttggagagctgatccaacatctgaacagaggagacagatgatggatcagctcaacctggcggcagcgcaaaagatg

SEQ ID NO: 151964 - DNA, 103 bp, Artificial Sequence
  Synthetic Polynucleotide
taatacgactcactatagggcacaccgagtgatgtttttggagagctgataacagaggagaatcagcatgccaaaaacaaacctggcggcagcgcaaaagatg

SEQ ID NO: 151965 - DNA, 103 bp, Artificial Sequence
  Synthetic Polynucleotide
taatacgactcactatagggttggacagcccacaccgagtgatgtttttgaacagaggagacaaaaaatgcactcggtgaacctggcggcagcgcaaaagatg

SEQ ID NO: 151966 - DNA, 103 bp, Artificial Sequence
  Synthetic Polynucleotide
taatacgactcactataggggggaaaggcgttgccgttcgggggctccttaacagaggagaaaggagatgccgaacggcaacctggcggcagcgcaaaagatg

SEQ ID NO: 151967 - DNA, 103 bp, Artificial Sequence
  Synthetic Polynucleotide
taatacgactcactataggggagagtggaattggacagcccacaccgagtaacagaggagaactcggatggggctgtccaacctggcggcagcgcaaaagatg

SEQ ID NO: 151968 - DNA, 103 bp, Artificial Sequence
  Synthetic Polynucleotide
taatacgactcactatagggggaggtagttgagagtggaattggacagccaacagaggagaggctgtatgattccactcaacctggcggcagcgcaaaagatg

SEQ ID NO: 151969 - DNA, 103 bp, Artificial Sequence
  Synthetic Polynucleotide
taatacgactcactatagggacacagagtcggaggtagttgagagtggaaaacagaggagattccacatgcaactacctaacctggcggcagcgcaaaagatg

SEQ ID NO: 151970 - DNA, 103 bp, Artificial Sequence
  Synthetic Polynucleotide
taatacgactcactatagggctcgagtatcacacagagtcggaggtagttaacagaggagaaactacatgcgactctgtaacctggcggcagcgcaaaagatg

SEQ ID NO: 151971 - DNA, 103 bp, Artificial Sequence
  Synthetic Polynucleotide
taatacgactcactatagggcttgcatgggctcgagtatcacacagagtcaacagaggagagactctatgtgatactcgaacctggcggcagcgcaaaagatg

SEQ ID NO: 151972 - DNA, 103 bp, Artificial Sequence
  Synthetic Polynucleotide
taatacgactcactataggggacatgagctcttgcatgggctcgagtatcaacagaggagagatactatggcccatgcaaacctggcggcagcgcaaaagatg

SEQ ID NO: 151973 - DNA, 103 bp, Artificial Sequence
  Synthetic Polynucleotide
taatacgactcactatagggcttgtggcgtgacatgagctcttgcatgggaacagaggagacccatgatggagctcatgaacctggcggcagcgcaaaagatg

SEQ ID NO: 151974 - DNA, 103 bp, Artificial Sequence
  Synthetic Polynucleotide
taatacgactcactatagggggctgtaggtcttgtggcgtgacatgagctaacagaggagaagctcaatgcacgccacaaacctggcggcagcgcaaaagatg

SEQ ID NO: 151975 - DNA, 103 bp, Artificial Sequence
  Synthetic Polynucleotide
taatacgactcactatagggcgggggctgaggctgtaggtcttgtggcgtaacagaggagaacgccaatggacctacagaacctggcggcagcgcaaaagatg

SEQ ID NO: 151976 - DNA, 103 bp, Artificial Sequence
  Synthetic Polynucleotide
taatacgactcactataggggaggcagtcgcgggggctgaggctgtaggtaacagaggagaacctacatgctcagccccaacctggcggcagcgcaaaagatg

SEQ ID NO: 151977 - DNA, 103 bp, Artificial Sequence
  Synthetic Polynucleotide
taatacgactcactataggggatggaaggggggaaaggcgttgccgttcgaacagaggagacgaacgatgacgcctttcaacctggcggcagcgcaaaagatg

SEQ ID NO: 151978 - DNA, 103 bp, Artificial Sequence
  Synthetic Polynucleotide
taatacgactcactatagggggcaggtcttgaggcagtcgcgggggctgaaacagaggagatcagccatggcgactgccaacctggcggcagcgcaaaagatg

SEQ ID NO: 151979 - DNA, 103 bp, Artificial Sequence
  Synthetic Polynucleotide
taatacgactcactatagggttctggaaaaggcaggtcttgaggcagtcgaacagaggagacgactgatgcaagacctgaacctggcggcagcgcaaaagatg

SEQ ID NO: 151980 - DNA, 103 bp, Artificial Sequence
  Synthetic Polynucleotide
taatacgactcactataggggcgctgccacttctggaaaaggcaggtcttaacagaggagaaagaccatgcttttccagaacctggcggcagcgcaaaagatg

SEQ ID NO: 151981 - DNA, 103 bp, Artificial Sequence
  Synthetic Polynucleotide
taatacgactcactataggggtgctaccatgcgctgccacttctggaaaaaacagaggagattttccatgagtggcagcaacctggcggcagcgcaaaagatg

SEQ ID NO: 151982 - DNA, 103 bp, Artificial Sequence
  Synthetic Polynucleotide
taatacgactcactatagggtccgcagggggtgctaccatgcgctgccacaacagaggagagtggcaatgcatggtagcaacctggcggcagcgcaaaagatg

SEQ ID NO: 151983 - DNA, 103 bp, Artificial Sequence
  Synthetic Polynucleotide
taatacgactcactatagggacgtgtgggctccgcagggggtgctaccataacagaggagaatggtaatgccccctgcgaacctggcggcagcgcaaaagatg

SEQ ID NO: 151984 - DNA, 103 bp, Artificial Sequence
  Synthetic Polynucleotide
taatacgactcactatagggtgggctgctgacgtgtgggctccgcaggggaacagaggagacccctgatgagcccacacaacctggcggcagcgcaaaagatg

SEQ ID NO: 151985 - DNA, 103 bp, Artificial Sequence
  Synthetic Polynucleotide
taatacgactcactatagggcgccgtttgctgggctgctgacgtgtgggcaacagaggagagcccacatgtcagcagccaacctggcggcagcgcaaaagatg

SEQ ID NO: 151986 - DNA, 103 bp, Artificial Sequence
  Synthetic Polynucleotide
taatacgactcactatagggcttccgtttccgccgtttgctgggctgctgaacagaggagacagcagatgagcaaacggaacctggcggcagcgcaaaagatg

SEQ ID NO: 151987 - DNA, 103 bp, Artificial Sequence
  Synthetic Polynucleotide
taatacgactcactatagggcccctgacatcttccgtttccgccgtttgcaacagaggagagcaaacatgggaaacggaaacctggcggcagcgcaaaagatg

SEQ ID NO: 151988 - DNA, 103 bp, Artificial Sequence
  Synthetic Polynucleotide
taatacgactcactatagggatggtgccgggatggaaggggggaaaggcgaacagaggagacgccttatgccccttccaaacctggcggcagcgcaaaagatg

SEQ ID NO: 151989 - DNA, 103 bp, Artificial Sequence
  Synthetic Polynucleotide
taatacgactcactatagggatggtgctgccccctgacatcttccgtttcaacagaggagagaaacgatggatgtcaggaacctggcggcagcgcaaaagatg

SEQ ID NO: 151990 - DNA, 103 bp, Artificial Sequence
  Synthetic Polynucleotide
taatacgactcactatagggaccagagctcatggtgctgccccctgacataacagaggagaatgtcaatgggcagcaccaacctggcggcagcgcaaaagatg

SEQ ID NO: 151991 - DNA, 103 bp, Artificial Sequence
  Synthetic Polynucleotide
taatacgactcactatagggtgttgccaccaccagagctcatggtgctgcaacagaggagagcagcaatgtgagctctgaacctggcggcagcgcaaaagatg

SEQ ID NO: 151992 - DNA, 103 bp, Artificial Sequence
  Synthetic Polynucleotide
taatacgactcactatagggctgttgttggtgttgccaccaccagagctcaacagaggagagagctcatgtggtggcaaaacctggcggcagcgcaaaagatg

SEQ ID NO: 151993 - DNA, 103 bp, Artificial Sequence
  Synthetic Polynucleotide
taatacgactcactatagggcttgctgttgctgttgttggtgttgccaccaacagaggagaggtggcatgaccaacaacaacctggcggcagcgcaaaagatg

SEQ ID NO: 151994 - DNA, 103 bp, Artificial Sequence
  Synthetic Polynucleotide
taatacgactcactatagggggctcttcttcttgctgttgctgttgttggaacagaggagaccaacaatggcaacagcaaacctggcggcagcgcaaaagatg

SEQ ID NO: 151995 - DNA, 103 bp, Artificial Sequence
  Synthetic Polynucleotide
taatacgactcactataggggtgctagctgggctcttcttcttgctgttgaacagaggagacaacagatggaagaagagaacctggcggcagcgcaaaagatg

SEQ ID NO: 151996 - DNA, 103 bp, Artificial Sequence
  Synthetic Polynucleotide
taatacgactcactataggggagggcgaaggtgctagctgggctcttcttaacagaggagaaagaagatgccagctagcaacctggcggcagcgcaaaagatg

SEQ ID NO: 151997 - DNA, 103 bp, Artificial Sequence
  Synthetic Polynucleotide
taatacgactcactatagggcctggctggagagggcgaaggtgctagctgaacagaggagacagctaatgccttcgcccaacctggcggcagcgcaaaagatg

SEQ ID NO: 151998 - DNA, 103 bp, Artificial Sequence
  Synthetic Polynucleotide
taatacgactcactatagggacatcaggtacctggctggagagggcgaagaacagaggagacttcgcatgctccagccaaacctggcggcagcgcaaaagatg

SEQ ID NO: 151999 - DNA, 103 bp, Artificial Sequence
  Synthetic Polynucleotide
taatacgactcactataggggccgccacctcctccggagagttggggcataacagaggagaatgcccatgctctccggaaacctggcggcagcgcaaaagatg

SEQ ID NO: 152000 - DNA, 103 bp, Artificial Sequence
  Synthetic Polynucleotide
taatacgactcactatagggctcggcgaagatcttttccttctgaggatcaacagaggagagatcctatgaaggaaaagaacctggcggcagcgcaaaagatg

SEQ ID NO: 152001 - DNA, 103 bp, Artificial Sequence
  Synthetic Polynucleotide
taatacgactcactataggggagggcatgccaccttctgccaagaatctgaacagaggagacagattatgggcagaaggaacctggcggcagcgcaaaagatg

SEQ ID NO: 152002 - DNA, 103 bp, Artificial Sequence
  Synthetic Polynucleotide
taatacgactcactatagggcttcacgggagagggcatgccaccttctgcaacagaggagagcagaaatgggcatgcccaacctggcggcagcgcaaaagatg

SEQ ID NO: 152003 - DNA, 103 bp, Artificial Sequence
  Synthetic Polynucleotide
taatacgactcactatagggttagcctgctcttcacgggagagggcatgcaacagaggagagcatgcatgctcccgtgaaacctggcggcagcgcaaaagatg

SEQ ID NO: 152004 - DNA, 103 bp, Artificial Sequence
  Synthetic Polynucleotide
taatacgactcactatagggttcataatatttagcctgctcttcacgggaaacagaggagatcccgtatggagcaggctaacctggcggcagcgcaaaagatg

SEQ ID NO: 152005 - DNA, 103 bp, Artificial Sequence
  Synthetic Polynucleotide
taatacgactcactatagggtccgtgctaattcataatatttagcctgctaacagaggagaagcaggatgaatattatgaacctggcggcagcgcaaaagatg

SEQ ID NO: 152006 - DNA, 103 bp, Artificial Sequence
  Synthetic Polynucleotide
taatacgactcactatagggtgtctttctttccgtgctaattcataatataacagaggagaatattaatgattagcacgaacctggcggcagcgcaaaagatg

SEQ ID NO: 152007 - DNA, 103 bp, Artificial Sequence
  Synthetic Polynucleotide
taatacgactcactatagggcatatgtagctgtctttctttccgtgctaaaacagaggagattagcaatgaaagaaagaaacctggcggcagcgcaaaagatg

SEQ ID NO: 152008 - DNA, 103 bp, Artificial Sequence
  Synthetic Polynucleotide
taatacgactcactataggggataaagctgcatatgtagctgtctttcttaacagaggagaaagaaaatgagctacataaacctggcggcagcgcaaaagatg

SEQ ID NO: 152009 - DNA, 103 bp, Artificial Sequence
  Synthetic Polynucleotide
taatacgactcactataggggaccagcctggataaagctgcatatgtagcaacagaggagagctacaatggcagctttaaacctggcggcagcgcaaaagatg

SEQ ID NO: 152010 - DNA, 103 bp, Artificial Sequence
  Synthetic Polynucleotide
taatacgactcactataggggtctcttgcagaccagcctggataaagctgaacagaggagacagcttatgccaggctggaacctggcggcagcgcaaaagatg

SEQ ID NO: 152011 - DNA, 103 bp, Artificial Sequence
  Synthetic Polynucleotide
taatacgactcactataggggatgactgatctcggcgaagatcttttcctaacagaggagaaggaaaatgtcttcgccgaacctggcggcagcgcaaaagatg

SEQ ID NO: 152012 - DNA, 103 bp, Artificial Sequence
  Synthetic Polynucleotide
taatacgactcactatagggtaccataattgtctcttgcagaccagcctgaacagaggagacaggctatgctgcaagagaacctggcggcagcgcaaaagatg

SEQ ID NO: 152013 - DNA, 103 bp, Artificial Sequence
  Synthetic Polynucleotide
taatacgactcactatagggttctttttcttaccataattgtctcttgcaaacagaggagatgcaagatgcaattatggaacctggcggcagcgcaaaagatg

SEQ ID NO: 152014 - DNA, 103 bp, Artificial Sequence
  Synthetic Polynucleotide
taatacgactcactatagggtctcttcctcttctttttcttaccataattaacagaggagaaattatatgaagaaaaagaacctggcggcagcgcaaaagatg

SEQ ID NO: 152015 - DNA, 103 bp, Artificial Sequence
  Synthetic Polynucleotide
taatacgactcactataggggtagtttctctctcttcctcttctttttctaacagaggagaagaaaaatgagaggaagaaacctggcggcagcgcaaaagatg

SEQ ID NO: 152016 - DNA, 103 bp, Artificial Sequence
  Synthetic Polynucleotide
taatacgactcactataggggcagattcctgtagtttctctctcttcctcaacagaggagagaggaaatgagagaaactaacctggcggcagcgcaaaagatg

SEQ ID NO: 152017 - DNA, 103 bp, Artificial Sequence
  Synthetic Polynucleotide
taatacgactcactatagggtgtacctgatgcagattcctgtagtttctcaacagaggagagagaaaatgcaggaatctaacctggcggcagcgcaaaagatg

SEQ ID NO: 152018 - DNA, 103 bp, Artificial Sequence
  Synthetic Polynucleotide
taatacgactcactatagggttcttggacctgtacctgatgcagattcctaacagaggagaaggaatatgcatcaggtaaacctggcggcagcgcaaaagatg

SEQ ID NO: 152019 - DNA, 103 bp, Artificial Sequence
  Synthetic Polynucleotide
taatacgactcactataggggcagctgtcattcttggacctgtacctgataacagaggagaatcaggatgaggtccaagaacctggcggcagcgcaaaagatg

SEQ ID NO: 152020 - DNA, 103 bp, Artificial Sequence
  Synthetic Polynucleotide
taatacgactcactatagggtcagatgtaggcagctgtcattcttggaccaacagaggagaggtccaatgatgacagctaacctggcggcagcgcaaaagatg

SEQ ID NO: 152021 - DNA, 103 bp, Artificial Sequence
  Synthetic Polynucleotide
taatacgactcactatagggtcctcttcgggatgactgatctcggcgaagaacagaggagacttcgcatggatcagtcaaacctggcggcagcgcaaaagatg

SEQ ID NO: 152022 - DNA, 103 bp, Artificial Sequence
  Synthetic Polynucleotide
taatacgactcactatagggtaaatcgccttcctcttcgggatgactgataacagaggagaatcagtatgcccgaagagaacctggcggcagcgcaaaagatg

SEQ ID NO: 152023 - DNA, 103 bp, Artificial Sequence
  Synthetic Polynucleotide
taatacgactcactatagggtgatgtcagctaaatcgccttcctcttcggaacagaggagaccgaagatgaaggcgattaacctggcggcagcgcaaaagatg

SEQ ID NO: 152024 - DNA, 103 bp, Artificial Sequence
  Synthetic Polynucleotide
taatacgactcactatagggaaggaagacttgatgtcagctaaatcgcctaacagaggagaaggcgaatgagctgacataacctggcggcagcgcaaaagatg

SEQ ID NO: 152025 - DNA, 103 bp, Artificial Sequence
  Synthetic Polynucleotide
taatacgactcactatagggctcgttcaccaaggaagacttgatgtcagcaacagaggagagctgacatgaagtcttccaacctggcggcagcgcaaaagatg

SEQ ID NO: 152026 - DNA, 103 bp, Artificial Sequence
  Synthetic Polynucleotide
taatacgactcactatagggtgatttcagactcgttcaccaaggaagactaacagaggagaagtcttatgtggtgaacgaacctggcggcagcgcaaaagatg

SEQ ID NO: 152027 - DNA, 103 bp, Artificial Sequence
  Synthetic Polynucleotide
taatacgactcactatagggctggccgggatgatttcagactcgttcaccaacagaggagaggtgaaatggtctgaaataacctggcggcagcgcaaaagatg

SEQ ID NO: 152028 - DNA, 103 bp, Artificial Sequence
  Synthetic Polynucleotide
taatacgactcactataggggtgtccgttgctggccgggatgatttcagaaacagaggagatctgaaatgatcccggccaacctggcggcagcgcaaaagatg

SEQ ID NO: 152029 - DNA, 103 bp, Artificial Sequence
  Synthetic Polynucleotide
taatacgactcactatagggcccccccgccgccgccacctcctccggagaaacagaggagatctccgatggaggtggcgaacctggcggcagcgcaaaagatg

SEQ ID NO: 152030 - DNA, 103 bp, Artificial Sequence
  Synthetic Polynucleotide
taatacgactcactatagggtggccacctcgtgtccgttgctggccgggaaacagaggagatcccggatggcaacggacaacctggcggcagcgcaaaagatg

SEQ ID NO: 152031 - DNA, 103 bp, Artificial Sequence
  Synthetic Polynucleotide
taatacgactcactatagggtgtgcttgtctggccacctcgtgtccgttgaacagaggagacaacggatgcgaggtggcaacctggcggcagcgcaaaagatg

SEQ ID NO: 152032 - DNA, 103 bp, Artificial Sequence
  Synthetic Polynucleotide
taatacgactcactatagggctgagaggtttgtgcttgtctggccacctcaacagaggagagaggtgatgagacaagcaaacctggcggcagcgcaaaagatg

SEQ ID NO: 152033 - DNA, 103 bp, Artificial Sequence
  Synthetic Polynucleotide
taatacgactcactatagggggtagggctcctgagaggtttgtgcttgtcaacagaggagagacaagatgaaacctctcaacctggcggcagcgcaaaagatg

SEQ ID NO: 152034 - DNA, 103 bp, Artificial Sequence
  Synthetic Polynucleotide
taatacgactcactataggggccttgtcgtggtagggctcctgagaggttaacagaggagaaacctcatgggagccctaaacctggcggcagcgcaaaagatg

SEQ ID NO: 152035 - DNA, 103 bp, Artificial Sequence
  Synthetic Polynucleotide
taatacgactcactataggggtgttctctggccttgtcgtggtagggctcaacagaggagagagcccatgcacgacaagaacctggcggcagcgcaaaagatg

SEQ ID NO: 152036 - DNA, 103 bp, Artificial Sequence
  Synthetic Polynucleotide
taatacgactcactatagggcgtcatcggggtgttctctggccttgtcgtaacagaggagaacgacaatgccagagaacaacctggcggcagcgcaaaagatg

SEQ ID NO: 152037 - DNA, 103 bp, Artificial Sequence
  Synthetic Polynucleotide
taatacgactcactatagggggatgctttccgtcatcggggtgttctctgaacagaggagacagagaatgccccgatgaaacctggcggcagcgcaaaagatg

SEQ ID NO: 152038 - DNA, 103 bp, Artificial Sequence
  Synthetic Polynucleotide
taatacgactcactataggggcctccatctggatgctttccgtcatcgggaacagaggagacccgatatgggaaagcataacctggcggcagcgcaaaagatg

SEQ ID NO: 152039 - DNA, 103 bp, Artificial Sequence
  Synthetic Polynucleotide
taatacgactcactatagggtgttgtagaggcctccatctggatgctttcaacagaggagagaaagcatgcagatggagaacctggcggcagcgcaaaagatg

SEQ ID NO: 152040 - DNA, 103 bp, Artificial Sequence
  Synthetic Polynucleotide
taatacgactcactatagggagttccgggtcccccccgccgccgccacctaacagaggagaaggtggatgcggcgggggaacctggcggcagcgcaaaagatg

SEQ ID NO: 152041 - DNA, 103 bp, Artificial Sequence
  Synthetic Polynucleotide
taatacgactcactataggggagggtcccttgttgtagaggcctccatctaacagaggagaagatggatgcctctacaaaacctggcggcagcgcaaaagatg

SEQ ID NO: 152042 - DNA, 103 bp, Artificial Sequence
  Synthetic Polynucleotide
taatacgactcactatagggactcgagtaggagggtcccttgttgtagagaacagaggagactctacatgaagggacccaacctggcggcagcgcaaaagatg

SEQ ID NO: 152043 - DNA, 103 bp, Artificial Sequence
  Synthetic Polynucleotide
taatacgactcactatagggacccggaataactcgagtaggagggtccctaacagaggagaagggacatgcctactcgaaacctggcggcagcgcaaaagatg

SEQ ID NO: 152044 - DNA, 103 bp, Artificial Sequence
  Synthetic Polynucleotide
taatacgactcactatagggatcattatgtacccggaataactcgagtagaacagaggagactactcatgttattccggaacctggcggcagcgcaaaagatg

SEQ ID NO: 152045 - DNA, 103 bp, Artificial Sequence
  Synthetic Polynucleotide
taatacgactcactatagggcatatttggcatcattatgtacccggaataaacagaggagatattccatgtacataatgaacctggcggcagcgcaaaagatg

SEQ ID NO: 152046 - DNA, 103 bp, Artificial Sequence
  Synthetic Polynucleotide
taatacgactcactatagggggtcgttattcatatttggcatcattatgtaacagaggagaacataaatgtgccaaataaacctggcggcagcgcaaaagatg

SEQ ID NO: 152047 - DNA, 103 bp, Artificial Sequence
  Synthetic Polynucleotide
taatacgactcactataggggacatgtatgggtcgttattcatatttggcaacagaggagagccaaaatggaataacgaaacctggcggcagcgcaaaagatg

SEQ ID NO: 152048 - DNA, 103 bp, Artificial Sequence
  Synthetic Polynucleotide
taatacgactcactatagggagatccatttgacatgtatgggtcgttattaacagaggagaaataacatgccatacatgaacctggcggcagcgcaaaagatg

SEQ ID NO: 152049 - DNA, 103 bp, Artificial Sequence
  Synthetic Polynucleotide
taatacgactcactataggggtggagaaagagatccatttgacatgtatgaacagaggagacatacaatgcaaatggataacctggcggcagcgcaaaagatg

SEQ ID NO: 152050 - DNA, 103 bp, Artificial Sequence
  Synthetic Polynucleotide
taatacgactcactatagggctcgggatgggtggagaaagagatccatttaacagaggagaaaatggatgtctttctccaacctggcggcagcgcaaaagatg

SEQ ID NO: 152051 - DNA, 103 bp, Artificial Sequence
  Synthetic Polynucleotide
taatacgactcactatagggcgtggcgcagagttccgggtcccccccgccaacagaggagaggcgggatggacccggaaaacctggcggcagcgcaaaagatg

SEQ ID NO: 152052 - DNA, 103 bp, Artificial Sequence
  Synthetic Polynucleotide
taatacgactcactatagggatttgatgttctcgggatgggtggagaaagaacagaggagactttctatgcccatcccgaacctggcggcagcgcaaaagatg

SEQ ID NO: 152053 - DNA, 103 bp, Artificial Sequence
  Synthetic Polynucleotide
taatacgactcactatagggcgggcactttatttgatgttctcgggatggaacagaggagaccatccatggaacatcaaaacctggcggcagcgcaaaagatg

SEQ ID NO: 152054 - DNA, 103 bp, Artificial Sequence
  Synthetic Polynucleotide
taatacgactcactatagggggctgcaccacgggcactttatttgatgttaacagaggagaaacatcatgtaaagtgccaacctggcggcagcgcaaaagatg

SEQ ID NO: 152055 - DNA, 103 bp, Artificial Sequence
  Synthetic Polynucleotide
taatacgactcactatagggcgcatgggatggctgcaccacgggcactttaacagaggagaaaagtgatggtggtgcagaacctggcggcagcgcaaaagatg

SEQ ID NO: 152056 - DNA, 103 bp, Artificial Sequence
  Synthetic Polynucleotide
taatacgactcactataggggaggatggaccgcatgggatggctgcaccaaacagaggagatggtgcatgcatcccatgaacctggcggcagcgcaaaagatg

SEQ ID NO: 152057 - DNA, 103 bp, Artificial Sequence
  Synthetic Polynucleotide
taatacgactcactatagggaggggggtgagaggatggaccgcatgggataacagaggagaatcccaatgggtccatccaacctggcggcagcgcaaaagatg

SEQ ID NO: 152058 - DNA, 103 bp, Artificial Sequence
  Synthetic Polynucleotide
taatacgactcactataggggtaagtgatgaggggggtgagaggatggacaacagaggagagtccatatgctcacccccaacctggcggcagcgcaaaagatg

SEQ ID NO: 152059 - DNA, 103 bp, Artificial Sequence
  Synthetic Polynucleotide
taatacgactcactataggggctcgtcactgtaagtgatgaggggggtgaaacagaggagatcacccatgtcatcacttaacctggcggcagcgcaaaagatg

SEQ ID NO: 152060 - DNA, 103 bp, Artificial Sequence
  Synthetic Polynucleotide
taatacgactcactatagggggagaaaagtgctcgtcactgtaagtgatgaacagaggagacatcacatgcagtgacgaaacctggcggcagcgcaaaagatg

SEQ ID NO: 152061 - DNA, 103 bp, Artificial Sequence
  Synthetic Polynucleotide
taatacgactcactataggggtgtgatcctggagaaaagtgctcgtcactaacagaggagaagtgacatgcacttttctaacctggcggcagcgcaaaagatg

SEQ ID NO: 152062 - DNA, 103 bp, Artificial Sequence
  Synthetic Polynucleotide
taatacgactcactatagggtcatctcgtccgtggcgcagagttccgggtaacagaggagaacccggatgtctgcgccaaacctggcggcagcgcaaaagatg

SEQ ID NO: 152063 - DNA, 103 bp, Artificial Sequence
  Synthetic Polynucleotide
taatacgactcactatagggtgtgtgacgggtgtgatcctggagaaaagtaacagaggagaacttttatgcaggatcacaacctggcggcagcgcaaaagatg

SEQ ID NO: 152064 - DNA, 103 bp, Artificial Sequence
  Synthetic Polynucleotide
taatacgactcactatagggtctgatgggatgtgtgacgggtgtgatcctaacagaggagaaggatcatgcccgtcacaaacctggcggcagcgcaaaagatg

SEQ ID NO: 152065 - DNA, 103 bp, Artificial Sequence
  Synthetic Polynucleotide
taatacgactcactatagggggagttgacatctgatgggatgtgtgacggaacagaggagaccgtcaatgatcccatcaaacctggcggcagcgcaaaagatg

SEQ ID NO: 152066 - DNA, 103 bp, Artificial Sequence
  Synthetic Polynucleotide
taatacgactcactatagggtgccttgtttggagttgacatctgatgggaaacagaggagatcccatatgatgtcaactaacctggcggcagcgcaaaagatg

SEQ ID NO: 152067 - DNA, 103 bp, Artificial Sequence
  Synthetic Polynucleotide
taatacgactcactatagggtgtctggacatgccttgtttggagttgacaaacagaggagatgtcaaatgcaaacaaggaacctggcggcagcgcaaaagatg

SEQ ID NO: 152068 - DNA, 103 bp, Artificial Sequence
  Synthetic Polynucleotide
taatacgactcactatagggagctggaggatgtctggacatgccttgtttaacagaggagaaaacaaatgatgtccagaaacctggcggcagcgcaaaagatg

SEQ ID NO: 152069 - DNA, 103 bp, Artificial Sequence
  Synthetic Polynucleotide
taatacgactcactatagggggatatcaggagctggaggatgtctggacaaacagaggagatgtccaatgatcctccagaacctggcggcagcgcaaaagatg

SEQ ID NO: 152070 - DNA, 103 bp, Artificial Sequence
  Synthetic Polynucleotide
taatacgactcactatagggtaaaaagtagggatatcaggagctggaggaaacagaggagatcctccatgtcctgatataacctggcggcagcgcaaaagatg

SEQ ID NO: 152071 - DNA, 103 bp, Artificial Sequence
  Synthetic Polynucleotide
taatacgactcactatagggagacaagggataaaaagtagggatatcaggaacagaggagacctgatatgcctacttttaacctggcggcagcgcaaaagatg

SEQ ID NO: 152072 - DNA, 103 bp, Artificial Sequence
  Synthetic Polynucleotide
taatacgactcactatagggcaccacccggagacaagggataaaaagtagaacagaggagactacttatgatcccttgtaacctggcggcagcgcaaaagatg

SEQ ID NO: 152073 - DNA, 103 bp, Artificial Sequence
  Synthetic Polynucleotide
taatacgactcactatagggttgaaggggatcatctcgtccgtggcgcagaacagaggagactgcgcatgggacgagataacctggcggcagcgcaaaagatg

SEQ ID NO: 152074 - DNA, 103 bp, Artificial Sequence
  Synthetic Polynucleotide
taatacgactcactatagggatctgtccaacaccacccggagacaagggaaacagaggagatcccttatgtccgggtggaacctggcggcagcgcaaaagatg

SEQ ID NO: 152075 - DNA, 103 bp, Artificial Sequence
  Synthetic Polynucleotide
taatacgactcactatagggaggtggggtgatctgtccaacaccacccggaacagaggagaccgggtatggttggacagaacctggcggcagcgcaaaagatg

SEQ ID NO: 152076 - DNA, 103 bp, Artificial Sequence
  Synthetic Polynucleotide
taatacgactcactataggggccagccaagaggtggggtgatctgtccaaaacagaggagattggacatgtcaccccacaacctggcggcagcgcaaaagatg

SEQ ID NO: 152077 - DNA, 103 bp, Artificial Sequence
  Synthetic Polynucleotide
taatacgactcactatagggggctgaccttgccagccaagaggtggggtgaacagaggagacaccccatgtcttggctgaacctggcggcagcgcaaaagatg

SEQ ID NO: 152078 - DNA, 103 bp, Artificial Sequence
  Synthetic Polynucleotide
taatacgactcactataggggggatatacaggctgaccttgccagccaagaacagaggagacttggcatgcaaggtcagaacctggcggcagcgcaaaagatg

SEQ ID NO: 152079 - DNA, 103 bp, Artificial Sequence
  Synthetic Polynucleotide
taatacgactcactatagggcacccgtgatgggatatacaggctgaccttaacagaggagaaaggtcatgctgtatatcaacctggcggcagcgcaaaagatg

SEQ ID NO: 152080 - DNA, 103 bp, Artificial Sequence
  Synthetic Polynucleotide
taatacgactcactatagggtgcctgaatccacccgtgatgggatatacaaacagaggagatgtataatgcatcacgggaacctggcggcagcgcaaaagatg

SEQ ID NO: 152081 - DNA, 103 bp, Artificial Sequence
  Synthetic Polynucleotide
taatacgactcactatagggtgggtagggttgcctgaatccacccgtgataacagaggagaatcacgatgggattcaggaacctggcggcagcgcaaaagatg

SEQ ID NO: 152082 - DNA, 103 bp, Artificial Sequence
  Synthetic Polynucleotide
taatacgactcactatagggacagtgaggatgggtagggttgcctgaatcaacagaggagagattcaatgaaccctaccaacctggcggcagcgcaaaagatg

SEQ ID NO: 152083 - DNA, 103 bp, Artificial Sequence
  Synthetic Polynucleotide
taatacgactcactataggggtgtcgactgacagtgaggatgggtagggtaacagaggagaaccctaatgatcctcactaacctggcggcagcgcaaaagatg

SEQ ID NO: 152084 - DNA, 103 bp, Artificial Sequence
  Synthetic Polynucleotide
taatacgactcactataggggccctcgtccttgaaggggatcatctcgtcaacagaggagagacgagatgatccccttcaacctggcggcagcgcaaaagatg

SEQ ID NO: 152085 - DNA, 103 bp, Artificial Sequence
  Synthetic Polynucleotide
taatacgactcactatagggggacatggaagtgtcgactgacagtgaggaaacagaggagatcctcaatgtcagtcgacaacctggcggcagcgcaaaagatg

SEQ ID NO: 152086 - DNA, 103 bp, Artificial Sequence
  Synthetic Polynucleotide
taatacgactcactataggggggaaaacctggacatggaagtgtcgactgaacagaggagacagtcgatgcttccatgtaacctggcggcagcgcaaaagatg

SEQ ID NO: 152087 - DNA, 103 bp, Artificial Sequence
  Synthetic Polynucleotide
taatacgactcactatagggatcatatgatgggaaaacctggacatggaaaacagaggagattccatatgcaggttttcaacctggcggcagcgcaaaagatg

SEQ ID NO: 152088 - DNA, 103 bp, Artificial Sequence
  Synthetic Polynucleotide
taatacgactcactatagggaggaccgggaatcatatgatgggaaaacctaacagaggagaaggtttatgcatcatatgaacctggcggcagcgcaaaagatg

SEQ ID NO: 152089 - DNA, 103 bp, Artificial Sequence
  Synthetic Polynucleotide
taatacgactcactatagggggggaccaggaggaccgggaatcatatgataacagaggagaatcataatgttcccggtcaacctggcggcagcgcaaaagatg

SEQ ID NO: 152090 - DNA, 103 bp, Artificial Sequence
  Synthetic Polynucleotide
taatacgactcactatagggccagttgtgtggggaccaggaggaccgggaaacagaggagatcccggatgtcctggtccaacctggcggcagcgcaaaagatg

SEQ ID NO: 152091 - DNA, 103 bp, Artificial Sequence
  Synthetic Polynucleotide
taatacgactcactatagggatgagggatgccagttgtgtggggaccaggaacagaggagacctggtatgcacacaactaacctggcggcagcgcaaaagatg

SEQ ID NO: 152092 - DNA, 103 bp, Artificial Sequence
  Synthetic Polynucleotide
taatacgactcactatagggcaatagctggatgagggatgccagttgtgtaacagaggagaacacaaatggcatccctcaacctggcggcagcgcaaaagatg

SEQ ID NO: 152093 - DNA, 103 bp, Artificial Sequence
  Synthetic Polynucleotide
taatacgactcactatagggtgaggtgttacaatagctggatgagggatgaacagaggagacatcccatgtccagctataacctggcggcagcgcaaaagatg

SEQ ID NO: 152094 - DNA, 103 bp, Artificial Sequence
  Synthetic Polynucleotide
taatacgactcactatagggctgtttgacctgaggtgttacaatagctggaacagaggagaccagctatggtaacacctaacctggcggcagcgcaaaagatg

SEQ ID NO: 152095 - DNA, 103 bp, Artificial Sequence
  Synthetic Polynucleotide
taatacgactcactatagggtctgaggatcgccctcgtccttgaaggggaaacagaggagatcccctatgaggacgaggaacctggcggcagcgcaaaagatg

SEQ ID NO: 152096 - DNA, 103 bp, Artificial Sequence
  Synthetic Polynucleotide
taatacgactcactatagggggggatgttcctgtttgacctgaggtgttaaacagaggagataacacatgaggtcaaacaacctggcggcagcgcaaaagatg

SEQ ID NO: 152097 - DNA, 103 bp, Artificial Sequence
  Synthetic Polynucleotide
taatacgactcactatagggctgtcagtgtggggatgttcctgtttgaccaacagaggagaggtcaaatgggaacatccaacctggcggcagcgcaaaagatg

SEQ ID NO: 152098 - DNA, 103 bp, Artificial Sequence
  Synthetic Polynucleotide
taatacgactcactatagggcattaggtcactgtcagtgtggggatgttcaacagaggagagaacatatgcacactgacaacctggcggcagcgcaaaagatg

SEQ ID NO: 152099 - DNA, 103 bp, Artificial Sequence
  Synthetic Polynucleotide
taatacgactcactataggggcttcacgtgcattaggtcactgtcagtgtaacagaggagaacactgatggtgacctaaaacctggcggcagcgcaaaagatg

SEQ ID NO: 152100 - DNA, 103 bp, Artificial Sequence
  Synthetic Polynucleotide
taatacgactcactatagggtcatgctgaggcttcacgtgcattaggtcaaacagaggagatgacctatggcacgtgaaaacctggcggcagcgcaaaagatg

SEQ ID NO: 152101 - DNA, 103 bp, Artificial Sequence
  Synthetic Polynucleotide
taatacgactcactatagggctttctctgttcatgctgaggcttcacgtgaacagaggagacacgtgatgcctcagcataacctggcggcagcgcaaaagatg

SEQ ID NO: 152102 - DNA, 103 bp, Artificial Sequence
  Synthetic Polynucleotide
taatacgactcactataggggctcctgctcctttctctgttcatgctgagaacagaggagactcagcatgaacagagaaaacctggcggcagcgcaaaagatg

SEQ ID NO: 152103 - DNA, 103 bp, Artificial Sequence
  Synthetic Polynucleotide
taatacgactcactatagggggtctttttggctcctgctcctttctctgtaacagaggagaacagagatgggagcaggaaacctggcggcagcgcaaaagatg

SEQ ID NO: 152104 - DNA, 103 bp, Artificial Sequence
  Synthetic Polynucleotide
taatacgactcactatagggcttaatgtgaggtctttttggctcctgctcaacagaggagagagcagatgccaaaaagaaacctggcggcagcgcaaaagatg

SEQ ID NO: 152105 - DNA, 103 bp, Artificial Sequence
  Synthetic Polynucleotide
taatacgactcactatagggtcagaggcttcttaatgtgaggtctttttgaacagaggagacaaaaaatgctcacattaaacctggcggcagcgcaaaagatg

SEQ ID NO: 152106 - DNA, 103 bp, Artificial Sequence
  Synthetic Polynucleotide
taatacgactcactatagggatcttttccttctgaggatcgccctcgtccaacagaggagaggacgaatgcgatcctcaaacctggcggcagcgcaaaagatg

SEQ ID NO: 152107 - DNA, 103 bp, Artificial Sequence
  Synthetic Polynucleotide
taatacgactcactatagggataaaagcattcagaggcttcttaatgtgaaacagaggagatcacatatggaagcctctaacctggcggcagcgcaaaagatg

SEQ ID NO: 152108 - DNA, 103 bp, Artificial Sequence
  Synthetic Polynucleotide
taatacgactcactatagggcatgtataacataaaagcattcagaggcttaacagaggagaaagcctatgaatgcttttaacctggcggcagcgcaaaagatg

SEQ ID NO: 152109 - DNA, 103 bp, Artificial Sequence
  Synthetic Polynucleotide
taatacgactcactatagggtcatttctttcatgtataacataaaagcataacagaggagaatgcttatgtgttatacaaacctggcggcagcgcaaaagatg

SEQ ID NO: 152110 - DNA, 103 bp, Artificial Sequence
  Synthetic Polynucleotide
taatacgactcactatagggacattcgctctcatttctttcatgtataacaacagaggagagttataatggaaagaaataacctggcggcagcgcaaaagatg

SEQ ID NO: 152111 - DNA, 103 bp, Artificial Sequence
  Synthetic Polynucleotide
taatacgactcactatagggctcagcaacgacattcgctctcatttctttaacagaggagaaaagaaatgagagcgaataacctggcggcagcgcaaaagatg

SEQ ID NO: 152112 - DNA, 103 bp, Artificial Sequence
  Synthetic Polynucleotide
taatacgactcactatagggttagagtacactcagcaacgacattcgctcaacagaggagagagcgaatgtcgttgctgaacctggcggcagcgcaaaagatg

SEQ ID NO: 152113 - DNA, 103 bp, Artificial Sequence
  Synthetic Polynucleotide
taatacgactcactataggggcactttcttttagagtacactcagcaacgaacagaggagacgttgcatggtgtactctaacctggcggcagcgcaaaagatg

SEQ ID NO: 152114 - DNA, 103 bp, Artificial Sequence
  Synthetic Polynucleotide
taatacgactcactataggggttgatagctgcactttcttttagagtacaaacagaggagatgtactatgaaagaaagtaacctggcggcagcgcaaaagatg

SEQ ID NO: 152115 - DNA, 103 bp, Artificial Sequence
  Synthetic Polynucleotide
taatacgactcactatagggcaagaatctggttgatagctgcactttcttaacagaggagaaagaaaatgcagctatcaaacctggcggcagcgcaaaagatg

SEQ ID NO: 152116 - DNA, 103 bp, Artificial Sequence
  Synthetic Polynucleotide
taatacgactcactatagggcaccttctgccaagaatctggttgatagctaacagaggagaagctatatgccagattctaacctggcggcagcgcaaaagatg

SEQ ID NO: 152117 - DNA, 103 bp, Artificial Sequence
  Synthetic Polynucleotide
taatacgactcactatagggctcggggcccgacagactgtggaacagcataacagaggagaatgctgatgcacagtctgaacctggcggcagcgcaaaagatg

SEQ ID NO: 152118 - DNA, 103 bp, Artificial Sequence
  Synthetic Polynucleotide
taatacgactcactatagggcgtctcggtgtcgccgcggtcgatggcggaaacagaggagatccgccatggaccgcggcaacctggcggcagcgcaaaagatg

SEQ ID NO: 152119 - DNA, 103 bp, Artificial Sequence
  Synthetic Polynucleotide
taatacgactcactatagggcgccgcgtctgtcgacttgtccacgcccgtaacagaggagaacgggcatggacaagtcgaacctggcggcagcgcaaaagatg

SEQ ID NO: 152120 - DNA, 103 bp, Artificial Sequence
  Synthetic Polynucleotide
taatacgactcactatagggctgtctgcagcgccgcgtctgtcgacttgtaacagaggagaacaagtatgcagacgcggaacctggcggcagcgcaaaagatg

SEQ ID NO: 152121 - DNA, 103 bp, Artificial Sequence
  Synthetic Polynucleotide
taatacgactcactataggggatggcgtccctgtctgcagcgccgcgtctaacagaggagaagacgcatggctgcagacaacctggcggcagcgcaaaagatg

SEQ ID NO: 152122 - DNA, 103 bp, Artificial Sequence
  Synthetic Polynucleotide
taatacgactcactatagggggccgggcccgatggcgtccctgtctgcagaacagaggagactgcagatggggacgccaaacctggcggcagcgcaaaagatg

SEQ ID NO: 152123 - DNA, 103 bp, Artificial Sequence
  Synthetic Polynucleotide
taatacgactcactatagggagagctccgaggccgggcccgatggcgtccaacagaggagaggacgcatgcgggcccggaacctggcggcagcgcaaaagatg

SEQ ID NO: 152124 - DNA, 103 bp, Artificial Sequence
  Synthetic Polynucleotide
taatacgactcactataggggaggcgttggagagctccgaggccgggcccaacagaggagagggcccatgctcggagctaacctggcggcagcgcaaaagatg

SEQ ID NO: 152125 - DNA, 103 bp, Artificial Sequence
  Synthetic Polynucleotide
taatacgactcactatagggggggctgagcgaggcgttggagagctccgaaacagaggagatcggagatgtccaacgccaacctggcggcagcgcaaaagatg

SEQ ID NO: 152126 - DNA, 103 bp, Artificial Sequence
  Synthetic Polynucleotide
taatacgactcactataggggcgtgctggaggggctgagcgaggcgttggaacagaggagaccaacgatgcgctcagccaacctggcggcagcgcaaaagatg

SEQ ID NO: 152127 - DNA, 103 bp, Artificial Sequence
  Synthetic Polynucleotide
taatacgactcactatagggagggtggtgggcgtgctggaggggctgagcaacagaggagagctcagatgctccagcacaacctggcggcagcgcaaaagatg

SEQ ID NO: 152128 - DNA, 103 bp, Artificial Sequence
  Synthetic Polynucleotide
taatacgactcactatagggcaagtctgtcagggtggtgggcgtgctggaaacagaggagatccagcatgcccaccaccaacctggcggcagcgcaaaagatg

SEQ ID NO: 152129 - DNA, 103 bp, Artificial Sequence
  Synthetic Polynucleotide
taatacgactcactatagggacggcatggtcgtctcggtgtcgccgcggtaacagaggagaaccgcgatgacaccgagaaacctggcggcagcgcaaaagatg

SEQ ID NO: 152130 - DNA, 103 bp, Artificial Sequence
  Synthetic Polynucleotide
taatacgactcactatagggtggggctagtcaagtctgtcagggtggtggaacagaggagaccaccaatgtgacagactaacctggcggcagcgcaaaagatg

SEQ ID NO: 152131 - DNA, 103 bp, Artificial Sequence
  Synthetic Polynucleotide
taatacgactcactataggggttggcagggtggggctagtcaagtctgtcaacagaggagagacagaatggactagcccaacctggcggcagcgcaaaagatg

SEQ ID NO: 152132 - DNA, 103 bp, Artificial Sequence
  Synthetic Polynucleotide
taatacgactcactatagggggacgtcacagttggcagggtggggctagtaacagaggagaactagcatgaccctgccaaacctggcggcagcgcaaaagatg

SEQ ID NO: 152133 - DNA, 103 bp, Artificial Sequence
  Synthetic Polynucleotide
taatacgactcactatagggaagttaagacggacgtcacagttggcagggaacagaggagaccctgcatgctgtgacgtaacctggcggcagcgcaaaagatg

SEQ ID NO: 152134 - DNA, 103 bp, Artificial Sequence
  Synthetic Polynucleotide
taatacgactcactatagggccaggcacagaagttaagacggacgtcacaaacagaggagatgtgacatgcgtcttaacaacctggcggcagcgcaaaagatg

SEQ ID NO: 152135 - DNA, 103 bp, Artificial Sequence
  Synthetic Polynucleotide
taatacgactcactatagggctccaggttgccaggcacagaagttaagacaacagaggagagtcttaatgtctgtgcctaacctggcggcagcgcaaaagatg

SEQ ID NO: 152136 - DNA, 103 bp, Artificial Sequence
  Synthetic Polynucleotide
taatacgactcactataggggctcatggccctccaggttgccaggcacagaacagaggagactgtgcatggcaacctggaacctggcggcagcgcaaaagatg

SEQ ID NO: 152137 - DNA, 103 bp, Artificial Sequence
  Synthetic Polynucleotide
taatacgactcactataggggggctgtgaggctcatggccctccaggttgaacagaggagacaacctatggggccatgaaacctggcggcagcgcaaaagatg

SEQ ID NO: 152138 - DNA, 103 bp, Artificial Sequence
  Synthetic Polynucleotide
taatacgactcactatagggcgtttgtgaggggctgtgaggctcatggccaacagaggagaggccatatgcctcacagcaacctggcggcagcgcaaaagatg

SEQ ID NO: 152139 - DNA, 103 bp, Artificial Sequence
  Synthetic Polynucleotide
taatacgactcactatagggtggtaagagtcgtttgtgaggggctgtgagaacagaggagactcacaatgcctcacaaaaacctggcggcagcgcaaaagatg

SEQ ID NO: 152140 - DNA, 103 bp, Artificial Sequence
  Synthetic Polynucleotide
taatacgactcactatagggctgctgatggacggcatggtcgtctcggtgaacagaggagacaccgaatggaccatgccaacctggcggcagcgcaaaagatg

SEQ ID NO: 152141 - DNA, 103 bp, Artificial Sequence
  Synthetic Polynucleotide
taatacgactcactatagggtagaaaaggttggtaagagtcgtttgtgagaacagaggagactcacaatggactcttacaacctggcggcagcgcaaaagatg

SEQ ID NO: 152142 - DNA, 103 bp, Artificial Sequence
  Synthetic Polynucleotide
taatacgactcactatagggggcgcggtcactgctgatggacggcatggtaacagaggagaaccatgatgtccatcagcaacctggcggcagcgcaaaagatg

SEQ ID NO: 152143 - DNA, 103 bp, Artificial Sequence
  Synthetic Polynucleotide
taatacgactcactatagggcgcacagcgcggcgcggtcactgctgatggaacagaggagaccatcaatggtgaccgcgaacctggcggcagcgcaaaagatg

SEQ ID NO: 152144 - DNA, 103 bp, Artificial Sequence
  Synthetic Polynucleotide
taatacgactcactatagggccgcagccggcgcacagcgcggcgcggtcaaacagaggagatgaccgatgcgcgctgtgaacctggcggcagcgcaaaagatg

SEQ ID NO: 152145 - DNA, 103 bp, Artificial Sequence
  Synthetic Polynucleotide
taatacgactcactataggggatcttgcccccgcagccggcgcacagcgcaacagaggagagcgctgatggccggctgcaacctggcggcagcgcaaaagatg

SEQ ID NO: 152146 - DNA, 103 bp, Artificial Sequence
  Synthetic Polynucleotide
taatacgactcactatagggagcggtccgagatcttgcccccgcagccggaacagaggagaccggctatgggggcaagaaacctggcggcagcgcaaaagatg

SEQ ID NO: 152147 - DNA, 103 bp, Artificial Sequence
  Synthetic Polynucleotide
taatacgactcactatagggagcaggtagtagcggtccgagatcttgcccaacagaggagagggcaaatgctcggaccgaacctggcggcagcgcaaaagatg

SEQ ID NO: 152148 - DNA, 103 bp, Artificial Sequence
  Synthetic Polynucleotide
taatacgactcactataggggtccaccgccagcaggtagtagcggtccgaaacagaggagatcggacatgtactacctgaacctggcggcagcgcaaaagatg

SEQ ID NO: 152149 - DNA, 103 bp, Artificial Sequence
  Synthetic Polynucleotide
taatacgactcactatagggccccgtgcacctcggggcccgacagactgtaacagaggagaacagtcatgcgggccccgaacctggcggcagcgcaaaagatg

SEQ ID NO: 152150 - DNA, 103 bp, Artificial Sequence
  Synthetic Polynucleotide
taatacgactcactataggggccactgcttgtccaccgccagcaggtagtaacagaggagaactaccatgtggcggtggaacctggcggcagcgcaaaagatg

SEQ ID NO: 152151 - DNA, 103 bp, Artificial Sequence
  Synthetic Polynucleotide
taatacgactcactatagggcagcgcatgtgccactgcttgtccaccgccaacagaggagaggcggtatgcaagcagtgaacctggcggcagcgcaaaagatg

SEQ ID NO: 152152 - DNA, 103 bp, Artificial Sequence
  Synthetic Polynucleotide
taatacgactcactataggggcacttgaggcagcgcatgtgccactgcttaacagaggagaaagcagatgcacatgcgcaacctggcggcagcgcaaaagatg

SEQ ID NO: 152153 - DNA, 103 bp, Artificial Sequence
  Synthetic Polynucleotide
taatacgactcactatagggtgcactcgcagcacttgaggcagcgcatgtaacagaggagaacatgcatggcctcaagtaacctggcggcagcgcaaaagatg

SEQ ID NO: 152154 - DNA, 103 bp, Artificial Sequence
  Synthetic Polynucleotide
taatacgactcactatagggaggttgagcttgcactcgcagcacttgaggaacagaggagacctcaaatgctgcgagtgaacctggcggcagcgcaaaagatg

SEQ ID NO: 152155 - DNA, 103 bp, Artificial Sequence
  Synthetic Polynucleotide
taatacgactcactatagggctccgactccaggttgagcttgcactcgcaaacagaggagatgcgagatgaagctcaacaacctggcggcagcgcaaaagatg

SEQ ID NO: 152156 - DNA, 103 bp, Artificial Sequence
  Synthetic Polynucleotide
taatacgactcactatagggaacaggtgagctccgactccaggttgagctaacagaggagaagctcaatgtggagtcggaacctggcggcagcgcaaaagatg

SEQ ID NO: 152157 - DNA, 103 bp, Artificial Sequence
  Synthetic Polynucleotide
taatacgactcactatagggtccttgctgaaacaggtgagctccgactccaacagaggagaggagtcatggctcacctgaacctggcggcagcgcaaaagatg

SEQ ID NO: 152158 - DNA, 103 bp, Artificial Sequence
  Synthetic Polynucleotide
taatacgactcactataggggatgctaccgtccttgctgaaacaggtgagaacagaggagactcaccatgttcagcaagaacctggcggcagcgcaaaagatg

SEQ ID NO: 152159 - DNA, 103 bp, Artificial Sequence
  Synthetic Polynucleotide
taatacgactcactatagggccttgcagtagatgctaccgtccttgctgaaacagaggagatcagcaatgacggtagcaaacctggcggcagcgcaaaagatg

SEQ ID NO: 152160 - DNA, 103 bp, Artificial Sequence
  Synthetic Polynucleotide
taatacgactcactatagggtcgtcgatgaccccgtgcacctcggggcccaacagaggagagggcccatgggtgcacggaacctggcggcagcgcaaaagatg

SEQ ID NO: 152161 - DNA, 103 bp, Artificial Sequence
  Synthetic Polynucleotide
taatacgactcactatagggtagtagtcttccttgcagtagatgctaccgaacagaggagacggtagatgctactgcaaaacctggcggcagcgcaaaagatg

SEQ ID NO: 152162 - DNA, 103 bp, Artificial Sequence
  Synthetic Polynucleotide
taatacgactcactataggggaagcgcctgtagtagtcttccttgcagtaaacagaggagatactgcatggaagactacaacctggcggcagcgcaaaagatg

SEQ ID NO: 152163 - DNA, 103 bp, Artificial Sequence
  Synthetic Polynucleotide
taatacgactcactataggggctgcacagagaagcgcctgtagtagtcttaacagaggagaaagactatgacaggcgctaacctggcggcagcgcaaaagatg

SEQ ID NO: 152164 - DNA, 103 bp, Artificial Sequence
  Synthetic Polynucleotide
taatacgactcactatagggcgggcgcagcgctgcacagagaagcgcctgaacagaggagacaggcgatgctctgtgcaaacctggcggcagcgcaaaagatg

SEQ ID NO: 152165 - DNA, 103 bp, Artificial Sequence
  Synthetic Polynucleotide
taatacgactcactatagggcaggtggcagcgggcgcagcgctgcacagaaacagaggagatctgtgatgcgctgcgccaacctggcggcagcgcaaaagatg

SEQ ID NO: 152166 - DNA, 103 bp, Artificial Sequence
  Synthetic Polynucleotide
taatacgactcactatagggccgagatgcccaggtggcagcgggcgcagcaacagaggagagctgcgatggctgccaccaacctggcggcagcgcaaaagatg

SEQ ID NO: 152167 - DNA, 103 bp, Artificial Sequence
  Synthetic Polynucleotide
taatacgactcactatagggatctccgaggccgagatgcccaggtggcagaacagaggagactgccaatggggcatctcaacctggcggcagcgcaaaagatg

SEQ ID NO: 152168 - DNA, 103 bp, Artificial Sequence
  Synthetic Polynucleotide
taatacgactcactataggggcgcatcaccatctccgaggccgagatgccaacagaggagaggcatcatggcctcggagaacctggcggcagcgcaaaagatg

SEQ ID NO: 152169 - DNA, 103 bp, Artificial Sequence
  Synthetic Polynucleotide
taatacgactcactatagggagtcccgagcgcgcatcaccatctccgaggaacagaggagacctcggatgtggtgatgcaacctggcggcagcgcaaaagatg

SEQ ID NO: 152170 - DNA, 103 bp, Artificial Sequence
  Synthetic Polynucleotide
taatacgactcactatagggtgataaaccaagtcccgagcgcgcatcaccaacagaggagaggtgatatgcgctcgggaaacctggcggcagcgcaaaagatg

SEQ ID NO: 152171 - DNA, 103 bp, Artificial Sequence
  Synthetic Polynucleotide
taatacgactcactataggggcggtccatctcgtcgatgaccccgtgcacaacagaggagagtgcacatggtcatcgacaacctggcggcagcgcaaaagatg

SEQ ID NO: 152172 - DNA, 103 bp, Artificial Sequence
  Synthetic Polynucleotide
taatacgactcactataggggcagttgaggtgataaaccaagtcccgagcaacagaggagagctcggatgttggtttataacctggcggcagcgcaaaagatg

SEQ ID NO: 152173 - DNA, 103 bp, Artificial Sequence
  Synthetic Polynucleotide
taatacgactcactatagggtgcacgtgaagcagttgaggtgataaaccaaacagaggagatggtttatgacctcaactaacctggcggcagcgcaaaagatg

SEQ ID NO: 152174 - DNA, 103 bp, Artificial Sequence
  Synthetic Polynucleotide
taatacgactcactatagggttacacgtggtgcacgtgaagcagttgaggaacagaggagacctcaaatgcttcacgtgaacctggcggcagcgcaaaagatg

SEQ ID NO: 152175 - DNA, 103 bp, Artificial Sequence
  Synthetic Polynucleotide
taatacgactcactatagggcagcatcttgttacacgtggtgcacgtgaaaacagaggagattcacgatgaccacgtgtaacctggcggcagcgcaaaagatg

SEQ ID NO: 152176 - DNA, 103 bp, Artificial Sequence
  Synthetic Polynucleotide
taatacgactcactatagggcgcccgtggtcagcatcttgttacacgtggaacagaggagaccacgtatgacaagatgcaacctggcggcagcgcaaaagatg

SEQ ID NO: 152177 - DNA, 103 bp, Artificial Sequence
  Synthetic Polynucleotide
taatacgactcactatagggccgaagtggtcgcccgtggtcagcatcttgaacagaggagacaagatatggaccacgggaacctggcggcagcgcaaaagatg

SEQ ID NO: 152178 - DNA, 103 bp, Artificial Sequence
  Synthetic Polynucleotide
taatacgactcactataggggtccttcatgccgaagtggtcgcccgtggtaacagaggagaaccacgatggaccacttcaacctggcggcagcgcaaaagatg

SEQ ID NO: 152179 - DNA, 103 bp, Artificial Sequence
  Synthetic Polynucleotide
taatacgactcactatagggagaccaggctgtccttcatgccgaagtggtaacagaggagaaccactatggcatgaaggaacctggcggcagcgcaaaagatg

SEQ ID NO: 152180 - DNA, 103 bp, Artificial Sequence
  Synthetic Polynucleotide
taatacgactcactatagggaagcggcagtagaccaggctgtccttcatgaacagaggagacatgaaatgcagcctggtaacctggcggcagcgcaaaagatg

SEQ ID NO: 152181 - DNA, 103 bp, Artificial Sequence
  Synthetic Polynucleotide
taatacgactcactatagggctcgaagtgcaagcggcagtagaccaggctaacagaggagaagcctgatgtactgccgcaacctggcggcagcgcaaaagatg

SEQ ID NO: 152182 - DNA, 103 bp, Artificial Sequence
  Synthetic Polynucleotide
taatacgactcactatagggtcttggccctgcggtccatctcgtcgatgaaacagaggagatcatcgatgagatggaccaacctggcggcagcgcaaaagatg

SEQ ID NO: 152183 - DNA, 103 bp, Artificial Sequence
  Synthetic Polynucleotide
taatacgactcactataggggcagcagcgcctcgaagtgcaagcggcagtaacagaggagaactgccatgtgcacttcgaacctggcggcagcgcaaaagatg

SEQ ID NO: 152184 - DNA, 103 bp, Artificial Sequence
  Synthetic Polynucleotide
taatacgactcactatagggtactcgccctgcagcagcgcctcgaagtgcaacagaggagagcacttatgggcgctgctaacctggcggcagcgcaaaagatg

SEQ ID NO: 152185 - DNA, 103 bp, Artificial Sequence
  Synthetic Polynucleotide
taatacgactcactataggggtgtgcggggtactcgccctgcagcagcgcaacagaggagagcgctgatgcagggcgagaacctggcggcagcgcaaaagatg

SEQ ID NO: 152186 - DNA, 103 bp, Artificial Sequence
  Synthetic Polynucleotide
taatacgactcactatagggcatggttgaagtgtgcggggtactcgccctaacagaggagaagggcgatgaccccgcacaacctggcggcagcgcaaaagatg

SEQ ID NO: 152187 - DNA, 103 bp, Artificial Sequence
  Synthetic Polynucleotide
taatacgactcactataggggccacgtcggcatggttgaagtgtgcggggaacagaggagaccccgcatgcttcaaccaaacctggcggcagcgcaaaagatg

SEQ ID NO: 152188 - DNA, 103 bp, Artificial Sequence
  Synthetic Polynucleotide
taatacgactcactatagggggccgccgctgccacgtcggcatggttgaaaacagaggagattcaacatggccgacgtgaacctggcggcagcgcaaaagatg

SEQ ID NO: 152189 - DNA, 103 bp, Artificial Sequence
  Synthetic Polynucleotide
taatacgactcactatagggcggctgcagcggccgccgctgccacgtcggaacagaggagaccgacgatgcagcggcggaacctggcggcagcgcaaaagatg

SEQ ID NO: 152190 - DNA, 103 bp, Artificial Sequence
  Synthetic Polynucleotide
taatacgactcactatagggttggccgccgcggctgcagcggccgccgctaacagaggagaagcggcatgcgctgcagcaacctggcggcagcgcaaaagatg

SEQ ID NO: 152191 - DNA, 103 bp, Artificial Sequence
  Synthetic Polynucleotide
taatacgactcactatagggccccgcgctcttggccgccgcggctgcagcaacagaggagagctgcaatggcggcggccaacctggcggcagcgcaaaagatg

SEQ ID NO: 152192 - DNA, 103 bp, Artificial Sequence
  Synthetic Polynucleotide
taatacgactcactatagggctgcgcccagccccgcgctcttggccgccgaacagaggagacggcggatgagagcgcggaacctggcggcagcgcaaaagatg

SEQ ID NO: 152193 - DNA, 103 bp, Artificial Sequence
  Synthetic Polynucleotide
taatacgactcactatagggggagcctcgctcttggccctgcggtccatcaacagaggagagatggaatgcagggccaaaacctggcggcagcgcaaaagatg

SEQ ID NO: 152194 - DNA, 103 bp, Artificial Sequence
  Synthetic Polynucleotide
taatacgactcactatagggttggcccctgctgcgcccagccccgcgctcaacagaggagagagcgcatggctgggcgcaacctggcggcagcgcaaaagatg

SEQ ID NO: 152195 - DNA, 103 bp, Artificial Sequence
  Synthetic Polynucleotide
taatacgactcactatagggacccagagggttggcccctgctgcgcccagaacagaggagactgggcatggcaggggccaacctggcggcagcgcaaaagatg

SEQ ID NO: 152196 - DNA, 103 bp, Artificial Sequence
  Synthetic Polynucleotide
taatacgactcactatagggagtagggaagacccagagggttggcccctgaacagaggagacaggggatgaccctctggaacctggcggcagcgcaaaagatg

SEQ ID NO: 152197 - DNA, 103 bp, Artificial Sequence
  Synthetic Polynucleotide
taatacgactcactatagggacgccattgtagtagggaagacccagagggaacagaggagaccctctatgtcttccctaaacctggcggcagcgcaaaagatg

SEQ ID NO: 152198 - DNA, 103 bp, Artificial Sequence
  Synthetic Polynucleotide
taatacgactcactatagggcacagtgcccacgccattgtagtagggaagaacagaggagacttcccatgtacaatggcaacctggcggcagcgcaaaagatg

SEQ ID NO: 152199 - DNA, 103 bp, Artificial Sequence
  Synthetic Polynucleotide
taatacgactcactataggggccccttctgcacagtgcccacgccattgtaacagaggagaacaatgatgtgggcactgaacctggcggcagcgcaaaagatg

SEQ ID NO: 152200 - DNA, 103 bp, Artificial Sequence
  Synthetic Polynucleotide
taatacgactcactatagggttcctcggccgccccttctgcacagtgcccaacagaggagagggcacatggcagaagggaacctggcggcagcgcaaaagatg

SEQ ID NO: 152201 - DNA, 103 bp, Artificial Sequence
  Synthetic Polynucleotide
taatacgactcactataggggctcttacgtttcctcggccgccccttctgaacagaggagacagaagatgcggccgaggaacctggcggcagcgcaaaagatg

SEQ ID NO: 152202 - DNA, 103 bp, Artificial Sequence
  Synthetic Polynucleotide
taatacgactcactatagggcggggcccgggctcttacgtttcctcggccaacagaggagaggccgaatgaacgtaagaaacctggcggcagcgcaaaagatg

SEQ ID NO: 152203 - DNA, 103 bp, Artificial Sequence
  Synthetic Polynucleotide
taatacgactcactatagggagatccgcaccggggcccgggctcttacgtaacagaggagaacgtaaatgcccgggcccaacctggcggcagcgcaaaagatg

SEQ ID NO: 152204 - DNA, 103 bp, Artificial Sequence
  Synthetic Polynucleotide
taatacgactcactataggggctgatggcgggagcctcgctcttggccctaacagaggagaagggccatgagcgaggctaacctggcggcagcgcaaaagatg

SEQ ID NO: 152205 - DNA, 103 bp, Artificial Sequence
  Synthetic Polynucleotide
taatacgactcactataggggtaggccgccagatccgcaccggggcccggaacagaggagaccgggcatgggtgcggataacctggcggcagcgcaaaagatg

SEQ ID NO: 152206 - DNA, 103 bp, Artificial Sequence
  Synthetic Polynucleotide
taatacgactcactataggggcgcagcgttgtaggccgccagatccgcacaacagaggagagtgcggatgtggcggcctaacctggcggcagcgcaaaagatg

SEQ ID NO: 152207 - DNA, 103 bp, Artificial Sequence
  Synthetic Polynucleotide
taatacgactcactatagggttgcagcttagcgcagcgttgtaggccgccaacagaggagaggcggcatgcaacgctgcaacctggcggcagcgcaaaagatg

SEQ ID NO: 152208 - DNA, 103 bp, Artificial Sequence
  Synthetic Polynucleotide
taatacgactcactataggggtcgttttcgttgcagcttagcgcagcgttaacagaggagaaacgctatgctaagctgcaacctggcggcagcgcaaaagatg

SEQ ID NO: 152209 - DNA, 103 bp, Artificial Sequence
  Synthetic Polynucleotide
taatacgactcactatagggggtgctctgcgtcgttttcgttgcagcttaaacagaggagataagctatgacgaaaacgaacctggcggcagcgcaaaagatg

SEQ ID NO: 152210 - DNA, 103 bp, Artificial Sequence
  Synthetic Polynucleotide
taatacgactcactatagggtcacggtccaggtgctctgcgtcgttttcgaacagaggagacgaaaaatgcgcagagcaaacctggcggcagcgcaaaagatg

SEQ ID NO: 152211 - DNA, 103 bp, Artificial Sequence
  Synthetic Polynucleotide
taatacgactcactataggggtatggctggtcacggtccaggtgctctgcaacagaggagagcagagatgctggaccgtaacctggcggcagcgcaaaagatg

SEQ ID NO: 152212 - DNA, 103 bp, Artificial Sequence
  Synthetic Polynucleotide
taatacgactcactatagggggctgctcgggtatggctggtcacggtccaaacagaggagatggaccatgaccagccataacctggcggcagcgcaaaagatg

SEQ ID NO: 152213 - DNA, 103 bp, Artificial Sequence
  Synthetic Polynucleotide
taatacgactcactatagggttggtcttctggctgctcgggtatggctggaacagaggagaccagccatgcccgagcagaacctggcggcagcgcaaaagatg

SEQ ID NO: 152214 - DNA, 103 bp, Artificial Sequence
  Synthetic Polynucleotide
taatacgactcactataggggcgcatgcgcttggtcttctggctgctcggaacagaggagaccgagcatgcagaagaccaacctggcggcagcgcaaaagatg

SEQ ID NO: 152215 - DNA, 103 bp, Artificial Sequence
  Synthetic Polynucleotide
taatacgactcactatagggcgatggcggagctgatggcgggagcctcgcaacagaggagagcgaggatgccgccatcaaacctggcggcagcgcaaaagatg

SEQ ID NO: 152216 - DNA, 103 bp, Artificial Sequence
  Synthetic Polynucleotide
taatacgactcactatagggtgaaggacgtgcgcatgcgcttggtcttctaacagaggagaagaagaatgagcgcatgcaacctggcggcagcgcaaaagatg

SEQ ID NO: 152217 - DNA, 103 bp, Artificial Sequence
  Synthetic Polynucleotide
taatacgactcactatagggtggtggtgcttgaaggacgtgcgcatgcgcaacagaggagagcgcatatgcacgtccttaacctggcggcagcgcaaaagatg

SEQ ID NO: 152218 - DNA, 103 bp, Artificial Sequence
  Synthetic Polynucleotide
taatacgactcactatagggggtccgaagctggtggtgcttgaaggacgtaacagaggagaacgtccatgaagcaccacaacctggcggcagcgcaaaagatg

SEQ ID NO: 152219 - DNA, 103 bp, Artificial Sequence
  Synthetic Polynucleotide
taatacgactcactatagggaagacttcatggtccgaagctggtggtgctaacagaggagaagcaccatgagcttcggaaacctggcggcagcgcaaaagatg

SEQ ID NO: 152220 - DNA, 103 bp, Artificial Sequence
  Synthetic Polynucleotide
taatacgactcactatagggatggcaaagtaagacttcatggtccgaagcaacagaggagagcttcgatgcatgaagtcaacctggcggcagcgcaaaagatg

SEQ ID NO: 152221 - DNA, 103 bp, Artificial Sequence
  Synthetic Polynucleotide
taatacgactcactataggggttgtggttaatggcaaagtaagacttcataacagaggagaatgaagatgtactttgccaacctggcggcagcgcaaaagatg

SEQ ID NO: 152222 - DNA, 103 bp, Artificial Sequence
  Synthetic Polynucleotide
taatacgactcactatagggtggcgtcggggttgtggttaatggcaaagtaacagaggagaactttgatgttaaccacaaacctggcggcagcgcaaaagatg

SEQ ID NO: 152223 - DNA, 103 bp, Artificial Sequence
  Synthetic Polynucleotide
taatacgactcactatagggttcaagtccttggcgtcggggttgtggttaaacagaggagataaccaatgccccgacgcaacctggcggcagcgcaaaagatg

SEQ ID NO: 152224 - DNA, 103 bp, Artificial Sequence
  Synthetic Polynucleotide
taatacgactcactatagggcgcgagctgcttcaagtccttggcgtcgggaacagaggagacccgacatgaaggacttgaacctggcggcagcgcaaaagatg

SEQ ID NO: 152225 - DNA, 103 bp, Artificial Sequence
  Synthetic Polynucleotide
taatacgactcactatagggccgtcttttgcgcgagctgcttcaagtcctaacagaggagaaggactatgagcagctcgaacctggcggcagcgcaaaagatg

SEQ ID NO: 152226 - DNA, 103 bp, Artificial Sequence
  Synthetic Polynucleotide
taatacgactcactatagggtcgccgcggtcgatggcggagctgatggcgaacagaggagacgccatatgctccgccataacctggcggcagcgcaaaagatg

SEQ ID NO: 152227 - DNA, 103 bp, Artificial Sequence
  Synthetic Polynucleotide
taatacgactcactatagggttggtgaggcccgtcttttgcgcgagctgcaacagaggagagcagctatggcaaaagacaacctggcggcagcgcaaaagatg

SEQ ID NO: 152228 - DNA, 103 bp, Artificial Sequence
  Synthetic Polynucleotide
taatacgactcactataggggaggacccgcttggtgaggcccgtcttttgaacagaggagacaaaagatgggcctcaccaacctggcggcagcgcaaaagatg

SEQ ID NO: 152229 - DNA, 103 bp, Artificial Sequence
  Synthetic Polynucleotide
taatacgactcactatagggaccagacctggaggacccgcttggtgaggcaacagaggagagcctcaatgagcgggtccaacctggcggcagcgcaaaagatg

SEQ ID NO: 152230 - DNA, 103 bp, Artificial Sequence
  Synthetic Polynucleotide
taatacgactcactataggggcgttctggaaccagacctggaggacccgcaacagaggagagcgggtatgccaggtctgaacctggcggcagcgcaaaagatg

SEQ ID NO: 152231 - DNA, 103 bp, Artificial Sequence
  Synthetic Polynucleotide
taatacgactcactatagggcttggctcgggcgttctggaaccagacctgaacagaggagacaggtcatgttccagaacaacctggcggcagcgcaaaagatg

SEQ ID NO: 152232 - DNA, 103 bp, Artificial Sequence
  Synthetic Polynucleotide
taatacgactcactatagggtgcgcctgaacttggctcgggcgttctggaaacagaggagatccagaatgcccgagccaaacctggcggcagcgcaaaagatg

SEQ ID NO: 152233 - DNA, 103 bp, Artificial Sequence
  Synthetic Polynucleotide
taatacgactcactatagggcgtaagaggttgcgcctgaacttggctcggaacagaggagaccgagcatggttcaggcgaacctggcggcagcgcaaaagatg

SEQ ID NO: 152234 - DNA, 103 bp, Artificial Sequence
  Synthetic Polynucleotide
taatacgactcactataggggttttcctgccgtaagaggttgcgcctgaaaacagaggagattcaggatgaacctcttaaacctggcggcagcgcaaaagatg

SEQ ID NO: 152235 - DNA, 103 bp, Artificial Sequence
  Synthetic Polynucleotide
taatacgactcactatagggccacgcccgtgttttcctgccgtaagaggtaacagaggagaacctctatgggcaggaaaaacctggcggcagcgcaaaagatg

SEQ ID NO: 152236 - DNA, 103 bp, Artificial Sequence
  Synthetic Polynucleotide
taatacgactcactataggggtcgacttgtccacgcccgtgttttcctgcaacagaggagagcaggaatgcacgggcgtaacctggcggcagcgcaaaagatg

SEQ ID NO: 152237 - DNA, 103 bp, Artificial Sequence
  Synthetic Polynucleotide
taatacgactcactatagggggccgggcccagctccccgcgcgcctccataacagaggagaatggagatgcgcggggagaacctggcggcagcgcaaaagatg

SEQ ID NO: 152238 - DNA, 103 bp, Artificial Sequence
  Synthetic Polynucleotide
taatacgactcactataggggtcacagccagcgcacagcgggatctctcgaacagaggagacgagagatgccgctgtgcaacctggcggcagcgcaaaagatg

SEQ ID NO: 152239 - DNA, 103 bp, Artificial Sequence
  Synthetic Polynucleotide
taatacgactcactatagggggagaggaggggctgggggccagggaggctaacagaggagaagcctcatgggcccccagaacctggcggcagcgcaaaagatg

SEQ ID NO: 152240 - DNA, 103 bp, Artificial Sequence
  Synthetic Polynucleotide
taatacgactcactatagggacaccaggctggagaggaggggctgggggcaacagaggagagcccccatgccctcctctaacctggcggcagcgcaaaagatg

SEQ ID NO: 152241 - DNA, 103 bp, Artificial Sequence
  Synthetic Polynucleotide
taatacgactcactataggggtgtctgggtacaccaggctggagaggaggaacagaggagacctcctatgcagcctggtaacctggcggcagcgcaaaagatg

SEQ ID NO: 152242 - DNA, 103 bp, Artificial Sequence
  Synthetic Polynucleotide
taatacgactcactataggggcccaagctggtgtctgggtacaccaggctaacagaggagaagcctgatgtacccagacaacctggcggcagcgcaaaagatg

SEQ ID NO: 152243 - DNA, 103 bp, Artificial Sequence
  Synthetic Polynucleotide
taatacgactcactatagggagggcacaaggcccaagctggtgtctgggtaacagaggagaacccagatgccagcttggaacctggcggcagcgcaaaagatg

SEQ ID NO: 152244 - DNA, 103 bp, Artificial Sequence
  Synthetic Polynucleotide
taatacgactcactatagggggggctcccgagggcacaaggcccaagctgaacagaggagacagcttatgccttgtgccaacctggcggcagcgcaaaagatg

SEQ ID NO: 152245 - DNA, 103 bp, Artificial Sequence
  Synthetic Polynucleotide
taatacgactcactataggggggcccgccgggggctcccgagggcacaagaacagaggagacttgtgatgtcgggagccaacctggcggcagcgcaaaagatg

SEQ ID NO: 152246 - DNA, 103 bp, Artificial Sequence
  Synthetic Polynucleotide
taatacgactcactatagggtcatgggtgggggcccgccgggggctcccgaacagaggagacgggagatgccggcgggcaacctggcggcagcgcaaaagatg

SEQ ID NO: 152247 - DNA, 103 bp, Artificial Sequence
  Synthetic Polynucleotide
taatacgactcactataggggccagcaccctcatgggtgggggcccgccgaacagaggagacggcggatgcccacccataacctggcggcagcgcaaaagatg

SEQ ID NO: 152248 - DNA, 103 bp, Artificial Sequence
  Synthetic Polynucleotide
taatacgactcactatagggtccgttccctgccagcaccctcatgggtggaacagaggagaccacccatgagggtgctgaacctggcggcagcgcaaaagatg

SEQ ID NO: 152249 - DNA, 103 bp, Artificial Sequence
  Synthetic Polynucleotide
taatacgactcactatagggggatgtgctggtcacagccagcgcacagcgaacagaggagacgctgtatgctggctgtgaacctggcggcagcgcaaaagatg

SEQ ID NO: 152250 - DNA, 103 bp, Artificial Sequence
  Synthetic Polynucleotide
taatacgactcactatagggcagaactgggtccgttccctgccagcacccaacagaggagagggtgcatgcagggaacgaacctggcggcagcgcaaaagatg

SEQ ID NO: 152251 - DNA, 103 bp, Artificial Sequence
  Synthetic Polynucleotide
taatacgactcactataggggtggataggtcagaactgggtccgttccctaacagaggagaagggaaatgacccagttcaacctggcggcagcgcaaaagatg

SEQ ID NO: 152252 - DNA, 103 bp, Artificial Sequence
  Synthetic Polynucleotide
taatacgactcactataggggctgctccccgtggataggtcagaactgggaacagaggagacccagtatggacctatccaacctggcggcagcgcaaaagatg

SEQ ID NO: 152253 - DNA, 103 bp, Artificial Sequence
  Synthetic Polynucleotide
taatacgactcactatagggggtaacccccgctgctccccgtggataggtaacagaggagaacctatatgcggggagcaaacctggcggcagcgcaaaagatg

SEQ ID NO: 152254 - DNA, 103 bp, Artificial Sequence
  Synthetic Polynucleotide
taatacgactcactataggggggaagtcggggtaacccccgctgctccccaacagaggagaggggagatgcgggggttaaacctggcggcagcgcaaaagatg

SEQ ID NO: 152255 - DNA, 103 bp, Artificial Sequence
  Synthetic Polynucleotide
taatacgactcactatagggggggctggcagggaagtcggggtaacccccaacagaggagagggggtatgcccgacttcaacctggcggcagcgcaaaagatg

SEQ ID NO: 152256 - DNA, 103 bp, Artificial Sequence
  Synthetic Polynucleotide
taatacgactcactataggggccaggaggcggggctggcagggaagtcggaacagaggagaccgactatgctgccagccaacctggcggcagcgcaaaagatg

SEQ ID NO: 152257 - DNA, 103 bp, Artificial Sequence
  Synthetic Polynucleotide
taatacgactcactatagggacctcatccagccaggaggcggggctggcaaacagaggagatgccagatgcgcctcctgaacctggcggcagcgcaaaagatg

SEQ ID NO: 152258 - DNA, 103 bp, Artificial Sequence
  Synthetic Polynucleotide
taatacgactcactatagggagcgtggtctacctcatccagccaggaggcaacagaggagagcctccatgctggatgagaacctggcggcagcgcaaaagatg

SEQ ID NO: 152259 - DNA, 103 bp, Artificial Sequence
  Synthetic Polynucleotide
taatacgactcactatagggaagcggtccaggatgtgctggtcacagccaaacagaggagatggctgatgccagcacataacctggcggcagcgcaaaagatg

SEQ ID NO: 152260 - DNA, 103 bp, Artificial Sequence
  Synthetic Polynucleotide
taatacgactcactatagggcttgaggatgaagcggtccaggatgtgctgaacagaggagacagcacatgctggaccgcaacctggcggcagcgcaaaagatg

SEQ ID NO: 152261 - DNA, 103 bp, Artificial Sequence
  Synthetic Polynucleotide
taatacgactcactatagggggtccagagccttgaggatgaagcggtccaaacagaggagatggaccatgtcatcctcaaacctggcggcagcgcaaaagatg

SEQ ID NO: 152262 - DNA, 103 bp, Artificial Sequence
  Synthetic Polynucleotide
taatacgactcactatagggtgccagtggcggtccagagccttgaggatgaacagaggagacatcctatgggctctggaaacctggcggcagcgcaaaagatg

SEQ ID NO: 152263 - DNA, 103 bp, Artificial Sequence
  Synthetic Polynucleotide
taatacgactcactatagggacacttgctgtgccagtggcggtccagagcaacagaggagagctctgatgcgccactggaacctggcggcagcgcaaaagatg

SEQ ID NO: 152264 - DNA, 103 bp, Artificial Sequence
  Synthetic Polynucleotide
taatacgactcactatagggtgcacttgagacacttgctgtgccagtggcaacagaggagagccactatgacagcaagtaacctggcggcagcgcaaaagatg

SEQ ID NO: 152265 - DNA, 103 bp, Artificial Sequence
  Synthetic Polynucleotide
taatacgactcactatagggtggcagtcgctgcacttgagacacttgctgaacagaggagacagcaaatgtctcaagtgaacctggcggcagcgcaaaagatg

SEQ ID NO: 152266 - DNA, 103 bp, Artificial Sequence
  Synthetic Polynucleotide
taatacgactcactatagggcagtggcgtgtggcagtcgctgcacttgagaacagaggagactcaagatgagcgactgcaacctggcggcagcgcaaaagatg

SEQ ID NO: 152267 - DNA, 103 bp, Artificial Sequence
  Synthetic Polynucleotide
taatacgactcactatagggccgactcccgggccgggcccagctccccgcaacagaggagagcggggatgtgggcccggaacctggcggcagcgcaaaagatg

SEQ ID NO: 152268 - DNA, 103 bp, Artificial Sequence
  Synthetic Polynucleotide
taatacgactcactatagggagcgctcggccagtggcgtgtggcagtcgcaacagaggagagcgactatgacacgccacaacctggcggcagcgcaaaagatg

SEQ ID NO: 152269 - DNA, 103 bp, Artificial Sequence
  Synthetic Polynucleotide
taatacgactcactatagggcggctgaagcagcgctcggccagtggcgtgaacagaggagacacgccatgggccgagcgaacctggcggcagcgcaaaagatg

SEQ ID NO: 152270 - DNA, 103 bp, Artificial Sequence
  Synthetic Polynucleotide
taatacgactcactataggggctctcccctcggctgaagcagcgctcggcaacagaggagagccgagatgtgcttcagcaacctggcggcagcgcaaaagatg

SEQ ID NO: 152271 - DNA, 103 bp, Artificial Sequence
  Synthetic Polynucleotide
taatacgactcactatagggtgcagtaaacgctctcccctcggctgaagcaacagaggagagcttcaatggaggggagaaacctggcggcagcgcaaaagatg

SEQ ID NO: 152272 - DNA, 103 bp, Artificial Sequence
  Synthetic Polynucleotide
taatacgactcactatagggaagtcgtccttgcagtaaacgctctcccctaacagaggagaaggggaatgcgtttactgaacctggcggcagcgcaaaagatg

SEQ ID NO: 152273 - DNA, 103 bp, Artificial Sequence
  Synthetic Polynucleotide
taatacgactcactataggggcgcttgaaaaagtcgtccttgcagtaaacaacagaggagagtttacatgaaggacgacaacctggcggcagcgcaaaagatg

SEQ ID NO: 152274 - DNA, 103 bp, Artificial Sequence
  Synthetic Polynucleotide
taatacgactcactatagggtggtcccgaagcgcttgaaaaagtcgtcctaacagaggagaaggacgatgttttcaagcaacctggcggcagcgcaaaagatg

SEQ ID NO: 152275 - DNA, 103 bp, Artificial Sequence
  Synthetic Polynucleotide
taatacgactcactataggggcggcgcacttggtcccgaagcgcttgaaaaacagaggagatttcaaatgcttcgggacaacctggcggcagcgcaaaagatg

SEQ ID NO: 152276 - DNA, 103 bp, Artificial Sequence
  Synthetic Polynucleotide
taatacgactcactatagggcagctggcacgcggcgcacttggtcccgaaaacagaggagattcgggatgaagtgcgccaacctggcggcagcgcaaaagatg

SEQ ID NO: 152277 - DNA, 103 bp, Artificial Sequence
  Synthetic Polynucleotide
taatacgactcactataggggcgggatgcccagctggcacgcggcgcactaacagaggagaagtgcgatgcgtgccagcaacctggcggcagcgcaaaagatg

SEQ ID NO: 152278 - DNA, 103 bp, Artificial Sequence
  Synthetic Polynucleotide
taatacgactcactatagggtcgcctcccgccgactcccgggccgggcccaacagaggagagggcccatgccgggagtcaacctggcggcagcgcaaaagatg

SEQ ID NO: 152279 - DNA, 103 bp, Artificial Sequence
  Synthetic Polynucleotide
taatacgactcactatagggacctgcgtgggcgggatgcccagctggcacaacagaggagagtgccaatggggcatcccaacctggcggcagcgcaaaagatg

SEQ ID NO: 152280 - DNA, 103 bp, Artificial Sequence
  Synthetic Polynucleotide
taatacgactcactataggggcggcgcaccacctgcgtgggcgggatgccaacagaggagaggcatcatgcccacgcagaacctggcggcagcgcaaaagatg

SEQ ID NO: 152281 - DNA, 103 bp, Artificial Sequence
  Synthetic Polynucleotide
taatacgactcactatagggagtcctgggcgcggcgcaccacctgcgtggaacagaggagaccacgcatgtggtgcgccaacctggcggcagcgcaaaagatg

SEQ ID NO: 152282 - DNA, 103 bp, Artificial Sequence
  Synthetic Polynucleotide
taatacgactcactatagggtggtacacgaagtcctgggcgcggcgcaccaacagaggagaggtgcgatgcgcccaggaaacctggcggcagcgcaaaagatg

SEQ ID NO: 152283 - DNA, 103 bp, Artificial Sequence
  Synthetic Polynucleotide
taatacgactcactataggggcagtgcaggtggtacacgaagtcctgggcaacagaggagagcccagatgttcgtgtacaacctggcggcagcgcaaaagatg

SEQ ID NO: 152284 - DNA, 103 bp, Artificial Sequence
  Synthetic Polynucleotide
taatacgactcactatagggcgcaggcaaagcagtgcaggtggtacacgaaacagaggagatcgtgtatgacctgcactaacctggcggcagcgcaaaagatg

SEQ ID NO: 152285 - DNA, 103 bp, Artificial Sequence
  Synthetic Polynucleotide
taatacgactcactatagggttgcacacgacgcaggcaaagcagtgcaggaacagaggagacctgcaatgctttgcctgaacctggcggcagcgcaaaagatg

SEQ ID NO: 152286 - DNA, 103 bp, Artificial Sequence
  Synthetic Polynucleotide
taatacgactcactatagggcagctgccgcttgcacacgacgcaggcaaaaacagaggagatttgccatggtcgtgtgcaacctggcggcagcgcaaaagatg

SEQ ID NO: 152287 - DNA, 103 bp, Artificial Sequence
  Synthetic Polynucleotide
taatacgactcactatagggcgcccgtggccagctgccgcttgcacacgaaacagaggagatcgtgtatgagcggcagcaacctggcggcagcgcaaaagatg

SEQ ID NO: 152288 - DNA, 103 bp, Artificial Sequence
  Synthetic Polynucleotide
taatacgactcactatagggtagaactcgtcgcccgtggccagctgccgcaacagaggagagcggcaatgggccacgggaacctggcggcagcgcaaaagatg

SEQ ID NO: 152289 - DNA, 103 bp, Artificial Sequence
  Synthetic Polynucleotide
taatacgactcactatagggtagcagcaggtcgcctcccgccgactcccgaacagaggagacgggagatggcgggaggcaacctggcggcagcgcaaaagatg

SEQ ID NO: 152290 - DNA, 103 bp, Artificial Sequence
  Synthetic Polynucleotide
taatacgactcactatagggctccatgaggtagaactcgtcgcccgtggcaacagaggagagccacgatggacgagttcaacctggcggcagcgcaaaagatg

SEQ ID NO: 152291 - DNA, 103 bp, Artificial Sequence
  Synthetic Polynucleotide
taatacgactcactataggggccggctgtcctccatgaggtagaactcgtaacagaggagaacgagtatgacctcatggaacctggcggcagcgcaaaagatg

SEQ ID NO: 152292 - DNA, 103 bp, Artificial Sequence
  Synthetic Polynucleotide
taatacgactcactatagggttgcacacgagccggctgtcctccatgaggaacagaggagacctcatatgggacagccgaacctggcggcagcgcaaaagatg

SEQ ID NO: 152293 - DNA, 103 bp, Artificial Sequence
  Synthetic Polynucleotide
taatacgactcactataggggtagtccgccttgcacacgagccggctgtcaacagaggagagacagcatgctcgtgtgcaacctggcggcagcgcaaaagatg

SEQ ID NO: 152294 - DNA, 103 bp, Artificial Sequence
  Synthetic Polynucleotide
taatacgactcactatagggtggcggtttcgtagtccgccttgcacacgaaacagaggagatcgtgtatgaggcggactaacctggcggcagcgcaaaagatg

SEQ ID NO: 152295 - DNA, 103 bp, Artificial Sequence
  Synthetic Polynucleotide
taatacgactcactatagggtctcgctgcttggcggtttcgtagtccgccaacagaggagaggcggaatgcgaaaccgcaacctggcggcagcgcaaaagatg

SEQ ID NO: 152296 - DNA, 103 bp, Artificial Sequence
  Synthetic Polynucleotide
taatacgactcactatagggggcctcggcctctcgctgcttggcggtttcaacagaggagagaaaccatgaagcagcgaaacctggcggcagcgcaaaagatg

SEQ ID NO: 152297 - DNA, 103 bp, Artificial Sequence
  Synthetic Polynucleotide
taatacgactcactataggggcttggccgtggcctcggcctctcgctgctaacagaggagaagcagcatgaggccgaggaacctggcggcagcgcaaaagatg

SEQ ID NO: 152298 - DNA, 103 bp, Artificial Sequence
  Synthetic Polynucleotide
taatacgactcactataggggtgcgcggccgcttggccgtggcctcggccaacagaggagaggccgaatgcacggccaaaacctggcggcagcgcaaaagatg

SEQ ID NO: 152299 - DNA, 103 bp, Artificial Sequence
  Synthetic Polynucleotide
taatacgactcactatagggggtgatggtcgtgcgcggccgcttggccgtaacagaggagaacggccatgcggccgcgcaacctggcggcagcgcaaaagatg

SEQ ID NO: 152300 - DNA, 103 bp, Artificial Sequence
  Synthetic Polynucleotide
taatacgactcactatagggccagcagtgctagcagcaggtcgcctcccgaacagaggagacgggagatgacctgctgcaacctggcggcagcgcaaaagatg

SEQ ID NO: 152301 - DNA, 103 bp, Artificial Sequence
  Synthetic Polynucleotide
taatacgactcactataggggctgcttggcggtgatggtcgtgcgcggccaacagaggagaggccgcatgcgaccatcaaacctggcggcagcgcaaaagatg

SEQ ID NO: 152302 - DNA, 103 bp, Artificial Sequence
  Synthetic Polynucleotide
taatacgactcactatagggagcgtctccagctgcttggcggtgatggtcaacagaggagagaccatatgcgccaagcaaacctggcggcagcgcaaaagatg

SEQ ID NO: 152303 - DNA, 103 bp, Artificial Sequence
  Synthetic Polynucleotide
taatacgactcactatagggagcgctcttcagcgtctccagctgcttggcaacagaggagagccaagatgctggagacgaacctggcggcagcgcaaaagatg

SEQ ID NO: 152304 - DNA, 103 bp, Artificial Sequence
  Synthetic Polynucleotide
taatacgactcactatagggaggtgttgtaagcgctcttcagcgtctccaaacagaggagatggagaatgtgaagagcgaacctggcggcagcgcaaaagatg

SEQ ID NO: 152305 - DNA, 103 bp, Artificial Sequence
  Synthetic Polynucleotide
taatacgactcactatagggggcttgggcgaggtgttgtaagcgctcttcaacagaggagagaagagatgttacaacacaacctggcggcagcgcaaaagatg

SEQ ID NO: 152306 - DNA, 103 bp, Artificial Sequence
  Synthetic Polynucleotide
taatacgactcactataggggtggcgcgccggcttgggcgaggtgttgtaaacagaggagatacaacatgtcgcccaagaacctggcggcagcgcaaaagatg

SEQ ID NO: 152307 - DNA, 103 bp, Artificial Sequence
  Synthetic Polynucleotide
taatacgactcactataggggctcgcgcacgtggcgcgccggcttgggcgaacagaggagacgcccaatgcggcgcgccaacctggcggcagcgcaaaagatg

SEQ ID NO: 152308 - DNA, 103 bp, Artificial Sequence
  Synthetic Polynucleotide
taatacgactcactataggggacgagagctgctcgcgcacgtggcgcgccaacagaggagaggcgcgatgcgtgcgcgaaacctggcggcagcgcaaaagatg

SEQ ID NO: 152309 - DNA, 103 bp, Artificial Sequence
  Synthetic Polynucleotide
taatacgactcactataggggcccgtctcggacgagagctgctcgcgcacaacagaggagagtgcgcatgcagctctcgaacctggcggcagcgcaaaagatg

SEQ ID NO: 152310 - DNA, 103 bp, Artificial Sequence
  Synthetic Polynucleotide
taatacgactcactataggggcatgtccaggcccgtctcggacgagagctaacagaggagaagctctatgccgagacggaacctggcggcagcgcaaaagatg

SEQ ID NO: 152311 - DNA, 103 bp, Artificial Sequence
  Synthetic Polynucleotide
taatacgactcactataggggccctccgcgccagcagtgctagcagcaggaacagaggagacctgctatgagcactgctaacctggcggcagcgcaaaagatg

SEQ ID NO: 152312 - DNA, 103 bp, Artificial Sequence
  Synthetic Polynucleotide
taatacgactcactatagggtgcaccacgcgcatgtccaggcccgtctcgaacagaggagacgagacatgcctggacataacctggcggcagcgcaaaagatg

SEQ ID NO: 152313 - DNA, 103 bp, Artificial Sequence
  Synthetic Polynucleotide
taatacgactcactataggggaaccaaacctgcaccacgcgcatgtccagaacagaggagactggacatgcgcgtggtgaacctggcggcagcgcaaaagatg

SEQ ID NO: 152314 - DNA, 103 bp, Artificial Sequence
  Synthetic Polynucleotide
taatacgactcactatagggggcggttctggaaccaaacctgcaccacgcaacagaggagagcgtggatgaggtttggtaacctggcggcagcgcaaaagatg

SEQ ID NO: 152315 - DNA, 103 bp, Artificial Sequence
  Synthetic Polynucleotide
taatacgactcactatagggtccttggcccggcggttctggaaccaaaccaacagaggagaggtttgatgccagaaccgaacctggcggcagcgcaaaagatg

SEQ ID NO: 152316 - DNA, 103 bp, Artificial Sequence
  Synthetic Polynucleotide
taatacgactcactatagggcagcctcttctccttggcccggcggttctgaacagaggagacagaacatgcgggccaagaacctggcggcagcgcaaaagatg

SEQ ID NO: 152317 - DNA, 103 bp, Artificial Sequence
  Synthetic Polynucleotide
taatacgactcactatagggcgtccttcttcagcctcttctccttggcccaacagaggagagggccaatgagaagaggcaacctggcggcagcgcaaaagatg

SEQ ID NO: 152318 - DNA, 103 bp, Artificial Sequence
  Synthetic Polynucleotide
taatacgactcactatagggtgccggccggcgtccttcttcagcctcttcaacagaggagagaagagatggaagaaggaaacctggcggcagcgcaaaagatg

SEQ ID NO: 152319 - DNA, 103 bp, Artificial Sequence
  Synthetic Polynucleotide
taatacgactcactatagggcccccagcgctgccggccggcgtccttcttaacagaggagaaagaagatggccggccggaacctggcggcagcgcaaaagatg

SEQ ID NO: 152320 - DNA, 103 bp, Artificial Sequence
  Synthetic Polynucleotide
taatacgactcactatagggggaaatactgcccccagcgctgccggccggaacagaggagaccggccatgagcgctgggaacctggcggcagcgcaaaagatg

SEQ ID NO: 152321 - DNA, 103 bp, Artificial Sequence
  Synthetic Polynucleotide
taatacgactcactatagggttcatgttgcggaaatactgcccccagcgcaacagaggagagcgctgatggcagtatttaacctggcggcagcgcaaaagatg

SEQ ID NO: 152322 - DNA, 103 bp, Artificial Sequence
  Synthetic Polynucleotide
taatacgactcactataggggcgcaggtccgccctccgcgccagcagtgcaacagaggagagcactgatggcgcggaggaacctggcggcagcgcaaaagatg

SEQ ID NO: 152323 - DNA, 103 bp, Artificial Sequence
  Synthetic Polynucleotide
taatacgactcactataggggcgggagcgcttcatgttgcggaaatactgaacagaggagacagtatatgcgcaacatgaacctggcggcagcgcaaaagatg

SEQ ID NO: 152324 - DNA, 103 bp, Artificial Sequence
  Synthetic Polynucleotide
taatacgactcactatagggtggagccgccgcgggagcgcttcatgttgcaacagaggagagcaacaatgagcgctcccaacctggcggcagcgcaaaagatg

SEQ ID NO: 152325 - DNA, 103 bp, Artificial Sequence
  Synthetic Polynucleotide
taatacgactcactatagggttgtccgacttggagccgccgcgggagcgcaacagaggagagcgctcatgcggcggctcaacctggcggcagcgcaaaagatg

SEQ ID NO: 152326 - DNA, 103 bp, Artificial Sequence
  Synthetic Polynucleotide
taatacgactcactatagggaacgctgtccttgtccgacttggagccgccaacagaggagaggcggcatgaagtcggacaacctggcggcagcgcaaaagatg

SEQ ID NO: 152327 - DNA, 103 bp, Artificial Sequence
  Synthetic Polynucleotide
taatacgactcactataggggcccctcctgaacgctgtccttgtccgactaacagaggagaagtcggatgaggacagcgaacctggcggcagcgcaaaagatg

SEQ ID NO: 152328 - DNA, 103 bp, Artificial Sequence
  Synthetic Polynucleotide
taatacgactcactatagggtcgctgtcctgcccctcctgaacgctgtccaacagaggagaggacagatgtcaggagggaacctggcggcagcgcaaaagatg

SEQ ID NO: 152329 - DNA, 103 bp, Artificial Sequence
  Synthetic Polynucleotide
taatacgactcactataggggacctcagcgtcgctgtcctgcccctcctgaacagaggagacaggagatgcaggacagcaacctggcggcagcgcaaaagatg

SEQ ID NO: 152330 - DNA, 103 bp, Artificial Sequence
  Synthetic Polynucleotide
taatacgactcactatagggcggggaaggagacctcagcgtcgctgtcctaacagaggagaaggacaatgacgctgaggaacctggcggcagcgcaaaagatg

SEQ ID NO: 152331 - DNA, 103 bp, Artificial Sequence
  Synthetic Polynucleotide
taatacgactcactataggggaaggctcatcggggaaggagacctcagcgaacagaggagacgctgaatgctccttcccaacctggcggcagcgcaaaagatg

SEQ ID NO: 152332 - DNA, 103 bp, Artificial Sequence
  Synthetic Polynucleotide
taatacgactcactatagggttccgccaaggaaggctcatcggggaaggaaacagaggagatccttcatggatgagcctaacctggcggcagcgcaaaagatg

SEQ ID NO: 152333 - DNA, 103 bp, Artificial Sequence
  Synthetic Polynucleotide
taatacgactcactatagggggatctctcggcgcaggtccgccctccgcgaacagaggagacgcggaatgcggacctgcaacctggcggcagcgcaaaagatg

SEQ ID NO: 152334 - DNA, 103 bp, Artificial Sequence
  Synthetic Polynucleotide
taatacgactcactatagggccgggcccatttccgccaaggaaggctcataacagaggagaatgagcatgccttggcggaacctggcggcagcgcaaaagatg

SEQ ID NO: 152335 - DNA, 103 bp, Artificial Sequence
  Synthetic Polynucleotide
taatacgactcactatagggaggccattggccgggcccatttccgccaagaacagaggagacttggcatgaatgggcccaacctggcggcagcgcaaaagatg

SEQ ID NO: 152336 - DNA, 103 bp, Artificial Sequence
  Synthetic Polynucleotide
taatacgactcactataggggctcccgtagaggccattggccgggcccataacagaggagaatgggcatggccaatggcaacctggcggcagcgcaaaagatg

SEQ ID NO: 152337 - DNA, 103 bp, Artificial Sequence
  Synthetic Polynucleotide
taatacgactcactataggggttcccccaagctcccgtagaggccattggaacagaggagaccaatgatgtctacgggaaacctggcggcagcgcaaaagatg

SEQ ID NO: 152338 - DNA, 103 bp, Artificial Sequence
  Synthetic Polynucleotide
taatacgactcactataggggcctgggtgggttcccccaagctcccgtagaacagaggagactacggatgcttgggggaaacctggcggcagcgcaaaagatg

SEQ ID NO: 152339 - DNA, 103 bp, Artificial Sequence
  Synthetic Polynucleotide
taatacgactcactatagggccggcccaaggcctgggtgggttcccccaaaacagaggagattggggatgcccacccagaacctggcggcagcgcaaaagatg

SEQ ID NO: 152340 - DNA, 103 bp, Artificial Sequence
  Synthetic Polynucleotide
taatacgactcactatagggctcccgagggccggcccaaggcctgggtggaacagaggagaccacccatgccttgggccaacctggcggcagcgcaaaagatg

SEQ ID NO: 152341 - DNA, 103 bp, Artificial Sequence
  Synthetic Polynucleotide
taatacgactcactatagggttgcccagggctcccgagggccggcccaagaacagaggagacttgggatggccctcgggaacctggcggcagcgcaaaagatg

SEQ ID NO: 152342 - DNA, 103 bp, Artificial Sequence
  Synthetic Polynucleotide
taatacgactcactatagggcagggagaagttgcccagggctcccgagggaacagaggagaccctcgatggccctgggcaacctggcggcagcgcaaaagatg

SEQ ID NO: 152343 - DNA, 103 bp, Artificial Sequence
  Synthetic Polynucleotide
taatacgactcactatagggctccatgctccagggagaagttgcccagggaacagaggagaccctggatgacttctcccaacctggcggcagcgcaaaagatg

SEQ ID NO: 152344 - DNA, 103 bp, Artificial Sequence
  Synthetic Polynucleotide
taatacgactcactataggggcgcacagcgggatctctcggcgcaggtccaacagaggagaggacctatgccgagagataacctggcggcagcgcaaaagatg

SEQ ID NO: 152345 - DNA, 103 bp, Artificial Sequence
  Synthetic Polynucleotide
taatacgactcactatagggcctgccaggcctccatgctccagggagaagaacagaggagacttctcatgggagcatggaacctggcggcagcgcaaaagatg

SEQ ID NO: 152346 - DNA, 103 bp, Artificial Sequence
  Synthetic Polynucleotide
taatacgactcactatagggctgctctgggcctgccaggcctccatgctcaacagaggagagagcatatgggcctggcaaacctggcggcagcgcaaaagatg

SEQ ID NO: 152347 - DNA, 103 bp, Artificial Sequence
  Synthetic Polynucleotide
taatacgactcactataggggctctcggtactgctctgggcctgccaggcaacagaggagagcctggatggcccagagcaacctggcggcagcgcaaaagatg

SEQ ID NO: 152348 - DNA, 103 bp, Artificial Sequence
  Synthetic Polynucleotide
taatacgactcactatagggccgggacgcagctctcggtactgctctgggaacagaggagacccagaatggtaccgagaaacctggcggcagcgcaaaagatg

SEQ ID NO: 152349 - DNA, 103 bp, Artificial Sequence
  Synthetic Polynucleotide
taatacgactcactataggggtaggggctgccgggacgcagctctcggtaaacagaggagataccgaatgctgcgtcccaacctggcggcagcgcaaaagatg

SEQ ID NO: 152350 - DNA, 103 bp, Artificial Sequence
  Synthetic Polynucleotide
taatacgactcactataggggggggacaccgtaggggctgccgggacgcaaacagaggagatgcgtcatggcagcccctaacctggcggcagcgcaaaagatg

SEQ ID NO: 152351 - DNA, 103 bp, Artificial Sequence
  Synthetic Polynucleotide
taatacgactcactataggggcgggggatggggggacaccgtaggggctgaacagaggagacagcccatgcggtgtcccaacctggcggcagcgcaaaagatg

SEQ ID NO: 152352 - DNA, 103 bp, Artificial Sequence
  Synthetic Polynucleotide
taatacgactcactatagggctgcggggcggcgggggatggggggacaccaacagaggagaggtgtcatgccatcccccaacctggcggcagcgcaaaagatg

SEQ ID NO: 152353 - DNA, 103 bp, Artificial Sequence
  Synthetic Polynucleotide
taatacgactcactatagggcagggaggctctgcggggcggcgggggatgaacagaggagacatcccatgccgccccgcaacctggcggcagcgcaaaagatg

SEQ ID NO: 152354 - DNA, 103 bp, Artificial Sequence
  Synthetic Polynucleotide
taatacgactcactatagggggctgggggccagggaggctctgcggggcgaacagaggagacgccccatggagcctcccaacctggcggcagcgcaaaagatg

SEQ ID NO: 152355 - DNA, 103 bp, Artificial Sequence
  Synthetic Polynucleotide
taatacgactcactatagggggccgcctggtaaggtcctggaaccgacataacagaggagaatgtcgatgccaggacctaacctggcggcagcgcaaaagatg

SEQ ID NO: 152356 - DNA, 103 bp, Artificial Sequence
  Synthetic Polynucleotide
taatacgactcactatagggcatgggagctggaggtgtggggtaataactaacagaggagaagttatatgcccacacctaacctggcggcagcgcaaaagatg

SEQ ID NO: 152357 - DNA, 103 bp, Artificial Sequence
  Synthetic Polynucleotide
taatacgactcactatagggttggcccaggcatgggagctggaggtgtggaacagaggagaccacacatgcagctcccaaacctggcggcagcgcaaaagatg

SEQ ID NO: 152358 - DNA, 103 bp, Artificial Sequence
  Synthetic Polynucleotide
taatacgactcactatagggagccccgtagttggcccaggcatgggagctaacagaggagaagctccatggcctgggccaacctggcggcagcgcaaaagatg

SEQ ID NO: 152359 - DNA, 103 bp, Artificial Sequence
  Synthetic Polynucleotide
taatacgactcactatagggccccgtcacaagccccgtagttggcccaggaacagaggagacctgggatgactacggggaacctggcggcagcgcaaaagatg

SEQ ID NO: 152360 - DNA, 103 bp, Artificial Sequence
  Synthetic Polynucleotide
taatacgactcactatagggtcccatcaggccccgtcacaagccccgtagaacagaggagactacggatgttgtgacggaacctggcggcagcgcaaaagatg

SEQ ID NO: 152361 - DNA, 103 bp, Artificial Sequence
  Synthetic Polynucleotide
taatacgactcactatagggttcatgcccttcccatcaggccccgtcacaaacagaggagatgtgacatggcctgatggaacctggcggcagcgcaaaagatg

SEQ ID NO: 152362 - DNA, 103 bp, Artificial Sequence
  Synthetic Polynucleotide
taatacgactcactatagggcgaaggaggattcatgcccttcccatcaggaacagaggagacctgatatgaagggcatgaacctggcggcagcgcaaaagatg

SEQ ID NO: 152363 - DNA, 103 bp, Artificial Sequence
  Synthetic Polynucleotide
taatacgactcactataggggggtataatacgaaggaggattcatgccctaacagaggagaagggcaatgatcctccttaacctggcggcagcgcaaaagatg

SEQ ID NO: 152364 - DNA, 103 bp, Artificial Sequence
  Synthetic Polynucleotide
taatacgactcactatagggggcgctggctgggtataatacgaaggaggaaacagaggagatcctccatggtattatacaacctggcggcagcgcaaaagatg

SEQ ID NO: 152365 - DNA, 103 bp, Artificial Sequence
  Synthetic Polynucleotide
taatacgactcactatagggattggggatgggcgctggctgggtataataaacagaggagatattatatgcagccagcgaacctggcggcagcgcaaaagatg

SEQ ID NO: 152366 - DNA, 103 bp, Artificial Sequence
  Synthetic Polynucleotide
taatacgactcactatagggaaggcccagtggccgcctggtaaggtcctgaacagaggagacaggacatgaccaggcggaacctggcggcagcgcaaaagatg

SEQ ID NO: 152367 - DNA, 103 bp, Artificial Sequence
  Synthetic Polynucleotide
taatacgactcactatagggttggattgttattggggatgggcgctggctaacagaggagaagccagatgccatccccaaacctggcggcagcgcaaaagatg

SEQ ID NO: 152368 - DNA, 103 bp, Artificial Sequence
  Synthetic Polynucleotide
taatacgactcactatagggtgcacggtaattggattgttattggggatgaacagaggagacatcccatgtaacaatccaacctggcggcagcgcaaaagatg

SEQ ID NO: 152369 - DNA, 103 bp, Artificial Sequence
  Synthetic Polynucleotide
taatacgactcactataggggtagaccgtctgcacggtaattggattgttaacagaggagaaacaatatgattaccgtgaacctggcggcagcgcaaaagatg

SEQ ID NO: 152370 - DNA, 103 bp, Artificial Sequence
  Synthetic Polynucleotide
taatacgactcactatagggggtgctgcacgtagaccgtctgcacggtaaaacagaggagattaccgatgagacggtctaacctggcggcagcgcaaaagatg

SEQ ID NO: 152371 - DNA, 103 bp, Artificial Sequence
  Synthetic Polynucleotide
taatacgactcactatagggaaggtgatggggtgctgcacgtagaccgtcaacagaggagagacggtatgcgtgcagcaaacctggcggcagcgcaaaagatg

SEQ ID NO: 152372 - DNA, 103 bp, Artificial Sequence
  Synthetic Polynucleotide
taatacgactcactataggggcggtccaaaaaggtgatggggtgctgcacaacagaggagagtgcagatgcccatcaccaacctggcggcagcgcaaaagatg

SEQ ID NO: 152373 - DNA, 103 bp, Artificial Sequence
  Synthetic Polynucleotide
taatacgactcactatagggtttggatagggcggtccaaaaaggtgatggaacagaggagaccatcaatgttttggaccaacctggcggcagcgcaaaagatg

SEQ ID NO: 152374 - DNA, 103 bp, Artificial Sequence
  Synthetic Polynucleotide
taatacgactcactatagggggacaacacatttggatagggcggtccaaaaacagaggagatttggaatgccctatccaaacctggcggcagcgcaaaagatg

SEQ ID NO: 152375 - DNA, 103 bp, Artificial Sequence
  Synthetic Polynucleotide
taatacgactcactataggggttgcaggaaggacaacacatttggataggaacagaggagacctatcatgatgtgttgtaacctggcggcagcgcaaaagatg

SEQ ID NO: 152376 - DNA, 103 bp, Artificial Sequence
  Synthetic Polynucleotide
taatacgactcactatagggcgatcatcttgttgcaggaaggacaacacaaacagaggagatgtgttatgcttcctgcaaacctggcggcagcgcaaaagatg

SEQ ID NO: 152377 - DNA, 103 bp, Artificial Sequence
  Synthetic Polynucleotide
taatacgactcactatagggggtgctgaggaaggcccagtggccgcctggaacagaggagaccaggcatgcactgggccaacctggcggcagcgcaaaagatg

SEQ ID NO: 152378 - DNA, 103 bp, Artificial Sequence
  Synthetic Polynucleotide
taatacgactcactatagggagctgactcacgatcatcttgttgcaggaaaacagaggagattcctgatgcaagatgataacctggcggcagcgcaaaagatg

SEQ ID NO: 152379 - DNA, 103 bp, Artificial Sequence
  Synthetic Polynucleotide
taatacgactcactataggggttataggacagctgactcacgatcatcttaacagaggagaaagatgatggtgagtcagaacctggcggcagcgcaaaagatg

SEQ ID NO: 152380 - DNA, 103 bp, Artificial Sequence
  Synthetic Polynucleotide
taatacgactcactataggggagcaccggcgttataggacagctgactcaaacagaggagatgagtcatgtgtcctataaacctggcggcagcgcaaaagatg

SEQ ID NO: 152381 - DNA, 103 bp, Artificial Sequence
  Synthetic Polynucleotide
taatacgactcactatagggagccaggtcagagcaccggcgttataggacaacagaggagagtcctaatgcgccggtgcaacctggcggcagcgcaaaagatg

SEQ ID NO: 152382 - DNA, 103 bp, Artificial Sequence
  Synthetic Polynucleotide
taatacgactcactatagggcccgcaggacagccaggtcagagcaccggcaacagaggagagccggtatgctgacctggaacctggcggcagcgcaaaagatg

SEQ ID NO: 152383 - DNA, 103 bp, Artificial Sequence
  Synthetic Polynucleotide
taatacgactcactatagggggcacaggctcccgcaggacagccaggtcaaacagaggagatgacctatgtgtcctgcgaacctggcggcagcgcaaaagatg

SEQ ID NO: 152384 - DNA, 103 bp, Artificial Sequence
  Synthetic Polynucleotide
taatacgactcactatagggcaccccagcaggcacaggctcccgcaggacaacagaggagagtcctgatggagcctgtgaacctggcggcagcgcaaaagatg

SEQ ID NO: 152385 - DNA, 103 bp, Artificial Sequence
  Synthetic Polynucleotide
taatacgactcactataggggcccgctatgcaccccagcaggcacaggctaacagaggagaagcctgatgctgctggggaacctggcggcagcgcaaaagatg

SEQ ID NO: 152386 - DNA, 103 bp, Artificial Sequence
  Synthetic Polynucleotide
taatacgactcactatagggtgaagcagcagcccgctatgcaccccagcaaacagaggagatgctggatggcatagcggaacctggcggcagcgcaaaagatg

SEQ ID NO: 152387 - DNA, 103 bp, Artificial Sequence
  Synthetic Polynucleotide
taatacgactcactatagggcagaaggggatgaagcagcagcccgctatgaacagaggagacatagcatgctgctgcttaacctggcggcagcgcaaaagatg

SEQ ID NO: 152388 - DNA, 103 bp, Artificial Sequence
  Synthetic Polynucleotide
taatacgactcactatagggaggtgcggatggtgctgaggaaggcccagtaacagaggagaactgggatgtcctcagcaaacctggcggcagcgcaaaagatg

SEQ ID NO: 152389 - DNA, 103 bp, Artificial Sequence
  Synthetic Polynucleotide
taatacgactcactatagggggcatccacgcagaaggggatgaagcagcaaacagaggagatgctgcatgatccccttcaacctggcggcagcgcaaaagatg

SEQ ID NO: 152390 - DNA, 103 bp, Artificial Sequence
  Synthetic Polynucleotide
taatacgactcactatagggcgtcctgcagggcatccacgcagaaggggaaacagaggagatcccctatggcgtggatgaacctggcggcagcgcaaaagatg

SEQ ID NO: 152391 - DNA, 103 bp, Artificial Sequence
  Synthetic Polynucleotide
taatacgactcactatagggtaatggtccacgtcctgcagggcatccacgaacagaggagacgtggaatgcctgcaggaaacctggcggcagcgcaaaagatg

SEQ ID NO: 152392 - DNA, 103 bp, Artificial Sequence
  Synthetic Polynucleotide
taatacgactcactataggggttgggacagtaatggtccacgtcctgcagaacagaggagactgcagatggtggaccataacctggcggcagcgcaaaagatg

SEQ ID NO: 152393 - DNA, 103 bp, Artificial Sequence
  Synthetic Polynucleotide
taatacgactcactataggggagctctgcagttgggacagtaatggtccaaacagaggagatggaccatgactgtcccaaacctggcggcagcgcaaaagatg

SEQ ID NO: 152394 - DNA, 103 bp, Artificial Sequence
  Synthetic Polynucleotide
taatacgactcactataggggtgcccaggagagctctgcagttgggacagaacagaggagactgtccatgctgcagagcaacctggcggcagcgcaaaagatg

SEQ ID NO: 152395 - DNA, 103 bp, Artificial Sequence
  Synthetic Polynucleotide
taatacgactcactatagggacgcttgtaggtgcccaggagagctctgcaaacagaggagatgcagaatgctcctgggcaacctggcggcagcgcaaaagatg

SEQ ID NO: 152396 - DNA, 103 bp, Artificial Sequence
  Synthetic Polynucleotide
taatacgactcactatagggcataggatggaggtgcggatggtgctgaggaacagaggagacctcagatgcatccgcacaacctggcggcagcgcaaaagatg

SEQ ID NO: 152397 - DNA, 103 bp, Artificial Sequence
  Synthetic Polynucleotide
taatacgactcactatagggactgtctcttcataggatggaggtgcggataacagaggagaatccgcatgtccatcctaaacctggcggcagcgcaaaagatg

SEQ ID NO: 152398 - DNA, 103 bp, Artificial Sequence
  Synthetic Polynucleotide
taatacgactcactataggggttaacagccactgtctcttcataggatggaacagaggagaccatccatggaagagacaaacctggcggcagcgcaaaagatg

SEQ ID NO: 152399 - DNA, 103 bp, Artificial Sequence
  Synthetic Polynucleotide
taatacgactcactatagggggtaataactgttaacagccactgtctcttaacagaggagaaagagaatgtggctgttaaacctggcggcagcgcaaaagatg

SEQ ID NO: 152400 - DNA, 103 bp, Artificial Sequence
  Synthetic Polynucleotide
taatacgactcactatagggggaggtgtggggtaataactgttaacagccaacagaggagaggctgtatgcagttattaaacctggcggcagcgcaaaagatg

SEQ ID NO: 152401 - DNA, 103 bp, Artificial Sequence
  Synthetic Polynucleotide
taatacgactcactatagggctcaaggacagtcaccgcgctcccttccataacagaggagaatggaaatgagcgcggtgaacctggcggcagcgcaaaagatg

SEQ ID NO: 152402 - DNA, 103 bp, Artificial Sequence
  Synthetic Polynucleotide
taatacgactcactatagggtgctcgggcgccgccgccgccgccgccgtcaacagaggagagacggcatgggcggcggcaacctggcggcagcgcaaaagatg

SEQ ID NO: 152403 - DNA, 103 bp, Artificial Sequence
  Synthetic Polynucleotide
taatacgactcactatagggccccctcgggtgctcgggcgccgccgccgcaacagaggagagcggcgatggcgcccgagaacctggcggcagcgcaaaagatg

SEQ ID NO: 152404 - DNA, 103 bp, Artificial Sequence
  Synthetic Polynucleotide
taatacgactcactatagggggggctcggaccccctcgggtgctcgggcgaacagaggagacgcccgatgacccgagggaacctggcggcagcgcaaaagatg

SEQ ID NO: 152405 - DNA, 103 bp, Artificial Sequence
  Synthetic Polynucleotide
taatacgactcactataggggccggctgccggggctcggaccccctcgggaacagaggagacccgagatggtccgagccaacctggcggcagcgcaaaagatg

SEQ ID NO: 152406 - DNA, 103 bp, Artificial Sequence
  Synthetic Polynucleotide
taatacgactcactatagggcgcggggctggccggctgccggggctcggaaacagaggagatccgagatgcggcagccgaacctggcggcagcgcaaaagatg

SEQ ID NO: 152407 - DNA, 103 bp, Artificial Sequence
  Synthetic Polynucleotide
taatacgactcactatagggccctttgtggcgcggggctggccggctgccaacagaggagaggcagcatgccagccccgaacctggcggcagcgcaaaagatg

SEQ ID NO: 152408 - DNA, 103 bp, Artificial Sequence
  Synthetic Polynucleotide
taatacgactcactatagggcgggggcgctccctttgtggcgcggggctgaacagaggagacagcccatggccacaaagaacctggcggcagcgcaaaagatg

SEQ ID NO: 152409 - DNA, 103 bp, Artificial Sequence
  Synthetic Polynucleotide
taatacgactcactatagggtgccgggcggcgggggcgctccctttgtggaacagaggagaccacaaatggagcgccccaacctggcggcagcgcaaaagatg

SEQ ID NO: 152410 - DNA, 103 bp, Artificial Sequence
  Synthetic Polynucleotide
taatacgactcactatagggggaggcggggtgccgggcggcgggggcgctaacagaggagaagcgccatggccgcccggaacctggcggcagcgcaaaagatg

SEQ ID NO: 152411 - DNA, 103 bp, Artificial Sequence
  Synthetic Polynucleotide
taatacgactcactatagggcattggggagggaggcggggtgccgggcggaacagaggagaccgcccatgaccccgcctaacctggcggcagcgcaaaagatg

SEQ ID NO: 152412 - DNA, 103 bp, Artificial Sequence
  Synthetic Polynucleotide
taatacgactcactatagggcccctccgcgctcaaggacagtcaccgcgcaacagaggagagcgcggatgctgtccttgaacctggcggcagcgcaaaagatg

SEQ ID NO: 152413 - DNA, 103 bp, Artificial Sequence
  Synthetic Polynucleotide
taatacgactcactatagggtggccgaggacattggggagggaggcggggaacagaggagaccccgcatgcctccccaaaacctggcggcagcgcaaaagatg

SEQ ID NO: 152414 - DNA, 103 bp, Artificial Sequence
  Synthetic Polynucleotide
taatacgactcactatagggttcctttcgatggccgaggacattggggagaacagaggagactccccatggtcctcggcaacctggcggcagcgcaaaagatg

SEQ ID NO: 152415 - DNA, 103 bp, Artificial Sequence
  Synthetic Polynucleotide
taatacgactcactataggggtccaggctcttcctttcgatggccgaggaaacagaggagatcctcgatgatcgaaaggaacctggcggcagcgcaaaagatg

SEQ ID NO: 152416 - DNA, 103 bp, Artificial Sequence
  Synthetic Polynucleotide
taatacgactcactatagggcctctgaagggtccaggctcttcctttcgaaacagaggagatcgaaaatgagagcctggaacctggcggcagcgcaaaagatg

SEQ ID NO: 152417 - DNA, 103 bp, Artificial Sequence
  Synthetic Polynucleotide
taatacgactcactatagggtccactggttcctctgaagggtccaggctcaacagaggagagagcctatgcccttcagaaacctggcggcagcgcaaaagatg

SEQ ID NO: 152418 - DNA, 103 bp, Artificial Sequence
  Synthetic Polynucleotide
taatacgactcactatagggcagcacctcatccactggttcctctgaaggaacagaggagaccttcaatggaaccagtgaacctggcggcagcgcaaaagatg

SEQ ID NO: 152419 - DNA, 103 bp, Artificial Sequence
  Synthetic Polynucleotide
taatacgactcactataggggggggatctgcagcacctcatccactggttaacagaggagaaaccagatgatgaggtgcaacctggcggcagcgcaaaagatg

SEQ ID NO: 152420 - DNA, 103 bp, Artificial Sequence
  Synthetic Polynucleotide
taatacgactcactatagggagcagggatggggggatctgcagcacctcaaacagaggagatgaggtatggcagatcccaacctggcggcagcgcaaaagatg

SEQ ID NO: 152421 - DNA, 103 bp, Artificial Sequence
  Synthetic Polynucleotide
taatacgactcactataggggccgcatgtcagcagggatggggggatctgaacagaggagacagatcatgccatccctgaacctggcggcagcgcaaaagatg

SEQ ID NO: 152422 - DNA, 103 bp, Artificial Sequence
  Synthetic Polynucleotide
taatacgactcactataggggctggcagccgccgcatgtcagcagggatgaacagaggagacatcccatgtgacatgcgaacctggcggcagcgcaaaagatg

SEQ ID NO: 152423 - DNA, 103 bp, Artificial Sequence
  Synthetic Polynucleotide
taatacgactcactatagggggcgagctcgcccctccgcgctcaaggacaaacagaggagatgtcctatggcgcggaggaacctggcggcagcgcaaaagatg

SEQ ID NO: 152424 - DNA, 103 bp, Artificial Sequence
  Synthetic Polynucleotide
taatacgactcactatagggccaatgttctgctggcagccgccgcatgtcaacagaggagagacatgatgcggctgccaaacctggcggcagcgcaaaagatg

SEQ ID NO: 152425 - DNA, 103 bp, Artificial Sequence
  Synthetic Polynucleotide
taatacgactcactataggggtagcggtccccaatgttctgctggcagccaacagaggagaggctgcatgcagaacattaacctggcggcagcgcaaaagatg

SEQ ID NO: 152426 - DNA, 103 bp, Artificial Sequence
  Synthetic Polynucleotide
taatacgactcactatagggccttcaggaagtagcggtccccaatgttctaacagaggagaagaacaatggggaccgctaacctggcggcagcgcaaaagatg

SEQ ID NO: 152427 - DNA, 103 bp, Artificial Sequence
  Synthetic Polynucleotide
taatacgactcactatagggtggtcgatggccttcaggaagtagcggtccaacagaggagaggaccgatgcttcctgaaaacctggcggcagcgcaaaagatg

SEQ ID NO: 152428 - DNA, 103 bp, Artificial Sequence
  Synthetic Polynucleotide
taatacgactcactataggggtgccagtactggtcgatggccttcaggaaaacagaggagattcctgatggccatcgacaacctggcggcagcgcaaaagatg

SEQ ID NO: 152429 - DNA, 103 bp, Artificial Sequence
  Synthetic Polynucleotide
taatacgactcactatagggggcagtcctcgtgccagtactggtcgatggaacagaggagaccatcgatgagtactggcaacctggcggcagcgcaaaagatg

SEQ ID NO: 152430 - DNA, 103 bp, Artificial Sequence
  Synthetic Polynucleotide
taatacgactcactatagggtcgcagctcaggcagtcctcgtgccagtacaacagaggagagtactgatgcgaggactgaacctggcggcagcgcaaaagatg

SEQ ID NO: 152431 - DNA, 103 bp, Artificial Sequence
  Synthetic Polynucleotide
taatacgactcactataggggccacagaggtcgcagctcaggcagtcctcaacagaggagagaggacatgctgagctgcaacctggcggcagcgcaaaagatg

SEQ ID NO: 152432 - DNA, 103 bp, Artificial Sequence
  Synthetic Polynucleotide
taatacgactcactatagggccagccggcagccacagaggtcgcagctcaaacagaggagatgagctatgacctctgtgaacctggcggcagcgcaaaagatg

SEQ ID NO: 152433 - DNA, 103 bp, Artificial Sequence
  Synthetic Polynucleotide
taatacgactcactatagggcccacctcacccagccggcagccacagaggaacagaggagacctctgatgctgccggctaacctggcggcagcgcaaaagatg

SEQ ID NO: 152434 - DNA, 103 bp, Artificial Sequence
  Synthetic Polynucleotide
taatacgactcactataggggcgctccgccggcgagctcgcccctccgcgaacagaggagacgcggaatggcgagctcgaacctggcggcagcgcaaaagatg

SEQ ID NO: 152435 - DNA, 103 bp, Artificial Sequence
  Synthetic Polynucleotide
taatacgactcactataggggaggcgccgccccacctcacccagccggcaaacagaggagatgccggatgggtgaggtgaacctggcggcagcgcaaaagatg

SEQ ID NO: 152436 - DNA, 103 bp, Artificial Sequence
  Synthetic Polynucleotide
taatacgactcactataggggtttgtagtagaggcgccgccccacctcacaacagaggagagtgaggatgggcggcgccaacctggcggcagcgcaaaagatg

SEQ ID NO: 152437 - DNA, 103 bp, Artificial Sequence
  Synthetic Polynucleotide
taatacgactcactatagggttccggcccagtttgtagtagaggcgccgcaacagaggagagcggcgatgctactacaaaacctggcggcagcgcaaaagatg

SEQ ID NO: 152438 - DNA, 103 bp, Artificial Sequence
  Synthetic Polynucleotide
taatacgactcactatagggccggcagagcttccggcccagtttgtagtaaacagaggagatactacatgctgggccggaacctggcggcagcgcaaaagatg

SEQ ID NO: 152439 - DNA, 103 bp, Artificial Sequence
  Synthetic Polynucleotide
taatacgactcactataggggatagtctctccggcagagcttccggcccaaacagaggagatgggccatgagctctgccaacctggcggcagcgcaaaagatg

SEQ ID NO: 152440 - DNA, 103 bp, Artificial Sequence
  Synthetic Polynucleotide
taatacgactcactatagggaaaagcctgagatagtctctccggcagagcaacagaggagagctctgatggagagactaaacctggcggcagcgcaaaagatg

SEQ ID NO: 152441 - DNA, 103 bp, Artificial Sequence
  Synthetic Polynucleotide
taatacgactcactataggggtcttgcccaaaaagcctgagatagtctctaacagaggagaagagacatgctcaggcttaacctggcggcagcgcaaaagatg

SEQ ID NO: 152442 - DNA, 103 bp, Artificial Sequence
  Synthetic Polynucleotide
taatacgactcactatagggcgcagagaccgtcttgcccaaaaagcctgaaacagaggagatcaggcatgttgggcaagaacctggcggcagcgcaaaagatg

SEQ ID NO: 152443 - DNA, 103 bp, Artificial Sequence
  Synthetic Polynucleotide
taatacgactcactatagggtcacaggatgcgcagagaccgtcttgcccaaacagaggagatgggcaatgcggtctctgaacctggcggcagcgcaaaagatg

SEQ ID NO: 152444 - DNA, 103 bp, Artificial Sequence
  Synthetic Polynucleotide
taatacgactcactatagggaatccgcttgtcacaggatgcgcagagaccaacagaggagaggtctcatggcatcctgtaacctggcggcagcgcaaaagatg

SEQ ID NO: 152445 - DNA, 103 bp, Artificial Sequence
  Synthetic Polynucleotide
taatacgactcactataggggcttgctccggcgctccgccggcgagctcgaacagaggagacgagctatgcggcggagcaacctggcggcagcgcaaaagatg

SEQ ID NO: 152446 - DNA, 103 bp, Artificial Sequence
  Synthetic Polynucleotide
taatacgactcactatagggcataggcacgaatccgcttgtcacaggatgaacagaggagacatcctatgacaagcggaaacctggcggcagcgcaaaagatg

SEQ ID NO: 152447 - DNA, 103 bp, Artificial Sequence
  Synthetic Polynucleotide
taatacgactcactatagggattgtcatctcataggcacgaatccgcttgaacagaggagacaagcgatgtcgtgcctaaacctggcggcagcgcaaaagatg

SEQ ID NO: 152448 - DNA, 103 bp, Artificial Sequence
  Synthetic Polynucleotide
taatacgactcactatagggtttcacccgcattgtcatctcataggcacgaacagaggagacgtgccatggagatgacaaacctggcggcagcgcaaaagatg

SEQ ID NO: 152449 - DNA, 103 bp, Artificial Sequence
  Synthetic Polynucleotide
taatacgactcactatagggacactttgtctttcacccgcattgtcatctaacagaggagaagatgaatgtgcgggtgaaacctggcggcagcgcaaaagatg

SEQ ID NO: 152450 - DNA, 103 bp, Artificial Sequence
  Synthetic Polynucleotide
taatacgactcactatagggtccaggtgatacactttgtctttcacccgcaacagaggagagcgggtatgagacaaagtaacctggcggcagcgcaaaagatg

SEQ ID NO: 152451 - DNA, 103 bp, Artificial Sequence
  Synthetic Polynucleotide
taatacgactcactatagggtttgaaacattccaggtgatacactttgtcaacagaggagagacaaaatgtatcacctgaacctggcggcagcgcaaaagatg

SEQ ID NO: 152452 - DNA, 103 bp, Artificial Sequence
  Synthetic Polynucleotide
taatacgactcactatagggaggcggcgcatttgaaacattccaggtgataacagaggagaatcaccatgaatgtttcaaacctggcggcagcgcaaaagatg

SEQ ID NO: 152453 - DNA, 103 bp, Artificial Sequence
  Synthetic Polynucleotide
taatacgactcactatagggtgcttctgacaggcggcgcatttgaaacataacagaggagaatgtttatgatgcgccgcaacctggcggcagcgcaaaagatg

SEQ ID NO: 152454 - DNA, 103 bp, Artificial Sequence
  Synthetic Polynucleotide
taatacgactcactatagggtacacagaaatgcttctgacaggcggcgcaaacagaggagatgcgccatgtgtcagaagaacctggcggcagcgcaaaagatg

SEQ ID NO: 152455 - DNA, 103 bp, Artificial Sequence
  Synthetic Polynucleotide
taatacgactcactatagggatctgtcacctacacagaaatgcttctgacaacagaggagagtcagaatgatttctgtgaacctggcggcagcgcaaaagatg

SEQ ID NO: 152456 - DNA, 103 bp, Artificial Sequence
  Synthetic Polynucleotide
taatacgactcactatagggctgcgcctccgcttgctccggcgctccgccaacagaggagaggcggaatgccggagcaaaacctggcggcagcgcaaaagatg

SEQ ID NO: 152457 - DNA, 103 bp, Artificial Sequence
  Synthetic Polynucleotide
taatacgactcactatagggatgaggaggtatctgtcacctacacagaaaaacagaggagatttctgatgaggtgacagaacctggcggcagcgcaaaagatg

SEQ ID NO: 152458 - DNA, 103 bp, Artificial Sequence
  Synthetic Polynucleotide
taatacgactcactataggggtcagagttgatgaggaggtatctgtcaccaacagaggagaggtgacatgtacctcctcaacctggcggcagcgcaaaagatg

SEQ ID NO: 152459 - DNA, 103 bp, Artificial Sequence
  Synthetic Polynucleotide
taatacgactcactatagggcgcacactatgtcagagttgatgaggaggtaacagaggagaacctccatgtcaactctgaacctggcggcagcgcaaaagatg

SEQ ID NO: 152460 - DNA, 103 bp, Artificial Sequence
  Synthetic Polynucleotide
taatacgactcactatagggatgtcctgttcgcacactatgtcagagttgaacagaggagacaactcatgcatagtgtgaacctggcggcagcgcaaaagatg

SEQ ID NO: 152461 - DNA, 103 bp, Artificial Sequence
  Synthetic Polynucleotide
taatacgactcactatagggccactcgtagatgtcctgttcgcacactataacagaggagaatagtgatggaacaggacaacctggcggcagcgcaaaagatg

SEQ ID NO: 152462 - DNA, 103 bp, Artificial Sequence
  Synthetic Polynucleotide
taatacgactcactatagggtgatcttagtccactcgtagatgtcctgttaacagaggagaaacaggatgtctacgagtaacctggcggcagcgcaaaagatg

SEQ ID NO: 152463 - DNA, 103 bp, Artificial Sequence
  Synthetic Polynucleotide
taatacgactcactatagggatcatcccattgatcttagtccactcgtagaacagaggagactacgaatggactaagataacctggcggcagcgcaaaagatg

SEQ ID NO: 152464 - DNA, 103 bp, Artificial Sequence
  Synthetic Polynucleotide
taatacgactcactataggggccgccgctcctgcgcctccgcttgctccgaacagaggagacggagcatgcggaggcgcaacctggcggcagcgcaaaagatg

SEQ ID NO: 152465 - DNA, 103 bp, Artificial Sequence
  Synthetic Polynucleotide
taatacgactcactatagggcgccgccgtcgccgccgctcctgcgcctccaacagaggagaggaggcatgggagcggcgaacctggcggcagcgcaaaagatg

SEQ ID NO: 152466 - DNA, 103 bp, Artificial Sequence
  Synthetic Polynucleotide
taatacgactcactatagggccgccgccgccgccgccgtcgccgccgctcaacagaggagagagcggatgcgacggcggaacctggcggcagcgcaaaagatg

SEQ ID NO: 152467 - DNA, 103 bp, Artificial Sequence
  Synthetic Polynucleotide
taatacgactcactatagggcggctgcgagctgctgcccggattcaccataacagaggagaatggtgatgccgggcagcaacctggcggcagcgcaaaagatg

SEQ ID NO: 152468 - DNA, 103 bp, Artificial Sequence
  Synthetic Polynucleotide
taatacgactcactataggggtccatggcatagagcagaaagcggtccgcaacagaggagagcggacatgtttctgctcaacctggcggcagcgcaaaagatg

SEQ ID NO: 152469 - DNA, 103 bp, Artificial Sequence
  Synthetic Polynucleotide
taatacgactcactataggggccaatagctgtccatggcatagagcagaaaacagaggagattctgcatgatgccatggaacctggcggcagcgcaaaagatg

SEQ ID NO: 152470 - DNA, 103 bp, Artificial Sequence
  Synthetic Polynucleotide
taatacgactcactatagggcaccggctgtgccaatagctgtccatggcaaacagaggagatgccatatgcagctattgaacctggcggcagcgcaaaagatg

SEQ ID NO: 152471 - DNA, 103 bp, Artificial Sequence
  Synthetic Polynucleotide
taatacgactcactataggggcacttgaggcaccggctgtgccaatagctaacagaggagaagctatatgcacagccggaacctggcggcagcgcaaaagatg

SEQ ID NO: 152472 - DNA, 103 bp, Artificial Sequence
  Synthetic Polynucleotide
taatacgactcactatagggggcagcaggagcacttgaggcaccggctgtaacagaggagaacagccatggcctcaagtaacctggcggcagcgcaaaagatg

SEQ ID NO: 152473 - DNA, 103 bp, Artificial Sequence
  Synthetic Polynucleotide
taatacgactcactatagggagctgcgcctggcagcaggagcacttgaggaacagaggagacctcaaatgctcctgctgaacctggcggcagcgcaaaagatg

SEQ ID NO: 152474 - DNA, 103 bp, Artificial Sequence
  Synthetic Polynucleotide
taatacgactcactataggggatgtcgcccagctgcgcctggcagcaggaaacagaggagatcctgcatgcaggcgcagaacctggcggcagcgcaaaagatg

SEQ ID NO: 152475 - DNA, 103 bp, Artificial Sequence
  Synthetic Polynucleotide
taatacgactcactatagggaggacgtgccgatgtcgcccagctgcgcctaacagaggagaaggcgcatgtgggcgacaaacctggcggcagcgcaaaagatg

SEQ ID NO: 152476 - DNA, 103 bp, Artificial Sequence
  Synthetic Polynucleotide
taatacgactcactatagggttggtgtaacaggacgtgccgatgtcgcccaacagaggagagggcgaatgcggcacgtcaacctggcggcagcgcaaaagatg

SEQ ID NO: 152477 - DNA, 103 bp, Artificial Sequence
  Synthetic Polynucleotide
taatacgactcactatagggcatgccacttttggtgtaacaggacgtgccaacagaggagaggcacgatgtgttacaccaacctggcggcagcgcaaaagatg

SEQ ID NO: 152478 - DNA, 103 bp, Artificial Sequence
  Synthetic Polynucleotide
taatacgactcactatagggtcaccgggggcggctgcgagctgctgcccgaacagaggagacgggcaatggctcgcagcaacctggcggcagcgcaaaagatg

SEQ ID NO: 152479 - DNA, 103 bp, Artificial Sequence
  Synthetic Polynucleotide
taatacgactcactatagggtgcaaaggatcatgccacttttggtgtaacaacagaggagagttacaatgaaagtggcaaacctggcggcagcgcaaaagatg

SEQ ID NO: 152480 - DNA, 103 bp, Artificial Sequence
  Synthetic Polynucleotide
taatacgactcactatagggtagtcatttctgcaaaggatcatgccacttaacagaggagaaagtggatggatcctttgaacctggcggcagcgcaaaagatg

SEQ ID NO: 152481 - DNA, 103 bp, Artificial Sequence
  Synthetic Polynucleotide
taatacgactcactatagggtaacctaatgtagtcatttctgcaaaggataacagaggagaatccttatgagaaatgacaacctggcggcagcgcaaaagatg

SEQ ID NO: 152482 - DNA, 103 bp, Artificial Sequence
  Synthetic Polynucleotide
taatacgactcactatagggtatttccaaataacctaatgtagtcatttcaacagaggagagaaatgatgacattaggtaacctggcggcagcgcaaaagatg

SEQ ID NO: 152483 - DNA, 103 bp, Artificial Sequence
  Synthetic Polynucleotide
taatacgactcactatagggcaagcaccgctatttccaaataacctaatgaacagaggagacattagatgatttggaaaaacctggcggcagcgcaaaagatg

SEQ ID NO: 152484 - DNA, 103 bp, Artificial Sequence
  Synthetic Polynucleotide
taatacgactcactataggggcaagcgctgcaagcaccgctatttccaaaaacagaggagatttggaatgagcggtgctaacctggcggcagcgcaaaagatg

SEQ ID NO: 152485 - DNA, 103 bp, Artificial Sequence
  Synthetic Polynucleotide
taatacgactcactatagggtcgactgtccgcaagcgctgcaagcaccgcaacagaggagagcggtgatggcagcgcttaacctggcggcagcgcaaaagatg

SEQ ID NO: 152486 - DNA, 103 bp, Artificial Sequence
  Synthetic Polynucleotide
taatacgactcactatagggctcgcaggaatcgactgtccgcaagcgctgaacagaggagacagcgcatgcggacagtcaacctggcggcagcgcaaaagatg

SEQ ID NO: 152487 - DNA, 103 bp, Artificial Sequence
  Synthetic Polynucleotide
taatacgactcactataggggacgagttcactcgcaggaatcgactgtccaacagaggagaggacagatgattcctgcgaacctggcggcagcgcaaaagatg

SEQ ID NO: 152488 - DNA, 103 bp, Artificial Sequence
  Synthetic Polynucleotide
taatacgactcactataggggcgccctcatgacgagttcactcgcaggaaaacagaggagattcctgatggtgaactcgaacctggcggcagcgcaaaagatg

SEQ ID NO: 152489 - DNA, 103 bp, Artificial Sequence
  Synthetic Polynucleotide
taatacgactcactataggggagccggccgtcaccgggggcggctgcgagaacagaggagactcgcaatggcccccggtaacctggcggcagcgcaaaagatg

SEQ ID NO: 152490 - DNA, 103 bp, Artificial Sequence
  Synthetic Polynucleotide
taatacgactcactatagggacattgccttgcgccctcatgacgagttcaaacagaggagatgaactatgcatgagggcaacctggcggcagcgcaaaagatg

SEQ ID NO: 152491 - DNA, 103 bp, Artificial Sequence
  Synthetic Polynucleotide
taatacgactcactatagggaagatgatacacattgccttgcgccctcataacagaggagaatgaggatgcaaggcaataacctggcggcagcgcaaaagatg

SEQ ID NO: 152492 - DNA, 103 bp, Artificial Sequence
  Synthetic Polynucleotide
taatacgactcactatagggtaaaacacttaagatgatacacattgccttaacagaggagaaaggcaatgtgtatcatcaacctggcggcagcgcaaaagatg

SEQ ID NO: 152493 - DNA, 103 bp, Artificial Sequence
  Synthetic Polynucleotide
taatacgactcactataggggtagagcatgtaaaacacttaagatgatacaacagaggagagtatcaatgtaagtgtttaacctggcggcagcgcaaaagatg

SEQ ID NO: 152494 - DNA, 103 bp, Artificial Sequence
  Synthetic Polynucleotide
taatacgactcactatagggattccggcaggtagagcatgtaaaacacttaacagaggagaaagtgtatgacatgctctaacctggcggcagcgcaaaagatg

SEQ ID NO: 152495 - DNA, 103 bp, Artificial Sequence
  Synthetic Polynucleotide
taatacgactcactatagggggaccaggcgattccggcaggtagagcatgaacagaggagacatgctatgcctgccggaaacctggcggcagcgcaaaagatg

SEQ ID NO: 152496 - DNA, 103 bp, Artificial Sequence
  Synthetic Polynucleotide
taatacgactcactatagggcgatctcccgggaccaggcgattccggcagaacagaggagactgccgatgtcgcctggtaacctggcggcagcgcaaaagatg

SEQ ID NO: 152497 - DNA, 103 bp, Artificial Sequence
  Synthetic Polynucleotide
taatacgactcactataggggtagtgaaaccgatctcccgggaccaggcgaacagaggagacgcctgatgccgggagataacctggcggcagcgcaaaagatg

SEQ ID NO: 152498 - DNA, 103 bp, Artificial Sequence
  Synthetic Polynucleotide
taatacgactcactatagggtgccattgatgtagtgaaaccgatctcccgaacagaggagacgggagatgggtttcactaacctggcggcagcgcaaaagatg

SEQ ID NO: 152499 - DNA, 103 bp, Artificial Sequence
  Synthetic Polynucleotide
taatacgactcactatagggcaaaataaactgccattgatgtagtgaaacaacagaggagagtttcaatgcatcaatggaacctggcggcagcgcaaaagatg

SEQ ID NO: 152500 - DNA, 103 bp, Artificial Sequence
  Synthetic Polynucleotide
taatacgactcactatagggccaggagagggagccggccgtcaccgggggaacagaggagacccccgatgacggccggcaacctggcggcagcgcaaaagatg

SEQ ID NO: 152501 - DNA, 103 bp, Artificial Sequence
  Synthetic Polynucleotide
taatacgactcactatagggatcatgttcacaaaataaactgccattgataacagaggagaatcaatatgagtttatttaacctggcggcagcgcaaaagatg

SEQ ID NO: 152502 - DNA, 103 bp, Artificial Sequence
  Synthetic Polynucleotide
taatacgactcactatagggctgtaggtctatcatgttcacaaaataaacaacagaggagagtttatatggtgaacatgaacctggcggcagcgcaaaagatg

SEQ ID NO: 152503 - DNA, 103 bp, Artificial Sequence
  Synthetic Polynucleotide
taatacgactcactatagggttgatgagagctgtaggtctatcatgttcaaacagaggagatgaacaatgtagacctacaacctggcggcagcgcaaaagatg

SEQ ID NO: 152504 - DNA, 103 bp, Artificial Sequence
  Synthetic Polynucleotide
taatacgactcactatagggcaaatggccattgatgagagctgtaggtctaacagaggagaagacctatggctctcatcaacctggcggcagcgcaaaagatg

SEQ ID NO: 152505 - DNA, 103 bp, Artificial Sequence
  Synthetic Polynucleotide
taatacgactcactataggggaagtgaattcaaatggccattgatgagagaacagaggagactctcaatgatggccattaacctggcggcagcgcaaaagatg

SEQ ID NO: 152506 - DNA, 103 bp, Artificial Sequence
  Synthetic Polynucleotide
taatacgactcactatagggggattgctctgaagtgaattcaaatggccaaacagaggagatggccaatggaattcactaacctggcggcagcgcaaaagatg

SEQ ID NO: 152507 - DNA, 103 bp, Artificial Sequence
  Synthetic Polynucleotide
taatacgactcactatagggtggcagtagtggattgctctgaagtgaattaacagaggagaaattcaatgcagagcaataacctggcggcagcgcaaaagatg

SEQ ID NO: 152508 - DNA, 103 bp, Artificial Sequence
  Synthetic Polynucleotide
taatacgactcactatagggccttctggtctggcagtagtggattgctctaacagaggagaagagcaatgcactactgcaacctggcggcagcgcaaaagatg

SEQ ID NO: 152509 - DNA, 103 bp, Artificial Sequence
  Synthetic Polynucleotide
taatacgactcactatagggcgcaccgcttccaggagagggagccggccgaacagaggagacggccgatgccctctcctaacctggcggcagcgcaaaagatg

SEQ ID NO: 152510 - DNA, 103 bp, Artificial Sequence
  Synthetic Polynucleotide
taatacgactcactatagggccgcagcctgcgcaccgcttccaggagaggaacagaggagacctctcatggaagcggtgaacctggcggcagcgcaaaagatg

SEQ ID NO: 152511 - DNA, 103 bp, Artificial Sequence
  Synthetic Polynucleotide
taatacgactcactatagggaatcttgcccccgcagcctgcgcaccgcttaacagaggagaaagcggatggcaggctgcaacctggcggcagcgcaaaagatg

SEQ ID NO: 152512 - DNA, 103 bp, Artificial Sequence
  Synthetic Polynucleotide
taatacgactcactatagggagcggtccgcaatcttgcccccgcagcctgaacagaggagacaggctatgggggcaagaaacctggcggcagcgcaaaagatg

SEQ ID NO: 152513 - DNA, 103 bp, Artificial Sequence
  Synthetic Polynucleotide
taatacgactcactatagggtagagcagaaagcggtccgcaatcttgcccaacagaggagagggcaaatgtgcggaccgaacctggcggcagcgcaaaagatg

SEQ ID NO: 152514 - DNA, 103 bp, Artificial Sequence
  Synthetic Polynucleotide
taatacgactcactataggggttctcctccatctttaggccgtccagcataacagaggagaatgctgatgggcctaaagaacctggcggcagcgcaaaagatg

SEQ ID NO: 152515 - DNA, 103 bp, Artificial Sequence
  Synthetic Polynucleotide
taatacgactcactatagggccgctgacagccctcgcagacagacttgggaacagaggagacccaagatggtctgcgagaacctggcggcagcgcaaaagatg

SEQ ID NO: 152516 - DNA, 103 bp, Artificial Sequence
  Synthetic Polynucleotide
taatacgactcactataggggctatccaggtcatggaaaaggggctcggcaacagaggagagccgagatgcttttccataacctggcggcagcgcaaaagatg

SEQ ID NO: 152517 - DNA, 103 bp, Artificial Sequence
  Synthetic Polynucleotide
taatacgactcactatagggaggtgtcgtcgctatccaggtcatggaaaaaacagaggagattttccatgacctggataaacctggcggcagcgcaaaagatg

SEQ ID NO: 152518 - DNA, 103 bp, Artificial Sequence
  Synthetic Polynucleotide
taatacgactcactatagggttactgagggaggtgtcgtcgctatccaggaacagaggagacctggaatgcgacgacacaacctggcggcagcgcaaaagatg

SEQ ID NO: 152519 - DNA, 103 bp, Artificial Sequence
  Synthetic Polynucleotide
taatacgactcactatagggatcacccaggttactgagggaggtgtcgtcaacagaggagagacgacatgtccctcagtaacctggcggcagcgcaaaagatg

SEQ ID NO: 152520 - DNA, 103 bp, Artificial Sequence
  Synthetic Polynucleotide
taatacgactcactatagggctaggaaacaatcacccaggttactgagggaacagaggagaccctcaatgacctgggtgaacctggcggcagcgcaaaagatg

SEQ ID NO: 152521 - DNA, 103 bp, Artificial Sequence
  Synthetic Polynucleotide
taatacgactcactatagggtctgaggttgctaggaaacaatcacccaggaacagaggagacctgggatgttgtttcctaacctggcggcagcgcaaaagatg

SEQ ID NO: 152522 - DNA, 103 bp, Artificial Sequence
  Synthetic Polynucleotide
taatacgactcactatagggaggcccagcttctgaggttgctaggaaacaaacagaggagatgtttcatggcaacctcaaacctggcggcagcgcaaaagatg

SEQ ID NO: 152523 - DNA, 103 bp, Artificial Sequence
  Synthetic Polynucleotide
taatacgactcactatagggtggactgcagaggcccagcttctgaggttgaacagaggagacaacctatgaagctgggcaacctggcggcagcgcaaaagatg

SEQ ID NO: 152524 - DNA, 103 bp, Artificial Sequence
  Synthetic Polynucleotide
taatacgactcactatagggtttcccactctggactgcagaggcccagctaacagaggagaagctggatgtctgcagtcaacctggcggcagcgcaaaagatg

SEQ ID NO: 152525 - DNA, 103 bp, Artificial Sequence
  Synthetic Polynucleotide
taatacgactcactataggggtcaatggggtttcccactctggactgcagaacagaggagactgcagatgagagtgggaaacctggcggcagcgcaaaagatg

SEQ ID NO: 152526 - DNA, 103 bp, Artificial Sequence
  Synthetic Polynucleotide
taatacgactcactatagggccaagatgacccgctgacagccctcgcagaaacagaggagatctgcgatggctgtcagcaacctggcggcagcgcaaaagatg

SEQ ID NO: 152527 - DNA, 103 bp, Artificial Sequence
  Synthetic Polynucleotide
taatacgactcactatagggagtacagatggtcaatggggtttcccactcaacagaggagagagtggatgaccccattgaacctggcggcagcgcaaaagatg

SEQ ID NO: 152528 - DNA, 103 bp, Artificial Sequence
  Synthetic Polynucleotide
taatacgactcactatagggttctgcatggagtacagatggtcaatggggaacagaggagaccccatatgccatctgtaaacctggcggcagcgcaaaagatg

SEQ ID NO: 152529 - DNA, 103 bp, Artificial Sequence
  Synthetic Polynucleotide
taatacgactcactataggggaagtaagaattctgcatggagtacagatgaacagaggagacatctgatgtccatgcagaacctggcggcagcgcaaaagatg

SEQ ID NO: 152530 - DNA, 103 bp, Artificial Sequence
  Synthetic Polynucleotide
taatacgactcactatagggagaaacctgtccaagatgacccgctgacagaacagaggagactgtcaatgggtcatcttaacctggcggcagcgcaaaagatg

SEQ ID NO: 152531 - DNA, 103 bp, Artificial Sequence
  Synthetic Polynucleotide
taatacgactcactataggggagccgcagcagaaacctgtccaagatgacaacagaggagagtcatcatggacaggtttaacctggcggcagcgcaaaagatg

SEQ ID NO: 152532 - DNA, 103 bp, Artificial Sequence
  Synthetic Polynucleotide
taatacgactcactatagggagctgtcgttgagccgcagcagaaacctgtaacagaggagaacaggtatgtgctgcggcaacctggcggcagcgcaaaagatg

SEQ ID NO: 152533 - DNA, 103 bp, Artificial Sequence
  Synthetic Polynucleotide
taatacgactcactatagggtcatgccagaagctgtcgttgagccgcagcaacagaggagagctgcgatgcaacgacagaacctggcggcagcgcaaaagatg

SEQ ID NO: 152534 - DNA, 103 bp, Artificial Sequence
  Synthetic Polynucleotide
taatacgactcactatagggcacgcactgctcatgccagaagctgtcgttaacagaggagaaacgacatgttctggcataacctggcggcagcgcaaaagatg

SEQ ID NO: 152535 - DNA, 103 bp, Artificial Sequence
  Synthetic Polynucleotide
taatacgactcactatagggaggcgcactgcacgcactgctcatgccagaaacagaggagatctggcatgagcagtgcgaacctggcggcagcgcaaaagatg

SEQ ID NO: 152536 - DNA, 103 bp, Artificial Sequence
  Synthetic Polynucleotide
taatacgactcactatagggtctttgcaggaggcgcactgcacgcactgcaacagaggagagcagtgatggcagtgcgcaacctggcggcagcgcaaaagatg

SEQ ID NO: 152537 - DNA, 103 bp, Artificial Sequence
  Synthetic Polynucleotide
taatacgactcactatagggctccaggggctctttgcaggaggcgcactgaacagaggagacagtgcatgtcctgcaaaaacctggcggcagcgcaaaagatg

SEQ ID NO: 152538 - DNA, 103 bp, Artificial Sequence
  Synthetic Polynucleotide
taatacgactcactatagggcgctttggaagttctcctccatctttaggcaacagaggagagcctaaatgtggaggagaaacctggcggcagcgcaaaagatg

SEQ ID NO: 152539 - DNA, 103 bp, Artificial Sequence
  Synthetic Polynucleotide
taatacgactcactatagggagcaggtggtctccaggggctctttgcaggaacagaggagacctgcaatgagcccctggaacctggcggcagcgcaaaagatg

SEQ ID NO: 152540 - DNA, 103 bp, Artificial Sequence
  Synthetic Polynucleotide
taatacgactcactatagggtcccggtagaagcaggtggtctccaggggcaacagaggagagcccctatggaccacctgaacctggcggcagcgcaaaagatg

SEQ ID NO: 152541 - DNA, 103 bp, Artificial Sequence
  Synthetic Polynucleotide
taatacgactcactatagggcagcttcttgtcccggtagaagcaggtggtaacagaggagaaccaccatgttctaccggaacctggcggcagcgcaaaagatg

SEQ ID NO: 152542 - DNA, 103 bp, Artificial Sequence
  Synthetic Polynucleotide
taatacgactcactatagggacttgcagtacagcttcttgtcccggtagaaacagaggagatctaccatgacaagaagcaacctggcggcagcgcaaaagatg

SEQ ID NO: 152543 - DNA, 103 bp, Artificial Sequence
  Synthetic Polynucleotide
taatacgactcactatagggtcgtagtcatacttgcagtacagcttcttgaacagaggagacaagaaatggtactgcaaaacctggcggcagcgcaaaagatg

SEQ ID NO: 152544 - DNA, 103 bp, Artificial Sequence
  Synthetic Polynucleotide
taatacgactcactatagggaaacagcttctcgtagtcatacttgcagtaaacagaggagatactgcatgtatgactacaacctggcggcagcgcaaaagatg

SEQ ID NO: 152545 - DNA, 103 bp, Artificial Sequence
  Synthetic Polynucleotide
taatacgactcactatagggatttaacagcaaacagcttctcgtagtcataacagaggagaatgactatgagaagctgtaacctggcggcagcgcaaaagatg

SEQ ID NO: 152546 - DNA, 103 bp, Artificial Sequence
  Synthetic Polynucleotide
taatacgactcactatagggcagcccccacatttaacagcaaacagcttcaacagaggagagaagctatgtgctgttaaaacctggcggcagcgcaaaagatg

SEQ ID NO: 152547 - DNA, 103 bp, Artificial Sequence
  Synthetic Polynucleotide
taatacgactcactatagggggcctcgaagcagcccccacatttaacagcaacagaggagagctgttatgtgtgggggcaacctggcggcagcgcaaaagatg

SEQ ID NO: 152548 - DNA, 103 bp, Artificial Sequence
  Synthetic Polynucleotide
taatacgactcactatagggtgggagcgatggcctcgaagcagcccccacaacagaggagagtggggatggcttcgaggaacctggcggcagcgcaaaagatg

SEQ ID NO: 152549 - DNA, 103 bp, Artificial Sequence
  Synthetic Polynucleotide
taatacgactcactataggggtgtcgatcgcgctttggaagttctcctccaacagaggagaggaggaatgcttccaaagaacctggcggcagcgcaaaagatg

SEQ ID NO: 152550 - DNA, 103 bp, Artificial Sequence
  Synthetic Polynucleotide
taatacgactcactatagggacaaactcattgggagcgatggcctcgaagaacagaggagacttcgaatgcatcgctccaacctggcggcagcgcaaaagatg

SEQ ID NO: 152551 - DNA, 103 bp, Artificial Sequence
  Synthetic Polynucleotide
taatacgactcactatagggggcccgcataacaaactcattgggagcgataacagaggagaatcgctatgaatgagtttaacctggcggcagcgcaaaagatg

SEQ ID NO: 152552 - DNA, 103 bp, Artificial Sequence
  Synthetic Polynucleotide
taatacgactcactatagggcactcttctgggcccgcataacaaactcataacagaggagaatgagtatgttatgcgggaacctggcggcagcgcaaaagatg

SEQ ID NO: 152553 - DNA, 103 bp, Artificial Sequence
  Synthetic Polynucleotide
taatacgactcactatagggaggtggtatacactcttctgggcccgcataaacagaggagatatgcgatgccagaagagaacctggcggcagcgcaaaagatg

SEQ ID NO: 152554 - DNA, 103 bp, Artificial Sequence
  Synthetic Polynucleotide
taatacgactcactataggggaagcagctcaggtggtatacactcttctgaacagaggagacagaagatggtataccacaacctggcggcagcgcaaaagatg

SEQ ID NO: 152555 - DNA, 103 bp, Artificial Sequence
  Synthetic Polynucleotide
taatacgactcactatagggcacagcagcagaagcagctcaggtggtataaacagaggagatataccatgtgagctgctaacctggcggcagcgcaaaagatg

SEQ ID NO: 152556 - DNA, 103 bp, Artificial Sequence
  Synthetic Polynucleotide
taatacgactcactatagggcgctcgcagacacagcagcagaagcagctcaacagaggagagagctgatgctgctgctgaacctggcggcagcgcaaaagatg

SEQ ID NO: 152557 - DNA, 103 bp, Artificial Sequence
  Synthetic Polynucleotide
taatacgactcactatagggctgaagctgtcgctcgcagacacagcagcaaacagaggagatgctgcatggtctgcgagaacctggcggcagcgcaaaagatg

SEQ ID NO: 152558 - DNA, 103 bp, Artificial Sequence
  Synthetic Polynucleotide
taatacgactcactatagggcatcacccttctgaagctgtcgctcgcagaaacagaggagatctgcgatggacagcttcaacctggcggcagcgcaaaagatg

SEQ ID NO: 152559 - DNA, 103 bp, Artificial Sequence
  Synthetic Polynucleotide
taatacgactcactatagggaggacaaactcatcacccttctgaagctgtaacagaggagaacagctatggaagggtgaaacctggcggcagcgcaaaagatg

SEQ ID NO: 152560 - DNA, 103 bp, Artificial Sequence
  Synthetic Polynucleotide
taatacgactcactatagggggaggccgaggtgtcgatcgcgctttggaaaacagaggagattccaaatggcgatcgacaacctggcggcagcgcaaaagatg

SEQ ID NO: 152561 - DNA, 103 bp, Artificial Sequence
  Synthetic Polynucleotide
taatacgactcactatagggcccctccttcaggacaaactcatcacccttaacagaggagaaagggtatggagtttgtcaacctggcggcagcgcaaaagatg

SEQ ID NO: 152562 - DNA, 103 bp, Artificial Sequence
  Synthetic Polynucleotide
taatacgactcactatagggagagcagctgcccctccttcaggacaaactaacagaggagaagtttgatgtgaaggaggaacctggcggcagcgcaaaagatg

SEQ ID NO: 152563 - DNA, 103 bp, Artificial Sequence
  Synthetic Polynucleotide
taatacgactcactatagggtcccctttgcagagcagctgcccctccttcaacagaggagagaaggaatggcagctgctaacctggcggcagcgcaaaagatg

SEQ ID NO: 152564 - DNA, 103 bp, Artificial Sequence
  Synthetic Polynucleotide
taatacgactcactatagggcttctcatagtcccctttgcagagcagctgaacagaggagacagctgatgtgcaaagggaacctggcggcagcgcaaaagatg

SEQ ID NO: 152565 - DNA, 103 bp, Artificial Sequence
  Synthetic Polynucleotide
taatacgactcactataggggctcccgctccttctcatagtcccctttgcaacagaggagagcaaagatgactatgagaaacctggcggcagcgcaaaagatg

SEQ ID NO: 152566 - DNA, 103 bp, Artificial Sequence
  Synthetic Polynucleotide
taatacgactcactatagggaggctgagcagctcccgctccttctcatagaacagaggagactatgaatgggagcgggaaacctggcggcagcgcaaaagatg

SEQ ID NO: 152567 - DNA, 103 bp, Artificial Sequence
  Synthetic Polynucleotide
taatacgactcactatagggtgggctcaccaggctgagcagctcccgctcaacagaggagagagcggatgctgctcagcaacctggcggcagcgcaaaagatg

SEQ ID NO: 152568 - DNA, 103 bp, Artificial Sequence
  Synthetic Polynucleotide
taatacgactcactatagggctgaggctgctgggctcaccaggctgagcaaacagaggagatgctcaatgtggtgagccaacctggcggcagcgcaaaagatg

SEQ ID NO: 152569 - DNA, 103 bp, Artificial Sequence
  Synthetic Polynucleotide
taatacgactcactatagggttacctgagtctgaggctgctgggctcaccaacagaggagaggtgagatgagcagcctcaacctggcggcagcgcaaaagatg

SEQ ID NO: 152570 - DNA, 103 bp, Artificial Sequence
  Synthetic Polynucleotide
taatacgactcactatagggatcatcacttttacctgagtctgaggctgcaacagaggagagcagccatggactcaggtaacctggcggcagcgcaaaagatg

SEQ ID NO: 152571 - DNA, 103 bp, Artificial Sequence
  Synthetic Polynucleotide
taatacgactcactataggggcgaggagaaggaggccgaggtgtcgatcgaacagaggagacgatcgatgcctcggcctaacctggcggcagcgcaaaagatg

SEQ ID NO: 152572 - DNA, 103 bp, Artificial Sequence
  Synthetic Polynucleotide
taatacgactcactataggggactttcttcatcatcacttttacctgagtaacagaggagaactcagatgaaagtgatgaacctggcggcagcgcaaaagatg

SEQ ID NO: 152573 - DNA, 103 bp, Artificial Sequence
  Synthetic Polynucleotide
taatacgactcactataggggacttgcagagactttcttcatcatcacttaacagaggagaaagtgaatgtgaagaaagaacctggcggcagcgcaaaagatg

SEQ ID NO: 152574 - DNA, 103 bp, Artificial Sequence
  Synthetic Polynucleotide
taatacgactcactatagggcccatgggctgacttgcagagactttcttcaacagaggagagaagaaatgctctgcaagaacctggcggcagcgcaaaagatg

SEQ ID NO: 152575 - DNA, 103 bp, Artificial Sequence
  Synthetic Polynucleotide
taatacgactcactatagggctttccctgccccatgggctgacttgcagaaacagaggagatctgcaatgcagcccatgaacctggcggcagcgcaaaagatg

SEQ ID NO: 152576 - DNA, 103 bp, Artificial Sequence
  Synthetic Polynucleotide
taatacgactcactatagggtcagcagttcctttccctgccccatgggctaacagaggagaagcccaatgggcagggaaaacctggcggcagcgcaaaagatg

SEQ ID NO: 152577 - DNA, 103 bp, Artificial Sequence
  Synthetic Polynucleotide
taatacgactcactatagggcttgccttcctcagcagttcctttccctgcaacagaggagagcagggatgggaactgctaacctggcggcagcgcaaaagatg

SEQ ID NO: 152578 - DNA, 103 bp, Artificial Sequence
  Synthetic Polynucleotide
taatacgactcactataggggcttatggtccttgccttcctcagcagttcaacagaggagagaactgatgaggaaggcaaacctggcggcagcgcaaaagatg

SEQ ID NO: 152579 - DNA, 103 bp, Artificial Sequence
  Synthetic Polynucleotide
taatacgactcactatagggcgtttggggcgcttatggtccttgccttccaacagaggagaggaaggatgggaccataaaacctggcggcagcgcaaaagatg

SEQ ID NO: 152580 - DNA, 103 bp, Artificial Sequence
  Synthetic Polynucleotide
taatacgactcactatagggggttctcggacgtttggggcgcttatggtcaacagaggagagaccatatgcgccccaaaaacctggcggcagcgcaaaagatg

SEQ ID NO: 152581 - DNA, 103 bp, Artificial Sequence
  Synthetic Polynucleotide
taatacgactcactatagggttgtcaagatggttctcggacgtttggggcaacagaggagagccccaatggtccgagaaaacctggcggcagcgcaaaagatg

SEQ ID NO: 152582 - DNA, 103 bp, Artificial Sequence
  Synthetic Polynucleotide
taatacgactcactatagggctgcccagcagcgaggagaaggaggccgagaacagaggagactcggcatgcttctcctcaacctggcggcagcgcaaaagatg

SEQ ID NO: 152583 - DNA, 103 bp, Artificial Sequence
  Synthetic Polynucleotide
taatacgactcactatagggctctgttgagttgtcaagatggttctcggaaacagaggagatccgagatgcatcttgacaacctggcggcagcgcaaaagatg

SEQ ID NO: 152584 - DNA, 103 bp, Artificial Sequence
  Synthetic Polynucleotide
taatacgactcactataggggaatgctcgcctctgttgagttgtcaagataacagaggagaatcttgatgactcaacagaacctggcggcagcgcaaaagatg

SEQ ID NO: 152585 - DNA, 103 bp, Artificial Sequence
  Synthetic Polynucleotide
taatacgactcactatagggatgaggccttgaatgctcgcctctgttgagaacagaggagactcaacatgggcgagcataacctggcggcagcgcaaaagatg

SEQ ID NO: 152586 - DNA, 103 bp, Artificial Sequence
  Synthetic Polynucleotide
taatacgactcactataggggatacttcaaatgaggccttgaatgctcgcaacagaggagagcgagcatgcaaggcctcaacctggcggcagcgcaaaagatg

SEQ ID NO: 152587 - DNA, 103 bp, Artificial Sequence
  Synthetic Polynucleotide
taatacgactcactataggggggcttggaggatacttcaaatgaggccttaacagaggagaaaggccatgtttgaagtaaacctggcggcagcgcaaaagatg

SEQ ID NO: 152588 - DNA, 103 bp, Artificial Sequence
  Synthetic Polynucleotide
taatacgactcactatagggccttcctgcagggcttggaggatacttcaaaacagaggagattgaagatgcctccaagcaacctggcggcagcgcaaaagatg

SEQ ID NO: 152589 - DNA, 103 bp, Artificial Sequence
  Synthetic Polynucleotide
taatacgactcactataggggtctctctcaccttcctgcagggcttggagaacagaggagactccaaatgctgcaggaaaacctggcggcagcgcaaaagatg

SEQ ID NO: 152590 - DNA, 103 bp, Artificial Sequence
  Synthetic Polynucleotide
taatacgactcactatagggtgcagccagagtctctctcaccttcctgcaaacagaggagatgcaggatggtgagagagaacctggcggcagcgcaaaagatg

SEQ ID NO: 152591 - DNA, 103 bp, Artificial Sequence
  Synthetic Polynucleotide
taatacgactcactataggggccctgtctctgcagccagagtctctctcaaacagaggagatgagagatgctctggctgaacctggcggcagcgcaaaagatg

SEQ ID NO: 152592 - DNA, 103 bp, Artificial Sequence
  Synthetic Polynucleotide
taatacgactcactatagggcggacactcagccctgtctctgcagccagaaacagaggagatctggcatgagagacaggaacctggcggcagcgcaaaagatg

SEQ ID NO: 152593 - DNA, 103 bp, Artificial Sequence
  Synthetic Polynucleotide
taatacgactcactataggggctcaccgctctgcccagcagcgaggagaaaacagaggagattctccatgctgctgggcaacctggcggcagcgcaaaagatg

SEQ ID NO: 152594 - DNA, 103 bp, Artificial Sequence
  Synthetic Polynucleotide
taatacgactcactatagggctggacgacacggacactcagccctgtctcaacagaggagagagacaatgctgagtgtcaacctggcggcagcgcaaaagatg

SEQ ID NO: 152595 - DNA, 103 bp, Artificial Sequence
  Synthetic Polynucleotide
taatacgactcactatagggggaaccacacctggacgacacggacactcaaacagaggagatgagtgatggtgtcgtccaacctggcggcagcgcaaaagatg

SEQ ID NO: 152596 - DNA, 103 bp, Artificial Sequence
  Synthetic Polynucleotide
taatacgactcactatagggctctggttttggaaccacacctggacgacaaacagaggagatgtcgtatgggtgtggttaacctggcggcagcgcaaaagatg

SEQ ID NO: 152597 - DNA, 103 bp, Artificial Sequence
  Synthetic Polynucleotide
taatacgactcactatagggcatcttcgctctctggttttggaaccacacaacagaggagagtgtggatgcaaaaccagaacctggcggcagcgcaaaagatg

SEQ ID NO: 152598 - DNA, 103 bp, Artificial Sequence
  Synthetic Polynucleotide
taatacgactcactatagggccagcttcttcatcttcgctctctggttttaacagaggagaaaaaccatggagcgaagaaacctggcggcagcgcaaaagatg

SEQ ID NO: 152599 - DNA, 103 bp, Artificial Sequence
  Synthetic Polynucleotide
taatacgactcactatagggtgtcgcctggccagcttcttcatcttcgctaacagaggagaagcgaaatggaagaagctaacctggcggcagcgcaaaagatg

SEQ ID NO: 152600 - DNA, 103 bp, Artificial Sequence
  Synthetic Polynucleotide
taatacgactcactatagggctgctgctgctgtcgcctggccagcttcttaacagaggagaaagaagatggccaggcgaaacctggcggcagcgcaaaagatg

SEQ ID NO: 152601 - DNA, 103 bp, Artificial Sequence
  Synthetic Polynucleotide
taatacgactcactataggggatcttgctgctgctgctgctgtcgcctggaacagaggagaccaggcatgagcagcagcaacctggcggcagcgcaaaagatg

SEQ ID NO: 152602 - DNA, 103 bp, Artificial Sequence
  Synthetic Polynucleotide
taatacgactcactataggggtgttctgctgatcttgctgctgctgctgcaacagaggagagcagcaatggcagcaagaaacctggcggcagcgcaaaagatg

SEQ ID NO: 152603 - DNA, 103 bp, Artificial Sequence
  Synthetic Polynucleotide
taatacgactcactatagggcagcctctgggtgttctgctgatcttgctgaacagaggagacagcaaatgcagcagaacaacctggcggcagcgcaaaagatg

SEQ ID NO: 152604 - DNA, 103 bp, Artificial Sequence
  Synthetic Polynucleotide
taatacgactcactatagggcagacttggggctcaccgctctgcccagcaaacagaggagatgctggatggagcggtgaaacctggcggcagcgcaaaagatg

SEQ ID NO: 152605 - DNA, 103 bp, Artificial Sequence
  Synthetic Polynucleotide
taatacgactcactataggggagcagagctcagcctctgggtgttctgctaacagaggagaagcagaatgcccagaggcaacctggcggcagcgcaaaagatg

SEQ ID NO: 152606 - DNA, 103 bp, Artificial Sequence
  Synthetic Polynucleotide
taatacgactcactatagggccgtttgtctgagcagagctcagcctctggaacagaggagaccagagatggagctctgcaacctggcggcagcgcaaaagatg

SEQ ID NO: 152607 - DNA, 103 bp, Artificial Sequence
  Synthetic Polynucleotide
taatacgactcactatagggactcccaccaccgtttgtctgagcagagctaacagaggagaagctctatgcagacaaacaacctggcggcagcgcaaaagatg

SEQ ID NO: 152608 - DNA, 103 bp, Artificial Sequence
  Synthetic Polynucleotide
taatacgactcactatagggccatcccagcactcccaccaccgtttgtctaacagaggagaagacaaatggtggtgggaaacctggcggcagcgcaaaagatg

SEQ ID NO: 152609 - DNA, 103 bp, Artificial Sequence
  Synthetic Polynucleotide
taatacgactcactatagggatgattccttccatcccagcactcccaccaaacagaggagatggtggatgtgctgggataacctggcggcagcgcaaaagatg

SEQ ID NO: 152610 - DNA, 103 bp, Artificial Sequence
  Synthetic Polynucleotide
taatacgactcactataggggtaggggttcatgattccttccatcccagcaacagaggagagctgggatggaaggaatcaacctggcggcagcgcaaaagatg

SEQ ID NO: 152611 - DNA, 103 bp, Artificial Sequence
  Synthetic Polynucleotide
taatacgactcactataggggcagagccgtgtaggggttcatgattccttaacagaggagaaaggaaatgtgaacccctaacctggcggcagcgcaaaagatg

SEQ ID NO: 152612 - DNA, 103 bp, Artificial Sequence
  Synthetic Polynucleotide
taatacgactcactatagggtgtggggtgggcagagccgtgtaggggttcaacagaggagagaacccatgcacggctctaacctggcggcagcgcaaaagatg

SEQ ID NO: 152613 - DNA, 103 bp, Artificial Sequence
  Synthetic Polynucleotide
taatacgactcactatagggcaggagctgctgtggggtgggcagagccgtaacagaggagaacggctatgcccaccccaaacctggcggcagcgcaaaagatg

SEQ ID NO: 152614 - DNA, 103 bp, Artificial Sequence
  Synthetic Polynucleotide
taatacgactcactataggggctcgatggccaggagctgctgtggggtggaacagaggagaccacccatgagcagctccaacctggcggcagcgcaaaagatg

SEQ ID NO: 152615 - DNA, 103 bp, Artificial Sequence
  Synthetic Polynucleotide
taatacgactcactatagggccctcgcagacagacttggggctcaccgctaacagaggagaagcggtatgccccaagtcaacctggcggcagcgcaaaagatg

SEQ ID NO: 152616 - DNA, 103 bp, Artificial Sequence
  Synthetic Polynucleotide
taatacgactcactatagggtagacactctgctcgatggccaggagctgcaacagaggagagcagctatgggccatcgaaacctggcggcagcgcaaaagatg

SEQ ID NO: 152617 - DNA, 103 bp, Artificial Sequence
  Synthetic Polynucleotide
taatacgactcactatagggatctgagctgtagacactctgctcgatggcaacagaggagagccatcatgcagagtgtcaacctggcggcagcgcaaaagatg

SEQ ID NO: 152618 - DNA, 103 bp, Artificial Sequence
  Synthetic Polynucleotide
taatacgactcactataggggtcggaagggatctgagctgtagacactctaacagaggagaagagtgatgacagctcagaacctggcggcagcgcaaaagatg

SEQ ID NO: 152619 - DNA, 103 bp, Artificial Sequence
  Synthetic Polynucleotide
taatacgactcactataggggtgagaccctgtcggaagggatctgagctgaacagaggagacagctcatgtcccttccgaacctggcggcagcgcaaaagatg

SEQ ID NO: 152620 - DNA, 103 bp, Artificial Sequence
  Synthetic Polynucleotide
taatacgactcactatagggctggggtggggtgagaccctgtcggaagggaacagaggagacccttcatgcagggtctcaacctggcggcagcgcaaaagatg

SEQ ID NO: 152621 - DNA, 103 bp, Artificial Sequence
  Synthetic Polynucleotide
taatacgactcactatagggctccaggcatctggggtggggtgagaccctaacagaggagaagggtcatgccccaccccaacctggcggcagcgcaaaagatg

SEQ ID NO: 152622 - DNA, 103 bp, Artificial Sequence
  Synthetic Polynucleotide
taatacgactcactatagggtgcatgtggtctccaggcatctggggtgggaacagaggagacccaccatggatgcctggaacctggcggcagcgcaaaagatg

SEQ ID NO: 152623 - DNA, 103 bp, Artificial Sequence
  Synthetic Polynucleotide
taatacgactcactatagggaccataagggtgcatgtggtctccaggcataacagaggagaatgcctatggaccacatgaacctggcggcagcgcaaaagatg

SEQ ID NO: 152624 - DNA, 103 bp, Artificial Sequence
  Synthetic Polynucleotide
taatacgactcactatagggggggctcggcaccataagggtgcatgtggtaacagaggagaaccacaatgacccttatgaacctggcggcagcgcaaaagatg

SEQ ID NO: 152625 - DNA, 103 bp, Artificial Sequence
  Synthetic Polynucleotide
taatacgactcactatagggtcatggaaaaggggctcggcaccataagggaacagaggagacccttaatgtgccgagccaacctggcggcagcgcaaaagatg

SEQ ID NO: 152626 - DNA, 103 bp, Artificial Sequence
  Synthetic Polynucleotide
taatacgactcactatagggcagcgactcgggacctgttgctatatccataacagaggagaatggatatggcaacaggtaacctggcggcagcgcaaaagatg

SEQ ID NO: 152627 - DNA, 103 bp, Artificial Sequence
  Synthetic Polynucleotide
taatacgactcactatagggggcgggcccggggcgcagggcgtgctcctcaacagaggagagaggagatggccctgcgcaacctggcggcagcgcaaaagatg

SEQ ID NO: 152628 - DNA, 103 bp, Artificial Sequence
  Synthetic Polynucleotide
taatacgactcactataggggctgccgtaggggctctgttccatggccacaacagaggagagtggccatggaacagagcaacctggcggcagcgcaaaagatg

SEQ ID NO: 152629 - DNA, 103 bp, Artificial Sequence
  Synthetic Polynucleotide
taatacgactcactatagggaggggtcgctgctgccgtaggggctctgttaacagaggagaaacagaatgcctacggcaaacctggcggcagcgcaaaagatg

SEQ ID NO: 152630 - DNA, 103 bp, Artificial Sequence
  Synthetic Polynucleotide
taatacgactcactatagggccctgctggaaggggtcgctgctgccgtagaacagaggagactacggatgcagcgacccaacctggcggcagcgcaaaagatg

SEQ ID NO: 152631 - DNA, 103 bp, Artificial Sequence
  Synthetic Polynucleotide
taatacgactcactatagggcggcgtgaggccctgctggaaggggtcgctaacagaggagaagcgacatgttccagcagaacctggcggcagcgcaaaagatg

SEQ ID NO: 152632 - DNA, 103 bp, Artificial Sequence
  Synthetic Polynucleotide
taatacgactcactataggggcatttggggcggcgtgaggccctgctggaaacagaggagatccagcatggcctcacgcaacctggcggcagcgcaaaagatg

SEQ ID NO: 152633 - DNA, 103 bp, Artificial Sequence
  Synthetic Polynucleotide
taatacgactcactatagggtcgttccctggcatttggggcggcgtgaggaacagaggagacctcacatggccccaaataacctggcggcagcgcaaaagatg

SEQ ID NO: 152634 - DNA, 103 bp, Artificial Sequence
  Synthetic Polynucleotide
taatacgactcactataggggaagatggagtcgttccctggcatttggggaacagaggagaccccaaatgccagggaacaacctggcggcagcgcaaaagatg

SEQ ID NO: 152635 - DNA, 103 bp, Artificial Sequence
  Synthetic Polynucleotide
taatacgactcactatagggcgatgtcatggaagatggagtcgttccctgaacagaggagacagggaatgactccatctaacctggcggcagcgcaaaagatg

SEQ ID NO: 152636 - DNA, 103 bp, Artificial Sequence
  Synthetic Polynucleotide
taatacgactcactataggggtatcgctgtcgatgtcatggaagatggagaacagaggagactccatatgccatgacataacctggcggcagcgcaaaagatg

SEQ ID NO: 152637 - DNA, 103 bp, Artificial Sequence
  Synthetic Polynucleotide
taatacgactcactatagggggttaaggaggtatcgctgtcgatgtcatgaacagaggagacatgacatggacagcgataacctggcggcagcgcaaaagatg

SEQ ID NO: 152638 - DNA, 103 bp, Artificial Sequence
  Synthetic Polynucleotide
taatacgactcactatagggcccccagagtggcgggcccggggcgcagggaacagaggagaccctgcatgccgggcccgaacctggcggcagcgcaaaagatg

SEQ ID NO: 152639 - DNA, 103 bp, Artificial Sequence
  Synthetic Polynucleotide
taatacgactcactatagggcgctgaggctggttaaggaggtatcgctgtaacagaggagaacagcgatgcctccttaaaacctggcggcagcgcaaaagatg

SEQ ID NO: 152640 - DNA, 103 bp, Artificial Sequence
  Synthetic Polynucleotide
taatacgactcactatagggaggaagcagtcgctgaggctggttaaggagaacagaggagactccttatgcagcctcagaacctggcggcagcgcaaaagatg

SEQ ID NO: 152641 - DNA, 103 bp, Artificial Sequence
  Synthetic Polynucleotide
taatacgactcactatagggtgaggagccgaggaagcagtcgctgaggctaacagaggagaagcctcatggactgcttcaacctggcggcagcgcaaaagatg

SEQ ID NO: 152642 - DNA, 103 bp, Artificial Sequence
  Synthetic Polynucleotide
taatacgactcactatagggagcccacgtctgaggagccgaggaagcagtaacagaggagaactgctatgtcggctcctaacctggcggcagcgcaaaagatg

SEQ ID NO: 152643 - DNA, 103 bp, Artificial Sequence
  Synthetic Polynucleotide
taatacgactcactataggggcctgcagggagcccacgtctgaggagccgaacagaggagacggctcatgagacgtgggaacctggcggcagcgcaaaagatg

SEQ ID NO: 152644 - DNA, 103 bp, Artificial Sequence
  Synthetic Polynucleotide
taatacgactcactatagggccccacgcgggcctgcagggagcccacgtcaacagaggagagacgtgatgtccctgcagaacctggcggcagcgcaaaagatg

SEQ ID NO: 152645 - DNA, 103 bp, Artificial Sequence
  Synthetic Polynucleotide
taatacgactcactatagggcgatggggttccccacgcgggcctgcagggaacagaggagaccctgcatgcccgcgtggaacctggcggcagcgcaaaagatg

SEQ ID NO: 152646 - DNA, 103 bp, Artificial Sequence
  Synthetic Polynucleotide
taatacgactcactatagggtagagccggtcgatggggttccccacgcggaacagaggagaccgcgtatggaaccccataacctggcggcagcgcaaaagatg

SEQ ID NO: 152647 - DNA, 103 bp, Artificial Sequence
  Synthetic Polynucleotide
taatacgactcactatagggctgcatggagtagagccggtcgatggggttaacagaggagaaaccccatggaccggctcaacctggcggcagcgcaaaagatg

SEQ ID NO: 152648 - DNA, 103 bp, Artificial Sequence
  Synthetic Polynucleotide
taatacgactcactatagggagtaggaactctgcatggagtagagccggtaacagaggagaaccggcatgactccatgcaacctggcggcagcgcaaaagatg

SEQ ID NO: 152649 - DNA, 103 bp, Artificial Sequence
  Synthetic Polynucleotide
taatacgactcactatagggcccagcagcacccccagagtggcgggcccgaacagaggagacgggccatgcactctgggaacctggcggcagcgcaaaagatg

SEQ ID NO: 152650 - DNA, 103 bp, Artificial Sequence
  Synthetic Polynucleotide
taatacgactcactatagggcaggaggcgaagtaggaactctgcatggagaacagaggagactccatatggagttcctaaacctggcggcagcgcaaaagatg

SEQ ID NO: 152651 - DNA, 103 bp, Artificial Sequence
  Synthetic Polynucleotide
taatacgactcactataggggcagtcggagcccagcagcacccccagagtaacagaggagaactctgatggtgctgctgaacctggcggcagcgcaaaagatg

SEQ ID NO: 152652 - DNA, 103 bp, Artificial Sequence
  Synthetic Polynucleotide
taatacgactcactatagggcgggatgcgggcagtcggagcccagcagcaaacagaggagatgctgcatggctccgactaacctggcggcagcgcaaaagatg

SEQ ID NO: 152653 - DNA, 103 bp, Artificial Sequence
  Synthetic Polynucleotide
taatacgactcactatagggtcgcagacggcgggatgcgggcagtcggagaacagaggagactccgaatgcccgcatccaacctggcggcagcgcaaaagatg

SEQ ID NO: 152654 - DNA, 103 bp, Artificial Sequence
  Synthetic Polynucleotide
taatacgactcactatagggctggcagccctcgcagacggcgggatgcggaacagaggagaccgcatatggccgtctgcaacctggcggcagcgcaaaagatg

SEQ ID NO: 152655 - DNA, 103 bp, Artificial Sequence
  Synthetic Polynucleotide
taatacgactcactatagggagatgggccgctggcagccctcgcagacggaacagaggagaccgtctatgagggctgccaacctggcggcagcgcaaaagatg

SEQ ID NO: 152656 - DNA, 103 bp, Artificial Sequence
  Synthetic Polynucleotide
taatacgactcactatagggaagcggtcggagatgggccgctggcagcccaacagaggagagggctgatggcggcccataacctggcggcagcgcaaaagatg

SEQ ID NO: 152657 - DNA, 103 bp, Artificial Sequence
  Synthetic Polynucleotide
taatacgactcactatagggtcgcatcaggaagcggtcggagatgggccgaacagaggagacggcccatgtccgaccgcaacctggcggcagcgcaaaagatg

SEQ ID NO: 152658 - DNA, 103 bp, Artificial Sequence
  Synthetic Polynucleotide
taatacgactcactatagggagcacctctccagcgactcgggacctgttgaacagaggagacaacagatgccgagtcgcaacctggcggcagcgcaaaagatg

SEQ ID NO: 152659 - DNA, 103 bp, Artificial Sequence
  Synthetic Polynucleotide
taatacgactcactatagggactcgttgactcgcatcaggaagcggtcggaacagaggagaccgaccatgtcctgatgcaacctggcggcagcgcaaaagatg

SEQ ID NO: 152660 - DNA, 103 bp, Artificial Sequence
  Synthetic Polynucleotide
taatacgactcactatagggtgccaggacgactcgttgactcgcatcaggaacagaggagacctgatatgagtcaacgaaacctggcggcagcgcaaaagatg

SEQ ID NO: 152661 - DNA, 103 bp, Artificial Sequence
  Synthetic Polynucleotide
taatacgactcactatagggacactcctcgtgccaggacgactcgttgacaacagaggagagtcaacatgtcgtcctggaacctggcggcagcgcaaaagatg

SEQ ID NO: 152662 - DNA, 103 bp, Artificial Sequence
  Synthetic Polynucleotide
taatacgactcactatagggcgcactgcaaacactcctcgtgccaggacgaacagaggagacgtcctatgacgaggagtaacctggcggcagcgcaaaagatg

SEQ ID NO: 152663 - DNA, 103 bp, Artificial Sequence
  Synthetic Polynucleotide
taatacgactcactatagggtgacacgccgcgcactgcaaacactcctcgaacagaggagacgaggaatgtttgcagtgaacctggcggcagcgcaaaagatg

SEQ ID NO: 152664 - DNA, 103 bp, Artificial Sequence
  Synthetic Polynucleotide
taatacgactcactataggggagggcttgctgacacgccgcgcactgcaaaacagaggagattgcagatggcggcgtgtaacctggcggcagcgcaaaagatg

SEQ ID NO: 152665 - DNA, 103 bp, Artificial Sequence
  Synthetic Polynucleotide
taatacgactcactatagggagctggtggtgagggcttgctgacacgccgaacagaggagacggcgtatgagcaagcccaacctggcggcagcgcaaaagatg

SEQ ID NO: 152666 - DNA, 103 bp, Artificial Sequence
  Synthetic Polynucleotide
taatacgactcactatagggcggaagtagcagctggtggtgagggcttgcaacagaggagagcaagcatgcaccaccagaacctggcggcagcgcaaaagatg

SEQ ID NO: 152667 - DNA, 103 bp, Artificial Sequence
  Synthetic Polynucleotide
taatacgactcactatagggtttccgatcccggaagtagcagctggtggtaacagaggagaaccaccatgtgctacttcaacctggcggcagcgcaaaagatg

SEQ ID NO: 152668 - DNA, 103 bp, Artificial Sequence
  Synthetic Polynucleotide
taatacgactcactatagggtgcagtacagtttccgatcccggaagtagcaacagaggagagctactatggggatcggaaacctggcggcagcgcaaaagatg

SEQ ID NO: 152669 - DNA, 103 bp, Artificial Sequence
  Synthetic Polynucleotide
taatacgactcactatagggccgcgagggaagcacctctccagcgactcgaacagaggagacgagtcatgggagaggtgaacctggcggcagcgcaaaagatg

SEQ ID NO: 152670 - DNA, 103 bp, Artificial Sequence
  Synthetic Polynucleotide
taatacgactcactatagggtagtcttgtttgcagtacagtttccgatccaacagaggagaggatcgatgactgtactgaacctggcggcagcgcaaaagatg

SEQ ID NO: 152671 - DNA, 103 bp, Artificial Sequence
  Synthetic Polynucleotide
taatacgactcactataggggagctgttggtagtcttgtttgcagtacagaacagaggagactgtacatgaaacaagacaacctggcggcagcgcaaaagatg

SEQ ID NO: 152672 - DNA, 103 bp, Artificial Sequence
  Synthetic Polynucleotide
taatacgactcactatagggtggccgcgaagagctgttggtagtcttgttaacagaggagaaacaagatgaccaacagcaacctggcggcagcgcaaaagatg

SEQ ID NO: 152673 - DNA, 103 bp, Artificial Sequence
  Synthetic Polynucleotide
taatacgactcactatagggccgctgcacttggccgcgaagagctgttggaacagaggagaccaacaatgcttcgcggcaacctggcggcagcgcaaaagatg

SEQ ID NO: 152674 - DNA, 103 bp, Artificial Sequence
  Synthetic Polynucleotide
taatacgactcactatagggctccatgcagccgctgcacttggccgcgaaaacagaggagattcgcgatgaagtgcagcaacctggcggcagcgcaaaagatg

SEQ ID NO: 152675 - DNA, 103 bp, Artificial Sequence
  Synthetic Polynucleotide
taatacgactcactataggggggcgatcttctccatgcagccgctgcactaacagaggagaagtgcaatggctgcatggaacctggcggcagcgcaaaagatg

SEQ ID NO: 152676 - DNA, 103 bp, Artificial Sequence
  Synthetic Polynucleotide
taatacgactcactatagggaactcggtgggggcgatcttctccatgcagaacagaggagactgcatatggaagatcgcaacctggcggcagcgcaaaagatg

SEQ ID NO: 152677 - DNA, 103 bp, Artificial Sequence
  Synthetic Polynucleotide
taatacgactcactatagggccgcatcacgaactcggtgggggcgatcttaacagaggagaaagatcatgcccaccgagaacctggcggcagcgcaaaagatg

SEQ ID NO: 152678 - DNA, 103 bp, Artificial Sequence
  Synthetic Polynucleotide
taatacgactcactatagggactccagcgcccgcatcacgaactcggtggaacagaggagaccaccgatgtcgtgatgcaacctggcggcagcgcaaaagatg

SEQ ID NO: 152679 - DNA, 103 bp, Artificial Sequence
  Synthetic Polynucleotide
taatacgactcactatagggtggtacacgcactccagcgcccgcatcacgaacagaggagacgtgatatgggcgctggaaacctggcggcagcgcaaaagatg

SEQ ID NO: 152680 - DNA, 103 bp, Artificial Sequence
  Synthetic Polynucleotide
taatacgactcactataggggtccgtctgcccgcgagggaagcacctctcaacagaggagagagaggatgttccctcgcaacctggcggcagcgcaaaagatg

SEQ ID NO: 152681 - DNA, 103 bp, Artificial Sequence
  Synthetic Polynucleotide
taatacgactcactataggggcagcccaggtggtacacgcactccagcgcaacagaggagagcgctgatgtgcgtgtacaacctggcggcagcgcaaaagatg

SEQ ID NO: 152682 - DNA, 103 bp, Artificial Sequence
  Synthetic Polynucleotide
taatacgactcactatagggagcagcagaagcagcccaggtggtacacgcaacagaggagagcgtgtatgacctgggctaacctggcggcagcgcaaaagatg

SEQ ID NO: 152683 - DNA, 103 bp, Artificial Sequence
  Synthetic Polynucleotide
taatacgactcactatagggtcacacacgcagcagcagaagcagcccaggaacagaggagacctgggatgcttctgctgaacctggcggcagcgcaaaagatg

SEQ ID NO: 152684 - DNA, 103 bp, Artificial Sequence
  Synthetic Polynucleotide
taatacgactcactatagggtagctgccgttcacacacgcagcagcagaaaacagaggagattctgcatgtgcgtgtgtaacctggcggcagcgcaaaagatg

SEQ ID NO: 152685 - DNA, 103 bp, Artificial Sequence
  Synthetic Polynucleotide
taatacgactcactatagggcgcccttgcgtagctgccgttcacacacgcaacagaggagagcgtgtatgaacggcagcaacctggcggcagcgcaaaagatg

SEQ ID NO: 152686 - DNA, 103 bp, Artificial Sequence
  Synthetic Polynucleotide
taatacgactcactatagggacgaattcgtcgcccttgcgtagctgccgtaacagaggagaacggcaatgacgcaagggaacctggcggcagcgcaaaagatg

SEQ ID NO: 152687 - DNA, 103 bp, Artificial Sequence
  Synthetic Polynucleotide
taatacgactcactatagggctccttgagcacgaattcgtcgcccttgcgaacagaggagacgcaagatggacgaattcaacctggcggcagcgcaaaagatg

SEQ ID NO: 152688 - DNA, 103 bp, Artificial Sequence
  Synthetic Polynucleotide
taatacgactcactataggggcagctggccctccttgagcacgaattcgtaacagaggagaacgaatatgtgctcaaggaacctggcggcagcgcaaaagatg

SEQ ID NO: 152689 - DNA, 103 bp, Artificial Sequence
  Synthetic Polynucleotide
taatacgactcactatagggcccttgcacagcagctggccctccttgagcaacagaggagagctcaaatggggccagctaacctggcggcagcgcaaaagatg

SEQ ID NO: 152690 - DNA, 103 bp, Artificial Sequence
  Synthetic Polynucleotide
taatacgactcactatagggctcgtagtcacccttgcacagcagctggccaacagaggagaggccagatgctgtgcaagaacctggcggcagcgcaaaagatg

SEQ ID NO: 152691 - DNA, 103 bp, Artificial Sequence
  Synthetic Polynucleotide
taatacgactcactatagggtcttggcgcagtccgtctgcccgcgagggaaacagaggagatccctcatgggcagacggaacctggcggcagcgcaaaagatg

SEQ ID NO: 152692 - DNA, 103 bp, Artificial Sequence
  Synthetic Polynucleotide
taatacgactcactatagggccttctccttctcgtagtcacccttgcacaaacagaggagatgtgcaatggtgactacgaacctggcggcagcgcaaaagatg

SEQ ID NO: 152693 - DNA, 103 bp, Artificial Sequence
  Synthetic Polynucleotide
taatacgactcactatagggctgagcaggtccttctccttctcgtagtcaaacagaggagatgactaatggaaggagaaaacctggcggcagcgcaaaagatg

SEQ ID NO: 152694 - DNA, 103 bp, Artificial Sequence
  Synthetic Polynucleotide
taatacgactcactataggggctcacggagctgagcaggtccttctccttaacagaggagaaaggagatggacctgctcaacctggcggcagcgcaaaagatg

SEQ ID NO: 152695 - DNA, 103 bp, Artificial Sequence
  Synthetic Polynucleotide
taatacgactcactatagggactcgtcggggctcacggagctgagcaggtaacagaggagaacctgcatggctccgtgaaacctggcggcagcgcaaaagatg

SEQ ID NO: 152696 - DNA, 103 bp, Artificial Sequence
  Synthetic Polynucleotide
taatacgactcactatagggacggagtcggactcgtcggggctcacggagaacagaggagactccgtatgccccgacgaaacctggcggcagcgcaaaagatg

SEQ ID NO: 152697 - DNA, 103 bp, Artificial Sequence
  Synthetic Polynucleotide
taatacgactcactatagggctcgctcttcacggagtcggactcgtcgggaacagaggagacccgacatgtccgactccaacctggcggcagcgcaaaagatg

SEQ ID NO: 152698 - DNA, 103 bp, Artificial Sequence
  Synthetic Polynucleotide
taatacgactcactatagggcatcttcatcctcgctcttcacggagtcggaacagaggagaccgactatgtgaagagcgaacctggcggcagcgcaaaagatg

SEQ ID NO: 152699 - DNA, 103 bp, Artificial Sequence
  Synthetic Polynucleotide
taatacgactcactatagggttcatgtccccatcttcatcctcgctcttcaacagaggagagaagagatgggatgaagaaacctggcggcagcgcaaaagatg

SEQ ID NO: 152700 - DNA, 103 bp, Artificial Sequence
  Synthetic Polynucleotide
taatacgactcactatagggcttggccggcttcatgtccccatcttcatcaacagaggagagatgaaatgggggacatgaacctggcggcagcgcaaaagatg

SEQ ID NO: 152701 - DNA, 103 bp, Artificial Sequence
  Synthetic Polynucleotide
taatacgactcactatagggtgccctgccccttggccggcttcatgtcccaacagaggagagggacaatgagccggccaaacctggcggcagcgcaaaagatg

SEQ ID NO: 152702 - DNA, 103 bp, Artificial Sequence
  Synthetic Polynucleotide
taatacgactcactatagggccgtccaacatcttggcgcagtccgtctgcaacagaggagagcagacatgctgcgccaaaacctggcggcagcgcaaaagatg

SEQ ID NO: 152703 - DNA, 103 bp, Artificial Sequence
  Synthetic Polynucleotide
taatacgactcactatagggttgctctgactgccctgccccttggccggcaacagaggagagccggcatgggggcagggaacctggcggcagcgcaaaagatg

SEQ ID NO: 152704 - DNA, 103 bp, Artificial Sequence
  Synthetic Polynucleotide
taatacgactcactatagggcccgctgcccttgctctgactgccctgcccaacagaggagagggcagatgagtcagagcaacctggcggcagcgcaaaagatg

SEQ ID NO: 152705 - DNA, 103 bp, Artificial Sequence
  Synthetic Polynucleotide
taatacgactcactatagggtcccgtcatccccgctgcccttgctctgacaacagaggagagtcagaatgagggcagcgaacctggcggcagcgcaaaagatg

SEQ ID NO: 152706 - DNA, 103 bp, Artificial Sequence
  Synthetic Polynucleotide
taatacgactcactatagggcgcgggtccttcccgtcatccccgctgcccaacagaggagagggcagatgggatgacggaacctggcggcagcgcaaaagatg

SEQ ID NO: 152707 - DNA, 103 bp, Artificial Sequence
  Synthetic Polynucleotide
taatacgactcactatagggcttgggcctccgcgggtccttcccgtcatcaacagaggagagatgacatgaaggacccgaacctggcggcagcgcaaaagatg

SEQ ID NO: 152708 - DNA, 103 bp, Artificial Sequence
  Synthetic Polynucleotide
taatacgactcactatagggtccggggtcgcttgggcctccgcgggtcctaacagaggagaaggaccatgggaggcccaaacctggcggcagcgcaaaagatg

SEQ ID NO: 152709 - DNA, 103 bp, Artificial Sequence
  Synthetic Polynucleotide
taatacgactcactataggggtgaggatggtccggggtcgcttgggcctcaacagaggagagaggccatggcgaccccgaacctggcggcagcgcaaaagatg

SEQ ID NO: 152710 - DNA, 103 bp, Artificial Sequence
  Synthetic Polynucleotide
taatacgactcactatagggctgctgcgtggtgaggatggtccggggtcgaacagaggagacgacccatgaccatcctcaacctggcggcagcgcaaaagatg

SEQ ID NO: 152711 - DNA, 103 bp, Artificial Sequence
  Synthetic Polynucleotide
taatacgactcactatagggaggctcttcgctgctgcgtggtgaggatggaacagaggagaccatccatgccacgcagcaacctggcggcagcgcaaaagatg

SEQ ID NO: 152712 - DNA, 103 bp, Artificial Sequence
  Synthetic Polynucleotide
taatacgactcactataggggaggccttgaaggctcttcgctgctgcgtgaacagaggagacacgcaatggcgaagagcaacctggcggcagcgcaaaagatg

SEQ ID NO: 152713 - DNA, 103 bp, Artificial Sequence
  Synthetic Polynucleotide
taatacgactcactatagggcatcttgatgccgtccaacatcttggcgcaaacagaggagatgcgccatgatgttggacaacctggcggcagcgcaaaagatg

SEQ ID NO: 152714 - DNA, 103 bp, Artificial Sequence
  Synthetic Polynucleotide
taatacgactcactataggggacctcgaaggaggccttgaaggctcttcgaacagaggagacgaagaatgttcaaggccaacctggcggcagcgcaaaagatg

SEQ ID NO: 152715 - DNA, 103 bp, Artificial Sequence
  Synthetic Polynucleotide
taatacgactcactataggggcttcgacgagacctcgaaggaggccttgaaacagaggagatcaaggatgccttcgaggaacctggcggcagcgcaaaagatg

SEQ ID NO: 152716 - DNA, 103 bp, Artificial Sequence
  Synthetic Polynucleotide
taatacgactcactatagggtttcggcaaggcttcgacgagacctcgaagaacagaggagacttcgaatgctcgtcgaaaacctggcggcagcgcaaaagatg

SEQ ID NO: 152717 - DNA, 103 bp, Artificial Sequence
  Synthetic Polynucleotide
taatacgactcactatagggctctcggacctttcggcaaggcttcgacgaaacagaggagatcgtcgatgccttgccgaaacctggcggcagcgcaaaagatg

SEQ ID NO: 152718 - DNA, 103 bp, Artificial Sequence
  Synthetic Polynucleotide
taatacgactcactatagggctgccagtgtctctcggacctttcggcaagaacagaggagacttgccatgaggtccgagaacctggcggcagcgcaaaagatg

SEQ ID NO: 152719 - DNA, 103 bp, Artificial Sequence
  Synthetic Polynucleotide
taatacgactcactatagggcccgtctcagctgccagtgtctctcggaccaacagaggagaggtccgatggacactggcaacctggcggcagcgcaaaagatg

SEQ ID NO: 152720 - DNA, 103 bp, Artificial Sequence
  Synthetic Polynucleotide
taatacgactcactatagggcacactgaggcccgtctcagctgccagtgtaacagaggagaacactgatggctgagacgaacctggcggcagcgcaaaagatg

SEQ ID NO: 152721 - DNA, 103 bp, Artificial Sequence
  Synthetic Polynucleotide
taatacgactcactatagggggaccacgcgcacactgaggcccgtctcagaacagaggagactgagaatggcctcagtgaacctggcggcagcgcaaaagatg

SEQ ID NO: 152722 - DNA, 103 bp, Artificial Sequence
  Synthetic Polynucleotide
taatacgactcactatagggaaccagacctggaccacgcgcacactgaggaacagaggagacctcagatggcgcgtggtaacctggcggcagcgcaaaagatg

SEQ ID NO: 152723 - DNA, 103 bp, Artificial Sequence
  Synthetic Polynucleotide
taatacgactcactatagggttggttctgaaaccagacctggaccacgcgaacagaggagacgcgtgatgcaggtctggaacctggcggcagcgcaaaagatg

SEQ ID NO: 152724 - DNA, 103 bp, Artificial Sequence
  Synthetic Polynucleotide
taatacgactcactatagggcgtgctcctccatcttgatgccgtccaacaaacagaggagatgttggatggcatcaagaaacctggcggcagcgcaaaagatg

SEQ ID NO: 152725 - DNA, 103 bp, Artificial Sequence
  Synthetic Polynucleotide
taatacgactcactatagggtctttgctctttggttctgaaaccagacctaacagaggagaaggtctatgttcagaaccaacctggcggcagcgcaaaagatg

SEQ ID NO: 152726 - DNA, 103 bp, Artificial Sequence
  Synthetic Polynucleotide
taatacgactcactatagggagcttcttcatctttgctctttggttctgaaacagaggagatcagaaatgaagagcaaaaacctggcggcagcgcaaaagatg

SEQ ID NO: 152727 - DNA, 103 bp, Artificial Sequence
  Synthetic Polynucleotide
taatacgactcactatagggccgccgcgccagcttcttcatctttgctctaacagaggagaagagcaatgatgaagaagaacctggcggcagcgcaaaagatg

SEQ ID NO: 152728 - DNA, 103 bp, Artificial Sequence
  Synthetic Polynucleotide
taatacgactcactataggggctgctggtgccgccgcgccagcttcttcaaacagaggagatgaagaatgtggcgcggcaacctggcggcagcgcaaaagatg

SEQ ID NO: 152729 - DNA, 103 bp, Artificial Sequence
  Synthetic Polynucleotide
taatacgactcactatagggtgctcctgctgctgctggtgccgccgcgccaacagaggagaggcgcgatggcaccagcaaacctggcggcagcgcaaaagatg

SEQ ID NO: 152730 - DNA, 103 bp, Artificial Sequence
  Synthetic Polynucleotide
taatacgactcactatagggggagttctgctgctcctgctgctgctggtgaacagaggagacaccagatgcagcaggagaacctggcggcagcgcaaaagatg

SEQ ID NO: 152731 - DNA, 103 bp, Artificial Sequence
  Synthetic Polynucleotide
taatacgactcactatagggccagccgctgggagttctgctgctcctgctaacagaggagaagcaggatgagcagaactaacctggcggcagcgcaaaagatg

SEQ ID NO: 152732 - DNA, 103 bp, Artificial Sequence
  Synthetic Polynucleotide
taatacgactcactatagggtcaccctggcccagccgctgggagttctgcaacagaggagagcagaaatgccagcggctaacctggcggcagcgcaaaagatg

SEQ ID NO: 152733 - DNA, 103 bp, Artificial Sequence
  Synthetic Polynucleotide
taatacgactcactatagggcggccccggctcaccctggcccagccgctgaacagaggagacagcggatgggccagggtaacctggcggcagcgcaaaagatg

SEQ ID NO: 152734 - DNA, 103 bp, Artificial Sequence
  Synthetic Polynucleotide
taatacgactcactatagggggccctgccccggccccggctcaccctggcaacagaggagagccaggatgagccggggcaacctggcggcagcgcaaaagatg

SEQ ID NO: 152735 - DNA, 103 bp, Artificial Sequence
  Synthetic Polynucleotide
taatacgactcactataggggggcgcagggcgtgctcctccatcttgatgaacagaggagacatcaaatgggaggagcaaacctggcggcagcgcaaaagatg

SEQ ID NO: 152736 - DNA, 103 bp, Artificial Sequence
  Synthetic Polynucleotide
taatacgactcactatagggtcctggcccaggccctgccccggccccggcaacagaggagagccgggatgggggcagggaacctggcggcagcgcaaaagatg

SEQ ID NO: 152737 - DNA, 103 bp, Artificial Sequence
  Synthetic Polynucleotide
taatacgactcactatagggggacaggacctcctggcccaggccctgcccaacagaggagagggcagatgctgggccagaacctggcggcagcgcaaaagatg

SEQ ID NO: 152738 - DNA, 103 bp, Artificial Sequence
  Synthetic Polynucleotide
taatacgactcactatagggccatgcggctggacaggacctcctggcccaaacagaggagatgggccatgaggtcctgtaacctggcggcagcgcaaaagatg

SEQ ID NO: 152739 - DNA, 103 bp, Artificial Sequence
  Synthetic Polynucleotide
taatacgactcactatagggatcatgccctccatgcggctggacaggaccaacagaggagaggtcctatgcagccgcataacctggcggcagcgcaaaagatg

SEQ ID NO: 152740 - DNA, 103 bp, Artificial Sequence
  Synthetic Polynucleotide
taatacgactcactataggggtaggaagccatcatgccctccatgcggctaacagaggagaagccgcatggagggcatgaacctggcggcagcgcaaaagatg

SEQ ID NO: 152741 - DNA, 103 bp, Artificial Sequence
  Synthetic Polynucleotide
taatacgactcactatagggccagcggcgtgtaggaagccatcatgccctaacagaggagaagggcaatgtggcttcctaacctggcggcagcgcaaaagatg

SEQ ID NO: 152742 - DNA, 103 bp, Artificial Sequence
  Synthetic Polynucleotide
taatacgactcactatagggtgtggtggggccagcggcgtgtaggaagccaacagaggagaggcttcatgcacgccgctaacctggcggcagcgcaaaagatg

SEQ ID NO: 152743 - DNA, 103 bp, Artificial Sequence
  Synthetic Polynucleotide
taatacgactcactataggggatctgctgctgtggtggggccagcggcgtaacagaggagaacgccgatggccccaccaaacctggcggcagcgcaaaagatg

SEQ ID NO: 152744 - DNA, 103 bp, Artificial Sequence
  Synthetic Polynucleotide
taatacgactcactatagggccatggccacgatctgctgctgtggtggggaacagaggagaccccacatgagcagcagaaacctggcggcagcgcaaaagatg

SEQ ID NO: 152745 - DNA, 103 bp, Artificial Sequence
  Synthetic Polynucleotide
taatacgactcactataggggggctctgttccatggccacgatctgctgcaacagaggagagcagcaatgcgtggccataacctggcggcagcgcaaaagatg

SEQ ID NO: 152746 - DNA, 103 bp, Artificial Sequence
  Synthetic Polynucleotide
taatacgactcactatagggcagtcgcacgtagccagtgctcgccgccataacagaggagaatggcgatgagcactggcaacctggcggcagcgcaaaagatg

SEQ ID NO: 152747 - DNA, 103 bp, Artificial Sequence
  Synthetic Polynucleotide
taatacgactcactataggggagcaaccacgctcctgctgcagtgggaacaacagaggagagttcccatggcagcaggaaacctggcggcagcgcaaaagatg

SEQ ID NO: 152748 - DNA, 103 bp, Artificial Sequence
  Synthetic Polynucleotide
taatacgactcactatagggcccggtgagcgcggcgcccatgtcgctcagaacagaggagactgagcatgatgggcgccaacctggcggcagcgcaaaagatg

SEQ ID NO: 152749 - DNA, 103 bp, Artificial Sequence
  Synthetic Polynucleotide
taatacgactcactataggggggactcggccccggtgagcgcggcgcccaaacagaggagatgggcgatgcgctcaccgaacctggcggcagcgcaaaagatg

SEQ ID NO: 152750 - DNA, 103 bp, Artificial Sequence
  Synthetic Polynucleotide
taatacgactcactatagggtgcagctcatgggactcggccccggtgagcaacagaggagagctcacatgggccgagtcaacctggcggcagcgcaaaagatg

SEQ ID NO: 152751 - DNA, 103 bp, Artificial Sequence
  Synthetic Polynucleotide
taatacgactcactatagggcaggacgtcctgcagctcatgggactcggcaacagaggagagccgagatgcatgagctgaacctggcggcagcgcaaaagatg

SEQ ID NO: 152752 - DNA, 103 bp, Artificial Sequence
  Synthetic Polynucleotide
taatacgactcactatagggtggtctcttccaggacgtcctgcagctcataacagaggagaatgagcatgaggacgtccaacctggcggcagcgcaaaagatg

SEQ ID NO: 152753 - DNA, 103 bp, Artificial Sequence
  Synthetic Polynucleotide
taatacgactcactatagggttaggaatattggtctcttccaggacgtccaacagaggagaggacgtatgggaagagacaacctggcggcagcgcaaaagatg

SEQ ID NO: 152754 - DNA, 103 bp, Artificial Sequence
  Synthetic Polynucleotide
taatacgactcactataggggtacagccgcttaggaatattggtctcttcaacagaggagagaagagatgaatattcctaacctggcggcagcgcaaaagatg

SEQ ID NO: 152755 - DNA, 103 bp, Artificial Sequence
  Synthetic Polynucleotide
taatacgactcactatagggagagggccttgtacagccgcttaggaatataacagaggagaatattcatgagcggctgtaacctggcggcagcgcaaaagatg

SEQ ID NO: 152756 - DNA, 103 bp, Artificial Sequence
  Synthetic Polynucleotide
taatacgactcactatagggttcagcagggagagggccttgtacagccgcaacagaggagagcggctatgcaaggccctaacctggcggcagcgcaaaagatg

SEQ ID NO: 152757 - DNA, 103 bp, Artificial Sequence
  Synthetic Polynucleotide
taatacgactcactatagggaaattccttcttcagcagggagagggccttaacagaggagaaaggccatgtccctgctgaacctggcggcagcgcaaaagatg

SEQ ID NO: 152758 - DNA, 103 bp, Artificial Sequence
  Synthetic Polynucleotide
taatacgactcactataggggctggcctcggagcaaccacgctcctgctgaacagaggagacagcagatgcgtggttgcaacctggcggcagcgcaaaagatg

SEQ ID NO: 152759 - DNA, 103 bp, Artificial Sequence
  Synthetic Polynucleotide
taatacgactcactatagggtgctcagttcaaattccttcttcagcagggaacagaggagaccctgcatgagaaggaataacctggcggcagcgcaaaagatg

SEQ ID NO: 152760 - DNA, 103 bp, Artificial Sequence
  Synthetic Polynucleotide
taatacgactcactatagggtgctgcagcttgctcagttcaaattccttcaacagaggagagaaggaatgtgaactgagaacctggcggcagcgcaaaagatg

SEQ ID NO: 152761 - DNA, 103 bp, Artificial Sequence
  Synthetic Polynucleotide
taatacgactcactatagggccccaggcgctgctgcagcttgctcagttcaacagaggagagaactgatgaagctgcagaacctggcggcagcgcaaaagatg

SEQ ID NO: 152762 - DNA, 103 bp, Artificial Sequence
  Synthetic Polynucleotide
taatacgactcactatagggccacctcccgccccaggcgctgctgcagctaacagaggagaagctgcatgagcgcctggaacctggcggcagcgcaaaagatg

SEQ ID NO: 152763 - DNA, 103 bp, Artificial Sequence
  Synthetic Polynucleotide
taatacgactcactatagggatcttctcctccacctcccgccccaggcgcaacagaggagagcgcctatggcgggaggtaacctggcggcagcgcaaaagatg

SEQ ID NO: 152764 - DNA, 103 bp, Artificial Sequence
  Synthetic Polynucleotide
taatacgactcactatagggggtctgcttgatcttctcctccacctcccgaacagaggagacgggagatggaggagaagaacctggcggcagcgcaaaagatg

SEQ ID NO: 152765 - DNA, 103 bp, Artificial Sequence
  Synthetic Polynucleotide
taatacgactcactatagggacttacggtgggtctgcttgatcttctcctaacagaggagaaggagaatgtcaagcagaaacctggcggcagcgcaaaagatg

SEQ ID NO: 152766 - DNA, 103 bp, Artificial Sequence
  Synthetic Polynucleotide
taatacgactcactatagggtgcagcaggtacttacggtgggtctgcttgaacagaggagacaagcaatgccaccgtaaaacctggcggcagcgcaaaagatg

SEQ ID NO: 152767 - DNA, 103 bp, Artificial Sequence
  Synthetic Polynucleotide
taatacgactcactatagggtagctgctcctgcagcaggtacttacggtgaacagaggagacaccgtatgtacctgctgaacctggcggcagcgcaaaagatg

SEQ ID NO: 152768 - DNA, 103 bp, Artificial Sequence
  Synthetic Polynucleotide
taatacgactcactatagggtgatgatctttagctgctcctgcagcaggtaacagaggagaacctgcatgaggagcagcaacctggcggcagcgcaaaagatg

SEQ ID NO: 152769 - DNA, 103 bp, Artificial Sequence
  Synthetic Polynucleotide
taatacgactcactatagggtcgcaggtccgctggcctcggagcaaccacaacagaggagagtggttatgccgaggccaaacctggcggcagcgcaaaagatg

SEQ ID NO: 152770 - DNA, 103 bp, Artificial Sequence
  Synthetic Polynucleotide
taatacgactcactatagggagctccttcttgatgatctttagctgctccaacagaggagaggagcaatgaaagatcataacctggcggcagcgcaaaagatg

SEQ ID NO: 152771 - DNA, 103 bp, Artificial Sequence
  Synthetic Polynucleotide
taatacgactcactatagggctccaggcccagctccttcttgatgatcttaacagaggagaaagatcatgaagaaggagaacctggcggcagcgcaaaagatg

SEQ ID NO: 152772 - DNA, 103 bp, Artificial Sequence
  Synthetic Polynucleotide
taatacgactcactatagggtgtcgtccttctccaggcccagctccttctaacagaggagaagaaggatgtgggcctggaacctggcggcagcgcaaaagatg

SEQ ID NO: 152773 - DNA, 103 bp, Artificial Sequence
  Synthetic Polynucleotide
taatacgactcactatagggatggcatccttgtcgtccttctccaggcccaacagaggagagggcctatggaaggacgaaacctggcggcagcgcaaaagatg

SEQ ID NO: 152774 - DNA, 103 bp, Artificial Sequence
  Synthetic Polynucleotide
taatacgactcactatagggcttctcctcgatggcatccttgtcgtccttaacagaggagaaaggacatgaaggatgccaacctggcggcagcgcaaaagatg

SEQ ID NO: 152775 - DNA, 103 bp, Artificial Sequence
  Synthetic Polynucleotide
taatacgactcactataggggctcccggaacttctcctcgatggcatcctaacagaggagaaggatgatgtcgaggagaaacctggcggcagcgcaaaagatg

SEQ ID NO: 152776 - DNA, 103 bp, Artificial Sequence
  Synthetic Polynucleotide
taatacgactcactatagggtccttcaggcgctcccggaacttctcctcgaacagaggagacgaggaatggttccgggaaacctggcggcagcgcaaaagatg

SEQ ID NO: 152777 - DNA, 103 bp, Artificial Sequence
  Synthetic Polynucleotide
taatacgactcactataggggaccacgagctccttcaggcgctcccggaaaacagaggagattccggatgcgcctgaagaacctggcggcagcgcaaaagatg

SEQ ID NO: 152778 - DNA, 103 bp, Artificial Sequence
  Synthetic Polynucleotide
taatacgactcactatagggcgtgcttggggaccacgagctccttcaggcaacagaggagagcctgaatgagctcgtggaacctggcggcagcgcaaaagatg

SEQ ID NO: 152779 - DNA, 103 bp, Artificial Sequence
  Synthetic Polynucleotide
taatacgactcactatagggacatccatgacgtgcttggggaccacgagcaacagaggagagctcgtatgccccaagcaaacctggcggcagcgcaaaagatg

SEQ ID NO: 152780 - DNA, 103 bp, Artificial Sequence
  Synthetic Polynucleotide
taatacgactcactatagggaggagaggcgtcgcaggtccgctggcctcgaacagaggagacgaggcatgcggacctgcaacctggcggcagcgcaaaagatg

SEQ ID NO: 152781 - DNA, 103 bp, Artificial Sequence
  Synthetic Polynucleotide
taatacgactcactatagggctcgtccacaacatccatgacgtgcttgggaacagaggagacccaagatggtcatggataacctggcggcagcgcaaaagatg

SEQ ID NO: 152782 - DNA, 103 bp, Artificial Sequence
  Synthetic Polynucleotide
taatacgactcactatagggtgctcagctcctcgtccacaacatccatgaaacagaggagatcatggatgttgtggacgaacctggcggcagcgcaaaagatg

SEQ ID NO: 152783 - DNA, 103 bp, Artificial Sequence
  Synthetic Polynucleotide
taatacgactcactatagggaggcccagcttgctcagctcctcgtccacaaacagaggagatgtggaatgggagctgagaacctggcggcagcgcaaaagatg

SEQ ID NO: 152784 - DNA, 103 bp, Artificial Sequence
  Synthetic Polynucleotide
taatacgactcactataggggttgtccagcaggcccagcttgctcagctcaacagaggagagagctgatgaagctgggcaacctggcggcagcgcaaaagatg

SEQ ID NO: 152785 - DNA, 103 bp, Artificial Sequence
  Synthetic Polynucleotide
taatacgactcactatagggccgaggagtggttgtccagcaggcccagctaacagaggagaagctggatgtgctggacaaacctggcggcagcgcaaaagatg

SEQ ID NO: 152786 - DNA, 103 bp, Artificial Sequence
  Synthetic Polynucleotide
taatacgactcactatagggacattgaactccgaggagtggttgtccagcaacagaggagagctggaatgccactcctcaacctggcggcagcgcaaaagatg

SEQ ID NO: 152787 - DNA, 103 bp, Artificial Sequence
  Synthetic Polynucleotide
taatacgactcactataggggttgcgggtgacattgaactccgaggagtgaacagaggagacactccatggagttcaataacctggcggcagcgcaaaagatg

SEQ ID NO: 152788 - DNA, 103 bp, Artificial Sequence
  Synthetic Polynucleotide
taatacgactcactatagggagtctaggtagttgcgggtgacattgaactaacagaggagaagttcaatgtcacccgcaaacctggcggcagcgcaaaagatg

SEQ ID NO: 152789 - DNA, 103 bp, Artificial Sequence
  Synthetic Polynucleotide
taatacgactcactataggggacgtgagccagtctaggtagttgcgggtgaacagaggagacacccgatgctacctagaaacctggcggcagcgcaaaagatg

SEQ ID NO: 152790 - DNA, 103 bp, Artificial Sequence
  Synthetic Polynucleotide
taatacgactcactatagggccaagggatggacgtgagccagtctaggtaaacagaggagatacctaatgtggctcacgaacctggcggcagcgcaaaagatg

SEQ ID NO: 152791 - DNA, 103 bp, Artificial Sequence
  Synthetic Polynucleotide
taatacgactcactataggggtgcccaaggaggagaggcgtcgcaggtccaacagaggagaggacctatgacgcctctcaacctggcggcagcgcaaaagatg

SEQ ID NO: 152792 - DNA, 103 bp, Artificial Sequence
  Synthetic Polynucleotide
taatacgactcactatagggtgtacttgccccaagggatggacgtgagccaacagaggagaggctcaatgccatcccttaacctggcggcagcgcaaaagatg

SEQ ID NO: 152793 - DNA, 103 bp, Artificial Sequence
  Synthetic Polynucleotide
taatacgactcactatagggttctcgttgctgtacttgccccaagggatgaacagaggagacatcccatggggcaagtaaacctggcggcagcgcaaaagatg

SEQ ID NO: 152794 - DNA, 103 bp, Artificial Sequence
  Synthetic Polynucleotide
taatacgactcactatagggcaggtccaggttctcgttgctgtacttgccaacagaggagaggcaagatgagcaacgagaacctggcggcagcgcaaaagatg

SEQ ID NO: 152795 - DNA, 103 bp, Artificial Sequence
  Synthetic Polynucleotide
taatacgactcactataggggtgcccgcgccaggtccaggttctcgttgcaacagaggagagcaacgatgacctggaccaacctggcggcagcgcaaaagatg

SEQ ID NO: 152796 - DNA, 103 bp, Artificial Sequence
  Synthetic Polynucleotide
taatacgactcactatagggagcactgcctgtgcccgcgccaggtccaggaacagaggagacctggaatgggcgcgggcaacctggcggcagcgcaaaagatg

SEQ ID NO: 152797 - DNA, 103 bp, Artificial Sequence
  Synthetic Polynucleotide
taatacgactcactataggggtcttcctccagcactgcctgtgcccgcgcaacagaggagagcgcggatgcaggcagtgaacctggcggcagcgcaaaagatg

SEQ ID NO: 152798 - DNA, 103 bp, Artificial Sequence
  Synthetic Polynucleotide
taatacgactcactatagggtgccgtagtggtcttcctccagcactgcctaacagaggagaaggcagatgtggaggaagaacctggcggcagcgcaaaagatg

SEQ ID NO: 152799 - DNA, 103 bp, Artificial Sequence
  Synthetic Polynucleotide
taatacgactcactatagggacgtcctccatgccgtagtggtcttcctccaacagaggagaggaggaatgccactacggaacctggcggcagcgcaaaagatg

SEQ ID NO: 152800 - DNA, 103 bp, Artificial Sequence
  Synthetic Polynucleotide
taatacgactcactataggggcgtttcttgacgtcctccatgccgtagtgaacagaggagacactacatgatggaggacaacctggcggcagcgcaaaagatg

SEQ ID NO: 152801 - DNA, 103 bp, Artificial Sequence
  Synthetic Polynucleotide
taatacgactcactatagggactccaggatgcgtttcttgacgtcctccaaacagaggagatggaggatgtcaagaaacaacctggcggcagcgcaaaagatg

SEQ ID NO: 152802 - DNA, 103 bp, Artificial Sequence
  Synthetic Polynucleotide
taatacgactcactatagggcggccccacagtgcccaaggaggagaggcgaacagaggagacgcctcatgtccttgggcaacctggcggcagcgcaaaagatg

SEQ ID NO: 152803 - DNA, 103 bp, Artificial Sequence
  Synthetic Polynucleotide
taatacgactcactatagggacggcaatgaactccaggatgcgtttcttgaacagaggagacaagaaatgcatcctggaaacctggcggcagcgcaaaagatg

SEQ ID NO: 152804 - DNA, 103 bp, Artificial Sequence
  Synthetic Polynucleotide
taatacgactcactataggggagctggctaacggcaatgaactccaggataacagaggagaatcctgatgttcattgccaacctggcggcagcgcaaaagatg

SEQ ID NO: 152805 - DNA, 103 bp, Artificial Sequence
  Synthetic Polynucleotide
taatacgactcactatagggtggagccgcggagctggctaacggcaatgaaacagaggagatcattgatgttagccagcaacctggcggcagcgcaaaagatg

SEQ ID NO: 152806 - DNA, 103 bp, Artificial Sequence
  Synthetic Polynucleotide
taatacgactcactatagggttgccctgggtggagccgcggagctggctaaacagaggagatagccaatgccgcggctcaacctggcggcagcgcaaaagatg

SEQ ID NO: 152807 - DNA, 103 bp, Artificial Sequence
  Synthetic Polynucleotide
taatacgactcactataggggcagaggatcttgccctgggtggagccgcgaacagaggagacgcggcatgacccagggcaacctggcggcagcgcaaaagatg

SEQ ID NO: 152808 - DNA, 103 bp, Artificial Sequence
  Synthetic Polynucleotide
taatacgactcactatagggggccatagaagcagaggatcttgccctgggaacagaggagacccaggatgagatcctctaacctggcggcagcgcaaaagatg

SEQ ID NO: 152809 - DNA, 103 bp, Artificial Sequence
  Synthetic Polynucleotide
taatacgactcactatagggacgccaggggggccatagaagcagaggatcaacagaggagagatcctatgcttctatggaacctggcggcagcgcaaaagatg

SEQ ID NO: 152810 - DNA, 103 bp, Artificial Sequence
  Synthetic Polynucleotide
taatacgactcactatagggggtcttacccacgccaggggggccatagaaaacagaggagattctatatgccccctggcaacctggcggcagcgcaaaagatg

SEQ ID NO: 152811 - DNA, 103 bp, Artificial Sequence
  Synthetic Polynucleotide
taatacgactcactataggggagcaatgctggtcttacccacgccaggggaacagaggagacccctgatgtgggtaagaaacctggcggcagcgcaaaagatg

SEQ ID NO: 152812 - DNA, 103 bp, Artificial Sequence
  Synthetic Polynucleotide
taatacgactcactataggggcgatggagcgagcaatgctggtcttacccaacagaggagagggtaaatgcagcattgcaacctggcggcagcgcaaaagatg

SEQ ID NO: 152813 - DNA, 103 bp, Artificial Sequence
  Synthetic Polynucleotide
taatacgactcactatagggtgccgggcctcggccccacagtgcccaaggaacagaggagaccttggatgctgtggggcaacctggcggcagcgcaaaagatg

SEQ ID NO: 152814 - DNA, 103 bp, Artificial Sequence
  Synthetic Polynucleotide
taatacgactcactatagggcagggcgcgggcgatggagcgagcaatgctaacagaggagaagcattatgcgctccatcaacctggcggcagcgcaaaagatg

SEQ ID NO: 152815 - DNA, 103 bp, Artificial Sequence
  Synthetic Polynucleotide
taatacgactcactatagggactctcggttcagggcgcgggcgatggagcaacagaggagagctccaatgcccgcgcccaacctggcggcagcgcaaaagatg

SEQ ID NO: 152816 - DNA, 103 bp, Artificial Sequence
  Synthetic Polynucleotide
taatacgactcactatagggaagcggaagtactctcggttcagggcgcggaacagaggagaccgcgcatggaaccgagaaacctggcggcagcgcaaaagatg

SEQ ID NO: 152817 - DNA, 103 bp, Artificial Sequence
  Synthetic Polynucleotide
taatacgactcactatagggcccgacgctgaagcggaagtactctcggttaacagaggagaaaccgaatgtacttccgcaacctggcggcagcgcaaaagatg

SEQ ID NO: 152818 - DNA, 103 bp, Artificial Sequence
  Synthetic Polynucleotide
taatacgactcactatagggcagtcatgcccccgacgctgaagcggaagtaacagaggagaacttccatgtcagcgtcgaacctggcggcagcgcaaaagatg

SEQ ID NO: 152819 - DNA, 103 bp, Artificial Sequence
  Synthetic Polynucleotide
taatacgactcactatagggtcagccacgtcagtcatgcccccgacgctgaacagaggagacagcgtatggggcatgacaacctggcggcagcgcaaaagatg

SEQ ID NO: 152820 - DNA, 103 bp, Artificial Sequence
  Synthetic Polynucleotide
taatacgactcactataggggcccttgatctcagccacgtcagtcatgccaacagaggagaggcatgatggacgtggctaacctggcggcagcgcaaaagatg

SEQ ID NO: 152821 - DNA, 103 bp, Artificial Sequence
  Synthetic Polynucleotide
taatacgactcactatagggtccgcctgtggcccttgatctcagccacgtaacagaggagaacgtggatgagatcaaggaacctggcggcagcgcaaaagatg

SEQ ID NO: 152822 - DNA, 103 bp, Artificial Sequence
  Synthetic Polynucleotide
taatacgactcactatagggcccacgtaggtccgcctgtggcccttgatcaacagaggagagatcaaatgccacaggcgaacctggcggcagcgcaaaagatg

SEQ ID NO: 152823 - DNA, 103 bp, Artificial Sequence
  Synthetic Polynucleotide
taatacgactcactataggggggcatggcgcccacgtaggtccgcctgtgaacagaggagacacaggatgacctacgtgaacctggcggcagcgcaaaagatg

SEQ ID NO: 152824 - DNA, 103 bp, Artificial Sequence
  Synthetic Polynucleotide
taatacgactcactatagggggcccccaattgccgggcctcggccccacaaacagaggagatgtgggatggaggcccggaacctggcggcagcgcaaaagatg

SEQ ID NO: 152825 - DNA, 103 bp, Artificial Sequence
  Synthetic Polynucleotide
taatacgactcactatagggtgatcttcccgggcatggcgcccacgtaggaacagaggagacctacgatggcgccatgcaacctggcggcagcgcaaaagatg

SEQ ID NO: 152826 - DNA, 103 bp, Artificial Sequence
  Synthetic Polynucleotide
taatacgactcactatagggaaacactggatgatcttcccgggcatggcgaacagaggagacgccatatgcgggaagataacctggcggcagcgcaaaagatg

SEQ ID NO: 152827 - DNA, 103 bp, Artificial Sequence
  Synthetic Polynucleotide
taatacgactcactatagggggtcttcttcaaacactggatgatcttcccaacagaggagagggaagatgatccagtgtaacctggcggcagcgcaaaagatg

SEQ ID NO: 152828 - DNA, 103 bp, Artificial Sequence
  Synthetic Polynucleotide
taatacgactcactatagggtctccgtcttggtcttcttcaaacactggaaacagaggagatccagtatgtgaagaagaaacctggcggcagcgcaaaagatg

SEQ ID NO: 152829 - DNA, 103 bp, Artificial Sequence
  Synthetic Polynucleotide
taatacgactcactatagggatcagggggttctccgtcttggtcttcttcaacagaggagagaagaaatgcaagacggaaacctggcggcagcgcaaaagatg

SEQ ID NO: 152830 - DNA, 103 bp, Artificial Sequence
  Synthetic Polynucleotide
taatacgactcactataggggtcgatgaggatcagggggttctccgtcttaacagaggagaaagacgatgaaccccctgaacctggcggcagcgcaaaagatg

SEQ ID NO: 152831 - DNA, 103 bp, Artificial Sequence
  Synthetic Polynucleotide
taatacgactcactatagggtgtccacctcgtcgatgaggatcagggggtaacagaggagaacccccatgtcctcatcgaacctggcggcagcgcaaaagatg

SEQ ID NO: 152832 - DNA, 103 bp, Artificial Sequence
  Synthetic Polynucleotide
taatacgactcactatagggcggccgatcttgtccacctcgtcgatgaggaacagaggagacctcatatgcgaggtggaaacctggcggcagcgcaaaagatg

SEQ ID NO: 152833 - DNA, 103 bp, Artificial Sequence
  Synthetic Polynucleotide
taatacgactcactatagggctggtagcctcggccgatcttgtccacctcaacagaggagagaggtgatgaagatcggcaacctggcggcagcgcaaaagatg

SEQ ID NO: 152834 - DNA, 103 bp, Artificial Sequence
  Synthetic Polynucleotide
taatacgactcactatagggacgggtccccctggtagcctcggccgatctaacagaggagaagatcgatggaggctaccaacctggcggcagcgcaaaagatg

SEQ ID NO: 152835 - DNA, 103 bp, Artificial Sequence
  Synthetic Polynucleotide
taatacgactcactatagggccccgccattggcccccaattgccgggcctaacagaggagaaggcccatgaattgggggaacctggcggcagcgcaaaagatg

SEQ ID NO: 152836 - DNA, 103 bp, Artificial Sequence
  Synthetic Polynucleotide
taatacgactcactatagggagtgccgacgacgggtccccctggtagcctaacagaggagaaggctaatggggggacccaacctggcggcagcgcaaaagatg

SEQ ID NO: 152837 - DNA, 103 bp, Artificial Sequence
  Synthetic Polynucleotide
taatacgactcactatagggcagctccagcagtgccgacgacgggtccccaacagaggagaggggacatgtcgtcggcaaacctggcggcagcgcaaaagatg

SEQ ID NO: 152838 - DNA, 103 bp, Artificial Sequence
  Synthetic Polynucleotide
taatacgactcactatagggctgggtccagcagctccagcagtgccgacgaacagaggagacgtcggatgtgctggagcaacctggcggcagcgcaaaagatg

SEQ ID NO: 152839 - DNA, 103 bp, Artificial Sequence
  Synthetic Polynucleotide
taatacgactcactataggggcattctgctctgggtccagcagctccagcaacagaggagagctggaatggctggacccaacctggcggcagcgcaaaagatg

SEQ ID NO: 152840 - DNA, 103 bp, Artificial Sequence
  Synthetic Polynucleotide
taatacgactcactatagggcaggaagttggcattctgctctgggtccagaacagaggagactggacatggagcagaataacctggcggcagcgcaaaagatg

SEQ ID NO: 152841 - DNA, 103 bp, Artificial Sequence
  Synthetic Polynucleotide
taatacgactcactatagggggtagtggtccaggaagttggcattctgctaacagaggagaagcagaatgccaacttccaacctggcggcagcgcaaaagatg

SEQ ID NO: 152842 - DNA, 103 bp, Artificial Sequence
  Synthetic Polynucleotide
taatacgactcactatagggggcacgtccaggtagtggtccaggaagttgaacagaggagacaacttatgggaccactaaacctggcggcagcgcaaaagatg

SEQ ID NO: 152843 - DNA, 103 bp, Artificial Sequence
  Synthetic Polynucleotide
taatacgactcactatagggcaagtccacgggcacgtccaggtagtggtcaacagaggagagaccacatgctggacgtgaacctggcggcagcgcaaaagatg

SEQ ID NO: 152844 - DNA, 103 bp, Artificial Sequence
  Synthetic Polynucleotide
taatacgactcactataggggcaccttggacaagtccacgggcacgtccaaacagaggagatggacgatgccgtggactaacctggcggcagcgcaaaagatg

SEQ ID NO: 152845 - DNA, 103 bp, Artificial Sequence
  Synthetic Polynucleotide
taatacgactcactatagggcagatgaacagcaccttggacaagtccacgaacagaggagacgtggaatggtccaaggtaacctggcggcagcgcaaaagatg

SEQ ID NO: 152846 - DNA, 103 bp, Artificial Sequence
  Synthetic Polynucleotide
taatacgactcactatagggttcccaaaacccccgccattggcccccaataacagaggagaattgggatgcaatggcggaacctggcggcagcgcaaaagatg

SEQ ID NO: 152847 - DNA, 103 bp, Artificial Sequence
  Synthetic Polynucleotide
taatacgactcactataggggttggccgtgcagatgaacagcaccttggaaacagaggagatccaagatgctgttcatcaacctggcggcagcgcaaaagatg

SEQ ID NO: 152848 - DNA, 103 bp, Artificial Sequence
  Synthetic Polynucleotide
taatacgactcactatagggtgtccgtgacgttggccgtgcagatgaacaaacagaggagatgttcaatggcacggccaaacctggcggcagcgcaaaagatg

SEQ ID NO: 152849 - DNA, 103 bp, Artificial Sequence
  Synthetic Polynucleotide
taatacgactcactatagggtcggggatggtgtccgtgacgttggccgtgaacagaggagacacggcatgcgtcacggaaacctggcggcagcgcaaaagatg

SEQ ID NO: 152850 - DNA, 103 bp, Artificial Sequence
  Synthetic Polynucleotide
taatacgactcactatagggtcgcagcggctcggggatggtgtccgtgacaacagaggagagtcacgatgaccatccccaacctggcggcagcgcaaaagatg

SEQ ID NO: 152851 - DNA, 103 bp, Artificial Sequence
  Synthetic Polynucleotide
taatacgactcactatagggccatacggtctcgcagcggctcggggatggaacagaggagaccatccatgagccgctgcaacctggcggcagcgcaaaagatg

SEQ ID NO: 152852 - DNA, 103 bp, Artificial Sequence
  Synthetic Polynucleotide
taatacgactcactatagggttgatcatctccatacggtctcgcagcggcaacagaggagagccgctatgagaccgtataacctggcggcagcgcaaaagatg

SEQ ID NO: 152853 - DNA, 103 bp, Artificial Sequence
  Synthetic Polynucleotide
taatacgactcactataggggcccgacacgttgatcatctccatacggtcaacagaggagagaccgtatggagatgatcaacctggcggcagcgcaaaagatg

SEQ ID NO: 152854 - DNA, 103 bp, Artificial Sequence
  Synthetic Polynucleotide
taatacgactcactataggggggccacgtagcccgacacgttgatcatctaacagaggagaagatgaatgacgtgtcggaacctggcggcagcgcaaaagatg

SEQ ID NO: 152855 - DNA, 103 bp, Artificial Sequence
  Synthetic Polynucleotide
taatacgactcactatagggagcttctcctgggccacgtagcccgacacgaacagaggagacgtgtcatgctacgtggcaacctggcggcagcgcaaaagatg

SEQ ID NO: 152856 - DNA, 103 bp, Artificial Sequence
  Synthetic Polynucleotide
taatacgactcactatagggcgcaatggccagcttctcctgggccacgtaaacagaggagatacgtgatgcaggagaagaacctggcggcagcgcaaaagatg

SEQ ID NO: 152857 - DNA, 103 bp, Artificial Sequence
  Synthetic Polynucleotide
taatacgactcactatagggccgctccccacagtcgcacgtagccagtgcaacagaggagagcactgatgacgtgcgacaacctggcggcagcgcaaaagatg

SEQ ID NO: 152858 - DNA, 103 bp, Artificial Sequence
  Synthetic Polynucleotide
taatacgactcactatagggggctgctcgcttcccaaaacccccgccattaacagaggagaaatggcatgggttttgggaacctggcggcagcgcaaaagatg

SEQ ID NO: 152859 - DNA, 103 bp, Artificial Sequence
  Synthetic Polynucleotide
taatacgactcactatagggggtagcgctccgcaatggccagcttctcctaacagaggagaaggagaatgtggccattgaacctggcggcagcgcaaaagatg

SEQ ID NO: 152860 - DNA, 103 bp, Artificial Sequence
  Synthetic Polynucleotide
taatacgactcactatagggtggggcaccaggtagcgctccgcaatggccaacagaggagaggccatatgggagcgctaaacctggcggcagcgcaaaagatg

SEQ ID NO: 152861 - DNA, 103 bp, Artificial Sequence
  Synthetic Polynucleotide
taatacgactcactatagggggcgcgagcctggggcaccaggtagcgctcaacagaggagagagcgcatgctggtgcccaacctggcggcagcgcaaaagatg

SEQ ID NO: 152862 - DNA, 103 bp, Artificial Sequence
  Synthetic Polynucleotide
taatacgactcactatagggagccacacagggcgcgagcctggggcaccaaacagaggagatggtgcatgaggctcgcgaacctggcggcagcgcaaaagatg

SEQ ID NO: 152863 - DNA, 103 bp, Artificial Sequence
  Synthetic Polynucleotide
taatacgactcactatagggctctcatccaagccacacagggcgcgagccaacagaggagaggctcgatgcctgtgtggaacctggcggcagcgcaaaagatg

SEQ ID NO: 152864 - DNA, 103 bp, Artificial Sequence
  Synthetic Polynucleotide
taatacgactcactatagggcttggccttgctctcatccaagccacacagaacagaggagactgtgtatgttggatgagaacctggcggcagcgcaaaagatg

SEQ ID NO: 152865 - DNA, 103 bp, Artificial Sequence
  Synthetic Polynucleotide
taatacgactcactatagggccgatgacagcttggccttgctctcatccaaacagaggagatggatgatggcaaggccaaacctggcggcagcgcaaaagatg

SEQ ID NO: 152866 - DNA, 103 bp, Artificial Sequence
  Synthetic Polynucleotide
taatacgactcactataggggtcagcacgtccgatgacagcttggccttgaacagaggagacaaggcatggctgtcatcaacctggcggcagcgcaaaagatg

SEQ ID NO: 152867 - DNA, 103 bp, Artificial Sequence
  Synthetic Polynucleotide
taatacgactcactataggggatgagcagcgtcagcacgtccgatgacagaacagaggagactgtcaatggacgtgctgaacctggcggcagcgcaaaagatg

SEQ ID NO: 152868 - DNA, 103 bp, Artificial Sequence
  Synthetic Polynucleotide
taatacgactcactatagggagtactgcttgatgagcagcgtcagcacgtaacagaggagaacgtgcatgcgctgctcaaacctggcggcagcgcaaaagatg

SEQ ID NO: 152869 - DNA, 103 bp, Artificial Sequence
  Synthetic Polynucleotide
taatacgactcactatagggcctccgccgcggctgctcgcttcccaaaacaacagaggagagttttgatgagcgagcagaacctggcggcagcgcaaaagatg

SEQ ID NO: 152870 - DNA, 103 bp, Artificial Sequence
  Synthetic Polynucleotide
taatacgactcactatagggctctcgcggcagtactgcttgatgagcagcaacagaggagagctgctatgcaagcagtaaacctggcggcagcgcaaaagatg

SEQ ID NO: 152871 - DNA, 103 bp, Artificial Sequence
  Synthetic Polynucleotide
taatacgactcactataggggcggacaccgctctcgcggcagtactgcttaacagaggagaaagcagatgtgccgcgagaacctggcggcagcgcaaaagatg

SEQ ID NO: 152872 - DNA, 103 bp, Artificial Sequence
  Synthetic Polynucleotide
taatacgactcactatagggtctgcaggttgcggacaccgctctcgcggcaacagaggagagccgcgatggcggtgtccaacctggcggcagcgcaaaagatg

SEQ ID NO: 152873 - DNA, 103 bp, Artificial Sequence
  Synthetic Polynucleotide
taatacgactcactatagggtccacttgcttctgcaggttgcggacaccgaacagaggagacggtgtatgcaacctgcaaacctggcggcagcgcaaaagatg

SEQ ID NO: 152874 - DNA, 103 bp, Artificial Sequence
  Synthetic Polynucleotide
taatacgactcactatagggtaacaccttctccacttgcttctgcaggttaacagaggagaaacctgatgaagcaagtgaacctggcggcagcgcaaaagatg

SEQ ID NO: 152875 - DNA, 103 bp, Artificial Sequence
  Synthetic Polynucleotide
taatacgactcactatagggccgatttccgtaacaccttctccacttgctaacagaggagaagcaagatgagaaggtgtaacctggcggcagcgcaaaagatg

SEQ ID NO: 152876 - DNA, 103 bp, Artificial Sequence
  Synthetic Polynucleotide
taatacgactcactatagggatcttgtaggccgatttccgtaacaccttcaacagaggagagaaggtatgacggaaatcaacctggcggcagcgcaaaagatg

SEQ ID NO: 152877 - DNA, 103 bp, Artificial Sequence
  Synthetic Polynucleotide
taatacgactcactataggggccgctgacaatcttgtaggccgatttccgaacagaggagacggaaaatggcctacaagaacctggcggcagcgcaaaagatg

SEQ ID NO: 152878 - DNA, 103 bp, Artificial Sequence
  Synthetic Polynucleotide
taatacgactcactatagggactcggcctcgccgctgacaatcttgtaggaacagaggagacctacaatgttgtcagcgaacctggcggcagcgcaaaagatg

SEQ ID NO: 152879 - DNA, 103 bp, Artificial Sequence
  Synthetic Polynucleotide
taatacgactcactatagggacctccacggactcggcctcgccgctgacaaacagaggagatgtcagatgcgaggccgaaacctggcggcagcgcaaaagatg

SEQ ID NO: 152880 - DNA, 103 bp, Artificial Sequence
  Synthetic Polynucleotide
taatacgactcactatagggcgagaatgcgcctccgccgcggctgctcgcaacagaggagagcgagcatgcgcggcggaaacctggcggcagcgcaaaagatg

SEQ ID NO: 152881 - DNA, 103 bp, Artificial Sequence
  Synthetic Polynucleotide
taatacgactcactatagggctcgggcgtcacctccacggactcggcctcaacagaggagagaggccatgtccgtggagaacctggcggcagcgcaaaagatg

SEQ ID NO: 152882 - DNA, 103 bp, Artificial Sequence
  Synthetic Polynucleotide
taatacgactcactatagggcctgcaggttctcgggcgtcacctccacggaacagaggagaccgtggatgtgacgcccgaacctggcggcagcgcaaaagatg

SEQ ID NO: 152883 - DNA, 103 bp, Artificial Sequence
  Synthetic Polynucleotide
taatacgactcactatagggcccacgaagtcctgcaggttctcgggcgtcaacagaggagagacgccatggaacctgcaaacctggcggcagcgcaaaagatg

SEQ ID NO: 152884 - DNA, 103 bp, Artificial Sequence
  Synthetic Polynucleotide
taatacgactcactatagggcacgggcttccccacgaagtcctgcaggttaacagaggagaaacctgatggacttcgtgaacctggcggcagcgcaaaagatg

SEQ ID NO: 152885 - DNA, 103 bp, Artificial Sequence
  Synthetic Polynucleotide
taatacgactcactatagggccacggtgaacacgggcttccccacgaagtaacagaggagaacttcgatgggaagcccgaacctggcggcagcgcaaaagatg

SEQ ID NO: 152886 - DNA, 103 bp, Artificial Sequence
  Synthetic Polynucleotide
taatacgactcactatagggtacatgcgctccacggtgaacacgggcttcaacagaggagagaagccatggttcaccgtaacctggcggcagcgcaaaagatg

SEQ ID NO: 152887 - DNA, 103 bp, Artificial Sequence
  Synthetic Polynucleotide
taatacgactcactatagggtgtcacgtcatacatgcgctccacggtgaaaacagaggagattcaccatggagcgcatgaacctggcggcagcgcaaaagatg

SEQ ID NO: 152888 - DNA, 103 bp, Artificial Sequence
  Synthetic Polynucleotide
taatacgactcactatagggcgccgggcggtgtcacgtcatacatgcgctaacagaggagaagcgcaatgatgacgtgaaacctggcggcagcgcaaaagatg

SEQ ID NO: 152889 - DNA, 103 bp, Artificial Sequence
  Synthetic Polynucleotide
taatacgactcactatagggcccatgaccacgccgggcggtgtcacgtcaaacagaggagatgacgtatgaccgcccggaacctggcggcagcgcaaaagatg

SEQ ID NO: 152890 - DNA, 103 bp, Artificial Sequence
  Synthetic Polynucleotide
taatacgactcactatagggccaggccagccccatgaccacgccgggcggaacagaggagaccgcccatggtggtcatgaacctggcggcagcgcaaaagatg

SEQ ID NO: 152891 - DNA, 103 bp, Artificial Sequence
  Synthetic Polynucleotide
taatacgactcactatagggcctcgccccccgagaatgcgcctccgccgcaacagaggagagcggcgatggcgcattctaacctggcggcagcgcaaaagatg

SEQ ID NO: 152892 - DNA, 103 bp, Artificial Sequence
  Synthetic Polynucleotide
taatacgactcactatagggccattgcggtccaggccagccccatgaccaaacagaggagatggtcaatgggctggcctaacctggcggcagcgcaaaagatg

SEQ ID NO: 152893 - DNA, 103 bp, Artificial Sequence
  Synthetic Polynucleotide
taatacgactcactataggggtggagcctcccattgcggtccaggccagcaacagaggagagctggcatggaccgcaataacctggcggcagcgcaaaagatg

SEQ ID NO: 152894 - DNA, 103 bp, Artificial Sequence
  Synthetic Polynucleotide
taatacgactcactatagggcacaaacagcgtggagcctcccattgcggtaacagaggagaaccgcaatgggaggctccaacctggcggcagcgcaaaagatg

SEQ ID NO: 152895 - DNA, 103 bp, Artificial Sequence
  Synthetic Polynucleotide
taatacgactcactataggggggatgtctccacaaacagcgtggagcctcaacagaggagagaggctatgcgctgtttgaacctggcggcagcgcaaaagatg

SEQ ID NO: 152896 - DNA, 103 bp, Artificial Sequence
  Synthetic Polynucleotide
taatacgactcactatagggggccgtctcagggatgtctccacaaacagcaacagaggagagctgttatgggagacatcaacctggcggcagcgcaaaagatg

SEQ ID NO: 152897 - DNA, 103 bp, Artificial Sequence
  Synthetic Polynucleotide
taatacgactcactatagggcttgtcctgtggccgtctcagggatgtctcaacagaggagagagacaatgctgagacggaacctggcggcagcgcaaaagatg

SEQ ID NO: 152898 - DNA, 103 bp, Artificial Sequence
  Synthetic Polynucleotide
taatacgactcactatagggccttggcatccttgtcctgtggccgtctcaaacagaggagatgagacatgcacaggacaaacctggcggcagcgcaaaagatg

SEQ ID NO: 152899 - DNA, 103 bp, Artificial Sequence
  Synthetic Polynucleotide
taatacgactcactatagggtccttgtcacccttggcatccttgtcctgtaacagaggagaacaggaatgggatgccaaaacctggcggcagcgcaaaagatg

SEQ ID NO: 152900 - DNA, 103 bp, Artificial Sequence
  Synthetic Polynucleotide
taatacgactcactatagggcaggctgccatccttgtcacccttggcatcaacagaggagagatgccatgggtgacaagaacctggcggcagcgcaaaagatg

SEQ ID NO: 152901 - DNA, 103 bp, Artificial Sequence
  Synthetic Polynucleotide
taatacgactcactatagggctgtcacctccaggctgccatccttgtcacaacagaggagagtgacaatgatggcagccaacctggcggcagcgcaaaagatg

SEQ ID NO: 152902 - DNA, 103 bp, Artificial Sequence
  Synthetic Polynucleotide
taatacgactcactatagggtcggaggcgtcctcgccccccgagaatgcgaacagaggagacgcattatgggggggcgaaacctggcggcagcgcaaaagatg

SEQ ID NO: 152903 - DNA, 103 bp, Artificial Sequence
  Synthetic Polynucleotide
taatacgactcactatagggcccagctggcctgtcacctccaggctgccaaacagaggagatggcagatgggaggtgacaacctggcggcagcgcaaaagatg

SEQ ID NO: 152904 - DNA, 103 bp, Artificial Sequence
  Synthetic Polynucleotide
taatacgactcactatagggcatcacctcccccagctggcctgtcacctcaacagaggagagaggtgatgggccagctgaacctggcggcagcgcaaaagatg

SEQ ID NO: 152905 - DNA, 103 bp, Artificial Sequence
  Synthetic Polynucleotide
taatacgactcactatagggcgctctccttcatcacctcccccagctggcaacagaggagagccagcatggggaggtgaaacctggcggcagcgcaaaagatg

SEQ ID NO: 152906 - DNA, 103 bp, Artificial Sequence
  Synthetic Polynucleotide
taatacgactcactataggggctatgcgggcgctctccttcatcacctccaacagaggagaggaggtatggaaggagagaacctggcggcagcgcaaaagatg

SEQ ID NO: 152907 - DNA, 103 bp, Artificial Sequence
  Synthetic Polynucleotide
taatacgactcactataggggaaggtgtaggctatgcgggcgctctccttaacagaggagaaaggagatggcccgcataaacctggcggcagcgcaaaagatg

SEQ ID NO: 152908 - DNA, 103 bp, Artificial Sequence
  Synthetic Polynucleotide
taatacgactcactatagggaggctctggcgaaggtgtaggctatgcgggaacagaggagacccgcaatgcctacacctaacctggcggcagcgcaaaagatg

SEQ ID NO: 152909 - DNA, 103 bp, Artificial Sequence
  Synthetic Polynucleotide
taatacgactcactatagggtgcatgaggaaggctctggcgaaggtgtagaacagaggagactacacatgcgccagagcaacctggcggcagcgcaaaagatg

SEQ ID NO: 152910 - DNA, 103 bp, Artificial Sequence
  Synthetic Polynucleotide
taatacgactcactataggggggggcgtgctgcatgaggaaggctctggcaacagaggagagccagaatgttcctcatgaacctggcggcagcgcaaaagatg

SEQ ID NO: 152911 - DNA, 103 bp, Artificial Sequence
  Synthetic Polynucleotide
taatacgactcactatagggagtcattggcgggggcgtgctgcatgaggaaacagaggagatcctcaatgagcacgcccaacctggcggcagcgcaaaagatg

SEQ ID NO: 152912 - DNA, 103 bp, Artificial Sequence
  Synthetic Polynucleotide
taatacgactcactataggggtcaccaggtagtcattggcgggggcgtgcaacagaggagagcacgcatgcgccaatgaaacctggcggcagcgcaaaagatg

SEQ ID NO: 152913 - DNA, 103 bp, Artificial Sequence
  Synthetic Polynucleotide
taatacgactcactatagggcgcgccgccctcggaggcgtcctcgcccccaacagaggagagggggcatggacgcctccaacctggcggcagcgcaaaagatg

SEQ ID NO: 152914 - DNA, 103 bp, Artificial Sequence
  Synthetic Polynucleotide
taatacgactcactataggggatgtgtgaggtcaccaggtagtcattggcaacagaggagagccaatatgtacctggtgaacctggcggcagcgcaaaagatg

SEQ ID NO: 152915 - DNA, 103 bp, Artificial Sequence
  Synthetic Polynucleotide
taatacgactcactatagggcatgcaggtggatgtgtgaggtcaccaggtaacagaggagaacctggatgcctcacacaaacctggcggcagcgcaaaagatg

SEQ ID NO: 152916 - DNA, 103 bp, Artificial Sequence
  Synthetic Polynucleotide
taatacgactcactatagggccctcgggcacatgcaggtggatgtgtgagaacagaggagactcacaatgccacctgcaaacctggcggcagcgcaaaagatg

SEQ ID NO: 152917 - DNA, 103 bp, Artificial Sequence
  Synthetic Polynucleotide
taatacgactcactataggggggggtggcgccctcgggcacatgcaggtgaacagaggagacacctgatggtgcccgagaacctggcggcagcgcaaaagatg

SEQ ID NO: 152918 - DNA, 103 bp, Artificial Sequence
  Synthetic Polynucleotide
taatacgactcactatagggggccgtccttgggggtggcgccctcgggcaaacagaggagatgcccgatggcgccacccaacctggcggcagcgcaaaagatg

SEQ ID NO: 152919 - DNA, 103 bp, Artificial Sequence
  Synthetic Polynucleotide
taatacgactcactatagggcctgcgcttgggccgtccttgggggtggcgaacagaggagacgccacatgcaaggacggaacctggcggcagcgcaaaagatg

SEQ ID NO: 152920 - DNA, 103 bp, Artificial Sequence
  Synthetic Polynucleotide
taatacgactcactataggggatggtgcagcctgcgcttgggccgtccttaacagaggagaaaggacatgccaagcgcaaacctggcggcagcgcaaaagatg

SEQ ID NO: 152921 - DNA, 103 bp, Artificial Sequence
  Synthetic Polynucleotide
taatacgactcactataggggggccgtgacgatggtgcagcctgcgcttgaacagaggagacaagcgatggctgcaccaaacctggcggcagcgcaaaagatg

SEQ ID NO: 152922 - DNA, 103 bp, Artificial Sequence
  Synthetic Polynucleotide
taatacgactcactatagggagggacagcagggccgtgacgatggtgcagaacagaggagactgcacatgcgtcacggcaacctggcggcagcgcaaaagatg

SEQ ID NO: 152923 - DNA, 103 bp, Artificial Sequence
  Synthetic Polynucleotide
taatacgactcactataggggcccatggccagggacagcagggccgtgacaacagaggagagtcacgatgctgctgtccaacctggcggcagcgcaaaagatg

SEQ ID NO: 152924 - DNA, 103 bp, Artificial Sequence
  Synthetic Polynucleotide
taatacgactcactatagggctccttcctccgcgccgccctcggaggcgtaacagaggagaacgcctatgagggcggcgaacctggcggcagcgcaaaagatg

SEQ ID NO: 152925 - DNA, 103 bp, Artificial Sequence
  Synthetic Polynucleotide
taatacgactcactatagggggacaggcctgcccatggccagggacagcaaacagaggagatgctgtatgtggccatggaacctggcggcagcgcaaaagatg

SEQ ID NO: 152926 - DNA, 103 bp, Artificial Sequence
  Synthetic Polynucleotide
taatacgactcactatagggagattctgccggacaggcctgcccatggccaacagaggagaggccatatgcaggcctgtaacctggcggcagcgcaaaagatg

SEQ ID NO: 152927 - DNA, 103 bp, Artificial Sequence
  Synthetic Polynucleotide
taatacgactcactatagggagtcatggccagattctgccggacaggcctaacagaggagaaggcctatgcggcagaataacctggcggcagcgcaaaagatg

SEQ ID NO: 152928 - DNA, 103 bp, Artificial Sequence
  Synthetic Polynucleotide
taatacgactcactatagggagacttcgccagtcatggccagattctgccaacagaggagaggcagaatgtggccatgaaacctggcggcagcgcaaaagatg

SEQ ID NO: 152929 - DNA, 103 bp, Artificial Sequence
  Synthetic Polynucleotide
taatacgactcactatagggcccgtgagggagacttcgccagtcatggccaacagaggagaggccatatgtggcgaagtaacctggcggcagcgcaaaagatg

SEQ ID NO: 152930 - DNA, 103 bp, Artificial Sequence
  Synthetic Polynucleotide
taatacgactcactatagggcaggatcttgcccgtgagggagacttcgccaacagaggagaggcgaaatgtccctcacgaacctggcggcagcgcaaaagatg

SEQ ID NO: 152931 - DNA, 103 bp, Artificial Sequence
  Synthetic Polynucleotide
taatacgactcactatagggcaccaacaggcaggatcttgcccgtgagggaacagaggagaccctcaatggcaagatccaacctggcggcagcgcaaaagatg

SEQ ID NO: 152932 - DNA, 103 bp, Artificial Sequence
  Synthetic Polynucleotide
taatacgactcactatagggtccttgatgccaccaacaggcaggatcttgaacagaggagacaagatatggcctgttggaacctggcggcagcgcaaaagatg

SEQ ID NO: 152933 - DNA, 103 bp, Artificial Sequence
  Synthetic Polynucleotide
taatacgactcactatagggaatggtcttctccttgatgccaccaacaggaacagaggagacctgttatgggcatcaagaacctggcggcagcgcaaaagatg

SEQ ID NO: 152934 - DNA, 103 bp, Artificial Sequence
  Synthetic Polynucleotide
taatacgactcactataggggcttggccgcaatggtcttctccttgatgcaacagaggagagcatcaatgagaagaccaaacctggcggcagcgcaaaagatg

SEQ ID NO: 152935 - DNA, 103 bp, Artificial Sequence
  Synthetic Polynucleotide
taatacgactcactataggggcgccgccggctccttcctccgcgccgcccaacagaggagagggcggatgggaggaaggaacctggcggcagcgcaaaagatg

SEQ ID NO: 152936 - DNA, 103 bp, Artificial Sequence
  Synthetic Polynucleotide
taatacgactcactatagggacccctgcgcgcttggccgcaatggtcttcaacagaggagagaagacatgtgcggccaaaacctggcggcagcgcaaaagatg

SEQ ID NO: 152937 - DNA, 103 bp, Artificial Sequence
  Synthetic Polynucleotide
taatacgactcactataggggatgcacgtcacccctgcgcgcttggccgcaacagaggagagcggccatgcgcgcagggaacctggcggcagcgcaaaagatg

SEQ ID NO: 152938 - DNA, 103 bp, Artificial Sequence
  Synthetic Polynucleotide
taatacgactcactatagggctggcaggacgatgcacgtcacccctgcgcaacagaggagagcgcagatgtgacgtgcaaacctggcggcagcgcaaaagatg

SEQ ID NO: 152939 - DNA, 103 bp, Artificial Sequence
  Synthetic Polynucleotide
taatacgactcactatagggttgttctcggctggcaggacgatgcacgtcaacagaggagagacgtgatgcgtcctgccaacctggcggcagcgcaaaagatg

SEQ ID NO: 152940 - DNA, 103 bp, Artificial Sequence
  Synthetic Polynucleotide
taatacgactcactataggggaagtccttcttgttctcggctggcaggacaacagaggagagtcctgatggccgagaacaacctggcggcagcgcaaaagatg

SEQ ID NO: 152941 - DNA, 103 bp, Artificial Sequence
  Synthetic Polynucleotide
taatacgactcactatagggccaggtcgtagaagtccttcttgttctcggaacagaggagaccgagaatgagaaggactaacctggcggcagcgcaaaagatg

SEQ ID NO: 152942 - DNA, 103 bp, Artificial Sequence
  Synthetic Polynucleotide
taatacgactcactatagggatgaaggctgccaggtcgtagaagtccttcaacagaggagagaaggaatgctacgacctaacctggcggcagcgcaaaagatg

SEQ ID NO: 152943 - DNA, 103 bp, Artificial Sequence
  Synthetic Polynucleotide
taatacgactcactataggggccctcggtgatgaaggctgccaggtcgtaaacagaggagatacgacatggcagccttcaacctggcggcagcgcaaaagatg

SEQ ID NO: 152944 - DNA, 103 bp, Artificial Sequence
  Synthetic Polynucleotide
taatacgactcactataggggcacctccaggccctcggtgatgaaggctgaacagaggagacagcctatgtcaccgaggaacctggcggcagcgcaaaagatg

SEQ ID NO: 152945 - DNA, 103 bp, Artificial Sequence
  Synthetic Polynucleotide
taatacgactcactatagggtccacgaagtgcacctccaggccctcggtgaacagaggagacaccgaatgcctggaggtaacctggcggcagcgcaaaagatg

SEQ ID NO: 152946 - DNA, 103 bp, Artificial Sequence
  Synthetic Polynucleotide
taatacgactcactataggggctgccccccgcgccgccggctccttcctcaacagaggagagaggaaatggccggcggcaacctggcggcagcgcaaaagatg

SEQ ID NO: 152947 - DNA, 103 bp, Artificial Sequence
  Synthetic Polynucleotide
taatacgactcactatagggccggtagtgttccacgaagtgcacctccagaacagaggagactggagatgcacttcgtgaacctggcggcagcgcaaaagatg

SEQ ID NO: 152948 - DNA, 103 bp, Artificial Sequence
  Synthetic Polynucleotide
taatacgactcactatagggcgaagatctcccggtagtgttccacgaagtaacagaggagaacttcgatgaacactaccaacctggcggcagcgcaaaagatg

SEQ ID NO: 152949 - DNA, 103 bp, Artificial Sequence
  Synthetic Polynucleotide
taatacgactcactatagggaaggcgatgtcgaagatctcccggtagtgtaacagaggagaacactaatgggagatcttaacctggcggcagcgcaaaagatg

SEQ ID NO: 152950 - DNA, 103 bp, Artificial Sequence
  Synthetic Polynucleotide
taatacgactcactatagggctcgtccgggaaggcgatgtcgaagatctcaacagaggagagagatcatggacatcgccaacctggcggcagcgcaaaagatg

SEQ ID NO: 152951 - DNA, 103 bp, Artificial Sequence
  Synthetic Polynucleotide
taatacgactcactatagggcctctgcctgctcgtccgggaaggcgatgtaacagaggagaacatcgatgtcccggacgaacctggcggcagcgcaaaagatg

SEQ ID NO: 152952 - DNA, 103 bp, Artificial Sequence
  Synthetic Polynucleotide
taatacgactcactatagggacggccagcgcctctgcctgctcgtccgggaacagaggagacccggaatggcaggcagaaacctggcggcagcgcaaaagatg

SEQ ID NO: 152953 - DNA, 103 bp, Artificial Sequence
  Synthetic Polynucleotide
taatacgactcactatagggtcaccgttccacggccagcgcctctgcctgaacagaggagacaggcaatggcgctggccaacctggcggcagcgcaaaagatg

SEQ ID NO: 152954 - DNA, 103 bp, Artificial Sequence
  Synthetic Polynucleotide
taatacgactcactatagggcggcgcccgcgctgccccccgcgccgccggaacagaggagaccggcgatgcggggggcaaacctggcggcagcgcaaaagatg

SEQ ID NO: 152955 - DNA, 103 bp, Artificial Sequence
  Synthetic Polynucleotide
taatacgactcactatagggcagcaccgcgccgctccccacagtcgcacgaacagaggagacgtgcgatggtggggagcaacctggcggcagcgcaaaagatg

SEQ ID NO: 152956 - DNA, 103 bp, Artificial Sequence
  Synthetic Polynucleotide
taatacgactcactataggggggccttccccggcgcccgcgctgccccccaacagaggagaggggggatgcgcgggcgcaacctggcggcagcgcaaaagatg

SEQ ID NO: 152957 - DNA, 103 bp, Artificial Sequence
  Synthetic Polynucleotide
taatacgactcactatagggcgttatgaccgggccttccccggcgcccgcaacagaggagagcgggcatgggggaaggcaacctggcggcagcgcaaaagatg

SEQ ID NO: 152958 - DNA, 103 bp, Artificial Sequence
  Synthetic Polynucleotide
taatacgactcactataggggcgtgagcgccgttatgaccgggccttcccaacagaggagagggaagatgcggtcataaaacctggcggcagcgcaaaagatg

SEQ ID NO: 152959 - DNA, 103 bp, Artificial Sequence
  Synthetic Polynucleotide
taatacgactcactatagggatcgtcatgggcgtgagcgccgttatgaccaacagaggagaggtcatatgggcgctcacaacctggcggcagcgcaaaagatg

SEQ ID NO: 152960 - DNA, 103 bp, Artificial Sequence
  Synthetic Polynucleotide
taatacgactcactatagggcacatcggggatcgtcatgggcgtgagcgcaacagaggagagcgctcatgcccatgacgaacctggcggcagcgcaaaagatg

SEQ ID NO: 152961 - DNA, 103 bp, Artificial Sequence
  Synthetic Polynucleotide
taatacgactcactatagggggtgcggaaacacatcggggatcgtcatggaacagaggagaccatgaatgtccccgatgaacctggcggcagcgcaaaagatg

SEQ ID NO: 152962 - DNA, 103 bp, Artificial Sequence
  Synthetic Polynucleotide
taatacgactcactatagggatgagcggcaggtgcggaaacacatcggggaacagaggagaccccgaatggtttccgcaaacctggcggcagcgcaaaagatg

SEQ ID NO: 152963 - DNA, 103 bp, Artificial Sequence
  Synthetic Polynucleotide
taatacgactcactatagggggtgatggcgatgagcggcaggtgcggaaaaacagaggagatttccgatgctgccgctcaacctggcggcagcgcaaaagatg

SEQ ID NO: 152964 - DNA, 103 bp, Artificial Sequence
  Synthetic Polynucleotide
taatacgactcactatagggccgggttgcgggtgatggcgatgagcggcaaacagaggagatgccgcatgtcgccatcaaacctggcggcagcgcaaaagatg

SEQ ID NO: 152965 - DNA, 103 bp, Artificial Sequence
  Synthetic Polynucleotide
taatacgactcactatagggcgcgggaacaccgggttgcgggtgatggcgaacagaggagacgccatatgccgcaacccaacctggcggcagcgcaaaagatg

SEQ ID NO: 152966 - DNA, 103 bp, Artificial Sequence
  Synthetic Polynucleotide
taatacgactcactatagggccgcagcacccagcaccgcgccgctccccaaacagaggagatggggaatggcgcggtgcaacctggcggcagcgcaaaagatg

SEQ ID NO: 152967 - DNA, 103 bp, Artificial Sequence
  Synthetic Polynucleotide
taatacgactcactatagggcttgataaagcgcgggaacaccgggttgcgaacagaggagacgcaacatggtgttcccgaacctggcggcagcgcaaaagatg

SEQ ID NO: 152968 - DNA, 103 bp, Artificial Sequence
  Synthetic Polynucleotide
taatacgactcactatagggcctcgataatcttgataaagcgcgggaacaaacagaggagatgttccatggctttatcaaacctggcggcagcgcaaaagatg

SEQ ID NO: 152969 - DNA, 103 bp, Artificial Sequence
  Synthetic Polynucleotide
taatacgactcactatagggttatttttaacctcgataatcttgataaagaacagaggagactttatatggattatcgaaacctggcggcagcgcaaaagatg

SEQ ID NO: 152970 - DNA, 103 bp, Artificial Sequence
  Synthetic Polynucleotide
taatacgactcactatagggaaccaacttcttatttttaacctcgataataacagaggagaattatcatggttaaaaataacctggcggcagcgcaaaagatg

SEQ ID NO: 152971 - DNA, 103 bp, Artificial Sequence
  Synthetic Polynucleotide
taatacgactcactatagggtcagcagctcaaccaacttcttatttttaaaacagaggagattaaaaatgagaagttggaacctggcggcagcgcaaaagatg

SEQ ID NO: 152972 - DNA, 103 bp, Artificial Sequence
  Synthetic Polynucleotide
taatacgactcactatagggactttccttctcagcagctcaaccaacttcaacagaggagagaagttatgtgagctgctaacctggcggcagcgcaaaagatg

SEQ ID NO: 152973 - DNA, 103 bp, Artificial Sequence
  Synthetic Polynucleotide
taatacgactcactatagggggcgagacgaactttccttctcagcagctcaacagaggagagagctgatgagaaggaaaaacctggcggcagcgcaaaagatg

SEQ ID NO: 152974 - DNA, 103 bp, Artificial Sequence
  Synthetic Polynucleotide
taatacgactcactatagggcataaggctgggcgagacgaactttccttcaacagaggagagaaggaatgttcgtctcgaacctggcggcagcgcaaaagatg

SEQ ID NO: 152975 - DNA, 103 bp, Artificial Sequence
  Synthetic Polynucleotide
taatacgactcactatagggaagacgccgacataaggctgggcgagacgaaacagaggagatcgtctatgccagccttaaacctggcggcagcgcaaaagatg

SEQ ID NO: 152976 - DNA, 103 bp, Artificial Sequence
  Synthetic Polynucleotide
taatacgactcactatagggtctctttagaaagacgccgacataaggctgaacagaggagacagcctatggtcggcgtcaacctggcggcagcgcaaaagatg

SEQ ID NO: 152977 - DNA, 103 bp, Artificial Sequence
  Synthetic Polynucleotide
taatacgactcactataggggcatcggccgccgcagcacccagcaccgcgaacagaggagacgcggtatggggtgctgcaacctggcggcagcgcaaaagatg

SEQ ID NO: 152978 - DNA, 103 bp, Artificial Sequence
  Synthetic Polynucleotide
taatacgactcactatagggtgctgtcatctctctttagaaagacgccgaaacagaggagatcggcgatgttctaaagaaacctggcggcagcgcaaaagatg

SEQ ID NO: 152979 - DNA, 103 bp, Artificial Sequence
  Synthetic Polynucleotide
taatacgactcactatagggtccgactcattgctgtcatctctctttagaaacagaggagatctaaaatgagatgacagaacctggcggcagcgcaaaagatg

SEQ ID NO: 152980 - DNA, 103 bp, Artificial Sequence
  Synthetic Polynucleotide
taatacgactcactatagggctcgaccacatccgactcattgctgtcatcaacagaggagagatgacatgaatgagtcgaacctggcggcagcgcaaaagatg

SEQ ID NO: 152981 - DNA, 103 bp, Artificial Sequence
  Synthetic Polynucleotide
taatacgactcactatagggcatccaggctctcgaccacatccgactcataacagaggagaatgagtatgatgtggtcgaacctggcggcagcgcaaaagatg

SEQ ID NO: 152982 - DNA, 103 bp, Artificial Sequence
  Synthetic Polynucleotide
taatacgactcactatagggtggtagatttcatccaggctctcgaccacaaacagaggagatgtggtatggagcctggaaacctggcggcagcgcaaaagatg

SEQ ID NO: 152983 - DNA, 103 bp, Artificial Sequence
  Synthetic Polynucleotide
taatacgactcactatagggcgtccccgtgtggtagatttcatccaggctaacagaggagaagcctgatggaaatctacaacctggcggcagcgcaaaagatg

SEQ ID NO: 152984 - DNA, 103 bp, Artificial Sequence
  Synthetic Polynucleotide
taatacgactcactatagggtctgggcaaacgtccccgtgtggtagatttaacagaggagaaaatctatgacacggggaaacctggcggcagcgcaaaagatg

SEQ ID NO: 152985 - DNA, 103 bp, Artificial Sequence
  Synthetic Polynucleotide
taatacgactcactatagggatctcatggatctgggcaaacgtccccgtgaacagaggagacacgggatggtttgcccaaacctggcggcagcgcaaaagatg

SEQ ID NO: 152986 - DNA, 103 bp, Artificial Sequence
  Synthetic Polynucleotide
taatacgactcactatagggaaggtcctgcatctcatggatctgggcaaaaacagaggagatttgccatgatccatgagaacctggcggcagcgcaaaagatg

SEQ ID NO: 152987 - DNA, 103 bp, Artificial Sequence
  Synthetic Polynucleotide
taatacgactcactataggggcttgtccccaaggtcctgcatctcatggaaacagaggagatccatgatgtgcaggaccaacctggcggcagcgcaaaagatg

SEQ ID NO: 152988 - DNA, 103 bp, Artificial Sequence
  Synthetic Polynucleotide
taatacgactcactataggggcggcggccagcatcggccgccgcagcaccaacagaggagaggtgctatggcggccgataacctggcggcagcgcaaaagatg

SEQ ID NO: 152989 - DNA, 103 bp, Artificial Sequence
  Synthetic Polynucleotide
taatacgactcactatagggatcatgcgcagcttgtccccaaggtcctgcaacagaggagagcaggaatgtggggacaaaacctggcggcagcgcaaaagatg

SEQ ID NO: 152990 - DNA, 103 bp, Artificial Sequence
  Synthetic Polynucleotide
taatacgactcactatagggtcccatgacgatcatgcgcagcttgtccccaacagaggagaggggacatgctgcgcatgaacctggcggcagcgcaaaagatg

SEQ ID NO: 152991 - DNA, 103 bp, Artificial Sequence
  Synthetic Polynucleotide
taatacgactcactatagggctcttctgtgtcccatgacgatcatgcgcaaacagaggagatgcgcaatgtcgtcatggaacctggcggcagcgcaaaagatg

SEQ ID NO: 152992 - DNA, 103 bp, Artificial Sequence
  Synthetic Polynucleotide
taatacgactcactatagggctgatatggactcttctgtgtcccatgacgaacagaggagacgtcatatgacacagaagaacctggcggcagcgcaaaagatg

SEQ ID NO: 152993 - DNA, 103 bp, Artificial Sequence
  Synthetic Polynucleotide
taatacgactcactatagggcagctgtctgctgatatggactcttctgtgaacagaggagacacagaatggtccatatcaacctggcggcagcgcaaaagatg

SEQ ID NO: 152994 - DNA, 103 bp, Artificial Sequence
  Synthetic Polynucleotide
taatacgactcactataggggctccacctccagctgtctgctgatatggaaacagaggagatccataatggcagacagcaacctggcggcagcgcaaaagatg

SEQ ID NO: 152995 - DNA, 103 bp, Artificial Sequence
  Synthetic Polynucleotide
taatacgactcactatagggggctcctcgggctccacctccagctgtctgaacagaggagacagacaatgggaggtggaaacctggcggcagcgcaaaagatg

SEQ ID NO: 152996 - DNA, 103 bp, Artificial Sequence
  Synthetic Polynucleotide
taatacgactcactatagggctccgcctccggctcctcgggctccacctcaacagaggagagaggtgatgcccgaggagaacctggcggcagcgcaaaagatg

SEQ ID NO: 152997 - DNA, 103 bp, Artificial Sequence
  Synthetic Polynucleotide
taatacgactcactatagggtgtgcttgttctccgcctccggctcctcggaacagaggagaccgaggatgcggaggcggaacctggcggcagcgcaaaagatg

SEQ ID NO: 152998 - DNA, 103 bp, Artificial Sequence
  Synthetic Polynucleotide
taatacgactcactatagggctgcggggcttgtgcttgttctccgcctccaacagaggagaggaggcatggaacaagcaaacctggcggcagcgcaaaagatg

SEQ ID NO: 152999 - DNA, 103 bp, Artificial Sequence
  Synthetic Polynucleotide
taatacgactcactatagggccgccccccggcggcggccagcatcggccgaacagaggagacggccgatgctggccgccaacctggcggcagcgcaaaagatg

SEQ ID NO: 153000 - DNA, 103 bp, Artificial Sequence
  Synthetic Polynucleotide
taatacgactcactatagggctttgacttcctgcggggcttgtgcttgttaacagaggagaaacaagatgaagccccgcaacctggcggcagcgcaaaagatg

SEQ ID NO: 153001 - DNA, 103 bp, Artificial Sequence
  Synthetic Polynucleotide
taatacgactcactatagggtcttgccccgctttgacttcctgcggggctaacagaggagaagccccatgggaagtcaaaacctggcggcagcgcaaaagatg

SEQ ID NO: 153002 - DNA, 103 bp, Artificial Sequence
  Synthetic Polynucleotide
taatacgactcactatagggtccgcctccttcttgccccgctttgacttcaacagaggagagaagtcatggcggggcaaaacctggcggcagcgcaaaagatg

SEQ ID NO: 153003 - DNA, 103 bp, Artificial Sequence
  Synthetic Polynucleotide
taatacgactcactatagggcagctcgtcctccgcctccttcttgccccgaacagaggagacggggcatgaaggaggcgaacctggcggcagcgcaaaagatg

SEQ ID NO: 153004 - DNA, 103 bp, Artificial Sequence
  Synthetic Polynucleotide
taatacgactcactataggggcctggcgctcagctcgtcctccgcctcctaacagaggagaaggaggatgaggacgagcaacctggcggcagcgcaaaagatg

SEQ ID NO: 153005 - DNA, 103 bp, Artificial Sequence
  Synthetic Polynucleotide
taatacgactcactatagggtccgccgggtgcctggcgctcagctcgtccaacagaggagaggacgaatggagcgccagaacctggcggcagcgcaaaagatg

SEQ ID NO: 153006 - DNA, 103 bp, Artificial Sequence
  Synthetic Polynucleotide
taatacgactcactatagggcatcgccagctccgccgggtgcctggcgctaacagaggagaagcgccatgcacccggcgaacctggcggcagcgcaaaagatg

SEQ ID NO: 153007 - DNA, 103 bp, Artificial Sequence
  Synthetic Polynucleotide
taatacgactcactataggggggtgggctccatcgccagctccgccgggtaacagaggagaacccggatgagctggcgaaacctggcggcagcgcaaaagatg

SEQ ID NO: 153008 - DNA, 103 bp, Artificial Sequence
  Synthetic Polynucleotide
taatacgactcactataggggggagctcaggggtgggctccatcgccagcaacagaggagagctggcatgggagcccacaacctggcggcagcgcaaaagatg

SEQ ID NO: 153009 - DNA, 103 bp, Artificial Sequence
  Synthetic Polynucleotide
taatacgactcactatagggcacctcagccgggagctcaggggtgggctcaacagaggagagagcccatgcctgagctcaacctggcggcagcgcaaaagatg

SEQ ID NO: 153010 - DNA, 103 bp, Artificial Sequence
  Synthetic Polynucleotide
taatacgactcactatagggcagtgggaacccgccccccggcggcggccaaacagaggagatggccgatgccggggggcaacctggcggcagcgcaaaagatg

SEQ ID NO: 153011 - DNA, 103 bp, Artificial Sequence
  Synthetic Polynucleotide
taatacgactcactatagggccaccatgagcacctcagccgggagctcagaacagaggagactgagcatgcggctgaggaacctggcggcagcgcaaaagatg

SEQ ID NO: 153012 - DNA, 103 bp, Artificial Sequence
  Synthetic Polynucleotide
taatacgactcactatagggttctctacctccaccatgagcacctcagccaacagaggagaggctgaatggctcatggtaacctggcggcagcgcaaaagatg

SEQ ID NO: 153013 - DNA, 103 bp, Artificial Sequence
  Synthetic Polynucleotide
taatacgactcactataggggtggacaacgttctctacctccaccatgagaacagaggagactcatgatggaggtagagaacctggcggcagcgcaaaagatg

SEQ ID NO: 153014 - DNA, 103 bp, Artificial Sequence
  Synthetic Polynucleotide
taatacgactcactatagggggaagtcctcgtggacaacgttctctacctaacagaggagaaggtagatgacgttgtccaacctggcggcagcgcaaaagatg

SEQ ID NO: 153015 - DNA, 103 bp, Artificial Sequence
  Synthetic Polynucleotide
taatacgactcactatagggtccgtgacctggaagtcctcgtggacaacgaacagaggagacgttgtatgcgaggacttaacctggcggcagcgcaaaagatg

SEQ ID NO: 153016 - DNA, 103 bp, Artificial Sequence
  Synthetic Polynucleotide
taatacgactcactatagggtttcacctcctccgtgacctggaagtcctcaacagaggagagaggacatgcaggtcacgaacctggcggcagcgcaaaagatg

SEQ ID NO: 153017 - DNA, 103 bp, Artificial Sequence
  Synthetic Polynucleotide
taatacgactcactatagggcagtcagggctttcacctcctccgtgacctaacagaggagaaggtcaatgaggaggtgaaacctggcggcagcgcaaaagatg

SEQ ID NO: 153018 - DNA, 103 bp, Artificial Sequence
  Synthetic Polynucleotide
taatacgactcactatagggacgatctctgcagtcagggctttcacctccaacagaggagaggaggtatgagccctgacaacctggcggcagcgcaaaagatg

SEQ ID NO: 153019 - DNA, 103 bp, Artificial Sequence
  Synthetic Polynucleotide
taatacgactcactataggggatggtcttcacgatctctgcagtcagggcaacagaggagagccctgatggcagagatcaacctggcggcagcgcaaaagatg

SEQ ID NO: 153020 - DNA, 103 bp, Artificial Sequence
  Synthetic Polynucleotide
taatacgactcactatagggtgatgtcccggatggtcttcacgatctctgaacagaggagacagagaatgtgaagaccaaacctggcggcagcgcaaaagatg

SEQ ID NO: 153021 - DNA, 103 bp, Artificial Sequence
  Synthetic Polynucleotide
taatacgactcactataggggctcctgctgcagtgggaacccgccccccgaacagaggagacgggggatgggttcccacaacctggcggcagcgcaaaagatg

SEQ ID NO: 153022 - DNA, 103 bp, Artificial Sequence
  Synthetic Polynucleotide
taatacgactcactatagggttcaaggcaatgatgtcccggatggtcttcaacagaggagagaagacatgccgggacataacctggcggcagcgcaaaagatg

SEQ ID NO: 153023 - DNA, 103 bp, Artificial Sequence
  Synthetic Polynucleotide
taatacgactcactataggggtagagagggttcaaggcaatgatgtcccgaacagaggagacgggacatgattgccttgaacctggcggcagcgcaaaagatg

SEQ ID NO: 153024 - DNA, 103 bp, Artificial Sequence
  Synthetic Polynucleotide
taatacgactcactatagggctgactccctgtagagagggttcaaggcaaaacagaggagattgcctatgaccctctctaacctggcggcagcgcaaaagatg

SEQ ID NO: 153025 - DNA, 103 bp, Artificial Sequence
  Synthetic Polynucleotide
taatacgactcactatagggatctgcagcactgactccctgtagagagggaacagaggagaccctctatgcagggagtcaacctggcggcagcgcaaaagatg

SEQ ID NO: 153026 - DNA, 103 bp, Artificial Sequence
  Synthetic Polynucleotide
taatacgactcactatagggagcctgcatcatctgcagcactgactccctaacagaggagaagggagatggtgctgcagaacctggcggcagcgcaaaagatg

SEQ ID NO: 153027 - DNA, 103 bp, Artificial Sequence
  Synthetic Polynucleotide
taatacgactcactatagggcccgctggccagcctgcatcatctgcagcaaacagaggagatgctgcatgtgatgcaggaacctggcggcagcgcaaaagatg

SEQ ID NO: 153028 - DNA, 103 bp, Artificial Sequence
  Synthetic Polynucleotide
taatacgactcactatagggttgtccaccacccgctggccagcctgcatcaacagaggagagatgcaatgtggccagcgaacctggcggcagcgcaaaagatg

SEQ ID NO: 153029 - DNA, 103 bp, Artificial Sequence
  Synthetic Polynucleotide
taatacgactcactataggggtagatggggttgtccaccacccgctggccaacagaggagaggccagatggtggtggacaacctggcggcagcgcaaaagatg

SEQ ID NO: 153030 - DNA, 103 bp, Artificial Sequence
  Synthetic Polynucleotide
taatacgactcactatagggtgtcgctcaggtagatggggttgtccaccaaacagaggagatggtggatgaccccatctaacctggcggcagcgcaaaagatg

SEQ ID NO: 153031 - DNA, 103 bp, Artificial Sequence
  Synthetic Polynucleotide
taatacgactcactataggggcggcgcccatgtcgctcaggtagatggggaacagaggagaccccatatgcctgagcgaaacctggcggcagcgcaaaagatg

SEQ ID NO: 153032 - DNA, 103 bp, Artificial Sequence
  Synthetic Polynucleotide
taatacgactcactatagggccggctttgagcggccgcggggctggtcataacagaggagaatgaccatgcccgcggccaacctggcggcagcgcaaaagatg

SEQ ID NO: 153033 - DNA, 103 bp, Artificial Sequence
  Synthetic Polynucleotide
taatacgactcactataggggatctcgcgagcctccgcgcgggccgcccgaacagaggagacgggcgatgcgcgcggagaacctggcggcagcgcaaaagatg

SEQ ID NO: 153034 - DNA, 103 bp, Artificial Sequence
  Synthetic Polynucleotide
taatacgactcactatagggacctgctaaggttcctaggaatggggcagtaacagaggagaactgccatgttcctaggaaacctggcggcagcgcaaaagatg

SEQ ID NO: 153035 - DNA, 103 bp, Artificial Sequence
  Synthetic Polynucleotide
taatacgactcactatagggcataggtagcacctgctaaggttcctaggaaacagaggagatcctagatgccttagcagaacctggcggcagcgcaaaagatg

SEQ ID NO: 153036 - DNA, 103 bp, Artificial Sequence
  Synthetic Polynucleotide
taatacgactcactatagggacctgttcctcataggtagcacctgctaagaacagaggagacttagcatgtgctacctaaacctggcggcagcgcaaaagatg

SEQ ID NO: 153037 - DNA, 103 bp, Artificial Sequence
  Synthetic Polynucleotide
taatacgactcactatagggttggctttgaacctgttcctcataggtagcaacagaggagagctaccatggaggaacagaacctggcggcagcgcaaaagatg

SEQ ID NO: 153038 - DNA, 103 bp, Artificial Sequence
  Synthetic Polynucleotide
taatacgactcactatagggtctcaagaatttggctttgaacctgttcctaacagaggagaaggaacatgttcaaagccaacctggcggcagcgcaaaagatg

SEQ ID NO: 153039 - DNA, 103 bp, Artificial Sequence
  Synthetic Polynucleotide
taatacgactcactatagggagagaactgctctcaagaatttggctttgaaacagaggagatcaaagatgaattcttgaaacctggcggcagcgcaaaagatg

SEQ ID NO: 153040 - DNA, 103 bp, Artificial Sequence
  Synthetic Polynucleotide
taatacgactcactataggggttttcagggagagaactgctctcaagaataacagaggagaattcttatgagcagttctaacctggcggcagcgcaaaagatg

SEQ ID NO: 153041 - DNA, 103 bp, Artificial Sequence
  Synthetic Polynucleotide
taatacgactcactatagggcctgtactgtgttttcagggagagaactgcaacagaggagagcagttatgtccctgaaaaacctggcggcagcgcaaaagatg

SEQ ID NO: 153042 - DNA, 103 bp, Artificial Sequence
  Synthetic Polynucleotide
taatacgactcactatagggtttgactcaacctgtactgtgttttcagggaacagaggagaccctgaatgcacagtacaaacctggcggcagcgcaaaagatg

SEQ ID NO: 153043 - DNA, 103 bp, Artificial Sequence
  Synthetic Polynucleotide
taatacgactcactatagggcatgacctcatttgactcaacctgtactgtaacagaggagaacagtaatggttgagtcaaacctggcggcagcgcaaaagatg

SEQ ID NO: 153044 - DNA, 103 bp, Artificial Sequence
  Synthetic Polynucleotide
taatacgactcactatagggccttcatgcggatctcgcgagcctccgcgcaacagaggagagcgcggatgctcgcgagaaacctggcggcagcgcaaaagatg

SEQ ID NO: 153045 - DNA, 103 bp, Artificial Sequence
  Synthetic Polynucleotide
taatacgactcactatagggctggtgcacccatgacctcatttgactcaaaacagaggagattgagtatgatgaggtcaaacctggcggcagcgcaaaagatg

SEQ ID NO: 153046 - DNA, 103 bp, Artificial Sequence
  Synthetic Polynucleotide
taatacgactcactataggggtcctgtcatctggtgcacccatgacctcaaacagaggagatgaggtatggggtgcaccaacctggcggcagcgcaaaagatg

SEQ ID NO: 153047 - DNA, 103 bp, Artificial Sequence
  Synthetic Polynucleotide
taatacgactcactataggggggagttctggtcctgtcatctggtgcaccaacagaggagaggtgcaatggatgacaggaacctggcggcagcgcaaaagatg

SEQ ID NO: 153048 - DNA, 103 bp, Artificial Sequence
  Synthetic Polynucleotide
taatacgactcactatagggatggctcaaggggagttctggtcctgtcataacagaggagaatgacaatgccagaactcaacctggcggcagcgcaaaagatg

SEQ ID NO: 153049 - DNA, 103 bp, Artificial Sequence
  Synthetic Polynucleotide
taatacgactcactatagggcaacagttggatggctcaaggggagttctgaacagaggagacagaacatgccttgagccaacctggcggcagcgcaaaagatg

SEQ ID NO: 153050 - DNA, 103 bp, Artificial Sequence
  Synthetic Polynucleotide
taatacgactcactatagggtaagtcactccaacagttggatggctcaagaacagaggagacttgagatgtccaactgtaacctggcggcagcgcaaaagatg

SEQ ID NO: 153051 - DNA, 103 bp, Artificial Sequence
  Synthetic Polynucleotide
taatacgactcactatagggtcccaccatctaagtcactccaacagttggaacagaggagaccaactatgggagtgactaacctggcggcagcgcaaaagatg

SEQ ID NO: 153052 - DNA, 103 bp, Artificial Sequence
  Synthetic Polynucleotide
taatacgactcactatagggtctgtgtggttcccaccatctaagtcactcaacagaggagagagtgaatgagatggtggaacctggcggcagcgcaaaagatg

SEQ ID NO: 153053 - DNA, 103 bp, Artificial Sequence
  Synthetic Polynucleotide
taatacgactcactatagggtcccacattctctgtgtggttcccaccatcaacagaggagagatggtatgaaccacacaaacctggcggcagcgcaaaagatg

SEQ ID NO: 153054 - DNA, 103 bp, Artificial Sequence
  Synthetic Polynucleotide
taatacgactcactatagggctgctgcctctcccacattctctgtgtggtaacagaggagaaccacaatgagaatgtggaacctggcggcagcgcaaaagatg

SEQ ID NO: 153055 - DNA, 103 bp, Artificial Sequence
  Synthetic Polynucleotide
taatacgactcactatagggcgctccagctccttcatgcggatctcgcgaaacagaggagatcgcgaatgccgcatgaaaacctggcggcagcgcaaaagatg

SEQ ID NO: 153056 - DNA, 103 bp, Artificial Sequence
  Synthetic Polynucleotide
taatacgactcactatagggacctgagtcactgctgcctctcccacattcaacagaggagagaatgtatgagaggcagcaacctggcggcagcgcaaaagatg

SEQ ID NO: 153057 - DNA, 103 bp, Artificial Sequence
  Synthetic Polynucleotide
taatacgactcactatagggctgctcttcaacctgagtcactgctgcctcaacagaggagagaggcaatggtgactcagaacctggcggcagcgcaaaagatg

SEQ ID NO: 153058 - DNA, 103 bp, Artificial Sequence
  Synthetic Polynucleotide
taatacgactcactatagggctgtgcctgcctgctcttcaacctgagtcaaacagaggagatgactcatgttgaagagcaacctggcggcagcgcaaaagatg

SEQ ID NO: 153059 - DNA, 103 bp, Artificial Sequence
  Synthetic Polynucleotide
taatacgactcactatagggcacgaggccactgtgcctgcctgctcttcaaacagaggagatgaagaatgggcaggcacaacctggcggcagcgcaaaagatg

SEQ ID NO: 153060 - DNA, 103 bp, Artificial Sequence
  Synthetic Polynucleotide
taatacgactcactatagggccctaaaggacacgaggccactgtgcctgcaacagaggagagcaggcatggtggcctcgaacctggcggcagcgcaaaagatg

SEQ ID NO: 153061 - DNA, 103 bp, Artificial Sequence
  Synthetic Polynucleotide
taatacgactcactatagggcatcactatgccctaaaggacacgaggccaaacagaggagatggcctatggtcctttagaacctggcggcagcgcaaaagatg

SEQ ID NO: 153062 - DNA, 103 bp, Artificial Sequence
  Synthetic Polynucleotide
taatacgactcactatagggtaaactgtgtcatcactatgccctaaaggaaacagaggagatcctttatggcatagtgaaacctggcggcagcgcaaaagatg

SEQ ID NO: 153063 - DNA, 103 bp, Artificial Sequence
  Synthetic Polynucleotide
taatacgactcactataggggtcatcatgataaactgtgtcatcactatgaacagaggagacatagtatggacacagttaacctggcggcagcgcaaaagatg

SEQ ID NO: 153064 - DNA, 103 bp, Artificial Sequence
  Synthetic Polynucleotide
taatacgactcactatagggccatacatttgtcatcatgataaactgtgtaacagaggagaacacagatgatcatgatgaacctggcggcagcgcaaaagatg

SEQ ID NO: 153065 - DNA, 103 bp, Artificial Sequence
  Synthetic Polynucleotide
taatacgactcactataggggggacctctaccatacatttgtcatcatgaaacagaggagatcatgaatgcaaatgtataacctggcggcagcgcaaaagatg

SEQ ID NO: 153066 - DNA, 103 bp, Artificial Sequence
  Synthetic Polynucleotide
taatacgactcactatagggcttctgctgccgctccagctccttcatgcgaacagaggagacgcatgatggagctggagaacctggcggcagcgcaaaagatg

SEQ ID NO: 153067 - DNA, 103 bp, Artificial Sequence
  Synthetic Polynucleotide
taatacgactcactatagggtaactcttgggggacctctaccatacatttaacagaggagaaaatgtatggtagaggtcaacctggcggcagcgcaaaagatg

SEQ ID NO: 153068 - DNA, 103 bp, Artificial Sequence
  Synthetic Polynucleotide
taatacgactcactatagggtgcttgtctctaactcttgggggacctctaaacagaggagatagaggatgcccaagagtaacctggcggcagcgcaaaagatg

SEQ ID NO: 153069 - DNA, 103 bp, Artificial Sequence
  Synthetic Polynucleotide
taatacgactcactatagggctatgccctgtgcttgtctctaactcttggaacagaggagaccaagaatgagagacaagaacctggcggcagcgcaaaagatg

SEQ ID NO: 153070 - DNA, 103 bp, Artificial Sequence
  Synthetic Polynucleotide
taatacgactcactatagggtttctctaaactatgccctgtgcttgtctcaacagaggagagagacaatgacagggcataacctggcggcagcgcaaaagatg

SEQ ID NO: 153071 - DNA, 103 bp, Artificial Sequence
  Synthetic Polynucleotide
taatacgactcactatagggtggtgaattctttctctaaactatgccctgaacagaggagacagggcatggtttagagaaacctggcggcagcgcaaaagatg

SEQ ID NO: 153072 - DNA, 103 bp, Artificial Sequence
  Synthetic Polynucleotide
taatacgactcactataggggcttcctggttggtgaattctttctctaaaaacagaggagatttagaatgagaattcacaacctggcggcagcgcaaaagatg

SEQ ID NO: 153073 - DNA, 103 bp, Artificial Sequence
  Synthetic Polynucleotide
taatacgactcactataggggggctcagctgcttcctggttggtgaattcaacagaggagagaattcatgaaccaggaaaacctggcggcagcgcaaaagatg

SEQ ID NO: 153074 - DNA, 103 bp, Artificial Sequence
  Synthetic Polynucleotide
taatacgactcactataggggaacctccttgggctcagctgcttcctggtaacagaggagaaccaggatgcagctgagcaacctggcggcagcgcaaaagatg

SEQ ID NO: 153075 - DNA, 103 bp, Artificial Sequence
  Synthetic Polynucleotide
taatacgactcactatagggctgtgcgctggaacctccttgggctcagctaacagaggagaagctgaatgcaaggaggtaacctggcggcagcgcaaaagatg

SEQ ID NO: 153076 - DNA, 103 bp, Artificial Sequence
  Synthetic Polynucleotide
taatacgactcactatagggtacttctgtactgtgcgctggaacctccttaacagaggagaaaggagatgccagcgcacaacctggcggcagcgcaaaagatg

SEQ ID NO: 153077 - DNA, 103 bp, Artificial Sequence
  Synthetic Polynucleotide
taatacgactcactatagggtgtcttcctccttctgctgccgctccagctaacagaggagaagctggatgggcagcagaaacctggcggcagcgcaaaagatg

SEQ ID NO: 153078 - DNA, 103 bp, Artificial Sequence
  Synthetic Polynucleotide
taatacgactcactataggggatccctacctacttctgtactgtgcgctgaacagaggagacagcgcatggtacagaagaacctggcggcagcgcaaaagatg

SEQ ID NO: 153079 - DNA, 103 bp, Artificial Sequence
  Synthetic Polynucleotide
taatacgactcactatagggtcttcgttgtgatccctacctacttctgtaaacagaggagatacagaatgaggtagggaaacctggcggcagcgcaaaagatg

SEQ ID NO: 153080 - DNA, 103 bp, Artificial Sequence
  Synthetic Polynucleotide
taatacgactcactatagggttcaccctcttcttcgttgtgatccctaccaacagaggagaggtaggatgcacaacgaaaacctggcggcagcgcaaaagatg

SEQ ID NO: 153081 - DNA, 103 bp, Artificial Sequence
  Synthetic Polynucleotide
taatacgactcactatagggatcctgtttcttcaccctcttcttcgttgtaacagaggagaacaacgatgaagagggtgaacctggcggcagcgcaaaagatg

SEQ ID NO: 153082 - DNA, 103 bp, Artificial Sequence
  Synthetic Polynucleotide
taatacgactcactatagggtcgtcccttaatcctgtttcttcaccctctaacagaggagaagagggatgagaaacaggaacctggcggcagcgcaaaagatg

SEQ ID NO: 153083 - DNA, 103 bp, Artificial Sequence
  Synthetic Polynucleotide
taatacgactcactataggggattggtttctcgtcccttaatcctgtttcaacagaggagagaaacaatgttaagggacaacctggcggcagcgcaaaagatg

SEQ ID NO: 153084 - DNA, 103 bp, Artificial Sequence
  Synthetic Polynucleotide
taatacgactcactatagggcttctgtcttgattggtttctcgtcccttaaacagaggagataagggatgagaaaccaaaacctggcggcagcgcaaaagatg

SEQ ID NO: 153085 - DNA, 103 bp, Artificial Sequence
  Synthetic Polynucleotide
taatacgactcactataggggaaccaggaacttctgtcttgattggtttcaacagaggagagaaaccatgcaagacagaaacctggcggcagcgcaaaagatg

SEQ ID NO: 153086 - DNA, 103 bp, Artificial Sequence
  Synthetic Polynucleotide
taatacgactcactatagggtcctgctggagaaccaggaacttctgtcttaacagaggagaaagacaatggttcctggtaacctggcggcagcgcaaaagatg

SEQ ID NO: 153087 - DNA, 103 bp, Artificial Sequence
  Synthetic Polynucleotide
taatacgactcactatagggtgccctcagttcctgctggagaaccaggaaaacagaggagattcctgatgctccagcagaacctggcggcagcgcaaaagatg

SEQ ID NO: 153088 - DNA, 103 bp, Artificial Sequence
  Synthetic Polynucleotide
taatacgactcactatagggtagcgctcactgtcttcctccttctgctgcaacagaggagagcagcaatgggaggaagaaacctggcggcagcgcaaaagatg

SEQ ID NO: 153089 - DNA, 103 bp, Artificial Sequence
  Synthetic Polynucleotide
taatacgactcactatagggtcctgacagttgccctcagttcctgctggaaacagaggagatccagcatgaactgagggaacctggcggcagcgcaaaagatg

SEQ ID NO: 153090 - DNA, 103 bp, Artificial Sequence
  Synthetic Polynucleotide
taatacgactcactatagggacctgtcgcttcctgacagttgccctcagtaacagaggagaactgagatgaactgtcagaacctggcggcagcgcaaaagatg

SEQ ID NO: 153091 - DNA, 103 bp, Artificial Sequence
  Synthetic Polynucleotide
taatacgactcactatagggctgtacttggacctgtcgcttcctgacagtaacagaggagaactgtcatgaagcgacagaacctggcggcagcgcaaaagatg

SEQ ID NO: 153092 - DNA, 103 bp, Artificial Sequence
  Synthetic Polynucleotide
taatacgactcactatagggtgagtgtctactgtacttggacctgtcgctaacagaggagaagcgacatgtccaagtacaacctggcggcagcgcaaaagatg

SEQ ID NO: 153093 - DNA, 103 bp, Artificial Sequence
  Synthetic Polynucleotide
taatacgactcactataggggggttcattttgagtgtctactgtacttggaacagaggagaccaagtatggtagacactaacctggcggcagcgcaaaagatg

SEQ ID NO: 153094 - DNA, 103 bp, Artificial Sequence
  Synthetic Polynucleotide
taatacgactcactatagggtcatatctaagggttcattttgagtgtctaaacagaggagatagacaatgaaaatgaacaacctggcggcagcgcaaaagatg

SEQ ID NO: 153095 - DNA, 103 bp, Artificial Sequence
  Synthetic Polynucleotide
taatacgactcactatagggtcgggctctttcatatctaagggttcatttaacagaggagaaaatgaatgcttagatataacctggcggcagcgcaaaagatg

SEQ ID NO: 153096 - DNA, 103 bp, Artificial Sequence
  Synthetic Polynucleotide
taatacgactcactatagggcttttcttcatcgggctctttcatatctaaaacagaggagattagatatgaaagagcccaacctggcggcagcgcaaaagatg

SEQ ID NO: 153097 - DNA, 103 bp, Artificial Sequence
  Synthetic Polynucleotide
taatacgactcactataggggttggtcactcttttcttcatcgggctcttaacagaggagaaagagcatgatgaagaaaaacctggcggcagcgcaaaagatg

SEQ ID NO: 153098 - DNA, 103 bp, Artificial Sequence
  Synthetic Polynucleotide
taatacgactcactataggggcctctccctgttggtcactcttttcttcaaacagaggagatgaagaatggagtgaccaaacctggcggcagcgcaaaagatg

SEQ ID NO: 153099 - DNA, 103 bp, Artificial Sequence
  Synthetic Polynucleotide
taatacgactcactatagggtctacgagagtagcgctcactgtcttcctcaacagaggagagaggaaatgagtgagcgcaacctggcggcagcgcaaaagatg

SEQ ID NO: 153100 - DNA, 103 bp, Artificial Sequence
  Synthetic Polynucleotide
taatacgactcactatagggtgagtccaatgcctctccctgttggtcactaacagaggagaagtgacatgcagggagagaacctggcggcagcgcaaaagatg

SEQ ID NO: 153101 - DNA, 103 bp, Artificial Sequence
  Synthetic Polynucleotide
taatacgactcactatagggtcttctgcgatgagtccaatgcctctccctaacagaggagaagggagatgcattggactaacctggcggcagcgcaaaagatg

SEQ ID NO: 153102 - DNA, 103 bp, Artificial Sequence
  Synthetic Polynucleotide
taatacgactcactatagggttctttgtcttcttctgcgatgagtccaataacagaggagaattggaatgatcgcagaaaacctggcggcagcgcaaaagatg

SEQ ID NO: 153103 - DNA, 103 bp, Artificial Sequence
  Synthetic Polynucleotide
taatacgactcactatagggctttttcttgttctttgtcttcttctgcgaaacagaggagatcgcagatgaagacaaagaacctggcggcagcgcaaaagatg

SEQ ID NO: 153104 - DNA, 103 bp, Artificial Sequence
  Synthetic Polynucleotide
taatacgactcactatagggtcttgtttttctttttcttgttctttgtctaacagaggagaagacaaatgacaagaaaaaacctggcggcagcgcaaaagatg

SEQ ID NO: 153105 - DNA, 103 bp, Artificial Sequence
  Synthetic Polynucleotide
taatacgactcactataggggattttttcttcttgtttttctttttcttgaacagaggagacaagaaatggaaaaacaaaacctggcggcagcgcaaaagatg

SEQ ID NO: 153106 - DNA, 103 bp, Artificial Sequence
  Synthetic Polynucleotide
taatacgactcactataggggggtactggggattttttcttcttgtttttaacagaggagaaaaaacatgaagaaaaaaaacctggcggcagcgcaaaagatg

SEQ ID NO: 153107 - DNA, 103 bp, Artificial Sequence
  Synthetic Polynucleotide
taatacgactcactataggggggtttctacgggtactggggattttttctaacagaggagaagaaaaatgccccagtacaacctggcggcagcgcaaaagatg

SEQ ID NO: 153108 - DNA, 103 bp, Artificial Sequence
  Synthetic Polynucleotide
taatacgactcactatagggacatctttaagggtttctacgggtactgggaacagaggagacccagtatgcgtagaaacaacctggcggcagcgcaaaagatg

SEQ ID NO: 153109 - DNA, 103 bp, Artificial Sequence
  Synthetic Polynucleotide
taatacgactcactatagggctcttttttaacatctttaagggtttctacaacagaggagagtagaaatgcttaaagataacctggcggcagcgcaaaagatg

SEQ ID NO: 153110 - DNA, 103 bp, Artificial Sequence
  Synthetic Polynucleotide
taatacgactcactatagggttcttctggatctacgagagtagcgctcacaacagaggagagtgagcatgactctcgtaaacctggcggcagcgcaaaagatg

SEQ ID NO: 153111 - DNA, 103 bp, Artificial Sequence
  Synthetic Polynucleotide
taatacgactcactataggggatacgttaactcttttttaacatctttaaaacagaggagattaaagatgttaaaaaagaacctggcggcagcgcaaaagatg

SEQ ID NO: 153112 - DNA, 103 bp, Artificial Sequence
  Synthetic Polynucleotide
taatacgactcactatagggtctgtgttctgatacgttaactcttttttaaacagaggagataaaaaatggttaacgtaaacctggcggcagcgcaaaagatg

SEQ ID NO: 153113 - DNA, 103 bp, Artificial Sequence
  Synthetic Polynucleotide
taatacgactcactatagggttcacttaaatctgtgttctgatacgttaaaacagaggagattaacgatgcagaacacaaacctggcggcagcgcaaaagatg

SEQ ID NO: 153114 - DNA, 103 bp, Artificial Sequence
  Synthetic Polynucleotide
taatacgactcactatagggcttccttaatttcacttaaatctgtgttctaacagaggagaagaacaatgatttaagtgaacctggcggcagcgcaaaagatg

SEQ ID NO: 153115 - DNA, 103 bp, Artificial Sequence
  Synthetic Polynucleotide
taatacgactcactatagggacctgctcttcttccttaatttcacttaaaaacagaggagatttaagatgaattaaggaaacctggcggcagcgcaaaagatg

SEQ ID NO: 153116 - DNA, 103 bp, Artificial Sequence
  Synthetic Polynucleotide
taatacgactcactatagggagtagactttacctgctcttcttccttaataacagaggagaattaagatggaagagcagaacctggcggcagcgcaaaagatg

SEQ ID NO: 153117 - DNA, 103 bp, Artificial Sequence
  Synthetic Polynucleotide
taatacgactcactatagggactttctgtcagtagactttacctgctcttaacagaggagaaagagcatgtaaagtctaaacctggcggcagcgcaaaagatg

SEQ ID NO: 153118 - DNA, 103 bp, Artificial Sequence
  Synthetic Polynucleotide
taatacgactcactatagggtccactgctgactttctgtcagtagactttaacagaggagaaaagtcatgtgacagaaaaacctggcggcagcgcaaaagatg

SEQ ID NO: 153119 - DNA, 103 bp, Artificial Sequence
  Synthetic Polynucleotide
taatacgactcactataggggttttgggcttccactgctgactttctgtcaacagaggagagacagaatgtcagcagtgaacctggcggcagcgcaaaagatg

SEQ ID NO: 153120 - DNA, 103 bp, Artificial Sequence
  Synthetic Polynucleotide
taatacgactcactatagggcagtcacctcgttttgggcttccactgctgaacagaggagacagcagatgaagcccaaaaacctggcggcagcgcaaaagatg

SEQ ID NO: 153121 - DNA, 103 bp, Artificial Sequence
  Synthetic Polynucleotide
taatacgactcactataggggccgatgtgtttcttctggatctacgagagaacagaggagactctcgatgatccagaagaacctggcggcagcgcaaaagatg

SEQ ID NO: 153122 - DNA, 103 bp, Artificial Sequence
  Synthetic Polynucleotide
taatacgactcactatagggtttggattttcagtcacctcgttttgggctaacagaggagaagcccaatgcgaggtgacaacctggcggcagcgcaaaagatg

SEQ ID NO: 153123 - DNA, 103 bp, Artificial Sequence
  Synthetic Polynucleotide
taatacgactcactatagggaattttctgttttggattttcagtcacctcaacagaggagagaggtgatggaaaatccaaacctggcggcagcgcaaaagatg

SEQ ID NO: 153124 - DNA, 103 bp, Artificial Sequence
  Synthetic Polynucleotide
taatacgactcactatagggtttctgctgcaattttctgttttggattttaacagaggagaaaaatcatgaacagaaaaaacctggcggcagcgcaaaagatg

SEQ ID NO: 153125 - DNA, 103 bp, Artificial Sequence
  Synthetic Polynucleotide
taatacgactcactatagggttttcactgctttctgctgcaattttctgtaacagaggagaacagaaatgtgcagcagaaacctggcggcagcgcaaaagatg

SEQ ID NO: 153126 - DNA, 103 bp, Artificial Sequence
  Synthetic Polynucleotide
taatacgactcactatagggacaatcaacattttcactgctttctgctgcaacagaggagagcagcaatgagcagtgaaaacctggcggcagcgcaaaagatg

SEQ ID NO: 153127 - DNA, 103 bp, Artificial Sequence
  Synthetic Polynucleotide
taatacgactcactataggggattctccggacaatcaacattttcactgcaacagaggagagcagtgatgatgttgattaacctggcggcagcgcaaaagatg

SEQ ID NO: 153128 - DNA, 103 bp, Artificial Sequence
  Synthetic Polynucleotide
taatacgactcactatagggttaattttaggattctccggacaatcaacaaacagaggagatgttgaatgtccggagaaaacctggcggcagcgcaaaagatg

SEQ ID NO: 153129 - DNA, 103 bp, Artificial Sequence
  Synthetic Polynucleotide
taatacgactcactatagggtccatccaacttaattttaggattctccggaacagaggagaccggagatgcctaaaattaacctggcggcagcgcaaaagatg

SEQ ID NO: 153130 - DNA, 103 bp, Artificial Sequence
  Synthetic Polynucleotide
taatacgactcactatagggggtcaagttttccatccaacttaattttagaacagaggagactaaaaatgagttggatgaacctggcggcagcgcaaaagatg

SEQ ID NO: 153131 - DNA, 103 bp, Artificial Sequence
  Synthetic Polynucleotide
taatacgactcactatagggtcaccttcttggtcaagttttccatccaacaacagaggagagttggaatgaaaacttgaaacctggcggcagcgcaaaagatg

SEQ ID NO: 153132 - DNA, 103 bp, Artificial Sequence
  Synthetic Polynucleotide
taatacgactcactatagggttcatcagaagccgatgtgtttcttctggaaacagaggagatccagaatgaacacatcgaacctggcggcagcgcaaaagatg

SEQ ID NO: 153133 - DNA, 103 bp, Artificial Sequence
  Synthetic Polynucleotide
taatacgactcactatagggttgtacatcatcaccttcttggtcaagtttaacagaggagaaaacttatgcaagaaggtaacctggcggcagcgcaaaagatg

SEQ ID NO: 153134 - DNA, 103 bp, Artificial Sequence
  Synthetic Polynucleotide
taatacgactcactatagggcagctgctgtttgtacatcatcaccttcttaacagaggagaaagaagatgatgatgtacaacctggcggcagcgcaaaagatg

SEQ ID NO: 153135 - DNA, 103 bp, Artificial Sequence
  Synthetic Polynucleotide
taatacgactcactatagggagtacctcctcagctgctgtttgtacatcaaacagaggagatgatgtatgaacagcagcaacctggcggcagcgcaaaagatg

SEQ ID NO: 153136 - DNA, 103 bp, Artificial Sequence
  Synthetic Polynucleotide
taatacgactcactatagggtccatcagctagtacctcctcagctgctgtaacagaggagaacagcaatggaggaggtaaacctggcggcagcgcaaaagatg

SEQ ID NO: 153137 - DNA, 103 bp, Artificial Sequence
  Synthetic Polynucleotide
taatacgactcactatagggctaatgtgtctccatcagctagtacctcctaacagaggagaaggaggatgtagctgatgaacctggcggcagcgcaaaagatg

SEQ ID NO: 153138 - DNA, 103 bp, Artificial Sequence
  Synthetic Polynucleotide
taatacgactcactatagggtcctcaaaatctaatgtgtctccatcagctaacagaggagaagctgaatgagacacattaacctggcggcagcgcaaaagatg

SEQ ID NO: 153139 - DNA, 103 bp, Artificial Sequence
  Synthetic Polynucleotide
taatacgactcactatagggaacggtgtcatcctcaaaatctaatgtgtcaacagaggagagacacaatggattttgagaacctggcggcagcgcaaaagatg

SEQ ID NO: 153140 - DNA, 103 bp, Artificial Sequence
  Synthetic Polynucleotide
taatacgactcactatagggctgatgattgaacggtgtcatcctcaaaataacagaggagaattttgatgatgacaccgaacctggcggcagcgcaaaagatg

SEQ ID NO: 153141 - DNA, 103 bp, Artificial Sequence
  Synthetic Polynucleotide
taatacgactcactataggggccctcgggcctgatgattgaacggtgtcaaacagaggagatgacacatgtcaatcatcaacctggcggcagcgcaaaagatg

SEQ ID NO: 153142 - DNA, 103 bp, Artificial Sequence
  Synthetic Polynucleotide
taatacgactcactatagggttcaccaccagccctcgggcctgatgattgaacagaggagacaatcaatgggcccgaggaacctggcggcagcgcaaaagatg

SEQ ID NO: 153143 - DNA, 103 bp, Artificial Sequence
  Synthetic Polynucleotide
taatacgactcactatagggagtcgatctcccggctttgagcggccgcggaacagaggagaccgcggatgctcaaagccaacctggcggcagcgcaaaagatg

SEQ ID NO: 153144 - DNA, 103 bp, Artificial Sequence
  Synthetic Polynucleotide
taatacgactcactatagggtgcgctcgtcttcatcagaagccgatgtgtaacagaggagaacacatatgcttctgatgaacctggcggcagcgcaaaagatg

SEQ ID NO: 153145 - DNA, 103 bp, Artificial Sequence
  Synthetic Polynucleotide
taatacgactcactatagggcatctaattcttcaccaccagccctcgggcaacagaggagagcccgaatgctggtggtgaacctggcggcagcgcaaaagatg

SEQ ID NO: 153146 - DNA, 103 bp, Artificial Sequence
  Synthetic Polynucleotide
taatacgactcactataggggcaacaccttcatctaattcttcaccaccaaacagaggagatggtggatgagaattagaaacctggcggcagcgcaaaagatg

SEQ ID NO: 153147 - DNA, 103 bp, Artificial Sequence
  Synthetic Polynucleotide
taatacgactcactatagggattatcttttgcaacaccttcatctaattcaacagaggagagaattaatggaaggtgttaacctggcggcagcgcaaaagatg

SEQ ID NO: 153148 - DNA, 103 bp, Artificial Sequence
  Synthetic Polynucleotide
taatacgactcactatagggctattttagcattatcttttgcaacaccttaacagaggagaaaggtgatgcaaaagataaacctggcggcagcgcaaaagatg

SEQ ID NO: 153149 - DNA, 103 bp, Artificial Sequence
  Synthetic Polynucleotide
taatacgactcactataggggtggcaccatctattttagcattatcttttaacagaggagaaaaagaatgtgctaaaataacctggcggcagcgcaaaagatg

SEQ ID NO: 153150 - DNA, 103 bp, Artificial Sequence
  Synthetic Polynucleotide
taatacgactcactatagggactgctttgagtggcaccatctattttagcaacagaggagagctaaaatggatggtgccaacctggcggcagcgcaaaagatg

SEQ ID NO: 153151 - DNA, 103 bp, Artificial Sequence
  Synthetic Polynucleotide
taatacgactcactataggggttctgcaggactgctttgagtggcaccataacagaggagaatggtgatgctcaaagcaaacctggcggcagcgcaaaagatg

SEQ ID NO: 153152 - DNA, 103 bp, Artificial Sequence
  Synthetic Polynucleotide
taatacgactcactatagggtcgctctttggttctgcaggactgctttgaaacagaggagatcaaagatgtcctgcagaaacctggcggcagcgcaaaagatg

SEQ ID NO: 153153 - DNA, 103 bp, Artificial Sequence
  Synthetic Polynucleotide
taatacgactcactatagggatctgcgtcttcgctctttggttctgcaggaacagaggagacctgcaatgccaaagagcaacctggcggcagcgcaaaagatg

SEQ ID NO: 153154 - DNA, 103 bp, Artificial Sequence
  Synthetic Polynucleotide
taatacgactcactataggggggtgcagcgatctgcgtcttcgctctttgaacagaggagacaaagaatgaagacgcagaacctggcggcagcgcaaaagatg

SEQ ID NO: 153155 - DNA, 103 bp, Artificial Sequence
  Synthetic Polynucleotide
taatacgactcactatagggcccactgacatgcgctcgtcttcatcagaaaacagaggagattctgaatgagacgagcgaacctggcggcagcgcaaaagatg

SEQ ID NO: 153156 - DNA, 103 bp, Artificial Sequence
  Synthetic Polynucleotide
taatacgactcactatagggtgttcgggcagggtgcagcgatctgcgtctaacagaggagaagacgcatgtcgctgcacaacctggcggcagcgcaaaagatg

SEQ ID NO: 153157 - DNA, 103 bp, Artificial Sequence
  Synthetic Polynucleotide
taatacgactcactataggggggactttcatgttcgggcagggtgcagcgaacagaggagacgctgcatgctgcccgaaaacctggcggcagcgcaaaagatg

SEQ ID NO: 153158 - DNA, 103 bp, Artificial Sequence
  Synthetic Polynucleotide
taatacgactcactatagggtgtcctgtgagggactttcatgttcgggcaaacagaggagatgcccgatgatgaaagtcaacctggcggcagcgcaaaagatg

SEQ ID NO: 153159 - DNA, 103 bp, Artificial Sequence
  Synthetic Polynucleotide
taatacgactcactataggggcatcactaatgtcctgtgagggactttcaaacagaggagatgaaagatgctcacaggaaacctggcggcagcgcaaaagatg

SEQ ID NO: 153160 - DNA, 103 bp, Artificial Sequence
  Synthetic Polynucleotide
taatacgactcactatagggtgcttcacaggcatcactaatgtcctgtgaaacagaggagatcacagatgattagtgataacctggcggcagcgcaaaagatg

SEQ ID NO: 153161 - DNA, 103 bp, Artificial Sequence
  Synthetic Polynucleotide
taatacgactcactatagggctgtactttctgcttcacaggcatcactaaaacagaggagattagtgatgcctgtgaagaacctggcggcagcgcaaaagatg

SEQ ID NO: 153162 - DNA, 103 bp, Artificial Sequence
  Synthetic Polynucleotide
taatacgactcactatagggtcacacctctctgtactttctgcttcacagaacagaggagactgtgaatgagaaagtacaacctggcggcagcgcaaaagatg

SEQ ID NO: 153163 - DNA, 103 bp, Artificial Sequence
  Synthetic Polynucleotide
taatacgactcactatagggttctgacatctcacacctctctgtactttcaacagaggagagaaagtatggagaggtgtaacctggcggcagcgcaaaagatg

SEQ ID NO: 153164 - DNA, 103 bp, Artificial Sequence
  Synthetic Polynucleotide
taatacgactcactataggggacttggatgttctgacatctcacacctctaacagaggagaagaggtatgagatgtcagaacctggcggcagcgcaaaagatg

SEQ ID NO: 153165 - DNA, 103 bp, Artificial Sequence
  Synthetic Polynucleotide
taatacgactcactatagggctgacggtctgacttggatgttctgacatcaacagaggagagatgtcatgacatccaagaacctggcggcagcgcaaaagatg

SEQ ID NO: 153166 - DNA, 103 bp, Artificial Sequence
  Synthetic Polynucleotide
taatacgactcactatagggtccacgactacccactgacatgcgctcgtcaacagaggagagacgagatgatgtcagtgaacctggcggcagcgcaaaagatg

SEQ ID NO: 153167 - DNA, 103 bp, Artificial Sequence
  Synthetic Polynucleotide
taatacgactcactatagggtaaagctttcctgacggtctgacttggatgaacagaggagacatccaatgcagaccgtcaacctggcggcagcgcaaaagatg

SEQ ID NO: 153168 - DNA, 103 bp, Artificial Sequence
  Synthetic Polynucleotide
taatacgactcactatagggtattgctgtctaaagctttcctgacggtctaacagaggagaagaccgatgggaaagcttaacctggcggcagcgcaaaagatg

SEQ ID NO: 153169 - DNA, 103 bp, Artificial Sequence
  Synthetic Polynucleotide
taatacgactcactatagggttctctaggctattgctgtctaaagctttcaacagaggagagaaagcatgagacagcaaaacctggcggcagcgcaaaagatg

SEQ ID NO: 153170 - DNA, 103 bp, Artificial Sequence
  Synthetic Polynucleotide
taatacgactcactatagggcaagtcatcgttctctaggctattgctgtcaacagaggagagacagcatgagcctagagaacctggcggcagcgcaaaagatg

SEQ ID NO: 153171 - DNA, 103 bp, Artificial Sequence
  Synthetic Polynucleotide
taatacgactcactatagggctggtgccgacaagtcatcgttctctaggcaacagaggagagcctagatgacgatgactaacctggcggcagcgcaaaagatg

SEQ ID NO: 153172 - DNA, 103 bp, Artificial Sequence
  Synthetic Polynucleotide
taatacgactcactatagggggctctcttcctggtgccgacaagtcatcgaacagaggagacgatgaatggtcggcaccaacctggcggcagcgcaaaagatg

SEQ ID NO: 153173 - DNA, 103 bp, Artificial Sequence
  Synthetic Polynucleotide
taatacgactcactataggggaagtgccctggctctcttcctggtgccgaaacagaggagatcggcaatgggaagagagaacctggcggcagcgcaaaagatg

SEQ ID NO: 153174 - DNA, 103 bp, Artificial Sequence
  Synthetic Polynucleotide
taatacgactcactatagggtttctggattgaagtgccctggctctcttcaacagaggagagaagagatgcagggcactaacctggcggcagcgcaaaagatg

SEQ ID NO: 153175 - DNA, 103 bp, Artificial Sequence
  Synthetic Polynucleotide
taatacgactcactatagggtcttctctgctttctggattgaagtgccctaacagaggagaagggcaatgcaatccagaaacctggcggcagcgcaaaagatg

SEQ ID NO: 153176 - DNA, 103 bp, Artificial Sequence
  Synthetic Polynucleotide
taatacgactcactatagggtcctctggtatcttctctgctttctggattaacagaggagaaatccaatgagcagagaaaacctggcggcagcgcaaaagatg

SEQ ID NO: 153177 - DNA, 103 bp, Artificial Sequence
  Synthetic Polynucleotide
taatacgactcactatagggccctcaggcttccacgactacccactgacaaacagaggagatgtcagatggtagtcgtgaacctggcggcagcgcaaaagatg

SEQ ID NO: 153178 - DNA, 103 bp, Artificial Sequence
  Synthetic Polynucleotide
taatacgactcactatagggtctcattccctcctctggtatcttctctgcaacagaggagagcagagatgataccagagaacctggcggcagcgcaaaagatg

SEQ ID NO: 153179 - DNA, 103 bp, Artificial Sequence
  Synthetic Polynucleotide
taatacgactcactatagggcttttgcccttctcattccctcctctggtaaacagaggagataccagatgagggaatgaaacctggcggcagcgcaaaagatg

SEQ ID NO: 153180 - DNA, 103 bp, Artificial Sequence
  Synthetic Polynucleotide
taatacgactcactataggggtcttctttgcttttgcccttctcattcccaacagaggagagggaatatgaagggcaaaaacctggcggcagcgcaaaagatg

SEQ ID NO: 153181 - DNA, 103 bp, Artificial Sequence
  Synthetic Polynucleotide
taatacgactcactatagggacatggtacagtcttctttgcttttgccctaacagaggagaagggcaatggcaaagaagaacctggcggcagcgcaaaagatg

SEQ ID NO: 153182 - DNA, 103 bp, Artificial Sequence
  Synthetic Polynucleotide
taatacgactcactatagggctctcttctaccctcaggcttccacgactaaacagaggagatagtcgatgaagcctgagaacctggcggcagcgcaaaagatg

SEQ ID NO: 153183 - DNA, 103 bp, Artificial Sequence
  Synthetic Polynucleotide
taatacgactcactatagggtttttctggtctctcttctaccctcaggctaacagaggagaagcctgatggtagaagagaacctggcggcagcgcaaaagatg

SEQ ID NO: 153184 - DNA, 103 bp, Artificial Sequence
  Synthetic Polynucleotide
taatacgactcactatagggcagtaaaatctttttctggtctctcttctaaacagaggagatagaagatggaccagaaaaacctggcggcagcgcaaaagatg

SEQ ID NO: 153185 - DNA, 103 bp, Artificial Sequence
  Synthetic Polynucleotide
taatacgactcactataggggaccccttctcagtaaaatctttttctggtaacagaggagaaccagaatgagattttacaacctggcggcagcgcaaaagatg

SEQ ID NO: 153186 - DNA, 103 bp, Artificial Sequence
  Synthetic Polynucleotide
taatacgactcactatagggcatgttacgagaccccttctcagtaaaatcaacagaggagagattttatggagaaggggaacctggcggcagcgcaaaagatg

SEQ ID NO: 153187 - DNA, 103 bp, Artificial Sequence
  Synthetic Polynucleotide
taatacgactcactatagggacaggcccggcatgttacgagaccccttctaacagaggagaagaaggatgctcgtaacaaacctggcggcagcgcaaaagatg

SEQ ID NO: 153188 - DNA, 103 bp, Artificial Sequence
  Synthetic Polynucleotide
taatacgactcactataggggggctcaaacagtcgatctcccggctttgaaacagaggagatcaaagatgggagatcgaaacctggcggcagcgcaaaagatg

SEQ ID NO: 153189 - DNA, 103 bp, Artificial Sequence
  Synthetic Polynucleotide
taatacgactcactataggggtggctgcagacaggcccggcatgttacgaaacagaggagatcgtaaatggccgggcctaacctggcggcagcgcaaaagatg

SEQ ID NO: 153190 - DNA, 103 bp, Artificial Sequence
  Synthetic Polynucleotide
taatacgactcactatagggagaggccagcgtggctgcagacaggcccggaacagaggagaccgggcatgtctgcagccaacctggcggcagcgcaaaagatg

SEQ ID NO: 153191 - DNA, 103 bp, Artificial Sequence
  Synthetic Polynucleotide
taatacgactcactatagggtcccacccagagaggccagcgtggctgcagaacagaggagactgcagatgcgctggcctaacctggcggcagcgcaaaagatg

SEQ ID NO: 153192 - DNA, 103 bp, Artificial Sequence
  Synthetic Polynucleotide
taatacgactcactatagggcgagaggaagtcccacccagagaggccagcaacagaggagagctggcatgtctgggtggaacctggcggcagcgcaaaagatg

SEQ ID NO: 153193 - DNA, 103 bp, Artificial Sequence
  Synthetic Polynucleotide
taatacgactcactataggggctgcctctccgagaggaagtcccacccagaacagaggagactgggtatgacttcctctaacctggcggcagcgcaaaagatg

SEQ ID NO: 153194 - DNA, 103 bp, Artificial Sequence
  Synthetic Polynucleotide
taatacgactcactatagggaggtgtctccgctgcctctccgagaggaagaacagaggagacttcctatgggagaggcaaacctggcggcagcgcaaaagatg

SEQ ID NO: 153195 - DNA, 103 bp, Artificial Sequence
  Synthetic Polynucleotide
taatacgactcactatagggatggagatggaggtgtctccgctgcctctcaacagaggagagagaggatgcggagacacaacctggcggcagcgcaaaagatg

SEQ ID NO: 153196 - DNA, 103 bp, Artificial Sequence
  Synthetic Polynucleotide
taatacgactcactatagggctcggtgtcgatggagatggaggtgtctccaacagaggagaggagacatgtccatctccaacctggcggcagcgcaaaagatg

SEQ ID NO: 153197 - DNA, 103 bp, Artificial Sequence
  Synthetic Polynucleotide
taatacgactcactatagggtgatggatgcctcggtgtcgatggagatggaacagaggagaccatctatgtcgacaccgaacctggcggcagcgcaaaagatg

SEQ ID NO: 153198 - DNA, 103 bp, Artificial Sequence
  Synthetic Polynucleotide
taatacgactcactatagggttgatttccctgatggatgcctcggtgtcgaacagaggagacgacacatgggcatccataacctggcggcagcgcaaaagatg

SEQ ID NO: 153199 - DNA, 103 bp, Artificial Sequence
  Synthetic Polynucleotide
taatacgactcactatagggctgcgcttccgggctcaaacagtcgatctcaacagaggagagagatcatgtgtttgagcaacctggcggcagcgcaaaagatg

SEQ ID NO: 153200 - DNA, 103 bp, Artificial Sequence
  Synthetic Polynucleotide
taatacgactcactatagggtagagagtccttgatttccctgatggatgcaacagaggagagcatccatgagggaaatcaacctggcggcagcgcaaaagatg

SEQ ID NO: 153201 - DNA, 103 bp, Artificial Sequence
  Synthetic Polynucleotide
taatacgactcactatagggcaacttctgctagagagtccttgatttcccaacagaggagagggaaaatgaggactctcaacctggcggcagcgcaaaagatg

SEQ ID NO: 153202 - DNA, 103 bp, Artificial Sequence
  Synthetic Polynucleotide
taatacgactcactatagggtatttctcttcaacttctgctagagagtccaacagaggagaggactcatgagcagaagtaacctggcggcagcgcaaaagatg

SEQ ID NO: 153203 - DNA, 103 bp, Artificial Sequence
  Synthetic Polynucleotide
taatacgactcactatagggagccttcttatatttctcttcaacttctgcaacagaggagagcagaaatggaagagaaaaacctggcggcagcgcaaaagatg

SEQ ID NO: 153204 - DNA, 103 bp, Artificial Sequence
  Synthetic Polynucleotide
taatacgactcactatagggtggaaaccatagccttcttatatttctcttaacagaggagaaagagaatgataagaaggaacctggcggcagcgcaaaagatg

SEQ ID NO: 153205 - DNA, 103 bp, Artificial Sequence
  Synthetic Polynucleotide
taatacgactcactatagggagctgagcattggaaaccatagccttcttaaacagaggagataagaaatgtatggtttcaacctggcggcagcgcaaaagatg

SEQ ID NO: 153206 - DNA, 103 bp, Artificial Sequence
  Synthetic Polynucleotide
taatacgactcactatagggttcattgtctagctgagcattggaaaccataacagaggagaatggttatgaatgctcagaacctggcggcagcgcaaaagatg

SEQ ID NO: 153207 - DNA, 103 bp, Artificial Sequence
  Synthetic Polynucleotide
taatacgactcactatagggagtttgtcttttcattgtctagctgagcataacagaggagaatgctcatgtagacaatgaacctggcggcagcgcaaaagatg

SEQ ID NO: 153208 - DNA, 103 bp, Artificial Sequence
  Synthetic Polynucleotide
taatacgactcactatagggtggtacatgaagtttgtcttttcattgtctaacagaggagaagacaaatgaaagacaaaaacctggcggcagcgcaaaagatg

SEQ ID NO: 153209 - DNA, 103 bp, Artificial Sequence
  Synthetic Polynucleotide
taatacgactcactatagggggtatcaacctggtacatgaagtttgtcttaacagaggagaaagacaatgttcatgtacaacctggcggcagcgcaaaagatg

SEQ ID NO: 153210 - DNA, 103 bp, Artificial Sequence
  Synthetic Polynucleotide
taatacgactcactatagggccgccagcttctgcgcttccgggctcaaacaacagaggagagtttgaatgcggaagcgcaacctggcggcagcgcaaaagatg

SEQ ID NO: 153211 - DNA, 103 bp, Artificial Sequence
  Synthetic Polynucleotide
taatacgactcactatagggtatcttttagggtatcaacctggtacatgaaacagaggagatcatgtatgaggttgataaacctggcggcagcgcaaaagatg

SEQ ID NO: 153212 - DNA, 103 bp, Artificial Sequence
  Synthetic Polynucleotide
taatacgactcactatagggtccagcaacatatcttttagggtatcaaccaacagaggagaggttgaatgcctaaaagaaacctggcggcagcgcaaaagatg

SEQ ID NO: 153213 - DNA, 103 bp, Artificial Sequence
  Synthetic Polynucleotide
taatacgactcactatagggttcttcaagctccagcaacatatcttttagaacagaggagactaaaaatgatgttgctgaacctggcggcagcgcaaaagatg

SEQ ID NO: 153214 - DNA, 103 bp, Artificial Sequence
  Synthetic Polynucleotide
taatacgactcactatagggcagccagctgttcttcaagctccagcaacaaacagaggagatgttgcatgagcttgaagaacctggcggcagcgcaaaagatg

SEQ ID NO: 153215 - DNA, 103 bp, Artificial Sequence
  Synthetic Polynucleotide
taatacgactcactatagggcgcctagattcagccagctgttcttcaagcaacagaggagagcttgaatgacagctggcaacctggcggcagcgcaaaagatg

SEQ ID NO: 153216 - DNA, 103 bp, Artificial Sequence
  Synthetic Polynucleotide
taatacgactcactatagggttcgtactgccgcctagattcagccagctgaacagaggagacagctgatggaatctaggaacctggcggcagcgcaaaagatg

SEQ ID NO: 153217 - DNA, 103 bp, Artificial Sequence
  Synthetic Polynucleotide
taatacgactcactatagggtgtttttctcttcgtactgccgcctagattaacagaggagaaatctaatgggcagtacgaacctggcggcagcgcaaaagatg

SEQ ID NO: 153218 - DNA, 103 bp, Artificial Sequence
  Synthetic Polynucleotide
taatacgactcactatagggtcaaattctttgtttttctcttcgtactgcaacagaggagagcagtaatgagagaaaaaaacctggcggcagcgcaaaagatg

SEQ ID NO: 153219 - DNA, 103 bp, Artificial Sequence
  Synthetic Polynucleotide
taatacgactcactatagggtttttccctttcaaattctttgtttttctcaacagaggagagagaaaatgaaagaatttaacctggcggcagcgcaaaagatg

SEQ ID NO: 153220 - DNA, 103 bp, Artificial Sequence
  Synthetic Polynucleotide
taatacgactcactatagggtgtgggcgtgtttttccctttcaaattcttaacagaggagaaagaatatgaaagggaaaaacctggcggcagcgcaaaagatg

SEQ ID NO: 153221 - DNA, 103 bp, Artificial Sequence
  Synthetic Polynucleotide
taatacgactcactatagggagccgggcttccgccagcttctgcgcttccaacagaggagaggaagcatggaagctggcaacctggcggcagcgcaaaagatg

SEQ ID NO: 153222 - DNA, 103 bp, Artificial Sequence
  Synthetic Polynucleotide
taatacgactcactatagggtgcagtatactgtgggcgtgtttttcccttaacagaggagaaagggaatgacacgcccaaacctggcggcagcgcaaaagatg

SEQ ID NO: 153223 - DNA, 103 bp, Artificial Sequence
  Synthetic Polynucleotide
taatacgactcactatagggaaactgaaattgcagtatactgtgggcgtgaacagaggagacacgccatgagtatactgaacctggcggcagcgcaaaagatg

SEQ ID NO: 153224 - DNA, 103 bp, Artificial Sequence
  Synthetic Polynucleotide
taatacgactcactatagggtgacttcagcaaactgaaattgcagtatacaacagaggagagtatacatgaatttcagtaacctggcggcagcgcaaaagatg

SEQ ID NO: 153225 - DNA, 103 bp, Artificial Sequence
  Synthetic Polynucleotide
taatacgactcactatagggagggcctccttgacttcagcaaactgaaataacagaggagaatttcaatgtgctgaagtaacctggcggcagcgcaaaagatg

SEQ ID NO: 153226 - DNA, 103 bp, Artificial Sequence
  Synthetic Polynucleotide
taatacgactcactatagggtctttgcttcagggcctccttgacttcagcaacagaggagagctgaaatgaaggaggccaacctggcggcagcgcaaaagatg

SEQ ID NO: 153227 - DNA, 103 bp, Artificial Sequence
  Synthetic Polynucleotide
taatacgactcactataggggcatttcctctctttgcttcagggcctcctaacagaggagaaggaggatgtgaagcaaaaacctggcggcagcgcaaaagatg

SEQ ID NO: 153228 - DNA, 103 bp, Artificial Sequence
  Synthetic Polynucleotide
taatacgactcactatagggtgtttctcgagcatttcctctctttgcttcaacagaggagagaagcaatgagaggaaataacctggcggcagcgcaaaagatg

SEQ ID NO: 153229 - DNA, 103 bp, Artificial Sequence
  Synthetic Polynucleotide
taatacgactcactataggggattattccatgtttctcgagcatttcctcaacagaggagagaggaaatgctcgagaaaaacctggcggcagcgcaaaagatg

SEQ ID NO: 153230 - DNA, 103 bp, Artificial Sequence
  Synthetic Polynucleotide
taatacgactcactatagggctgaatttaggattattccatgtttctcgaaacagaggagatcgagaatgatggaataaaacctggcggcagcgcaaaagatg

SEQ ID NO: 153231 - DNA, 103 bp, Artificial Sequence
  Synthetic Polynucleotide
taatacgactcactataggggtagctatttctgaatttaggattattccaaacagaggagatggaatatgcctaaattcaacctggcggcagcgcaaaagatg

SEQ ID NO: 153232 - DNA, 103 bp, Artificial Sequence
  Synthetic Polynucleotide
taatacgactcactatagggttttgcagcgagccgggcttccgccagcttaacagaggagaaagctgatggaagcccggaacctggcggcagcgcaaaagatg

SEQ ID NO: 153233 - DNA, 103 bp, Artificial Sequence
  Synthetic Polynucleotide
taatacgactcactatagggctctccattggtagctatttctgaatttagaacagaggagactaaatatggaaatagctaacctggcggcagcgcaaaagatg

SEQ ID NO: 153234 - DNA, 103 bp, Artificial Sequence
  Synthetic Polynucleotide
taatacgactcactatagggtgtcggaagtctctccattggtagctatttaacagaggagaaaatagatgccaatggagaacctggcggcagcgcaaaagatg

SEQ ID NO: 153235 - DNA, 103 bp, Artificial Sequence
  Synthetic Polynucleotide
taatacgactcactatagggttattgagggtgtcggaagtctctccattgaacagaggagacaatggatggacttccgaaacctggcggcagcgcaaaagatg

SEQ ID NO: 153236 - DNA, 103 bp, Artificial Sequence
  Synthetic Polynucleotide
taatacgactcactataggggtatccaacattattgagggtgtcggaagtaacagaggagaacttccatgaccctcaataacctggcggcagcgcaaaagatg

SEQ ID NO: 153237 - DNA, 103 bp, Artificial Sequence
  Synthetic Polynucleotide
taatacgactcactatagggtaggaccttggtatccaacattattgagggaacagaggagaccctcaatgatgttggataacctggcggcagcgcaaaagatg

SEQ ID NO: 153238 - DNA, 103 bp, Artificial Sequence
  Synthetic Polynucleotide
taatacgactcactataggggtcatcttggtaggaccttggtatccaacaaacagaggagatgttggatgccaaggtccaacctggcggcagcgcaaaagatg

SEQ ID NO: 153239 - DNA, 103 bp, Artificial Sequence
  Synthetic Polynucleotide
taatacgactcactatagggctcttcttttgtcatcttggtaggaccttgaacagaggagacaaggtatgaccaagatgaacctggcggcagcgcaaaagatg

SEQ ID NO: 153240 - DNA, 103 bp, Artificial Sequence
  Synthetic Polynucleotide
taatacgactcactataggggggcatttaactcttcttttgtcatcttggaacagaggagaccaagaatgcaaaagaagaacctggcggcagcgcaaaagatg

SEQ ID NO: 153241 - DNA, 103 bp, Artificial Sequence
  Synthetic Polynucleotide
taatacgactcactataggggtcgacttgagggcatttaactcttcttttaacagaggagaaaaagaatggttaaatgcaacctggcggcagcgcaaaagatg

SEQ ID NO: 153242 - DNA, 103 bp, Artificial Sequence
  Synthetic Polynucleotide
taatacgactcactatagggcccatcccctgtcgacttgagggcatttaaaacagaggagattaaatatgctcaagtcgaacctggcggcagcgcaaaagatg

SEQ ID NO: 153243 - DNA, 103 bp, Artificial Sequence
  Synthetic Polynucleotide
taatacgactcactataggggggccgcccgttttgcagcgagccgggcttaacagaggagaaagcccatgtcgctgcaaaacctggcggcagcgcaaaagatg

SEQ ID NO: 153244 - DNA, 103 bp, Artificial Sequence
  Synthetic Polynucleotide
taatacgactcactatagggttcctagggtcccatcccctgtcgacttgaaacagaggagatcaagtatgcaggggatgaacctggcggcagcgcaaaagatg

SEQ ID NO: 153245 - DNA, 103 bp, Artificial Sequence
  Synthetic Polynucleotide
taatacgactcactatagggtcactggctcttcctagggtcccatcccctaacagaggagaaggggaatggaccctaggaacctggcggcagcgcaaaagatg

SEQ ID NO: 153246 - DNA, 103 bp, Artificial Sequence
  Synthetic Polynucleotide
taatacgactcactatagggcacctccacttcactggctcttcctagggtaacagaggagaaccctaatgagagccagtaacctggcggcagcgcaaaagatg

SEQ ID NO: 153247 - DNA, 103 bp, Artificial Sequence
  Synthetic Polynucleotide
taatacgactcactatagggtttcatttttcacctccacttcactggctcaacagaggagagagccaatgaagtggaggaacctggcggcagcgcaaaagatg

SEQ ID NO: 153248 - DNA, 103 bp, Artificial Sequence
  Synthetic Polynucleotide
taatacgactcactatagggttcgccacgatttcatttttcacctccactaacagaggagaagtggaatggaaaaatgaaacctggcggcagcgcaaaagatg

SEQ ID NO: 153249 - DNA, 103 bp, Artificial Sequence
  Synthetic Polynucleotide
taatacgactcactatagggtttccccacattcgccacgatttcatttttaacagaggagaaaaaatatgatcgtggcgaacctggcggcagcgcaaaagatg

SEQ ID NO: 153250 - DNA, 103 bp, Artificial Sequence
  Synthetic Polynucleotide
taatacgactcactatagggagatttctcttttccccacattcgccacgaaacagaggagatcgtggatgatgtggggaaacctggcggcagcgcaaaagatg

SEQ ID NO: 153251 - DNA, 103 bp, Artificial Sequence
  Synthetic Polynucleotide
taatacgactcactataggggtattgtgcaagatttctcttttccccacaaacagaggagatgtgggatgaagagaaataacctggcggcagcgcaaaagatg

SEQ ID NO: 153252 - DNA, 103 bp, Artificial Sequence
  Synthetic Polynucleotide
taatacgactcactatagggttctttctcagtattgtgcaagatttctctaacagaggagaagagaaatgttgcacaataacctggcggcagcgcaaaagatg

SEQ ID NO: 153253 - DNA, 103 bp, Artificial Sequence
  Synthetic Polynucleotide
taatacgactcactatagggctgtgtgttgttctttctcagtattgtgcaaacagaggagatgcacaatgctgagaaagaacctggcggcagcgcaaaagatg

SEQ ID NO: 153254 - DNA, 103 bp, Artificial Sequence
  Synthetic Polynucleotide
taatacgactcactataggggcctccgcgcgggccgcccgttttgcagcgaacagaggagacgctgcatgacgggcggcaacctggcggcagcgcaaaagatg

SEQ ID NO: 153255 - DNA, 103 bp, Artificial Sequence
  Synthetic Polynucleotide
taatacgactcactatagggactgtgtcctctgtgtgttgttctttctcaaacagaggagatgagaaatgacaacacacaacctggcggcagcgcaaaagatg

SEQ ID NO: 153256 - DNA, 103 bp, Artificial Sequence
  Synthetic Polynucleotide
taatacgactcactatagggacagtccttcactgtgtcctctgtgtgttgaacagaggagacaacacatggaggacacaaacctggcggcagcgcaaaagatg

SEQ ID NO: 153257 - DNA, 103 bp, Artificial Sequence
  Synthetic Polynucleotide
taatacgactcactatagggctatgtccacacagtccttcactgtgtcctaacagaggagaaggacaatgtgaaggactaacctggcggcagcgcaaaagatg

SEQ ID NO: 153258 - DNA, 103 bp, Artificial Sequence
  Synthetic Polynucleotide
taatacgactcactataggggggaatacctctatgtccacacagtccttcaacagaggagagaaggaatgtgtggacataacctggcggcagcgcaaaagatg

SEQ ID NO: 153259 - DNA, 103 bp, Artificial Sequence
  Synthetic Polynucleotide
taatacgactcactatagggctcaccagcagggaatacctctatgtccacaacagaggagagtggacatggaggtattcaacctggcggcagcgcaaaagatg

SEQ ID NO: 153260 - DNA, 103 bp, Artificial Sequence
  Synthetic Polynucleotide
taatacgactcactatagggcctcggtattctcaccagcagggaatacctaacagaggagaaggtatatgctgctggtgaacctggcggcagcgcaaaagatg

SEQ ID NO: 153261 - DNA, 103 bp, Artificial Sequence
  Synthetic Polynucleotide
taatacgactcactataggggatttctggtcctcggtattctcaccagcaaacagaggagatgctggatggaataccgaaacctggcggcagcgcaaaagatg

SEQ ID NO: 153262 - DNA, 103 bp, Artificial Sequence
  Synthetic Polynucleotide
taatacgactcactataggggtcttcagaggatttctggtcctcggtattaacagaggagaaataccatggaccagaaaaacctggcggcagcgcaaaagatg

SEQ ID NO: 153263 - DNA, 103 bp, Artificial Sequence
  Synthetic Polynucleotide
taatacgactcactatagggatggggcagtgtcttcagaggatttctggtaacagaggagaaccagaatgcctctgaagaacctggcggcagcgcaaaagatg

SEQ ID NO: 153264 - DNA, 103 bp, Artificial Sequence
  Synthetic Polynucleotide
taatacgactcactataggggttcctaggaatggggcagtgtcttcagagaacagaggagactctgaatgcactgccccaacctggcggcagcgcaaaagatg

SEQ ID NO: 153265 - DNA, 103 bp, Artificial Sequence
  Synthetic Polynucleotide
taatacgactcactatagggcacctctgcctgtgcctgaggcgggcacataacagaggagaatgtgcatgcctcaggcaaacctggcggcagcgcaaaagatg

SEQ ID NO: 153266 - DNA, 103 bp, Artificial Sequence
  Synthetic Polynucleotide
taatacgactcactatagggcgggggcccaggcgaggcaggcttagggggaacagaggagaccccctatgcctgcctcgaacctggcggcagcgcaaaagatg

SEQ ID NO: 153267 - DNA, 103 bp, Artificial Sequence
  Synthetic Polynucleotide
taatacgactcactatagggcctccacctgcgggggcccaggcgaggcagaacagaggagactgcctatgctgggccccaacctggcggcagcgcaaaagatg

SEQ ID NO: 153268 - DNA, 103 bp, Artificial Sequence
  Synthetic Polynucleotide
taatacgactcactatagggtggcccacctcctccacctgcgggggcccaaacagaggagatgggccatggcaggtggaaacctggcggcagcgcaaaagatg

SEQ ID NO: 153269 - DNA, 103 bp, Artificial Sequence
  Synthetic Polynucleotide
taatacgactcactataggggcctcctcggtggcccacctcctccacctgaacagaggagacaggtgatggaggtgggcaacctggcggcagcgcaaaagatg

SEQ ID NO: 153270 - DNA, 103 bp, Artificial Sequence
  Synthetic Polynucleotide
taatacgactcactatagggggggcgaggagcctcctcggtggcccacctaacagaggagaaggtggatgaccgaggagaacctggcggcagcgcaaaagatg

SEQ ID NO: 153271 - DNA, 103 bp, Artificial Sequence
  Synthetic Polynucleotide
taatacgactcactatagggggcagcctggggggcgaggagcctcctcggaacagaggagaccgaggatgctcctcgccaacctggcggcagcgcaaaagatg

SEQ ID NO: 153272 - DNA, 103 bp, Artificial Sequence
  Synthetic Polynucleotide
taatacgactcactatagggtacaccaggtggcagcctggggggcgaggaaacagaggagatcctcgatgcccaggctgaacctggcggcagcgcaaaagatg

SEQ ID NO: 153273 - DNA, 103 bp, Artificial Sequence
  Synthetic Polynucleotide
taatacgactcactatagggtgatcactggtacaccaggtggcagcctggaacagaggagaccaggcatgcacctggtgaacctggcggcagcgcaaaagatg

SEQ ID NO: 153274 - DNA, 103 bp, Artificial Sequence
  Synthetic Polynucleotide
taatacgactcactatagggtggcccaggctgatcactggtacaccaggtaacagaggagaacctggatgaccagtgataacctggcggcagcgcaaaagatg

SEQ ID NO: 153275 - DNA, 103 bp, Artificial Sequence
  Synthetic Polynucleotide
taatacgactcactataggggggcctgctgtggcccaggctgatcactggaacagaggagaccagtgatgagcctgggcaacctggcggcagcgcaaaagatg

SEQ ID NO: 153276 - DNA, 103 bp, Artificial Sequence
  Synthetic Polynucleotide
taatacgactcactatagggtggtggggcccacctctgcctgtgcctgagaacagaggagactcaggatgaggcagaggaacctggcggcagcgcaaaagatg

SEQ ID NO: 153277 - DNA, 103 bp, Artificial Sequence
  Synthetic Polynucleotide
taatacgactcactatagggctacccctgggggcctgctgtggcccaggcaacagaggagagcctggatgacagcaggcaacctggcggcagcgcaaaagatg

SEQ ID NO: 153278 - DNA, 103 bp, Artificial Sequence
  Synthetic Polynucleotide
taatacgactcactataggggtgggcatggctacccctgggggcctgctgaacagaggagacagcagatgcccaggggtaacctggcggcagcgcaaaagatg

SEQ ID NO: 153279 - DNA, 103 bp, Artificial Sequence
  Synthetic Polynucleotide
taatacgactcactatagggcagctctgtggtgggcatggctacccctggaacagaggagaccagggatggccatgcccaacctggcggcagcgcaaaagatg

SEQ ID NO: 153280 - DNA, 103 bp, Artificial Sequence
  Synthetic Polynucleotide
taatacgactcactataggggcagagtgcccagctctgtggtgggcatggaacagaggagaccatgcatgccacagagcaacctggcggcagcgcaaaagatg

SEQ ID NO: 153281 - DNA, 103 bp, Artificial Sequence
  Synthetic Polynucleotide
taatacgactcactatagggagcgggggccgcagagtgcccagctctgtgaacagaggagacacagaatggggcactctaacctggcggcagcgcaaaagatg

SEQ ID NO: 153282 - DNA, 103 bp, Artificial Sequence
  Synthetic Polynucleotide
taatacgactcactataggggagttgcagcagcgggggccgcagagtgccaacagaggagaggcactatgcggcccccgaacctggcggcagcgcaaaagatg

SEQ ID NO: 153283 - DNA, 103 bp, Artificial Sequence
  Synthetic Polynucleotide
taatacgactcactatagggccagggtggagagttgcagcagcgggggccaacagaggagaggccccatgtgctgcaacaacctggcggcagcgcaaaagatg

SEQ ID NO: 153284 - DNA, 103 bp, Artificial Sequence
  Synthetic Polynucleotide
taatacgactcactatagggggggcagttcccagggtggagagttgcagcaacagaggagagctgcaatgctccaccctaacctggcggcagcgcaaaagatg

SEQ ID NO: 153285 - DNA, 103 bp, Artificial Sequence
  Synthetic Polynucleotide
taatacgactcactatagggcaaagtgggcggggcagttcccagggtggaaacagaggagatccaccatgggaactgccaacctggcggcagcgcaaaagatg

SEQ ID NO: 153286 - DNA, 103 bp, Artificial Sequence
  Synthetic Polynucleotide
taatacgactcactatagggagtgcagggccaaagtgggcggggcagttcaacagaggagagaactgatgcgcccacttaacctggcggcagcgcaaaagatg

SEQ ID NO: 153287 - DNA, 103 bp, Artificial Sequence
  Synthetic Polynucleotide
taatacgactcactatagggttctcagtcatggtggggcccacctctgccaacagaggagaggcagaatggggccccacaacctggcggcagcgcaaaagatg

SEQ ID NO: 153288 - DNA, 103 bp, Artificial Sequence
  Synthetic Polynucleotide
taatacgactcactatagggtgagggtggtagtgcagggccaaagtgggcaacagaggagagcccacatgggccctgcaaacctggcggcagcgcaaaagatg

SEQ ID NO: 153289 - DNA, 103 bp, Artificial Sequence
  Synthetic Polynucleotide
taatacgactcactataggggaggaaggggtgagggtggtagtgcagggcaacagaggagagccctgatgtaccaccctaacctggcggcagcgcaaaagatg

SEQ ID NO: 153290 - DNA, 103 bp, Artificial Sequence
  Synthetic Polynucleotide
taatacgactcactatagggagacactgttgaggaaggggtgagggtggtaacagaggagaaccaccatgaccccttccaacctggcggcagcgcaaaagatg

SEQ ID NO: 153291 - DNA, 103 bp, Artificial Sequence
  Synthetic Polynucleotide
taatacgactcactatagggggcccaatgtagacactgttgaggaaggggaacagaggagaccccttatgcaacagtgtaacctggcggcagcgcaaaagatg

SEQ ID NO: 153292 - DNA, 103 bp, Artificial Sequence
  Synthetic Polynucleotide
taatacgactcactatagggaggtcctgctggcccaatgtagacactgttaacagaggagaaacagtatgtacattgggaacctggcggcagcgcaaaagatg

SEQ ID NO: 153293 - DNA, 103 bp, Artificial Sequence
  Synthetic Polynucleotide
taatacgactcactatagggagatgctaaaaggtcctgctggcccaatgtaacagaggagaacattgatgcagcaggacaacctggcggcagcgcaaaagatg

SEQ ID NO: 153294 - DNA, 103 bp, Artificial Sequence
  Synthetic Polynucleotide
taatacgactcactatagggctgctagggaagatgctaaaaggtcctgctaacagaggagaagcaggatgttttagcataacctggcggcagcgcaaaagatg

SEQ ID NO: 153295 - DNA, 103 bp, Artificial Sequence
  Synthetic Polynucleotide
taatacgactcactatagggcttcaaccggctgctagggaagatgctaaaaacagaggagatttagcatgttccctagcaacctggcggcagcgcaaaagatg

SEQ ID NO: 153296 - DNA, 103 bp, Artificial Sequence
  Synthetic Polynucleotide
taatacgactcactatagggttggtctccgcttcaaccggctgctagggaaacagaggagatccctaatggccggttgaaacctggcggcagcgcaaaagatg

SEQ ID NO: 153297 - DNA, 103 bp, Artificial Sequence
  Synthetic Polynucleotide
taatacgactcactatagggtcacagtggcttggtctccgcttcaaccggaacagaggagaccggttatggcggagaccaacctggcggcagcgcaaaagatg

SEQ ID NO: 153298 - DNA, 103 bp, Artificial Sequence
  Synthetic Polynucleotide
taatacgactcactatagggcatctctgccttctcagtcatggtggggccaacagaggagaggccccatgatgactgagaacctggcggcagcgcaaaagatg

SEQ ID NO: 153299 - DNA, 103 bp, Artificial Sequence
  Synthetic Polynucleotide
taatacgactcactatagggcaggtccagctcacagtggcttggtctccgaacagaggagacggagaatgagccactgtaacctggcggcagcgcaaaagatg

SEQ ID NO: 153300 - DNA, 103 bp, Artificial Sequence
  Synthetic Polynucleotide
taatacgactcactataggggcccctcagccaggtccagctcacagtggcaacagaggagagccactatgagctggaccaacctggcggcagcgcaaaagatg

SEQ ID NO: 153301 - DNA, 103 bp, Artificial Sequence
  Synthetic Polynucleotide
taatacgactcactatagggtggggctggtgcccctcagccaggtccagcaacagaggagagctggaatgggctgagggaacctggcggcagcgcaaaagatg

SEQ ID NO: 153302 - DNA, 103 bp, Artificial Sequence
  Synthetic Polynucleotide
taatacgactcactatagggggccaccttctggggctggtgcccctcagcaacagaggagagctgagatgcaccagcccaacctggcggcagcgcaaaagatg

SEQ ID NO: 153303 - DNA, 103 bp, Artificial Sequence
  Synthetic Polynucleotide
taatacgactcactatagggacacgcgccgggccaccttctggggctggtaacagaggagaaccagcatgagaaggtggaacctggcggcagcgcaaaagatg

SEQ ID NO: 153304 - DNA, 103 bp, Artificial Sequence
  Synthetic Polynucleotide
taatacgactcactatagggctgttggtgaacacgcgccgggccaccttcaacagaggagagaaggtatgccggcgcgtaacctggcggcagcgcaaaagatg

SEQ ID NO: 153305 - DNA, 103 bp, Artificial Sequence
  Synthetic Polynucleotide
taatacgactcactataggggcgctcccggctgttggtgaacacgcgccgaacagaggagacggcgcatgttcaccaacaacctggcggcagcgcaaaagatg

SEQ ID NO: 153306 - DNA, 103 bp, Artificial Sequence
  Synthetic Polynucleotide
taatacgactcactataggggctgccgccagcgctcccggctgttggtgaaacagaggagatcaccaatggccgggagcaacctggcggcagcgcaaaagatg

SEQ ID NO: 153307 - DNA, 103 bp, Artificial Sequence
  Synthetic Polynucleotide
taatacgactcactatagggttaacgttctgctgccgccagcgctcccggaacagaggagaccgggaatgctggcggcaaacctggcggcagcgcaaaagatg

SEQ ID NO: 153308 - DNA, 103 bp, Artificial Sequence
  Synthetic Polynucleotide
taatacgactcactataggggaaggcgccgttaacgttctgctgccgccaaacagaggagatggcggatgcagaacgttaacctggcggcagcgcaaaagatg

SEQ ID NO: 153309 - DNA, 103 bp, Artificial Sequence
  Synthetic Polynucleotide
taatacgactcactataggggggcacacaccatctctgccttctcagtcaaacagaggagatgactgatgaggcagagaaacctggcggcagcgcaaaagatg

SEQ ID NO: 153310 - DNA, 103 bp, Artificial Sequence
  Synthetic Polynucleotide
taatacgactcactatagggtcagctcggcgaaggcgccgttaacgttctaacagaggagaagaacgatgacggcgcctaacctggcggcagcgcaaaagatg

SEQ ID NO: 153311 - DNA, 103 bp, Artificial Sequence
  Synthetic Polynucleotide
taatacgactcactatagggagcagcttcctcagctcggcgaaggcgccgaacagaggagacggcgcatgcgccgagctaacctggcggcagcgcaaaagatg

SEQ ID NO: 153312 - DNA, 103 bp, Artificial Sequence
  Synthetic Polynucleotide
taatacgactcactataggggtgcgtcggcagcagcttcctcagctcggcaacagaggagagccgagatgaggaagctgaacctggcggcagcgcaaaagatg

SEQ ID NO: 153313 - DNA, 103 bp, Artificial Sequence
  Synthetic Polynucleotide
taatacgactcactatagggggtcgggcgggtgcgtcggcagcagcttccaacagaggagaggaagcatgtgccgacgcaacctggcggcagcgcaaaagatg

SEQ ID NO: 153314 - DNA, 103 bp, Artificial Sequence
  Synthetic Polynucleotide
taatacgactcactatagggctcagcttccggtcgggcgggtgcgtcggcaacagaggagagccgacatgcccgcccgaaacctggcggcagcgcaaaagatg

SEQ ID NO: 153315 - DNA, 103 bp, Artificial Sequence
  Synthetic Polynucleotide
taatacgactcactatagggctcgttcttgctcagcttccggtcgggcggaacagaggagaccgcccatgcggaagctgaacctggcggcagcgcaaaagatg

SEQ ID NO: 153316 - DNA, 103 bp, Artificial Sequence
  Synthetic Polynucleotide
taatacgactcactatagggggcggagcacctcgttcttgctcagcttccaacagaggagaggaagcatggcaagaacgaacctggcggcagcgcaaaagatg

SEQ ID NO: 153317 - DNA, 103 bp, Artificial Sequence
  Synthetic Polynucleotide
taatacgactcactatagggttcatggctaggcggagcacctcgttcttgaacagaggagacaagaaatgggtgctccgaacctggcggcagcgcaaaagatg

SEQ ID NO: 153318 - DNA, 103 bp, Artificial Sequence
  Synthetic Polynucleotide
taatacgactcactataggggccgatgtacttcatggctaggcggagcacaacagaggagagtgctcatgctagccatgaacctggcggcagcgcaaaagatg

SEQ ID NO: 153319 - DNA, 103 bp, Artificial Sequence
  Synthetic Polynucleotide
taatacgactcactataggggcaccaggaagccgatgtacttcatggctaaacagaggagatagccaatgagtacatcgaacctggcggcagcgcaaaagatg

SEQ ID NO: 153320 - DNA, 103 bp, Artificial Sequence
  Synthetic Polynucleotide
taatacgactcactataggggctgggctgggggcacacaccatctctgccaacagaggagaggcagaatgggtgtgtgcaacctggcggcagcgcaaaagatg

SEQ ID NO: 153321 - DNA, 103 bp, Artificial Sequence
  Synthetic Polynucleotide
taatacgactcactatagggcgcagcagccgcaccaggaagccgatgtacaacagaggagagtacatatgcttcctggtaacctggcggcagcgcaaaagatg

SEQ ID NO: 153322 - DNA, 103 bp, Artificial Sequence
  Synthetic Polynucleotide
taatacgactcactatagggggcttggtcgcgcagcagccgcaccaggaaaacagaggagattcctgatgcggctgctgaacctggcggcagcgcaaaagatg

SEQ ID NO: 153323 - DNA, 103 bp, Artificial Sequence
  Synthetic Polynucleotide
taatacgactcactatagggccagagctgcggcttggtcgcgcagcagccaacagaggagaggctgcatggcgaccaagaacctggcggcagcgcaaaagatg

SEQ ID NO: 153324 - DNA, 103 bp, Artificial Sequence
  Synthetic Polynucleotide
taatacgactcactataggggggcctgcggccagagctgcggcttggtcgaacagaggagacgaccaatgcgcagctctaacctggcggcagcgcaaaagatg

SEQ ID NO: 153325 - DNA, 103 bp, Artificial Sequence
  Synthetic Polynucleotide
taatacgactcactataggggggaggggtggggcctgcggccagagctgcaacagaggagagcagctatggccgcaggcaacctggcggcagcgcaaaagatg

SEQ ID NO: 153326 - DNA, 103 bp, Artificial Sequence
  Synthetic Polynucleotide
taatacgactcactatagggtgcgaggcccgggaggggtggggcctgcggaacagaggagaccgcagatgccacccctcaacctggcggcagcgcaaaagatg

SEQ ID NO: 153327 - DNA, 103 bp, Artificial Sequence
  Synthetic Polynucleotide
taatacgactcactatagggaccggccgtttgcgaggcccgggaggggtgaacagaggagacaccccatgcgggcctcgaacctggcggcagcgcaaaagatg

SEQ ID NO: 153328 - DNA, 103 bp, Artificial Sequence
  Synthetic Polynucleotide
taatacgactcactataggggacccggtgcaccggccgtttgcgaggcccaacagaggagagggcctatgaaacggccgaacctggcggcagcgcaaaagatg

SEQ ID NO: 153329 - DNA, 103 bp, Artificial Sequence
  Synthetic Polynucleotide
taatacgactcactatagggcgtcgtctgggacccggtgcaccggccgttaacagaggagaaacggcatgtgcaccgggaacctggcggcagcgcaaaagatg

SEQ ID NO: 153330 - DNA, 103 bp, Artificial Sequence
  Synthetic Polynucleotide
taatacgactcactatagggcggcgggcgccgtcgtctgggacccggtgcaacagaggagagcaccgatgcccagacgaaacctggcggcagcgcaaaagatg

SEQ ID NO: 153331 - DNA, 103 bp, Artificial Sequence
  Synthetic Polynucleotide
taatacgactcactatagggtggggcaggcgctgggctgggggcacacacaacagaggagagtgtgtatgcccagcccaaacctggcggcagcgcaaaagatg

SEQ ID NO: 153332 - DNA, 103 bp, Artificial Sequence
  Synthetic Polynucleotide
taatacgactcactatagggtccggatccccggcgggcgccgtcgtctggaacagaggagaccagacatgggcgcccgcaacctggcggcagcgcaaaagatg

SEQ ID NO: 153333 - DNA, 103 bp, Artificial Sequence
  Synthetic Polynucleotide
taatacgactcactatagggcggccctgcgtccggatccccggcgggcgcaacagaggagagcgcccatgggggatccgaacctggcggcagcgcaaaagatg

SEQ ID NO: 153334 - DNA, 103 bp, Artificial Sequence
  Synthetic Polynucleotide
taatacgactcactataggggctgccgcctcggccctgcgtccggatcccaacagaggagagggatcatgacgcagggcaacctggcggcagcgcaaaagatg

SEQ ID NO: 153335 - DNA, 103 bp, Artificial Sequence
  Synthetic Polynucleotide
taatacgactcactatagggctgcgagcgcgctgccgcctcggccctgcgaacagaggagacgcaggatggaggcggcaaacctggcggcagcgcaaaagatg

SEQ ID NO: 153336 - DNA, 103 bp, Artificial Sequence
  Synthetic Polynucleotide
taatacgactcactatagggggggcgcgggctgcgagcgcgctgccgcctaacagaggagaaggcggatgcgcgctcgcaacctggcggcagcgcaaaagatg

SEQ ID NO: 153337 - DNA, 103 bp, Artificial Sequence
  Synthetic Polynucleotide
taatacgactcactataggggggtcggccgggggcgcgggctgcgagcgcaacagaggagagcgctcatggcccgcgccaacctggcggcagcgcaaaagatg

SEQ ID NO: 153338 - DNA, 103 bp, Artificial Sequence
  Synthetic Polynucleotide
taatacgactcactataggggctgccgtcggggtcggccgggggcgcgggaacagaggagacccgcgatgccggccgacaacctggcggcagcgcaaaagatg

SEQ ID NO: 153339 - DNA, 103 bp, Artificial Sequence
  Synthetic Polynucleotide
taatacgactcactatagggctccaccggggctgccgtcggggtcggccgaacagaggagacggccgatgccgacggcaaacctggcggcagcgcaaaagatg

SEQ ID NO: 153340 - DNA, 103 bp, Artificial Sequence
  Synthetic Polynucleotide
taatacgactcactatagggggccgggccgctccaccggggctgccgtcgaacagaggagacgacggatgccccggtggaacctggcggcagcgcaaaagatg

SEQ ID NO: 153341 - DNA, 103 bp, Artificial Sequence
  Synthetic Polynucleotide
taatacgactcactatagggcatcttgatgggccgggccgctccaccgggaacagaggagacccggtatggcggcccggaacctggcggcagcgcaaaagatg

SEQ ID NO: 153342 - DNA, 103 bp, Artificial Sequence
  Synthetic Polynucleotide
taatacgactcactataggggcttagggggtggggcaggcgctgggctggaacagaggagaccagccatgcgcctgcccaacctggcggcagcgcaaaagatg

SEQ ID NO: 153343 - DNA, 103 bp, Artificial Sequence
  Synthetic Polynucleotide
taatacgactcactatagggcggtttgctccatcttgatgggccgggccgaacagaggagacggcccatgccatcaagaaacctggcggcagcgcaaaagatg

SEQ ID NO: 153344 - DNA, 103 bp, Artificial Sequence
  Synthetic Polynucleotide
taatacgactcactataggggggctcaaagcggtttgctccatcttgatgaacagaggagacatcaaatgggagcaaacaacctggcggcagcgcaaaagatg

SEQ ID NO: 153345 - DNA, 103 bp, Artificial Sequence
  Synthetic Polynucleotide
taatacgactcactatagggccgcacctctgggctcaaagcggtttgctcaacagaggagagagcaaatggctttgagcaacctggcggcagcgcaaaagatg

SEQ ID NO: 153346 - DNA, 103 bp, Artificial Sequence
  Synthetic Polynucleotide
taatacgactcactatagggggcgaggcaggcttagggggtggggcaggcaacagaggagagcctgcatgaccccctaaaacctggcggcagcgcaaaagatg

SEQ ID NO: 153347 - DNA, 103 bp, Artificial Sequence
  Synthetic Polynucleotide
taatacgactcactatagggccgaaaatgttttctttcagtgattagcataacagaggagaatgctaatgactgaaagaaacctggcggcagcgcaaaagatg

SEQ ID NO: 153348 - DNA, 103 bp, Artificial Sequence
  Synthetic Polynucleotide
taatacgactcactataggggcattctgtaatattgcaactttttgagagaacagaggagactctcaatgagttgcaataacctggcggcagcgcaaaagatg

SEQ ID NO: 153349 - DNA, 103 bp, Artificial Sequence
  Synthetic Polynucleotide
taatacgactcactatagggcaagtcgattagcttgacttggatggtgtcaacagaggagagacaccatgcaagtcaagaacctggcggcagcgcaaaagatg

SEQ ID NO: 153350 - DNA, 103 bp, Artificial Sequence
  Synthetic Polynucleotide
taatacgactcactatagggttacctgactcaagtcgattagcttgacttaacagaggagaaagtcaatgtaatcgactaacctggcggcagcgcaaaagatg

SEQ ID NO: 153351 - DNA, 103 bp, Artificial Sequence
  Synthetic Polynucleotide
taatacgactcactatagggactagatacattacctgactcaagtcgattaacagaggagaaatcgaatggagtcaggtaacctggcggcagcgcaaaagatg

SEQ ID NO: 153352 - DNA, 103 bp, Artificial Sequence
  Synthetic Polynucleotide
taatacgactcactatagggtgcagcaaccactagatacattacctgactaacagaggagaagtcagatgatgtatctaaacctggcggcagcgcaaaagatg

SEQ ID NO: 153353 - DNA, 103 bp, Artificial Sequence
  Synthetic Polynucleotide
taatacgactcactatagggctttagcttgtgcagcaaccactagatacaaacagaggagatgtatcatgtggttgctgaacctggcggcagcgcaaaagatg

SEQ ID NO: 153354 - DNA, 103 bp, Artificial Sequence
  Synthetic Polynucleotide
taatacgactcactataggggacggaagagctttagcttgtgcagcaaccaacagaggagaggttgcatgacaagctaaaacctggcggcagcgcaaaagatg

SEQ ID NO: 153355 - DNA, 103 bp, Artificial Sequence
  Synthetic Polynucleotide
taatacgactcactatagggggcagctggtgacggaagagctttagcttgaacagaggagacaagctatggctcttccgaacctggcggcagcgcaaaagatg

SEQ ID NO: 153356 - DNA, 103 bp, Artificial Sequence
  Synthetic Polynucleotide
taatacgactcactatagggcccaaatggtggcagctggtgacggaagagaacagaggagactcttcatgcaccagctgaacctggcggcagcgcaaaagatg

SEQ ID NO: 153357 - DNA, 103 bp, Artificial Sequence
  Synthetic Polynucleotide
taatacgactcactatagggtggatataatcccaaatggtggcagctggtaacagaggagaaccagcatgcaccatttgaacctggcggcagcgcaaaagatg

SEQ ID NO: 153358 - DNA, 103 bp, Artificial Sequence
  Synthetic Polynucleotide
taatacgactcactatagggggtggttttgtggatataatcccaaatggtaacagaggagaaccattatggattatatcaacctggcggcagcgcaaaagatg

SEQ ID NO: 153359 - DNA, 103 bp, Artificial Sequence
  Synthetic Polynucleotide
taatacgactcactatagggctgggtcctggcattctgtaatattgcaacaacagaggagagttgcaatgttacagaataacctggcggcagcgcaaaagatg

SEQ ID NO: 153360 - DNA, 103 bp, Artificial Sequence
  Synthetic Polynucleotide
taatacgactcactatagggttccaattgaggtggttttgtggatataataacagaggagaattataatgacaaaaccaaacctggcggcagcgcaaaagatg

SEQ ID NO: 153361 - DNA, 103 bp, Artificial Sequence
  Synthetic Polynucleotide
taatacgactcactatagggggtccataaattccaattgaggtggttttgaacagaggagacaaaacatgctcaattggaacctggcggcagcgcaaaagatg

SEQ ID NO: 153362 - DNA, 103 bp, Artificial Sequence
  Synthetic Polynucleotide
taatacgactcactataggggatatatttgggtccataaattccaattgaaacagaggagatcaattatgatttatggaaacctggcggcagcgcaaaagatg

SEQ ID NO: 153363 - DNA, 103 bp, Artificial Sequence
  Synthetic Polynucleotide
taatacgactcactatagggaactgggatggatatatttgggtccataaaaacagaggagatttatgatgccaaatataaacctggcggcagcgcaaaagatg

SEQ ID NO: 153364 - DNA, 103 bp, Artificial Sequence
  Synthetic Polynucleotide
taatacgactcactatagggacaacagtaaaactgggatggatatatttgaacagaggagacaaataatgccatcccagaacctggcggcagcgcaaaagatg

SEQ ID NO: 153365 - DNA, 103 bp, Artificial Sequence
  Synthetic Polynucleotide
taatacgactcactatagggaactgttaaaacaacagtaaaactgggatgaacagaggagacatcccatgtttactgttaacctggcggcagcgcaaaagatg

SEQ ID NO: 153366 - DNA, 103 bp, Artificial Sequence
  Synthetic Polynucleotide
taatacgactcactatagggtgtgtccacaaactgttaaaacaacagtaaaacagaggagattactgatgttttaacagaacctggcggcagcgcaaaagatg

SEQ ID NO: 153367 - DNA, 103 bp, Artificial Sequence
  Synthetic Polynucleotide
taatacgactcactatagggggcatataattgtgtccacaaactgttaaaaacagaggagatttaacatgttgtggacaaacctggcggcagcgcaaaagatg

SEQ ID NO: 153368 - DNA, 103 bp, Artificial Sequence
  Synthetic Polynucleotide
taatacgactcactatagggaagctgtcctggcatataattgtgtccacaaacagaggagatgtggaatgaattatatgaacctggcggcagcgcaaaagatg

SEQ ID NO: 153369 - DNA, 103 bp, Artificial Sequence
  Synthetic Polynucleotide
taatacgactcactatagggcagaaattgtaagctgtcctggcatataataacagaggagaattataatgcaggacagcaacctggcggcagcgcaaaagatg

SEQ ID NO: 153370 - DNA, 103 bp, Artificial Sequence
  Synthetic Polynucleotide
taatacgactcactatagggtgaagcaagtctgggtcctggcattctgtaaacagaggagatacagaatgccaggacccaacctggcggcagcgcaaaagatg

SEQ ID NO: 153371 - DNA, 103 bp, Artificial Sequence
  Synthetic Polynucleotide
taatacgactcactatagggttcttaatatcagaaattgtaagctgtcctaacagaggagaaggacaatgtacaatttcaacctggcggcagcgcaaaagatg

SEQ ID NO: 153372 - DNA, 103 bp, Artificial Sequence
  Synthetic Polynucleotide
taatacgactcactatagggttttccacccttcttaatatcagaaattgtaacagaggagaacaattatggatattaagaacctggcggcagcgcaaaagatg

SEQ ID NO: 153373 - DNA, 103 bp, Artificial Sequence
  Synthetic Polynucleotide
taatacgactcactataggggagatatgttttttccacccttcttaatataacagaggagaatattaatgagggtggaaaacctggcggcagcgcaaaagatg

SEQ ID NO: 153374 - DNA, 103 bp, Artificial Sequence
  Synthetic Polynucleotide
taatacgactcactatagggaacacaactggagatatgttttttccacccaacagaggagagggtggatgaaacatatcaacctggcggcagcgcaaaagatg

SEQ ID NO: 153375 - DNA, 103 bp, Artificial Sequence
  Synthetic Polynucleotide
taatacgactcactatagggccagagctgaaacacaactggagatatgttaacagaggagaaacataatgccagttgtgaacctggcggcagcgcaaaagatg

SEQ ID NO: 153376 - DNA, 103 bp, Artificial Sequence
  Synthetic Polynucleotide
taatacgactcactatagggactgcttcccccagagctgaaacacaactgaacagaggagacagttgatgttcagctctaacctggcggcagcgcaaaagatg

SEQ ID NO: 153377 - DNA, 103 bp, Artificial Sequence
  Synthetic Polynucleotide
taatacgactcactatagggagtaaaaatgactgcttcccccagagctgaaacagaggagatcagctatgggggaagcaaacctggcggcagcgcaaaagatg

SEQ ID NO: 153378 - DNA, 103 bp, Artificial Sequence
  Synthetic Polynucleotide
taatacgactcactatagggtggcttgtcaagtaaaaatgactgcttcccaacagaggagagggaagatgtcatttttaaacctggcggcagcgcaaaagatg

SEQ ID NO: 153379 - DNA, 103 bp, Artificial Sequence
  Synthetic Polynucleotide
taatacgactcactatagggttaaatcttgtggcttgtcaagtaaaaatgaacagaggagacattttatgttgacaagcaacctggcggcagcgcaaaagatg

SEQ ID NO: 153380 - DNA, 103 bp, Artificial Sequence
  Synthetic Polynucleotide
taatacgactcactatagggatagaaatacttaaatcttgtggcttgtcaaacagaggagatgacaaatgacaagatttaacctggcggcagcgcaaaagatg

SEQ ID NO: 153381 - DNA, 103 bp, Artificial Sequence
  Synthetic Polynucleotide
taatacgactcactatagggcggccaattgtgaagcaagtctgggtcctgaacagaggagacaggacatggacttgcttaacctggcggcagcgcaaaagatg

SEQ ID NO: 153382 - DNA, 103 bp, Artificial Sequence
  Synthetic Polynucleotide
taatacgactcactatagggacaggaaaaaatagaaatacttaaatcttgaacagaggagacaagatatgagtatttctaacctggcggcagcgcaaaagatg

SEQ ID NO: 153383 - DNA, 103 bp, Artificial Sequence
  Synthetic Polynucleotide
taatacgactcactatagggaatcaggatcacaggaaaaaatagaaatacaacagaggagagtatttatgttttttcctaacctggcggcagcgcaaaagatg

SEQ ID NO: 153384 - DNA, 103 bp, Artificial Sequence
  Synthetic Polynucleotide
taatacgactcactatagggtttacttcaaaatcaggatcacaggaaaaaaacagaggagatttttcatgtgatcctgaaacctggcggcagcgcaaaagatg

SEQ ID NO: 153385 - DNA, 103 bp, Artificial Sequence
  Synthetic Polynucleotide
taatacgactcactatagggtccttctgtctttacttcaaaatcaggatcaacagaggagagatcctatgtttgaagtaaacctggcggcagcgcaaaagatg

SEQ ID NO: 153386 - DNA, 103 bp, Artificial Sequence
  Synthetic Polynucleotide
taatacgactcactatagggctttcctttctccttctgtctttacttcaaaacagaggagattgaagatgagacagaagaacctggcggcagcgcaaaagatg

SEQ ID NO: 153387 - DNA, 103 bp, Artificial Sequence
  Synthetic Polynucleotide
taatacgactcactatagggtgtttaatttctttcctttctccttctgtcaacagaggagagacagaatgagaaaggaaaacctggcggcagcgcaaaagatg

SEQ ID NO: 153388 - DNA, 103 bp, Artificial Sequence
  Synthetic Polynucleotide
taatacgactcactatagggcaactgcttttgtttaatttctttcctttcaacagaggagagaaaggatggaaattaaaaacctggcggcagcgcaaaagatg

SEQ ID NO: 153389 - DNA, 103 bp, Artificial Sequence
  Synthetic Polynucleotide
taatacgactcactatagggcacctgcttccaactgcttttgtttaatttaacagaggagaaaattaatgaaaagcagtaacctggcggcagcgcaaaagatg

SEQ ID NO: 153390 - DNA, 103 bp, Artificial Sequence
  Synthetic Polynucleotide
taatacgactcactatagggtgaactacttcacctgcttccaactgctttaacagaggagaaaagcaatgggaagcaggaacctggcggcagcgcaaaagatg

SEQ ID NO: 153391 - DNA, 103 bp, Artificial Sequence
  Synthetic Polynucleotide
taatacgactcactatagggaaattgttgatgaactacttcacctgcttcaacagaggagagaagcaatggaagtagttaacctggcggcagcgcaaaagatg

SEQ ID NO: 153392 - DNA, 103 bp, Artificial Sequence
  Synthetic Polynucleotide
taatacgactcactatagggtgaaagcatccggccaattgtgaagcaagtaacagaggagaacttgcatgacaattggcaacctggcggcagcgcaaaagatg

SEQ ID NO: 153393 - DNA, 103 bp, Artificial Sequence
  Synthetic Polynucleotide
taatacgactcactatagggaagaaaataaaaattgttgatgaactacttaacagaggagaaagtagatgatcaacaataacctggcggcagcgcaaaagatg

SEQ ID NO: 153394 - DNA, 103 bp, Artificial Sequence
  Synthetic Polynucleotide
taatacgactcactatagggtgctcaactaaagaaaataaaaattgttgaaacagaggagatcaacaatgtttattttcaacctggcggcagcgcaaaagatg

SEQ ID NO: 153395 - DNA, 103 bp, Artificial Sequence
  Synthetic Polynucleotide
taatacgactcactatagggcatctctctgtgctcaactaaagaaaataaaacagaggagattatttatgttagttgagaacctggcggcagcgcaaaagatg

SEQ ID NO: 153396 - DNA, 103 bp, Artificial Sequence
  Synthetic Polynucleotide
taatacgactcactatagggcaaacaagtgcatctctctgtgctcaactaaacagaggagatagttgatgacagagagaaacctggcggcagcgcaaaagatg

SEQ ID NO: 153397 - DNA, 103 bp, Artificial Sequence
  Synthetic Polynucleotide
taatacgactcactatagggacacaaaaatcaaacaagtgcatctctctgaacagaggagacagagaatggcacttgttaacctggcggcagcgcaaaagatg

SEQ ID NO: 153398 - DNA, 103 bp, Artificial Sequence
  Synthetic Polynucleotide
taatacgactcactatagggctccacttgaacacaaaaatcaaacaagtgaacagaggagacacttgatggatttttgtaacctggcggcagcgcaaaagatg

SEQ ID NO: 153399 - DNA, 103 bp, Artificial Sequence
  Synthetic Polynucleotide
taatacgactcactatagggcattgggaggctccacttgaacacaaaaataacagaggagaatttttatgttcaagtggaacctggcggcagcgcaaaagatg

SEQ ID NO: 153400 - DNA, 103 bp, Artificial Sequence
  Synthetic Polynucleotide
taatacgactcactatagggactggttcaccattgggaggctccacttgaaacagaggagatcaagtatggcctcccaaaacctggcggcagcgcaaaagatg

SEQ ID NO: 153401 - DNA, 103 bp, Artificial Sequence
  Synthetic Polynucleotide
taatacgactcactataggggaactgtgcaactggttcaccattgggaggaacagaggagacctcccatgggtgaaccaaacctggcggcagcgcaaaagatg

SEQ ID NO: 153402 - DNA, 103 bp, Artificial Sequence
  Synthetic Polynucleotide
taatacgactcactatagggtagtgatagagaactgtgcaactggttcacaacagaggagagtgaacatgttgcacagtaacctggcggcagcgcaaaagatg

SEQ ID NO: 153403 - DNA, 103 bp, Artificial Sequence
  Synthetic Polynucleotide
taatacgactcactatagggccacgaagggtgaaagcatccggccaattgaacagaggagacaattgatgggatgctttaacctggcggcagcgcaaaagatg

SEQ ID NO: 153404 - DNA, 103 bp, Artificial Sequence
  Synthetic Polynucleotide
taatacgactcactatagggggatcaggagtagtgatagagaactgtgcaaacagaggagatgcacaatgctctatcacaacctggcggcagcgcaaaagatg

SEQ ID NO: 153405 - DNA, 103 bp, Artificial Sequence
  Synthetic Polynucleotide
taatacgactcactataggggtttggggttggatcaggagtagtgatagaaacagaggagatctatcatgactcctgataacctggcggcagcgcaaaagatg

SEQ ID NO: 153406 - DNA, 103 bp, Artificial Sequence
  Synthetic Polynucleotide
taatacgactcactataggggtctttttaggtttggggttggatcaggagaacagaggagactcctgatgcaaccccaaaacctggcggcagcgcaaaagatg

SEQ ID NO: 153407 - DNA, 103 bp, Artificial Sequence
  Synthetic Polynucleotide
taatacgactcactatagggagattcgagagtctttttaggtttggggttaacagaggagaaaccccatgcctaaaaagaacctggcggcagcgcaaaagatg

SEQ ID NO: 153408 - DNA, 103 bp, Artificial Sequence
  Synthetic Polynucleotide
taatacgactcactatagggatagcctggcagattcgagagtctttttagaacagaggagactaaaaatgctctcgaataacctggcggcagcgcaaaagatg

SEQ ID NO: 153409 - DNA, 103 bp, Artificial Sequence
  Synthetic Polynucleotide
taatacgactcactatagggtcttctgcaaatagcctggcagattcgagaaacagaggagatctcgaatgtgccaggctaacctggcggcagcgcaaaagatg

SEQ ID NO: 153410 - DNA, 103 bp, Artificial Sequence
  Synthetic Polynucleotide
taatacgactcactatagggatttcctccttcttctgcaaatagcctggcaacagaggagagccaggatgtttgcagaaaacctggcggcagcgcaaaagatg

SEQ ID NO: 153411 - DNA, 103 bp, Artificial Sequence
  Synthetic Polynucleotide
taatacgactcactatagggagcagacttgatttcctccttcttctgcaaaacagaggagattgcagatgaaggaggaaaacctggcggcagcgcaaaagatg

SEQ ID NO: 153412 - DNA, 103 bp, Artificial Sequence
  Synthetic Polynucleotide
taatacgactcactataggggtgataaaggagcagacttgatttcctcctaacagaggagaaggaggatgtcaagtctgaacctggcggcagcgcaaaagatg

SEQ ID NO: 153413 - DNA, 103 bp, Artificial Sequence
  Synthetic Polynucleotide
taatacgactcactatagggagaatttttggtgataaaggagcagacttgaacagaggagacaagtcatgtcctttatcaacctggcggcagcgcaaaagatg

SEQ ID NO: 153414 - DNA, 103 bp, Artificial Sequence
  Synthetic Polynucleotide
taatacgactcactatagggagcattattaccacgaagggtgaaagcatcaacagaggagagatgctatgacccttcgtaacctggcggcagcgcaaaagatg

SEQ ID NO: 153415 - DNA, 103 bp, Artificial Sequence
  Synthetic Polynucleotide
taatacgactcactatagggatatttaacaagaatttttggtgataaaggaacagaggagacctttaatgccaaaaattaacctggcggcagcgcaaaagatg

SEQ ID NO: 153416 - DNA, 103 bp, Artificial Sequence
  Synthetic Polynucleotide
taatacgactcactataggggaaatgtaggatatttaacaagaatttttgaacagaggagacaaaaaatgttgttaaataacctggcggcagcgcaaaagatg

SEQ ID NO: 153417 - DNA, 103 bp, Artificial Sequence
  Synthetic Polynucleotide
taatacgactcactataggggttttatcttgaaatgtaggatatttaacaaacagaggagatgttaaatgtcctacattaacctggcggcagcgcaaaagatg

SEQ ID NO: 153418 - DNA, 103 bp, Artificial Sequence
  Synthetic Polynucleotide
taatacgactcactatagggaaagttcaatgttttatcttgaaatgtaggaacagaggagacctacaatgcaagataaaaacctggcggcagcgcaaaagatg

SEQ ID NO: 153419 - DNA, 103 bp, Artificial Sequence
  Synthetic Polynucleotide
taatacgactcactatagggcatagttgctaaagttcaatgttttatcttaacagaggagaaagataatgcattgaactaacctggcggcagcgcaaaagatg

SEQ ID NO: 153420 - DNA, 103 bp, Artificial Sequence
  Synthetic Polynucleotide
taatacgactcactatagggagggttaccccatagttgctaaagttcaataacagaggagaattgaaatgtagcaactaaacctggcggcagcgcaaaagatg

SEQ ID NO: 153421 - DNA, 103 bp, Artificial Sequence
  Synthetic Polynucleotide
taatacgactcactatagggcactgccttcagggttaccccatagttgctaacagaggagaagcaacatgggggtaaccaacctggcggcagcgcaaaagatg

SEQ ID NO: 153422 - DNA, 103 bp, Artificial Sequence
  Synthetic Polynucleotide
taatacgactcactatagggtttgtcttagcactgccttcagggttacccaacagaggagagggtaaatgtgaaggcagaacctggcggcagcgcaaaagatg

SEQ ID NO: 153423 - DNA, 103 bp, Artificial Sequence
  Synthetic Polynucleotide
taatacgactcactatagggtcaatcttgctttgtcttagcactgccttcaacagaggagagaaggcatggctaagacaaacctggcggcagcgcaaaagatg

SEQ ID NO: 153424 - DNA, 103 bp, Artificial Sequence
  Synthetic Polynucleotide
taatacgactcactatagggaaggaagtaatcaatcttgctttgtcttagaacagaggagactaagaatgagcaagattaacctggcggcagcgcaaaagatg

SEQ ID NO: 153425 - DNA, 103 bp, Artificial Sequence
  Synthetic Polynucleotide
taatacgactcactatagggcaactttggaagcattattaccacgaagggaacagaggagacccttcatggtaataatgaacctggcggcagcgcaaaagatg

SEQ ID NO: 153426 - DNA, 103 bp, Artificial Sequence
  Synthetic Polynucleotide
taatacgactcactatagggtgaaatattcaaggaagtaatcaatcttgcaacagaggagagcaagaatgattacttccaacctggcggcagcgcaaaagatg

SEQ ID NO: 153427 - DNA, 103 bp, Artificial Sequence
  Synthetic Polynucleotide
taatacgactcactataggggtgtcccctttgaaatattcaaggaagtaaaacagaggagattacttatgtgaatatttaacctggcggcagcgcaaaagatg

SEQ ID NO: 153428 - DNA, 103 bp, Artificial Sequence
  Synthetic Polynucleotide
taatacgactcactataggggagagctattgtgtcccctttgaaatattcaacagaggagagaatatatgaaaggggacaacctggcggcagcgcaaaagatg

SEQ ID NO: 153429 - DNA, 103 bp, Artificial Sequence
  Synthetic Polynucleotide
taatacgactcactatagggcttccccgaggagagctattgtgtccccttaacagaggagaaaggggatgcaatagctcaacctggcggcagcgcaaaagatg

SEQ ID NO: 153430 - DNA, 103 bp, Artificial Sequence
  Synthetic Polynucleotide
taatacgactcactatagggtttaccttaccttccccgaggagagctattaacagaggagaaatagcatgcctcggggaaacctggcggcagcgcaaaagatg

SEQ ID NO: 153431 - DNA, 103 bp, Artificial Sequence
  Synthetic Polynucleotide
taatacgactcactatagggaccaatagcttttaccttaccttccccgagaacagaggagactcgggatgggtaaggtaaacctggcggcagcgcaaaagatg

SEQ ID NO: 153432 - DNA, 103 bp, Artificial Sequence
  Synthetic Polynucleotide
taatacgactcactatagggctttggactgaccaatagcttttaccttacaacagaggagagtaaggatgaagctattgaacctggcggcagcgcaaaagatg

SEQ ID NO: 153433 - DNA, 103 bp, Artificial Sequence
  Synthetic Polynucleotide
taatacgactcactatagggcattctttcactttggactgaccaatagctaacagaggagaagctatatgtcagtccaaaacctggcggcagcgcaaaagatg

SEQ ID NO: 153434 - DNA, 103 bp, Artificial Sequence
  Synthetic Polynucleotide
taatacgactcactatagggtcctacataccattctttcactttggactgaacagaggagacagtccatggtgaaagaaaacctggcggcagcgcaaaagatg

SEQ ID NO: 153435 - DNA, 103 bp, Artificial Sequence
  Synthetic Polynucleotide
taatacgactcactatagggctctgaggactcctacataccattctttcaaacagaggagatgaaagatgggtatgtagaacctggcggcagcgcaaaagatg

SEQ ID NO: 153436 - DNA, 103 bp, Artificial Sequence
  Synthetic Polynucleotide
taatacgactcactatagggaatggatttgcaactttggaagcattattaaacagaggagataataaatgttccaaagtaacctggcggcagcgcaaaagatg

SEQ ID NO: 153437 - DNA, 103 bp, Artificial Sequence
  Synthetic Polynucleotide
taatacgactcactatagggccaatcttacctctgaggactcctacatacaacagaggagagtatgtatgagtcctcagaacctggcggcagcgcaaaagatg

SEQ ID NO: 153438 - DNA, 103 bp, Artificial Sequence
  Synthetic Polynucleotide
taatacgactcactataggggtgtacaagtccaatcttacctctgaggacaacagaggagagtcctcatgggtaagattaacctggcggcagcgcaaaagatg

SEQ ID NO: 153439 - DNA, 103 bp, Artificial Sequence
  Synthetic Polynucleotide
taatacgactcactatagggcatttttgcagtgtacaagtccaatcttacaacagaggagagtaagaatggacttgtacaacctggcggcagcgcaaaagatg

SEQ ID NO: 153440 - DNA, 103 bp, Artificial Sequence
  Synthetic Polynucleotide
taatacgactcactatagggatcaccttgacatttttgcagtgtacaagtaacagaggagaacttgtatgctgcaaaaaaacctggcggcagcgcaaaagatg

SEQ ID NO: 153441 - DNA, 103 bp, Artificial Sequence
  Synthetic Polynucleotide
taatacgactcactatagggctcctttgaaatcaccttgacatttttgcaaacagaggagatgcaaaatggtcaaggtgaacctggcggcagcgcaaaagatg

SEQ ID NO: 153442 - DNA, 103 bp, Artificial Sequence
  Synthetic Polynucleotide
taatacgactcactatagggacattacttgctcctttgaaatcaccttgaaacagaggagatcaaggatgtttcaaaggaacctggcggcagcgcaaaagatg

SEQ ID NO: 153443 - DNA, 103 bp, Artificial Sequence
  Synthetic Polynucleotide
taatacgactcactatagggtctgacataaacattacttgctcctttgaaaacagaggagattcaaaatggcaagtaataacctggcggcagcgcaaaagatg

SEQ ID NO: 153444 - DNA, 103 bp, Artificial Sequence
  Synthetic Polynucleotide
taatacgactcactatagggaaagacactatctgacataaacattacttgaacagaggagacaagtaatgtttatgtcaaacctggcggcagcgcaaaagatg

SEQ ID NO: 153445 - DNA, 103 bp, Artificial Sequence
  Synthetic Polynucleotide
taatacgactcactatagggttctggttgtaaagacactatctgacataaaacagaggagattatgtatgatagtgtctaacctggcggcagcgcaaaagatg

SEQ ID NO: 153446 - DNA, 103 bp, Artificial Sequence
  Synthetic Polynucleotide
taatacgactcactatagggtcaagaagatttctggttgtaaagacactaaacagaggagatagtgtatgtacaaccagaacctggcggcagcgcaaaagatg

SEQ ID NO: 153447 - DNA, 103 bp, Artificial Sequence
  Synthetic Polynucleotide
taatacgactcactatagggttgattccagaatggatttgcaactttggaaacagaggagatccaaaatggcaaatccaaacctggcggcagcgcaaaagatg

SEQ ID NO: 153448 - DNA, 103 bp, Artificial Sequence
  Synthetic Polynucleotide
taatacgactcactataggggacaatctgttcaagaagatttctggttgtaacagaggagaacaaccatgaatcttcttaacctggcggcagcgcaaaagatg

SEQ ID NO: 153449 - DNA, 103 bp, Artificial Sequence
  Synthetic Polynucleotide
taatacgactcactatagggttaaaggcaggacaatctgttcaagaagataacagaggagaatcttcatgaacagattgaacctggcggcagcgcaaaagatg

SEQ ID NO: 153450 - DNA, 103 bp, Artificial Sequence
  Synthetic Polynucleotide
taatacgactcactataggggtcaatttttttaaaggcaggacaatctgtaacagaggagaacagatatgcctgcctttaacctggcggcagcgcaaaagatg

SEQ ID NO: 153451 - DNA, 103 bp, Artificial Sequence
  Synthetic Polynucleotide
taatacgactcactataggggtagatataagtcaatttttttaaaggcagaacagaggagactgcctatgaaaaaattgaacctggcggcagcgcaaaagatg

SEQ ID NO: 153452 - DNA, 103 bp, Artificial Sequence
  Synthetic Polynucleotide
taatacgactcactatagggatacaactgagtagatataagtcaatttttaacagaggagaaaaaatatgcttatatctaacctggcggcagcgcaaaagatg

SEQ ID NO: 153453 - DNA, 103 bp, Artificial Sequence
  Synthetic Polynucleotide
taatacgactcactatagggaccaaggttaatacaactgagtagatataaaacagaggagattatatatgctcagttgtaacctggcggcagcgcaaaagatg

SEQ ID NO: 153454 - DNA, 103 bp, Artificial Sequence
  Synthetic Polynucleotide
taatacgactcactatagggtttttctgacaccaaggttaatacaactgaaacagaggagatcagttatgttaaccttgaacctggcggcagcgcaaaagatg

SEQ ID NO: 153455 - DNA, 103 bp, Artificial Sequence
  Synthetic Polynucleotide
taatacgactcactatagggaatcataaactttttctgacaccaaggttaaacagaggagataacctatgtgtcagaaaaacctggcggcagcgcaaaagatg

SEQ ID NO: 153456 - DNA, 103 bp, Artificial Sequence
  Synthetic Polynucleotide
taatacgactcactatagggaaaactttccaatcataaactttttctgacaacagaggagagtcagaatgagtttatgaaacctggcggcagcgcaaaagatg

SEQ ID NO: 153457 - DNA, 103 bp, Artificial Sequence
  Synthetic Polynucleotide
taatacgactcactataggggacatcagctaaaactttccaatcataaacaacagaggagagtttatatgtggaaagttaacctggcggcagcgcaaaagatg

SEQ ID NO: 153458 - DNA, 103 bp, Artificial Sequence
  Synthetic Polynucleotide
taatacgactcactatagggttcttcctgaccgaaaatgttttctttcagaacagaggagactgaaaatgaacattttcaacctggcggcagcgcaaaagatg

SEQ ID NO: 153459 - DNA, 103 bp, Artificial Sequence
  Synthetic Polynucleotide
taatacgactcactatagggaagcagacagttgattccagaatggatttgaacagaggagacaaatcatgtctggaatcaacctggcggcagcgcaaaagatg

SEQ ID NO: 153460 - DNA, 103 bp, Artificial Sequence
  Synthetic Polynucleotide
taatacgactcactatagggagtaacccaggacatcagctaaaactttccaacagaggagaggaaagatgtagctgatgaacctggcggcagcgcaaaagatg

SEQ ID NO: 153461 - DNA, 103 bp, Artificial Sequence
  Synthetic Polynucleotide
taatacgactcactataggggacagatgtgagtaacccaggacatcagctaacagaggagaagctgaatgcctgggttaaacctggcggcagcgcaaaagatg

SEQ ID NO: 153462 - DNA, 103 bp, Artificial Sequence
  Synthetic Polynucleotide
taatacgactcactatagggatcttccagggacagatgtgagtaacccagaacagaggagactgggtatgtcacatctgaacctggcggcagcgcaaaagatg

SEQ ID NO: 153463 - DNA, 103 bp, Artificial Sequence
  Synthetic Polynucleotide
taatacgactcactatagggtttgatcaaaatcttccagggacagatgtgaacagaggagacacatcatgccctggaagaacctggcggcagcgcaaaagatg

SEQ ID NO: 153464 - DNA, 103 bp, Artificial Sequence
  Synthetic Polynucleotide
taatacgactcactatagggtctgcttgaatttgatcaaaatcttccaggaacagaggagacctggaatgttttgatcaaacctggcggcagcgcaaaagatg

SEQ ID NO: 153465 - DNA, 103 bp, Artificial Sequence
  Synthetic Polynucleotide
taatacgactcactatagggtgattctttgtctgcttgaatttgatcaaaaacagaggagatttgatatgattcaagcaaacctggcggcagcgcaaaagatg

SEQ ID NO: 153466 - DNA, 103 bp, Artificial Sequence
  Synthetic Polynucleotide
taatacgactcactatagggaaactttctctgattctttgtctgcttgaaaacagaggagattcaagatgacaaagaataacctggcggcagcgcaaaagatg

SEQ ID NO: 153467 - DNA, 103 bp, Artificial Sequence
  Synthetic Polynucleotide
taatacgactcactatagggataacataagaaactttctctgattctttgaacagaggagacaaagaatgagagaaagtaacctggcggcagcgcaaaagatg

SEQ ID NO: 153468 - DNA, 103 bp, Artificial Sequence
  Synthetic Polynucleotide
taatacgactcactatagggtaacttctttataacataagaaactttctcaacagaggagagagaaaatgtcttatgttaacctggcggcagcgcaaaagatg

SEQ ID NO: 153469 - DNA, 103 bp, Artificial Sequence
  Synthetic Polynucleotide
taatacgactcactatagggaatcttcctttaacttctttataacataagaacagaggagacttatgatgtaaagaagtaacctggcggcagcgcaaaagatg

SEQ ID NO: 153470 - DNA, 103 bp, Artificial Sequence
  Synthetic Polynucleotide
taatacgactcactatagggaatgggttagaagcagacagttgattccagaacagaggagactggaaatgactgtctgcaacctggcggcagcgcaaaagatg

SEQ ID NO: 153471 - DNA, 103 bp, Artificial Sequence
  Synthetic Polynucleotide
taatacgactcactatagggtctgtgtggcaatcttcctttaacttctttaacagaggagaaaagaaatgaaaggaagaaacctggcggcagcgcaaaagatg

SEQ ID NO: 153472 - DNA, 103 bp, Artificial Sequence
  Synthetic Polynucleotide
taatacgactcactatagggtgtatttctctctgtgtggcaatcttccttaacagaggagaaaggaaatgtgccacacaaacctggcggcagcgcaaaagatg

SEQ ID NO: 153473 - DNA, 103 bp, Artificial Sequence
  Synthetic Polynucleotide
taatacgactcactataggggaaacttccttgtatttctctctgtgtggcaacagaggagagccacaatgagagaaataaacctggcggcagcgcaaaagatg

SEQ ID NO: 153474 - DNA, 103 bp, Artificial Sequence
  Synthetic Polynucleotide
taatacgactcactatagggagttcatacagaaacttccttgtatttctcaacagaggagagagaaaatgaaggaagttaacctggcggcagcgcaaaagatg

SEQ ID NO: 153475 - DNA, 103 bp, Artificial Sequence
  Synthetic Polynucleotide
taatacgactcactatagggagccacaataagttcatacagaaacttcctaacagaggagaaggaagatgctgtatgaaaacctggcggcagcgcaaaagatg

SEQ ID NO: 153476 - DNA, 103 bp, Artificial Sequence
  Synthetic Polynucleotide
taatacgactcactatagggttttcagaagagccacaataagttcatacaaacagaggagatgtatgatgttattgtggaacctggcggcagcgcaaaagatg

SEQ ID NO: 153477 - DNA, 103 bp, Artificial Sequence
  Synthetic Polynucleotide
taatacgactcactatagggtggcaatccattttcagaagagccacaataaacagaggagatattgtatgtcttctgaaaacctggcggcagcgcaaaagatg

SEQ ID NO: 153478 - DNA, 103 bp, Artificial Sequence
  Synthetic Polynucleotide
taatacgactcactataggggactaactcttggcaatccattttcagaagaacagaggagacttctgatgatggattgcaacctggcggcagcgcaaaagatg

SEQ ID NO: 153479 - DNA, 103 bp, Artificial Sequence
  Synthetic Polynucleotide
taatacgactcactatagggtgagacgtgcgactaactcttggcaatccaaacagaggagatggattatgaagagttagaacctggcggcagcgcaaaagatg

SEQ ID NO: 153480 - DNA, 103 bp, Artificial Sequence
  Synthetic Polynucleotide
taatacgactcactataggggcttcttggatgagacgtgcgactaactctaacagaggagaagagttatgcgcacgtctaacctggcggcagcgcaaaagatg

SEQ ID NO: 153481 - DNA, 103 bp, Artificial Sequence
  Synthetic Polynucleotide
taatacgactcactataggggtcatccaaaaatgggttagaagcagacagaacagaggagactgtctatgtctaacccaaacctggcggcagcgcaaaagatg

SEQ ID NO: 153482 - DNA, 103 bp, Artificial Sequence
  Synthetic Polynucleotide
taatacgactcactatagggcagaacagcagcttcttggatgagacgtgcaacagaggagagcacgtatgatccaagaaaacctggcggcagcgcaaaagatg

SEQ ID NO: 153483 - DNA, 103 bp, Artificial Sequence
  Synthetic Polynucleotide
taatacgactcactatagggcagctgaagtcagaacagcagcttcttggaaacagaggagatccaagatgctgctgttcaacctggcggcagcgcaaaagatg

SEQ ID NO: 153484 - DNA, 103 bp, Artificial Sequence
  Synthetic Polynucleotide
taatacgactcactatagggccaagcttgacagctgaagtcagaacagcaaacagaggagatgctgtatggacttcagcaacctggcggcagcgcaaaagatg

SEQ ID NO: 153485 - DNA, 103 bp, Artificial Sequence
  Synthetic Polynucleotide
taatacgactcactatagggccagccttttccaagcttgacagctgaagtaacagaggagaacttcaatggtcaagcttaacctggcggcagcgcaaaagatg

SEQ ID NO: 153486 - DNA, 103 bp, Artificial Sequence
  Synthetic Polynucleotide
taatacgactcactatagggctagttccctccagccttttccaagcttgaaacagaggagatcaagcatggaaaaggctaacctggcggcagcgcaaaagatg

SEQ ID NO: 153487 - DNA, 103 bp, Artificial Sequence
  Synthetic Polynucleotide
taatacgactcactatagggaacttttcagctagttccctccagccttttaacagaggagaaaaaggatggagggaactaacctggcggcagcgcaaaagatg

SEQ ID NO: 153488 - DNA, 103 bp, Artificial Sequence
  Synthetic Polynucleotide
taatacgactcactataggggagtcgtactaacttttcagctagttccctaacagaggagaagggaaatggctgaaaagaacctggcggcagcgcaaaagatg

SEQ ID NO: 153489 - DNA, 103 bp, Artificial Sequence
  Synthetic Polynucleotide
taatacgactcactataggggttgctttgtgagtcgtactaacttttcagaacagaggagactgaaaatgtagtacgacaacctggcggcagcgcaaaagatg

SEQ ID NO: 153490 - DNA, 103 bp, Artificial Sequence
  Synthetic Polynucleotide
taatacgactcactataggggcctccatttgttgctttgtgagtcgtactaacagaggagaagtacgatgcacaaagcaaacctggcggcagcgcaaaagatg

SEQ ID NO: 153491 - DNA, 103 bp, Artificial Sequence
  Synthetic Polynucleotide
taatacgactcactatagggaatttcatatgcctccatttgttgctttgtaacagaggagaacaaagatgcaaatggagaacctggcggcagcgcaaaagatg

SEQ ID NO: 153492 - DNA, 103 bp, Artificial Sequence
  Synthetic Polynucleotide
taatacgactcactataggggttgagttatgtcatccaaaaatgggttagaacagaggagactaaccatgttttggatgaacctggcggcagcgcaaaagatg

SEQ ID NO: 153493 - DNA, 103 bp, Artificial Sequence
  Synthetic Polynucleotide
taatacgactcactatagggctcgatgaggaatttcatatgcctccatttaacagaggagaaaatggatgcatatgaaaaacctggcggcagcgcaaaagatg

SEQ ID NO: 153494 - DNA, 103 bp, Artificial Sequence
  Synthetic Polynucleotide
taatacgactcactatagggccagtgtttcctcgatgaggaatttcatataacagaggagaatatgaatgtcctcatcgaacctggcggcagcgcaaaagatg

SEQ ID NO: 153495 - DNA, 103 bp, Artificial Sequence
  Synthetic Polynucleotide
taatacgactcactatagggagcaacatctccagtgtttcctcgatgaggaacagaggagacctcatatgggaaacactaacctggcggcagcgcaaaagatg

SEQ ID NO: 153496 - DNA, 103 bp, Artificial Sequence
  Synthetic Polynucleotide
taatacgactcactatagggtcatctcaacagcaacatctccagtgtttcaacagaggagagaaacaatggagatgttgaacctggcggcagcgcaaaagatg

SEQ ID NO: 153497 - DNA, 103 bp, Artificial Sequence
  Synthetic Polynucleotide
taatacgactcactatagggggtttccacatcatctcaacagcaacatctaacagaggagaagatgtatgtgttgagataacctggcggcagcgcaaaagatg

SEQ ID NO: 153498 - DNA, 103 bp, Artificial Sequence
  Synthetic Polynucleotide
taatacgactcactatagggatcataggcaggtttccacatcatctcaacaacagaggagagttgagatgatgtggaaaaacctggcggcagcgcaaaagatg

SEQ ID NO: 153499 - DNA, 103 bp, Artificial Sequence
  Synthetic Polynucleotide
taatacgactcactatagggtatacagaaaatcataggcaggtttccacaaacagaggagatgtggaatgctgcctatgaacctggcggcagcgcaaaagatg

SEQ ID NO: 153500 - DNA, 103 bp, Artificial Sequence
  Synthetic Polynucleotide
taatacgactcactataggggcactccaggtatacagaaaatcataggcaaacagaggagatgcctaatgttttctgtaaacctggcggcagcgcaaaagatg

SEQ ID NO: 153501 - DNA, 103 bp, Artificial Sequence
  Synthetic Polynucleotide
taatacgactcactatagggtccatagtgagcactccaggtatacagaaaaacagaggagatttctgatgacctggagtaacctggcggcagcgcaaaagatg

SEQ ID NO: 153502 - DNA, 103 bp, Artificial Sequence
  Synthetic Polynucleotide
taatacgactcactatagggtgtagttatttccatagtgagcactccaggaacagaggagacctggaatgctcactatgaacctggcggcagcgcaaaagatg

SEQ ID NO: 153503 - DNA, 103 bp, Artificial Sequence
  Synthetic Polynucleotide
taatacgactcactatagggttatttcttagttgagttatgtcatccaaaaacagaggagatttggaatgcataactcaaacctggcggcagcgcaaaagatg

SEQ ID NO: 153504 - DNA, 103 bp, Artificial Sequence
  Synthetic Polynucleotide
taatacgactcactatagggaacacatctctgtagttatttccatagtgaaacagaggagatcactaatgaaataactaaacctggcggcagcgcaaaagatg

SEQ ID NO: 153505 - DNA, 103 bp, Artificial Sequence
  Synthetic Polynucleotide
taatacgactcactatagggaaggtcttgtaacacatctctgtagttattaacagaggagaaataacatgagagatgtgaacctggcggcagcgcaaaagatg

SEQ ID NO: 153506 - DNA, 103 bp, Artificial Sequence
  Synthetic Polynucleotide
taatacgactcactatagggaagctgactgaaggtcttgtaacacatctcaacagaggagagagatgatgtacaagaccaacctggcggcagcgcaaaagatg

SEQ ID NO: 153507 - DNA, 103 bp, Artificial Sequence
  Synthetic Polynucleotide
taatacgactcactatagggattctgtccaaagctgactgaaggtcttgtaacagaggagaacaagaatgtcagtcagcaacctggcggcagcgcaaaagatg

SEQ ID NO: 153508 - DNA, 103 bp, Artificial Sequence
  Synthetic Polynucleotide
taatacgactcactatagggagggtttttcattctgtccaaagctgactgaacagaggagacagtcaatgttggacagaaacctggcggcagcgcaaaagatg

SEQ ID NO: 153509 - DNA, 103 bp, Artificial Sequence
  Synthetic Polynucleotide
taatacgactcactataggggtttagtcacagggtttttcattctgtccaaacagaggagatggacaatgtgaaaaaccaacctggcggcagcgcaaaagatg

SEQ ID NO: 153510 - DNA, 103 bp, Artificial Sequence
  Synthetic Polynucleotide
taatacgactcactatagggtctctccagtgtttagtcacagggtttttcaacagaggagagaaaaaatgtgtgactaaaacctggcggcagcgcaaaagatg

SEQ ID NO: 153511 - DNA, 103 bp, Artificial Sequence
  Synthetic Polynucleotide
taatacgactcactatagggtccagttaattctctccagtgtttagtcacaacagaggagagtgactatgcactggagaaacctggcggcagcgcaaaagatg

SEQ ID NO: 153512 - DNA, 103 bp, Artificial Sequence
  Synthetic Polynucleotide
taatacgactcactataggggtattaaaactccagttaattctctccagtaacagaggagaactggaatgaattaactgaacctggcggcagcgcaaaagatg

SEQ ID NO: 153513 - DNA, 103 bp, Artificial Sequence
  Synthetic Polynucleotide
taatacgactcactataggggaatttactagtattaaaactccagttaataacagaggagaattaacatgagttttaataacctggcggcagcgcaaaagatg

SEQ ID NO: 153514 - DNA, 103 bp, Artificial Sequence
  Synthetic Polynucleotide
taatacgactcactatagggtctcttcctgttatttcttagttgagttataacagaggagaataactatgctaagaaataacctggcggcagcgcaaaagatg

SEQ ID NO: 153515 - DNA, 103 bp, Artificial Sequence
  Synthetic Polynucleotide
taatacgactcactatagggaacctccaaagaatttactagtattaaaacaacagaggagagttttaatgctagtaaataacctggcggcagcgcaaaagatg

SEQ ID NO: 153516 - DNA, 103 bp, Artificial Sequence
  Synthetic Polynucleotide
taatacgactcactatagggttactctcaaaacctccaaagaatttactaaacagaggagatagtaaatgctttggaggaacctggcggcagcgcaaaagatg

SEQ ID NO: 153517 - DNA, 103 bp, Artificial Sequence
  Synthetic Polynucleotide
taatacgactcactataggggagaatgcagttactctcaaaacctccaaaaacagaggagatttggaatgtttgagagtaacctggcggcagcgcaaaagatg

SEQ ID NO: 153518 - DNA, 103 bp, Artificial Sequence
  Synthetic Polynucleotide
taatacgactcactatagggctcagaagtggagaatgcagttactctcaaaacagaggagattgagaatgactgcattcaacctggcggcagcgcaaaagatg

SEQ ID NO: 153519 - DNA, 103 bp, Artificial Sequence
  Synthetic Polynucleotide
taatacgactcactatagggaaatattatttctcttcctgttatttcttaaacagaggagataagaaatgacaggaagaaacctggcggcagcgcaaaagatg

SEQ ID NO: 153520 - DNA, 103 bp, Artificial Sequence
  Synthetic Polynucleotide
taatacgactcactatagggtttaagatggaaatattatttctcttcctgaacagaggagacaggaaatgaaataatataacctggcggcagcgcaaaagatg

SEQ ID NO: 153521 - DNA, 103 bp, Artificial Sequence
  Synthetic Polynucleotide
taatacgactcactatagggaggatcttcctttaagatggaaatattattaacagaggagaaataatatgtccatcttaaacctggcggcagcgcaaaagatg

SEQ ID NO: 153522 - DNA, 103 bp, Artificial Sequence
  Synthetic Polynucleotide
taatacgactcactatagggagaaaagaaaaggatcttcctttaagatggaacagaggagaccatctatgaggaagatcaacctggcggcagcgcaaaagatg

SEQ ID NO: 153523 - DNA, 103 bp, Artificial Sequence
  Synthetic Polynucleotide
taatacgactcactatagggctttgtgcaattcttcctgaccgaaaatgtaacagaggagaacatttatggtcaggaagaacctggcggcagcgcaaaagatg

SEQ ID NO: 153524 - DNA, 103 bp, Artificial Sequence
  Synthetic Polynucleotide
taatacgactcactatagggatttctctacagaaaagaaaaggatcttccaacagaggagaggaagaatgttttcttttaacctggcggcagcgcaaaagatg

SEQ ID NO: 153525 - DNA, 103 bp, Artificial Sequence
  Synthetic Polynucleotide
taatacgactcactatagggtccattttctatttctctacagaaaagaaaaacagaggagatttcttatgtgtagagaaaacctggcggcagcgcaaaagatg

SEQ ID NO: 153526 - DNA, 103 bp, Artificial Sequence
  Synthetic Polynucleotide
taatacgactcactatagggcaaaagaatttccattttctatttctctacaacagaggagagtagagatgtagaaaatgaacctggcggcagcgcaaaagatg

SEQ ID NO: 153527 - DNA, 103 bp, Artificial Sequence
  Synthetic Polynucleotide
taatacgactcactatagggccggaggaatcaaaagaatttccattttctaacagaggagaagaaaaatgaaattctttaacctggcggcagcgcaaaagatg

SEQ ID NO: 153528 - DNA, 103 bp, Artificial Sequence
  Synthetic Polynucleotide
taatacgactcactatagggaagttcatcaccggaggaatcaaaagaattaacagaggagaaattctatggattcctccaacctggcggcagcgcaaaagatg

SEQ ID NO: 153529 - DNA, 103 bp, Artificial Sequence
  Synthetic Polynucleotide
taatacgactcactataggggatgcacatcaagttcatcaccggaggaataacagaggagaattcctatggtgatgaacaacctggcggcagcgcaaaagatg

SEQ ID NO: 153530 - DNA, 103 bp, Artificial Sequence
  Synthetic Polynucleotide
taatacgactcactatagggctaagtaactgatgcacatcaagttcatcaaacagaggagatgatgaatgtgatgtgcaaacctggcggcagcgcaaaagatg

SEQ ID NO: 153531 - DNA, 103 bp, Artificial Sequence
  Synthetic Polynucleotide
taatacgactcactatagggggaagtctgcctaagtaactgatgcacatcaacagaggagagatgtgatgcagttacttaacctggcggcagcgcaaaagatg

SEQ ID NO: 153532 - DNA, 103 bp, Artificial Sequence
  Synthetic Polynucleotide
taatacgactcactatagggaatttcttgaggaagtctgcctaagtaactaacagaggagaagttacatgggcagacttaacctggcggcagcgcaaaagatg

SEQ ID NO: 153533 - DNA, 103 bp, Artificial Sequence
  Synthetic Polynucleotide
taatacgactcactataggggatcttccagaatttcttgaggaagtctgcaacagaggagagcagacatgctcaagaaaaacctggcggcagcgcaaaagatg

SEQ ID NO: 153534 - DNA, 103 bp, Artificial Sequence
  Synthetic Polynucleotide
taatacgactcactatagggttcagacatactttgtgcaattcttcctgaaacagaggagatcaggaatgattgcacaaaacctggcggcagcgcaaaagatg

SEQ ID NO: 153535 - DNA, 103 bp, Artificial Sequence
  Synthetic Polynucleotide
taatacgactcactatagggaacacttttagatcttccagaatttcttgaaacagaggagatcaagaatgtctggaagaaacctggcggcagcgcaaaagatg

SEQ ID NO: 153536 - DNA, 103 bp, Artificial Sequence
  Synthetic Polynucleotide
taatacgactcactataggggaagttctgaaacacttttagatcttccagaacagaggagactggaaatgctaaaagtgaacctggcggcagcgcaaaagatg

SEQ ID NO: 153537 - DNA, 103 bp, Artificial Sequence
  Synthetic Polynucleotide
taatacgactcactatagggaaaatgtccagaagttctgaaacacttttaaacagaggagataaaagatgttcagaactaacctggcggcagcgcaaaagatg

SEQ ID NO: 153538 - DNA, 103 bp, Artificial Sequence
  Synthetic Polynucleotide
taatacgactcactatagggtgtgtcgtctaaaatgtccagaagttctgaaacagaggagatcagaaatgctggacattaacctggcggcagcgcaaaagatg

SEQ ID NO: 153539 - DNA, 103 bp, Artificial Sequence
  Synthetic Polynucleotide
taatacgactcactataggggggcatgtgctgtgtcgtctaaaatgtccaaacagaggagatggacaatgtagacgacaaacctggcggcagcgcaaaagatg

SEQ ID NO: 153540 - DNA, 103 bp, Artificial Sequence
  Synthetic Polynucleotide
taatacgactcactatagggatactctgatgggcatgtgctgtgtcgtctaacagaggagaagacgaatgagcacatgcaacctggcggcagcgcaaaagatg

SEQ ID NO: 153541 - DNA, 103 bp, Artificial Sequence
  Synthetic Polynucleotide
taatacgactcactatagggagagttatgtatactctgatgggcatgtgcaacagaggagagcacatatgcatcagagtaacctggcggcagcgcaaaagatg

SEQ ID NO: 153542 - DNA, 103 bp, Artificial Sequence
  Synthetic Polynucleotide
taatacgactcactatagggggatctggtcagagttatgtatactctgataacagaggagaatcagaatgtacataactaacctggcggcagcgcaaaagatg

SEQ ID NO: 153543 - DNA, 103 bp, Artificial Sequence
  Synthetic Polynucleotide
taatacgactcactatagggtcgtgtagtaggatctggtcagagttatgtaacagaggagaacataaatgtgaccagataacctggcggcagcgcaaaagatg

SEQ ID NO: 153544 - DNA, 103 bp, Artificial Sequence
  Synthetic Polynucleotide
taatacgactcactatagggccactctaagtcgtgtagtaggatctggtcaacagaggagagaccagatgctactacacaacctggcggcagcgcaaaagatg

SEQ ID NO: 153545 - DNA, 103 bp, Artificial Sequence
  Synthetic Polynucleotide
taatacgactcactatagggtcaaatttgcttcagacatactttgtgcaaaacagaggagattgcacatggtatgtctgaacctggcggcagcgcaaaagatg

SEQ ID NO: 153546 - DNA, 103 bp, Artificial Sequence
  Synthetic Polynucleotide
taatacgactcactatagggcatttttaagccactctaagtcgtgtagtaaacagaggagatactacatgacttagagtaacctggcggcagcgcaaaagatg

SEQ ID NO: 153547 - DNA, 103 bp, Artificial Sequence
  Synthetic Polynucleotide
taatacgactcactataggggcctcccgatcatttttaagccactctaagaacagaggagacttagaatggcttaaaaaaacctggcggcagcgcaaaagatg

SEQ ID NO: 153548 - DNA, 103 bp, Artificial Sequence
  Synthetic Polynucleotide
taatacgactcactatagggcattttataagcctcccgatcatttttaagaacagaggagacttaaaatggatcgggagaacctggcggcagcgcaaaagatg

SEQ ID NO: 153549 - DNA, 103 bp, Artificial Sequence
  Synthetic Polynucleotide
taatacgactcactatagggttaaccaagccattttataagcctcccgataacagaggagaatcgggatgcttataaaaaacctggcggcagcgcaaaagatg

SEQ ID NO: 153550 - DNA, 103 bp, Artificial Sequence
  Synthetic Polynucleotide
taatacgactcactatagggtggcgttgacttaaccaagccattttataaaacagaggagattataaatgggcttggttaacctggcggcagcgcaaaagatg

SEQ ID NO: 153551 - DNA, 103 bp, Artificial Sequence
  Synthetic Polynucleotide
taatacgactcactataggggcgggccagctggcgttgacttaaccaagcaacagaggagagcttggatgagtcaacgcaacctggcggcagcgcaaaagatg

SEQ ID NO: 153552 - DNA, 103 bp, Artificial Sequence
  Synthetic Polynucleotide
taatacgactcactatagggcaaggcaggagcgggccagctggcgttgacaacagaggagagtcaacatgagctggcccaacctggcggcagcgcaaaagatg

SEQ ID NO: 153553 - DNA, 103 bp, Artificial Sequence
  Synthetic Polynucleotide
taatacgactcactataggggtattcaaatcaaggcaggagcgggccagcaacagaggagagctggcatgctcctgcctaacctggcggcagcgcaaaagatg

SEQ ID NO: 153554 - DNA, 103 bp, Artificial Sequence
  Synthetic Polynucleotide
taatacgactcactatagggctgactaattgtattcaaatcaaggcaggaaacagaggagatcctgcatggatttgaataacctggcggcagcgcaaaagatg

SEQ ID NO: 153555 - DNA, 103 bp, Artificial Sequence
  Synthetic Polynucleotide
taatacgactcactatagggatccagggctctgactaattgtattcaaataacagaggagaatttgaatgcaattagtcaacctggcggcagcgcaaaagatg

SEQ ID NO: 153556 - DNA, 103 bp, Artificial Sequence
  Synthetic Polynucleotide
taatacgactcactatagggtccatgtcaatcaaatttgcttcagacataaacagaggagatatgtcatgagcaaatttaacctggcggcagcgcaaaagatg

SEQ ID NO: 153557 - DNA, 103 bp, Artificial Sequence
  Synthetic Polynucleotide
taatacgactcactataggggtctgggcccatccagggctctgactaattaacagaggagaaattagatggagccctggaacctggcggcagcgcaaaagatg

SEQ ID NO: 153558 - DNA, 103 bp, Artificial Sequence
  Synthetic Polynucleotide
taatacgactcactatagggcgcaagttgtgtctgggcccatccagggctaacagaggagaagccctatgtgggcccagaacctggcggcagcgcaaaagatg

SEQ ID NO: 153559 - DNA, 103 bp, Artificial Sequence
  Synthetic Polynucleotide
taatacgactcactatagggtggtgacctccgcaagttgtgtctgggcccaacagaggagagggcccatgcacaacttgaacctggcggcagcgcaaaagatg

SEQ ID NO: 153560 - DNA, 103 bp, Artificial Sequence
  Synthetic Polynucleotide
taatacgactcactatagggttgcaagctatggtgacctccgcaagttgtaacagaggagaacaactatgggaggtcacaacctggcggcagcgcaaaagatg

SEQ ID NO: 153561 - DNA, 103 bp, Artificial Sequence
  Synthetic Polynucleotide
taatacgactcactatagggatggtttactttgcaagctatggtgacctcaacagaggagagaggtcatgatagcttgcaacctggcggcagcgcaaaagatg

SEQ ID NO: 153562 - DNA, 103 bp, Artificial Sequence
  Synthetic Polynucleotide
taatacgactcactatagggaccctccttgatggtttactttgcaagctaaacagaggagatagcttatgaagtaaaccaacctggcggcagcgcaaaagatg

SEQ ID NO: 153563 - DNA, 103 bp, Artificial Sequence
  Synthetic Polynucleotide
taatacgactcactatagggaattgtactgaccctccttgatggtttactaacagaggagaagtaaaatgtcaaggaggaacctggcggcagcgcaaaagatg

SEQ ID NO: 153564 - DNA, 103 bp, Artificial Sequence
  Synthetic Polynucleotide
taatacgactcactatagggtgattcaggtaattgtactgaccctccttgaacagaggagacaaggaatgtcagtacaaaacctggcggcagcgcaaaagatg

SEQ ID NO: 153565 - DNA, 103 bp, Artificial Sequence
  Synthetic Polynucleotide
taatacgactcactatagggcagtgatgtctgattcaggtaattgtactgaacagaggagacagtacatgtacctgaataacctggcggcagcgcaaaagatg

SEQ ID NO: 153566 - DNA, 103 bp, Artificial Sequence
  Synthetic Polynucleotide
taatacgactcactatagggggcacatgaacagtgatgtctgattcaggtaacagaggagaacctgaatgagacatcacaacctggcggcagcgcaaaagatg

SEQ ID NO: 153567 - DNA, 103 bp, Artificial Sequence
  Synthetic Polynucleotide
taatacgactcactatagggttttccagcttccatgtcaatcaaatttgcaacagaggagagcaaatatgattgacatgaacctggcggcagcgcaaaagatg

SEQ ID NO: 153568 - DNA, 103 bp, Artificial Sequence
  Synthetic Polynucleotide
taatacgactcactatagggatgaccttggggcacatgaacagtgatgtcaacagaggagagacatcatggttcatgtgaacctggcggcagcgcaaaagatg

SEQ ID NO: 153569 - DNA, 103 bp, Artificial Sequence
  Synthetic Polynucleotide
taatacgactcactatagggccacagccacatgaccttggggcacatgaaaacagaggagattcatgatgcccaaggtcaacctggcggcagcgcaaaagatg

SEQ ID NO: 153570 - DNA, 103 bp, Artificial Sequence
  Synthetic Polynucleotide
taatacgactcactatagggtggaattctcccacagccacatgaccttggaacagaggagaccaaggatgtgtggctgtaacctggcggcagcgcaaaagatg

SEQ ID NO: 153571 - DNA, 103 bp, Artificial Sequence
  Synthetic Polynucleotide
taatacgactcactatagggagacacctcttggaattctcccacagccacaacagaggagagtggctatgggagaattcaacctggcggcagcgcaaaagatg

SEQ ID NO: 153572 - DNA, 103 bp, Artificial Sequence
  Synthetic Polynucleotide
taatacgactcactatagggaagcccttagagacacctcttggaattctcaacagaggagagagaatatgaagaggtgtaacctggcggcagcgcaaaagatg

SEQ ID NO: 153573 - DNA, 103 bp, Artificial Sequence
  Synthetic Polynucleotide
taatacgactcactatagggggatcaaggaaagcccttagagacacctctaacagaggagaagaggtatgtctaagggcaacctggcggcagcgcaaaagatg

SEQ ID NO: 153574 - DNA, 103 bp, Artificial Sequence
  Synthetic Polynucleotide
taatacgactcactatagggcatgtgtggcggatcaaggaaagcccttagaacagaggagactaaggatgttccttgataacctggcggcagcgcaaaagatg

SEQ ID NO: 153575 - DNA, 103 bp, Artificial Sequence
  Synthetic Polynucleotide
taatacgactcactatagggcatggttaagcatgtgtggcggatcaaggaaacagaggagatccttgatgcgccacacaaacctggcggcagcgcaaaagatg

SEQ ID NO: 153576 - DNA, 103 bp, Artificial Sequence
  Synthetic Polynucleotide
taatacgactcactatagggcacgaaagatcatggttaagcatgtgtggcaacagaggagagccacaatggcttaaccaaacctggcggcagcgcaaaagatg

SEQ ID NO: 153577 - DNA, 103 bp, Artificial Sequence
  Synthetic Polynucleotide
taatacgactcactataggggctcacagtgcacgaaagatcatggttaagaacagaggagacttaacatggatctttcgaacctggcggcagcgcaaaagatg

SEQ ID NO: 153578 - DNA, 103 bp, Artificial Sequence
  Synthetic Polynucleotide
taatacgactcactatagggtttttgagagttttccagcttccatgtcaaaacagaggagattgacaatgaagctggaaaacctggcggcagcgcaaaagatg

SEQ ID NO: 153579 - DNA, 103 bp, Artificial Sequence
  Synthetic Polynucleotide
taatacgactcactatagggccaacaacgggctcacagtgcacgaaagataacagaggagaatctttatggcactgtgaaacctggcggcagcgcaaaagatg

SEQ ID NO: 153580 - DNA, 103 bp, Artificial Sequence
  Synthetic Polynucleotide
taatacgactcactatagggaacatgatttccaacaacgggctcacagtgaacagaggagacactgtatgcccgttgttaacctggcggcagcgcaaaagatg

SEQ ID NO: 153581 - DNA, 103 bp, Artificial Sequence
  Synthetic Polynucleotide
taatacgactcactataggggaggttgcctaacatgatttccaacaacggaacagaggagaccgttgatggaaatcatgaacctggcggcagcgcaaaagatg

SEQ ID NO: 153582 - DNA, 103 bp, Artificial Sequence
  Synthetic Polynucleotide
taatacgactcactatagggccattgtattgaggttgcctaacatgatttaacagaggagaaaatcaatgtaggcaaccaacctggcggcagcgcaaaagatg

SEQ ID NO: 153583 - DNA, 103 bp, Artificial Sequence
  Synthetic Polynucleotide
taatacgactcactatagggaaaagggcttccattgtattgaggttgcctaacagaggagaaggcaaatgcaatacaataacctggcggcagcgcaaaagatg

SEQ ID NO: 153584 - DNA, 103 bp, Artificial Sequence
  Synthetic Polynucleotide
taatacgactcactatagggcatctccagcaaaagggcttccattgtattaacagaggagaaatacaatggaagcccttaacctggcggcagcgcaaaagatg

SEQ ID NO: 153585 - DNA, 103 bp, Artificial Sequence
  Synthetic Polynucleotide
taatacgactcactatagggccccaattttcatctccagcaaaagggcttaacagaggagaaagcccatgtgctggagaaacctggcggcagcgcaaaagatg

SEQ ID NO: 153586 - DNA, 103 bp, Artificial Sequence
  Synthetic Polynucleotide
taatacgactcactatagggcttacttcagccccaattttcatctccagcaacagaggagagctggaatggaaaattggaacctggcggcagcgcaaaagatg

SEQ ID NO: 153587 - DNA, 103 bp, Artificial Sequence
  Synthetic Polynucleotide
taatacgactcactatagggaggatcctttcttacttcagccccaattttaacagaggagaaaaattatggctgaagtaaacctggcggcagcgcaaaagatg

SEQ ID NO: 153588 - DNA, 103 bp, Artificial Sequence
  Synthetic Polynucleotide
taatacgactcactatagggcttggctgaaaggatcctttcttacttcagaacagaggagactgaagatggaaaggatcaacctggcggcagcgcaaaagatg

SEQ ID NO: 153589 - DNA, 103 bp, Artificial Sequence
  Synthetic Polynucleotide
taatacgactcactatagggatattgcaactttttgagagttttccagctaacagaggagaagctggatgactctcaaaaacctggcggcagcgcaaaagatg

SEQ ID NO: 153590 - DNA, 103 bp, Artificial Sequence
  Synthetic Polynucleotide
taatacgactcactatagggtctgtcatgacttggctgaaaggatcctttaacagaggagaaaaggaatgtttcagccaaacctggcggcagcgcaaaagatg

SEQ ID NO: 153591 - DNA, 103 bp, Artificial Sequence
  Synthetic Polynucleotide
taatacgactcactatagggacacaccatttctgtcatgacttggctgaaaacagaggagattcagcatggtcatgacaaacctggcggcagcgcaaaagatg

SEQ ID NO: 153592 - DNA, 103 bp, Artificial Sequence
  Synthetic Polynucleotide
taatacgactcactatagggagctgtgtaaacacaccatttctgtcatgaaacagaggagatcatgaatgaaatggtgtaacctggcggcagcgcaaaagatg

SEQ ID NO: 153593 - DNA, 103 bp, Artificial Sequence
  Synthetic Polynucleotide
taatacgactcactatagggtctttacccaagctgtgtaaacacaccattaacagaggagaaatggtatgtttacacagaacctggcggcagcgcaaaagatg

SEQ ID NO: 153594 - DNA, 103 bp, Artificial Sequence
  Synthetic Polynucleotide
taatacgactcactatagggaaaagggccttctttacccaagctgtgtaaaacagaggagattacacatgttgggtaaaaacctggcggcagcgcaaaagatg

SEQ ID NO: 153595 - DNA, 103 bp, Artificial Sequence
  Synthetic Polynucleotide
taatacgactcactatagggttaaaactttaaaagggccttctttacccaaacagaggagatgggtaatgaaggcccttaacctggcggcagcgcaaaagatg

SEQ ID NO: 153596 - DNA, 103 bp, Artificial Sequence
  Synthetic Polynucleotide
taatacgactcactatagggtagcagttgcttaaaactttaaaagggcctaacagaggagaaggcccatgtaaagttttaacctggcggcagcgcaaaagatg

SEQ ID NO: 153597 - DNA, 103 bp, Artificial Sequence
  Synthetic Polynucleotide
taatacgactcactatagggtttataaatgtagcagttgcttaaaactttaacagaggagaaaagttatgagcaactgcaacctggcggcagcgcaaaagatg

SEQ ID NO: 153598 - DNA, 103 bp, Artificial Sequence
  Synthetic Polynucleotide
taatacgactcactatagggggatggtgtctttataaatgtagcagttgcaacagaggagagcaactatgacatttataaacctggcggcagcgcaaaagatg

SEQ ID NO: 153599 - DNA, 103 bp, Artificial Sequence
  Synthetic Polynucleotide
taatacgactcactatagggagcttgacttggatggtgtctttataaatgaacagaggagacatttaatgagacaccataacctggcggcagcgcaaaagatg

SEQ ID NO: 153600 - DNA, 103 bp, Artificial Sequence
  Synthetic Polynucleotide
taatacgactcactatagggggagttgctcattgccagttctgatgccataacagaggagaatggcaatggaactggcaaacctggcggcagcgcaaaagatg

SEQ ID NO: 153601 - DNA, 103 bp, Artificial Sequence
  Synthetic Polynucleotide
taatacgactcactataggggtcggtctccaccggttcctttttcacttcaacagaggagagaagtgatgaaggaaccgaacctggcggcagcgcaaaagatg

SEQ ID NO: 153602 - DNA, 103 bp, Artificial Sequence
  Synthetic Polynucleotide
taatacgactcactatagggctcgcgcaccagcctggagatctcctgcttaacagaggagaaagcagatgatctccaggaacctggcggcagcgcaaaagatg

SEQ ID NO: 153603 - DNA, 103 bp, Artificial Sequence
  Synthetic Polynucleotide
taatacgactcactatagggacgcgtccctctcgcgcaccagcctggagaaacagaggagatctccaatgtggtgcgcgaacctggcggcagcgcaaaagatg

SEQ ID NO: 153604 - DNA, 103 bp, Artificial Sequence
  Synthetic Polynucleotide
taatacgactcactatagggttctccttgtacgcgtccctctcgcgcaccaacagaggagaggtgcgatggagggacgcaacctggcggcagcgcaaaagatg

SEQ ID NO: 153605 - DNA, 103 bp, Artificial Sequence
  Synthetic Polynucleotide
taatacgactcactatagggcttctcgtatttctccttgtacgcgtccctaacagaggagaagggacatgtacaaggagaacctggcggcagcgcaaaagatg

SEQ ID NO: 153606 - DNA, 103 bp, Artificial Sequence
  Synthetic Polynucleotide
taatacgactcactatagggtgctcaccaacttctcgtatttctccttgtaacagaggagaacaaggatgaatacgagaaacctggcggcagcgcaaaagatg

SEQ ID NO: 153607 - DNA, 103 bp, Artificial Sequence
  Synthetic Polynucleotide
taatacgactcactatagggcggaagccgctgctcaccaacttctcgtataacagaggagaatacgaatggttggtgagaacctggcggcagcgcaaaagatg

SEQ ID NO: 153608 - DNA, 103 bp, Artificial Sequence
  Synthetic Polynucleotide
taatacgactcactataggggccgttttctcggaagccgctgctcaccaaaacagaggagattggtgatgagcggcttcaacctggcggcagcgcaaaagatg

SEQ ID NO: 153609 - DNA, 103 bp, Artificial Sequence
  Synthetic Polynucleotide
taatacgactcactatagggcgctgctcgagccgttttctcggaagccgcaacagaggagagcggctatggagaaaacgaacctggcggcagcgcaaaagatg

SEQ ID NO: 153610 - DNA, 103 bp, Artificial Sequence
  Synthetic Polynucleotide
taatacgactcactataggggacgggttgtcgctgctcgagccgttttctaacagaggagaagaaaaatgctcgagcagaacctggcggcagcgcaaaagatg

SEQ ID NO: 153611 - DNA, 103 bp, Artificial Sequence
  Synthetic Polynucleotide
taatacgactcactatagggctcgggagaggacgggttgtcgctgctcgaaacagaggagatcgagcatggacaacccgaacctggcggcagcgcaaaagatg

SEQ ID NO: 153612 - DNA, 103 bp, Artificial Sequence
  Synthetic Polynucleotide
taatacgactcactatagggtgatgatgcggtcggtctccaccggttcctaacagaggagaaggaacatgtggagaccgaacctggcggcagcgcaaaagatg

SEQ ID NO: 153613 - DNA, 103 bp, Artificial Sequence
  Synthetic Polynucleotide
taatacgactcactatagggttatgaaaaactcgggagaggacgggttgtaacagaggagaacaaccatgcctctcccgaacctggcggcagcgcaaaagatg

SEQ ID NO: 153614 - DNA, 103 bp, Artificial Sequence
  Synthetic Polynucleotide
taatacgactcactataggggtgggctcagttatgaaaaactcgggagagaacagaggagactctccatggtttttcataacctggcggcagcgcaaaagatg

SEQ ID NO: 153615 - DNA, 103 bp, Artificial Sequence
  Synthetic Polynucleotide
taatacgactcactatagggcaacttgcgagtgggctcagttatgaaaaaaacagaggagatttttcatgactgagcccaacctggcggcagcgcaaaagatg

SEQ ID NO: 153616 - DNA, 103 bp, Artificial Sequence
  Synthetic Polynucleotide
taatacgactcactatagggctgatggctccaacttgcgagtgggctcagaacagaggagactgagcatgctcgcaagtaacctggcggcagcgcaaaagatg

SEQ ID NO: 153617 - DNA, 103 bp, Artificial Sequence
  Synthetic Polynucleotide
taatacgactcactataggggcgtatcccactgatggctccaacttgcgaaacagaggagatcgcaaatgggagccatcaacctggcggcagcgcaaaagatg

SEQ ID NO: 153618 - DNA, 103 bp, Artificial Sequence
  Synthetic Polynucleotide
taatacgactcactatagggccaaaatgtggcgtatcccactgatggctcaacagaggagagagccaatggtgggatacaacctggcggcagcgcaaaagatg

SEQ ID NO: 153619 - DNA, 103 bp, Artificial Sequence
  Synthetic Polynucleotide
taatacgactcactataggggctggggcttccaaaatgtggcgtatcccaaacagaggagatgggatatgccacattttaacctggcggcagcgcaaaagatg

SEQ ID NO: 153620 - DNA, 103 bp, Artificial Sequence
  Synthetic Polynucleotide
taatacgactcactatagggagtacacgatgctggggcttccaaaatgtgaacagaggagacacattatggaagccccaaacctggcggcagcgcaaaagatg

SEQ ID NO: 153621 - DNA, 103 bp, Artificial Sequence
  Synthetic Polynucleotide
taatacgactcactatagggcacactggtaagtacacgatgctggggcttaacagaggagaaagcccatgcatcgtgtaaacctggcggcagcgcaaaagatg

SEQ ID NO: 153622 - DNA, 103 bp, Artificial Sequence
  Synthetic Polynucleotide
taatacgactcactatagggattttgtgaacacactggtaagtacacgataacagaggagaatcgtgatgttaccagtgaacctggcggcagcgcaaaagatg

SEQ ID NO: 153623 - DNA, 103 bp, Artificial Sequence
  Synthetic Polynucleotide
taatacgactcactatagggccgcactggctgatgatgcggtcggtctccaacagaggagaggagacatgccgcatcataacctggcggcagcgcaaaagatg

SEQ ID NO: 153624 - DNA, 103 bp, Artificial Sequence
  Synthetic Polynucleotide
taatacgactcactataggggatgagacggccgcactggctgatgatgcgaacagaggagacgcatcatgagccagtgcaacctggcggcagcgcaaaagatg

SEQ ID NO: 153625 - DNA, 103 bp, Artificial Sequence
  Synthetic Polynucleotide
taatacgactcactatagggagcccccggcgatgagacggccgcactggcaacagaggagagccagtatggccgtctcaaacctggcggcagcgcaaaagatg

SEQ ID NO: 153626 - DNA, 103 bp, Artificial Sequence
  Synthetic Polynucleotide
taatacgactcactataggggaggacagcgagcccccggcgatgagacggaacagaggagaccgtctatgcgccgggggaacctggcggcagcgcaaaagatg

SEQ ID NO: 153627 - DNA, 103 bp, Artificial Sequence
  Synthetic Polynucleotide
taatacgactcactatagggcatgggggtggaggacagcgagcccccggcaacagaggagagccgggatgtcgctgtccaacctggcggcagcgcaaaagatg

SEQ ID NO: 153628 - DNA, 103 bp, Artificial Sequence
  Synthetic Polynucleotide
taatacgactcactatagggacggcgtgctcatgggggtggaggacagcgaacagaggagacgctgtatgccacccccaaacctggcggcagcgcaaaagatg

SEQ ID NO: 153629 - DNA, 103 bp, Artificial Sequence
  Synthetic Polynucleotide
taatacgactcactatagggaccgagctgcacggcgtgctcatgggggtgaacagaggagacaccccatggagcacgccaacctggcggcagcgcaaaagatg

SEQ ID NO: 153630 - DNA, 103 bp, Artificial Sequence
  Synthetic Polynucleotide
taatacgactcactatagggggaagggggcaccgagctgcacggcgtgctaacagaggagaagcacgatgtgcagctcgaacctggcggcagcgcaaaagatg

SEQ ID NO: 153631 - DNA, 103 bp, Artificial Sequence
  Synthetic Polynucleotide
taatacgactcactatagggtgggcaggtcggagttgctcattgccagttaacagaggagaaactggatgtgagcaactaacctggcggcagcgcaaaagatg

SEQ ID NO: 153632 - DNA, 103 bp, Artificial Sequence
  Synthetic Polynucleotide
taatacgactcactatagggagaagctgggggaagggggcaccgagctgcaacagaggagagcagctatgtgcccccttaacctggcggcagcgcaaaagatg

SEQ ID NO: 153633 - DNA, 103 bp, Artificial Sequence
  Synthetic Polynucleotide
taatacgactcactatagggctgggcgccgagaagctgggggaagggggcaacagaggagagcccccatgccccagcttaacctggcggcagcgcaaaagatg

SEQ ID NO: 153634 - DNA, 103 bp, Artificial Sequence
  Synthetic Polynucleotide
taatacgactcactatagggcgagcccgggctgggcgccgagaagctgggaacagaggagacccagcatgtcggcgcccaacctggcggcagcgcaaaagatg

SEQ ID NO: 153635 - DNA, 103 bp, Artificial Sequence
  Synthetic Polynucleotide
taatacgactcactataggggctcgctgcccgagcccgggctgggcgccgaacagaggagacggcgcatggcccgggctaacctggcggcagcgcaaaagatg

SEQ ID NO: 153636 - DNA, 103 bp, Artificial Sequence
  Synthetic Polynucleotide
taatacgactcactatagggtgcgccttctgctcgctgcccgagcccgggaacagaggagacccgggatggggcagcgaaacctggcggcagcgcaaaagatg

SEQ ID NO: 153637 - DNA, 103 bp, Artificial Sequence
  Synthetic Polynucleotide
taatacgactcactataggggtcttccaggtgcgccttctgctcgctgccaacagaggagaggcagcatgcagaaggcgaacctggcggcagcgcaaaagatg

SEQ ID NO: 153638 - DNA, 103 bp, Artificial Sequence
  Synthetic Polynucleotide
taatacgactcactatagggtccagtagtagtcttccaggtgcgccttctaacagaggagaagaaggatgacctggaagaacctggcggcagcgcaaaagatg

SEQ ID NO: 153639 - DNA, 103 bp, Artificial Sequence
  Synthetic Polynucleotide
taatacgactcactatagggtagccggtcatccagtagtagtcttccaggaacagaggagacctggaatgctactactgaacctggcggcagcgcaaaagatg

SEQ ID NO: 153640 - DNA, 103 bp, Artificial Sequence
  Synthetic Polynucleotide
taatacgactcactatagggctgctgcgggtagccggtcatccagtagtaaacagaggagatactacatgatgaccggcaacctggcggcagcgcaaaagatg

SEQ ID NO: 153641 - DNA, 103 bp, Artificial Sequence
  Synthetic Polynucleotide
taatacgactcactatagggcggggttcagctgctgcgggtagccggtcaaacagaggagatgaccgatgacccgcagcaacctggcggcagcgcaaaagatg

SEQ ID NO: 153642 - DNA, 103 bp, Artificial Sequence
  Synthetic Polynucleotide
taatacgactcactatagggaggggactggtgggcaggtcggagttgctcaacagaggagagagcaaatgcgacctgccaacctggcggcagcgcaaaagatg

SEQ ID NO: 153643 - DNA, 103 bp, Artificial Sequence
  Synthetic Polynucleotide
taatacgactcactatagggcccagcgcctcggggttcagctgctgcgggaacagaggagacccgcaatggctgaacccaacctggcggcagcgcaaaagatg

SEQ ID NO: 153644 - DNA, 103 bp, Artificial Sequence
  Synthetic Polynucleotide
taatacgactcactatagggggggctgaagcccagcgcctcggggttcagaacagaggagactgaacatggaggcgctgaacctggcggcagcgcaaaagatg

SEQ ID NO: 153645 - DNA, 103 bp, Artificial Sequence
  Synthetic Polynucleotide
taatacgactcactatagggccgcgtcctcggggctgaagcccagcgcctaacagaggagaaggcgcatggcttcagccaacctggcggcagcgcaaaagatg

SEQ ID NO: 153646 - DNA, 103 bp, Artificial Sequence
  Synthetic Polynucleotide
taatacgactcactatagggagcgcctcgaccgcgtcctcggggctgaagaacagaggagacttcagatgcgaggacgcaacctggcggcagcgcaaaagatg

SEQ ID NO: 153647 - DNA, 103 bp, Artificial Sequence
  Synthetic Polynucleotide
taatacgactcactataggggttgctgatgagcgcctcgaccgcgtcctcaacagaggagagaggacatggtcgaggcgaacctggcggcagcgcaaaagatg

SEQ ID NO: 153648 - DNA, 103 bp, Artificial Sequence
  Synthetic Polynucleotide
taatacgactcactataggggctggtggctgttgctgatgagcgcctcgaaacagaggagatcgaggatgtcatcagcaaacctggcggcagcgcaaaagatg

SEQ ID NO: 153649 - DNA, 103 bp, Artificial Sequence
  Synthetic Polynucleotide
taatacgactcactatagggccgccctggagctggtggctgttgctgatgaacagaggagacatcagatgcagccaccaaacctggcggcagcgcaaaagatg

SEQ ID NO: 153650 - DNA, 103 bp, Artificial Sequence
  Synthetic Polynucleotide
taatacgactcactataggggccatcgaagccgccctggagctggtggctaacagaggagaagccacatgctccagggcaacctggcggcagcgcaaaagatg

SEQ ID NO: 153651 - DNA, 103 bp, Artificial Sequence
  Synthetic Polynucleotide
taatacgactcactatagggcgcgcgcgtagccatcgaagccgccctggaaacagaggagatccaggatggcttcgatgaacctggcggcagcgcaaaagatg

SEQ ID NO: 153652 - DNA, 103 bp, Artificial Sequence
  Synthetic Polynucleotide
taatacgactcactatagggtgctgcgccccgcgcgcgtagccatcgaagaacagaggagacttcgaatgctacgcgcgaacctggcggcagcgcaaaagatg

SEQ ID NO: 153653 - DNA, 103 bp, Artificial Sequence
  Synthetic Polynucleotide
taatacgactcactatagggttccatggccaggggactggtgggcaggtcaacagaggagagacctgatgaccagtcccaacctggcggcagcgcaaaagatg

SEQ ID NO: 153654 - DNA, 103 bp, Artificial Sequence
  Synthetic Polynucleotide
taatacgactcactatagggcgcggccagctgctgcgccccgcgcgcgtaaacagaggagatacgcgatgggggcgcagaacctggcggcagcgcaaaagatg

SEQ ID NO: 153655 - DNA, 103 bp, Artificial Sequence
  Synthetic Polynucleotide
taatacgactcactatagggccccggccgccgcggccagctgctgcgcccaacagaggagagggcgcatgagctggccgaacctggcggcagcgcaaaagatg

SEQ ID NO: 153656 - DNA, 103 bp, Artificial Sequence
  Synthetic Polynucleotide
taatacgactcactatagggccggcaccggccccggccgccgcggccagcaacagaggagagctggcatgggcggccggaacctggcggcagcgcaaaagatg

SEQ ID NO: 153657 - DNA, 103 bp, Artificial Sequence
  Synthetic Polynucleotide
taatacgactcactatagggcaaggaggcgccggcaccggccccggccgcaacagaggagagcggccatggccggtgccaacctggcggcagcgcaaaagatg

SEQ ID NO: 153658 - DNA, 103 bp, Artificial Sequence
  Synthetic Polynucleotide
taatacgactcactatagggcgctgccgcccaaggaggcgccggcaccggaacagaggagaccggtgatggcgcctcctaacctggcggcagcgcaaaagatg

SEQ ID NO: 153659 - DNA, 103 bp, Artificial Sequence
  Synthetic Polynucleotide
taatacgactcactatagggatctcctcgccgctgccgcccaaggaggcgaacagaggagacgcctcatggggcggcagaacctggcggcagcgcaaaagatg

SEQ ID NO: 153660 - DNA, 103 bp, Artificial Sequence
  Synthetic Polynucleotide
taatacgactcactatagggggcggggcccatctcctcgccgctgccgccaacagaggagaggcggcatgggcgaggagaacctggcggcagcgcaaaagatg

SEQ ID NO: 153661 - DNA, 103 bp, Artificial Sequence
  Synthetic Polynucleotide
taatacgactcactatagggccacggcggcggcggggcccatctcctcgcaacagaggagagcgaggatgtgggccccgaacctggcggcagcgcaaaagatg

SEQ ID NO: 153662 - DNA, 103 bp, Artificial Sequence
  Synthetic Polynucleotide
taatacgactcactatagggacggcggacaccacggcggcggcggggcccaacagaggagagggcccatgcgccgccgtaacctggcggcagcgcaaaagatg

SEQ ID NO: 153663 - DNA, 103 bp, Artificial Sequence
  Synthetic Polynucleotide
taatacgactcactatagggcgcggcgatcacggcggacaccacggcggcaacagaggagagccgccatggtgtccgccaacctggcggcagcgcaaaagatg

SEQ ID NO: 153664 - DNA, 103 bp, Artificial Sequence
  Synthetic Polynucleotide
taatacgactcactatagggcattaacatattccatggccaggggactggaacagaggagaccagtcatgtggccatggaacctggcggcagcgcaaaagatg

SEQ ID NO: 153665 - DNA, 103 bp, Artificial Sequence
  Synthetic Polynucleotide
taatacgactcactataggggcgcggcggccgcggcgatcacggcggacaaacagaggagatgtccgatgtgatcgccgaacctggcggcagcgcaaaagatg

SEQ ID NO: 153666 - DNA, 103 bp, Artificial Sequence
  Synthetic Polynucleotide
taatacgactcactataggggcgccgctctgcgcggcggccgcggcgatcaacagaggagagatcgcatgggccgccgcaacctggcggcagcgcaaaagatg

SEQ ID NO: 153667 - DNA, 103 bp, Artificial Sequence
  Synthetic Polynucleotide
taatacgactcactataggggtgcgggcccgcgccgctctgcgcggcggcaacagaggagagccgccatgcagagcggcaacctggcggcagcgcaaaagatg

SEQ ID NO: 153668 - DNA, 103 bp, Artificial Sequence
  Synthetic Polynucleotide
taatacgactcactatagggggtggtggtagtgcgggcccgcgccgctctaacagaggagaagagcgatgcgggcccgcaacctggcggcagcgcaaaagatg

SEQ ID NO: 153669 - DNA, 103 bp, Artificial Sequence
  Synthetic Polynucleotide
taatacgactcactatagggtggtggtggtggtggtggtagtgcgggcccaacagaggagagggcccatgctaccaccaaacctggcggcagcgcaaaagatg

SEQ ID NO: 153670 - DNA, 103 bp, Artificial Sequence
  Synthetic Polynucleotide
taatacgactcactataggggccggcggcgtggtggtggtggtggtggtaaacagaggagataccacatgcaccaccacaacctggcggcagcgcaaaagatg

SEQ ID NO: 153671 - DNA, 103 bp, Artificial Sequence
  Synthetic Polynucleotide
taatacgactcactatagggggtggtggtggccggcggcgtggtggtggtaacagaggagaaccaccatgacgccgccgaacctggcggcagcgcaaaagatg

SEQ ID NO: 153672 - DNA, 103 bp, Artificial Sequence
  Synthetic Polynucleotide
taatacgactcactataggggccgtcgggtggtggtggtggccggcggcgaacagaggagacgccgcatgccaccaccaaacctggcggcagcgcaaaagatg

SEQ ID NO: 153673 - DNA, 103 bp, Artificial Sequence
  Synthetic Polynucleotide
taatacgactcactataggggggcgcgccggccgtcgggtggtggtggtgaacagaggagacaccacatgcacccgacgaacctggcggcagcgcaaaagatg

SEQ ID NO: 153674 - DNA, 103 bp, Artificial Sequence
  Synthetic Polynucleotide
taatacgactcactatagggccgcggcgccgggcgcgccggccgtcgggtaacagaggagaacccgaatgccggcgcgcaacctggcggcagcgcaaaagatg

SEQ ID NO: 153675 - DNA, 103 bp, Artificial Sequence
  Synthetic Polynucleotide
taatacgactcactatagggagatcgaagtcattaacatattccatggccaacagaggagaggccatatgatatgttaaaacctggcggcagcgcaaaagatg

SEQ ID NO: 153676 - DNA, 103 bp, Artificial Sequence
  Synthetic Polynucleotide
taatacgactcactataggggccgcgctgcccgcggcgccgggcgcgccgaacagaggagacggcgcatgcggcgccgcaacctggcggcagcgcaaaagatg

SEQ ID NO: 153677 - DNA, 103 bp, Artificial Sequence
  Synthetic Polynucleotide
taatacgactcactatagggggccgaggcggccgcgctgcccgcggcgccaacagaggagaggcgccatgggcagcgcgaacctggcggcagcgcaaaagatg

SEQ ID NO: 153678 - DNA, 103 bp, Artificial Sequence
  Synthetic Polynucleotide
taatacgactcactatagggcagcgccaccggccgaggcggccgcgctgcaacagaggagagcagcgatgccgcctcggaacctggcggcagcgcaaaagatg

SEQ ID NO: 153679 - DNA, 103 bp, Artificial Sequence
  Synthetic Polynucleotide
taatacgactcactatagggcccgcgcccccagcgccaccggccgaggcgaacagaggagacgcctcatgcggtggcgcaacctggcggcagcgcaaaagatg

SEQ ID NO: 153680 - DNA, 103 bp, Artificial Sequence
  Synthetic Polynucleotide
taatacgactcactataggggccaccgccgcccgcgcccccagcgccaccaacagaggagaggtggcatggggggcgcgaacctggcggcagcgcaaaagatg

SEQ ID NO: 153681 - DNA, 103 bp, Artificial Sequence
  Synthetic Polynucleotide
taatacgactcactatagggcgctggccgggccaccgccgcccgcgccccaacagaggagaggggcgatggcggcggtgaacctggcggcagcgcaaaagatg

SEQ ID NO: 153682 - DNA, 103 bp, Artificial Sequence
  Synthetic Polynucleotide
taatacgactcactatagggccgcccccagcgctggccgggccaccgccgaacagaggagacggcggatgcccggccagaacctggcggcagcgcaaaagatg

SEQ ID NO: 153683 - DNA, 103 bp, Artificial Sequence
  Synthetic Polynucleotide
taatacgactcactataggggccgccgccgccgcccccagcgctggccggaacagaggagaccggccatggctgggggcaacctggcggcagcgcaaaagatg

SEQ ID NO: 153684 - DNA, 103 bp, Artificial Sequence
  Synthetic Polynucleotide
taatacgactcactatagggcgccgccgccgccgccgccgccgcccccagaacagaggagactggggatggcggcggcgaacctggcggcagcgcaaaagatg

SEQ ID NO: 153685 - DNA, 103 bp, Artificial Sequence
  Synthetic Polynucleotide
taatacgactcactatagggccgccgcctccgccgccgccgccgccgccgaacagaggagacggcggatgcggcggcggaacctggcggcagcgcaaaagatg

SEQ ID NO: 153686 - DNA, 103 bp, Artificial Sequence
  Synthetic Polynucleotide
taatacgactcactatagggaaacttcatcagatcgaagtcattaacataaacagaggagatatgttatggacttcgataacctggcggcagcgcaaaagatg

SEQ ID NO: 153687 - DNA, 103 bp, Artificial Sequence
  Synthetic Polynucleotide
taatacgactcactatagggcgccgcgcccccgccgcctccgccgccgccaacagaggagaggcggcatgggaggcggcaacctggcggcagcgcaaaagatg

SEQ ID NO: 153688 - DNA, 103 bp, Artificial Sequence
  Synthetic Polynucleotide
taatacgactcactatagggcccccgcccccgccgcgcccccgccgcctcaacagaggagagaggcgatgggggcgcggaacctggcggcagcgcaaaagatg

SEQ ID NO: 153689 - DNA, 103 bp, Artificial Sequence
  Synthetic Polynucleotide
taatacgactcactatagggtgcagggcgccccccgcccccgccgcgcccaacagaggagagggcgcatggggggcgggaacctggcggcagcgcaaaagatg

SEQ ID NO: 153690 - DNA, 103 bp, Artificial Sequence
  Synthetic Polynucleotide
taatacgactcactataggggtggtgcgggtgcagggcgccccccgccccaacagaggagaggggcgatgggcgccctgaacctggcggcagcgcaaaagatg

SEQ ID NO: 153691 - DNA, 103 bp, Artificial Sequence
  Synthetic Polynucleotide
taatacgactcactatagggcgccggcggcgtggtgcgggtgcagggcgcaacagaggagagcgcccatgacccgcaccaacctggcggcagcgcaaaagatg

SEQ ID NO: 153692 - DNA, 103 bp, Artificial Sequence
  Synthetic Polynucleotide
taatacgactcactatagggaagtgcaggccgccggcggcgtggtgcgggaacagaggagacccgcaatgcgccgccggaacctggcggcagcgcaaaagatg

SEQ ID NO: 153693 - DNA, 103 bp, Artificial Sequence
  Synthetic Polynucleotide
taatacgactcactataggggcggtcgtcgaagtgcaggccgccggcggcaacagaggagagccgccatgggcctgcacaacctggcggcagcgcaaaagatg

SEQ ID NO: 153694 - DNA, 103 bp, Artificial Sequence
  Synthetic Polynucleotide
taatacgactcactatagggcgtcggagaagcggtcgtcgaagtgcaggcaacagaggagagcctgcatgtcgacgaccaacctggcggcagcgcaaaagatg

SEQ ID NO: 153695 - DNA, 103 bp, Artificial Sequence
  Synthetic Polynucleotide
taatacgactcactatagggaccagctgctcgtcggagaagcggtcgtcgaacagaggagacgacgaatgcttctccgaaacctggcggcagcgcaaaagatg

SEQ ID NO: 153696 - DNA, 103 bp, Artificial Sequence
  Synthetic Polynucleotide
taatacgactcactatagggagacatggtcaccagctgctcgtcggagaaaacagaggagattctccatggagcagctgaacctggcggcagcgcaaaagatg

SEQ ID NO: 153697 - DNA, 103 bp, Artificial Sequence
  Synthetic Polynucleotide
taatacgactcactatagggttttcacttcaaacttcatcagatcgaagtaacagaggagaacttcgatgtgatgaagtaacctggcggcagcgcaaaagatg

SEQ ID NO: 153698 - DNA, 103 bp, Artificial Sequence
  Synthetic Polynucleotide
taatacgactcactataggggctcgcgcacagacatggtcaccagctgctaacagaggagaagcagcatgtgaccatgtaacctggcggcagcgcaaaagatg

SEQ ID NO: 153699 - DNA, 103 bp, Artificial Sequence
  Synthetic Polynucleotide
taatacgactcactatagggtgccggttcagctcgcgcacagacatggtcaacagaggagagaccatatgtgtgcgcgaaacctggcggcagcgcaaaagatg

SEQ ID NO: 153700 - DNA, 103 bp, Artificial Sequence
  Synthetic Polynucleotide
taatacgactcactatagggcccgcgcagctgccggttcagctcgcgcacaacagaggagagtgcgcatgctgaaccggaacctggcggcagcgcaaaagatg

SEQ ID NO: 153701 - DNA, 103 bp, Artificial Sequence
  Synthetic Polynucleotide
taatacgactcactatagggccttgctgaccccgcgcagctgccggttcaaacagaggagatgaaccatgagctgcgcgaacctggcggcagcgcaaaagatg

SEQ ID NO: 153702 - DNA, 103 bp, Artificial Sequence
  Synthetic Polynucleotide
taatacgactcactatagggatcacctcctccttgctgaccccgcgcagcaacagaggagagctgcgatgggtcagcaaaacctggcggcagcgcaaaagatg

SEQ ID NO: 153703 - DNA, 103 bp, Artificial Sequence
  Synthetic Polynucleotide
taatacgactcactatagggcttcagccggatcacctcctccttgctgacaacagaggagagtcagcatggaggaggtgaacctggcggcagcgcaaaagatg

SEQ ID NO: 153704 - DNA, 103 bp, Artificial Sequence
  Synthetic Polynucleotide
taatacgactcactataggggcctcttctgcttcagccggatcacctcctaacagaggagaaggaggatgtccggctgaaacctggcggcagcgcaaaagatg

SEQ ID NO: 153705 - DNA, 103 bp, Artificial Sequence
  Synthetic Polynucleotide
taatacgactcactatagggttcagggtccgcctcttctgcttcagccggaacagaggagaccggctatggcagaagagaacctggcggcagcgcaaaagatg

SEQ ID NO: 153706 - DNA, 103 bp, Artificial Sequence
  Synthetic Polynucleotide
taatacgactcactataggggccgcggtttttcagggtccgcctcttctgaacagaggagacagaagatgcggaccctgaacctggcggcagcgcaaaagatg

SEQ ID NO: 153707 - DNA, 103 bp, Artificial Sequence
  Synthetic Polynucleotide
taatacgactcactatagggactgggcatagccgcggtttttcagggtccaacagaggagaggacccatgaaaaccgcgaacctggcggcagcgcaaaagatg

SEQ ID NO: 153708 - DNA, 103 bp, Artificial Sequence
  Synthetic Polynucleotide
taatacgactcactatagggaccggttcctttttcacttcaaacttcatcaacagaggagagatgaaatgtgaagtgaaaacctggcggcagcgcaaaagatg

SEQ ID NO: 153709 - DNA, 103 bp, Artificial Sequence
  Synthetic Polynucleotide
taatacgactcactatagggaagcggcaggactgggcatagccgcggtttaacagaggagaaaaccgatgctatgcccaaacctggcggcagcgcaaaagatg

SEQ ID NO: 153710 - DNA, 103 bp, Artificial Sequence
  Synthetic Polynucleotide
taatacgactcactatagggcaccctcttgaagcggcaggactgggcataaacagaggagatatgccatgtcctgccgcaacctggcggcagcgcaaaagatg

SEQ ID NO: 153711 - DNA, 103 bp, Artificial Sequence
  Synthetic Polynucleotide
taatacgactcactataggggtctctgctgcaccctcttgaagcggcaggaacagaggagacctgccatgtcaagagggaacctggcggcagcgcaaaagatg

SEQ ID NO: 153712 - DNA, 103 bp, Artificial Sequence
  Synthetic Polynucleotide
taatacgactcactatagggtccaggacgtgtctctgctgcaccctcttgaacagaggagacaagagatggcagcagagaacctggcggcagcgcaaaagatg

SEQ ID NO: 153713 - DNA, 103 bp, Artificial Sequence
  Synthetic Polynucleotide
taatacgactcactatagggcttctccgactccaggacgtgtctctgctgaacagaggagacagcagatgcacgtcctgaacctggcggcagcgcaaaagatg

SEQ ID NO: 153714 - DNA, 103 bp, Artificial Sequence
  Synthetic Polynucleotide
taatacgactcactataggggcagctggttcttctccgactccaggacgtaacagaggagaacgtccatgagtcggagaaacctggcggcagcgcaaaagatg

SEQ ID NO: 153715 - DNA, 103 bp, Artificial Sequence
  Synthetic Polynucleotide
taatacgactcactatagggacttgctgcagcagctggttcttctccgacaacagaggagagtcggaatggaaccagctaacctggcggcagcgcaaaagatg

SEQ ID NO: 153716 - DNA, 103 bp, Artificial Sequence
  Synthetic Polynucleotide
taatacgactcactataggggaggtggtcgacttgctgcagcagctggttaacagaggagaaaccagatgctgcagcaaaacctggcggcagcgcaaaagatg

SEQ ID NO: 153717 - DNA, 103 bp, Artificial Sequence
  Synthetic Polynucleotide
taatacgactcactatagggtctcctgcttgaggtggtcgacttgctgcaaacagaggagatgcagcatgtcgaccaccaacctggcggcagcgcaaaagatg

SEQ ID NO: 153718 - DNA, 103 bp, Artificial Sequence
  Synthetic Polynucleotide
taatacgactcactatagggagcctggagatctcctgcttgaggtggtcgaacagaggagacgaccaatgcaagcaggaaacctggcggcagcgcaaaagatg

SEQ ID NO: 153719 - DNA, 103 bp, Artificial Sequence
  Synthetic Polynucleotide
taatacgactcactatagggttcaaagctcgagttctccaatagcttcataacagaggagaatgaagatgttggagaacaacctggcggcagcgcaaaagatg

SEQ ID NO: 153720 - DNA, 103 bp, Artificial Sequence
  Synthetic Polynucleotide
taatacgactcactataggggtcgtctcctgccatcttacatgagtagctaacagaggagaagctacatgtgtaagatgaacctggcggcagcgcaaaagatg

SEQ ID NO: 153721 - DNA, 103 bp, Artificial Sequence
  Synthetic Polynucleotide
taatacgactcactatagggacatgtgtttgtcgtctcctgccatcttacaacagaggagagtaagaatgcaggagacgaacctggcggcagcgcaaaagatg

SEQ ID NO: 153722 - DNA, 103 bp, Artificial Sequence
  Synthetic Polynucleotide
taatacgactcactatagggaactgcttgaacatgtgtttgtcgtctcctaacagaggagaaggagaatgcaaacacataacctggcggcagcgcaaaagatg

SEQ ID NO: 153723 - DNA, 103 bp, Artificial Sequence
  Synthetic Polynucleotide
taatacgactcactatagggctcctggcagaactgcttgaacatgtgtttaacagaggagaaaacacatgttcaagcagaacctggcggcagcgcaaaagatg

SEQ ID NO: 153724 - DNA, 103 bp, Artificial Sequence
  Synthetic Polynucleotide
taatacgactcactatagggggggctggccctcctggcagaactgcttgaaacagaggagatcaagcatgtctgccaggaacctggcggcagcgcaaaagatg

SEQ ID NO: 153725 - DNA, 103 bp, Artificial Sequence
  Synthetic Polynucleotide
taatacgactcactatagggtccagcacgtggggctggccctcctggcagaacagaggagactgccaatggggccagccaacctggcggcagcgcaaaagatg

SEQ ID NO: 153726 - DNA, 103 bp, Artificial Sequence
  Synthetic Polynucleotide
taatacgactcactatagggagaaagtgcctccagcacgtggggctggccaacagaggagaggccagatgcacgtgctgaacctggcggcagcgcaaaagatg

SEQ ID NO: 153727 - DNA, 103 bp, Artificial Sequence
  Synthetic Polynucleotide
taatacgactcactatagggtctggggtggagaaagtgcctccagcacgtaacagaggagaacgtgcatgaggcactttaacctggcggcagcgcaaaagatg

SEQ ID NO: 153728 - DNA, 103 bp, Artificial Sequence
  Synthetic Polynucleotide
taatacgactcactatagggagtcctgaagtctggggtggagaaagtgccaacagaggagaggcactatgtccaccccaaacctggcggcagcgcaaaagatg

SEQ ID NO: 153729 - DNA, 103 bp, Artificial Sequence
  Synthetic Polynucleotide
taatacgactcactataggggctggggctcagtcctgaagtctggggtggaacagaggagaccacccatgacttcaggaaacctggcggcagcgcaaaagatg

SEQ ID NO: 153730 - DNA, 103 bp, Artificial Sequence
  Synthetic Polynucleotide
taatacgactcactatagggagttgatggcttcaaagctcgagttctccaaacagaggagatggagaatgcgagctttgaacctggcggcagcgcaaaagatg

SEQ ID NO: 153731 - DNA, 103 bp, Artificial Sequence
  Synthetic Polynucleotide
taatacgactcactatagggtgctgagtctgctggggctcagtcctgaagaacagaggagacttcagatgtgagccccaaacctggcggcagcgcaaaagatg

SEQ ID NO: 153732 - DNA, 103 bp, Artificial Sequence
  Synthetic Polynucleotide
taatacgactcactatagggccttggcttttgctgagtctgctggggctcaacagaggagagagcccatgcagactcagaacctggcggcagcgcaaaagatg

SEQ ID NO: 153733 - DNA, 103 bp, Artificial Sequence
  Synthetic Polynucleotide
taatacgactcactatagggctcctcaccgccttggcttttgctgagtctaacagaggagaagactcatgaaaagccaaaacctggcggcagcgcaaaagatg

SEQ ID NO: 153734 - DNA, 103 bp, Artificial Sequence
  Synthetic Polynucleotide
taatacgactcactataggggggggccctcctcctcaccgccttggctttaacagaggagaaaagccatggcggtgaggaacctggcggcagcgcaaaagatg

SEQ ID NO: 153735 - DNA, 103 bp, Artificial Sequence
  Synthetic Polynucleotide
taatacgactcactatagggttgtcactgagggggccctcctcctcaccgaacagaggagacggtgaatgggagggcccaacctggcggcagcgcaaaagatg

SEQ ID NO: 153736 - DNA, 103 bp, Artificial Sequence
  Synthetic Polynucleotide
taatacgactcactataggggcggctgcacttgtcactgagggggccctcaacagaggagagagggcatgctcagtgacaacctggcggcagcgcaaaagatg

SEQ ID NO: 153737 - DNA, 103 bp, Artificial Sequence
  Synthetic Polynucleotide
taatacgactcactatagggagagggtcttgcggctgcacttgtcactgaaacagaggagatcagtgatgagtgcagccaacctggcggcagcgcaaaagatg

SEQ ID NO: 153738 - DNA, 103 bp, Artificial Sequence
  Synthetic Polynucleotide
taatacgactcactatagggatcaggtagaagagggtcttgcggctgcacaacagaggagagtgcagatgcaagaccctaacctggcggcagcgcaaaagatg

SEQ ID NO: 153739 - DNA, 103 bp, Artificial Sequence
  Synthetic Polynucleotide
taatacgactcactataggggagcgtggcaatcaggtagaagagggtcttaacagaggagaaagaccatgttctacctgaacctggcggcagcgcaaaagatg

SEQ ID NO: 153740 - DNA, 103 bp, Artificial Sequence
  Synthetic Polynucleotide
taatacgactcactatagggaggactcattgagcgtggcaatcaggtagaaacagaggagatctaccatgttgccacgcaacctggcggcagcgcaaaagatg

SEQ ID NO: 153741 - DNA, 103 bp, Artificial Sequence
  Synthetic Polynucleotide
taatacgactcactataggggtcagctgtgagttgatggcttcaaagctcaacagaggagagagcttatgagccatcaaaacctggcggcagcgcaaaagatg

SEQ ID NO: 153742 - DNA, 103 bp, Artificial Sequence
  Synthetic Polynucleotide
taatacgactcactatagggtcaggcctgaaggactcattgagcgtggcaaacagaggagatgccacatgcaatgagtcaacctggcggcagcgcaaaagatg

SEQ ID NO: 153743 - DNA, 103 bp, Artificial Sequence
  Synthetic Polynucleotide
taatacgactcactataggggaagtcatagtcaggcctgaaggactcattaacagaggagaaatgagatgttcaggcctaacctggcggcagcgcaaaagatg

SEQ ID NO: 153744 - DNA, 103 bp, Artificial Sequence
  Synthetic Polynucleotide
taatacgactcactataggggggctgtgctgaagtcatagtcaggcctgaaacagaggagatcaggcatgactatgactaacctggcggcagcgcaaaagatg

SEQ ID NO: 153745 - DNA, 103 bp, Artificial Sequence
  Synthetic Polynucleotide
taatacgactcactatagggtcatggctgcgggctgtgctgaagtcatagaacagaggagactatgaatgcagcacagcaacctggcggcagcgcaaaagatg

SEQ ID NO: 153746 - DNA, 103 bp, Artificial Sequence
  Synthetic Polynucleotide
taatacgactcactatagggccggctgaactcatggctgcgggctgtgctaacagaggagaagcacaatgcgcagccataacctggcggcagcgcaaaagatg

SEQ ID NO: 153747 - DNA, 103 bp, Artificial Sequence
  Synthetic Polynucleotide
taatacgactcactatagggggctgggctcccggctgaactcatggctgcaacagaggagagcagccatgagttcagccaacctggcggcagcgcaaaagatg

SEQ ID NO: 153748 - DNA, 103 bp, Artificial Sequence
  Synthetic Polynucleotide
taatacgactcactatagggacccagctaaggctgggctcccggctgaacaacagaggagagttcagatgggagcccagaacctggcggcagcgcaaaagatg

SEQ ID NO: 153749 - DNA, 103 bp, Artificial Sequence
  Synthetic Polynucleotide
taatacgactcactatagggtgcattcaccacccagctaaggctgggctcaacagaggagagagcccatgcttagctggaacctggcggcagcgcaaaagatg

SEQ ID NO: 153750 - DNA, 103 bp, Artificial Sequence
  Synthetic Polynucleotide
taatacgactcactatagggtgcagttgactgcattcaccacccagctaaaacagaggagattagctatgtggtgaatgaacctggcggcagcgcaaaagatg

SEQ ID NO: 153751 - DNA, 103 bp, Artificial Sequence
  Synthetic Polynucleotide
taatacgactcactataggggagaacagactgcagttgactgcattcaccaacagaggagaggtgaaatgagtcaactgaacctggcggcagcgcaaaagatg

SEQ ID NO: 153752 - DNA, 103 bp, Artificial Sequence
  Synthetic Polynucleotide
taatacgactcactatagggagtctccacagtcagctgtgagttgatggcaacagaggagagccatcatgtcacagctgaacctggcggcagcgcaaaagatg

SEQ ID NO: 153753 - DNA, 103 bp, Artificial Sequence
  Synthetic Polynucleotide
taatacgactcactatagggccgcacagctgagaacagactgcagttgacaacagaggagagtcaacatgagtctgttcaacctggcggcagcgcaaaagatg

SEQ ID NO: 153754 - DNA, 103 bp, Artificial Sequence
  Synthetic Polynucleotide
taatacgactcactatagggtgaagtcctcccgcacagctgagaacagacaacagaggagagtctgtatgcagctgtgcaacctggcggcagcgcaaaagatg

SEQ ID NO: 153755 - DNA, 103 bp, Artificial Sequence
  Synthetic Polynucleotide
taatacgactcactatagggttcagatccttgaagtcctcccgcacagctaacagaggagaagctgtatgggaggacttaacctggcggcagcgcaaaagatg

SEQ ID NO: 153756 - DNA, 103 bp, Artificial Sequence
  Synthetic Polynucleotide
taatacgactcactatagggcagctgtggtttcagatccttgaagtcctcaacagaggagagaggacatgaaggatctgaacctggcggcagcgcaaaagatg

SEQ ID NO: 153757 - DNA, 103 bp, Artificial Sequence
  Synthetic Polynucleotide
taatacgactcactatagggccgcgttccacagctgtggtttcagatcctaacagaggagaaggatcatgaaccacagcaacctggcggcagcgcaaaagatg

SEQ ID NO: 153758 - DNA, 103 bp, Artificial Sequence
  Synthetic Polynucleotide
taatacgactcactatagggtcctcgtccaccgcgttccacagctgtggtaacagaggagaaccacaatggtggaacgcaacctggcggcagcgcaaaagatg

SEQ ID NO: 153759 - DNA, 103 bp, Artificial Sequence
  Synthetic Polynucleotide
taatacgactcactatagggcaggcagatctcctcgtccaccgcgttccaaacagaggagatggaacatggtggacgagaacctggcggcagcgcaaaagatg

SEQ ID NO: 153760 - DNA, 103 bp, Artificial Sequence
  Synthetic Polynucleotide
taatacgactcactatagggcacattcagccaggcagatctcctcgtccaaacagaggagatggacgatgagatctgccaacctggcggcagcgcaaaagatg

SEQ ID NO: 153761 - DNA, 103 bp, Artificial Sequence
  Synthetic Polynucleotide
taatacgactcactatagggctgtagatgtcacattcagccaggcagatcaacagaggagagatctgatgggctgaatgaacctggcggcagcgcaaaagatg

SEQ ID NO: 153762 - DNA, 103 bp, Artificial Sequence
  Synthetic Polynucleotide
taatacgactcactatagggtgggttatagctgtagatgtcacattcagcaacagaggagagctgaaatggacatctacaacctggcggcagcgcaaaagatg

SEQ ID NO: 153763 - DNA, 103 bp, Artificial Sequence
  Synthetic Polynucleotide
taatacgactcactataggggggcatctccagtctccacagtcagctgtgaacagaggagacacagcatgctgtggagaaacctggcggcagcgcaaaagatg

SEQ ID NO: 153764 - DNA, 103 bp, Artificial Sequence
  Synthetic Polynucleotide
taatacgactcactatagggagtccaagtctgggttatagctgtagatgtaacagaggagaacatctatggctataaccaacctggcggcagcgcaaaagatg

SEQ ID NO: 153765 - DNA, 103 bp, Artificial Sequence
  Synthetic Polynucleotide
taatacgactcactatagggaagggatctgagtccaagtctgggttatagaacagaggagactataaatgagacttggaaacctggcggcagcgcaaaagatg

SEQ ID NO: 153766 - DNA, 103 bp, Artificial Sequence
  Synthetic Polynucleotide
taatacgactcactatagggatcctccccgaagggatctgagtccaagtcaacagaggagagacttgatgtcagatcccaacctggcggcagcgcaaaagatg

SEQ ID NO: 153767 - DNA, 103 bp, Artificial Sequence
  Synthetic Polynucleotide
taatacgactcactatagggagaggctaccatcctccccgaagggatctgaacagaggagacagatcatgtcggggaggaacctggcggcagcgcaaaagatg

SEQ ID NO: 153768 - DNA, 103 bp, Artificial Sequence
  Synthetic Polynucleotide
taatacgactcactatagggttgaaggaccagaggctaccatcctccccgaacagaggagacggggaatgtggtagcctaacctggcggcagcgcaaaagatg

SEQ ID NO: 153769 - DNA, 103 bp, Artificial Sequence
  Synthetic Polynucleotide
taatacgactcactataggggaagaagtagttgaaggaccagaggctaccaacagaggagaggtagcatgtggtccttcaacctggcggcagcgcaaaagatg

SEQ ID NO: 153770 - DNA, 103 bp, Artificial Sequence
  Synthetic Polynucleotide
taatacgactcactataggggcttgttgtagaagaagtagttgaaggaccaacagaggagaggtcctatgactacttctaacctggcggcagcgcaaaagatg

SEQ ID NO: 153771 - DNA, 103 bp, Artificial Sequence
  Synthetic Polynucleotide
taatacgactcactatagggcgcttgagccgcttgttgtagaagaagtagaacagaggagactacttatgctacaacaaaacctggcggcagcgcaaaagatg

SEQ ID NO: 153772 - DNA, 103 bp, Artificial Sequence
  Synthetic Polynucleotide
taatacgactcactataggggaagacgattcgcttgagccgcttgttgtaaacagaggagatacaacatgcggctcaagaacctggcggcagcgcaaaagatg

SEQ ID NO: 153773 - DNA, 103 bp, Artificial Sequence
  Synthetic Polynucleotide
taatacgactcactatagggggcagctaaagaagacgattcgcttgagccaacagaggagaggctcaatggaatcgtctaacctggcggcagcgcaaaagatg

SEQ ID NO: 153774 - DNA, 103 bp, Artificial Sequence
  Synthetic Polynucleotide
taatacgactcactatagggccaatgatgtgggcatctccagtctccacaaacagaggagatgtggaatgtggagatgcaacctggcggcagcgcaaaagatg

SEQ ID NO: 153775 - DNA, 103 bp, Artificial Sequence
  Synthetic Polynucleotide
taatacgactcactatagggctgatggaacggcagctaaagaagacgattaacagaggagaaatcgtatgctttagctgaacctggcggcagcgcaaaagatg

SEQ ID NO: 153776 - DNA, 103 bp, Artificial Sequence
  Synthetic Polynucleotide
taatacgactcactatagggggtggagccactgatggaacggcagctaaaaacagaggagatttagcatgcgttccatcaacctggcggcagcgcaaaagatg

SEQ ID NO: 153777 - DNA, 103 bp, Artificial Sequence
  Synthetic Polynucleotide
taatacgactcactatagggagggtgtgtaggtggagccactgatggaacaacagaggagagttccaatggtggctccaaacctggcggcagcgcaaaagatg

SEQ ID NO: 153778 - DNA, 103 bp, Artificial Sequence
  Synthetic Polynucleotide
taatacgactcactatagggcctgcctctgagggtgtgtaggtggagccaaacagaggagatggctcatgctacacaccaacctggcggcagcgcaaaagatg

SEQ ID NO: 153779 - DNA, 103 bp, Artificial Sequence
  Synthetic Polynucleotide
taatacgactcactatagggcagctcgttgcctgcctctgagggtgtgtaaacagaggagatacacaatgtcagaggcaaacctggcggcagcgcaaaagatg

SEQ ID NO: 153780 - DNA, 103 bp, Artificial Sequence
  Synthetic Polynucleotide
taatacgactcactataggggctccatgtccagctcgttgcctgcctctgaacagaggagacagaggatggcaacgagcaacctggcggcagcgcaaaagatg

SEQ ID NO: 153781 - DNA, 103 bp, Artificial Sequence
  Synthetic Polynucleotide
taatacgactcactatagggtcctcccccagctccatgtccagctcgttgaacagaggagacaacgaatgggacatggaaacctggcggcagcgcaaaagatg

SEQ ID NO: 153782 - DNA, 103 bp, Artificial Sequence
  Synthetic Polynucleotide
taatacgactcactatagggctccacctcctcctcccccagctccatgtcaacagaggagagacatgatgctgggggagaacctggcggcagcgcaaaagatg

SEQ ID NO: 153783 - DNA, 103 bp, Artificial Sequence
  Synthetic Polynucleotide
taatacgactcactatagggtgctttcttcctccacctcctcctcccccaaacagaggagatgggggatgaggaggtggaacctggcggcagcgcaaaagatg

SEQ ID NO: 153784 - DNA, 103 bp, Artificial Sequence
  Synthetic Polynucleotide
taatacgactcactatagggcccccgcttctgctttcttcctccacctccaacagaggagaggaggtatgggaagaaagaacctggcggcagcgcaaaagatg

SEQ ID NO: 153785 - DNA, 103 bp, Artificial Sequence
  Synthetic Polynucleotide
taatacgactcactatagggctcaatcctgccaatgatgtgggcatctccaacagaggagaggagatatgcacatcattaacctggcggcagcgcaaaagatg

SEQ ID NO: 153786 - DNA, 103 bp, Artificial Sequence
  Synthetic Polynucleotide
taatacgactcactatagggggccccactgcccccgcttctgctttcttcaacagaggagagaagaaatgagaagcgggaacctggcggcagcgcaaaagatg

SEQ ID NO: 153787 - DNA, 103 bp, Artificial Sequence
  Synthetic Polynucleotide
taatacgactcactatagggtggtctcctcggccccactgcccccgcttcaacagaggagagaagcgatggcagtggggaacctggcggcagcgcaaaagatg

SEQ ID NO: 153788 - DNA, 103 bp, Artificial Sequence
  Synthetic Polynucleotide
taatacgactcactatagggtccatggtgctggtctcctcggccccactgaacagaggagacagtggatgcgaggagacaacctggcggcagcgcaaaagatg

SEQ ID NO: 153789 - DNA, 103 bp, Artificial Sequence
  Synthetic Polynucleotide
taatacgactcactatagggcctgtcctcctccatggtgctggtctcctcaacagaggagagaggagatgagcaccatgaacctggcggcagcgcaaaagatg

SEQ ID NO: 153790 - DNA, 103 bp, Artificial Sequence
  Synthetic Polynucleotide
taatacgactcactatagggtcactgggaccctgtcctcctccatggtgcaacagaggagagcaccaatgaggaggacaaacctggcggcagcgcaaaagatg

SEQ ID NO: 153791 - DNA, 103 bp, Artificial Sequence
  Synthetic Polynucleotide
taatacgactcactatagggcaaatacagatcactgggaccctgtcctccaacagaggagaggaggaatgggtcccagtaacctggcggcagcgcaaaagatg

SEQ ID NO: 153792 - DNA, 103 bp, Artificial Sequence
  Synthetic Polynucleotide
taatacgactcactatagggatgagtagctctcaatcctgccaatgatgtaacagaggagaacatcaatggcaggattgaacctggcggcagcgcaaaagatg

SEQ ID NO: 153793 - DNA, 103 bp, Artificial Sequence
  Synthetic Polynucleotide
taatacgactcactataggggccatcttacatgagtagctctcaatcctgaacagaggagacaggatatggagctactcaacctggcggcagcgcaaaagatg

SEQ ID NO: 153794 - DNA, 103 bp, Artificial Sequence
  Synthetic Polynucleotide
taatacgactcactatagggctcggcgcccatcgccagctccgcggccataacagaggagaatggccatggagctggcgaacctggcggcagcgcaaaagatg

SEQ ID NO: 153795 - DNA, 103 bp, Artificial Sequence
  Synthetic Polynucleotide
taatacgactcactataggggcgctcggcctcgggaggctccttcttcacaacagaggagagtgaagatggagcctcccaacctggcggcagcgcaaaagatg

SEQ ID NO: 153796 - DNA, 103 bp, Artificial Sequence
  Synthetic Polynucleotide
taatacgactcactatagggggcctgcggcggcgaaggctcccgcgggaaaacagaggagattcccgatggagccttcgaacctggcggcagcgcaaaagatg

SEQ ID NO: 153797 - DNA, 103 bp, Artificial Sequence
  Synthetic Polynucleotide
taatacgactcactatagggcgccgggaccggcctgcggcggcgaaggctaacagaggagaagccttatgcgccgcaggaacctggcggcagcgcaaaagatg

SEQ ID NO: 153798 - DNA, 103 bp, Artificial Sequence
  Synthetic Polynucleotide
taatacgactcactatagggcccttggccccgccgggaccggcctgcggcaacagaggagagccgcaatgcggtcccggaacctggcggcagcgcaaaagatg

SEQ ID NO: 153799 - DNA, 103 bp, Artificial Sequence
  Synthetic Polynucleotide
taatacgactcactataggggtcggccgtgcccttggccccgccgggaccaacagaggagaggtcccatgggggccaagaacctggcggcagcgcaaaagatg

SEQ ID NO: 153800 - DNA, 103 bp, Artificial Sequence
  Synthetic Polynucleotide
taatacgactcactatagggacaggaagaagtcggccgtgcccttggcccaacagaggagagggccaatggcacggccgaacctggcggcagcgcaaaagatg

SEQ ID NO: 153801 - DNA, 103 bp, Artificial Sequence
  Synthetic Polynucleotide
taatacgactcactatagggggtggcagaagcgctcggcctcgggaggctaacagaggagaagcctcatgaggccgagcaacctggcggcagcgcaaaagatg

SEQ ID NO: 153802 - DNA, 103 bp, Artificial Sequence
  Synthetic Polynucleotide
taatacgactcactatagggggcggcaggcggtggcagaagcgctcggccaacagaggagaggccgaatgcttctgccaaacctggcggcagcgcaaaagatg

SEQ ID NO: 153803 - DNA, 103 bp, Artificial Sequence
  Synthetic Polynucleotide
taatacgactcactatagggcagcgagcctggcggcaggcggtggcagaaaacagaggagattctgcatgcgcctgccgaacctggcggcagcgcaaaagatg

SEQ ID NO: 153804 - DNA, 103 bp, Artificial Sequence
  Synthetic Polynucleotide
taatacgactcactataggggcgtcgaggacagcgagcctggcggcaggcaacagaggagagcctgcatgcaggctcgcaacctggcggcagcgcaaaagatg

SEQ ID NO: 153805 - DNA, 103 bp, Artificial Sequence
  Synthetic Polynucleotide
taatacgactcactataggggtgctgagcggcgtcgaggacagcgagcctaacagaggagaaggctcatggtcctcgacaacctggcggcagcgcaaaagatg

SEQ ID NO: 153806 - DNA, 103 bp, Artificial Sequence
  Synthetic Polynucleotide
taatacgactcactatagggggagcagggcgtgctgagcggcgtcgaggaaacagaggagatcctcgatgccgctcagcaacctggcggcagcgcaaaagatg

SEQ ID NO: 153807 - DNA, 103 bp, Artificial Sequence
  Synthetic Polynucleotide
taatacgactcactatagggagggcacggaggagcagggcgtgctgagcgaacagaggagacgctcaatgcgccctgctaacctggcggcagcgcaaaagatg

SEQ ID NO: 153808 - DNA, 103 bp, Artificial Sequence
  Synthetic Polynucleotide
taatacgactcactatagggctgggcgaggagggcacggaggagcagggcaacagaggagagccctgatgctccgtgccaacctggcggcagcgcaaaagatg

SEQ ID NO: 153809 - DNA, 103 bp, Artificial Sequence
  Synthetic Polynucleotide
taatacgactcactatagggcgcgcagaagctgggcgaggagggcacggaaacagaggagatccgtgatgtcctcgcccaacctggcggcagcgcaaaagatg

SEQ ID NO: 153810 - DNA, 103 bp, Artificial Sequence
  Synthetic Polynucleotide
taatacgactcactatagggtgctgggcagctcggcgcccatcgccagctaacagaggagaagctggatgtgggcgccgaacctggcggcagcgcaaaagatg

SEQ ID NO: 153811 - DNA, 103 bp, Artificial Sequence
  Synthetic Polynucleotide
taatacgactcactatagggccgggctgggcgcgcagaagctgggcgaggaacagaggagacctcgcatggcttctgcgaacctggcggcagcgcaaaagatg

SEQ ID NO: 153812 - DNA, 103 bp, Artificial Sequence
  Synthetic Polynucleotide
taatacgactcactatagggccgccggtgcccgggctgggcgcgcagaagaacagaggagacttctgatggcccagcccaacctggcggcagcgcaaaagatg

SEQ ID NO: 153813 - DNA, 103 bp, Artificial Sequence
  Synthetic Polynucleotide
taatacgactcactataggggccgccgccgccgccggtgcccgggctgggaacagaggagacccagcatgggcaccggcaacctggcggcagcgcaaaagatg

SEQ ID NO: 153814 - DNA, 103 bp, Artificial Sequence
  Synthetic Polynucleotide
taatacgactcactatagggcgccccccgcgccgccgccgccgccggtgcaacagaggagagcaccgatggcggcggcgaacctggcggcagcgcaaaagatg

SEQ ID NO: 153815 - DNA, 103 bp, Artificial Sequence
  Synthetic Polynucleotide
taatacgactcactataggggagccgccgccgccccccgcgccgccgccgaacagaggagacggcggatgcgcggggggaacctggcggcagcgcaaaagatg

SEQ ID NO: 153816 - DNA, 103 bp, Artificial Sequence
  Synthetic Polynucleotide
taatacgactcactatagggggcctgagacgagccgccgccgccccccgcaacagaggagagcggggatgggcggcggcaacctggcggcagcgcaaaagatg

SEQ ID NO: 153817 - DNA, 103 bp, Artificial Sequence
  Synthetic Polynucleotide
taatacgactcactataggggggcgcccccggcctgagacgagccgccgcaacagaggagagcggcgatgcgtctcaggaacctggcggcagcgcaaaagatg

SEQ ID NO: 153818 - DNA, 103 bp, Artificial Sequence
  Synthetic Polynucleotide
taatacgactcactatagggggcggcccgggggcgcccccggcctgagacaacagaggagagtctcaatgcgggggcgcaacctggcggcagcgcaaaagatg

SEQ ID NO: 153819 - DNA, 103 bp, Artificial Sequence
  Synthetic Polynucleotide
taatacgactcactataggggcccccgctcggcggcccgggggcgcccccaacagaggagagggggcatgcccgggccgaacctggcggcagcgcaaaagatg

SEQ ID NO: 153820 - DNA, 103 bp, Artificial Sequence
  Synthetic Polynucleotide
taatacgactcactatagggcggcgccggggcccccgctcggcggcccggaacagaggagaccgggcatgcgagcggggaacctggcggcagcgcaaaagatg

SEQ ID NO: 153821 - DNA, 103 bp, Artificial Sequence
  Synthetic Polynucleotide
taatacgactcactataggggccagcgggctgctgggcagctcggcgcccaacagaggagagggcgcatggctgcccagaacctggcggcagcgcaaaagatg

SEQ ID NO: 153822 - DNA, 103 bp, Artificial Sequence
  Synthetic Polynucleotide
taatacgactcactataggggtgcccccgacggcgccggggcccccgctcaacagaggagagagcggatgccccggcgcaacctggcggcagcgcaaaagatg

SEQ ID NO: 153823 - DNA, 103 bp, Artificial Sequence
  Synthetic Polynucleotide
taatacgactcactatagggcttccccgaggtgcccccgacggcgccgggaacagaggagacccggcatggtcgggggcaacctggcggcagcgcaaaagatg

SEQ ID NO: 153824 - DNA, 103 bp, Artificial Sequence
  Synthetic Polynucleotide
taatacgactcactatagggccagcgccggcttccccgaggtgcccccgaaacagaggagatcggggatgcctcggggaaacctggcggcagcgcaaaagatg

SEQ ID NO: 153825 - DNA, 103 bp, Artificial Sequence
  Synthetic Polynucleotide
taatacgactcactatagggtacagatcctccagcgccggcttccccgagaacagaggagactcgggatggccggcgctaacctggcggcagcgcaaaagatg

SEQ ID NO: 153826 - DNA, 103 bp, Artificial Sequence
  Synthetic Polynucleotide
taatacgactcactataggggctcatccagtacagatcctccagcgccggaacagaggagaccggcgatggaggatctgaacctggcggcagcgcaaaagatg

SEQ ID NO: 153827 - DNA, 103 bp, Artificial Sequence
  Synthetic Polynucleotide
taatacgactcactataggggctggtagccgctcatccagtacagatcctaacagaggagaaggatcatgactggatgaaacctggcggcagcgcaaaagatg

SEQ ID NO: 153828 - DNA, 103 bp, Artificial Sequence
  Synthetic Polynucleotide
taatacgactcactatagggttgaggtgatgctggtagccgctcatccagaacagaggagactggatatgcggctaccaaacctggcggcagcgcaaaagatg

SEQ ID NO: 153829 - DNA, 103 bp, Artificial Sequence
  Synthetic Polynucleotide
taatacgactcactatagggcgcctcggggttgaggtgatgctggtagccaacagaggagaggctacatgcatcacctcaacctggcggcagcgcaaaagatg

SEQ ID NO: 153830 - DNA, 103 bp, Artificial Sequence
  Synthetic Polynucleotide
taatacgactcactatagggtcaggttgagcgcctcggggttgaggtgataacagaggagaatcaccatgaccccgaggaacctggcggcagcgcaaaagatg

SEQ ID NO: 153831 - DNA, 103 bp, Artificial Sequence
  Synthetic Polynucleotide
taatacgactcactatagggtcctcgggcgtcaggttgagcgcctcggggaacagaggagaccccgaatggctcaacctaacctggcggcagcgcaaaagatg

SEQ ID NO: 153832 - DNA, 103 bp, Artificial Sequence
  Synthetic Polynucleotide
taatacgactcactataggggtactcgatggccagcgggctgctgggcagaacagaggagactgcccatgagcccgctgaacctggcggcagcgcaaaagatg

SEQ ID NO: 153833 - DNA, 103 bp, Artificial Sequence
  Synthetic Polynucleotide
taatacgactcactatagggctccaccgcgtcctcgggcgtcaggttgagaacagaggagactcaacatgacgcccgagaacctggcggcagcgcaaaagatg

SEQ ID NO: 153834 - DNA, 103 bp, Artificial Sequence
  Synthetic Polynucleotide
taatacgactcactatagggcgatgagcgcctccaccgcgtcctcgggcgaacagaggagacgcccgatgacgcggtggaacctggcggcagcgcaaaagatg

SEQ ID NO: 153835 - DNA, 103 bp, Artificial Sequence
  Synthetic Polynucleotide
taatacgactcactatagggtggccgctgccgatgagcgcctccaccgcgaacagaggagacgcggtatgggcgctcataacctggcggcagcgcaaaagatg

SEQ ID NO: 153836 - DNA, 103 bp, Artificial Sequence
  Synthetic Polynucleotide
taatacgactcactatagggcgcgccgtggtggccgctgccgatgagcgcaacagaggagagcgctcatgggcagcggcaacctggcggcagcgcaaaagatg

SEQ ID NO: 153837 - DNA, 103 bp, Artificial Sequence
  Synthetic Polynucleotide
taatacgactcactatagggcgccgtggtgcgcgccgtggtggccgctgcaacagaggagagcagcgatgaccacggcgaacctggcggcagcgcaaaagatg

SEQ ID NO: 153838 - DNA, 103 bp, Artificial Sequence
  Synthetic Polynucleotide
taatacgactcactataggggggtggtgcgcgccgtggtgcgcgccgtggaacagaggagaccacggatggcaccacggaacctggcggcagcgcaaaagatg

SEQ ID NO: 153839 - DNA, 103 bp, Artificial Sequence
  Synthetic Polynucleotide
taatacgactcactatagggggcggccgccgggtggtgcgcgccgtggtgaacagaggagacaccacatggcgcaccacaacctggcggcagcgcaaaagatg

SEQ ID NO: 153840 - DNA, 103 bp, Artificial Sequence
  Synthetic Polynucleotide
taatacgactcactatagggcgtaggctgcggcggccgccgggtggtgcgaacagaggagacgcaccatgcggcggccgaacctggcggcagcgcaaaagatg

SEQ ID NO: 153841 - DNA, 103 bp, Artificial Sequence
  Synthetic Polynucleotide
taatacgactcactatagggcggaaagcctcgtaggctgcggcggccgccaacagaggagaggcggcatgcgcagcctaaacctggcggcagcgcaaaagatg

SEQ ID NO: 153842 - DNA, 103 bp, Artificial Sequence
  Synthetic Polynucleotide
taatacgactcactataggggcccgggccgcggaaagcctcgtaggctgcaacagaggagagcagccatggaggctttcaacctggcggcagcgcaaaagatg
